United States Patent 12,569,549 (FLAVIVIRUS VACCINE) - sequence listing, part 64

SEQ ID NO: 22254 - RNA, 9876 nt, synthetic construct
  misc_feature 1..9876: note = derived and/or modified CDS sequence (opt6) from DENV-2__KM279552__SS-prME
  source 1..9876: mol_type = other RNA
acagccgggataatcattatgatgatcccaacagtcatggcatttcacctgactacaagaaacggagagcctcatatgatagttagcagacaagaaaaaggtaaatcactcttatttaaaacagagaatggtgtaaatatgtgtaccttgatggcaatggacttaggagaactatgcgaggacaccatcacttacaactgcccgctcttaagacaaaacgaaccagaagatatagattgttggtgcaattcgacaagtacctgggtaacatatggtacttgcacagcaactggtgaacacagaagagaaaaacgaagcgtggctctggtgccacatgtagggatgggcttagaaacgcgaacggaaacatggatgagttccgaaggagcttggaaacatgcacaaagaatcgaaacatggattttacggcatccaggtttcacaataatggccgccattctcgcctacacaatagggacaacttactttcaaagggtcctgatattcattttgcttacagcagtaacaccaagtatggctatgcgctgcatcgggatatctaaccgagattttgtagaaggagtgtccggtggtagttgggtggatattgttctagagcacggttcatgcgtgacaacaatggcaaaaaacaaaccaacactcgattttgaattaattaaaacagaggcaaaacatttagctacactccgtaaatattgtgtagaggcaaagctaactaatacaacgaccgcaagcagatgcccgactcaaggtgaaccaagtttaaacgaagaacaagataaacgatttgtatgcaaacattccatggtagaccgaggttggggaaatggatgtggcctatttggaaaaggtggaatagtaacgtgtgcaatgttcacttgtaaaaagaatatggaaggtaaggtagttcagcctgaaaatttagagtacacaatagtaattactccacatagtggtgaagaaaacgcagtaggcaacgataccggtaagcacggaaaagaaataaaagtaacaccccagtcatccattacagaagctgaacttacgggttatgggactgtaactatggaatgctcgcctcgaactggattagactttaatgaaatggtactattacaaatggaaaacaaggcctggttagtccacaggcaatggttcttagatctaccattgccatggttaccaggtgctgacacgcaggggagcaattggattcagaaggagacgcttgtgacgtttaaaaaccctcacgccaaaaaacaagatgtagttgtgctaggctcacaagaaggtgctatgcatacagccctcacaggggccactgagattcagatgagttcgggtaatcttctgtttaccggtcatctaaagtgcagattgagaatggataagctacaactaaaagggatgagctattcaatgtgtacaggaaaattcaaagttgttaaagaaattgcagaaacacaacatggtacaatcgtaatcagagtgcaatatgagggagatgggagcccatgtaaaatacccttcgaaataatggacctagagaaacgacacgtactgggacgccttataactgtcaatcctatcgttacagagaaagattcaccagtgaacatagaagctgaaccaccatttggagattcctatataataattggagttgaacctggtcagttaaagcttagctggtttaaaaagggaagttctattgggcagatgttcgaaacaactatgagaggagcaaaacggatggccattttaggcgatactgcatgggattttgggagcttaggaggagtatttacgtcgatagggaaagcgttgcatcaggtattcggagctatatatggcgctgctttttccggtgttagctggacaatgaaaatactaataggtgtcgtaatcacatggataggcatgaactctagatcaacttccttgtcagtatcactagtccttgtgggagtcgtaacactatacctaggagtcatggtacaggcagatagtggatgtgttgtttcctggaaaaacaaggaacttaaatgtggaagcggaatatttattacggataacgtgcacacatggacagaacaatataaatttcaaccagaatctccgagcaagctagcttccgccatccaaaaagcgcacgaggaggggatttgcggaatccgaagtgtaactaggctagagaacttaatgtggaaacaaattacccctgaactgaatcatatactaacggaaaatgaagttaaattgacaataatgaccggtgacattaagggaattatgcaagcgggtaagaggtccctccgaccacagccgacggaactaaaatacagttggaaagcatggggaaaagcaaaaatgttaagtaccgaattacataatcatacattcctaatagacgggccagagaccgctgaatgtccaaataccaatagggcttggaattcattagaggtggaggactatggctttggtgtgtttacaactaatatatggctaaaactaaaagaaagacaggatgttttttgcgactctaaactgatgtcagccgcaataaaagacaatagagccgtacacgctgacatgggatattggatagagagcgcgttgaatgatacttggaaaatcgaaaaagcaagcttcatagaagttaaatcgtgtcactggcctaaaagccacacactatggagcaacggagttcttgaaagtgaaatgataattccgaagaattttgcggggccagtctcacaacataactatcgtcctgggtaccacacacaaaccgctggaccctggcacctgggtaggctagaaatggacttcgatttttgcgaaggaacaacagtagtcgtaacagaagattgtgggaatcgcggtccatcactgaggacgacaacggcatcaggcaaactcatcacagagtggtgctgtcggagttgtacactacctccacttagatacaggggtgaggatggttgttggtatgggatggagataagaccgcttaaggaaaaagaagaaaacctagtaaattcattagtaaccgcgggacatggtcaaatagataatttttccttgggggtactgggcatggctttattccttgaggaaatgctaagaacaagggttgggaccaagcatgctattctactagtagcggtcagttttgtcacattgattactgggaacatgtcatttcgagatcttgggcgtgtcatggtaatggtaggagctaccatgacagacgacataggaatgggagtaacctaccttgcacttctagctgcatttaaagttcgtccaacctttgcagctggacttttgttacggaaattgacatctaaggagcttatgatgacaaccataggaattgtactattatcacattcaacaattcctgaatccattcttgaacttacagatgcattagcgctaggtatgatggtactcaaaatagtaagaaatatggagaagtatcagttagccgtcacaataatggcaatattgtgcgtacccaatgccgtgatattacagaacgcgtggaaggtcagctgcactacactagcagttgtaagtgtatctccactattactaacaagtagtcaacagaaagctgattggattcccttagcgttgacaattaaaggactaaacccgacagcaatattcttgacaacattgagccgaacaagcaaaaaacggtcatggccacttaatgaagcgataatggcagtcggtatggtaagtattttagcaagctccttattaaaaaatgatatcccaatgaccggcccactggttgctggggggcttcttacagtctgttatgtccttactggacggagtgcagacttagaactcgaacgagccgccgacgttcgatgggaagaacaagctgagataagtggaagtagtccaatactatcgataacaataagcgaagatggctcgatgagcatcaaaaatgaagaggaagaacaaacgctaactatattgatacgtactggcctcctagtaatttccggtttattcccagtgagtattcctatcactgccgctgcatggtacttatgggaagtaaaaaagcaaagagcgggcgtgttgtgggacgttccttcaccaccacccgtaggcaaagcggaattggaagatggagcttatagaattaagcaaaaaggaatcctgggttattcccaaataggtgccggggtgtacaaagaggggacatttcacacgatgtggcacgtaacgagaggtgcggtattaatgcataagggcaaacgaattgaaccaagttgggcggacgtaaaaaaagacttgatatcttatggaggaggctggaagttggaaggagaatggaaagaaggcgaagaagttcaagtattggccttggagccgggaaaaaatccaagagcagtacaaacaaaaccaggtttatttaaaacaaatacggggacaatcggagcagtatcattagacttttctcctgggacatctggaagtcccatagtggataagaagggtaaagtagtcggcttatacggaaatggcgtagtaacaagatccggaacgtatgtatcagcaatagcccaaacggaaaaaagtatcgaggataatcccgaaattgaagatgatatctttcgaaaaaaaaggttaacaataatggatcttcatcccggtgccggtaagaccaaaagatacttaccagccatagtcagagaagcgataaagcgagggctaagaactttgatcttagcaccgacgagggttgttgctgctgaaatggaagaagcccttcgtggcttacccattaggtatcaaaccccagctatcagggctgagcatactgggcgagaaatagtcgatttaatgtgtcatgcaacatttacaatgcgattgttaagtccaataagggtacctaattacaacttaataattatggatgaagctcatttcacagacccagcatctattgccgccagaggttatatttccacacgggtagagatgggcgaagctgcaggcatatttatgaccgctacgcctccaggatcgcgtgatccctttccacagtcaaatgcaccaatcatggatgaagagagagaaataccagagagatcttggaactcaggtcatgaatgggtaacagacttcaaaggaaaaaccgtctggttcgtacccagtattaaagccggaaatgatatcgcagcatgcctgcgaaaaaacggcaaaaaagttattcaattaagtcgaaaaacatttgactctgaatatataaaaacaaggacaaatgattgggactttgttgtgactactgacataagcgaaatgggtgcaaactttaaagcagaaagagtcatcgatcccaggagatgtatgaaaccagtgatactaactgacggtgaagagcgagttattttagcgggtcccatgccagtaacacattctagtgccgcacagagaagagggagagtaggacgaaatccaaagaatgaaaatgatcaatacatctatatgggtgaaccactcgaaaatgatgaagattgcgcccactggaaggaagcgaaaatgttactggacaacattaatacacctgagggaataattccatcaatgttcgagccagaaagagaaaaagttgacgcaatagatggtgagtatagactaagaggagaagctcgaaaaacttttgtagatctcatgcggcgaggagatcttccggtatggctagcttacagggtagcagccgaagggatcaattatgcagacagacgatggtgttttgatggcgtcaaaaacaaccagatcttagaagaaaacgtcgaagttgaaatttggacgaaggagggtgaacgaaaaaagctaaaaccccgctggctagatgctaggatatactccgaccctctggctttaaaagaatttaaggaattcgccgctggacgaaaaagtctaacactcaacttgattacagaaatgggacgacttcccacctttatgacgcagaaggcgaaaaacgctttggataaccttgcggtattacacacagccgaagcgggcggtagggcttataaccacgcactaagtgaactccccgaaacgctcgaaactctgttactgttgacattactggcaactgtcacggggggtatttttctttttctcatgtccggcaaaggtattgggaaaatgactttaggcatgtgttgcattataactgcttcaatacttctgtggtacgctcaaatacaaccacactggattgcggccagtatcattttagagttttttttaatagtacttctgattccggaaccggagaaacaaagaactccccaagataatcaactaacatacgtcgtgatagcaatattgactgtggtcgccgcaacaatggccaatgagatgggattcctcgaaaaaactaaaaaagatttcggcctcggtagtataaccacccaacaaccggaatctaatatattagacatagatttacgtccggcttcagcatggacactctacgccgtcgcaacaacttttattaccccaatgctaaggcatagtatagaaaactcatcagtaaatgtctctctgacagctatagcaaatcaagccaccgtcctaatggggttgggaaaagggtggcccttatcgaaaatggatataggagtccccttattagctattggctgttatagccaggtaaatccaattacgttaaccgctgcgttacttttgctggttgctcattatgccataataggtccgggcctccaagcgaaggctaccagagaagctcaaaagcgagcagctgctggaataatgaaaaacccaacagtcgatggcatgactgtaatcgacctggaccccataccttatgatccaaagttcgaaaaacagctaggacaggttatgctactcgtgctttgcgtgacgcaagtattgatgatgcgaacgacttgggcattgtgtgaagcacttactttagcaaccggaccgataagcactctttgggaagggaatccaggcaggttttggaacacaaccatagctgtttcgatggcaaatatctttagaggaagttaccttgcaggggcgggtttactcttttccataatgaagaacacagctaacactaggagggggacgggaaatacgggagaaacacttggagagaaatggaaaaataggctaaatgcgttgggaaaaagtgagtttcaaatatataaaaaaagtggaattcaggaagtcgaccgaacgctagctaaagaagggattaaaagaggggaaacagaccatcatgcagtatcaagaggatcagctaaactacgctggtttgttgagcgcaacctagtgaccccagaaggaaaagtcgtagatctaggatgcggccgtggtggctggtcatattactgcggagggcttaaaaatgtaaaagaagtgaaaggcttgacaaagggcggccctggacatgaagagcccataccaatgtccacatacggatggaatttagtacgtttacagtctggggtggatgttttcttcaccccaccagaaaaatgtgacacactattatgtgatattggggagtcaagtccgaacccaacagtagaagcgggccggactcttagagttttaaatctcgtagaaaattggttaaacaataatacccaattttgcataaaggtattaaatccttacatgccatctgtaatagaaaagatggaagcgctccaaagaaagtatggtggagcattagtacgtaatccactttcgaggaattcaacgcacgaaatgtattgggtatcgaatgcatccggtaatatcgttagcagcgtgaatatgataagtcgtatgctgataaaccgttttacgatgcgtcacaagaaagcaacctacgagcctgatgtcgatttaggatcaggtacgagaaacattggaatagaatcagaaaccccgaacctagatattataggaaaacggatagaaaaaataaaacaggaacacgaaacatcatggcattacgatcaagaccatccttataaaacgtgggcataccatggcagttatgaaacaaaacaaaccggaagtgctagtagtatggtgaacggagttgtcaggcttttgacaaaaccttgggacgttataccaatggttactcaaatggcaatgactgatactacaccctttggtcaacaaagagtctttaaagaaaaagtagatacgagaacgcaagagcccaaagaagggacaaaaaagcttatgaaaattacagcggaatggttatggaaggaactaggaaagaaaaaaacaccaagaatgtgtacgcgagaggaattcaccaggaaagttagatctaatgctgcattgggagcaatttttaccgacgaaaacaaatggaaaagcgcaagggaagccgtggaggattcggggttttgggagttggtagacaaagaacgtaatctacatctggaaggcaaatgtgaaacctgcgtgtacaacatgatggggaaacgagaaaagaaattgggagaattcggaaaagccaaaggaagccgagcgatctggtatatgtggcttggagcaagattccttgaatttgaggctctaggattccttaacgaagatcattggttcagcagagagaattccctttcaggggtggaaggagaaggcctacataaactgggatacatattgagagacgttagcaaaaaagaaggaggggcaatgtatgccgacgacacggccgggtgggatacaagaattacattagaggacctaaaaaatgaagaaatggtaacaaatcacatggaaggtgagcataagaaactcgcggaggctatattcaaattgacataccaaaacaaagtagtgagagtacaacggccgacaccacgaggaactgttatggacataataagcagaagggaccaacgtgggagtggtcaggtggtaacatatggattaaatacatttactaacatggaagcacaactaattaggcaaatggagggtgagggtgtatttaaaagcatacagcaattaactgtaaaagaagaaatcgcagttaagaattggttaataagagtgggtcgcgagagacttagccgaatggcaatatctggggacgactgtgtggttaaaccccttgacgaccgattcgcgtcggccttaacggcgctaaatgatatgggaaaggtgaggaaggacatacaacaatgggagcccagcagaggatggaatgactggacgcaagtaccattttgttctcaccactttcatgaattaattatgaaggatggacgtgttttagttgtgccatgtagaaaccaagatgaactaatagggcgagcacgtatttcccaaggtgctgggtggagcttacgtgaaacggcctgtctcggcaagtcatacgctcaaatgtggagtttgatgtattttcaccgacgggatttgcgtctagccgcgaatgcaatctgctcagcagttccttcccattggataccgacttcaagaacaacttggtctatacatgccacacatgaatggatgaccaccgaagatatgctcacagtttggaatagggtctggatacaagaaaacccctggatggaagacaagacaccagtcgaatcatgggaagaaataccctatcttgggaaacgcgaagaccaatggtgtggttctcttatcgggctgacctcacgggcaacatgggctaagaacatacaaacagcgataaaccaagtcaggtctcttataggtaatgaagagtatacagattatatgccgagcatgaaaaggttcagacgggaagaagaagaagcaggtgttttatggtaa

SEQ ID NO: 22255 - RNA, 9876 nt, synthetic construct
  misc_feature 1..9876: note = derived and/or modified CDS sequence (opt6) from DENV-2__KM279557__SS-prME
  source 1..9876: mol_type = other RNA
actgctggcataataataatgatgatacctacagtaatggcatttcaccttacaacgcgaaatggcgaaccacatatgatagtcagccgtcaagaaaaaggcaaatctctactttttaaaactgaaaacggtgtcaacatgtgtaccctaatggctatggatttaggtgaactatgtgaagacactatcacgtacaattgtccattattgcggcaaaatgaacctgaagatatagattgctggtgcaattcgacaagtacgtgggttacgtatgggacctgtacggctacaggcgaacatagacgagaaaaacgaagtgtggcattagtaccacatgtaggaatgggactcgaaacgaggacagaaacatggatgtcatctgaaggtgcatggaaacatgcacaaagaatagaaacatggatacttcgtcatccaggatttacaattatggcagcaatattagcgtataccataggcacaacatactttcaaagagttcttatattcatccttttaacagctgtcactccaagtatggcaatgaggtgtataggtatatcaaacagagatttcgtcgaaggggtatccggaggctcttgggtagatatagttttagaacacgggtcatgtgtaaccactatggctaaaaataaaccaaccttggactttgaactgattaaaaccgaagcaaaacatcttgccacattacgaaaatattgcgttgaagcaaaactaacaaatacgacaacagcgagcagatgtccaacccaaggggaaccgtccttaaacgaagaacaagataaaagatttgtttgtaaacatagtatggtcgaccgaggatggggtaacggttgcggactttttggaaaaggaggcatagtgacttgtgcgatgtttacatgcaagaaaaacatggaaggtaaagtagtccagccggaaaacttggagtataccatagttataaccccacattcgggggaggagaatgcggtgggaaatgataccggaaaacatgggaaagaaattaaagtcacaccgcaaagttcaattacagaggccgaattaacgggttacggaaccgtaacaatggaatgcagtccaagaacaggcttggattttaacgagatggtgctgttacagatggaaaacaaagcgtggctagtacatagacaatggttcttagacttaccgttaccctggcttcctggagctgatacacaaggatcgaactggattcaaaaggagacactggtaacgtttaaaaatccacatgccaagaaacaagatgtagtagttctaggaagccaagagggagcgatgcacacagctttgacaggagccaccgaaatacagatgtcgagtggaaatctattatttactggacaccttaaatgccgcctaagaatggataagctgcaacttaaagggatgagctattccatgtgtacaggaaagttcaaagtagtaaaagaaattgcagaaacacaacatggcacgatagtgatcagagtacagtacgagggtgatggcagtccatgcaaaataccatttgagattatggacttagaaaaacgacatgttttgggacgtcttataacagtaaatccaattgtaacagaaaaagactcaccggttaacatagaagcggaaccgccattcggagattcctatataattataggtgtagaaccaggacaactgaaattaagttggtttaagaaaggtagctcaataggacaaatgtttgaaacaacaatgcggggcgccaaaagaatggccatacttggcgacacagcatgggacttcgggtctcttggcggtgtctttacaagcattggaaaagcattgcatcaagtgttcggagcaatatacggggcagcctttagtggcgtatcatggacaatgaaaatactaataggcgtagtcatcacgtggatcggaatgaactcacgttctacaagtctgtcagtctcattagtgctcgtcggggttgttacactatatttgggggtgatggtgcaggccgattctggctgtgtagtaagctggaaaaacaaggaacttaaatgcggatcaggaatttttatcacagataatgtgcatacttggaccgagcagtataaattccagccagaatcaccatctaaacttgcatcagcaattcaaaaagcacatgaggagggaatttgcggtattaggtcagtgacgagacttgaaaatctgatgtggaaacaaataacgcctgaattaaaccatattttaacggaaaatgaggttaaattaacgataatgaccggcgacattaaaggcatcatgcaggcaggcaaaagatcgctacggcctcaaccaacggaattaaaatattcgtggaaggcttggggaaaggcgaaaatgctgtccacagaactacataaccatacgtttttaatagatggacctgaaacagcagaatgcccgaataccaatagagcctggaactcgttggaagtagaggattatggatttggagttttcacgactaatatttggctgaaactgaaagaaaggcaagacgtgttctgcgattccaaacttatgtcagccgcaattaaagacaatagagcggtacatgcggatatgggttactggatagaaagcgcattaaacgatacatggaaaatcgagaaagcctcatttatagaagtaaaaagctgccactggccaaaatctcatacattgtggtctaatggcgttcttgaatcagaaatgataatacctaaaaattttgcaggacctgtatcacaacacaattaccgaccgggttatcacacacaaactgcagggccatggcacttaggacgcctagagatggatttcgacttttgcgaaggcacgactgtggtagtcacggaagattgtggcaatcgcggtccgtccttacgcacaacaacggcctcaggaaagttaataacagagtggtgttgccgatcatgtactctacccccacttagatacagaggtgaagatggatgctggtacgggatggaaatacggccgctaaaagaaaaagaagaaaatttagttaatagcttggtaacggcgggtcacggacaaatagataacttcagcctcggagtcttaggaatggctttatttttagaagaaatgttgcgtacacgagtgggaactaaacatgctatcttattagtagcagtgagctttgtaacactgattacaggaaacatgtcgtttagggatctgggtcgagtaatggtcatggtaggagcaacgatgacggacgatattggaatgggcgtcacctacctagcgttgcttgcagcgtttaaggttagaccaacttttgccgcaggacttctcttgcgtaaattaacgtcaaaggaactaatgatgacaacaataggaatagttttactcagtcaatctactattccggaatcaattttagaattgactgatgcgttggcgcttggaatgatggtcctaaaaattgtgaggaacatggaaaaatatcaactagcagtcacaataatggcgatcttgtgcgtcccaaacgcagttatactacagaatgcatggaaagttagttgcacaactttggccgtggtaagtgtatctccactattactaacaagtagtcaacagaaagcagattggatacccctagctttaacaataaagggattaaatcctaccgcaatatttcttacgactctatctaggacgtcgaagaaacggtcttggccgctgaatgaagcaattatggctgtggggatggtctcgatattagcaagctcattgcttaagaatgatataccgatgacgggaccattggtggctggaggcttattgacagtctgctacgtattaactgggagatccgcggatcttgaattggaacgcgcagcggatgtaaggtgggaagaacaagctgaaatatccggatcgtctcccatactttccattaccataagcgaagacggctctatgagcatcaaaaatgaagaagaagaacaaacacttacaatacttatacgcactgggttattagtaataagcggactatttcccgtaagcattccgataacggcggcagcatggtatctctgggaagttaagaagcaaagggcgggcgtgctgtgggatgttccgagtcctccacccgttggaaaagcagaattagaagatggagcctaccgtatcaaacaaaaaggtatactagggtatagtcaaatcggtgcaggagtatataaagaaggtacatttcacaccatgtggcatgttacccgtggagctgtattaatgcacaagggcaagaggattgaaccaagctgggccgatgttaagaaagaccttatcagttacggaggaggctggaaactagaaggcgaatggaaggaaggtgaagaagtacaagtcctagctctagaaccggggaaaaatccaagagcagtacaaacaaaaccaggattattcaagacgaatacgggtactataggtgcggtatcattagatttttcacccgggacatcaggtagtccaatagtagataagaaaggcaaagttgttgggctatacggaaatggggttgtgaccaggtctggtacgtatgtatcggctatagcacaaacggaaaagagcatagaggataatccggaaattgaagacgacatctttagaaagaagcggcttactattatggatctacatcctggagccggtaaaaccaagcgttacctcccagcaatagttcgggaagccattaaaagaggactcaggacactcattctggcgccaactagggtggttgctgcggaaatggaagaagcgttacgtggtctcccaatcaggtaccaaactcctgcgatcagagccgagcacacaggtcgcgaaatcgttgaccttatgtgtcacgcaaccttcaccatgagactactttcaccaatacgagttcctaattataacctcataataatggatgaagcacattttacggatccagcaagcattgccgcccgtggatatatatccacgcgtgttgaaatgggtgaagccgccggcatcttcatgacagcgacaccaccaggcagcagagatcctttccctcaatcaaatgcgcctataatggatgaagaaagggagatcccagaaagaagttggaactcggggcacgaatgggttacagacttcaagggtaagactgtatggttcgttccaagcataaaagcggggaatgacattgcagcgtgcttgcgtaaaaatgggaagaaggtcatacaactttccaggaagacgttcgatagtgaatacatcaaaacccgcacgaacgactgggatttcgtcgtgacgaccgacattagcgaaatgggtgccaatttcaaagcagaacgggtaatagatcctcgtcgttgcatgaaaccggtaatattaacagatggcgaagaacgagtcatattggcaggtccaatgcctgtgacgcattcatccgcagcacaacggagaggacgcgtaggtcgaaatcccaaaaatgaaaacgaccaatacatatatatgggtgaaccactggaaaacgacgaagattgtgcacattggaaagaagcgaagatgctattagataacataaatactccggaaggaatcataccaagtatgttcgaacctgagcgagagaaagtcgatgcaattgacggagaatacagattaagaggagaagctagaaaaacatttgttgaccttatgagacgcggtgatctacccgtatggctagcttatagggttgcggccgagggaatcaattatgcagatagaaggtggtgttttgacggcgtgaaaaataatcaaatactagaagaaaatgtggaagttgaaatatggaccaaagaaggagaacggaagaaactcaagccgcgatggttagatgctagaatatattcagacccactagcactcaaagaatttaaggagttcgcggctgggagaaaatcgttgacattaaatcttataacagaaatggggaggctcccaacattcatgacacagaaagccaaaaatgccctcgataacctagcggtacttcatacagctgaagcagggggacgagcttacaatcatgctctcagcgaactacccgaaacgttagaaaccctattattactaacattactagcgacagtgacaggaggtatctttttgtttttgatgagtggtaaaggaataggtaaaatgacgttgggtatgtgttgtattatcactgcctcaatcctcttatggtacgcacaaattcaaccacattggatagcggcaagcataatattagagttcttcttaattgttttattaatcccggaaccggaaaagcaacggacaccgcaagacaatcaactaacatatgtagttattgccatattaacagtagtggcggcaacaatggccaatgaaatgggatttcttgaaaagactaagaaagatttcggactgggatcaatcacaacacaacaacctgagagtaatatcttagatattgacttgcgtccagcatcggcatggacgttatacgctgtagctactacgtttataacccccatgttacgacactcgattgaaaactcgtctgtaaatgtatcattaacagctatagctaatcaagcaactgtgctaatggggttggggaagggatggccgctttccaagatggatataggtgttccgttattagccatcggttgctattcgcaagtcaacccgataactctcacagccgcactcctcctattagttgcccattatgctataattggcccaggtcttcaagccaaagcaacgcgcgaggctcagaagagagcagcagccggtatcatgaaaaaccctaccgtagacggcatgacagtcattgatctagatccaataccatatgatccgaaatttgaaaaacaattaggacaagttatgcttttggtgctatgtgttacacaagtcttaatgatgagaacaacttgggcgctatgtgaggctttaaccctagcaaccggacctatttctaccctatgggagggcaatccaggtagattttggaatactaccatcgcagtttctatggcaaatatattcagagggtcatatctggccggtgccggattactttttagtataatgaagaatactgccaatactcggcgtggtacaggaaacaccggagaaaccctaggagaaaaatggaagaatcggttaaatgcactaggaaagtctgagttccaaatatacaagaagagtggaatacaggaagtagatcgtacgctagccaaggaaggaattaagaggggagaaacagaccatcatgctgtaagcagggggagtgcaaaactcagatggttcgtcgaacgcaatttagtcacaccggagggaaaagtagttgacttgggttgtgggcgtggaggatggtcatattattgcggtggattgaaaaatgtcaaagaagtaaagggccttactaaaggaggccctgggcatgaagaacctattccaatgagtacatacggttggaacttagtaagattacaaagtggagtagacgtcttctttacaccacctgaaaagtgtgatactttgctctgtgatataggagaatcctcgccaaaccccacggtagaagcaggaagaacccttagagtccttaatttagtagagaactggcttaacaacaatacgcaattttgcattaaagtattaaacccctacatgccaagtgtgatagagaaaatggaagcactgcaacgaaagtatggtggagcattagttagaaatccactcagcagaaattcgacgcatgaaatgtactgggtttcgaatgcatcaggcaatatagtaagcagtgtaaacatgatatcccggatgctaatcaacaggttcacgatgaggcacaaaaaggcaacttacgagcccgatgtagatctcggatcgggcactagaaatattggtatagaatcggaaacaccgaatctagatattataggaaaacgtatagagaaaattaaacaagaacacgaaacttcatggcactacgatcaagaccatccttataaaacctgggcctaccacggaagctatgaaacaaagcaaacaggatctgcctcaagtatggtaaacggtgtggtaaggttactaacgaagccttgggatgtcataccaatggtcactcagatggccatgactgacaccacaccatttggacaacagagggtttttaaagaaaaagtagacaccagaacacaggaacccaaagaaggtaccaagaaattaatgaaaataacagcagaatggctttggaaagaactcggtaagaagaagacaccccgcatgtgcacaagagaggagttcacaaggaaagtgcgaagtaatgcggcattaggagctatattcacagacgagaacaaatggaaatcagcgcgagaagctgtagaggattctggattttgggagcttgtagacaaagaaagaaacttgcatttagagggtaaatgtgaaacatgcgtctacaatatgatggggaagagagagaagaaattaggagaatttggaaaggctaagggtagtagagcaatatggtatatgtggctaggtgctcggttcctagaatttgaagccctaggatttttgaacgaagatcattggttttcacgtgagaacagcctatcaggagttgaaggagaaggtctgcacaagttagggtacattctacgagacgtatccaagaaagaaggaggggcaatgtatgctgacgacacagcaggatgggatactcgcataacacttgaagacttgaaaaatgaggagatggtcacaaatcatatggaaggagaacataagaaactcgctgaagctatttttaagctaacgtatcaaaataaggtggttagagttcaacggcccaccccacgaggcacagtaatggacataatttccagaagagaccaaagaggctccggacaggtagtaacatatgggttgaataccttcacgaacatggaagcacaacttataaggcaaatggaaggtgagggagtgtttaagagcatacagcaattaacagtaaaagaagagatcgctgttaagaattggttgattcgagtcggaagagaaagattatctagaatggcaataagtggtgacgattgcgtagttaaaccattggatgacagattcgcatccgccttaacggctcttaatgatatgggaaaggtgcggaaagatatccagcagtgggaaccatcaagaggttggaatgattggacgcaagtaccgttctgcagtcaccatttccacgaattgattatgaaggatggccgagtgcttgtggtaccatgcagaaatcaagatgagctaattggacgagccagaattagccaaggtgccggttggtctctgagagaaactgcatgcttgggaaaatcctacgcgcagatgtggagtttgatgtactttcacagacgagatttaaggttagctgcaaattcaatatgcagcgctgtccctagtcactggataccgacgtctagaactacatggtctattcacgctactcacgaatggatgacaactgaggatatgctaaccgtttggaatagggtctggattcaagaaaacccatggatggaagacaaaacaccggttgaatcttgggaagaaataccatacctaggaaaaagggaagatcagtggtgtgggagcctaattggattaacctctagagcaacctgggccaaaaatatacaaacagcaataaatcaagtaagaagtctaatcggtaacgaagagtatacagattatatgcctagtatgaaaaggttccgacgagaagaggaagaagctggagtgttgtggtaa

SEQ ID NO: 22256 - RNA, 9876 nt, synthetic construct
  misc_feature 1..9876: note = derived and/or modified CDS sequence (opt6) from DENV-2__KM279591__SS-prME
  source 1..9876: mol_type = other RNA
actgctggaataattataatgatgataccaacagttatggcctttcatctcactaccagaaatggcgaacctcatatgatagttagccgccaggaaaaagggaaatcattgttgttcaaaactgaaaacggcgtaaacatgtgcactctaatggccatggatttaggagagttgtgcgaagatactataacgtacaactgtccactactaaggcaaaatgaaccggaagacatagattgttggtgtaattcaacaagcacttgggtgacatatggaacatgcacagccacaggcgaacatagacgagaaaaaaggtctgtcgccctagtgccacatgtaggaatgggactcgagactcgtacagaaacttggatgagtagtgaaggcgcgtggaagcatgcgcagaggatcgaaacatggatattaagacacccgggattcactataatggcggctattttggcatatacaattggaactacgtattttcaaagagttttgatctttatattacttacagcagttacccctagtatggctatgcggtgtatcggaatatcgaatagagactttgtagagggagtttcaggaggaagttgggtggatatcgtcctggaacacggatcctgtgtaacgaccatggcaaagaataaaccaacacttgatttcgaactaataaaaacagaagcaaaacatttagcaacgctaagaaagtattgcgttgaagctaaactgactaacactacgacagccagccgatgtcccacccagggagaaccgtcgctaaacgaagaacaagacaaaaggtttgtttgtaaacattcaatggtggatcgtggttggggaaatggatgtggcctttttggcaagggcggtatcgtgacatgtgcgatgtttacttgcaaaaaaaacatggaaggtaaagtggtacaaccagaaaatctcgaatacacaatagtcataacaccgcacagcggtgaagaaaatgctgtaggaaatgacactggtaagcatgggaaagaaatcaaagtcacgccacagagttcgataaccgaggccgaactcacaggatatggcacagtaacgatggagtgctcaccacgtaccgggttggatttcaatgagatggtcctcctacagatggaaaataaagcttggctcgttcatcggcagtggttccttgatttaccattaccatggttaccaggagcagatacacaaggatcaaattggattcagaaagagacccttgttacattcaaaaatccacacgcaaaaaagcaggatgtagttgtattaggatcgcaagaaggtgctatgcatactgctttgacaggtgcgacggagatacaaatgagctcaggtaatcttttatttactggtcatcttaaatgccggctacgaatggataaactccagctaaaaggaatgagctacagtatgtgtactggcaaatttaaggtagttaaggaaatagcagaaacgcaacacggcacgatcgtaatccgtgtccaatatgaaggcgatggatcaccgtgtaaaatacctttcgaaatcatggatctggaaaaaaggcacgtactggggcgactaattacagtaaatccaattgtaactgaaaaagatagccctgtaaacattgaagctgaaccaccgtttggtgattcatacataatcataggggtcgaacctggtcaacttaagttgagttggttcaaaaaaggatcaagtattggccaaatgtttgagacaacaatgagaggtgctaaaaggatggcgatactgggggatactgcgtgggattttggttcacttggcggagtttttacaagtatagggaaagcactacaccaagtgtttggtgcgatttacggtgcagccttcagtggcgtatcatggacgatgaaaatattgataggagtcgtcattacatggattggaatgaactcacgaagtactagtctctctgtgagtcttgttcttgttggtgtagtaactttatacttgggtgtgatggtccaggcagattcgggctgcgtcgtatcttggaagaacaaagaattgaaatgcggtagcggtatctttatcacagataatgttcatacttggaccgaacagtacaagtttcaacccgaatctccatcaaaactcgcgtcagccattcaaaaagctcatgaagaggggatttgtggaattcgatcggtaacacgtctggagaatttaatgtggaagcaaataacgcccgaactcaaccatatactgaccgaaaatgaagtcaagttaacaattatgacaggggacatcaaaggaattatgcaagcgggaaaacggactttacgcccccaacccacagaattgaaatattcgtggaaagcatggggaaaggctaaaatgctttctactgaactccataatcatacatttttaatagatggacccgaaacggccgaatgccctaatacaaaccgtgcatggaattcactcgaagtagaagattatggtttcggagtatttacaaccaacatatggttaaaattaaaagaacgtcaggatgttttctgtgatagtaaattaatgtccgctgctataaaagataatagagcagtacatgcagatatgggctattggatcgaatctgcgttgaatgacacctggaaaattgagaaggcatcttttatagaggtaaagagttgccactggcccaagtcacacactttatggtcaaatggggtactcgaaagcgaaatgataataccaaaaaattttgcaggtcctgtatcacaacataactatcgtccaggttaccacacacaaacagcgggaccatggcatttagggaggttagaaatggattttgatttttgtgaaggtaccacggtggtagtcaccgaggattgtgggaacagagggccgagccttagaactacaacagcttccggaaagctaatcacagaatggtgctgtcgttcatgtacactacctcccctgcggtataggggtgaagatgggtgctggtacggaatggaaataaggccattgaaggaaaaggaagagaatttagtcaattcactggtaacagcaggacacggtcaaatagacaactttagcttaggggtgttaggcatggcattattcttggaagaaatgctccgtacacgtgtgggaaccaaacatgcaatccttttagtagcagtttcatttgttacactgatcactggcaatatgagctttagggatttaggcagagtaatggtgatggtcggcgcgactatgacagatgatataggaatgggagtcacatacttagcattattagccgcctttaaagtaagaccgacctttgccgcaggcctcttgctaagaaaactaacctcaaaagaactgatgatgactaccataggtatagtattactgtctcaatcaacaatacctgaatccatattagagcttacggacgcacttgctcttggaatgatggtattaaaaattgttcgaaatatggaaaagtatcagttagctgtaacgataatggcgatattatgtgtaccaaacgctgtaatcttgcagaacgcgtggaaagtctcatgtacgaccctcgcggtggtaagtgttagcccattattgttaacatcttcacaacaaaaagcagactggatcccactagccttaactatcaaaggcctaaacccaacggccattttcttaaccacattaagtcgaacgtcaaagaaacgcagctggcccctgaatgaggcaataatggcagtgggaatggtatctatcttagcaagctccttactgaagaacgatataccaatgacgggaccattagtcgctggaggactgttaacagtttgttatgtattaaccggaagatcagccgatctcgaacttgaacgcgcagcggatgtaagatgggaggaacaagccgaaataagcggatcgtctcctatattatccataacgataagcgaggacggaagtatgtcgataaaaaacgaggaggaggaacaaacactcacaatactgatccgaacagggctacttgttataagcggattatttcctgtttccattcccattaccgcagcagcttggtatctttgggaagtgaaaaaacagcgtgctggcgtgttgtgggatgttcccagcccaccaccggtcggaaaggctgaacttgaagatggagcatatagaattaaacaaaaaggtattttaggatattcccaaataggagcaggtgtatataaagagggtacattccacactatgtggcacgtaacgagaggtgctgtactgatgcataagggaaagaggatcgaaccaagctgggcggacgttaaaaaagacttaatttcttacggcggtggatggaaactagaaggcgaatggaaggaaggtgaagaggtacaagttctagccttagagcctgggaaaaatccaagagctgttcaaaccaaaccgggcctttttaaaacaaatactgggacaatcggagcggtatcattagatttcagtccaggtaccagcgggagcccaatcgtagataaaaaaggtaaggtggttggcctatatggaaatggagtggtcacaagatcaggtacctatgtttcagcaattgctcagacagagaaaagtatcgaggataatcccgaaatagaagacgacatttttagaaaaaaaagattaacaataatggatctacaccctggagcaggcaaaacaaaaaggtatcttccagcgatcgtaagggaagctatcaagcgcgggctccgcactcttattctagcacctacaagagttgtagctgcagaaatggaggaagcgttacgaggtcttccgataagatatcaaactccagccatacgcgcggaacatactggtagagagatagtcgacctaatgtgccacgcaaccttcacaatgcgattactttcccccataagggtaccaaattacaatctaattattatggatgaagcccattttacagatccagcaagcattgcggcgcgtggctatattagtacgagagttgaaatgggtgaagctgctggcatatttatgacggcaactccaccaggttcaagagatccttttcctcaaagcaatgcgcccattatggacgaagagcgggaaatacctgaaagaagttggaattcgggtcatgaatgggttacagattttaaaggcaaaaccgtttggtttgtaccgagtattaaagcaggcaatgacatagcggcatgcttgagaaaaaatggcaaaaaagttattcaactgtcaaggaagacctttgatagcgaatatataaaaactagaactaatgattgggacttcgtagtgacaaccgatatttccgagatgggggcaaactttaaagcagaacgggtcatagatccaaggcggtgtatgaaacccgttatcctaaccgacggcgaagagagagtgatattagcaggtccaatgcctgtcacgcactctagcgcagcgcaaaggagaggacgcgttggccgaaatcctaagaacgaaaatgaccagtacatatatatgggcgaaccactagaaaacgatgaggactgcgcacattggaaagaagcgaagatgttgttggataacatcaacactcctgaagggataatacccagtatgttcgagccagagcgcgaaaaagttgatgcgatcgacggagaatacagattacgaggagaagcgcgtaagacttttgtagatcttatgagaagaggagatctaccagtatggttagcatatcgagttgccgccgaaggcataaattacgttgacagacggtggtgtttcgacggagttaaaaataaccagattttagaagagaatgtagaagtagagatatggacaaaagagggcgagcgcaagaagctaaagcccagatggctagatgccagaatatactcagatccactagcattgaaagaattcaaggaatttgcagctggacgcaaaagtcttaccctcaacttaataaccgaaatgggcagattgcctaccttcatgacacaaaaggctaaaaacgcgctagataacctggcagtcctacatactgcggaggctggggggcgggcgtataatcatgcactatctgaactacctgagacattagagaccttactattattgacacttttagcaacggtcacaggagggatttttctctttctcatgtcaggtaaaggaatcggaaaaatgactttgggaatgtgttgcataatcactgcaagtatattactgtggtatgcgcagatacaaccccattggatcgctgccagtataattttagaattcttcttaattgtactactgattccagaacctgaaaaacaacgaacacctcaagataatcaattaacttatgtggtaatagcgatcctaacggtggttgcagccacgatggctaatgaaatgggattccttgaaaaaacaaaaaaagactttggcttaggtagtataactacacaacaacccgagtccaacatacttgatatagatttacgacctgcatccgcatggactttatacgccgtcgcgaccacatttattacaccaatgttacgccattcaatagaaaattcgagtgtaaacgtttcccttacggccatcgctaatcaagcaacagttttgatgggattaggtaaggggtggcctttaagtaaaatggatattggggtgccattactagctataggatgctacagccaggtaaatccaatcacattaacggcagcactgctcctactggtagcccattacgccattatcggtccaggcttacaggctaaagcaactcgagaagcacagaaaagggcagctgctggaataatgaaaaacccgaccgtggatggcatgactgtaatcgacttagatcctatcccatatgatccaaaattcgagaaacaacttggccaagtcatgttattagtcctatgtgtaacccaggtattaatgatgcgtacaacatgggcgttgtgtgaagccctcacgctagcgaccggaccgatctcgaccttatgggaagggaatccaggacgattttggaacacaacaatagccgtaagtatggctaacatctttagaggatcttatctagctggagctggattattattttcgataatgaaaaacacggcgaatacacgacgagggacagggaacacaggagagactttaggagaaaaatggaagaacagacttaatgcattaggaaaaagcgaattccagatctacaaaaaatcgggaatacaagaagttgacagaaccttagcaaaagaaggaataaaacgtggtgagactgatcaccacgctgtatcacgcggttcggcgaaactcagatggtttgtagaacgtaatctcgtgactccagaaggaaaagtagtcgatttaggatgcgggagaggaggatggtcatattattgcggcgggctaaaaaacgttaaagaagtgaaaggacttactaaaggaggtccaggtcatgaagaacccattcctatgtcaacttatgggtggaacttggttcggctacaatccggagtggatgtattcttcacaccacctgaaaaatgcgataccctgttgtgcgatatcggtgaaagtagccctaatccgactgttgaagctggacgcactctaagagtgctgaatttggttgagaattggcttaacaacaatacacagttttgtattaaagtattgaatccatatatgcctagtgttatcgaaaaaatggaagcactgcaacgaaaatatggtggagcgctagtgcgtaaccccctatcaaggaattcgacccatgagatgtactgggtctccaatgcatcaggcaatatagtgtcaagtgtaaatatgatctctagaatgctcattaatcgatttacgatgagacataagaaagctacctacgaaccggacgttgacctgggcagtggtactcgtaatatagggatcgaatcagaaacacccaacttagatataataggtaaaagaatagagaaaattaaacaagagcatgaaactagttggcattatgaccaagaccatccatataaaacctgggcatatcacggaagttatgaaacaaaacaaaccggaagcgcatcttcaatggtaaacggggtagtaaggttgctcactaaaccatgggatgttatccccatggtgacgcaaatggcaatgactgatactactccctttggccagcaacgggtctttaaggaaaaggtagacacaagaacgcaggaacccaaagaaggaacgaaaaaactaatgaaaatcacagcagaatggttatggaaagaattaggaaagaagaagacaccgcgaatgtgtacgagggaggaattcacaagaaaagttcgttcaaatgcagcattaggggcgatatttaccgacgaaaataaatggaaatcggcgagggaagctgtggaagatagtggtttttgggaactcgtggacaaggaacggaatttacatcttgaaggcaagtgtgaaacatgtgtctataatatgatgggaaaaagagaaaaaaaattaggggaatttggaaaagcaaagggcagtcgggcaatatggtatatgtggctaggagcaagatttctagagtttgaagcccttggattcctcaatgaagatcattggttttcaagagaaaatagtttgtctggagttgagggtgagggcttacacaaactgggttacattcttcgagacgtatcgaagaaagaaggtggcgctatgtacgctgatgatacggccggatgggataccagaattacattagaagatttaaaaaacgaagagatggttaccaatcatatggagggcgaacataagaaactagctgaggctatattcaagttaacatatcaaaacaaagtagtaagagtacaacggccaactcctagaggaactgtcatggatatcataagccggcgagaccagcgaggttccggccaagttgtgacctatggcttaaatacatttacaaacatggaggcacaattgattcgtcaaatggaaggagaaggagtgtttaagagtatacagcagttaaccgtaaaagaagaaattgcagtcaagaattggcttataagagtaggacgtgaaaggctgtctcgaatggcgatatctggtgacgattgcgtagtaaaaccattggatgataggttcgcatcagctctaactgcgttgaatgacatgggaaaagttcggaaagacatacaacagtgggaaccatcaagaggatggaatgattggacacaggttccgttctgctcgcaccatttccacgaattaataatgaaagatggaagagtattagtggtaccatgccgtaatcaagacgaactgattggacgtgcgagaattagccagggtgcgggatggtctttgcgcgaaacagcttgtctaggtaaaagttacgcgcagatgtggagtttaatgtattttcaccggagagatctgcgcttagctgcaaatgcgatctgtagtgcggtaccatctcattggatcccaacatcccggacaacttggagtatacatgcaactcacgaatggatgacaacggaagacatgctcacagtatggaatcgcgtgtggatacaggaaaacccctggatggaagataaaacacccgttgaatcatgggaagaaataccatatctaggaaaaagggaagatcagtggtgcgggtcactaataggtctgacttctcgggccacttgggctaaaaacattcaaacagcaatcaaccaagttagaagcctaatcggaaatgaagagtacacggactatatgccatcgatgaagcgtttcagacgagaagaagaagaagcaggagtactatggtaa

SEQ ID NO: 22257 - RNA, 9876 nt, synthetic construct
  misc_feature 1..9876: note = derived and/or modified CDS sequence (opt6) from DENV-2__KM279558__SS-prME
  source 1..9876: mol_type = other RNA
accgctgggataattattatgatgataccaaccgttatggcgttccatctgacaacacgcaatggtgaacctcacatgatagtatcaagacaggaaaaagggaaaagccttttatttaaaacggaaaacggagtcaatatgtgtacattaatggcaatggacttaggtgagctatgtgaagatacgatcacatataactgtcctttacttagacaaaatgaaccagaagacatagattgctggtgtaattctacttctacttgggtaacgtacggtacatgcaccgcaactggagaacatcgcagagagaaaagatctgtggcactcgttccccatgtagggatgggtctcgagactagaacagaaacgtggatgtccagtgaaggagcatggaaacacgcacagagaattgagacctggatcttacgtcatccaggcttcacgataatggccgccattttggcttatacaattggaactacatactttcaaagagtgttaatatttatactcttaacagccgtaacaccttccatggctatgaggtgcattggtataagcaatagagacttcgtagagggtgtaagtggcggatcatgggtagatatagtgttagagcatggcagctgcgtgacaacaatggcgaaaaacaaacctacactagattttgaacttatcaaaacggaggcaaaacaccttgcaaccttaagaaaatactgcgtagaagctaaattgactaacactactacggcttcgcggtgcccgacacagggtgaaccgagcttaaatgaagaacaagataaaagatttgtatgcaaacattcaatggttgaccgaggatggggaaatggatgtggattgtttggaaaaggaggcattgttacatgtgcgatgtttacatgtaagaaaaatatggagggaaaagtagtacagcccgaaaatttagaatacaccatagtgattacgcctcattctggagaggaaaatgcagttggaaacgatactggaaaacacggaaaagaaattaaaataaccccacagtcttcgataacagaggcggagttaacaggatatggcacagtcactatggaatgcagcccgcgaactggactcgacttcaacgaaatggtacttctacagatggagaataaagcgtggctagtccatagacaatggtttctagatctgcctctcccatggttaccaggagctgacacgcaagggagcaactggatacaaaaagagactcttgtcacatttaaaaatcctcatgccaagaaacaagacgtggtagtattaggaagtcaggagggggcaatgcatacagcccttactggagcaacagaaatccagatgtcatctggcaacctactgtttacagggcacctaaaatgccgccttcgaatggataaacttcaactaaaaggaatgtcttattcaatgtgcacaggtaaattcaaagtagtaaaagaaatagcggaaactcaacacggaacaatagtaataagagtgcaatacgagggtgatggaagcccatgtaaaataccatttgaaataatggatctggagaaaagacatgtgctaggtcgcttgataacagtaaatccgatagttacagagaaagactcgccagtcaacatagaggcggagccgccgttcggtgacagctatataataataggcgtagagccaggacaactaaaactatcatggttcaagaaaggctcaagcataggccaaatgttcgaaacaacaatgagaggagcaaaacgtatggcgatattgggtgacactgcatgggatttcggttctttgggtggtgtattcacaagtatagggaaagcactacaccaggtgttcggggccatctatggagcagctttttccggagtttcttggacaatgaaaattttgataggggtagtgataacttggatcgggatgaacagtcgatctacaagcctaagtgtatcactggtactcgtcggtgtagtcacactgtatttaggtgtcatggtccaagccgattcgggatgtgtcgtcagctggaaaaataaagaattgaaatgcggtagtggcatattcattaccgataacgttcatacatggacggaacaatataaattccaacctgagtctccatcgaaattggcgtctgccatccaaaaagctcatgaagaaggcatatgtggcataagatcggttacaagactcgaaaacctgatgtggaaacagataaccccggaattgaaccacattctaacggagaatgaagttaagttaactatcatgacgggcgatatcaaaggcatcatgcaagccggtaagagaagtcttcgtcctcaaccaacagaattgaaatatagctggaaagcatggggcaaagccaaaatgttatcgactgaactacacaaccacaccttcctaattgacgggcccgagactgctgagtgtcctaatacgaatcgtgcctggaactcactggaggttgaagattatggattcggagtattcacaacaaatatttggttgaaacttaaagagaggcaggacgtcttttgcgactccaaactaatgtcagcggccattaaagacaatcgtgcagttcatgcagacatgggttattggatagagtctgccctaaacgatacttggaaaatagaaaaagcgagtttcattgaagtaaagagttgtcactggccgaagtcgcacacgctatggtcaaatggggttcttgaaagtgagatgataatccctaaaaactttgccggccctgtctcccaacacaattacaggccaggataccatacacagactgctggtccgtggcacctaggaaggttggaaatggattttgatttttgcgagggtacaactgtagtagttactgaggactgtggcaataggggaccaagtctcagaactactacagcatccggaaaattaataacggagtggtgttgccggtcttgtactctacctccattaaggtataggggagaagacggatgctggtacggtatggagattcgtcccctaaaagaaaaagaagagaatttagttaatagcttggttacagctggacacgggcagattgataacttttcattaggtgttctaggaatggcactattcctagaagaaatgttgaggactagagtaggaacaaagcacgcaatacttctcgtagcagtatcatttgtgaccctaatcacgggaaatatgtcttttcgcgacctgggtcgggtaatggtcatggtgggagcaacaatgaccgatgacataggaatgggtgtaacttaccttgctttattagcagcttttaaagtcagacctacatttgccgcaggattattacttcgtaaattgacctctaaagaactgatgatgactacgattgggatagtactactatcacagtccacgatcccggaatctatactcgaactgacggacgccttagccctcggaatgatggtccttaaaatagtcaggaatatggagaaataccaacttgcagtgacaataatggcaattagttgtgtaccgaatgcagtgatactacaaaatgcttggaaagttagctgtacgaccctagctgtagtatcagtgagccccctacttcttaccagtagtcaacaaaaagccgattggataccactagccttgacaatcaaaggccttaatccaacggctatatttttaacaacactaagtagaacatctaagaaaagatcctggccactcaatgaagcgatcatggcggtaggaatggtttctattctcgcatccagccttctgaaaaatgacataccaatgaccggtccgttagtagcaggagggctacttacagtttgttacgtgttgaccgggcgaagcgcagatttagaattagaaagagccgccgacgtaagatgggaagaacaagcggaaatcagtgggagttctcctattttaagcataaccatatctgaggatggttctatgtcgatcaaaaatgaagaagaagaacagacgctcacaatactcattcgtaccggtttattagtaattagtgggctgttcccagtaagcattccaataacagcagccgcatggtatctatgggaagtaaagaaacaaagggcaggagtcttatgggatgtgccttcacctcctcctgtaggaaaggctgagttagaagatggcgcataccgtataaaacaaaaaggtatactcggatatagtcagataggagctggcgtttataaagagggtactttccataccatgtggcacgtaacccgaggtgctgtcctaatgcataaaggaaaacgtattgaaccgagttgggccgatgttaagaaagacctaatatcgtatggagggggatggaaattagaaggtgaatggaaagagggcgaagaagttcaagtgttagcactagagccagggaaaaacccgagagctgtacaaacaaaaccaggactatttaaaacaaatactggaactattggcgctgtcagccttgattttagtccaggaacgtcaggatcaccgatcgttgataagaagggaaaagtagttggcttatacggcaatggtgtagtgacacgttcaggcacctatgtgagcgcgatcgctcaaacagaaaaatcaatagaagacaatccagaaatagaggatgatatttttaggaagaaaagattgactataatggatttacaccctggagcaggaaaaactaaacgatacctccctgctatagtaagagaggccataaaaagaggcctgcgcaccctgattctagcgccaaccagagtagtcgctgctgagatggaagaggccctcagaggactaccaattcggtatcaaactcctgcaatacgagcagaacatactggacgtgaaattgtcgatctaatgtgccatgcgactttcactatgagactcctcagcccaataagagtaccgaactacaatcttataataatggatgaggctcactttacggatccggcgagcatagcagcaagaggttacataagcacacgggttgaaatgggcgaagcagcaggtatcttcatgacagcaacaccacctggatccagagatccatttccacaatcaaatgcacctattatggacgaggagcgagaaattccagagagatcttggaactcaggacatgagtgggtgacagattttaaaggcaaaacagtttggttcgtccccagcataaaagccgggaatgatattgcagcctgtttaaggaaaaatggtaaaaaggtgatacaactatcacgcaagacatttgattcggaatacataaaaacgagaacgaatgattgggactttgtagttactaccgacatatccgaaatgggagctaattttaaggcggaaagagtcatagaccccagaagatgcatgaaacctgttatactgaccgacggagaagaacgagtcatactggcggggcctatgccagtaacgcatagttcagcagcgcaaagacgggggcgagttggtcggaatcccaaaaatgaaaatgaccaatatatctacatgggagaacccttagagaacgatgaagattgtgctcattggaaagaggcgaagatgctccttgataacataaatacacccgaggggattataccatcgatgttcgaaccagagcgagaaaaagtcgatgctatcgacggggagtaccgactacgcggtgaagctcgtaaaacatttgttgatttaatgcgtcgtggagatttaccggtctggctcgcctacagagtagcggcggaaggaataaattacgccgacagaagatggtgctttgacggcgtaaagaacaatcaaattttagaggaaaatgttgaagtagagatttggacaaaagaaggagaacgtaaaaagttaaaacccaggtggctggatgccagaatatattcagatcccttagctctaaaagagttcaaagaatttgctgctggaaggaaatctctcacgttaaatctcataactgagatgggtagattaccaaccttcatgacacagaaagcgaaaaacgctctggataatttagcagtactacacacggcagaagcaggagggcgggcatataaccacgcgttatccgaattgcctgaaacactagaaacactgcttctacttacattgctcgctacggtcacgggaggaatatttttattccttatgagcggaaaaggaataggtaagatgactctgggaatgtgctgcataattactgctagcatacttctgtggtatgcacaaatacaaccacattggatagcagcgtcgataatcttggagttctttttaatagtattactaatccctgaacctgaaaaacaaagaactcctcaggataatcaacttacatacgtagtcatagccattcttaccgtcgtggcagcgacgatggctaatgaaatgggttttctggagaaaaccaagaaagattttggattaggatctataacaacacaacagcccgaaagtaacattctggatatagatctcagaccggcatcagcatggactctatatgcagtggcgacaacctttataacaccaatgctaaggcattcgattgaaaattcaagtgtcaatgtcagtttaactgctatagcaaatcaggcgacagtacttatgggattaggtaaaggatggccgctatcaaaaatggatataggagtgcctctattagctataggatgctatagtcaagtgaatccaataacattgactgcagcacttttactcttagtggctcactatgctattatcgggccaggattgcaagcaaaagctacacgagaagcacaaaagagagccgcagcaggaataatgaaaaatcccacagtggatggtatgaccgttatagacttagatccaattccatatgaccctaagtttgaaaaacaattaggccaagttatgttgctagtactttgtgtgacacaagtcttaatgatgcggacgacatgggccctgtgtgaagcgttaacattagctacaggcccaatttcaacgctgtgggagggcaacccaggcagattctggaacaccacaatagctgttagcatggcgaatattttcaggggaagctatctagcgggtgctggactactgttcagtatcatgaagaatacggctaatacaagaaggggtacaggtaacacgggagagacactgggggagaaatggaaaaaccgattaaacgctctaggcaaaagcgaatttcaaatttataagaaaagtgggattcaagaagttgatcggaccttagccaaagaggggataaagagaggagaaacggaccatcacgcggtatcaagaggttctgctaaacttaggtggtttgtggaaagaaacttagtgacaccagaaggtaaagtagtggatctaggatgcggccgtgggggatggtcatactactgtggtggtttgaaaaacgttaaagaagtaaaaggtctaacaaagggaggcccgggacatgaagaaccaattcctatgagtacatacggttggaacctagtgaggctacaatctggagtagacgtattctttacaccgcccgaaaaatgcgatacattactctgtgatatcggagaatcttctccaaaccctaccgttgaagctgggcgaaccttgagagttttaaacttagtggaaaattggctaaacaataatactcaattttgcatcaaagtacttaatccatatatgccatcagtcatagaaaagatggaagcattgcaacgaaaatacggtggcgcattggtccgcaatccccttagcagaaactcaactcatgaaatgtattgggtaagcaacgcctcaggcaatatagtatcgtcggttaatatgatttcgagaatgctaataaacaggttcacaatgcgccataagaaagcaacttatgagcctgacgtggacttgggatcaggtacgcgaaacataggcattgaatcagaaacgccgaacctagacatcataggtaaaagaatagagaagataaaacaagaacatgaaaccagctggcattacgatcaggatcacccatataaaacatgggcctatcatggttcgtacgaaacgaaacaaacggggagtgcttcaagtatggtcaatggagttgtacgattactcactaaaccttgggacgtaatacctatggttacacaaatggctatgaccgataccacaccattcggacaacagcgagttttcaaggagaaagtagacacgcggacacaagagccaaaagagggcactaagaaacttatgaaaattacagcagaatggttgtggaaagaattaggaaagaagaaaacgcccagaatgtgtaccagggaagagttcacaagaaaagtgcgatcaaacgcagccctgggcgcaatatttactgacgaaaacaagtggaagtccgcgcgagaagctgtggaggactcggggttttgggaattggtagataaagaacgaaatttacatctcgaaggaaaatgtgaaacgtgcgtttataacatgatgggaaaaagggagaagaaactgggtgaatttggtaaagcgaaaggatcacgggcaatttggtatatgtggttgggcgcgagatttttagagttcgaagcactcggctttctaaatgaagatcattggtttagtagagaaaattcattgtcgggggtagagggtgaaggactacataaattaggctacatcctgagggatgtaagcaagaaagagggcggagcgatgtatgctgacgatacagcgggatgggatactcgcataacactagaagacctcaagaatgaagaaatggttacaaatcatatggaaggagaacacaagaaattggcggaggcaatctttaaactcacatatcaaaataaagtagtaagggttcaaagacccactccgcgcgggacagtcatggatataataagtaggcgcgatcaaaggggaagtggtcaagttgtaacatacgggttaaacactttcactaatatggaagcacaacttattaggcagatggaaggagaaggagtatttaaatcgatacagcaactaaccgtcaaagaagaaatagccgtcaagaattggttaataagagttggaagagaaagattaagccgaatggccattagtggggatgattgcgtagtaaaaccactcgatgataggtttgctagtgctcttactgcacttaacgatatgggaaaagtaaggaaggatattcaacagtgggaaccgagtcggggctggaatgattggacgcaagttccattctgttcacatcacttccatgaattgataatgaaagatggccgcgtcttagttgttccatgtagaaatcaagatgagctaattggacgagcccgcatttctcagggagctggttggtccctcagagaaactgcctgtttaggtaaaagttacgcacaaatgtggtcgctaatgtactttcatagacgagacttaagattagcggcaaacgcaatttgttcggcggtaccctcacattggatacctacttcaagaacaacgtggagcatacatgcgacccatgaatggatgacaaccgaagatatgcttacagtttggaacagggtatggatccaagagaatccctggatggaagacaaaacaccggtagagagttgggaagagataccttacttgggtaagcgggaggaccaatggtgcgggagtttaataggcctaacgagtcgcgctacatgggctaaaaatatccaaacagctataaaccaagtaaggtcgctcataggcaacgaagaatatacagattacatgccatcaatgaaacgctttagaagagaagaggaagaagccggtgttttatggtga

SEQ ID NO: 22258 - RNA, 9876 nt, synthetic construct
  misc_feature 1..9876: note = derived and/or modified CDS sequence (opt6) from DENV-2__KM279564__SS-prME
  source 1..9876: mol_type = other RNA
acagcaggaataataatcatgatgatcccaacagtcatggcatttcatctgactacacggaacggagaaccccatatgattgtttcgcgacaagaaaaagggaaaagtctgctatttaaaacagaaaacggagtgaacatgtgcacgctaatggcaatggatctaggggaattatgcgaagacacaattacatataattgtcccttgttacgacaaaatgaaccggaagatatagactgctggtgcaacagtacaagtacttgggtcacgtatggtacttgtactgcaaccggtgaacaccgacgagaaaaacgcagtgttgccttagtacctcatgtaggaatgggtctagaaacccgcacagaaacttggatgtcaagtgaaggagcatggaaacatgcacaaaggatagaaacgtggatactaagacacccggggtttacaattatggcagcaatcctagcctacacaataggaactacatactttcaacgggtattaatattcattttacttacagccgttacgccaagtatggcaatgcgatgtatcgggattagtaacagggatttcgtagaaggcgtcagtggcggaagttgggtagatatcgtactagaacacggatcctgtgttacaaccatggccaaaaataaaccaacactcgacttcgaactgataaaaacagaagcaaaacaccttgcaacgcttaggaaatattgtgtggaagcaaaattaactaacacgacaactgcaagtcgttgtccgacacaaggtgagccatcattaaatgaggagcaagataaaagatttgtatgcaaacattcaatggtggatagaggatggggaaacggatgtggcctctttggaaaaggtggaatagtaacatgcgcaatgtttacatgtaagaaaaatatggaaggaaaagtagtccaaccagaaaatctggaatataccatagtcattacgccacactcaggtgaagagaatgccgtaggaaatgacacgggaaagcatggcaaagaaattaagataacaccccagtcttcaataactgaagctgaactaactggctatggaacagttactatggaatgttcacctagaacgggattagattttaacgagatggtgcttctacaaatggaaaataaagcgtggcttgtacacagacaatggtttctagatctcccactcccctggttgccaggagctgatacacagggctctaactggatacaaaaagaaacgctagttactttcaaaaacccgcatgcaaagaagcaagacgtagtagtgttaggctcacaggaaggagctatgcatacagcattaacgggagctaccgaaatacaaatgtcgtcggggaatctcctttttacaggacacttgaaatgtcgattaaggatggataaattacaattgaaaggaatgtcatattccatgtgcacaggaaagttcaaagtagtaaaggaaatagccgaaacacaacatggtacaatcgtgataagggtacagtatgaaggtgacggcagtccttgcaaaattccgtttgaaattatggacctggagaaaaggcatgtcctagggagacttataacagtgaacccaatcgtgacagaaaaggattcaccagttaatatcgaagccgaacctccatttggggactcatatatcataattggggtagaaccaggtcaattgaagttaagctggttcaagaaagggtcatcaataggacaaatgtttgagacaaccatgcgtggggcaaaacgaatggctatcctaggagacactgcatgggatttcgggagtcttggaggggtattcacgagcattggaaaagcacttcatcaagtatttggagccatatatggggcggccttctcaggagtgagttggacaatgaaaatattaatcggcgtagttatcacttggattggaatgaatagccgcagtacaagcctctcagtgagcttagttctggttggcgtagttactctatatcttggggtcatggtgcaagctgatagtggctgtgttgtatcgtggaaaaataaagaactcaaatgcggttctggtatctttataacagacaacgtacacacttggaccgagcaatacaaatttcagccagaatccccgagtaagttagcgtcagcaattcaaaaagcccatgaggaaggcatttgcggaatacgaagcgtcacgagattagaaaacttgatgtggaaacaaataacccccgaactaaatcacatcctaaccgaaaatgaagtaaaactaacaataatgaccggtgacataaaaggtataatgcaagcaggcaaaaggagcttaagaccacaaccaacagaacttaagtattcatggaaggcttggggtaaagcgaaaatgttatccacagagctgcataatcataccttcttaatagatggaccagaaacagctgaatgtccaaatacgaacagggcatggaacagtctcgaagtggaagattacggttttggtgttttcactacaaatatatggttaaaacttaaagaaagacaagacgtattctgtgatagtaaattgatgagcgctgccataaaagacaatagagccgtccatgccgacatgggatactggattgaatctgcattaaacgatacttggaaaatagagaaagcatcgtttattgaggtaaagagttgtcattggcccaaatctcacaccctatggtcaaatggagttctagagtcagaaatgataatacccaaaaacttcgcaggccctgtatcccagcataactatcgtccaggctatcatactcaaactgccggtccatggcaccttggtcgactcgaaatggatttcgatttttgtgaggggacgacagttgttgtaacggaggattgtggcaatcggggaccgtctttaaggacaacaacggcctccggaaaactcataacagaatggtgttgtagaagctgtactctcccaccgcttagatatagaggtgaagacggctgctggtatggcatggaaataagaccacttaaagaaaaagaagaaaatctggtcaactcactggtaacggcaggacatggacagatagacaacttttcgttgggagtgctcggtatggccttatttcttgaagagatgctaagaacaagggtaggtacaaaacatgctattctcttagtggcagtatcatttgtcacactaatcacaggtaacatgagctttagagacttagggagggttatggtcatggtcggtgcaacgatgactgacgacatcggcatgggcgtgacatacctagctttacttgcggcatttaaagtaagacctacatttgcagctggactgctactgaggaaacttacaagtaaagagttaatgatgacaacgataggcatcgtattactttcgcaatccactatcccagaatcgatcttggaattaaccgatgccctggcattgggaatgatggtattaaagattgtaagaaatatggaaaaataccaattagccgttaccataatggctataagctgtgtacctaatgcagtcatcctacaaaacgcatggaaagtttcatgtactacactcgcagtggtcagtgttagcccattactcttaacatctagtcagcaaaaagcagattggattccattagcattaacaataaagggcctcaacccaactgcaatattcctaactacactatcacgaacaagtaagaagcgaagctggccacttaatgaagctataatggctgtaggcatggtatcgatattagcatcaagtcttctcaaaaatgatatccctatgacaggcccattagtagccgggggtctactgacagtttgttacgtcctcaccggtaggtcagccgatctagaacttgagagagcagctgatgtacgatgggaagaacaagccgaaataagtggatcaagcccaatactaagtataactatatccgaagatggcagcatgtcgataaagaacgaagaagaggaacaaactctaacgattctaataaggactggactcctagtcatatcgggattatttcctgtgtcaattccaattactgccgcagcatggtatttatgggaagtcaagaaacagagagccggtgtactctgggatgtaccttcgccgccacctgttggaaaggcagagctagaagatggtgcataccgcataaaacaaaaggggatacttggatatagccaaattggcgctggcgtttacaaggagggaacatttcatactatgtggcacgttacccggggtgcagtccttatgcacaaaggtaaaagaatagaaccatcatgggcagatgttaaaaaggatctaatatcgtatggcggaggctggaaactagaaggagaatggaaggaaggggaggaagtacaggtattggccttagagcctggcaagaatcctagagctgttcagaccaaacctggacttttcaaaaccaacacgggaactatcggcgcggtcagcctagactttagcccaggaacctccggaagcccaatcgtggacaagaaaggcaaagttgtcggactttacggaaatggcgttgtcaccagatcaggcacctatgtttctgctatagcccaaacagagaaatcaatagaggataatccggaaattgaagacgacatattccgcaaaaagagactcaccataatggatctgcaccccggagcgggaaagacaaagagataccttccagcaatcgtccgagaagccatcaagcgtggactgcgaacgttgatcttagctccaactagagtagtcgcagcagagatggaagaagccctaagaggactaccaataagatatcaaactcctgcaatcagagctgaacacacaggtcgcgaaattgtagacctaatgtgccatgcaacttttactatgagattactaagcccgataagagtcccgaactacaatctgattataatggatgaagcccactttacggatccggcttctattgctgctagaggctacatcagtacacgagtggaaatgggcgaagccgcaggaatctttatgacagctactccacccgggagtcgagacccgtttcctcaatccaatgcaccgatcatggacgaagagagggagattccagagagatcatggaatagtgggcacgagtgggtgaccgattttaaaggaaaaactgtttggtttgtaccctctattaaagctgggaacgatattgccgcatgtttgcgtaaaaatggtaagaaagtgatacaattgagcagaaaaacatttgatagcgaatatatcaagacacggacaaatgactgggatttcgtagtcacaactgacatatcagaaatgggggcgaatttcaaagctgagagagtaatcgatcccagaagatgcatgaaacccgtcattttgacggatggggaggagagagttatattagccggacctatgcccgtgacgcattcgtcagcagctcaaagaagaggacgtgtaggccgaaaccccaaaaatgaaaacgatcagtacatatacatgggagaaccgctagagaatgatgaggactgtgcacattggaaagaggcaaaaatgctcttagataacatcaatacaccagaaggaattataccttcgatgtttgaaccggaaagagaaaaagtagatgcaatagacggagaatacagactacgaggagaggcgagaaaaactttcgttgatctcatgagacgaggtgacttgccagtatggctggcctacagagtggctgcagaaggcattaactatgcagaccgaagatggtgcttcgatggggttaaaaataaccaaattctggaagaaaacgtagaggttgagatatggactaaggagggagaaagaaagaaactaaaacctcgttggttagatgcaaggatatactccgatccgcttgcactaaaagaatttaaagagttcgctgcaggcagaaaatcattaaccctgaacctcataacagagatgggcagactccccacattcatgactcaaaaagcaaagaatgctttggacaacttagctgtactacatactgcagaagcgggaggcagagcgtacaatcacgcattatcggaattaccagaaacactagagactctattgctactaaccctgctagcaactgtaacagggggtatatttcttttcttgatgagcggaaagggaatcggaaaaatgacgttaggtatgtgttgcatcattacagcatcgatacttttatggtatgcacaaatacaaccccattggatagcagcgtcaatcattttagagttctttttaattgtactattgattccggagccggaaaaacaaagaactccgcaggataaccaattaacttatgtagtgatagctatattgactgtagttgcagccaccatggcgaatgagatggggtttttggagaaaacgaaaaaggattttggactagggtctatcaccacgcaacaacccgaaagtaacatattagacatagatctgagaccggcaagtgcatggactctttatgctgttgcgacgacgtttattacgccgatgcttcggcatagtattgaaaacagctccgtaaacgtaagtttaacagctatcgcgaatcaagcaactgtgctgatggggctaggaaaagggtggcctttatcgaaaatggacataggtgttccactattagctataggttgctacagccaagttaatcccatcacactaacagctgcattactactattggtcgctcattacgctattattggaccgggcttacaagctaaagcaactcgcgaagcacaaaaacgagccgcggcaggaattatgaaaaaccctactgtagatggtatgactgttatcgatctagatccgatcccatatgacccgaaattcgaaaaacagttaggtcaagtcatgctattagtgctatgtgtcacacaagtcttaatgatgcgaaccacgtgggcattgtgcgaagcattaacattggcaacaggaccaatatctacactctgggagggaaatccaggtcggttttggaacacgactattgcggtttctatggcaaacatttttagaggtagctacctcgcaggggcgggcttactattttcgatcatgaaaaatactgccaacacaaggagagggacaggtaataccggagaaactctaggagaaaaatggaaaaatcgtcttaacgccctcggaaaatctgaatttcaaatctataagaaatcgggaatacaagaggtagaccgcacgttagccaaagagggaataaaacgaggtgagactgatcaccatgctgtaagtcggggctccgcaaagctgcgctggtttgttgaacgaaatctagtaacgcccgagggtaaagtggtggatttaggatgcggaaggggtggatggtcatattactgcgggggtctcaagaatgtaaaagaagtaaaaggactaacaaaaggcggaccgggacacgaagaaccaattccgatgtcgacatacggatggaacttggtccgattacaatcgggagtagacgtattctttactccacccgaaaagtgcgataccttgctatgtgacatcggggagagctccccaaaccctaccgttgaagctgggaggactctgagagtacttaatttggtagagaattggctaaacaacaacacgcagttttgtataaaagtgcttaatccctacatgccttcagtaatcgagaaaatggaagccttacagcgaaagtatgggggtgctctggtacgaaaccctttatcaagaaattctacccacgagatgtattgggtttctaatgcctcaggaaacatagtatcgtcagtaaatatgattagtagaatgctaataaatcgcttcaccatgagacataaaaaggcaacatacgagccagatgttgatttgggatcaggcaccagaaatatagggatagaaagcgaaactcctaacctagatataatcgggaaacgtatagaaaagataaaacaggaacacgagacttcttggcactacgatcaagaccacccttataagacgtgggcttaccatgggtcatatgaaaccaagcaaacaggaagtgcttcgtcaatggtaaatggcgtggtgagattacttacgaaaccgtgggatgttatccctatggtcacacagatggctatgacagacacaacaccatttggtcaacagcgcgtcttcaaagaaaaggtcgacaccagaactcaagaaccaaaagagggtaccaagaaattaatgaaaataacggctgaatggttatggaaagaacttgggaagaagaaaactccgagaatgtgtacgcgtgaagaatttactagaaaggtgcgctccaatgcggcgctaggtgcaatcttcacagatgaaaataaatggaaatcagcaagagaagcggttgaagattcgggattctgggaattagtagacaaagaacgtaatctacatttagagggaaaatgtgagacatgcgtttacaacatgatggggaagcgcgagaagaaactgggcgaatttggaaaagcaaaaggatccagagccatatggtacatgtggttaggggcgcgatttttagaatttgaggcactaggatttttgaatgaagaccattggttcagtagggaaaattcgcttagcggcgtagaaggtgaaggactccacaaactcggatacattctgcgtgacgttagcaagaaagaaggaggtgcgatgtatgcagatgatactgccggctgggacacaaggataacattggaagatctcaaaaatgaagaaatggtgacgaatcatatggagggagagcataagaaactagcagaagccatatttaaacttacataccaaaacaaagttgtgcgagtacaacggccaacacctaggggaacggttatggacataatcagtcgtcgggatcaaagaggatcaggacaggttgtaacttacggtctcaacacattcactaatatggaagcacagcttatacgacaaatggaaggggaaggagtatttaaatctattcagcaattaacagtcaaagaggaaatagcagtgaaaaattggctcatcagagtaggacgggaacgactgtcgagaatggctatatccggggacgattgtgttgtgaagccactagacgaccgctttgcctctgcccttactgcactgaatgacatgggtaaggtccgcaaagacatccaacaatgggagcccagcagagggtggaatgactggacccaggtacccttctgctcgcaccattttcatgaattgataatgaaagatgggcgtgtattagtagtaccatgtcgcaatcaagatgaattaatcgggcgtgcaagaatttctcagggtgctggatggtctttaagagaaacagcatgtctgggtaaatcatatgctcaaatgtggtcactaatgtactttcaccgtcgcgatctgcggttggcggctaatgcaatttgtagtgccgtacctagtcactggatacctacttcgcgaacaacctggtccatacatgcgactcacgaatggatgacgactgaagacatgttaacagtctggaaccgcgtatggatccaagaaaacccatggatggaagataaaactcccgtagaatcctgggaagaaattccgtaccttggcaaaagagaagatcaatggtgcggaagtctaattggactcacaagtagagcaacatgggccaagaatatacaaactgctattaatcaagtaagatcactaattgggaatgaagagtacacagattatatgcctagcatgaaacgtttccgaatagaagaagaagaagctggtgtattatggtaa

SEQ ID NO: 22259 - RNA, 9876 nt, synthetic construct
  misc_feature 1..9876: note = derived and/or modified CDS sequence (opt6) from DENV-2__KM279595__SS-prME
  source 1..9876: mol_type = other RNA
actgcggggatcattattatgatgataccgacagtgatggcatttcatctaacaacgagaaatggagaaccgcatatgatagtgtcccgtcaagaaaaagggaaaagtttgctatttaaaacggaaaatggtgtgaatatgtgcacacttatggcgatggatctgggagaactatgcgaagatacaatcacatacaattgtcctttattacgacaaaatgaacctgaagatattgattgctggtgtaatagtacaagtacatgggtaacatatggcacttgtactgcaacaggcgaacatagaagagagaaaaggtccgttgcgcttgtcccacatgtaggaatgggtctggaaactaggacagaaacatggatgtcatcagaaggggcatggaaacacgctcagagaatagaaacctggatattaagacacccaggtttcacaattatggcagcaatattggcttatactattggcaccacctacttccaaagagtccttatttttattttactgacagcagtaacgccatcaatggcaatgagatgtattggaatatccaatcgtgattttgtagaaggagtaagtgggggttcttgggtcgatattgtactggaacacggaagttgcgtaactacaatggcgaaaaacaaacctactttagatttcgaacttatcaaaacagaagcgaaacatttagcaacactacgaaaatattgtgtcgaagctaaattaacaaacacgacaaccgcaagtagatgccctacacaaggagaaccttcacttaatgaagaacaagataaaagatttgtatgtaaacattcaatggtcgaccgtggatggggtaatggttgcggacttttcggtaaaggaggcattgtgacatgcgcgatgttcacatgtaaaaagaatatggaaggaaaagtcgtccaaccagagaatttggagtatactatcgttattactccgcactcaggtgaagaaaacgcagtaggaaacgacactgggaaacatgggaaagaaattaaagtaacaccacaatcgtcaataacagaggcggagcttacaggatacggaacggtaactatggagtgttctcctaggacaggtttagactttaatgaaatggtgttgctacagatggaaaataaggcttggttggtacacagacagtggtttttagatttaccattaccatggttgccaggcgcagatactcagggatcgaattggatacaaaaagaaacattggtaacctttaaaaatcctcatgcaaagaaacaagatgtagtagtattgggcagtcaagaaggtgcaatgcatacagcattaacaggcgcgacagagatccaaatgtcatctgggaatttacttttcacgggacacttgaaatgccgactgcgaatggataaattacaacttaaaggaatgtcttattcgatgtgtacaggcaaattcaaagtagtgaaagaaatagcagaaacacaacacggaactatcgttataagagtgcaatacgaaggtgacggatcaccgtgtaaaataccattcgaaataatggacctagagaaaagacatgtgctgggcagactgattacagtaaaccccatagtcactgaaaaagacagtcctgtaaatatcgaagcggaaccaccattcggagattcgtatataataataggtgttgaaccagggcagcttaaacttagttggtttaagaaaggatcctcgattggtcagatgttcgaaacaaccatgcgtggagcaaaacgaatggcaatactaggggatacggcttgggactttggatcattgggaggagtatttacaagtataggaaaagcacttcaccaagtattcggcgcaatctatggtgccgcgttttcaggagtgagctggacgatgaaaatcctgataggagtagtaattacttggattggtatgaactcacgcagcacatcgttatcagtctctttagtcctagtgggtgtcgtaacgctgtaccttggcgtaatggtacaagccgattctgggtgtgtagtaagctggaaaaacaaagaactaaaatgtggctcgggtattttcataactgacaacgtacatacgtggacggaacaatataaatttcagcccgagagtccgtcaaaactagcttcggctatacaaaaagcacatgaagaagggatatgtggtataagatcagtcactagactagagaacctcatgtggaaacagataacaccagaacttaatcatatcctcacagaaaatgaggtcaaactaactatcatgactggggatataaaaggaatcatgcaggcaggaaagagaacactaagaccacaacccacggaactaaaatactcttggaaggcgtggggaaaagcaaaaatgttatctactgaattacataatcacacgttccttatagatggaccagaaaccgcagagtgtcctaatactaatagagcatggaactcgctagaggttgaagattacgggtttggcgtgtttacaacaaacatttggttgaaactgaaagaaagacaggatgtcttttgtgacagtaagttgatgagcgcagctataaaagacaatagagcagtacatgcagatatgggttattggattgagtcagcacttaacgacacctggaaaatagaaaaagcgtccttcatagaggttaaaagttgccattggcctaaaagccacacgctttggtcaaatggagtattggaatcagaaatgattatacccaaaaatttcgccggccccgtcagccaacataattatcgtcccgggtaccacacacaaaccgcggggccttggcacctaggtcggttagaaatggatttcgatttttgtgaaggtactactgtggtcgtaactgaagactgcggaaacagaggcccatcattgaggaccacgaccgcatccggaaaattaatcactgaatggtgctgtcgatcatgcactctacccccattgcggtatcggggagaagacggctgctggtatggaatggagatcagaccattaaaagaaaaagaggagaatttagtaaactccttagtaacggcgggacacggacagatcgataacttcagcttgggtgtattaggaatggctttattcttagaggaaatgttaagaaccagggtcggaacaaagcatgccatactcctagtcgcagtgagttttgtaacactgataacaggaaatatgtcatttagggatctaggacgagtcatggtgatggtgggggctacaatgaccgatgacatcggaatgggggttacatatctggctctcttggcagcgttcaaagttcgtcccacttttgcagctgggttactacttcgaaaactaacctcaaaagagctaatgatgacaactataggaatagttttactttcacaaagtactatccctgaatcgatactcgaattaaccgacgcattagccctggggatgatggtattaaaaatcgtcagaaatatggagaaatatcaattggcggtaacaataatggcgattttatgcgttccgaatgcagtaatcctccaaaatgcgtggaaagtttcatgcactacattggccgtagtgtctgtcagtccgctgctactaactagctcccaacaaaaagcagattggattccgctagctctgactataaagggattaaacccaacagctattttcctcacaacattgagtaggacatcaaagaagcgatcttggcccctaaatgaagctattatggcagtaggcatggtgtccatattggcatctagcctacttaaaaatgacattcctatgacgggccccctcgttgctggaggtttgttaactgtatgttatgttcttacaggtcgttcggcagatttagaattagaaagagctgcagatgtgagatgggaagaacaagcagagatctcaggaagttcgccgatattatcaatcacaatctccgaggatggtagtatgtcaattaaaaacgaggaagaagaacaaaccttaacgatattgatcaggacaggcctgttagtaattagtggtctttttcccgtcagcattccaataacggccgctgcatggtatttatgggaagttaagaaacaaagagctggcgtactgtgggatgtgcctagtcccccaccagtaggaaaagcagagctagaagacggagcatatcgaattaaacaaaaagggatactaggttactcgcagataggtgctggagtctacaaggaaggcactttccacacgatgtggcatgtcacaagaggagcagtactaatgcataaagggaagcggatagaacctagctgggcagatgttaagaaagatctaatcagctatggtgggggttggaagctcgagggagaatggaaagaaggcgaagaagtacaggtgctagcactagaacctggtaaaaatccacgtgcggtacaaacgaaacctggattgtttaaaacaaataccgggactatcggggccgtgagcctagactttagtccaggaaccagtggatccccgatagttgacaagaaaggaaaagtagttggcttgtatggaaatggtgtagttacaagaagcgggacgtacgtctctgcgatagcccaaacagaaaagaacattgaagacaatccggaaatagaagatgatatattccgtaagaaacgattaacgataatggatctacatcctggagccggaaaaacaaaaagatatttaccagcaattgtaagagaagctataaaacgggggcttaggacattaatacttgcccctacacgtgtagtcgctgctgaaatggaggaagcacttagaggattacctatcaggtatcaaaccccagctatcagagcagaacacactggtagagaaattgttgaccttatgtgccatgccacattcacaatgcgattgctgtcaccaataagggttcctaattacaatttaataattatggatgaggctcactttacagatccagcttcaatagctgctcgtggatacattagtacacgagttgaaatgggtgaggctgcaggaatttttatgacagcaacgcctcccggaagtcgtgatccatttccgcagagcaatgcacctataatggatgaggagaaagaaatcccagagcgatcgtggaactccggtcacgaatgggtaacggactttaaaggtaaaacggtctggtttgtaccatccataaaggcaggtaatgacatagctgcatgtttacgtaaaaatggaaagaaagtaatacagctatcgagaaaaacttttgatagcgaatacataaaaacaagaacaaatgactgggactttgtagttaccacagatattagtgaaatgggtgcaaatttcaaagcagagagagtaatagatccaaggcgatgcatgaagccagtcatacttacggatggagaggagcgggttatattagctggcccgatgcccgttactcattcctccgcggcacaaaggcgaggacgagtaggtcgaaatcccaaaaatgaaaatgaccagtatatatacatgggagaacctctggaaaacgatgaagattgcgcacattggaaagaagcaaaaatgttactagataatattaacacaccagagggaattattccaagtatgttcgaaccagaaagagaaaaagtggatgctattgatggcgaatatagattgcgcggagaagctagaaagaccttcgttgatctaatgagaaggggagatttaccagtgtggttagcatatagggtagctgcagaaggtattaattatgcagacaggcggtggtgtttcgatggggtaaagaacaaccagattcttgaagaaaatgtggaagttgagatatggactaaagagggggaaaggaagaaattgaagccaagatggctggatgcaaggatatattcagaccctctagcgttaaaagagttcaaagaatttgcagccggtagaaagtccctaactttaaatttgatcactgaaatgggaagattaccaacgttcatgacgcaaaaagccaaaaatgctttggacaatctggctgtattacacacagcagaagccggtggtcgcgcctacaatcacgcacttagtgagctgccggagaccttagaaacactactattacttacactactggcgactgttactggtgggatattcttattcctcatgtcaggtaaaggcataggaaagatgactttaggaatgtgttgtattataactgctagtatcttactatggtacgcacaaatacaaccgcattggattgctgcttcaataattttagagttctttttaatagtgttattgatccctgagccagaaaaacagaggacaccgcaagacaatcaactaacatatgtggtaatcgccatcctaacagtagttgctgctacgatggcaaatgaaatgggatttttagagaaaacgaagaaagactttggcctcgggtctattactacacaacaacccgaatcaaacatattggatattgacctaagaccagcatctgcctggacgttgtatgctgtagcaacgacatttataacacctatgttaagacatagcatagaaaatagctcggtaaacgtgtcattaacagcaatagccaaccaagcaacagtattaatggggcttggaaaaggttggcccctaagtaagatggacataggagtgccattgctcgccattgggtgctactcacaggtgaatcccattactttgacagcagcactattattgttagtcgcccactatgccataatcgggccagggctccaagcaaaagccacaagagaagcacaaaaacgagctgcggctggtatcatgaaaaacccaacagtagacggtatgacggtgattgatttagatccaataccatacgacccaaaatttgagaaacagcttggccaagttatgttattggtattatgtgtaacccaagttcttatgatgagaaccacgtgggcattatgtgaagcactgacattggcgacaggaccgatcagtacgttgtgggaaggtaacccaggtcgtttctggaatacaacaatagcagtaagtatggcgaatatctttcgtggaagctatctagcgggcgcgggtttgctgttttcaataatgaagaacacagctaacactaggaggggaacaggtaataccggtgaaacactaggggagaaatggaaaaaccgacttaacgcgctcggaaaaagtgaatttcagatatataaaaagagtgggatccaagaggtcgataggactctagcaaaagaaggcataaagagaggtgaaactgatcatcatgcagtatcacgtgggagcgcgaaacttcgatggttcgtcgaaagaaatctagtgactccagagggaaaagtggtagatctaggctgtggacgaggtggatggtcatattattgcggtggcctcaaaaatgttaaagaggtaaaaggtctcactaaagggggacccggacatgaagaacctataccaatgtcaacttacggatggaacctggttaggcttcaatcgggagtggatgtgttctttaccccacctgaaaagtgtgatacgttactttgtgatataggtgagagttcaccaaaccctacggtagaagcaggtagaacattacgcgtactaaatcttgttgaaaattggttgaataataatacccaattctgcattaaagtcctaaatccatatatgccaagcgtaatagagaaaatggaagcgcttcagaggaaatacgggggtgctcttgtacgaaatccactatccagaaattcgacgcacgaaatgtactgggtgtcaaacgcctccggcaatatcgttagcagtgtaaatatgataagtagaatgctgattaatagattcaccatgcgccacaagaaggcaacctacgaaccagatgtggacctaggatccggtactcggaacatcggcattgaaagtgaaacccctaacctagatattatagggaaacgtatagagaaaattaaacaagagcatgaaacctcctggcattatgatcaagatcacccttataaaacttgggcataccatgggtcatacgaaacaaaacagacaggctcagcatctagtatggttaatggtgttgtgcgacttcttaccaagccttgggacgtaataccaatggtaacacaaatggccatgacagacacgacaccttttggacaacaaagggtattcaaggaaaaagtagacactagaacccaagagcctaaagagggtactaagaagctaatgaaaattaccgccgaatggctgtggaaggaactaggtaagaagaaaactccaaggatgtgcactagggaagaatttacgagaaaagttcgatctaatgcagcgctaggcgcaatattcactgacgaaaacaagtggaagagtgctcgtgaggccgtggaggactccggattctgggaattagttgataaggaacggaatttgcatttagagggaaaatgtgaaacgtgcgtatataatatgatgggaaaaagagagaagaaattaggcgagtttggaaaagcaaaaggtagtagagcaatatggtacatgtggttaggagcacgtttcctagagttcgaagcattgggttttctcaacgaggaccattggttttccagggaaaatagtctgtcgggggttgagggagaagggttacataaattgggctacatccttcgggacgtcagcaagaaagaaggcggagcaatgtatgccgatgatacggctggctgggatactagaattaccctagaagatctcaaaaatgaagaaatggtaacgaatcacatggagggggaacataagaaattagcagaggcgatctttaaactgacgtatcaaaacaaagttgttagagtacagcgacctacacctagaggaactgtcatggatattataagccgaagagatcaacgggggagcggacaagtagttacctacgggcttaacacgtttacgaacatggaagctcaattgatcagacaaatggaaggagaaggtgtattcaaaagtatacaacaactaactgtaaaggaagaaatagcggttaaggattggctcataagggtcggaagagaacgactatcaagaatggccatttcgggagatgattgcgtagttaagccattagacgacagattcgctagtgcactaaccgcattgaatgacatgggaaaagttcgaaaggacatacagcaatgggaacctagcagaggttggaatgattggactcaagttccgttttgctcacatcactttcacgaattaataatgaaagacgggagagtacttgtggttccatgtcggaatcaagacgaactgataggacgagccaggatatctcaaggagctggatggtctctgagagaaacggcatgtctagggaaatcgtatgctcagatgtggagtctcatgtattttcatcgaagagatttacgacttgcggctaacgctatttgctccgcagtgccaagccattggattccaacaagtaggacgacctggtcaatacacgccacgcacgaatggatgacgaccgaagacatgctcacagtgtggaatagggtctggatccaagaaaatccatggatggaagacaagactccagtggaatcatgggaggaaataccatatttaggcaaacgagaagaccaatggtgcggctctttaatcggtttaaccagtcgagccacgtgggctaagaacattcaaacagctatcaaccaagttagatctttaatcggaaatgaagaatatacagattacatgccctctatgaagaggttccgccgagaagaagaggaggctggtgtgctgtggtaa

SEQ ID NO: 22260 - RNA, 9876 nt, synthetic construct
  misc_feature 1..9876: note = derived and/or modified CDS sequence (opt6) from DENV-2__KM279566__SS-prME
  source 1..9876: mol_type = other RNA
acagcaggtataatcataatgatgatacccactgtgatggcgtttcatttgacaacacggaatggagaaccccacatgatagtatccagacaggaaaaaggaaaaagtttactatttaaaaccgagaatggagttaatatgtgcacattaatggctatggacttaggtgaactttgtgaagatacaattacatacaactgccccctccttcgacaaaacgaaccagaagatattgattgctggtgcaactcaaccagtacatgggtaacgtatggaacatgcacagcaactggagaacatagacgagaaaaacgatcagttgcattagtaccacatgtaggaatgggtctagaaacacgcacggaaacctggatgtcatcagaaggagcttggaaacatgcccaaaggatcgaaacctggatactacgacatccaggctttactatcatggcggcaattctagcatatacaatagggaccacttactttcaacgcgtactgatctttattctacttacagcagtcacacctagcatggcaatgagatgtattggtatcagtaatcgagattttgtagaaggagttagcggtggctcctgggtagacatcgtattagaacatggatcgtgtgtgacaaccatggctaaaaacaaaccaacactagattttgaactcattaaaacagaagctaaacatctagccacattaagaaaatattgcgtagaggccaaacttactaacacaaccaccgcctcgcgatgccctacacaaggagaaccatcgttaaatgaagaacaagacaaaaggtttgtttgtaaacattctatggtagatcgtggatggggaaatggttgcggtctttttggaaaaggcggaattgtaacatgcgcaatgtttacatgcaagaaaaacatggaaggaaaagtagtacaacctgaaaatctggaatatacaatcgttataaccccacactcaggagaagagaacgccgtaggtaatgataccggtaagcatggtaaggagataaaagtcacgccccagtcctccatcacagaagcggaactcaccggatatggaacagttacgatggaatgcagcccaaggacaggcctggattttaacgagatggttcttttacagatggaaaataaggcctggttagtgcatcgtcaatggtttcttgacttacctctcccctggcttcctggggccgacacccaaggatctaattggatccaaaaggagaccctagtaacgttcaagaatcctcatgctaagaaacaagatgttgtagtactaggaagtcaagaaggagctatgcatacggccctaactggagcaacggagatacaaatgtcaagtggaaatttactattcactggccatcttaagtgtcgattgagaatggataaacttcaattaaagggcatgtcatactctatgtgcacaggaaaatttaaagtggtcaaagaaatcgctgaaacacaacatggcaccattgtaattcgtgtccagtacgaaggagacggatccccttgtaagataccattcgagatcatggatctagagaagaggcacgttcttggaagacttatcactgttaatccaatagttacggagaaagattcacctgtaaatattgaagcagaaccgccattcggagattcatatataatcataggagttgaaccaggccagctgaaattatcttggttcaagaaaggatcatccatcggacagatgtttgaaacaactatgcgaggcgctaaaagaatggccattttgggtgataccgcctgggatttcggtagcctaggaggcgtatttacaagtatcggcaaggctttacaccaagtgttcggagctatctacggtgctgcctttagcggagtaagttggaccatgaaaatactaatcggtgtggttataacatggatcggtatgaactcaaggtcaacttctctatctgtttctctagtcctagtaggtgtggtaacactttatctgggtgtaatggtccaagctgactcaggctgcgttgtatcttggaaaaataaagaactgaaatgtggatcaggcattttcataacagataacgtacatacatggacggagcagtataagtttcagcctgaatcccctagtaaacttgcatccgcgatacaaaaggctcatgaggaaggaatatgtggaatacgctcagtaacaagactggaaaatctaatgtggaaacagatcacacctgagctgaatcacatattaacagagaatgaagttaagctaaccatcatgaccggagatattaaaggaataatgcaagctggtaaacgaacactacgcccccaaccaacagaactaaaatacagctggaaggcatggggaaaagcaaaaatgttatcgactgaattacataaccacactttcctaatagatggcccagagacagctgagtgtccgaatactaatagagcatggaactcgttagaggttgaggactacggtttcggggtatttacgacaaatatttggttaaaacttaaagagcgacaagacgtgttctgcgactcaaaactaatgagcgcagctataaaagataatcgggctgttcacgcagacatgggttactggatagaatcagcattaaacgatacttggaaaatagagaaggcttcgttcatcgaggtaaaatcatgtcattggcccaagagtcatacactatggagtaatggtgtactagaatcggagatgattatcccgaaaaattttgctggacctgtatcccaacataactaccgaccaggctaccatacacagacagccgggccttggcacttagggagattagagatggactttgacttctgcgagggtaccactgttgttgtaacagaagattgcggcaatcgtggcccatcactccgcacgaccacagcgagtggtaaattaatcaccgagtggtgttgccgtagctgtactctacccccgctacgttatagaggcgaagacggttgctggtatggaatggaaattagaccactgaaagaaaaagaagagaaccttgtcaattctttagtgacagcaggtcatggacaaatcgacaactttagtcttggtgtgcttggcatggcattgtttttagaggaaatgttacgaacaagggttggaacgaaacacgctatattattagtagctgttagtttcgtaacattgattacaggtaatatgtcatttagggatttagggagagtgatggtaatggttggcgctaccatgacggatgatataggcatgggcgtgacatatttagcgctactagctgcgttcaaggtaagaccaacattcgcagcaggtctattgctgaggaaattaaccagcaaagaactaatgatgactacaattggtattgtgttactctctcaatctaccataccggagtcaatactggaactgacagatgcgttagcactaggaatgatggttctcaaaatagttcgaaatatggaaaaatatcaactagcagttacaattatggcaattctgtgcgtaccaaatgctgtaatactgcaaaacgcgtggaaagtttcatgcaccactttggcagtcgtcagcgtaagcccactgctgctaacgagcagccagcaaaaagcagactggattcctcttgcactaaccattaaaggactgaatccaacggcaatatttctcactactttaagtcgaacaagcaaaaagcgttcatggccgttaaatgaagcaataatggcagttggtatggtatccatattagcatctagtctattgaaaaacgatatccctatgactggtcctctggtggccggaggattattaaccgtttgctatgttttaactgggcgatccgccgatttggaattggagcgcgctgcggacgtccgttgggaagaacaagcagagatctccggctcctcaccgattctttcaataacgatttcagaagatggctccatgtctatcaaaaatgaagaagaggaacaaaccctgaccattttaattaggacaggtttgttagtcataagtggcctctttcctgtaagcatccccataacagcggcggcatggtacctctgggaagtcaagaaacaacgagcaggggtactatgggatgtgccatcacctcctcctgtgggaaaagcggaattggaggatggagcatatcggattaagcaaaagggcatactaggatactcccaaataggagcaggcgtctataaagaaggtaccttccacactatgtggcacgtaactcgtggtgcggtgttaatgcacaaagggaaaagaattgagccttcatgggctgacgtcaagaaagacctaatatcgtatggtggcggttggaaattagaaggggaatggaaagaaggtgaagaggttcaggtcctcgccctagaaccaggaaagaatccaagagcagtacagacgaagccaggcttattcaagactaacacgggtactataggagcagtgagccttgatttctccccaggaacttcaggatctccaattgtagataaaaagggtaaggtagtgggcttatacggtaatggagtggtaacacggtcaggtacatatgtatctgcaatcgcccagaccgagaagtccattgaagacaacccagaaattgaggatgacattttcagaaagaaacgattgaccattatggatttacaccctggagctgggaaaacaaaaagatatcttcccgccatagtacgggaagcgatcaaacgcggacttagaacactaatcctagctccaacaagagtagtagctgcggaaatggaagaagccctaagagggttgcccataagataccaaacaccagctataagggcggaacatacaggacgagaaattgtggatcttatgtgccatgctacattcacgatgagactattatctccaataagagtccctaattataatttaataatcatggacgaagcccactttactgatccagcatcgatagcagcacgaggatatataagtacacgagttgaaatgggagaggcggcaggcatattcatgaccgcaacacctcccggatcccgggatccatttccccaatctaatgccccgataatggatgaagaaaaagaaatacctgagagaagctggaatagtgggcacgaatgggtcacggactttaaagggaaaacagtttggttcgtgccatccattaaagcaggtaacgatattgccgcatgcttacgtaaaaatggtaagaaagtaattcaactctcaagaaaaacttttgacagcgagtatataaagactagaacaaatgactgggatttcgtggtaactacagatataagtgaaatgggtgcgaactttaaagcagaacgtgtaatcgatcctcgacgatgtatgaaaccagtcattctaacagatggcgaggagagagtgatacttgcaggaccaatgcctgtcacccacagttccgcagcacagcgaagaggtagagttggccgcaaccctaaaaatgagaacgatcaatatatttacatgggagaaccgttggaaaatgatgaagattgcgctcactggaaagaggccaaaatgcttttagacaacataaataccccggaaggcattataccgtcgatgtttgagccagaaagagaaaaggtagatgcgatcgatggagaatatagattgagaggtgaggcaagaaaaacattcgtagatttaatgcgaagaggtgacctcccagtctggctagcctatcgagtagcggcagaaggaattaactacgcggaccgaagatggtgctttgatggcgtgaagaacaaccaaattctggaagaaaacgtcgaagttgagatttggacaaaagaaggggaaaggaaaaagttgaaaccacgatggttagatgcacgaatttattctgaccctttagctctcaaggaatttaaagaatttgcagccgggcgaaaaagtctaacactaaacctaatcaccgaaatgggaagactaccaacatttatgacacagaaggccaaaaatgcgctagataatttagctgtcctacacactgcggaggctgggggaagggcatacaatcacgcactaagcgaactacctgagaccctagaaacattattacttttgacacttttagcgacagtgacagggggaatttttctgtttctaatgtcaggaaaagggattggaaaaatgacgcttggaatgtgttgtataattaccgcttctatattgttatggtatgcacaaattcaaccacattggatagctgcaagtataattctcgagttctttttaatagttctacttatacccgaaccggaaaagcaaagaacaccccaagacaatcaattgacctatgtagttattgcaattttgacggtcgtggctgccacaatggcaaatgaaatgggttttcttgagaaaactaagaaagatttcggacttgggtccataacaacgcaacaaccagaatcaaatattttagacatcgatcttcgtcccgctagtgcatggacgttatatgctgttgctacgactttcataacgccgatgctccgccattcaattgaaaatagcagtgtcaacgtttcgcttacagcaatcgccaaccaagccaccgtattaatgggtctcggaaaaggatggcctcttagcaagatggacatcggagttccccttttagcaataggatgctacagccaagtgaacccgataacgttgacagcggctttactactcttggtagctcactacgctatcataggccctggtctgcaagctaaagcaacaagagaagcgcaaaaacgagcagcggcaggaattatgaaaaatccaacggtggatggtatgactgtaattgacttagatcctattccttatgatccaaaatttgaaaaacaactaggacaggtaatgcttcttgtactttgtgtaacgcaagttctcatgatgagaacaacgtgggccttatgtgaagcactcacactagccactggaccgatctctacactctgggaagggaatcctggtagattttggaacactaccattgctgtgtcaatggcaaatatatttcgaggtagttatcttgccggagctgggcttcttttctctatcatgaagaatacggctaatacacgtaggggaacaggaaatacaggagaaacactcggtgaaaagtggaaaaatagacttaatgcactaggaaaatcagagttccaaatctataagaagagtggtatccaagaggttgaccgcaccttagcaaaagagggaataaaacgaggtgaaacagatcatcatgcagtatcaagaggttcggcaaaattacgatggtttgttgaacggaatttagtaacacccgaaggcaaagtagtggacttaggttgtggaagaggaggatggtcttactactgtggcggtctgaaaaacgttaaggaagttaaaggattaactaaaggaggccctgggcatgaagaaccaataccaatgtctacctacggttggaatttggtccgattacaatcaggtgtagacgtattctttacgccccctgaaaaatgcgatacactcctttgtgatatcggagaaagtagcccaaatccaacagtagaggcggggcgcacattaagagttttaaatctagtagagaactggttaaacaataatacacaattctgcataaaagtacttaacccgtacatgccaagtgtaatagaaaagatggaagcattacaaaggaagtatggaggagccttggtacgaaatccactgagtagaaattctacacacgaaatgtattgggtatctaacgctagcggaaatatagtctcgagtgtaaatatgatatctcgaatgctaattaacaggtttaccatgagacacaaaaaggcgacttatgaacctgacgtagatttgggttctggaactagaaacatcgggattgaaagtgaaacacctaacctagatataataggcaaaaggatagagaaaataaaacaggaacatgagacaagttggcattatgaccaagatcacccgtacaaaacctgggcctaccacggctcatatgagacaaaacaaaccggatcagcatcgtcaatggtgaatggcgttgtacgtttattaaccaaaccatgggatgtaataccaatggtaactcagatggctatgacagatactacacctttcggtcagcagcgggtgttcaaagaaaaagttgacactcgaactcaagaaccgaaggaaggaacaaagaaactaatgaaaataacagcagaatggctctggaaagaactaggtaaaaagaaaacacctagaatgtgcactcgagaggagttcacaagaaaagttcgatctaatgcagcattaggtgctatatttacagatgagaacaagtggaaatcagcaagggaagctgttgaagattctggcttttgggaattagtagacaaggagcgaaatcttcatctagaagggaagtgtgagacttgcgtatataacatgatgggaaaacgtgagaagaaattaggcgaatttggaaaggctaagggatcccgagcaatctggtacatgtggctcggagctaggtttcttgaatttgaagccttaggatttttaaacgaagatcattggttctcaagagagaatagtttgagtggggttgagggagaaggattacataaacttgggtatattctgagggatgtctctaaaaaggagggcggcgcaatgtacgcggacgacactgcaggatgggatacaagaattacactggaagacctaaagaatgaggaaatggttactaatcacatggaaggagaacacaagaaacttgcagaagccatattcaaactaacataccaaaacaaagtcgtccgcgtccaaagaccaacaccacgggggacagtgatggatatcatatcacgccgtgaccaacgtggatcgggccaggtggtgacttacggattgaatacatttactaacatggaggcgcaattaatacgtcagatggaaggagaaggagttttcaagtctatacaacaattaacagtaaaagaagagatagccgttaaaaattggcttataagagttggtagagagcgattgtctagaatggctatatcaggcgatgactgtgttgtaaaaccattagatgatcgtttcgcatcggccttaaccgccctgaacgatatgggaaaggtaagaaaagatatacaacagtgggaaccatcacgcggatggaatgattggacacaagtaccgttttgctctcatcattttcatgaattaataatgaaagatggtcgggtgctcgtagtaccatgcagaaaccaggatgaactaatcggacgagcacgaatttcacaaggtgccggctggtcattgcgtgaaaccgcatgtctcggtaaaagttatgctcagatgtggtcactaatgtattttcatagacgagatctccgtttggctgctaacgcgatatgctcagctgtacccagccattggataccaaccagtcgaactacttggtctattcacgctactcatgaatggatgacaaccgaggacatgttaactgtctggaacagggtctggatccaagaaaatccatggatggaggacaagacaccggttgaatcctgggaagagattccatatttagggaagcgtgaggaccaatggtgtgggtcactgatagggctaacttcaagagcaacatgggcgaaaaatatacaaactgcgatcaatcaggtaagatcactcattggcaatgaggagtacactgactatatgcctagcatgaaacgttttagaagagaagaagaggaagctggagtactatggtaa

SEQ ID NO: 22261 - RNA, 9876 nt, synthetic construct
  misc_feature 1..9876: note = derived and/or modified CDS sequence (opt6) from DENV-2__KM279574__SS-prME
  source 1..9876: mol_type = other RNA
accgcaggaatcataatcatgatgataccaaccgtgatggcattccatctcaccactagaaatggggaacctcatatgatagtttccagacaagaaaaaggtaaaagtttattgtttaaaactgaaaatggggtcaatatgtgtacccttatggcaatggacctgggggaactatgtgaagacactataacctacaattgtcccctgttaagacagaacgaacctgaagatatagactgttggtgtaattcaacttctacttgggtcacatacggaacttgcaccgcgacaggagaacacagacgtgagaaacgaagtgttgcgttagttccgcatgttggaatgggactagaaacacgaacagaaacgtggatgtcttctgaaggtgcatggaaacatgcacaaaggatagaaacatggattttgaggcatccgggattcacgataatggcagcgatactagcttatacaataggtaccacgtatttccaacgtgtacttatttttattttattaacagcagttaccccttccatggcaatgagatgcattgggatatctaacagagacttcgtagaaggagtttctggaggttcatgggtagatattgtccttgaacacggctcatgtgttacgacaatggcgaaaaacaaaccaactctagacttcgaactaataaaaacagaagccaaacatctggctacacttaggaaatattgcgtcgaagcgaaactaacaaatactacaaccgcttcaagatgtcctacacagggggaaccttctctcaacgaagaacaggataaaagatttgtatgcaaacactcgatggtagatagaggatggggaaacggatgtggactatttggaaaagggggtatcgtcacttgtgcaatgtttacatgcaagaaaaacatggagggtaaagtagttcaacctgaaaatctagaatatacaattgttattacaccacactcaggtgaagaaaatgctgttggtaacgacacgggtaagcatggcaaggaaatcaaagtaacaccccaatcgtcaatcacagaagctgaattaacgggttatggaaccgtcacaatggaatgcagtcctcggaccggcctagattttaacgaaatggtacttctacagatggaaaataaggcatggttagtgcataggcagtggttcttagatctgccgttaccttggctcccgggtgctgatacgcagggatcaaactggatacagaaagaaacacttgtgactttcaaaaatcctcatgcaaagaaacaagatgtagtagttttaggatctcaagaaggagccatgcatactgcacttacgggtgcgacagaaatccagatgtcgtcaggtaatttgctatttacaggacacctgaagtgcagattacgaatggataagctacaacttaaaggtatgtcgtatagtatgtgtacaggaaagttcaaagtggtaaaagaaatagcagaaacacaacacgggacgatagttatacgcgtacaatatgagggagatgggtcaccttgcaaaatcccgtttgaaatcatggatctagagaaaaggcacgtattggggcgactaataacagtaaatccaatagtaactgaaaaggacagcccagtaaatatcgaagcagaaccaccgtttggagattcgtatattattattggagtagagccaggtcaattgaaattgtcatggtttaagaaaggatcatccatcggccagatgtttgaaactacgatgagaggggcaaaaagaatggccatactgggagatacagcgtgggactttggcagtttgggcggagtctttacatcaataggtaaggcattacaccaggtgttcggagcaatatatggtgcggcattcagtggggtcagctggactatgaagattttaattggtgttgtaataacttggattggcatgaactctagatcaacatcattgtctgtgagcttagtattagtgggtgttgtaactctatatttaggtgtaatggtacaagcagacagcggctgcgtcgtatcatggaaaaataaggaactcaaatgtggttcaggaatttttataacagataatgtccacacatggacagaacaatacaaatttcaaccagaatctccgtctaaattggcaagtgctatacaaaaagcacatgaagaagggatttgtggaatcagatccgttaccagactagaaaacttaatgtggaagcaaattacgcccgaactaaaccatattctaacggaaaacgaagtaaagctgactataatgactggagatataaaaggaataatgcaggcaggaaaaagaacattaagaccacaacccacagagctaaaatattcgtggaaggcatggggtaaagctaagatgctttccacggaactacataaccacacattcttaatagatgggccagaaacagctgaatgccctaacacaaaccgagcatggaactcgcttgaagttgaagactacggttttggagtatttacgacaaatatatggttaaaactcaaagaaaggcaggatgtattctgcgactcaaaattaatgtcagccgcgatcaaagataatagagctgtccatgccgatatgggatactggatagagagcgcactaaatgacacgtggaaaattgaaaaagctagctttatagaagttaaatcttgtcattggccaaaaagtcacacactgtggtccaatggcgttttggagtcagagatgataattccgaaaaacttcgcaggccccgtatcacagcataattatagacccggatatcatacgcaaacagcaggtccttggcacttaggcagacttgaaatggattttgatttctgcgaagggactaccgtcgtagtgactgaagactgcggaaataggggccccagcttgcgaaccacaactgcatctggaaaattaataacagaatggtgttgccgttcttgtactttaccgccacttcgatatagaggcgaggacggctgttggtatgggatggaaatacgcccgttaaaagagaaagaggagaatttagtaaattcacttgtaacggccggacatggacaaattgacaacttttcgctgggcgttcttggtatggctttattcttggaagaaatgttaagaactcgcgtcgggaccaaacacgcaatactcctcgtagcggtgtcatttgtcacattaataacggggaatatgtcatttagagatctaggaagagtaatggtaatggtgggtgcgacgatgactgacgatataggtatgggagtaacttacttagcattactagcagctttcaagataagacctacctttgcagcgggattgcttttaagaaaacttacaagtaaagagttaatgatgacaactataggaattgttttgttgagccaaagcaccataccggagtcaatcttagaactaacggatgctctagcactcgggatgatggtactaaaaattgtccgaaatatggaaaaataccagttagctgtaacgataatggcaattctctgtgtcccaaatgcagtaatattacaaaacgcgtggaaagtatcgtgtactacactagccgttgtcagtgtatcacctcttctgcttacaagttcacaacaaaaagctgattggattcctctcgcattaactataaaaggtttgaatccgacagccatctttttaacgacactcagccgaacaagtaagaaacgatcatggccactgaatgaagcaattatggcagttggtatggtttctatccttgcatcgtcgctcttgaaaaatgatattccgatgacaggcccactcgtagcgggaggcttattaacagtatgttatgtgctaaccggaaggtcagcagacctcgaattagagagggcagcagacgtaaggtgggaagaacaagcagaaataagtgggtcatccccgatactatccataactatttcagaggacggaagcatgtccattaaaaacgaggaagaggaacaaacactaaccatattaattaggacgggcttgttagttataagtggtctctttcccgtgagtatccccataactgccgcagcgtggtacttatgggaagtgaagaaacaaagagccggtgttttatgggacgtaccctcccctcctccagttggaaaggcggagctggaagatggagcctatagaataaaacaaaaaggcattttaggatactcgcaaataggcgcgggtgtatataaggaaggaacgttccataccatgtggcacgtaactcgaggagcagtactaatgcataagggcaaaagaatagagccatcatgggcagatgtcaagaaagatctaatatcctacggaggtggatggaaacttgaaggtgaatggaaggagggcgaagaagtacaggtccttgcactggagccaggcaaaaatcctcgagctgtacaaacaaaaccaggactattcaaaacgaatacaggaacgataggggcagtcagtctcgacttcagtcctggaacctcggggtcaccgatagtagataaaaagggtaaagtagtaggtctgtatggtaatggagtagttacacgaagcggcacatatgtgagtgcaattgcccagacagaaaagagtatcgaggataacccggaaatcgaagatgatattttccgcaaaaagcgcttaactatcatggatctccatcccggtgcaggcaaaacaaagagatatctacctgccatcgtgagagaggcaataaaacgcggcctccgaacacttatactagcacctacacgagtagtcgctgcagaaatggaggaggctttacgtggtctaccgatacgttaccaaacaccagctattcgagctgaacacacagggcgcgaaatcgtagacctgatgtgtcacgcgacattcacgatgagacttttatctcccataagggtccctaactataacctgataataatggatgaagcacattttacagatccagcgagtatagcagcgcgaggatacataagtactcgagtagagatgggagaagcggccggaatttttatgacggcgactccgccgggatcacgtgatccattccctcaatcaaacgctccaatcatggatgaagaaaaagagatacctgaacgttcatggaactctggtcacgagtgggtaacagattttaaaggaaaaacagtatggttcgttcctagtataaaggccggaaatgacattgcagcctgtttacggaaaaatgggaagaaagtcattcaactaagcagaaaaacatttgatagtgaatacataaaaacaagaacaaatgattgggatttcgttgtaacaacagatataagcgaaatgggtgctaatttcaaagcagaaagagtcatcgatccaagacgttgtatgaaacctgtaatactaactgacggcgaggaacgtgtaatcttagccggaccaatgcctgtaactcacagctctgcagcgcaaagacgtggaagagtaggtcgaaaccctaaaaatgaaaatgatcaatacatttatatgggtgagcccctggaaaacgatgaagattgcgctcactggaaagaggctaagatgttactggacaacataaatactcccgaaggaataatccccagtatgtttgagcccgagcgagaaaaggttgatgcgatagacggagagtatagactcagaggggaagctcgtaaaacatttgtcgatctcatgagacgaggcgacttgcctgtgtggctagcttaccgcgtagctgcagagggtattaactatgccgaccgacgatggtgctttgatggagttaaaaacaaccaaatcctagaggaaaacgttgaagttgagatatggaccaaagaaggagaacgtaagaaactaaaacctaggtggttagatgcaagaatctattctgacccactagcattaaaggagttcaaagagttcgcagcaggacgaaaatccttaacactgaatctcataacagaaatgggtaggctgccaacgttcatgacacaaaaagccaaaaatgcactcgacaatctagctgtacttcatacagcggaagccggaggccgtgcatacaatcacgcactttcagaactcccagagactttagaaaccctgttattacttacattattggcaactgttacaggtggtatctttctctttttaatgtctggaaaaggcatcggtaagatgacactaggaatgtgttgtataataactgcctctatcctcttatggtatgcacagattcagcctcactggatcgcagctagcataatactagagttctttttaatagtactattgatcccagagccagaaaaacagcgcacaccacaagacaaccaattaacttatgtggtaatagctatattaacagtggttgccgcaacaatggcaaatgaaatgggatttctcgagaaaaccaaaaaggatttcggtttaggtagtataacgacacaacagccagaaagtaatattttagatatagacctaagaccggcttcagcgtggacattatacgctgttgcgacgacgtttatcacaccaatgttgcggcattccattgaaaactcatcagtcaatgtgtcattaactgcaattgcaaatcaagcaacagtgttgatggggcttggtaaaggttggcctttgtcgaagatggacataggtgtgccattgttagcaattggatgctatagtcaagtaaatccgattacattgacagccgcactattgctgcttgttgcacactatgctataataggtcctggactacaagctaaggccacaagagaggcgcagaaaagagcggccgctggaattatgaagaacccaactgtcgatggtatgacggtaattgacctggatccaatcccttacgatcccaagtttgaaaaacaactcggacaagtaatgctattagtgctttgtgtgacccaggtattaatgatgaggacgacgtgggcgttgtgtgaagcactaactctagctactggaccgataagcactctatgggaaggtaacccgggacgattttggaatacaaccattgctgtttcaatggctaatatttttagaggcagctatcttgccggagcaggtttactattttccatcatgaaaaacaccgctaatacgagaagaggaactggaaatacaggagagacactgggagaaaagtggaaaaatcgactaaacgctcttggtaaatctgagttccaaatatataaaaagtccggaatacaggaagtagatcgaaccttagctaaggaaggaataaaaagaggagagactgatcaccatgcagtatcaaggggatcagcaaaactccgctggtttgtagaaagaaatcttgtaacacctgaaggcaaagtggtggatttgggatgtggtagaggcggatggagctattactgcggtggactaaagaatgtgaaagaggtcaaaggtttaactaaaggagggccaggtcatgaagaaccaataccgatgtcaacctacggatggaatctcgttaggctacagagcggggtggatgtattctttacgagcccagagaaatgtgatacattactttgcgatattggcgaaagctctccaaacccgaccgtcgaggctgggcgtactctgagggtactaaatttggttgaaaattggctcaataataatacacagttttgcattaaagtgcttaacccatatatgccgagtgtgattgagaaaatggaagcgctacagaggaaatatggcggagctttagttaggaatccgctttcgagaaattccacgcacgaaatgtattgggtatcaaatgcgtcagggaacatagtttccagcgtgaacatgatcagccgcatgcttataaacagatttacaatgagacacaagaaagcaacttatgaacccgatgtcgatctagggtcgggaacgagaaacataggtatagaatctgaaactcctaatctcgatataatagggaagcgcattgaaaagataaagcaagaacatgaaaccagttggcattacgaccaagaccatccttacaagacatgggcataccacggaagttatgagactaagcaaaccggaagtgcatcttcaatggtaaacggcgtagttaggttgcttacgaaaccctgggatgtaatccctatggtcacacagatggcaatgacagatacgacgccattcggacagcaaagggttttcaaggagaaagttgatacgcgaacgcaagaacctaaggaaggcactaagaaattaatgaagattacagcagaatggctttggaaggaactaggcaagaagaaaactccgagaatgtgcaccagagaagagttcacacggaaagtacgatctaacgctgcgctaggtgccatattcactgatgaaaataaatggaaatcagcaagagaagcagttgaggattcgggtttctgggaattggtagataaagaaagaaatcttcatttagaaggaaaatgtgaaacctgtgtctacaatatgatgggaaaacgtgagaagaaactcggggaatttggtaaagcaaaaggatcgagagccatatggtatatgtggctaggcgcaagattcttagagttcgaggctttaggattcttaaatgaagaccactggtttagccgggagaactcactctcgggagtagaaggtgaagggttgcataaattgggatatatcttgagagatgtttcgaagaaagaaggaggtgctatgtacgcagatgacacagccggctgggatacgaggattacactagaggacctcgaaaatgaggaaatggtgacgaaccacatggagggagaacataagaaattagcagaagccatatttaagttaacatatcaaaacaaagtagtgcgtgtacaaaggcctacgccacgtggcactgtaatggatataatatcccgaagggatcaacgtggctcaggacaggttgtgacctatggactaaatacttttacaaacatggaagcccaattaataagacaaatggaaggggagggtgtgttcaaatcaatacaacagttaactgtaaaagaagaaatagcagttaaaaattggttgacgagagttgggcgagaacgattatccagaatggcaatatccggagatgattgtgtagttaaaccattagatgatcggtttgcaagcgcactaacggcattaaatgatatgggtaaagtacgcaaggacattcagcagtgggaaccatcgcggggatggaacgactggacacaagttccgttctgtagtcatcactttcatgaattaataatgaaggacggtagagtgctagtagtcccgtgtagaaaccaagacgagctaattgggcgagcaaggatttctcaaggcgcaggttggagtttaagagaaactgcctgtctcggaaaaagttatgcccaaatgtggtcgttaatgtactttcatcgtagagatttaagactagcggcaaacgccatatgtagcgcagtaccaagtcactggatacccacctctcggactacctggagcattcacgcaacacatgagtggatgacgacagaggatatgctcactgtatggaaccgagtatggattcaagaaaatccatggatggaagataaaactcctgtagagtcatgggaggaaatcccatacttagggaagagggaggaccaatggtgtggttcactaataggactgacatctcgagcgacttgggccaaaaatatacaaacggcaataaatcaagtaaggagtcttattggaaatgaagaatatactgactacatgcctagtatgaaaaggtttagaagagaagaggaagaggcaggcgtgctctggtaa

SEQ ID NO: 22262 - RNA, 9876 nt, synthetic construct
  misc_feature 1..9876: note = derived and/or modified CDS sequence (opt6) from DENV-2__KM279568__SS-prME
  source 1..9876: mol_type = other RNA
actgcagggataatcataatgatgattccaactgtaatggcgttccatctcactactaggaacggtgaaccgcacatgattgtaagcagacaagaaaaaggtaaatcattactctttaaaacagaaaacggggtaaacatgtgcactctcatggctatggatttaggagaactttgtgaagatactataacttataattgccctttgttacgtcaaaatgaaccagaagatatcgactgttggtgtaattcgacatcgacatgggtgacgtatggaacctgcaccgcgacaggagaacatagacgtgaaaaacgaagtgtggcactggtacctcatgttggcatgggactagaaactcggaccgaaacatggatgagcagcgaaggcgcatggaaacatgcacagagaatcgagacttggattttgagacatcctggatttacgattatggcagcaatcctcgcatataccatcggtacgacatacttccaaagagtattgatatttatattgttgacagcagtaacaccctccatggctatgagatgtatcgggatatcaaatagagatttcgtggagggcgtatctggaggttcatgggtcgacatagtactagaacatggcagttgcgtaaccaccatggctaaaaacaaaccgacactggatttcgagttgataaaaacagaagctaaacatctagccaccttacgaaaatactgcgtagaagcaaaattgactaatacaactacagccagtagatgtcctactcaaggcgaaccgagtctgaacgaagaacaagacaaaagattcgtttgcaagcattctatggttgacagaggatggggaaacggttgtggactctttggaaaaggaggtatagttacatgtgccatgtttacgtgtaagaaaaatatggaaggtaaagtagtccaacctgaaaatttagaatataccatagttatcactccacattcgggagaggaaaacgctgtggggaacgatactggtaaacacggtaaagaaatcaaaataacccctcaatcatcgataacagaggctgaattgacagggtatggtaccgttacaatggaatgttcaccaaggaccggtttagatttcaacgagatggtgctcctacaaatggaaaataaagcgtggctggttcacagacagtggtttctcgatttgccgttgccatggttgcctggggcagatacccaaggctcaaattggattcaaaaagaaacgttggtcacatttaaaaatcctcacgctaagaaacaggatatagtggtattgggatcacaagaaggagctatgcataccgccttgaccggcgcgaccgaaatacaaatgagctccggaaacttgttatttacaggtcacttaaaatgtcggttacgaatggataaacttcaactcaaaggcatgtcctattccatgtgcactggtaaattcaaagtagtcaaagaaatagcagaaacacaacacggtacaattgtcatacgagttcagtacgagggtgacggatcaccttgcaaaattcctttcgaaataatggatcttgagaaaagacatgtattaggacgtttaataactgttaatccgatcgtcacagaaaaagattcaccagtaaacatcgaggctgagccaccattcggagattcgtatataataatcggtgtagagcctggacaattaaaactttcgtggtttaagaaaggaagttcgataggacaaatgttcgagacaacaatgaggggagcgaaacggatggccatcctaggagacacagcctgggattttggaagtttgggtggagtatttacatcaattgggaaagcactgcaccaagtatttggggccatatatggcgccgcgtttagtggagtaagctggactatgaaaatacttattggagtagttataacatggatcggaatgaacagccgtagtacaagtctatctgtatcattggttctagttggagtggtaacactatatttaggagttatggtgcaggctgatagtggctgtgtcgtatcctggaaaaataaagaactgaaatgtgggtcgggaatattcataacagacaacgtccacacatggactgaacaatataaatttcaacctgaatcgccgtccaaattagctagcgcgattcagaaagcacatgaagaagggatatgtggtataaggagtgtcactagattagaaaatctcatgtggaaacagataacgcccgagttaaaccatattcttacagagaatgaagtgaaattaacaataatgacaggagacattaaaggaataatgcaagccggaaaaagatctttacggccacaacctaccgagttaaaatactcttggaaagcatggggtaaagccaaaatgttaagcaccgaacttcataatcatacattcttgatcgatggacccgaaactgccgaatgcccaaataccaatagagcctggaactcccttgaggtagaagactacgggttcggagtctttacaactaatatctggcttaaactgaaagagaggcaggatgtattttgtgattctaagctaatgagtgccgccattaaagacaatagagcagttcacgccgatatgggttactggattgagagtgcgttaaatgacacctggaaaattgaaaaggcatcatttatcgaagtaaaatcgtgccattggcccaaatcacacactctctggtccaatggagttttagaaagtgaaatgataatacccaaaaactttgccggacccgtcagccaacacaactaccgacctggctaccacacacaaacagcagggccatggcacttgggacgtttagaaatggactttgatttctgcgaaggtacaacagtagtcgtaacggaagattgtggtaataggggcccttccctacgcactacgacagcatcaggaaaactcattactgagtggtgttgtcgatcatgtactttgcccccgttaagatacagaggtgaagatgggtgttggtatggaatggaaatacgtcccttaaaggaaaaggaagagaatttggtaaacagcctggtgacagccggacacggacaaattgacaacttcagtttaggagttcttggcatggctctattcttagaggagatgttacgcacacgcgtgggcacaaaacacgccatcttgctggtcgcggtaagtttcgtaaccctcatcacaggtaatatgtcttttcgcgatcttgggcgtgttatggtaatggtaggcgcaaccatgacagatgatataggtatgggggttacgtatttagcattactagcggcattcaaagtcaggccaacatttgcagcggggttattacttaggaaactaacctctaaggaattaatgatgaccaccatagggatagttctcttatcccaatctactattcccgaatcaatattagagctgacggacgcgcttgcgttaggtatgatggtattgaaaatcgtgcgaaatatggagaagtatcaactggctgtcacaattatggcaatttcatgtgtaccaaacgcagtaattttacaaaacgcatggaaagttagctgcacaacgttagcggttgtctctgtatctcctctcctcttgacttccagccaacaaaaagcagactggatccctttagcattaactattaagggtttgaatccaacagcaatcttcctaactacacttagtagaacaagtaagaaacggtcctggcctctaaacgaagctattatggcggtggggatggtatcaatactggcgagcagtttactaaagaatgatataccgatgaccggaccactggtcgcaggaggacttttgacagtttgttacgtcttaacgggtcgcagtgcggaccttgaactagaaagggccgctgacgtaaggtgggaggaacaggccgaaatatcagggagttcaccaattctatcgataacaataagtgaagacggatcgatgagtatcaaaaatgaggaagaagaacaaacgctaacaatattaataagaacaggtctgttagtaatatccggtctatttccagtatcgatccccattactgcagcagcttggtatttatgggaagtaaagaaacaacgtgccggggtactttgggatgttccatccccgccccctgttggtaaggcggaattagaagatggtgcttaccggatcaaacagaaaggaatcctaggctattcgcaaatcggcgcaggagtctacaaagaaggtacgttccataccatgtggcacgttacaaggggagcagtattaatgcataaaggtaaacgcatagaaccatcttgggcagatgtaaagaaagatttaattagctatgggggaggttggaaattagaaggcgaatggaaagagggtgaagaagtacaggttttagctctagaaccaggaaagaatcctagagcagttcaaaccaaacccggactattcaagactaatacaggcacaatcggtgcagtatctctcgatttctcaccgggaacaagcggaagcccgatagtcgacaagaaaggaaaagtagtaggcctgtacggtaatggagtagtcacacgatcgggtacatacgtatctgcgattgcacaaacagaaaaatcgatcgaagataacccagagatcgaagatgacatttttagaaagaaacgactgacgataatggatttgcatcctggtgcaggtaagacaaaaagatacctccctgctattgtaagggaggcaattaaacgtggactacgaacactcatccttgcaccaaccagagtagtagccgcagaaatggaagaagcactgagaggattgccaatacgatatcaaacgcccgctatccgagccgaacacacgggtagagaaatagtagaccttatgtgccatgccactttcactatgagattattgagtccgataagagttccaaactataacttgatcatcatggacgaagcccattttactgatccagcaagtatagccgcaagaggctatattagcacgcgggtagaaatgggtgaagctgctggtatattcatgacagcaacacctcccggatctcgtgacccatttcctcaatctaacgcaccaataatggatgaagaacgcgaaatacctgagcgctcttggaactctggtcatgagtgggtcactgacttcaaaggtaaaacagtatggttcgtcccctcgattaaggctggtaatgacattgctgcgtgccttcgtaaaaatggtaaaaaggtaatacagctttctagaaagacttttgattcagaatacattaaaactagaacgaacgactgggatttcgtagtgactacagacataagtgaaatgggcgcaaattttaaagcagaaagagttatagacccgagaagatgtatgaagcctgtcattctcactgatggggaagaaagagtcatactagctggcccaatgccggtaacacacagctcagctgcacagcgaagaggacgcgtgggaagaaatcctaaaaatgaaaatgaccagtatatctatatgggtgagccgcttgaaaacgacgaagactgtgcacattggaaagaagccaaaatgttattggataatatcaatactcccgaaggtataataccttccatgtttgaaccagagagagaaaaagttgacgcgatagatggagaatatcgattgagaggtgaagcaagaaaaacattcgtcgatctaatgcgcagaggggacctcccagtatggctagcctaccgagttgctgcagaaggaataaattatgccgatcgaagatggtgttttgatggcgtcaaaaacaaccaaattttggaagaaaatgtggaggtagaaatatggactaaagaaggagaaagaaagaaactcaaaccaagatggcttgacgcacgaatttattctgatcccctggcgctgaaagagttcaaggagttcgcagccggtaggaaatccttaactctcaatctcattactgaaatgggtaggctacctacgtttatgacgcaaaaggccaaaaacgcgttagataatttggcggtgctacacacagcagaagctggaggccgagcatataatcatgcactatcagaactcccagaaacattggaaactctactattgctcacacttttagctactgtaacaggagggatttttctgtttctaatgtcggggaagggtatcgggaaaatgacgttaggtatgtgctgcattattactgcgagtatcctcctctggtatgcacaaattcaaccacactggatcgccgcgtccataattctggaatttttcctcattgtgctattaataccagaacctgaaaaacaaagaacaccacaagacaatcaactaacgtatgttgtcattgctatcctcaccgtggtggcagcgacaatggcaaatgagatggggttcctcgagaaaacgaagaaagacttcggattaggctcgatcacaactcaacagccagaaagtaatatattagacatcgatcttcgccccgcaagtgcttggacgctgtatgcggtcgcgacaacattcataacccctatgctacgacatagtatagaaaacagtagtgtaaacgtctcactaacggccatagccaatcaagcaacagtcctgatgggattaggtaaaggatggccactatcaaagatggatatcggagtcccgttattagcaatcggctgttactcgcaagtcaaccctattaccttaacagctgccttactactcctagtcgcacactatgccataattggaccaggccttcaagcaaaagcaactcgagaggcacagaaaagagcagccgcagggattatgaaaaacccaaccgtcgatggcatgactgttatagatcttgacccaatcccatatgatcccaaattcgaaaaacaactaggacaagttatgttactcgtcctctgtgttacacaagtgctaatgatgcgtaccacatgggcgttatgtgaagcactgactttagcaacgggaccaatttcaacgttatgggaagggaatcctggacggttttggaataccactattgcagttagtatggcaaacatttttcggggttcgtatttagctggggcgggactgttattcagcataatgaaaaacacagcaaacacgagaagaggaactggcaacaccggggaaacactaggagaaaagtggaaaaacagactaaatgcattaggtaagtctgaatttcagatatacaagaaaagtgggatacaagaagtcgaccgcaccctagccaaagaaggaataaagcggggagaaacggatcaccatgcagtaagtaggggttcagcaaaattaagatggttcgtggaacgtaatttagtaacaccagagggaaaagttgttgatctaggttgtggtcgagggggttggtcatactattgtggaggtcttaaaaacgtaaaagaagtaaaaggattaacaaaagggggaccgggacacgaagaacctatacctatgtccacttatggctggaatttagttagactacaaagcggggttgatgtattctttacaccgcctgagaaatgtgatacacttctatgtgatataggcgaaagttcgcctaatcccacagtagaggccgggagaactttgagagtcttaaatttagtagaaaactggctgaacaataacacccaattttgtatcaaggtgctaaacccctacatgccttcagtaatagagaaaatggaggccttgcaacgaaaatatgggggagcattagtaagaaacccactcagccgaaatagcacccacgagatgtactgggtaagtaacgcctcaggtaatattgtaagttcagtcaatatgatttcacggatgctaataaaccgattcactatgcgtcacaagaaagcgacatatgaacctgacgtagatctaggctcagggactagaaacatagggatagaatcagaaacacccaacttggacataataggtaaaagaatagaaaagatcaagcaggagcacgaaacaagttggcactatgatcaagaccatccatataaaacatgggcctaccatggatcgtatgagactaaacaaacaggatcagcatctagcatggtaaacggagttgtcagacttctaactaaaccttgggatgtaataccaatggtaacgcaaatggcaatgacagatacaactcctttcggacagcagcgagtatttaaagaaaaggttgatacgcggacacaagaaccaaaagaggggaccaagaaattaatgaaaataactgctgaatggctgtggaaagagctcggcaagaagaaaacaccaagaatgtgcactagggaagaatttactcgaaaagtaagaagtaacgcagctctgggcgccatattcacagatgagaacaaatggaaatccgcacgcgaagcagttgaagactcaggattttgggagttagttgataaagaacggaatctgcatctcgaaggaaaatgcgaaacgtgcgtatataacatgatgggaaagagagagaagaaattaggagagttcggtaaagcaaaaggatcgagagcgatatggtacatgtggttaggtgccaggtttctagagttcgaagcattgggatttctgaatgaagatcactggtttagccgagaaaactctttaagcggtgtggaaggggaaggattacacaaattaggctatatacttagggatgtatctaagaaagaagggggagcgatgtacgccgatgataccgccggatgggatacacgtatcactttagaagacctgaaaaatgaagaaatggtaacgaaccatatggaaggtgagcacaagaaacttgcagaagccattttcaagctaacttaccagaacaaggttgttagggttcaacgaccgaccccgcgcggtaccgtcatggatataatttcaagacgagaccaacgggggtcaggtcaagtggttacgtacggactaaatacgtttacgaacatggaagctcaattaattcgccaaatggaaggtgaaggggtttttaaatcaattcagcaactcaccgtcaaagaggaaatagctgtaaagaattggttaattagagtaggacgagaacgactaagcaggatggcgatttcaggagatgattgtgtggtgaaaccgctagacgatagattcgccagtgccctaacagcattaaacgacatggggaaggtgcgaaaagatattcaacaatgggaaccatccagaggatggaatgattggacacaagtaccattttgtagtcatcattttcacgagttaattatgaaagatggaagggttctcgtcgttccgtgtagaaatcaagacgagttgataggtagagccaggatctcccaaggtgctggatggagcttacgtgaaacagcgtgcctgggaaaatcttacgcacaaatgtggtcccttatgtactttcatcgacgtgacttaagattggcagcaaatgcaatctgcagtgctgttccaagtcactggatacccacctcaagaacaacatggagtatccacgctacgcacgaatggatgactactgaagatatgttaactgtttggaatagagtatggattcaagaaaatccttggatggaagataagacaccggtcgaatcatgggaagaaataccatatttgggaaaaagagaggatcaatggtgtggctcgttgattggattaactagcagagcaacctgggccaaaaacatccagaccgcaataaatcaagtaagatcattgatcggaaatgaagaatataccgattatatgcccagtatgaaaagatttcgtcgagaagaagaagaagcaggcgttctttggtag

SEQ ID NO: 22263 - RNA, 9876 nt, synthetic construct
  misc_feature 1..9876: note = derived and/or modified CDS sequence (opt6) from DENV-2__KM279569__SS-prME
  source 1..9876: mol_type = other RNA
acagcaggaataatcattatgatgattccaacagttatggcatttcatctgacaacacgaaatggtgaaccacacatgattgtaagcagacaagaaaaaggaaaaagtttactttttaaaactgaaaatggtgtgaatatgtgtacactaatggcaatggatttaggggaactgtgtgaagatacaataacgtataactgcccgttattacgccaaaacgaacctgaagacatagactgttggtgtaactcaacatccacatgggtaacgtatggtacatgtaccgcaacgggagaacatcgacgggaaaaacggtcagttgctttagttccacacgttggaatgggtcttgaaacacgaacggaaacttggatgtcgtcagaaggtgcatggaaacatgcacaaagaattgaaacatggatacttagacaccccggattcacaatcatggcagctatattagcatacacaatcggaaccacttacttccaaagagttctgattttcatactactgaccgcagtaactccctcaatggcgatgagatgcataggaattagcaacagagactttgtggaaggagttagcggaggatcctgggttgacattgtactagaacatgggtcatgcgtcactacaatggctaaaaataaacctactctggactttgaacttataaaaacggaagcaaaacatctagctacacttaggaaatattgtgtagaagcaaaacttacaaatacaactactgcttcgcgctgccccacccaaggtgaaccaagtcttaacgaagaacaagacaaaaggtttgtttgtaaacatagcatggtagaccgaggatggggaaatggttgtggattatttggcaagggaggcattgtgacatgtgctatgttcacttgcaagaaaaatatggagggtaaagttgttcaaccagaaaacctagaatatacaatagtgattacaccacattcgggagaagaaaacgctgtgggaaacgatactgggaaacatggtaaagaaataaaggttacaccacaaagctcaataaccgaagcagaattaacaggatatggaacggttacgatggaatgctcgccgagaacgggcctagacttcaatgagatggttttattacaaatggaaaacaaggcttggctcgtccacagacaatggttcctagatctcccactaccatggttaccaggagcggatactcaagggtcgaactggatacaaaaggaaaccctagttacattcaagaacccccacgctaagaaacaagatgtagtagtactcggttcgcaagaaggcgctatgcacaccgcgctgacaggtgcaacagagatacaaatgtcgagtggaaatttgctttttaccggacatcttaaatgtaggcttaggatggacaagttgcaattaaagggtatgtcctacagcatgtgtacgggtaaatttaaagtagtaaaggaaattgcagagactcaacacggaacaattgttatcagagtacaatatgaaggagatgggagcccatgcaaaataccctttgaaataatggatctagagaaaagacatgtgcttggtagactaataacagtaaaccctattgttacagaaaaagatagcccagttaatatagaagcagagccaccgttcggagattcttatataataattggtgttgagccgggacagctcaaactttcatggttcaagaagggtagttcaataggccaaatgtttgaaaccacaatgaggggagcaaaaagaatggcgattttaggagacactgcatgggatttcggatcactgggaggagtatttacaagcataggtaaggcacttcatcaagttttcggcgccatatatggagctgcattctccggtgtctcatggactatgaaaattttaattggtgtagtaatcacttggataggaatgaactcaagatccacgtcattgtccgtctcattggtattggtaggagtagttaccttatatctaggcgtaatggtgcaagctgacagtggatgtgtggtatcttggaaaaataaagaactgaagtgtggctctggaatctttataaccgataacgtgcatacatggacggaacaatacaaattccaacccgaaagtccttctaaattagcatcagcgatacaaaaggcacacgaggaaggaatttgcgggataagatcagtgactcggttagaaaatctaatgtggaaacaaatcacaccagaattgaaccacatcttaacagaaaatgaagtaaaacttacaataatgactggcgatataaaagggattatgcaagcagggaagcgaacattgcggccacagccgacagaattaaaatatagctggaaggcttggggaaaggcaaaaatgttaagtacagaattacacaatcacacatttcttatagacgggccagagacagctgagtgccctaatacaaatcgagcttggaactcattagaagtagaagactacggttttggcgttttcacgacaaatatatggctgaaattgaaagaacgacaggatgtattttgtgattcaaaactaatgtcagcagccattaaagacaatagggcagtgcacgcagacatgggatattggattgagagcgctctaaatgatacatggaaaatcgaaaaagcaagttttattgaagtgaaatcttgccattggccgaaatcacacacattgtggtcaaatggagtcctagaatcggagatgataattccgaaaaattttgcaggaccggtcagtcagcataactatagacctggatatcacacacagacagcaggtccttggcaccttggtagattggaaatggatttcgatttttgtgagggaaccacagtggtggttacagaagattgcgggaaccgcggccctagtctacgcacaaccaccgcatcgggaaaattaataacagagtggtgctgccgatcgtgtactctaccccctttaagatatagaggtgaggacgggtgttggtacggaatggaaatacgacccttaaaagaaaaggaagaaaacctagtaaatagtctggtgacagcggggcatggacaaatagataatttttcactaggagtactgggaatggcacttttcctcgaagagatgttacgaacaagagtcgggactaagcatgcaatattattagttgcggtctccttcgtaacgttaataacaggaaatatgtccttcagagacttgggcagagtgatggtgatggttggagcaacaatgactgatgatattggtatgggagtgacttatctggcactattagccgcctttaaagtacggccgacgtttgcggcaggactcctactgcgaaagctaacctcaaaagaacttatgatgactaccattggtattgtgctgctcagccaatcgacgatcccagaaagtatattggagctaacagatgcattagcgttaggaatgatggtgttaaaaatagtgaggaatatggaaaaataccaattagctgtaactattatggccatactttgcgtgccaaacgcagtaatcttgcaaaacgcatggaaggtatcatgtacaactcttgctgttgtgtctgtatcacccctccttctaaccagcagccagcaaaaagctgattggataccattagcgctaacaattaaaggattaaacccaactgcgatatttttgaccacattatccaggactagcaagaaacgatcttggcctttgaatgaggctattatggcagtgggaatggtcagtatactagcaagtagtttgcttaaaaacgatatacctatgactggcccattggtagccggtgggttactaacagtctgctatgttctaactggtaggtcagcagatttagagctcgagagggccgcggatgtacgttgggaggaacaggcggaaatatcaggttcatctccaatcttaagtataacgatatcggaggatggatcgatgagcatcaaaaatgaagaagaagaacagaccctaacaatcttgataagaacaggtctattggtaataagtggactgttcccagtatcaattccaataactgcagccgcatggtatctatgggaggtcaagaaacagcgagcgggggtactctgggatgtgccgagtccacctccagtggggaaagcagaattagaagatggtgcttacagaattaaacaaaaaggtatattaggttattcgcaaattggagcaggggtgtacaaggaagggaccttccacacgatgtggcacgtaactagaggtgccgtcctaatgcataagggtaaacgaattgagccgtcatgggcagacgtcaagaaagatttaatatcttatggcggaggttggaagttagagggagaatggaaagaaggagaagaagttcaagtgttagcattagaaccaggcaaaaatcctagagcggtgcaaactaagccaggtttattcaaaacgaatacaggaacaataggagcggtatcgttagacttcagcccaggcacatcaggctctcctatagtagacaaaaagggaaaggtagtcgggctttacgggaatggagtggtgacaagatcaggtacgtatgtgagtgcaattgcacagacagaaaaatcgatcgaggacaatcccgaaatcgaagatgatatattcaggaaaaagcgactaacaataatggaccttcacccgggagcagggaaaacaaaaaggtacctccctgccatagtacgtgaagccataaaaagaggccttaggaccttaatcttagcaccaactcgagttgtcgctgctgagatggaggaagccctgagaggcttaccgatcagatatcaaactccagcaataagagcagaacacacaggaagagagattgttgacttaatgtgtcatgcaaccttcactatgagacttctttcacccatacgcgttcccaattacaacttaatcatcatggatgaagcccattttacagatccagcgtcaattgcagcacggggatacatcagcacaagagtagaaatgggagaggctgcaggcatcttcatgacagctactccaccgggatcaagagatcctttcccacagtcgaacgcccctataatggatgaggagaaagaaatacctgagcgatcttggaactcgggccatgaatgggtaacagattttaagggcaaaacagtgtggtttgttcctagcataaaagccggcaatgacattgcggcctgccttaggaagaatggcaagaaagtaatacaattgtcaagaaagacatttgactcagaatatataaagacgagaaccaatgattgggatttcgttgtaacgacggacataagcgaaatgggggccaactttaaagctgaaagagtcattgacccacgaagatgtatgaaaccggtaatattaaccgatggcgaagagagggttatcctagcaggaccaatgcctgtcacgcacagctcagcagcccaaagaaggggtagagtgggtagaaatcctaaaaacgagaatgatcagtacatttacatgggggaaccgctagagaacgatgaagattgtgcacactggaaagaagccaaaatgttgttagacaacattaacacaccagaaggaataatcccatcaatgttcgaaccagaacgtgaaaaagtcgacgcaattgacggcgaatataggctgagaggagaagcgagaaaaacgttcgtagacctcatgcggcgaggagacctacctgtttggctagcttatagagtcgcagcagaaggcataaactacgcagacaggagatggtgtttcgatggcgtcaagaacaaccaaatacttgaagaaaatgttgaggtggagatctggaccaaggaaggggaaagaaagaagttaaaaccacgttggttagatgccaggatctatagtgaccctctagctctgaaagaatttaaggaatttgcagcaggaagaaaaagtctaactttgaacttgatcacagaaatgggtaggttacctacttttatgacccaaaaagcaaagaatgctctagacaacctagcggtgctgcatactgcggaagcagggggacgagcatacaatcatgcactatccgaattaccggaaacgcttgaaacattacttctactcactcttttagcaacagtgactggaggaatcttcttatttctaatgagcggaaaaggtataggtaagatgacgctagggatgtgttgtattataaccgcaagcatactcttatggtacgctcaaatacaaccacactggatagcagcctctattatcctagagttctttcttatagtgctactaattcccgaacccgaaaaacaaagaactcctcaagataatcaattaacatacgtagtaatagctatattgactgtagttgcagccacgatggccaacgaaatgggattcttagagaaaaccaagaaagactttggacttggctccataacaactcaacaaccagaatcaaatatactggacatagacctgaggcccgcgtcggcatggacactctatgcagttgcaactacattcataacgccgatgttaaggcacagtatagaaaattcatctgtcaatgtgagccttacggcaattgctaaccaagcaactgtattgatgggtttaggaaaaggctggcctctttcaaagatggatataggagtacctctactggcaataggatgctattcacaagttaaccctataacattgacggcagctctactactattggtcgcacactatgcaataattggtcctggattgcaggcgaaagctactagagaggcacaaaaacgagcggcagctgggattatgaaaaaccctactgtagatggaatgacagtaatagatttggaccccattccctacgatccgaagtttgaaaagcagctcggacaagttatgctattagtactctgcgttactcaggtattgatgatgcgcacaacctgggcactatgtgaggccttaacccttgctacagggccaatttcgactctatgggaagggaaccccggtaggttttggaacactacaatagcggtgagtatggcgaacatttttaggggaagctatttagccggtgcaggtttactcttttccattatgaagaatacagctaacacacgaagaggaacaggtaacactggggaaactttaggtgagaaatggaagaaccgattaaatgctctaggaaaaagcgaatttcaaatctataagaaatccggcattcaggaagtggatcgaacgctagccaaagagggtataaaaaggggtgagaccgaccaccacgcagtatcgcgaggctcagccaaacttagatggtttgttgaaaggaacttggttacacctgaaggcaaagtggtagatctgggttgcgggagaggtggctggagctactactgtgggggtctcaaaaacgtaaaagaagtcaaaggtctaacgaaaggtggccctggtcacgaagaaccgataccaatgagcacctatggatggaatcttgtacgactgcagtcgggagttgatgttttctttacaccaccagaaaaatgtgatacgttactatgtgacataggagaatcgtcgcctaacccaacagttgaagcagggaggacattaagggttttaaacttagtggaaaattggttaaacaataatacgcagttttgtatcaaagtgctaaacccgtacatgccctcagtgatagagaaaatggaagctctacaacgtaagtacggtggtgcgttagtcagaaatcccttaagtcgaaacagtacacacgaaatgtactgggtaagcaatgcatctggaaatatcgttagcagcgttaacatgatttcaaggatgctcattaacaggtttaccatgagacataagaaagcgacgtacgaaccggatgtcgatctcggatcaggaacaaggaacataggaatagaaagcgaaacgccaaatttagacataataggtaaaagaatagagaaaataaaacaagaacatgaaacgtcttggcattatgaccaggatcatccgtataaaacatgggcctatcacggatcatatgaaaccaaacaaacaggatctgcttcaagtatggtaaatggagtggtacgattgttgaccaagccatgggatgttatacccatggttacccagatggcgatgacagacacaacacccttcggccaacaacgagtctttaaagaaaaagtagacacgcgtacacaggaacctaaagaaggaacaaagaaattaatgaaaataaccgcggaatggctgtggaaagaactgggcaagaagaaaacaccacgcatgtgtactcgcgaagagttcacgagaaaagtaagatcgaacgccgctctcggagctatatttacagatgagaataaatggaaaagcgctagggaagccgttgaggattctggattttgggaattagtagataaggaacgaaacctacacctagaaggtaagtgcgaaacatgtgtttacaacatgatggggaaaagagaaaagaaactaggtgagttcgggaaggccaaggggagcagggcaatctggtatatgtggttgggcgctcgattcttggagtttgaggccctgggattcttaaacgaggatcattggttttctagagaaaacagtctatctggagtagagggggaaggattgcacaaacttggatatatactaagggatgtgagcaagaaggaaggaggtgcaatgtatgcagatgatactgcaggatgggacacaagaatcacattagaagacttgaaaaatgaagaaatggtaacaaaccatatggaaggagaacataaaaagctagcggaagcaatctttaagttgacgtatcaaaataaagtggttcgggtccagagaccaacacccagaggaacagttatggacataataagtagacgagatcaaagagggtccgggcaagttgttacctatggattaaacacgttcaccaatatggaagcacaactgatacggcagatggaaggagaaggagtgttcaaaagcatccaacagttaaccgtcaaagaagagatagcagtaaaagactggctaattcgcgttggaagagaacggctcagtcgtatggccatttccggtgacgactgcgtagtaaaacctctggacgacaggttcgcaagcgcgttaactgcacttaatgatatgggtaaagtaagaaaagatatacaacaatgggaaccctcccgaggctggaatgactggacgcaagtgcctttttgcagccatcatttccacgagctaatcatgaaagatggtcgagtactggtagtaccatgtcgtaaccaagacgagctgattggcagagcaagaatttcacagggtgccggatggagcctaagggagacggcgtgcttaggaaaatcttatgcgcaaatgtggtctttaatgtactttcatcgaagagacttgagattagcggcgaacgcaatttgtagtgcagttccatcgcattggatacccacatcgagaacaacgtggagcattcacgctacacatgagtggatgacgaccgaagacatgttgaccgtgtggaacagagtatggatccaagaaaatccctggatggaagacaaaacgcctgtagaaagttgggaggagataccatacctaggcaaaagagaagatcaatggtgcggcagcctcattgggctcacatctagagcgacctgggctaagaatatacaaaccgcgataaatcaagttaggagcttgatcggtaacgaagaatataccgactacatgcccagcatgaagcgtttcagaagggaagaggaggaagccggtgttttgtggtaa

SEQ ID NO: 22264 - RNA, 9876 nt, synthetic construct
  misc_feature 1..9876: note = derived and/or modified CDS sequence (opt6) from DENV-2__KM279570__SS-prME
  source 1..9876: mol_type = other RNA
acagcaggtataattatcatgatgatacccacggtaatggcatttcatttaactaccagaaacggtgaaccacatatgatcgtctctcgacaagaaaaaggtaaaagtttgttatttaaaaccgaaaatggtgtaaacatgtgtacacttatggcaatggatcttggtgaactatgtgaagataccataacatacaactgtccacttttacgtcaaaacgaaccagaagacatagattgctggtgtaattcgacgtcaacttgggttacctatgggacctgcacagcaactggcgaacacagacgtgaaaaacgtagcgtcgcgctagtcccgcatgtaggtatgggtcttgaaacgagaaccgaaacctggatgtctagtgaaggtgcatggaaacatgcacagcgtattgaaacatggatattgcgccatccgggttttacaattatggctgccatacttgcttatacgataggaacaacatattttcaaagggtattaatatttatacttctaactgcagtaacacctagtatggcaatgagatgcattggtatctcgaacagagattttgtggaaggggtgagtggagggtcatgggtggatatcgtactagaacatggctcgtgcgtaacaacaatggctaaaaataaaccaacactggacttcgaattaataaaaacagaagcaaaacacttggcgacactacgtaaatactgtgtcgaagcaaaattgacaaacactactacagcttcaaggtgtccaacacagggagaaccctcattgaatgaagaacaagataaacgttttgtctgtaaacacagtatggttgataggggctggggaaatggttgtggccttttcggcaaaggagggatagtgacatgcgcgatgtttacatgtaagaaaaatatggaaggtaaagtcgtacaaccggagaatttagaatacactattgtaataacgccacactccggtgaagaaaacgctgttgggaacgacactggtaaacatggtaaagaaataaaagttactcctcaaagcagtatcacagaagctgaactaaccggatatggtacagtaacaatggagtgttcaccaagaaccggacttgacttcaacgaaatggttttgttacaaatggaaaataaagcgtggttggtccacagacagtggtttttggacttgcccctgccatggttacccggggcagacacccaaggctcaaattggatacaaaaagaaacgctggtgacattcaaaaacccacatgccaagaaacaagatgtcgttgtattgggatctcaagaaggggcaatgcatactgctctaaccggtgctacagagatccaaatgtcgagcggcaacctcttattcactggtcacttaaaatgtagactgcgcatggataaactacaattaaaagggatgagctactcaatgtgcaccggaaaatttaaagttgtgaaagagatcgcggaaacgcaacacgggacaatagtgataagagtgcagtatgagggagatggttcaccatgcaaaataccctttgaaatcatggatctagaaaaacgtcatgtacttggccgccttatcacagtcaatccaatcgtcacggaaaaagatagtcctgtaaatatcgaagccgaaccacctttcggagattcatatattataataggagtagaaccaggtcaacttaaactatcgtggtttaaaaagggcagctcaattggacaaatgttcgagaccacgatgagaggggcgaaaagaatggctatattgggagacacggcttgggattttggcagccttggtggtgtatttacgtcgatcgggaaggctctacaccaggtgtttggggcaatctatggagcagcattcagtggagtatcgtggactatgaaaatccttataggagttgtaataacctggattggaatgaactccagaagtacaagtctatcggtaagtttggttctagttggggtagttaccctatatctaggtgtcatggtacaagcggactcaggctgtgtagtttcatggaaaaataaagagttgaaatgtggaagcggaatttttattaccgacaacgtgcatacatggacagaacaatacaaattccaacctgagagcccgtcgaaactcgcctcggctatacagaaagcacatgaagaaggtatttgtggtataagatcagtaacgcgcctagaaaaccttatgtggaaacagataactccagaattaaatcatatacttacagaaaacgaggttaaactcacaatcatgacaggagatattaaaggaataatgcaggctgggaaaagaagtttacgcccacagcctacggagttaaaatacagttggaaagcgtggggaaaagcaaagatgttaagcacggagttacacaatcacacatttcttatagatggccccgaaacagcagagtgtcctaacacaaaccgggcatggaactctttggaagtcgaagattatgggtttggagtgtttactacaaatatatggcttaaactcaaggaacgtcaagatgtattctgcgatagcaaactaatgagtgctgcgatcaaagataacagagcagtgcatgctgatatgggatactggatagaatctgcgttaaacgatacttggaaaattgaaaaagctagttttatcgaagttaaaagttgtcattggcccaagagccacacactgtggtctaacggagtccttgaaagcgaaatgataatccctaaaaacttcgcagggcctgtcagccaacataactataggcctggttaccatacccaaactgccggaccatggcacctaggtagactggaaatggacttcgatttttgtgaaggaaccaccgttgcagttacggaagactgtggaaatagaggccccagtctaaggactacaaccgcatccggcaagttaattacagagtggtgttgccgcagttgtacccttcctccgttaagatacagaggagaggatggatgctggtatggtatggagatacgaccactaaaagagaaagaagaaaatctagtaaacagtcttgtcacggcaggtcatgggcaaatagataacttcagtttaggagtgttaggaatggcattatttcttgaagaaatgctaagaacgcgagtaggcacaaagcatgccatcctattagtagcagtgtctttcgtgacactgattacagggaacatgtcgttccgcgatcttggaagagtcatggtgatggttggcgctaccatgaccgacgacataggtatgggtgtcacctacttagccttacttgcagcgtttaaagtaagaccaacatttgcggcgggtttgctactaagaaaactaacatcaaaagagttaatgatgactacaataggaatagtgttgttaagtcaatctacaattccggaatcaattcttgaattaacggatgctttagcattgggaatgatggtactgaagatagtaagaaatatggagaaatatcagcttgcagttacaataatggcgattttatgcgtacctaacgcagtcattttacagaatgcatggaaagtttcttgtacaactttagctgtcgtcagtgtcagcccactactactaacttctagccaacaaaaagccgactggatcccgctcgccttaactattaaaggccttaatccaacagcaatcttccttacaacactttctcgaacatccaagaaaagaagttggcctttaaatgaagcaataatggcagtaggaatggtaagcatactagcgagctccctactcaaaaacgatatccccatgacaggacccctagtggccggtggactcctcaccgtatgttatgtgttaacaggccggtctgcagaccttgaactagaacgagcagcagacgtccggtgggaggaacaagcagaaataagtggaagttcaccgatactttccattaccatctcagaagatgggtcaatgtctattaagaacgaagaggaagaacaaactttgacaatattaatacgaacaggtttattagtaataagtgggctatttccggtttcaatccctataacggcagcggcatggtatctgtgggaagtaaagaaacagcgcgcgggtgtattatgggacgtaccctcccctccaccggttggtaaagccgaattagaagatggtgcatatagaataaaacagaaaggaatactaggttattcgcagataggagccggagtttataaagaaggcactttccatacaatgtggcatgtaactagaggggcggtgctaatgcacaaaggcaaaagaatagaaccctcctgggcagatgtcaagaaagatttaatctcttatggtggaggatggaaactagagggggaatggaaagaaggagaagaagtacaagtactggcgcttgagcctgggaaaaacccacgagcagtgcaaaccaaacctggactgtttaaaaccaatacggggactatcggtgctgtttcactcgattttagtccaggtacaagtgggtcacctatcgtagataagaaaggcaaagttgttgggctgtatggtaatggggtcgtgacccggagtgggacatatgtgtccgctattgcacagacagaaaaatcgatagaagataacccagaaatcgaagacgatattttccggaagaaaagattgacaataatggaccttcacccgggggccggaaaaacgaagagatacctccccgctatagttagagaagcaattaaacgtggactaagaacattaatactagcccctaccagagttgtagcagctgaaatggaagaagcattacgaggattaccaatacgatatcaaacccctgcgatccgagccgaacatactggtagagaaatagttgacttaatgtgccacgcgacgttcactatgagattgttatcgcccattcgtgtacctaactacaatctcatcataatggacgaagctcactttactgatccggcaagcatagcagcgcgggggtacatatcaacaagagtagaaatgggagaagcagcaggaatattcatgacagctacaccaccagggagtcgggatccttttcctcaaagtaatgctccgataatggatgaggagagagaaataccggaaaggtcgtggaatagcggccatgaatgggttaccgatttcaaaggaaagaccgtttggttcgtaccttcaataaaagcagggaatgatattgcagcgtgcctcaggaaaaatgggaagaaagtaattcaactcagccgaaaaacattcgactcagaatacataaaaacgcgtactaacgattgggattttgtagttactacagacataagtgaaatgggggccaatttcaaggccgagagagtgatagatccaaggcgatgtatgaaaccggtcattttaactgacggagaagaacgtgtaatactagctgggcccatgccggtcacgcattctagcgcagcacaaagacggggtcgcgtaggaaggaaccccaaaaacgagaatgatcaatacatttatatgggcgagccgttagaaaatgacgaggactgtgctcattggaaagaagcaaagatgctattagacaacattaacacaccggaagggattataccctcgatgttcgagcctgagagagagaaagtagatgcaatagacggagaatatagactcagaggcgaggcaagaaagacattcgttgacctaatgcgaagaggagacctacccgtctggttagcgtatcgcgtagctgcagaaggcattaactatgcagatagaagatggtgtttcgatggagtcaaaaataaccaaatattagaggaaaacgttgaagtagaaatatggacaaaagaaggggagcgtaagaaacttaaaccgagatggctagatgcaagaatctatagtgacccattagcacttaaggaatttaaagagtttgcagcgggaagaaagagcttaacactaaacttgataacggaaatgggaagacttccaacattcatgacacaaaaagctaaaaatgctctagataatcttgccgtccttcatactgccgaagcaggcggccgcgcctataatcatgctttaagcgaactccctgaaacattagaaacattactacttttgacgttattggctacggtgactggaggtattttcttatttttaatgagcggaaaaggaatcggtaaaatgactttaggaatgtgttgcattataacagcatcaatactactatggtacgcccaaatacaaccacattggatagcagcatcgataattcttgagttcttcttaattgtcttattaatacctgagccagagaaacaaaggacaccacaagacaaccagttaacttatgtagtaattgctatcttgactgtcgtagcagctacaatggctaacgagatgggtttccttgagaaaactaaaaaggactttgggttaggctccataacaacgcaacaacctgagtcaaatatcttagacatcgatttaagaccagcatcggcctggaccttatacgcagtagccactacatttataacacctatgttaagacatagtatagaaaatagcagtgttaatgtgagcttaacagcgatcgctaatcaggctaccgttctaatgggccttggtaaggggtggccgctaagcaaaatggatattggagtacctctcctggcaatcgggtgttattctcaagttaaccctatcacattaactgccgcattactactattagttgcacactacgctataatcggtccaggtcttcaagctaaggcgacaagagaagcgcagaaaagggccgcagcaggaattatgaagaatcccactgttgatgggatgactgttatcgacctcgatccgataccctatgatccaaagttcgaaaaacagttagggcaggtcatgttattggttctttgtgtaacgcaagtattgatgatgagaacaacatgggctctttgcgaggcgcttacattagcaacaggaccgatttcaaccctttgggaaggaaatcccggtcgtttttggaatactactatcgcagtgtccatggctaatatttttaggggtagctatctcgctggggctggcttattgtttagtattatgaaaaatacagctaatacacgtagaggcactggtaatacaggggaaactctaggagaaaagtggaaaaataggttaaatgcattgggcaaatcagagtttcaaatatataagaaaagcggaatacaagaggtggaccgcactctggctaaggaaggtataaaacgaggagaaacggatcatcatgccgtaagcagaggttcagccaagttgcgatggtttgtagagagaaatcttgttactccagaagggaaggttgttgatctcggatgtggacgtggagggtggtcttattattgcggaggcctcaaaaacgttaaagaagtaaaagggttaacaaaagggggacccgggcacgaggagcccatacccatgagtacctatggttggaacctggtgcgattacaatctggggttgatgtattctttacacctcccgaaaaatgtgatacactactatgcgacatcggtgaatcttcgcccaatcctactgtcgaagcaggtcgcacactccgcgtcttaaatcttgttgagaattggctaaataataatacacaattttgcataaaagtacttaatccgtacatgccctctgtgatcgagaagatggaggcgctacaaaggaagtatggcggagctctcgtaaggaatcccctatcaaggaactcaacccacgaaatgtattgggtttcaaacgcttcaggcaacatagtatccagtgttaacatgatttcgagaatgctaataaaccgtttcacaatgcgacataagaaagcgacctacgaacccgatgtagacttaggaagtggaacacgtaacattggaatagaatctgaaactcccaacttagatataatagggaaacgcatagaaaagattaagcaggaacacgaaacctcatggcattacgatcaagatcatccatacaaaacgtgggcataccatggtagctatgaaactaagcaaaccggatctgcttcatccatggtaaatggggtagtaagattgctaacgaaaccgtgggacgtgattccaatggtcacacaaatggctatgaccgacactacgccatttggacaacaaagagtatttaaagagaaagtagacacacgaacccaggagcctaaagaaggcacgaaaaagctaatgaagattacagcagaatggctatggaaagaattgggtaagaagaaaacccctaggatgtgcacacgtgaagaatttacacgcaaagtccgtagcaacgccgctcttggagctatattcacagacgagaacaaatggaaatctgcccgggaagctgtagaggatagcggtttttgggagctggtagataaagaaagaaaccttcatctggaaggaaaatgtgagacttgtgtctataatatgatggggaaaagagagaagaaattaggagagttcgggaaggcaaaaggtagtagggctatctggtatatgtggctaggtgcaagatttcttgagttcgaggctttaggatttctaaatgaagatcactggttttcgagagaaaattccttgagtggcgttgagggtgaaggtttacataaacttggatatattttaagagatgtgagcaagaaagaagggggagccatgtacgctgatgacactgcaggttgggatacgcgaataacattagaggacctgaaaaatgaggaaatggttactaatcacatggaaggagaacacaagaaattagcagaagcaatctttaaattaacttatcagaataaagttgtacgagtacaacgacctactcccagaggtacagtaatggatataatatccagacgagatcaaagaggatctggccaagtagtaacatatggactaaacactttcaccaatatggaagctcagcttatacgacaaatggagggtgaaggtgtatttaaatcaatccaacaattaactgtaaaggaggaaatagcagttaaaaactggttaattagagttggtcgggaacgattgagcaggatggcaatatcgggagatgattgtgtagtaaaaccgttagatgacagattcgcgtcagcattaacagcacttaacgacatgggtaaagtacgtaaagatattcaacaatgggagccaagcagaggatggaatgattggacacaagtaccattctgctctcaccatttccacgaattaatcatgaaagatggtcgggtcctagtagttccatgtcggaatcaagatgagcttataggccgagcgcgtatatcccagggcgcaggatggtcactgcgggagacagcatgccttggtaaaagctatgcacaaatgtggtcattaatgtattttcacaggcgtgatttgaggctggcagccaatgcaatttgtagtgcggtaccatctcattggataccgacaagcagaaccacatggtcaatacacgctacacatgaatggatgactacagaggatatgttaactgtttggaaccgagtgtggatacaagaaaatccatggatggaagacaaaacgcctgtagaatcatgggaagaaataccatacctcggtaagagagaggaccaatggtgtggatctcttataggcctcacatccagggccacctgggccaagaacatacagacagctataaaccaagtacgtagtttgataggaaatgaagaatacacagattatatgccatcaatgaaacgatttaggcgtgaagaagaagaagcaggcgtattatggtaa

SEQ ID NO: 22265 - RNA, 9876 nt, synthetic construct
  misc_feature 1..9876: note = derived and/or modified CDS sequence (opt6) from DENV-2__KM279596__SS-prME
  source 1..9876: mol_type = other RNA
acggctggaattataattatgatgataccaacagtaatggcatttcacctaaccactagaaatggagaaccgcatatgatagtgtcacgtcaagaaaaaggtaaatcattactctttaaaactgaaaacggggtaaacatgtgtacactcatggctatggacttaggagaattatgtgaagatactataacttataattgtcccctacttagacaaaatgaaccagaagacatagactgttggtgcaattcgaccagcacgtgggttacatatggaacttgcacggctactggagagcacaggcgtgagaaaaggtctgtggctctggttccacatgtgggtatgggactagaaacaagaaccgaaacgtggatgtcatctgaaggagcatggaaacacgcgcagcgaatagaaacatggatcctcagacatccaggtttcactataatggcagcgatcttagcatacacaatagggacaacatactttcaaagggtgttaatttttatcctattaacggcggtgacaccgagtatggcaatgaggtgtataggaatttccaacagagactttgtagaaggtgtatctgggggatcatgggtagatattgtacttgagcatggttcctgtgtgacgaccatggccaaaaataaaccaacacttgacttcgagttaatcaaaaccgaggcgaaacacttagctacattacgtaaatactgtgtagaggcgaaattgacaaataccacgaccgctagtagatgccctacgcaaggagaaccaagtctaaatgaagaacaagacaaaaggtttgtatgcaaacatagcatggtagatagaggctggggaaatggatgtggattatttggcaaaggcgggatagtgacgtgtgcaatgtttacatgcaagaaaaacatggaaggtaaagtagtacaacctgaaaatttagaatatacgatagtaatcacgcctcattcaggggaagaaaatgcagtaggaaatgacactggaaaacatggaaaagaaattaaagtaacaccgcaaagcagtataacagaagcagaactaacaggatatggtacagtcaccatggaatgttctccacgaacgggtctagatttcaacgaaatggtacttttacaaatggaaaacaaagcctggctagttcatcgtcaatggttcttagacctaccgctaccatggttacctggagcggatacacaagggagcaactggattcaaaaagagacgcttgttacttttaaaaatccacatgcgaagaaacaggatgtagtagtactaggatcacaggagggtgcgatgcacacggctttaactggggcaacagaaatacagatgagtagtggtaatctgctttttacggggcatcttaaatgtcgtctaagaatggacaaacttcagttgaaaggaatgagctacagtatgtgcaccgggaaatttaaagttgtaaaagaaatagctgaaacgcaacacggaacaattgttattcgagttcagtatgagggagatggttcaccttgtaaaattcccttcgaaataatggacctagaaaaacgacacgtgttaggtagactaattaccgtcaacccgatagtgacggaaaaagatagcccggtcaacatagaggcggaaccaccttttggcgacagctacattattataggcgtcgagcccggacaattaaaattgagctggttcaagaaaggttcttcaataggccaaatgtttgaaaccacgatgcgaggtgcgaaaagaatggccatattaggagacacggcatgggactttggatcactgggaggggtatttacctctattggtaaagccttgcaccaagtattcggtgctatctacggagcagcattcagtggagtttcctggacaatgaaaatactcataggcgtagttataacctggatcggcatgaactcaagaagcacaagtttgtcagtttctctagttttagttggagtagtgacattgtatctaggcgtaatggtgcaggcggactcagggtgtgtagtttcttggaaaaacaaagaattgaaatgtggctctggtatatttataacagacaatgtacacacttggacagagcagtacaaattccagcctgagtctccgtcgaaattagcaagcgcgatacaaaaagcccatgaagaaggtatatgtggaataagatcagtaaccagactcgaaaacctaatgtggaaacaaatcactcccgagctcaaccatatcttaacagaaaacgaagtaaaactaactataatgactggagacataaaaggaattatgcaagctggaaaaagatcgttaaggccccagcctacagaattaaaatactcatggaaagcatgggggaaagccaaaatgttaagcacagaattacacaaccacacatttttaattgatgggccagagacagcagagtgtccgaatactaaccgagcctggaactcgctagaagtagaggattatggattcggtgtatttacgacaaacatttggctgaaactaaaagaaagacaagacgtattttgtgattcaaaacttatgtccgctgcgataaaagataatagagcagttcatgccgacatgggatactggatcgaatccgccctaaatgacacttggaaaatcgaaaaggcttcattcatcgaagtcaaatcctgccattggcctaaatcacataccttatggagcaatggagtattggaaagtgaaatgataattccaaagaattttgcaggaccagttagtcaacataattacagaccaggataccatactcagacagcaggaccatggcacttagggcgactggaaatggactttgacttttgcgaaggaactaccgttgcagtaaccgaggactgtggaaataggggcccgtcattaaggacaacgacagcctctggtaaattaataactgaatggtgttgtcggtcgtgcacacttccaccccttagatacaggggagaagacggctgttggtacggaatggagattagaccattaaaagaaaaagaagagaacttagtaaactcacttgtgactgcagggcacgggcaaatagacaatttttcgttaggcgtgttaggaatggccttatttctggaagaaatgctacggactagagtcggaaccaagcacgcaatactcttagtggcagtatcctttgttaccctgattactgggaatatgtcattccgagacctgggtagggtcatggtaatggtaggagccacaatgactgatgatattgggatgggagtcacttacttggccttacttgctgcgttcaaagtccggccgaccttcgctgccggacttttattgagaaaactaacaagcaaggagctaatgatgaccacaatcgggatagtattattatcacaatcaactatccccgaaagcatactcgaactaacagatgccttagccttagggatgatggttctgaaaattgtccgaaatatggagaaataccaactggctgtaactatcatggctattctgtgcgtccctaacgctgtaatattacaaaatgcttggaaagtcagctgtacgacattagcagtagtatctgtatcgcctttattattaacatcatcccaacaaaaagcggactggatacctttggcactcacaattaagggattaaatccaacagcaatatttttaacgactctgagtaggacatcaaagaagagatcctggccccttaacgaagcaataatggcagttggaatggtgtctatactggcatcaagtctcctaaagaatgacataccgatgacaggacccttagtggctggaggactccttacagtctgttacgtgttgacgggaagatcggcagatttagaactagagcgtgcggctgatgtcaggtgggaagaacaagctgaaataagtggaagtagtcctattcttagtataaccatttcagaagatgggagtatgtcaatcaaaaatgaagaggaagaacaaacactaactatattgatccgcacaggattgctggttataagcggccttttccctgtaagcataccaataacggcggcagcttggtatctatgggaagtcaagaaacaaagagcaggcgtgctttgggatgtcccaagtccaccacctgttggaaaagcggagcttgaagatggtgcctaccgaatcaagcaaaagggaattttaggatatagtcaaattggggccggagtatataaagaaggcacatttcatacaatgtggcacgtcacccggggtgcggtactgatgcacaaaggtaaacgtatcgagcctagttgggccgatgtaaagaaagacttaatatcgtacggtgggggctggaaattagaaggagaatggaaagaaggggaagaggtgcaagtactagcgctagaacctggtaagaatccacgtgcagttcaaacaaaacccggactgtttaaaactaatactggtaccataggagccgtttcactggatttctcacccggaacttcggggtctcctatcgttgataaaaagggtaaagtagtgggtctttatggaaatggtgtagtgactcgcagtggcacatatgttagcgctattgcgcagactgagaaaagtatagaagacaacccagagatagaagacgatatattcagaaagaaaaggctgaccataatggacctgcacccaggagcaggcaaaacaaaacgctatttgccagcaatagtaagagaagcaattaaacgcggattgcgaactttaatcttagccccaacaagggttgtcgcagccgaaatggaagaggccttaagaggtctaccgattcgatatcaaacaccggcgatacgcgcggagcatacgggacgagaaatagtagatctcatgtgtcatgccacatttactatgagactattaagtcctattcgagtaccaaattacaatttaattataatggacgaagcacacttcactgatccggcgagcatagccgcgaggggctacatatcaacaagagtagaaatgggagaagccgctggcatttttatgacggcaacgccgcctggaagccgtgacccttttcctcagtcgaatgctcctataatggatgaagaaagagagataccagagagaagttggaactccggacatgaatgggtcaccgatttcaaaggaaaaaccgtctggttcgtgcccagcataaaagcgggaaatgacattgctgcatgtttaagaaagaacggtaagaaagtgattcagctaagccgaaagacgttcgatagtgaatacataaaaacaagaacgaacgattgggatttcgtagtgactactgatatatccgaaatgggcgccaattttaaagcggagagagtaatagatcctagaagatgcatgaaaccagtcattttgacggacggggaggaaagagtaatattagccggaccaatgcctgtaactcattcatcagcagcacaacgtcgaggacgagtcggtcgcaaccctaaaaatgaaaacgatcaatacatatatatgggagagccacttgaaaatgatgaagactgcgcacattggaaggaagccaaaatgctattagacaatatcaatacaccagaaggcatcataccaagtatgttcgaaccagaaagagaaaaagttgatgctattgacggcgaatatagacttaggggtgaagctcggaaaacttttgtagacttaatgagacgcggggacctcccagtttggctggcctaccgggtagcagccgaaggtataaattatgcggacagaagatggtgtttcgatggtgtcaaaaataaccaaatattggaagaaaacgtagaagttgagatatggactaaagaaggcgaacgtaaaaagctaaaaccacgatggttagatgctcgtatctatagtgacccattagcattgaaagaatttaaagaatttgccgcaggtcgtaagtctttaacactcaatcttatcacagaaatgggtagactgccaacatttatgactcaaaaagctaaaaacgcattagacaacttagccgtgttacataccgcagaagcgggaggtagagcgtacaatcacgctttaagcgaactcccggaaactctagaaaccctactgttactgacactacttgcgacagttacaggtggcatattcctatttttaatgtccggtaaaggtatcggcaagatgacgctgggaatgtgctgcataattactgcatctatactactatggtacgctcaaatacagccacactggattgcagccagcataatactagagttctttttgatagtacttttgattcctgagccagaaaaacaacgaacaccacaggataatcaactaacctacgtcgtaatagcaatacttactgtcgtggccgcaactatggctaatgaaatggggtttcttgagaaaaccaagaaagatttcggacttggatcaatcgctacacaacaaccagaatcaaatatattagacatagacttacggccggcgagcgcttggaccttatatgccgtagctactactttcataacgcctatgctcagacattcaatcgaaaactcatcggtcaatgtctcgttaacggcgatcgctaaccaagctactgtattaatgggtttagggaaaggatggccacttagtaaaatggacattggcgtgccactcttagctattggatgttattctcaagttaatcccatcacattaacagcagcacttcttctcctagtagctcactacgcaatcataggtcctggtcttcaggcgaaagcaacacgagaagcgcaaaaacgagcagcagctggaataatgaagaacccaactgtggacggaatgactgtcatagatctagatccaataccatacgatccaaaatttgagaaacagttaggacaagtaatgctgttggttctgtgtgtaacacaggttctaatgatgcgtacaacatgggcgttatgtgaagcattaacactggcaaccggacccatctccaccctttgggaagggaatccaggtagattttggaatactacaatagcagtatcaatggccaatatttttcgcggatcgtatcttgctggcgcaggtcttctattttctataatgaagaatactgctaatacaagaaggggaactgggaacactggtgaaaccctgggggaaaaatggaaaaataggcttaatgctttaggtaaaagtgaatttcagatatacaaaaagtctggaatacaagaggttgaccgaacattagctaaagagggaatcaagagaggcgagactgaccaccatgcggtaagtcgtggtagtgcgaaacttaggtggtttgtcgaaagaaatttagttacaccagaaggaaaagttgtagacctaggttgcggacgaggaggttggtcgtattactgcggcggtcttaaaaacgttaaagaggtgaaaggactaacaaaagggggaccgggtcatgaagaaccaatacctatgtcgacatatggatggaatttagtcagattacaaagtggtgtagatgtattctttaccccaccggagaaatgcgataccctattatgcgacattggggaatcatccccgaacccaaccgttgaggctggtagaaccctgagagttttaaatctagtagaaaattggctcaataataacacacagttctgtatcaaagttctaaatccatacatgccgagcgttatagaaaagatggaagccttacaaagaaaatatggcggagcattagttagaaacccccttagcagaaattcgacacacgagatgtattgggtttcgaatgcaagtggaaacatcgtatcttctgtgaatatgataagtcgtatgctaattaaccgattcacgatgcgccacaagaaagcgacctacgaaccagacgttgatctaggatcaggaactcgaaatattggaatcgaatctgaaacaccaaacttagacataatcggtaaaagaatagagaaaataaaacaagaacacgaaacaagctggcactacgatcaggatcatccatacaagacatgggcttatcacggaagctatgaaactaagcagaccggttctgccagtagtatggtgaacggcgttgtccgactactcacgaaaccttgggatgtaattcccatggtaacccaaatggcgatgacagacacaacaccttttggtcaacaaagagtattcaaagaaaaagtggatacgagaactcaagaacctaaagaaggcacgaagaaacttatgaaaataaccgccgaatggctatggaaggaactcggtaagaagaaaacaccaaggatgtgtacacgagaagaatttacccgcaaagtaagatcaaacgcggcattaggagctatatttaccgacgaaaacaaatggaaaagtgctcgtgaagcagtggaagactcagggttttgggagttagtcgacaaggaacgaaatcttcatctagaaggcaagtgcgaaacatgcgtatacaatatgatgggcaaaagagagaagaaactcggcgaatttggaaaagctaaggggtctagagcaatctggtacatgtggttgggtgctaggtttcttgagttcgaagctcttggatttttgaatgaagaccattggttctcaagggaaaatagtctttcgggtgtagaaggtgaaggattacataaactgggatacatcttgcgagacgtgtctaagaaagaaggtggtgccatgtacgcagacgataccgcaggctgggatactcgcataacgttagaggatcttaaaaacgaagagatggtaacaaatcatatggagggcgaacacaagaaattagcggaagccatttttaaactgacataccaaaacaaggttgtccgtgtccagagaccaacaccaagaggaactgttatggacataatctcacgtagagatcaaagggggagtggacaagtagtgacatatgggttgaatacatttaccaacatggaggcacaattaataagacaaatggagggggagggtgtctttaaaagcattcaacaattaacggttaaggaggaaatagcagtaaagaattggttaataagagtaggacgagagcggttgagtagaatggcaattagcggcgatgattgcgtagtgaaacccctagatgacagattcgcctccgcactcacagctttgaacgatatgggaaaggtcagaaaggacatacagcagtgggaacccagccgaggttggaacgactggacacaagtccctttctgttcacatcatttccacgaactaataatgaaagatggtagagtccttgttgtaccatgccgtaaccaagacgaattgatcggacgagcacgaatctctcaaggcgcaggatggagcctaagagaaactgcttgtttaggaaaaagttacgcacaaatgtggagcttaatgtatttccataggcgtgatctgagactagcggcgaatgcgatttgttcagctgtcccatcacattggataccaacctctaggacaacatggagtattcacgctacccatgagtggatgactacggaggatatgctaacggtctggaaccgtgtgtggatacaagaaaatccttggatggaagacaaaacaccagttgaatcatgggaagaaataccctacctcggtaagcgagaagatcagtggtgcggatcccttattggattgacatcgagagctacttgggccaaaaatattcaaacagcaataaaccaagttaggtctcttataggaaatgaagagtatacagactatatgccatcaatgaaacgtttccgaagagaagaagaggaggcgggcgtattatggtga

SEQ ID NO: 22266 - RNA, 9876 nt, synthetic construct
  misc_feature 1..9876: note = derived and/or modified CDS sequence (opt6) from DENV-2__FJ850072__SS-prME
  source 1..9876: mol_type = other RNA
acggcaggggttataattatgcttatcccgacagcgatggcatttcatttaaccacacgaaatggagaacctcacatgattgtaggaaggcaagaaaaaggaaaatcattattgtttaaaacagaagacggggtaaacatgtgcactctgatggcaatggatctaggtgaattatgtgaagacacaattacatacaaatgcccattactaaggcaaaatgaaccggaagacattgactgctggtgtaattcgacctcaacttgggtcacttatggaacgtgcacaactaccggtgaacataggagagagaaaagatcagtagcgttagtaccccatgtcggtatgggtttggaaacgagaactgaaacgtggatgtcaagcgaaggagcttggaaacacgtacaacgaatcgaaacctggattttacggcaccctggatttgctattatggcagcaatcttagcatatacaatagggacaactcattttcaaagagcgcttatatttatattgcttactgccgtagctccgtccatgacgatgagatgtataggaatatcaaatagagatttcgtcgaaggagtgagcggtggaagttgggttgatatagtcctggaacatggtagttgtgtcacaacaatggctaaaaacaaaccaacgttagacttcgaactcattaaaactgaagcaaaacaacctgctacacttcgtaaatactgcatagaggcgaaattaacaaatactaccacagaaagcagatgtcctacgcaaggtgaaccatccttgaatgaggaacaagacaaaaggtttatttgcaaacattcaatggtagatagaggatggggtaatgggtgtggactcttcggaaaaggtggaatagtcacatgtgcgatgttcacatgcaagaaaaatatggaagggaaggtcgtgctaccggaaaacttagaatacaccattgttataacaccacattcaggtgaggaacatgctgtagggaatgatacagggaaacacggtgaggaaataaaaatcacaccacaatcctcaataacagaagcagaattaacaggttacgggacggtaactatggaatgttctcccagaaccggcttggatttcaatgagatggtcttacttcaaatggaagaaaaagcatggttagtacatcggcaatggtttttagacttaccattaccatggctgccaggagccgatactcagggatcgaattggatacaaaaagaaactctagtaacatttaaaaatcctcatgcaaagaaacaggacgttgtagtattaggatcacaagaaggcgcaatgcataccgcattaaccggagcaactgaaatacaaatgtcttctgggaacctcttattcaccggacacctaaaatgtagactacgaatggataaattgcagcttaaaggtatgtcctatagcatgtgcacaggaaaattcaaaatcgtaaaagagattgccgaaactcaacatggaacaatcgttatacgagtacaatacgaaggtgacggctcaccatgcaaaataccctttgaaattatggaccttgagaaaagacacgcattaggacgtttaataaccgtgaatcccattgttacagaaaaagactcgccggtaaacatagaagcagagcctccatttggagacagttacattatcataggtgtagaaccaggacagctaaaattaaattggtttaagaaaggcagctctattggccaaatgttcgagaccacaatgagaggagctaaaagaatggcaattctaggcgataccgcatgggacttcggatctttaggtggcgtgtttacttctataggtaaggctttacatcaagtatttggagcaatatatggagcagcttttagcggagtttcgtggaccatgaaaatattaattggcgtaataataacttggataggtatgaatagtaggagtaccagcctgtccgtaagtctcgtacttgtaggagttgtcactctgtatttaggtgccatggttcaggcagatagcggctgtgttgtaagttggaaaaataaggagctaaaatgtggatctgggatttttataacagacaatgttcatacctggacagagcaatataaatttcaacctgaatccccgtctaagttagcatcagctattcaaaaggctcatgaagaagggatctgtgggatacgttccgtcactagactcgagaatttaatgtggaaacaaattacgccggaattaaatcatattctttcagaaaatgaggtaaagttaacaatcatgacaggcgacataaaaggcataatgcaagctgggaaaaggtcattacggccacagccaacggaattaaagtatagctggaaaacttggggtaaggcgaaaatgctatcaaccgaatcccataatcaaacgttcctcatcgatggacctgaaacagctgaatgtcccaatactaacagagcgtggaactcgttagaggttgaagattatggttttggcgtatttactaccaatatatggttaaaactaagggaaaagcaagacgttttctgcgattcaaaattaatgtcagcggcgattaaagacaacagagcagttcatgcagacatgggatattggatagagtcagcgctaaacgacacctggaaaatggaaaaggcttcgtttatagaggtaaaaagttgtcattggccaaaatcacataccctatggtcaaacggagtattggaatcggagatgattatccccaaaaattttgcggggccagtttctcagcataactatcgcccaggttatcacacccaaacagcaggtccgtggcaccttggtaagctagaaatggacttcgacttctgcgaagggactacagtggtcgtcacagaagattgcggtaataggggcccatctctaagaacaaccacagccagtggaaaacttataacagagtggtgttgcagatcatgcacattaccgccattacgctatagaggggaagatggctgttggtacggaatggaaataagacccttaaaggaaaaagaagaaaatttggtcaacagtttggtgacagcagggcatggtcaaatagataattttagtttaggtgtactaggtatggcacttttcttagaagaaatgcttaggacgagagtcggaactaaacacgcaatacttttagttgctgtaagttttgtcacccttattactggtaatatgtcatttagagatttgggacgtgttatggtgatggtaggtgtggctatgactgatgatattggcatgggcgtaacgtatcttgcgctcttggccgcgtttaaagtgagaccaacattcgcggccggtcttctattaagaaaactaacttctaaagaacttatgatggcgacaataggaattacacttttaagccaaagtactataccagaaacaatattagagctcactgatgcattagcattgggaatgatggtcctaaaaattgtgcgaaatatggagaaatatcaactagctgttacaattatgaccataagctgtgttccgaatgcaatgattttgctgaatgcttggaaagtcagttgtacaattctcgccgtagtcagcgtaagtccactactattaacatcctctcaacagaaaactgattggataccacttgccctaacgatcaagggactaaatccaacagcaatctttctcacaacgctttccagaacatcgaaaaagcgctcgtggccgttgaatgaagcagtaatggcggttggtatggtctcaatactagctagttcattactgaaaaacgacattcccatgactggaccgcttgtagccggagggcttttgacagtgtgctacgtactcaccgggagatctgccgatctggaactggagagagcaacagatgttaaatgggaagaccaagctgaaataagcggtagtagccccatcttatcgataactatcagcgaagatggatcaatgagcatcaaaaacgaagaagaggaacaaacactaaccattctaattaggacgggactgttagtaattagtggtgtatttccagtgagtattccaattacggcggctgcctggtacctctgggaggtgaagaaacagcgagcgggagtactgtgggatgtaccgagtcctccacctgttgaaaaagcagaattagaagatggagcatacagaataaaacaaaggggtatattaggctatagtcagattggcgctggtgtatacaaagaagggacattccatactatgtggcacgttactaggggtgcggttctgatgcacagagggaagcggatagaacctagttgggcagacgtaaagaaggatttgattagctacggtggaggatggaaactcgaaggtgaatggaaggaaggcgaagaggtacaggtcttagccttggaaccaggcaaaaatccaagagcggtacaaactaaacctggattatttaagacgaatactggaacaattggggcagtatctcttgatttcagtccgggaacgtccggatccccgattgtagacagaaaaggaaaagttgttggactatatggaaacggagtagtaactcgctctggagcctatgtgagtgcgatagcccaaacagaaaaatcaatcgaagataacccagagatagaagatgatattttccgcaagaaacgcctcacaattatggatcttcatcctggtgctggaaaaacaaaacgatatcttccagctattgttagagaggcgatcaaacgggggctaagaacattaatcctagcacccacaagagtcgttgctgcagagatggaagaagctctacgagggttaccaattcgatatcaaacacccgctataagagcggaacatacaggtagagaaattgtagatcttatgtgtcacgccacattcacaatgcgtctactatcaccagttagggtcccaaattacaacctaataattatggatgaggctcactttacggatcctgcaagtatcgcggcgcgtggttatataagcacaagggtagaaatgggggaagcggccggaatatttatgaccgcgacccctcctggaagcagagacccattccctcaatctaatgcgcctataatggacgaagaacgcgaaataccagaacgatcgtggaactctggacacgaatgggttaccgatttcaaaggcaaaacagtatggtttgtcccaagcattaaagctggtaatgatattgcagcatgcttaaggaaaaacggtaagaaagtaatacagttatcccggaagacattcgattccgagtacgtcaaaacaagggccaatgattgggacttcgttgttacaacagatataagcgaaatgggtgccaacttccgtgcagagcgtgtaattgacccacgacgatgtatgaaacccgtaatactaaccgacggagaagaacgagtcatactagcaggacctatgcctgtaactcatagtagtgcagcccaaagacgtggaagagtcgggcgaaatcctaaaaacgagaatgaccaatacatatacatgggtgaaccacttgaaaacgacgaggattgcgcccactggaaggaagccaagatgttacttgacaacataaacacaccagagggaattatcccttcaatgtttgaaccggaacgagaaaaagtagatgcaattgatggagaatacagattacgtggtgaagcaagaaaaacatttgtagatctaatgagaaggggtgacctaccagtttggctagcatatcgcgttgctgctgaaggaattaactacgcagatagaaggtggtgttttgatggaataaagaacaaccaaatacttgaagaaaacgtagaggtagaaatttggacgaaggagggtgagaggaagaaattgaaaccacgttggttagatgcacgcatctattcggacccactagcattaaaagagttcaaggaatttgctgcaggaaggaaaagtttaacactcaatttaataacagaaatggggaggctcccaactttcatgacccagaaagctaggaatgctcttgataacctagccgtacttcatacagcggaagcaggaggcagagcttataatcacgctctttcagaactccccgaaactctcgagacgctacttttactcaccctactggctacagtaactggtggcatttttctatttctcatgtcaggaaagggaattgggaaaatgacacttggtatgtgttgcatcatcactgcgtctatactgttatggtatgctcaaatccaaccacattggatagccgcatccatcatcttagagtttttcttgatagtattattaataccggaacctgaaaaacaaaggactccgcaagacaaccaattaacgtacgtggtgatagcaatactaaccgtcgttgctgcgacgatggctaatgaaatgggttttctggagaaaaccaagaaagatttgggattagggtctatcacgacacaggagagtgaatcaaatatactagatatagacttgaggcctgctagtgcatggaccttatatgcggtagcaaccacttttattactccaatgttaagacattcgatagaaaatagttcggtaaatgtatcactgactgctatagccaaccaagcaaccgttctcatgggattaggtaaagggtggcctctaagcaaaatggacataggagtaccacttctagcgattgggtgctactctcaagttaatcctataaccctaaccgctgcattattgtcgctggtagcccattatgccataattggacccggattacaagcaaaagcaacaagagaagcacagaaaagggcagcagcagggataatgaaaaaccccacagtggacggtataactgttatagatttggagccaataccgtacgacccaaaatttgagaaacaactaggacaagtgatgttattaatattgtgtgtgactcaggtgcttatgatgcgtacaacctgggcattgtgtgaagccctaacactagccactggccctatctctacactctgggaggggaacccaggacggttttggaacaccacgatagctgtgagcatggcaaatatttttagagggtcatacttggccggtgcaggcttgttatttagtattatgaagaacactacgaacacgcgaagaggaacaggtaacattggggaaacattaggggaaaaatggaaatcacgattaaacgcattgggcaagtccgaatttcaaatatacaaaagaagcggtattcaggaagttgacagaactctcgcaaaggaagggatcaaacgtggggaaaccgatcatcatgcagtatcaaggggcagcgcgaaattacgctggttcgtcgagcgcaatatggtaaccccagaaggaaaagtcgtggacttaggatgcggaaggggtggatggtcttattactgtgggggcttgaaaaacgtccgagaggttaaaggtctaacgaaaggtggaccaggacacgaagaaccaataccaatgtctacttatggttggaacctagtgagattacagagcggtgtagacgtattctttacacctcccgaaaagtgcgataccttgttatgtgacataggagagtcgtcaccaaatcccacaatagaagccgggcgaacattgcgtgtcttaaatctagtagaaaattggttaaataataacacacagttttgtattaaagtactaaatccttatatgccatcagttatagagaaaatggagacacttcaaagaaaatacggtggtgcactcgtaagaaatcctctaagccgaaactcaactcatgagatgtattgggtatcaaacgcaaccggcaatatcgtaagtagtgtcaacatgataagtagaatgctgatcaacagattcactatgaaacataagaaagccacttacgaaccagatgtagacttgggaagcggtacccgcaatataggaatagaatctgagattccgaacctggatatcataggaaaacgaatagagaaaatcaaacaggaacatgaaacctcatggcactatgatcaggatcatccctacaaaacatgggcctatcatggtagttacgaaactaagcaaacgggcagtgcgagttcaatggtcaatggggtggtgcgcctactgaccaagccatgggatgtggtaccaatggtcactcaaatggcgatgacagatacaacaccattcggtcagcaaagagtgttcaaagagaaagtggatacacgtacacaagaaccaaaagaggggaccaaaaagttaatgcgaattacagctgaatggctctggaaagagttaggcaagaagaaaacaccgcgtatgtgtacgagagaggaatttaccaggaaagtacgtagtaacgctgcattaggcgccatttttactgacgaaaataagtggaaatctgcgagagaagcagtagaagattcaaggttctgggagttagtagatagagaaaggaatctccacctcgaggggaaatgtgagacttgcgtatacaatatgatgggaaagcgtgagaagaaattaggtgaatttggaaaagctaaaggcagtcgcgctatatggtacatgtggctaggagctcgctttctagaatttgaagcattagggttccttaatgaagaccattggtttagcagaggaaatagcttatccggggtagagggagagggactgcataggcttggatatatactacgtgatgtatctaagaaagaaggtggtgcgatgtacgctgacgacaccgcggggtgggacacaaggatcacgttagaagatttgaaaaatgaggaaatggttacaaaccatatgaaaggagaacataagaaactagctgaagccgttttcaaattaacttaccaaaacaaagtagtcagggtacagaggccaacccctcgtggtactgttatggacatcatatccagaagagatcaaagaggatctggtcaagtgggaacttacggattaaatactttcacaaacatggaagctcaattgataagacaaatggaaggggaaggcatatttaaatccatacaacatttgacagtcacagaagaaatagcggtacagaattggctagctcgagtcggacgcgaaaggttaagcaggatggccatctctggagatgattgcgtagtaaaacccttagatgaccgatttgcttcagcacttacagcactcaatgatatgggtaaagtcaggaaagatatacaacaatgggaaccatcacgtgggtggaatgactggacccaagtccccttctgcagtcatcattttcatgagcttgtgatgaaggacggccgaatgctcgttgttccatgtagaaatcaagatgaactaattggccgcgctagaatttcacaaggggctggttggagtttgaaagagacagcttgccttggaaaatcatatgcacagatgtggaccttaatgtatttccatcgaagagacctaagattagcagctaatgctatatgttctgccgtaccatcacattgggtcccaacatcacgtactacatggtctatacatgctaaacatgaatggatgacaaccgaagatatgctcgcagtctggaatagagtttggatacaagagaatccgtggatggaggataagacaccagtggaatcgtgggaagaagtgccctacttaggtaaaagagaggaccagtggtgtggctcactcataggtttgacatcaagagcaacctgggctaaaaatattcaaacggctataaaccaagttagaagtttgatagggaatgaagaatataccgactatatgccaagtatgaaacggttcagaagagaggaagaagaggcaggagtcctctggtaa

SEQ ID NO: 22267 - RNA, 9876 nt, synthetic construct
  misc_feature 1..9876: note = derived and/or modified CDS sequence (opt6) from DENV-2__JN819419__SS-prME
  source 1..9876: mol_type = other RNA
acagcgggtgtaatagtaatgttgatacctacagcgatggcatttcacttaacgacccggaatggtgaaccacatatgatagtcggaagacaagaaaaaggtaaaagtcttttattcaaaactgaagatggagtcaatatgtgtacattgatggctattgacttaggagaattatgcgaagatacgattacatacaaatgtccacttttaagacagaatgaaccagaagacattgattgctggtgtaattcgacatccacatgggtaacctatggaacatgtactactactggcgaacatcgaagagagaaaaggtccgttgcacttgtccctcacgtcggtatgggccttgaaactagaacggaaacatggatgtcctccgaaggcgcatggaaacatgtacaacgaattgaaacatggattttaagacatcctggtttcaccatcatggcagcaatattagcatatacaattggaaccacccattttcaacgagcgctgatattcattctactgacagcagttgcgccaagtatgaccatgcggtgcataggaataagcaatagagattttgtagaaggagtaagtggaggatcctgggtcgatatagtgttagaacatggatcctgtgtaacaacaatggctaaaaacaaaccaactttagattttgagctgatcaaaacagaagccaaacaaccagccactctaagaaaatattgcgttgaagcaaaactaacgaacactacaacagaaagtcgatgcccgactcaaggagaaccaagtttaaatgaagaacaggacaaaagatttatatgcaaacactccatggttgatcgtggatggggtaacggatgtggcttgttcggcaaaggcggcatcgttacgtgtgcgatgtttacatgtaagaaaaatatggaaggaaaagtcgttcagcccgaaaatttagaatacacgatcgtcataactccacattctggggaagaacatgcggtaggtaatgatacgggtaaacatggaaaagaaataaaaataacaccacaatcgagcattacagaagcagagctcacaggctatggaactgtcaccatggaatgttctccgcggacagggctagattttaacgaaatggtactactacagatggaagataaagcatggctggtacacagacaatggttcttagatttgccattaccatggcttccaggcgctgatacacaaggatcaaattggattcaaaaagaaactctagtgacattcaaaaatccccatgcgaagaaacaagatgtcgtggtgctaggaagtcaggaaggcgctatgcacacagccttaactggtgctaccgaaatacaaatgtcatcaggaaacttattattcacaggacatcttaaatgcagactacgaatggataaactgcaattgaaagggatgtcttactcaatgtgtaccgggaaattcaaaatagttaaagagatagctgagacgcaacacggtactatcgttataagagttcaatatgagggagacggcagtccttgcaaaattccatttgaaataatggaccttgaaaaacgccatgtcttagggagacttattacagtgaacccaatcgtcaccgagaaagattcaccagtaaatatcgaagctgaacctccgttcggtgattcatatattattatcggtgtcgaacccggtcagttaaaacttaactggttcaagaaaggttcctccatcggacaaatgtttgaaacgactatgcgaggtgcaaaaaggatggctattttaggagacaccgcatgggatttcggctctctaggtggagtttttacgagtattggtaaagcactgcaccaagtatttggagcgatctatggcgccgcattcagtggcgttagctggacaatgaaaattttgattggagtcataattacttggattggcatgaactctcgctcaacaagtttgagtgtcagcttagtcttagtcggtgtagtcacgctatatttaggggcaatggtccaagccgatagcggatgcgtagtgtcatggaaaaacaaagaactaaaatgtgggagtggtatctttataaccgataacgtacatacatggacagaacaatacaaattccaacccgagtctccatcaaaattggcgagcgctatacaaaaagcacatgaggagggcatatgtggtataaggtctgtaacacgacttgagaatctaatgtggaaacagatcactccagagctgaatcatatcctatcagagaatgaagtaaaacttaccataatgacaggcgacatcaaaggcattatgcaagcaggaaaacgtagtttaaggccacaacccaccgaactgaaatatagctggaaaacgtggggtaaagcaaaaatgctcagcactgagtcgcataatcaaacctttctaatcgatggccctgaaacagctgaatgcccaaatacaaatcgcgcctggaatagtttagaagtagaggattatggatttggagtctttacaactaatatatggttgaaacttagggagaaacaagacgtattttgtgattcgaaattgatgagcgcagctatcaaagataatagagcagttcatgctgatatgggatattggatagaatcagcgttgaatgacacatggaaaatggaaaaagcaagttttatcgaagtgaagtcgtgtcattggccgaagtcacatactttatggagcaatggtgtattggaatcggaaatgataatacctaaaaacttcgccggcccggttagccaacacaattacagaccaggataccacacgcaaacagcaggaccatggcatctagggaaattagagatggatttcgacttctgcgaaggaacaactgttgttgtaaccgaagactgtggaaacagaggaccatcacttcgtacaactacggccagtggaaaactaataacagaatggtgctgcagaagttgtacactgccacctctaagatataggggtgaggacggctgctggtatggtatggaaatacggcctttaaaagaaaaagaagaaaatcttgtaaactccttagttaccgctggccatggccagatcgataatttctcattaggcgtattaggcatggctctcttcttagaagaaatgttacgaacacgggtgggaactaaacatgcaattttactcgttgcggtaagttttgtaacattaattactggaaatatgtcgttccgtgacttgggacgcgtaatggttatggtcggcgctactatgacagacgacattggtatgggtgtaacatacttagctttacttgcggcgtttaaagtaagacccaccttcgcagccggtcttttattgagaaaactcacatccaaagaattgatgatggcgacaattggagtcgctttactctctcaatcgacaatacccgaaacaatattagaactaaccgacgcgctagcgctaggtatgatggcattaaaaatcgttaaaaatatggaaaaataccaactagcggtaactatcatggcaattagttgcgtacctaatgctgtaatactacaaaatgcttggaaagttagttgtacaatcctagctgcagtatctgtatctcctctcttattgactagcagccaacaaaaagcagactggattccactggccttaactataaaaggcctaaatcccacagcaatatttttaaccactctctcgagaacgtcaaagaaaagaagttggccactaaatgaagcgataatggcggtcggtatggttagtattctcgcatcaagtttgttgaaaaacgatattccaatgaccggaccattagttgctggtggactacttacggtatgttatgtgctaaccggtagatcagcagatttggaattagaaagagcggctgatgtaaaatgggaagatcaggctgagatatcaggttcatccccaattctatcaataacaattagcgaggatggatccatgtctatcaaaaacgaggaagaagaacaaactttaactatattgatccggactgggttactcgtaatatctggagtatttcctgtatccataccaatcacagctgccgcatggtatctgtgggaggtcaagaaacaaagggccggggtactatgggatgttcctagtcctccaccagttggtaaagcggaactggaagatggtgcataccgaataaaacaaagagggatcttagggtatagtcaaattggtgctggcgtatataaagaaggcacctttcacacgatgtggcatgtcactcgcggcgcagttttaatgcatcgaggaaaaaggatagaacctagctgggccgacgtgaagaaagatttagtgagttacggaggtggctggaaattggaaggggaatggaaggaaggcgaggaagttcaagtcctagctcttgaacccggtaaaaaccctcgcgctgtccaaacaaaaccgggaatcttcaagactaatactgggaacataggtgcggtctctctcgattttagcccaggcacctcaggctcaccaatagttgaccgaaaaggaaaagtcgtcggactctatggcaatggagtagtaacgcgaagcggggcctatgtctcagcaattgcgcagacagagaaatcaattgaggataaccctgaaatagaggacgacatattcaggaagaaacgtttaacgataatggatttacacccaggtgccggaaaaactaaaaggtacctacccgccatagttcgggaggccataaagagaggattaagaaccttaattcttgctcctaccagagtcgtagctgccgaaatggaagaagcactgaggggactacccatccgttatcagacgccagccatacgagccgagcacactggacgcgaaatcgtagatctaatgtgccatgctacattcaccatgcgattattaagtccagtgcgcgttccaaactataatctaataataatggacgaagctcactttacggatcctgctagcattgctgcaagagggtatatctctacgagggtggaaatgggagaagctgcaggtatatttatgactgccactccccctggatctcgagacccctttccacagagcaacgcgcccattatggacgaagaaagagagattcctgaacgaagctggaactcgggacatgaatgggtaacagactttaaaggaaagactgtatggtttgtgccttcgattaaagcaggcaatgatatagctgcatgcttacggaaaaatggaaagaaagtgatacaattatcccgaaaaacgtttgacagcgaatacgtaaaaactagagccaacgactgggactttgtagtaacaacggacatctccgaaatgggtgcaaactttaaagcggaacgtgtgatagatcccagaagatgtatgaagcccgtaatcttaacagacggagaagaacgagtaatcctggcaggaccgatgcccgtaactcacagctcagcagcacagcgcagaggtagaataggaagaaatcccaagaatgagaatgaccaatacatatacatgggtgagccactagagaatgatgaagactgcgcacattggaaagaagcgaaaatgttacttgacaacattaatacaccagaaggaataatacccagcatgttcgaacccgaaagagagaaagtagacgcaattgacggcgaatatagacttagaggggaggctaggaagacctttgtagatctcatgcgtagaggggacttaccagtgtggttggcatacaaagtagcagcagaaggaataaactacgcggatcggaggtggtgcttcgacgggataaagaacaatcaaatactagaagaaaatgtggaggttgaaatttggacaaaggaaggtgagaggaagaaacttaaacctagatggctagatgctagaatatactcagatcctcttgcactaaaagaatttaaggagttcgcggccggccgaaaaagtttaacactaaatttaattactgaaatgggaagactcccgaccttcatgacccaaaaagcgcgcaacgcgcttgataacttagcagtccttcacacggcagaagccggcggcaaggcttataatcatgccctcagtgaacttcctgaaactttagagacattgcttttgctaaccttattagcaacagtgacaggcgggattttcctctttctaatgagtggaaaaggaataggtaaaatgacattggggatgtgctgtataataacagcttcaatactattgtggtacgctcagatccaaccacactggatagccgcttctataattctggaatttttcttaatagtacttttgattccagaaccagaaaagcaaagaacacctcaagacaaccaattaacatatgtagtgattgccatcctaaccgtagtagctgctacaatggcaaatgagatgggttttctagagaagacaaagaaggatctaggcttaggatcaataactactcaggagagcgaatcaaacatattagatatagatctcagaccagcatctgcgtggacactatatgccgtggctacgaccttcgtgaccccaatgctcagacatagcattgaaaactctagtgtcaatgtatctttaaccgctatagcaaaccaagccacagtgctaatgggcctgggaaaaggatggccattaagcaaaatggatataggggctccgttattggcaattggctgctatagccaagttaatccgataacgttaactgcggcgttactattattggttgcacattacgcgataataggtccagggctacaagcgaaagcaacaagagaagcccagaaacgagccgcagcagggataatgaagaaccctaccgtagacggaattactgtgatagatttagaaccaatcccatacgatcctaaattcgagaagcagttaggtcaggttatgttactcatcctatgcgtgacgcaagttttaatgatgagaaccacttgggcactttgtgaagcattaacactagcaacgggacctatcagtacattgtgggaagggaatcccggacggttttggaacacaactatcgcggtctcaatggcaaacatattccggggtagctaccttgccggggcaggcttgttgtttagcataatgaaaaatacgacaaatactcgccggggcacgggcaatattggtgaaaccttaggagagaaatggaagtcgcggctgaacgctctaggaaaatctgagtttcaaatctacaagaaaagtggtatccaggaagttgacagaactttagctaaagagggtataaagagaggtgaaacagaccaccatgcagtgagccgtggaagcgcaaaacttagatggtttgtagagagaaacatggttacccccgaaggtaaagtagtcgacttgggatgtgggaggggtggatggagttattattgcggtggtcttaaaaatgttcgcgaggtaaagggcctaaccaagggagggcccggccatgaagaacctataccgatgtcaacatatggctggaatttagttcgcttacaatcgggagtagacgttttcttcacgccgccggaaaaatgtgataccctgctgtgtgacatcggtgaatcttcacccaatcccaccatagaagcaggcaggactctacgagttctaaatttggtcgaaaattggttaaacaataatacgcaattctgtattaaggtactaaacccatatatgccgagcgtaatagaaaagatggaaactttacagaggaagtacggcggggccttggtgcggaatcccttaagtcgcaactcaacacacgagatgtattgggtttcaaatgcaacaggtaatatagtttcatcagtaaatatgatatcaagaatgttaatcaacaggtttactatgaaacataagaaagcgacatatgaaccagatgtagatttaggctcaggaactaggaacattggtattgaatccgaaataccaaacctagatataataggcaaaagaattgagaaaattaaacaggaacacgaaacatcatggcattatgatcaagatcatccttataaaacctgggcctatcatggaagctatgaaacaaaacaaaccgggagtgcgtcatccatggtgaatggagtagtaagactacttacaaaaccttgggacgttgttccaatggtaacgcaaatggcaatgacagacactacaccttttggacagcaacgcgttttcaaggaaaaggtagatacaaggacgcaggaaccaaaagaaggaactaagaaactaatgaaaataacggctgagtggctttggaaggaactggggaagaagaaaatacctagaatgtgtaccagagaagagttcacaagaaaagtaagaagcaacgctgcccttggggccatattcacggatgaaaataaatggaaatccgccagagaagctgtggaagacggacgtttttgggagctcgtcgatcgagagaggaatctccaccttgaaggaaaatgcgaaacctgtgtatataatatgatgggtaaaagagagaagaaactaggagaatttggaaaagctaaaggatcgcgagcgatctggtatatgtggctgggagcaagatttctagaatttgaggctttagggttcctgaatgaggaccactggtttagtcgtggcaactctcttagcggagttgaaggcgaaggactacaccgactcggttatatcctaagagatgtaagcaagaaagaaggcggcgccatgtatgcagatgacactgcgggatgggatacaagaattactctagaagatctaaagaatgaagaaatggtgacaaatcacatgaaaggagaacataagaaattagccgaagctattttcaagttaacgtaccagaataaggtagtcagagtacaacgtccaacaccaagaggtactgtaatggatattatatcaaggcgagatcaacgagggtcaggacaggttggcacgtatggtctcaacacgtttacgaatatggaagctcagttaataaggcagatggaaggtgaaggaatttttaaatccatacaacatctaacagtaacagaagagattgcggtacagaattggttagcgagagtagggcgagaaagattaacaagaatggcaataagtggtgacgattgtgtagttaaacccatagacgataggttcgcaaacgctctgacggctctcaatgatatgggaaaagtccgaaaagacatacagcaatgggaaccatcacggggatggaacgactggacacaggtacctttttgctctcaccactttcacgagctcgtaatgaaagatggaagagtgttagtggtaccttgtaggaaccaggatgaactaatcggtcgagcaagaatatcccagggcgcaggctggagcctgaaagaaacagcatgtttaggaaagtcctatgcccaaatgtggacactaatgtatttccatagaagagacctaagattagccgcgaatgccatctgttcagccgtaccgtctcattgggtcccgacctcaagaacaacatggtcaatccatgcaaaacacgagtggatgacaacagaagatatgcttgcagtttggaacagggtatggattcaggaaaatccgtggatggaagataaaacgccagtagaatcttgggaggaggttccgtacctaggtaagcgtgaggaccagtggtgcggatctttgattggcttaacaagtcgggcgacctgggccaaaaacattcaaactgcaattaatcaagtacgcagtttgatcggaaatgaagaatatacagattacatgccgtctatgaagagatttagaagagaagaagaagaagcaggcgttctatggtaa

SEQ ID NO: 22268 - RNA, 9876 nt, synthetic construct
  misc_feature 1..9876: note = derived and/or modified CDS sequence (opt6) from DENV-2__FJ850074__SS-prME
  source 1..9876: mol_type = other RNA
acagcgggagtgatagtaatgttaattccaacggtaatggcatttcacttgacaactagaaatggagagccacatatgatagtgggacggcaagaaaaaggaaaatctttactattcaaaacagaagatggtgtaaatatgtgcacacttatggccattgatctcggggaactatgtgaagatacaataacgtataaatgcccattgttaaggcaaaatgaaccagaagacatagattgctggtgcaattcaaccagcacttgggttacttacgggacttgcactacaacaggagaacacagaagagagaaaagatcagttgcgctagtacctcacgtagggatgggactggagacacgaactgaaacgtggatgtcaagtgaaggagcatggaaacatgtgcaaaggatagaaacatggattctgaggcacccaggcttcaccatgatggctgccattctagcgtataccataggaacaacacatttccaaagggcgttgattttcatattactaactgcggtcgcgccaagcatgactatgaggtgcattgggataagcaatcgagattttgtggaaggagtaagcgggggtagttgggtagatatagtattagaacatgggtcgtgtgtcacaacaatggctaaaaataaacctaccttagattttgaactcataaaaaccgaagcaaaacaacctgccacgttaaggaagtattgtgttgaagctaaattaacaaacactactaccgagtcaagatgcccgacacagggggaacccagcctcaacgaagaacaagataaaaggtttatatgtaagcatagtatggtagatcgtgggtggggaaacggctgtggtctcttcggaaagggaggaattgtaacgtgtgctatgtttacgtgcaagaaaaacatggaaggtaaagtcgttcagcctgaaaatctagaatacactatcgtgataacaccacattctggagaagaacacgcagtaggaaacgatacaggcaaacatggtaaagaaataaaaattactccacaaagctccattacagaagctgaattaacaggttatggaacagtcaccatggaatgttcgccaaggacaggattagattttaatgaaatggttctcttacaaatggaagataaggcatggcttgtccatcgccagtggtttctggatctccctttgccatggctcccaggggctgatactcaaggctcaaattggatacaaaaagaaacactcgtcacttttaagaatccacacgccaagaaacaggatgttgtagtgttagggagccaagaaggggcgatgcacacggcactaacaggtgcaacggaaatccaaatgtctagcggtaacctcttatttacaggacacttaaagtgcagactcagaatggataaactccaacttaaaggaatgagttactctatgtgtacgggaaagttcaagatcgtgaaagaaatagcagagacacagcatggcacaatagtgatacgtgtgcaatacgaaggtgatggcagtccttgtaaaatcccattcgagataatggatttagaaaagagacacgtgctaggtcggctaataacggtcaatccaatagtaacggaaaaagatagtccggtcaacatagaagctgaacccccatttggtgacagttatattataataggtgtagaacccgggcaacttaagttaaactggtttaagaagggaagctctattggacaaatgtttgaaactaccatgagaggagcgaaaaggatggcgatactaggagatactgcatgggattttgggagtttgggaggtgtattcacctcaataggaaaagcattacatcaggtatttggagcaatatacggtgctgctttctcgggagtgagttggacaatgaaaattttaattggagttattataacttggattgggatgaatagtagaagcacatccctgagtgttagcttggtattagtcggagtagtaactctctacctaggggctatggtgcaagccgattccggctgtgtagtcagttggaaaaataaagaattgaaatgtggttcaggtatatttattacagataacgtccacacctggacagaacagtataaatttcagcctgaaagccccagcaaacttgcaagtgcaatacaaaaagctcatgaagaaggcatatgtggcatacgtagtgtcacaagacttgaaaatctaatgtggaaacagataacacccgaacttaatcatattctctccgaaaacgaagttaaattaacaatcatgactggggacataaaaggtataatgcaagctggtaaacgctctctcagacctcaacctacagaattaaaatattcatggaaaacctggggcaaggccaagatgcttcccacggaatcacacaaccaaactttcttaattgatgggccagaaactgcggaatgccctaatacaaaccgagcgtggaatagtctagaagtggaagactatgggtttggagtttttacaacaaatatttggctaaaactaagagagaagcaagacgtattttgtgacagcaagttaatgagtgcagctatcaaagataatcgagctgttcacgcggatatgggttactggatagaatcagcgctaaatgatacttggaaaatggaaaaggcatcattcattgaagttaaatcctgtcactggccaaaatctcacactctttggtctaatggtgtacttgaatcagaaatgataatcccgaagaattttgcaggcccagtttcccaacataattacagaccaggataccatacccagacagccggtccatggcacctgggcaaactggagatggatttcgatttttgcgaaggaacaactgtagttgtaacggaagattgcggaaatagaggtccttcattgagaacaacaacagctagtgggaaacttataactgaatggtgttgcaggagctgtactctacccccactgagatacagaggggaagatggatgctggtacggaatggaaatacgcccactgaaggaaaaagaagaaaatttagtaaactccctagtcacagcaggtcacggacaaattgacaacttttcattaggagtgttaggcatggctttatttttagaagaaatgttaagaactcgggtaggaacaaagcatgcgatactcctagttgccgttagctttgtaacattaatcacgggcaacatgtcttttcgagatctcggacgcgtaatggtaatggttggagccactatgactgatgatataggtatgggagttacctacctagctttacttgctgcattcaaagtgagaccaacctttgccgcaggacttctactgaggaaattaacatccaaagagctgatgatggctacgataggggtagcccttctcagccaaagcaccataccagaaactatacttgaactaactgacgccctagcacttgggatgatggctctgaagattgttaaaaacatggaaaagtatcaactagcagttactataatggctattagttgcgttccaaacgcagtgatactacaaaacgcttggaaggttagctgtaccattctagcagcagtttctgtatccccacttcttctaacatccagccagcaaaaagcagattggataccacttgcactcacgataaaaggtctaaatccaacggctattttcttgactacactctctcgaacaagtaagaaacgatcttggccacttaatgaagcaattatggccgttggtatggtatcaatacttgcctcttctttactgaaaaatgatattccaatgacagggccacttgtagctggtggattattaactgtttgttatgtgttgacaggacgttctgcagatttggagttggaacgagcggctgatgtgaaatgggaagatcaagctgaaatatccggctcaagtccgatcttgtcgattacgatatcggaagatggctcaatgtctatcaaaaacgaggaagaggaacaaactttaacaatccttatacgaacagggcttctagtaatatctggtgtgtttccggtctcaataccaataactgccgccgcatggtacctatgggaagtcaagaaacagcgcgcaggggtattgtgggatgtcccttcgccacccccagtaggaaaagctgagctcgaagatggagcatatagaatcaaacaaagaggaatacttggctattcacaaataggcgctggagtatataaggagggaacattccacacaatgtggcatgtgactagaggcgcagtattaatgcacagaggcaaaaggatcgaaccctcctgggccgacgttaagaaagacttagtttcatacggtggaggttggaagctcgagggagaatggaaagaaggtgaagaggtgcaagtgttagccctggaaccaggaaagaaccctagagcagtacaaactaaaccgggtatatttaagacaaatacaggaacaattggagccgtatcgctcgactttagcccaggtacatctgggtcaccgatagtagacaggaagggcaaagtagtaggtctctacggcaatggagttgtaacacgatcaggagcgtacgtgtcagctatagcgcaaaccgaaaaatcaatagaagataaccccgaaatagaagatgacatatttagaaagaaacgattgactatcatggatttgcatcctggcgctggaaaaacaaagcggtatctccctgctatagttagagaagcgataaagagggggttacgaacattaatattagcacccacacgggtcgtagctgcagaaatggaagaagctcttagaggactacccattcgatatcagacgccagctatccgggccgaacatactggcagagaaattgtagatttgatgtgccacgcaacattcaccatgagattgctttcaccagttcgtgtaccaaattacaatcttataattatggacgaggctcacttcactgatcctgcgtcaatagctgcaagaggatatataagtacaagagttgaaatgggtgaagccgcgggaatatttatgacagcgacaccgcccggatctagagaccctttccctcaatcaaatgctcctataatggacgaagaacgtgaaataccggaacgatcttggaacagcggacatgagtgggtaacagattttaagggaaagacagtctggtttgtaccttctatcaaagctggcaacgacattgcggcttgccttaggaaaaacggcaaaaaggtgatacaactttctagaaaaacgttcgattctgagtacgttaagacgcgcagcaatgattgggatttcgtcgtaaccacggacatatcagagatgggcgccaattttaaagctgagagggttatcgatccgaggcgctgtatgaaaccagtaatattaactgatggagaagaaagagtgatattggcgggaccaatgcccgttacacactcatccgcagcacaacgtagggggagaatcggcagaaaccccaaaaatgaaaatgaccaatatatttacatgggtgagccgcttgaaaacgatgaggattgcgcacattggaaagaggcaaaaatgctacttgataacataaatacgccggaaggtataattccaagtatgtttgaaccagaaagggaaaaagttgacgcaattgatggggaatatcgacttagaggggaggctagaaaaacatttgtcgacttgatgagacgaggtgatcttcctgtatggcttgcatataaagtagcagctgaaggcattaattatgctgatcgtcggtggtgttttgacggaatcaaaaataatcaaatattagaagagaatgtcgaggtagaaatttggacaaaagaaggagaacgcaagaaacttaagccacgatggttggacgcaagaatatactcagacccattagccctcaaagagttcaaggaatttgcagcgggacgaaaaagccttacgttaaatttgataactgaaatggggcgcttgccaacatttatgacgcaaaaggcgagaaatgcattagataacctagcagtattacatacagcagaagcaggaggaaaggcttataaccatgctctaagcgaactaccggaaacattagaaactcttcttcttctgacactacttgcaactgtgacaggcggtatttttctttttctaatgtctggcaagggaataggtaagatgacactaggtatgtgttgtataatcacggcctcaatcttattatggtacgcccagatacaacctcattggatcgcggcgagcataattctcgagttctttttaatagtactcttgataccagaacccgaaaaacaaagaactccccaagataaccagctcacctatgtcgtaatagcaattctgacggtagtagctgccaccatggcaaatgagatgggatttttagagaaaactaagaaagacttaggtcttggatctataactacacaggaaagtgaatcaaatatattagacatcgatttaagacctgcgtctgcgtggaccttgtacgcagttgcaactacatttgttacacctatgttaaggcattcaattgaaaacagctcagttaatgtatcattaactgcaatagcgaatcaggcaacagtattgatggggttaggcaagggttggccattatcaaagatggacattggggtaccgctgctcgcaataggatgctattcccaagtaaaccctattacgttaacagcagccctattgcttctagtagctcactacgctataattggtccgggactacaagcaaaggcgaccagggaggcgcagaaaagagctgcagcaggtataatgaaaaatccaactgttgacgggataacagtgatcgatcttgaaccaatcccttacgacccaaaattcgaaaaacaattaggccaagtaatgttattgatactatgtgtaacccaggtcctaatgatgagaacaacgtgggcactatgtgaggcattaactcttgcaacgggaccgatttccactttatgggaaggtaatccgggtcggttctggaatacgacgattgcagtaagcatggcaaatatattccggggttcatatttagccggggccggattattgttcagtatcatgaaaaacaccacgaataccagacgcgggactggcaacatcggggaaacacttggagagaaatggaagtcgagacttaatgcattaggtaaaagtgagtttcaaatatataagaagtctggcattcaagaggtagaccgaacattagctaaggaaggcataaagagaggggagactgatcatcatgcagtaagccgaggttctgcaaagttaagatggtttgttgagagaaacatggttacgccggaaggcaaagtagtagatcttggttgtggtagaggaggatggagctattactgcgggggactaaagaacgtgagggaagtaaaaggcctaacgaaagggggtcctggtcatgaagaaccaattcccatgtcgacgtatggatggaatcttgttcgtcttcaatcgggagtagatgtattctttactcctcccgaaaaatgtgacacgctactatgtgacataggtgaaagcagtcctaatcctactatagaggctggacggacactgcgagtattgaatttagtcgaaaattggttgaataataatacacaattctgtattaaagtgttaaacccttatatgccatctgtaatagaaaagatggaaacccttcagagaaagtatggaggcgccttagtacggaatccgctgagcagaaatagtacccacgaaatgtattgggtttcaaacgctacgggaaacatcgtatcaagtgttaatatgataagtcgtatgctaattaacagattcaccatgaaacataagaaagctacctacgagccagatgtagatcttggatcagggactaggaacatagggatcgaaagcgagatacctaatctagacataatagggaaaaggatcgagaaaattaagcaggaacatgaaacatcatggcattacgaccaagaccatccatacaaaacttgggcctatcatggatcctacgaaacaaaacaaacaggctcggcttcctcaatggtcaatggagttgtcaggctgttaacaaaaccttgggatgtagtacccatggtgacacaaatggctatgacggataccactccttttggacaacaacgggtctttaaggaaaaagtagacacaagaacacaagaaccaaaagaagggaccaagaaacttatgaaaataacagcagaatggctatggaaagaactagggaaaaagaaaacaccacggatgtgtacaagagaagagttcacccgtaaagtgagaagcaacgcagcactaggtgcaatctttaccgatgagaataaatggaaatcagctagagaggcggttgaagatggacgcttctgggagctagttgaccgggaaagaaatttgcatttggaaggcaaatgcgaaacatgtgtctataacatgatgggaaaacgagagaagaaattgggggagttcggaaaagcaaaaggaagtcgggcgatatggtacatgtggctcggtgcgaggtttttggagttcgaagcattgggatttctgaacgaggaccactggttcagccggggaaacagtctcagcggagttgaaggcgaaggcttacaccgcctagggtatatacttagagatgtatcaaagaaagaaggaggagctatgtatgctgatgacaccgcgggatgggatacaaggataaccttagaggaccttaaaaacgaggagatggtaacaaatcatatgaaaggggaacacaagaaattagccgaggctattttcaaattaacgtatcaaaataaagtcgtacgagtgcaacgcccgacgccgagaggaaccgttatggacatcatttctcgaagagatcagcggggaagtggtcaagtcggaacatatggcctcaatacgtttaccaacatggaagcacaactgataagacaaatggaaggtgagggtatattcaaaagcattcaacatcttacagtaacggaggaaatagcagtccaaaattggctagctcgcgtaggacgagagaggttgactcgaatggctatctcaggcgatgattgtgtagtaaaaccaatagacgacaggtttgcaaatgccttgacggctcttaacgatatgggcaaagttcggaaagacatccaacaatgggagccatctcgtggatggaatgactggacacaagtaccgttctgttcgcaccattttcacgaacttgtcatgaaagacgggagggtcctagtggttccatgcaggaatcaagacgagctgatagggagggcacgtattagtcagggggctggttggagcttgaaagagacagcatgtttaggcaaatcatacgctcaaatgtggactctcatgtattttcatagacgtgacttacgtcttgcagcaaatgccatatgttcagctgtcccatctcactgggtacccacaagcagaacaacatggtctatccacgccaaacatgaatggatgacaacagaagacatgctggctgtatggaatagagtatggatacaggaaaacccgtggatggaagataagaccccagtggaatcatgggaggaagtgccatatttaggaaagcgggaagatcaatggtgtgggagcttgataggtttaacgtccagagctacatgggctaaaaacattcaaaccgccattaaccaagtgagatctctaattggaaatgaagaatatacggattatatgccatctatgaaaaggtttagaagagaggaagaggaagctggtgtattatggtag

SEQ ID NO: 22269 - RNA, 9876 nt, synthetic construct
  misc_feature 1..9876: note = derived and/or modified CDS sequence (opt6) from DENV-2__FJ850076__SS-prME
  source 1..9876: mol_type = other RNA
accgcaggagcaatagtgatgctaattccaaccgtaatggcatttcatctgacaacacgaaacggtgaaccacatatgattgtaggtaggcaagaaaaaggtaaatcacttttgtttaaaaccgaagacggtgttaatatgtgcacattaatggcaatagatcttggggaattatgtgaagatacaattacctacaaatgtcccctattaagacagaatgaaccagaagatattgattgttggtgtaatagtacttctacgtgggtcacatatggaacatgtacaacgacgggagaacacagaagagagaaaagatccgtggcattagtaccgcacgtcggtatgggtttagaaactagaacagaaacgtggatgagtagtgaaggagcatggaaacatgtacaaaggatagaaacatggatattgcgccaccccgggtttacgatgatggccgcaatattggcgtataccataggaacaacacattttcaacgggcactaatttttatactgctaactgctgtcgctccctctatgacaatgagatgcattgggatttcaaatagggacttcgttgaaggagtatctgggggatcatgggtagacatcgtgcttgaacatggatcttgtgtgaccacaatggctaaaaacaaacctaccctagattttgaactcatcaaaacagaagcgaaacaaccagctacacttcgcaaatattgcgttgaagcaaaactaacgaacaccacaactgaatcaaggtgtcccacacaaggagagccctctttaaatgaagaacaagataaaaggtttatttgcaaacattcaatggtagatcgtggatggggaaatggttgcggcttattcgggaaaggaggtatagtaacatgtgcaatgttcacatgtaaaaagaatatggagggtaaggtagtacaacctgaaaacctagaatataccatagttattactcctcattcaggagaagaacacgcagtaggaaacgacacgggaaaacacgggaaagagattaaaatcacaccacaatcatcaattactgaggctgagcttacaggatatggaacagttactatggaatgttcacccagaacagggctggatttcaatgaaatggtactactacagatggaagataaagcatggctagtacacagacagtggttccttgacctaccactgccatggttacccggggcagatactcaaggctctaattggattcagaaagaaaccttagtcaccttcaaaaatccgcatgcaaagaaacaagatgtagtggttctcggttcacaggagggcgctatgcatacagctttaacaggagcaacagaaatacaaatgagttcgggcaacttgctattcacaggacacttgaaatgcaggctacgaatggataaattacaactcaaaggaatgagttattcgatgtgcacaggtaaattcaaaatcgtgaaagaaatcgctgagacccaacatgggaccatagtgataagagtacaatatgaaggggacggttcaccttgtaagataccattcgagattatggacctagagaaaagacacgttttaggtagattaataacagttaatcctattgtaactgaaaaggattcaccagtaaatatcgaagctgaaccaccatttggcgattcctatattataatcggagttgaaccaggacaattgaaactgaattggttcaagaaaggatcaagtataggccaaatgttcgaaacaacgatgcgaggtgcaaaacgaatggcaatactaggtgatacagcgtgggactttgggagtttaggaggcgtattcacgagtatcggcaaggcactacaccaagtctttggggccatttatggcgcagccttttctggcgtctcatggacgatgaaaatactgattggcgtaataataacctggataggaatgaacagccgttcaacgtcactatcggtaagtctagtactggtaggggtagttacactgtacttaggtgcaatggtacaggcagattcaggttgcgtagtaagttggaaaaacaaagagttaaagtgcggctcaggcattttcataaccgataacgttcatacatggacagaacaatataagtttcaacccgaatcaccatctaaattggcatcagcaatacaaaaagcacatgaggagggcatatgcggaataagaagtgtaactagattagaaaatctgatgtggaaacagataacacctgaactaaatcacatattatccgaaaacgaagtaaagttaaccattatgacaggtgacattaaaggtataatgcaggcaggaaaaagaagtttacggccccagccaacggaattgaaatactcatggaagacttggggcaaagcaaaaatgctgccaacggaaagccacaaccaaacattcctaatcgacggcccggagaccgcagaatgcccaaatacgaatcgtgcctggaactcacttgaagtagaagattatggatttggtgtctttactactaacatttggttaaaactccgcgaaaaacaagacgttttctgtgattcaaaattgatgtctgcagccatcaaggataatagagctgtacacgctgacatgggttactggattgaatcagcattaaatgatacatggaaaatggaaaaagcctcatttattgaggtaaaatcctgtcactggcccaaatcgcatacattatggagtaatggagttttagaatccgaaatgataatacccaaaaacttcgctgggcctgtatctcaacacaattacagaccaggctaccatacacaaacagcaggaccatggcatctgggaaagctggaaatggattttgatttttgcgaagggactactgtcgtagttaccgaagactgtggaaatagggggccttctcttaggacaactaccgcatcaggtaagttaattactgaatggtgttgccgatcatgcacattacccccactcagatatcggggcgaagatggctgttggtatggaatggagattaggcctctgaaagagaaagaggagaatttagttaatagcctggttaccgcaggacacggtcaaatcgataattttagtcttggagttttagggatggctttatttcttgaagagatgttaagaacaagagtcgggacgaagcatgctattctattagttgctgtatcgtttgtaacgctcataacgggtaacatgtcatttagagacctgggtcgagtgatggttatggttggtgccacaatgacagatgatataggtatgggtgttacgtacttagccttattggccgccttcaaagtacgcccaacatttgctgccgggttacttcttagaaagttaacgtcaaaggaactgatgatggccacaattggagtagcattactcagccaaagcactatacctgagacaattctcgaactgacggacgcactcgctctcggtatgatggcacttaaaattgtaaagaacatggaaaagtatcaactggccgttacaataatggcgataagctgtgtacctaatgcggtaatacttcagaacgcctggaaggtttcatgtaccatcttggcagctgtatcagtaagtccgttgttactaacaagcagtcaacaaaaagctgactggattccattagccttaacaataaaggggctaaatccaacggccatctttctcacgacactgagtagaacgagcaagaaaagatcgtggccacttaacgaagcaatcatggcagtgggaatggtatccatcttagctagtagtttactcaaaaacgacgttcccatgacaggaccactggtagcgggcggtttactaacagtatgttatgtcttaactggacgctcagcagacctagagctggaacgtgctgccgatgtaaaatgggaggatcaagctgaaatttcgggaagtagtccgatattatccatcacaatttcggaagacggatcaatgtccatcaaaaatgaagaggaagaacaaacactaaccattctgattaggacgggattgctagtaataagcggagtatttccagttagtatccctataactgcggccgcatggtacttgtgggaagttaagaagcaaagagccggtgtactatgggatgtgcccagtcctcctcctgtcggcaaagctgagttggaagatggcgcgtatagaattaaacaaagggggatactcggctacagccaaataggcgcgggagtgtacaaagaaggtacattccatacaatgtggcatgttactcgcggtgcagttttaatgcatagggggaaacgaatagaaccatcctgggctgacgtaaagaaggacctggtcagctatggtggagggtggaaactagaaggagaatggaaagagggcgaagaggtccaagtgctggcactcgagcccggcaaaaacccccgtgcagtgcagacaaaaccaggtattttcaaaacaaacacaggaacaattggtgccgtaagtctcgactttagccctggaacatctggcagtccgatagtagataggaaaggcaaagtagtaggactatatggaaatggtgtggtcacacgatcgggtgcctatgtaagtgcaatcgcacagacggaaaaatcaatagaagacaatcccgagatagaagacgacatatttaggaagaaacgccttaccatcatggatttgcacccaggtgcaggaaaaactaaaagatatctgccagcgattgtccgagaagccattaaaaggggactgcgtacattgatactcgcccccactagagttgtcgcagctgaaatggaagaagcccttcgcgggttgcctatacgttaccaaactccagcaattcgcgccgaacatacaggacgagaaatcgttgacttaatgtgtcatgcaacatttacaatgcgcctattaagcccagtacgtgtaccgaactataatttgataatcatggacgaagcgcactttacagatccagcatctatagcagcaagggggtatatatctacacgagtagaaatgggcgaggcagcaggaatattcatgacggcaacacccccgggctcacgtgacccctttccccaatctaatgctccaataatggatgaagaacgtgagatccccgaaagaagttggaactctggccacgaatgggtaacggattttaagggaaaaacagtatggtttgttcctagcatcaaagcaggcaatgacatagcagcttgtctaaggaagaatggcaagaaggtaatccaactaagcagaaagacattcgactcagaatatgtaaagacaaggtcgaatgattgggattttgtagtcacaacggatatttcagaaatgggcgcaaattttaaagcagaaagggttatagaccctcggcgatgtatgaagcccgtaatattaacagacggggaagaacgagtgattttagcaggcccaatgccagtaacacatagctcggcagcccaacgaagggggagaattggtcgaaacccgaaaaatgagaatgaccagtatatctatatgggagaaccattagagaatgacgaagattgtgcccattggaaagaagcaaagatgctattggataatatcaacactccggaaggaataattccgagtatgtttgaaccagaaagagaaaaggtggatgcaatcgacggcgaataccgattgagaggcgaagcgagaaaaactttcgttgatcttatgcgaagaggagatctaccagtatggttagcatacaaggtagcagcggagggaataaattatgctgatcgtcgttggtgtttcgatggaatcaaaaacaatcaaatattagaagaaaacgttgaagtcgaaatctggacaaaggagggcgagaggaagaaactaaagcctcgttggttagatgcacggatctactcagacccattggccttgaaagaatttaaagagtttgcagctgggcgaaaatcactcactcttaatctaataacagagatgggacgcttaccaacattcatgacacaaaaagctagaaacgcgctggacaatctggcagtactacacacagccgaggccggtgggaaggcttacaaccatgctttgtcagaattacccgagactctcgaaacgttactgttattaaccttattagcaactgtaacaggagggatatttttgtttcttatgtcaggaaagggaatcggtaagatgaccctaggcatgtgttgcatcataaccgcatccatattgctctggtatgcacaaatacaaccccactggatcgctgcaagcataatactagagttctttttgatagtattgctcataccagagccggaaaaacaacgaacaccgcaagataaccagttaacgtatgtcgtaatagccatattgacagtagtagcagcaacaatggctaatgaaatgggctttttggagaaaaccaagaaagacttgggactaggctccataacaactcaggagtcagaatccaatatcttagacatagacttgcgcccagcaagcgcatggacgctatacgctgtcgcaaccacattcgttacaccaatgttaaggcacagcatagaaaactccagcgtcaacgtaagtttgaccgcaatcgctaatcaagccacggttctcatgggattgggaaaaggctggcccctatcaaagatggatattggtgtaccgctattagcaataggctgttacagtcaagttaatccaattacgttaacagcagctttgttacttctcgttgcccattatgctataatcggtccaggtcttcaagccaaggctacaagagaagcacagaaacgagcggctgcaggaataatgaaaaaccccacggtagacggtatcacagtaatcgacctggaacctataccatatgatcccaaatttgaaaaacaactaggacaagtaatgcttctcatattgtgtgtgacccaggttttgatgatgagaacaacctgggcattgtgtgaggcgttgactctagcaacaggtcccatatccacactttgggaagggaacccaggtagattttggaatacgactatagccgtaagtatggctaatatttttcgggggagttacttagccggagctggtctcttgttttctataatgaaaaatacgacaaatactagaagaggaaccggaaacattggagaaaccttgggggaaaagtggaaaagtcgccttaatgccttgggaaaatcagagtttcagatttataagaaaagtggcatacaagaagttgaccgtacactagcaaaggagggcataaagcgcggcgagacagaccaccacgctgttagtcgaggctcagcaaaactacgttggtttgtagaacgaaacatggtgactccagaagggaaagtagtggacctaggttgcgggaggggcggatggtcgtactattgtggagggctcaagaatgtaagggaagtaaaaggattaacaaagggaggtccaggtcatgaagaaccgataccgatgagcacgtacggatggaatttagtccgcctccaaagcggtgtcgacgtgttctttaccccaccagaaaaatgtgatacgctactatgcgacataggggaatcatcgcctaatccaaccatagaagcaggtagaactttaagggtactgaacctagtggaaaattggttaaataacaacacacaattctgcataaaagtattaaacccatacatgcctagtgtaatcgagaagatggaaactttacaaagaaaatatggaggagccttagttcgtaaccctttatcccggaactctacacatgagatgtattgggtgtctaatgccacaggaaatatcgtttcttcggtaaacatgataagtagaatgctaatcaacagatttaccatgaagcataagaaagcaacatatgaaccggacgtagatttaggctcaggtacaagaaatattgggattgaatctgaaattccgaatttggatataataggtaaaagaatcgaaaagatcaaacaggaacatgagacgagctggcattatgatcaagatcacccatacaaaacatgggcatatcacggttcttatgaaacaaaacagaccgggagtgcctccagtatggttaatggcgtagtacgcctattaacaaagccatgggatgtagttccaatggttacccagatggcgatgacagatacaactccattcgggcaacagcgagtgttcaaggaaaaagtagatactcgaactcaagagcccaaagaaggcactaagaaattaatgaaaataacggcagagtggctatggaaagagctgggtaagaagaaaactcctaggatgtgtacaagggaggagtttacgcgtaaagtcaggagtaacgccgcactaggagcaattttcaccgatgagaacaagtggaagtccgctcgtgaagccgttgaggacgggcgattttgggagttagttgatagagaacgaaatcttcatctagagggcaagtgtgagacatgtgtatataacatgatgggtaagagagagaagaaattgggtgagttcggtaaagcaaaagggagcagggctatttggtacatgtggctaggtgcaaggttcctagagtttgaagcgcttggatttctaaatgaggaccactggtttagccgaggtaatagtctaagcggtgtggaaggagaggggctacaccgattagggtatatactaagagatgtatctaaaaaggaaggaggggccatgtacgcagacgacactgcagggtgggacacaaggataacattagaggaccttaaaaacgaagaaatggtgactaatcacatgaagggtgaacacaagaaactagctgaggccattttcaaactaacttatcaaaacaaagtcgtaagagtccagagaccaactccacgcggtacagttatggacataatctctaggagagatcagagaggatcaggtcaggttggaacgtatggattgaacactttcacgaatatggaagcccagttaataaggcaaatggaaggagaggggatatttaaatccatccagcatttaacagtgacagaggaaatcgctgtgcagaattggctggctagagttggccgagagaggttgacccgaatggccatttcaggtgatgattgtgttgtcaagcctattgatgatagattcgcaaatgctctaactgccctaaacgatatgggaaaggtaaggaaagacattcaacaatgggagccgagtagagggtggaacgactggacgcaagttccattttgttctcatcatttccatgaattagtcatgaaagatggaagagtgctagtcgtaccctgtagaaatcaagatgaactgattggcagagcgaggatatcccagggagcaggatggtccttgaaggaaacagcatgtctaggtaaatcttacgcacagatgtggacactaatgtacttccatagacgtgatttacgcttagcagcaaatgcaatatgcagtgcagtaccatcacactgggttcccacgtccagaactacctggtcgatacacgcaaaacatgaatggatgactacagaagatatgctagcggtgtggaaccgagtgtggatccaagaaaacccatggatggaagataagacaccagtcgaatcttgggaagaggtaccttacttaggcaagagagaagatcaatggtgtggatcactaattggattaacaagtcgtgccacgtgggccaaaaacattcagacggctataaaccaggtaagatctttaataggaaatgaagaatatacagattacatgccttccatgaaaagatttcgtagagaagaggaagaagcgggagttttatggtaa

SEQ ID NO: 22270 - RNA, 9876 nt, synthetic construct
  misc_feature 1..9876: note = derived and/or modified CDS sequence (opt6) from DENV-2__GQ868640__SS-prME
  source 1..9876: mol_type = other RNA
acagcaggagcgatagtaatgctaattccgactgtaatggcctttcatctcacgacaagaaacggggaaccacatatgatcgtaggaagacaagaaaaaggaaaaagcctgttgtttaaaacagaggacggagtaaatatgtgtacactgatggctattgatttaggtgaactctgtgaagatacgataacgtacaaatgtccattactaagacagaatgaacccgaggatatagattgttggtgcaatagtacttcaacatgggtaacatacgggacgtgcactactactggagagcaccggagagaaaaacgctctgtagcactcgtacctcatgttggaatgggacttgaaacgcgaactgaaacctggatgagttcagaaggcgcttggaaacatgtccaaagaattgaaacatggatattacgacatccgggattcactatgatggcggctattttagcatatactattggtacgacccatttccagagggctctgatatttatcctactcacagccgtagcaccctctatgaccatgagatgtataggcataagtaatcgtgattttgtagaaggagtcagtggagggtcttgggtagacatagtacttgaacatggatcctgcgtaacaacaatggcaaaaaataaaccaacattagactttgagttaatcaaaactgaggctaaacaacctgccacattaagaaaatattgcgtagaggcgaaactcacaaatacgacgactgaaagtcgatgcccaacacagggtgaaccatcactaaacgaggaacaagacaaacgattcatttgtaaacactcaatggtggatagaggatgggggaatggttgtggcctcttcggaaaagggggaatagtaacgtgtgccatgttcacgtgcaaaaaaaacatggagggtaaagtagtacagcctgaaaatctagaatacacaatcgtcataacccctcactcaggtgaagaacatgcagttgggaatgacactggaaaacatggaaaagagataaagataacaccccaaagttcgattaccgaagcagagctaacggggtacgggactgttacaatggaatgctccccgcgaactggattagatttcaacgaaatggtattgttacaaatggaagacaaagcatggcttgtccaccgacaatggtttttggacttacctctaccttggttacccggagcagatacacaaggtagtaattggatacagaaagagacgctggtcacattcaaaaatccccacgcgaaaaagcaagacgtagtagttctaggtagccaagagggagcaatgcacaccgcgttaacaggtgcgaccgaaattcaaatgagtagtgggaatttgttgttcacaggccatttgaaatgcaggcttcgaatggataaactccaacttaaaggaatgagttactcaatgtgcacaggcaagttcaagattgtaaaagaaatagctgaaactcaacatggaacaatagtaattagggtacaatacgaaggagatggttctccatgtaaaatcccatttgagataatggacttagaaaaaagacacgtcttaggacgtcttatcaccgtaaacccaatagtaacggaaaaagattcacctgtcaacatagaagccgagccaccttttggagactcttatatcattattggtgtagagcctggacaattaaaattaaactggttcaagaaaggttcaagtataggccaaatgttcgaaactaccatgagaggtgccaaacgcatggcgattctaggtgacactgcatgggattttggatcactgggtggtgtattcaccagcatagggaaggctttacatcaggtttttggcgcaatatacggagcagcatttagtggtgtcagttggaccatgaaaatactcattggagtaatcatcacatggatagggatgaattcaagaagcacatcgttatctgtcagtttagtactagtaggggtcgtgactttgtacttaggcgcaatggttcaagctgattctggctgtgtagtttcttggaagaacaaagaacttaagtgcggaagcggcatattcataacagacaatgttcacacatggaccgagcaatacaaatttcaaccagagtctccgagcaaactcgctagtgccatacaaaaagcacacgaggaagggatttgtggaatacggagtgttaccaggttggaaaacttaatgtggaaacaaataactcctgaattaaatcatattcttagtgagaatgaggtaaaactaacgataatgacaggagatattaaaggtataatgcaggcgggaaagagaagtctacgaccacaacctactgaactaaaatatagctggaaaacttggggaaaagccaaaatgttacccaccgagtcacataaccaaacatttctaatcgatggcccggaaaccgctgaatgccctaataccaatagggcgtggaattcgttggaagtggaagattatggattcggagtcttcacaaccaacatctggctcaagttaagagagaaacaagatgtattttgcgactcaaaactaatgtcagccgctataaaagacaacagagccgtccatgcagatatgggatactggattgagagtgcccttaacgacacatggaaaatggaaaaagcatctttcattgaagttaagtcctgtcactggcctaaatcccataccctatggtctaatggcgtactagaatcagaaatgataatcccaaaaaatttcgcagggcctgtctctcaacataactaccgccctggatatcacacgcaaactgctggtccctggcatctgggaaaactagaaatggattttgacttttgtgaaggaacgactgttgtagttacagaagactgtggcaatagagggcccagtttgaggaccaccactgcttcaggaaagcttattactgagtggtgctgccgatcatgtacattaccacccttacggtataggggagaagatggctgctggtacggtatggagataagacctttgaaggagaaagaagaaaacttagttaactcacttgtgacagcaggacatggtcagatcgataatttttccctaggagttttaggaatggcgttgtttctggaggagatgttgagaacgcgagtaggaacaaaacatgctattttgctagttgcagtcagttttgtaactcttataacaggaaacatgtctttccgggatcttggacgcgttatggtcatggtaggcgcaacaattacagatgacattggcatgggggtaacatatcttgccctactggcagcgtttaaagtccgtccaacatttgcagcgggtctcttacttcggaaattgacgagcaaggaacttatgatggcaaccataggagttgctctattgtcacaaagcacgataccggaaacaatacttgaacttacagacgcgcttgcgttggggatgatggcactaaaaatagtaaaaaatatggaaaagtatcaactggcagttacgataatggctatatcatgtgtaccaaacgccgttatattacaaaatgcatggaaagtatcatgcacaatactagctgcagttagtgtatccccactactacttacttcaagtcaacaaaaagctgactggataccgctagcattgacaatcaaagggttgaacccgactgcaatattcctaactacgctatcgagaactagtaagaaacgttcgtggccattaaatgaagcgataatggccgttggtatggtatcgatcctagccagtagtttgttaaaaaatgatgtaccaatgacaggtccgcttgtagcgggcggactactaaccgtctgttacgtattaacaggtaggagtgcagatctggagctagagagagccgccgatgtaaaatgggaagaccaggctgagatctcaggatcatcaccaattctaagtataacgatttctgaggatggatctatgtcaattaaaaacgaagaagaagagcaaacgcttacaatattaataagaacaggcttgcttgtaattagtggagtattcccggtatcaataccaattactgccgccgcatggtatctttgggaagttaaaaaacagagggcaggtgtattgtgggatgtcccgagccccccacccgtgggtaaggcagagctcgaagacggggcttatagaattaaacaaaggggaatattaggatattcacaaattggtgcaggagtatataaagaaggtacttttcatactatgtggcatgtaactaggggagcagtattaatgcacagaggtaagcgaattgaaccttcatgggcagatgtaaaaaaagacttggtctcatatgggggaggatggaaacttgaaggcgaatggaaagagggtgaagaagtccaagtacttgcgttagagccgggaaaaaacccacgtgcagtacaaacaaaacccggcatttttaaaacaaatacaggaaccataggagcagtaagcctagacttctcaccgggcactagcggctcacccatcgttgatagaaaaggaaaagttgtgggcctttacggaaatggagtggtaaccagaagcggtgcttacgtgagtgcgatagctcagactgaaaaaagcatagaagataatccagaaatcgaagacgacatctttcggaagaaacgattgacgatcatggatttgcatccaggcgccgggaaaactaaacgatatctacctgcgattgtacgcgaagccatcaagcggggcttaaggaccctaattttagcacctactagagttgttgctgcagagatggaagaagctctacggggactaccaatacggtaccaaacacccgcaatacgggctgaacatacaggaagggaaatcgtagatctaatgtgtcacgcaacatttacaatgagattactaagtcctgtaagagttccaaattacaatctcataataatggatgaagcacattttactgatccagcgtcaatagctgcaagagggtatatcagcactcgtgtagagatgggagaggcagcaggaatattcatgacagccacacccccgggttccagggatccctttccccaatcaaatgcccccataatggacgaagagcgagaaatacctgaacgttcttggaattcaggacacgaatgggtaacagattttaaaggcaagacagtatggttcgttccctcaatcaaggctggtaacgatattgctgcttgtttacgaaaaaacgggaaaaaagtaatacaactgagtcgaaaaacttttgatagtgagtacgttaaaactcgcagtaatgattgggactttgttgttactaccgacatatcggaaatgggagcaaactttaaggccgaaagagtcatagacccgaggaggtgcatgaagccagtaattctaactgatggcgaagagcgagtaattcttgcagggccaatgccggtgacccacagctccgcagcacaaaggcgcggccgtatagggcggaatcctaaaaatgaaaatgaccagtacatttatatgggggaaccgctagaaaatgacgaggattgcgctcactggaaggaggccaagatgttactagataatataaacaccccagaaggaattataccatcaatgtttgagcccgaacgagagaaggttgacgcgatcgatggagaatacaggttacggggagaagcgaggaaaacattcgtagacctaatgcgtcgtggtgacctacctgtgtggttagcgtacaaagttgcagcagaaggaataaattacgcggacagaaggtggtgtttcgatggtattaaaaataatcaaatattagaggaaaatgtcgaagtagaaatatggaccaaggaaggtgaaaggaaaaaactaaagccaaggtggttagacgcaagaatatattctgatccattagcactaaaggagtttaaagaatttgctgctggaaggaagagtctcactcttaacctaataacagaaatgggacgcctacctacgtttatgacccaaaaggccagaaatgcgctcgacaatctagccgtactacatacggctgaggccggaggaaaagcgtacaaccacgcgcttagtgagttgccagaaacattggaaacattactgcttctgacactactagcaacagtaactggcggaatattcttgttcttaatgagcggcaaaggcattggaaaaatgacccttggcatgtgctgtatcatcactgcgagtatactcttatggtatgctcaaatacaaccacattggatcgccgcatctatcattcttgagtttttcttgatagtacttttaattccggaaccagaaaaacaaagaacaccgcaggacaatcaattaacatacgtagtgatcgccatactcactgttgtagcggcaactatggcgaatgaaatgggatttctagaaaaaacaaaaaaagaccttggactaggctccatcactactcaggagtctgaatctaatattctagatatagatttacggcctgcttcagcatggacactctacgcagtagcaactacctttgtgacacctatgttacgccactcgatagaaaatagtagcgttaatgtaagtttgactgctatcgcaaatcaagcgacagttctaatgggactgggcaaaggttggcccttgtccaaaatggatataggagttccattactagccataggatgctatagtcaagttaatccgatcaccctaactgcagcattattgctgctagtggcacattatgcaattatcggacccggcttacaggcaaaagcaacgcgagaggcacaaaagcgggcagctgccggcatcatgaaaaacccaacagtagatggaataaccgtcatagacttagaacctataccgtatgaccctaaatttgaaaagcaactaggtcaagtaatgttactcatactatgtgtgacccaggtcttgatgatgagaaccacttgggcattatgtgaggcattgactttagcgactggaccaattagtaccttatgggaaggcaacccaggtaggttttggaatactacgatagcagtatcaatggcaaacatctttcgaggctcatatctagcaggcgctgggctgttattttcaattatgaaaaacaccacaaacacacgaaggggcactggtaatatcggagaaacactaggagaaaaatggaaatccagattaaatgccttgggcaaaagtgaatttcaaatctataaaaaaagtggtattcaggaggttgatagaacattggcaaaagagggtataaaaagaggggagacagatcatcatgcagtttctaggggaagtgcgaagttgagatggttcgtggaaagaaacatggttacaccggaaggtaaagtggttgacttagggtgtggaagaggaggctggagctactactgtggaggtctcaaaaacgtaagggaagtaaaaggccttacaaaaggtggaccagggcacgaagagcccataccaatgagtacatacggctggaacttggtcagattgcaaagcggtgtagatgtgttttttacccctccagaaaagtgcgacacactattatgtgatataggagaaagtagtccaaatccgacaatagaggccggccggaccttgagggtacttaatctcgtggaaaactggctaaataacaatacccaattttgcattaaagtgctcaatccttatatgccatcggtaattgaaaaaatggaaacactgcaaaggaaatacggcggtgccctagtgagaaacccactcagccggaactctacccacgaaatgtattgggtatccaatgcaacggggaacatagtgtcctcagtcaatatgatcagtcgaatgttaattaatcgattcacgatgaaacataagaaggcaacctacgaaccagatgtagatcttggttcgggaacacgcaatataggtatagaatcagaaatacctaatttagatatcataggtaaacgcatagagaaaatcaagcaggaacatgaaacatcatggcattacgatcaggatcatccatacaaaacgtgggcgtatcatggttcttatgagactaaacaaacaggtagtgcaagttctatggtaaatggtgtggtacgacttctcactaaaccctgggatgtagtccctatggtaacacagatggctatgacagatacgacgccgttcggacaacaaagagtattcaaagaaaaagttgatacgagaactcaagaaccgaaggaaggaactaaaaaactaatgaaaataacggctgagtggttatggaaagaactcggtaaaaaaaagacaccgagaatgtgcacccgtgaggagttcacacgaaaagtacgaagcaatgcagcattaggagctattttcacagatgaaaacaagtggaaaagcgccagagaagcagtagaagatggaagattctgggagctcgtcgatagagaacggaatttgcatttagaaggcaaatgtgaaacttgcgtatataatatgatggggaaacgagaaaaaaaacttggtgagtttgggaaagctaaaggatcgagagcaatttggtatatgtggttaggagctaggttcctagagttcgaggcattaggttttcttaatgaagatcattggttttctagaggaaattcattatctggtgtcgaaggagaaggacttcatcgattaggatacattttaagagacgtttcgaaaaaggaaggtggtgcgatgtacgcagatgacacagccgggtgggataccagaataaccctcgaagaccttaaaaatgaagagatggtgaccaatcatatgaagggagagcacaaaaaactcgcagaagcaatatttaaattgacctatcaaaataaagtagtacgcgtacaacggccaacacctcgtggaaccgttatggacataattagccgaagagaccaaagagggtcagggcaagtaggcacatatggactcaacacatttacgaacatggaagcacagttaataagacaaatggaaggtgaaggcatatttaaaagcatccaacacttgactgtcacagaagaaattgcggttcaaaattggcttgcacgtgtaggccgtgaaaggctgacgagaatggcaatttcgggtgacgactgcgttgtcaaaccaattgacgatagattcgcaaatgctctaaccgccctaaatgacatgggcaaagtcagaaaagatattcaacaatgggaaccttctagagggtggaatgattggacccaagtaccattctgttcacatcacttccatgaactggtaatgaaggatggaagggtcttagtagtaccttgtagaaaccaagacgaattgattggtagagcccgcattagtcaaggcgccggatggtcactaaaagaaacagcttgtctaggaaaatcctacgcacaaatgtggacgctaatgtattttcatagacgtgatttacgtttagcggcaaacgcgatttgctctgctgtaccaagccattgggtcccaaccagccgaaccacctggtcaatacacgctaaacatgaatggatgacgaccgaggacatgttagccgtatggaaccgagtatggatacaagaaaatccatggatggaagacaagacgcccgtagaatcctgggaagaagttccctatcttggaaaaagagaagatcaatggtgtggctctctaataggactaactagccgagcgacatgggcaaaaaatatacaaactgcaattaatcaggtcaggtctttgattggaaacgaggaatacactgactacatgccttcaatgaaacgtttccgtagagaagaggaggaagcaggtgtactatggtaa

SEQ ID NO: 22271 - RNA, 9876 nt, synthetic construct
  misc_feature 1..9876: note = derived and/or modified CDS sequence (opt6) from DENV-2__FJ850078__SS-prME
  source 1..9876: mol_type = other RNA
actgcgggagtcattgttatgttaattccaacggttatggctttccacctaacgaccagaaacggggaaccacacatgatagtagggagacaagaaaaaggtaaaagtttgctattcaagactgaagatggtgtaaatatgtgcaccttaatggcaattgatctaggtgaactatgcgaagatacaataacatataaatgccctctacttcgtcaaaatgaacccgaagatatagattgctggtgtaactctacatccacctgggttacgtatgggacgtgcacgacaacaggagaacatagaagagagaaaagatcagtcgccttagtaccacacgtcggtatgggattggaaactcgtactgaaacatggatgtcttctgaaggggcatggaaacatgttcaacggattgaaacatggatcctccgtcatccaggttttacgatgatggcagcaatacttgcttacacaataggaactacacacttccaaagagctttgatatttattttactaacagcagtcgctccgtcaatgacaatgcgttgcataggtattagcaatcgagattttgtcgaaggtgtatctggaggttcctgggtagatatcgtattagaacatggatcttgcgttactactatggctaagaataagccaacactagactttgaactcataaagacagaggcaaaacagccagctacgttaagaaaatattgtgttgaagctaaacttacaaacaccaccacggagagtagatgtcctacccaaggggagccgtcactgaacgaagaacaagataaaaggtttatctgcaaacatagcatggtcgatcgtggatggggaaatggttgtggtctatttggtaaaggaggaattgttacgtgcgcaatgttcacatgcaagaaaaatatggaaggtaaggtcgttcaacctgagaatctggaatacactatagtaattacgccacacagtggagaggaacatgcagtaggaaacgatacggggaagcatggaaaagaaattaagataacgcctcaatcaagtattacagaggcagaactaacggggtacggaactgtaacaatggaatgttctcctagaacaggattggattttaatgaaatggtgttattgcaaatggaagataaggcgtggttagttcatagacagtggttcttagacctaccattgccctggttaccaggtgcggatacacagggatccaattggattcaaaaagaaactctagtaacatttaaaaatccacatgccaagaaacaggatgtcgtggttctaggcagtcaagaaggggcaatgcacactgcactgactggagcaacagagatacaaatgagtagcggaaacttattattcactggacatctgaaatgtagattacggatggacaagctgcaattgaaaggcatgagttatagtatgtgcaccgggaaatttaagattgtgaaggaaatagccgaaactcaacacggaaccatagttataagagtgcagtacgaaggagatggcagcccttgtaaaattccgtttgagataatggacttagaaaagagacatgtattgggcagacttattacggtcaatcctatcgtaactgaaaaagatagtccagtgaatatcgaggctgaacccccatttggggactcgtacatcatagtcggcgtagaaccagggcaactaaaacttaattggttcaagaaaggtagtagcataggtcaaatgtttgaaactacaatgcgaggagctaaaaggatggctatcttaggcgatacggcctgggactttggctcgcttggaggtgtctttacatcaattggaaaggcattacatcaggttttcggggccatttatggagcagcctttaatggcgtgtcctggacgatgaaaattttaattggagtcataataacctggataggaatgaactctaggtcaacatctttatctgtatcattggtactggtaggtgtagtgacgctctatttaggagcgatggtacaggcggactccgggtgcgtcgtctcgtggaagaataaagaattaaaatgcggatcgggcatattcattacagataacgttcacacatggaccgaacaatataaatttcaaccagagtccccgagtaaactcgctagtgctatacaaaaagctcacgaagaaggtatctgcggaatacgcagtgtaacacgccttgaaaatttgatgtggaaacaaataacccctgaattaaatcatatcctgtcagaaaatgaagtaaaactcactataatgacgggagacatcaaaggtatcatgcaagccggtaagcgaagccttcgccctcaaccaactgaattaaaatatagctggaagacatgggggaaagcaaagatgctgccaacggaaagccacaaccagacatttctaattgacgggcccgaaacagctgaatgcccgaatgctaatagggcatggaactctcttgaggtagaagattatggatttggagtttttacgacaaatatttggttaaaattacgcgaaaaacaagacgtcttttgtgacagtaaacttatgagcgcagcaataaaggacaacagagcagtccatgccgatatgggttattggatcgaatcagcacttaatgacacatggaagatggaaaaagcgtcgtttattgaggtaaaatcgtgtcattggccaaagagtcatactctatggtctaatggggtgttagaatcagaaatgatcattcccaaaaattttgcaggaccggtgtctcaacacaactacaggccaggatatcatacccagacggccggaccttggcatttagggaaattagagatggacttcgatttttgtgagggtacaacagtcgtggtcacagaagattgtggaaaccgaggtcccagcttacgaaccacgaccgcgtcaggcaaactgataaccgaatggtgctgcagatcgtgcacacttcctcctttaagatatcgaggagaagatggatgttggtacggaatggagattagaccgctgaaagaaaaagaagagaatctcgtaaactcactcgtaacagcaggacacggtcaaatagacaactttagtttaggtgtattaggtatggcattatttcttgaggaaatgttaagaacaagagttggcaccaaacatgcaatactcctggtggctgttagtttcgttacgctgattacgggaaatatgagttttagagatctgggccgggtcatggtaatggtaggagctacaatgacagacgacattggcatgggagtcacttaccttgctctcttagccgcatttaaagtaagaccaacctttgcggcaggtctattattaagaaaactcacctctaaagaattgatgatggcgacgattggtgtcgctctattgagtcaaagcactatacccgagactattttagaattaacagatgcattagcactaggtatgatggcgttaaaaatagtaaagaatatggagaaataccaattggccgtaacaatcatggctatttcttgtgttccaaacgcagttatattacaaaacgcatggaaagtaagttgcactatattggcagccgtgtcagtttctccactacttttaacaagtagtcagcagaaagcagattggatcccgctcgcactcactataaaaggtctaaatcctactgctattttccttaccacactatccagaactagcaagaaaagaagctggcctttaaatgaagccgtaatggcagtagggatggtctctatccttgcaagttcattacttaaaaatgatattccgatgacgggacctttagtggccggtggattactaactgtatgttacgtcttgaccgggcgctcagccgatctcgaacttgaacgagctgcagatgtaaaatgggaagaccaagccgaaataagtggttccagtcccatactgagcattacaatatctgaagacggtagtatgtctattaaaaatgaggaggaagaacagacccttactatattgataagaacaggtctattagtcatatctggtgtcttcccggtgtccataccgataacggccgccgcgtggtatctatgggaggtcaagaaacaacgagcgggcgttctttgggatgttccttcacctccaccagtagagaaagcagaactcgaggatggagcatatcgtattaaacaacgagggattctaggatatagccagattggagctggagtttataaagagggaacctttcatactatgtggcatgtcacaagaggggcagtactgatgcacagaggcaagagaatagagcccagttgggcagatgtaaagaaagacttggtctcatatggaggtggatggaaactcgaaggagagtggaaagaaggtgaagaggtacaggtactggcacttgaaccaggcaaaaatccacgagctgtgcagacgaaacccggtatatttaaaacaaatacgggtacgataggtgccgttagtctagatttctccccaggaacctcagggtcgccgatagtagacagaaagggtaaggtagtaggtctatatggtaacggagttgtcacaagaagtggtgcctacgtctcggctatagcacaaacagaaaaatcaatcgaagataatcctgaaatagaggatgatattttcagaaagaaacgattaacgatcatggatttacatccgggggcaggtaaaacaaaaaggtatctaccagctatagtacgtgaagctataaaaagaggactacggacactaatcttagcaccaacccgagtcgtcgcagcagagatggaggaggccttaagagggttacctattaggtatcaaactcctgccatacgagcagaacacactgggcgtgaaatagtcgacttgatgtgccacgccacatttacaatgcgtctcctatcacccgtacgagtgcccaactataacctaatcataatggacgaggcccacttcacagaccccgcctccatcgctgcaagaggttacatttcgactcgggtcgaaatgggtgaagctgcaggaatatttatgactgccacaccaccgggcagtcgggacccgttcccgcaatcaaatgctccaataatggacgaggagagggaaattccggagcgttcttggaatagtggacacgagtgggttactgatttcaaaggcaaaacagtatggttcgtacctagtattaaagcaggtaacgatatagccgcatgcctcaggaagaatgggaagaaagtcatacaactatcacgtaaaactttcgatagcgaatatgtcaaaactaggtcaaacgactgggattttgttgtaactacagatatatcggaaatgggagcgaattttaaagcagagagagtgatagacccccgtaggtgtatgaagccagtaattcttactgatggagaggagcgagtaatcctcgcagggccgatgccagtgacacacagtagcgctgcccagagacgtggtaggatagggcgaaatcccaaaaatgaaaatgatcaatatatatacatgggtgagccattagaaaatgatgaggactgcgcacattggaaagaagctaagatgcttctcgacaacataaatacaccagaaggaatcataccgtcaatgtttgaaccagaacgagagaaagtcgacgctatagatggagagtatagattacggggagaagcgagaaaaacctttgttgatcttatgcgacgcggagatttaccagtctggcttgcctacaaagtggcagcagaaggtattaattacgccgatcgacgatggtgttttgacggaattaaaaacaatcagatattagaagaaaacgtggaagtagaaatatggaccaaggaaggagaacgaaagaagttaaagcctcgatggctagatgcaagaatatacagcgatcccttagcgcttaaagagtttaaagagtttgcggccggtcgaaaatcacttacattgaatttaataactgaaatgggaagactcccaacttttatgacacaaaaagcaaggaatgcacttgacaatttagccgtcttgcacactgcggaggccggaggaaaggcgtacaaccatgcactaagcgagttacccgaaacactagagaccctactgttgttgactttattagctacggtaacaggcggtattttcctattcttgatgagtggaaagggaataggtaaaatgactttaggtatgtgctgcatcatcactgcaagtatacttctatggtatgcacagatccaaccgcattggattgcagcatcaatcatattagaatttttcttaatcgtattgttaatccctgaaccagaaaaacaaagaacaccccaagacaaccaattgacctatgtggttatagccatactaacagtcgttgcagctacaatggccaatgagatgggattcctcgagaaaactaagaaagatttaggattaggaagtataactacccaagaatcagaatcgaatatcctggatatagatctacggccagcttcggcatggaccctctatgcggttgcgacaacgttcgtcacgccaatgttaagacactcaatcgaaaactcttcggtaaatgtaagtctaactgcaatagctaatcaggcgacagtgctaatgggcttaggaaaaggctggccattaagtaaaatggatataggagtaccactactagcaataggctgctattcgcaggtaaatccaatcacgctaacagcggcgctgttattgctcgtggcacactatgcaatcatcggaccagggttacaagctaaagccaccagagaggcccagaaacgtgcagctgcgggaatcatgaaaaaccccactgtagatggtatcacggttatcgatcttgaacctataccctatgaccctaaatttgaaaaacagttaggacaagtaatgcttttaatattatgtgtcacgcaagttttaatgatgagaacaacttgggcgctttgcgaagctctaacgttagcaacaggtcccatttctacgttatgggaaggtaatccagggagattttggaatactacgatagccgtatcaatggcgaatatattccgtgggagttaccttgcgggggcgggcttactttttagcatcatgaaaaacacaactaacacccgtcgagggacaggcaatatcggcgagaccctaggagaaaaatggaaatcacgactaaacgcactggggaaaagtgaatttcaaatatataagaaatctgggatacaagaagtagatcgaacactagccaaagagggaattaaacgaggagaaaccgaccaccatgcagtatcaaggggatccgctaaactgaggtggttcgttgagcgaaatatggtcacaccagaaggaaaagttgtagacctgggatgcggtcgaggtggctggagttattattgcggaggtctgaaaaatgtaagagaagtcaaaggtctaacacgtggcggtccaggacacgaagaacctatacctatgtccacatacggttggaatctagtcagattacaaagtggcgttgacgtattctttactcccccagaaaaatgtgacacgttgttatgcgatataggagaaagcagcccaaaccccactattgaagcagggagaaccctaagagtattaaatttagtcgagaattggttaaataataacactcaattttgtataaaagtccttaatccatatatgccatcagttatagagaaaatggaaacgttgcagaggaaatatggaggagctcttgtgcggaatcccctttccaggaatagcactcatgaaatgtattgggtatccaacgcaaccggtaacatcgtatcgtccgtcaacatgattagtagaatgttgatcaacagatttacaatgaaacacaaaaaggccacctacgagcccgatgtagacttaggatctggcacaagaaacatcggtatagagtcagagataccaaacctagatattatcggcaagagaattgagaaaataaagcaagagcatgaaacttcgtggcattacgatcaagaccatccctataaaacatgggcttaccatggcagttacgaaactaagcaaacaggatcagcctctagcatggtaaatggagtggtcagactcttgactaaaccttgggacgttgtcccaatggttacacaaatggcgatgacggatacaacaccttttggtcaacaacgagtcttcaaagagaaagtagatactcgaactcaggaacctaaagaagggacgaagaaattgatgaaaattacagctgaatggctatggaaagaattaggcaaaaagaaaacacctagaatgtgtactagagaagagttcacaagaaaagtaaggagcaacgcagctctaggagcaatattcacagacgaaaacaaatggaagagtgcgagagaggctgtcgaggatggacgattttgggaattagtagacagagaacgaaacttgcatcttgaaggtaaatgtgagacatgtgtttacaatatgatgggtaaacgagagaagaaactaggtgaatttggcaaagcgaaaggatccagggcaatttggtacatgtggctcggagcccgatttctagagtttgaagccctgggatttctaaatgaagaccattggttctcaaggggaaattctcttagcggcgttgaaggagaaggtctacatcggttgggatatatattaagggacgtttctaagaaagagggaggagcaatgtacgccgatgatacagcgggatgggatactagaataactctcgaagatcttaaaaatgaggaaatggttacaaatcacatgaaaggtgaacacaagaaattggctgaagcaattttcaaattgacataccaaaacaaagtagtaagagtccaacgaccaacgccaaggggtacagtgatggatatcatatctagaagggatcaaagaggtagtgggcaggttgggacatatggtttaaacacttttactaacatggaagctcaactcattagacaaatggaaggggaaggaatattcaaatcaatccaacatttaacagtgacggaagagatagcagttcaaaattggctagcaagagtgggacgagagcgtctgacgagaatggcaattagtggagacgattgtgtcgtaaaaccaatagatgataggttcgccaacgcattgaccgccctcaacgacatgggtaaagttcgcaaagacatccaacagtgggaaccgtcacggggatggaacgattggacacaagtcccattctgtagtcaccattttcatgaattggtgatgaaagatggccgcgtgctggtcgtaccttgtcgcaatcaagatgaattaattgggcgcgcacgaatcagccaaggtgccggatggagtctcaaggagacggcttgtttgggtaaatcatatgcacagatgtggacactaatgtatttccatagaagagacttacgacttgctgcaaatgcaatctgtagtgcagtaccatctcactgggtacctacgtctagaacgacttggtctatacatgcaaaacatgaatggatgaccactgaagatatgttggccgtatggaatcgtgtatggatacaagagaatccatggatggaagacaaaacaccagtcgaatcatgggaggaagtcccgtacctaggaaagcgagaagatcaatggtgtggaagtcttataggcttaacttcacgggcaacttgggcaaagaatatacaaactgctataaatcaagtgaggagcttaataggaaacgaagaatatacagactacatgccctcaatgaaacgatttagaagagaagaagaagaagccggtgtattatggtaa

SEQ ID NO: 22272 - RNA, 9876 nt, synthetic construct
  misc_feature 1..9876: note = derived and/or modified CDS sequence (opt6) from DENV-2__FJ850082__SS-prME
  source 1..9876: mol_type = other RNA
accgtaggagttattgttatgcttatacccactgctatggctttccatctcactacaagaaacggagaaccacatatgatcgttggaagacaagaaaaaggaaaaagtttgctatttaaaacagagaatggagtgaacatgtgcacactaatggctatagacttaggggaactatgtgaagacacaattacatacaaatgtcccttgttaagacaaaacgagccggaagacattgattgctggtgtaatagcacctctacctgggtaacatacggtacctgtaccacaacaggagagcataggcgagaaaaacgcagcgttgctttagttccccacgtagggatgggacttgaaactaggaccgaaacatggatgtcctctgaaggagcttggaaacatgtacagaggattgagacatggatacttcgacatcctggttttacaatcatggcagcgatattagcatatacgataggtacaacacactttcagagagcattaatttttattctactcacagcagtagctcctagtatgacaatgagatgcataggaatatcaaacagagactttgttgagggagttagcgggggttcttgggtagacatcgttttagaacacggttcatgtgtcacaacaatggccaaaaataaaccaacattagatttcgaacttataaaaacagaagcaaaacaaccagcaacattgcgtaaatattgtgttgaagccaaactaacgaacacaacaacagaaagtagatgccctactcagggcgagccttcgctaaatgaggaacaagataaacgttttatttgcaaacattcaatggtagatagagggtggggaaatggatgcgggttatttggaaaaggaggtatagtaacatgtgctatgtttacatgtaagaaaaacatggagggaaaagtcgttcaacctgaaaacttagaatacactattgtgataaccccacactcaggcgaagaacacgcagtaggcaatgatacaggaaaacatggtaaagaaataaaaataacgccacaaagttcaataacggaagcggaacttacaggctatggtacggtcactatggagtgctcaccacgtactggtttagactttaacgaaatggtattactccagatggaagacaaagcatggctcgtacatagacagtggttcctagatttaccactaccctggctcccaggagctgatacccaaggatcaaactggatacaaaaagaaacgctagtaacatttaaaaacccacacgctaagaaacaagacgtggtcgtactcggaagtcaagaaggagcaatgcacacagctctcacaggtgctactgaaatccaaatgagttctggaaacctcttattcactggtcatttgaaatgcaggttgaggatggacaaactacaattaaaaggaatgtcctacagtatgtgcactggtaaattcaaaattgtaaaagaaatagcagagacacaacatggaaccattgtaattcgagtccagtatgaaggagacggtagtccgtgtaaaataccgttcgaaataatggacctcgagaaaagacacgtgctggggcgactcataactgtaaacccaatagtaactgaaaaagactctcctgtaaacattgaagcggaacctccgtttggcgattcatatattatcataggagtcgaaccaggtcagctgaaactcaattggttcaagaaagggagtagtattggacaaatgtttgaaacaacaatgcggggagctaaacgaatggcaatactaggggatacggcctgggatttcggtagtcttggcggagtttttacatctataggaaaggctttacaccaagtcttcggagcaatctacggagcagccttttcaggtgtgtcatggacgatgaaaattttaattggcgtcatcattacttggattggaatgaatagccgttctacatccctgtctgtatctttagtgctggtaggggttgtgacgttgtacctcggagcaatggtccaggcagattcagggtgcgtagtcagctggaaaaataaagaacttaaatgtggctcgggtatattcattacggacaacgtccacacctggacggaacagtataagttccaacctgagagtccgagtaaactagcatccgctatacaaaaagcgcatgaggaggggatttgtggaattagatctgtaactcgtctggagaatttaatgtggaaacagatcacgccggagctcaatcatatactgagcgaaaacgaagtaaaattaacaattatgacaggtgatataaaaggaattatgcaagctggtaaaagatcattaagaccacaacctacagaattaaaatattcatggaaaacgtggggcaaagcaaagatgttatcaacggaaagccataatcaaacattcctgatagatggccctgaaaccgcagaatgcccgaacacaaatagagcatggaactcacttgaggttgaagattatggatttggggtttttacaactaatatctggttgaaattaagagaaaagcaagatgtattttgtgattccaaactaatgagtgcggcggtaaaagataatagagcggtacatgctgatatgggatattggatagaatcggccttgaatgatacttggaagatggaaaaggcctcatttatagaagttaagagttgtcactggccaaagtcacataccctatggtctaacggagtattagaaagcgaaatgataatacctaaaaacttcgctgggcctgtgtcacaacacaactaccgaccaggttaccacactcagacagcagggccttggcatctagggaagctggaaatggactttgatttctgcgagggtactacagttgttgttactgaagattgtggaaatagagggcctagtctgcgaacaacaactgcaagcggaaaattgataacagaatggtgttgtcgtagctgcacattgccacctctaagatatagaggcgaggatgggtgttggtatgggatggaaataaggccgttaaaagagaaagaggaaaatctcgtcaatagtctggttaccgcggggcatggtcaaattgacaattttagcctaggagtactgggaatggcattgtttctagaagagatgttaagaactagagtaggaaccaagcatgctattctattagttgcggtttcgtttgtaacgttaatcactggtaatatgtcatttcgcgatttaggccgcgtaatggtaatggttggggctacaatgacagacgatatagggatgggtgtgacttacctcgcgttattagccgcatttaaagtgagaccaacgtttgctgctgggttacttctcagaaaattaacatcaaaagaactaatgatggcaactattggtgtcgctctactctcccaaagtaccataccagagacaatccttgaactaacagatgcccttgcactagggatgatggcattaaaaatagtcaaaaatatggaaaaataccaacttgcggtaaccataatggccattagttgtgtaccaaatgcagtaatattacaaaacgcatggaaggtttcttgcacaatactagcagcagtatcagtttcaccgttgttattgacaagttcccaacaaaaagcagactggatcccactggctttgacaatcaaaggcctgaatccgacggcaatatttttaacaacactctcaagaacttccaagaaaagaagctggccgttgaacgaagctataatggcggtcggtatggtatcgattttggcttcaagtttactcaagaacgatatcccaatgacaggtccattagttgcagggggtttattaaccgtttgttatgttttaacgggacgatcagctgatctggaactagagagagccgcagacgtcaaatgggaagaccaagccgaaatcagtggttctagtcctatactgtcgataaccatctcggaagacggttctatgagcatcaaaaacgaggaggaagaacaaacattgacaatattgatacgaacaggactattagtcatatcaggtgtgttcccagtatcgataccgataactgcagctgcttggtatctgtgggaggtcaagaaacaacgtgctggagtactctgggatgtaccgagcccaccgccagtcggcaaagcggaattagaggaaggtgcatatcgaattaagcagcgcggcatactggggtatagtcaaatcggtgcaggagtttataaggaaggaaccttccatactatgtggcacgtaacccgaggcgcagtccttatgcacagaggtaaaagaattgaaccatcatgggcagacgttaagaaagatctagtatcttacggtggtgggtggaagttagaaggagagtggaaagaaggagaagaagtgcaagtactagctcttgagccaggcaaaaatcctcgtgccgtacaaactaaaccaggaatatttaaaacaaataccggaacgataggcgcagtcagccttgacttttcaccaggtacgtcaggttcgcccatagttgatcgtaaagggaaagtcgtgggactatatggtaatggagttgtaacaagatctggtgcatacgtaagtgcgatagcgcagacggacaaatcaatagaagataaccctgaaatagaagatgacatattccgtaagaaacgtcttaccataatggatctgcacccgggcgcaggaaaaactaaacggtaccttccagccatcgttagagaagcaatcaaacgagggttaagaactttaatactagctccgaccagggttgtagcagccgaaatggaagaggctttacgagggctacctattagatatcaaacaccggctataagggcagaacatacaggtagagaaatcgttgatttgatgtgccacgcaacgttcacgatgagattgcttagtccagtaagagtccctaattataatctaattataatggatgaggcacacttcacagatccggccagtatagcggcccgcgggtacatctcaaccagagttgaaatgggagaggctgctggtattttcatgactgctaccccaccaggctcaagagacccattcccacaatccaacgcaccgatcatggatgaagaacgcgagataccagagcgttcttggaactcaggacacgaatgggtaaccgatttcaaagggaaaacagtgtggtttgtaccttccataaaagcgggcaacgacatagcagcatgtttaaggaaaaacgggaagaaagtaattcaactaagcagaaaaacgtttgatagcgagtatgttaaaactcgggcaaatgattgggactttgtagtaaccactgacatctctgaaatgggagcaaatttcaaagcagaacgcgtgatcgatccaagacgatgtatgaaaccggtaatcttaaccgatggtgaagaacgagttattttagcaggacccatgccggttactcatagtagtgcagcacaaagacgaggaaggattggacgcaatccgaaaaatgaaaatgaccaatatatttatatgggtgaaccattagaaaatgatgaggactgcgcacattggaaagaagcaaagatgctattggataatatcaataccccagaaggaataatacctagcatgtttgagcctgagcgagaaaaagtagacgctattgatggcgagtaccgattacgtggtgaggcacgcaaaacatttgtagatttaatgagacgcggagatttaccggtatggctggcttataaagtagcagcagagggtattaactacgcggatagaagatggtgttttgatggcattaagaataatcagatattagaagaaaatgtggaggtcgaaatctggacaaaggaaggggaacgtaagaaacttaaaccaagatggttagacgcccgaatttattccgacccattagctcttaaagagttcaaagaatttgctgctggcaggaaatcgttaaccctgaatctaattactgaaatgggtagactgcccacttttatgacgcaaaaagcaaggaacgcacttgataatttagccgtattgcataccgcagaagctggcggtaaggcttataatcatgcactaagtgaactaccggaaacattagaaacacttttattactaacattattagccacagtaacaggtggcattttcctctttttaatgagtggaaaaggaattgggaaaatgacactaggcatgtgctgtataatcaccgcgtcaatactactttggtatgcccaaatacaaccacattggatagcagcaagtataatactggagttctttctaattgttttgctaatcccagaacctgaaaaacaacgtacaccgcaggacaaccagttaacttacgtcgtgattgccatattaacagtcgtggccgctaccatggcaaacgaaatgggatttcttgaaaagacaaagaaggacctaggtttagggagcataaccacacaagaatcggaatcgaacatacttgacattgatctgagaccagcttcggcctggactctctacgcagttgctactacattcgttaccccaatgttaagacattctatagaaaattcgagcgtaaatgtatcattaaccgctattgctaaccaagccacggtgctaatgggtttaggaaaaggatggcctctttcaaaaatggatataggagtcccattactagcaattggatgctactcacaagtaaacccgataacattaaccgctgcattattattattagttgcacattacgcaatcattgggccggggttacaagcgaaggctacaagagaggcacagaaaagggcggctgcaggtatcatgaaaaacccaacggtggacggaattacggttattgacttagaaccaatcccctacgatccaaaattcgagaaacaattagggcaagtcatgctacttatcttatgcgttacacaagtcctaatgatgaggaccacttgggccttatgcgaagcactcaccttagccaccggacccatttctacgttatgggaaggaaacccgggacgcttctggaatacaacaatagctgttagcatggccaatatatttcgaggtagctatttggcgggtgcaggcttattgttcagtattatgaaaaacacgacaaatacgcgaagaggtacaggcaatatcggtgaaacactaggagaaaaatggaaatctaggctaaacgccttaggcaaatctgaatttcaaatttataagaaatcaggcattcaagaggttgatcgcacactggcaaaggaaggcatcaaacgaggtgaaacagatcaccatgctgttagtagaggctccgcaaagctacgttggtttgtggaaagaaatatggtcacacccgaaggtaaagttgtcgatctaggctgcgggagaggcggctggtcctactattgtggaggattgaaaaacgttcgtgaagtaaaaggtttaaccaaaggtggtcccggacacgaagaaccaattccaatgagtacttacggatggaatttagtaagactccaaagcggagttgatgtgtttttcaccccgccggagaaatgcgatacccttttatgcgatataggggaatcgtcgcctaatccaacaatcgaagcaggaagaactttacgtgtactgaaccttgtagaaaactggttaaataacaatactcaattttgtattaaagtgctaaatccttacatgccttcagtaatcgaaaagatggagacgctccaaagaaagtacggtggtgctctagtccgaaatcctctgtcgagaaatagcacacacgaaatgtactgggtttctaacgcgacgggcaatatagtatcaagtgtcaatatgattagtagaatgttgatcaaccgtttcacaatgaagcataagaaggcgacatatgagccagatgttgacttgggatccggaaccaggaatattggtatcgagagcgaagtacccaacctcgatataataggaaaaaggatagagaaaataaaacaagaacatgagacatcatggcactatgatcaagatcatccttataagacatgggcatatcacggtagttatgaaacaaagcaaacaggatcagccagcagtatggtgaacggggtagtaaggctgttaactaaaccgtgggacgtagtccccatggtcactcaaatggctatgacagatacaactccttttggacaacaacgagtgttcaaagagaaagtggatactagaacgcaagaaccaaaagagggaaccaagaaattaatgaaaattactgctgaatggttatggaaagagttaggtaagaagaaaattccgcgcatgtgcaccagagaagaatttacacggaaggtgagaagtaacgccgccctgggcgcaatttttacagacgaaaataaatggaaaagcgccagggaagccgtagaagatggtagattttgggaactcgtagaccgtgaaagaaatttgcacctcgaaggaaaatgtgaaacttgcgtttacaacatgatgggaaagcgagaaaagaaattgggggaatttggtaaggcaaaaggtagtagagctatatggtatatgtggcttggcgcgaggtttttagaatttgaagcactcggcttcctcaacgaggatcattggttcagtcgtggtaactcactaagtggtgttgaaggtgaaggactccacagattgggatacatattaagagatgtgtctaagaaagagggtggggctatgtatgctgacgatacagccggatgggatacccgaatcactctggaagacttaaagaatgaggagatgatcactaatcatatgaagggagaacataagaaactagcagaagcgatcttcaaacttacctatcaaaataaagttgtaagagttcaacgccctacacctagaggcaccgttatggatatcatcagtcgcagagaccagagaggatcaggtcaagtcggaacatacggtttgaacacttttacaaatatggaggcgcaattgataaggcaaatggaaggagaaggaatattcaaatctatacaacatttaacggtaaccgaggaaatcgcagtacagaattggctagcaagagtcggaagagaacgcttaacacggatggcaatcagcggggatgattgcgtcgtaaaacctatagatgatagatttgcgaatgctctcaccgcactaaatgatatgggtaaagttcggaaggatattcaacaatgggagccaagtagagggtggaacgattggacccaggttcctttctgcagccatcattttcatgaattggttatgaaagatggaagagtgttagtcgtaccttgtcggaaccaagacgagttaattgggagggctcgtatatcacaaggagccggttggagtttaaaagaaacggcatgccttggtaaaagctatgcccaaatgtggacattaatgtactttcataggagggacctacgactagcagcgaatgccatttgctctgctgttccgtcacattgggtgcccacttcaaggaccacatggtccatacatgcaaaacacgagtggatgaccaccgaagatatgctagcagtatggaatcgcgtatggatccaagaaaatccttggatggaagataaaacaccggtagaatcctgggaagaagtaccttatctagggaaacgtgaagatcaatggtgcggaagtcttataggcttaacttcacgcgctacctgggccaaaaacattcaaactgcaataaatcaggttaggagcttaataggaaatgagggatatacggattatatgcccagcatgaaaagatttcgacgagaggaagaggaagcaggggttttgtggtga

SEQ ID NO: 22273 - RNA, 9876 nt, synthetic construct
  misc_feature 1..9876: note = derived and/or modified CDS sequence (opt6) from DENV-2__FJ850085__SS-prME
  source 1..9876: mol_type = other RNA
acagtaggtgtgatagtcatgcttatcccaactgctatggcgtttcacctgacaacgaggaatggggaaccacacatgatcgtgggccgacaagagaaaggaaaatcattattgtttaaaacggaaaatggtgtaaatatgtgtacactaatggcaattgacttgggggagttgtgtgaggatacaatcacttataaatgccctctactaaggcaaaatgaaccggaagacatagattgttggtgcaactcaacttccacttgggtaacatacggtacttgtacgacgacaggtgaacatcgaagggagaaaaggtcggtagctctagtcccgcacgtaggcatgggcctagaaaccaggacagagacgtggatgagttcagaaggagcatggaaacacgtgcagagaatagaaacttggatacttagacatccaggatttacaataatggcggcgatactagcttataccattggaactacccattttcagcgcgcattgatcttcattctactaacagctgtagcacctagcatgaccatgcggtgcatcggcattagcaatagagacttcgtagaaggagtaagcggtggatcttgggttgacatcgtgctcgaacatggaagttgcgtaacaactatggccaaaaataaacctactcttgactttgaactaataaaaactgaagcgaaacaacctgcgaccttacgtaaatactgtgttgaagcaaaattaactaacacaacaactgaaagtagatgtcctacccaaggagaacctagcttgaatgaagaacaagataaaagatttatatgcaaacactctatggttgatcgtggatggggtaatggttgtggattatttggaaaaggaggtatagtaacttgcgcaatgttcacatgcaagaaaaacatggaaggtaaagttgtccaaccggaaaacttagagtatacaattgtaattaccccacactcaggtgaagaacatgctgttggaaacgacacaggtaaacatgggaaagaaatcaaaataacaccccaatcaagtataacagaagctgaattaacggggtatggtacggtaacaatggaatgcagcccgcgaacgggcttagactttaacgaaatggtattattacaaatggaggacaaagcatggcttgtccacaggcaatggttcctagatctaccactgccgtggctgccaggggcggatacacagggcagtaactggattcaaaaagaaactttagtaacattcaaaaaccctcacgcaaagaaacaggatgttgtcgttcttggttcacaagaaggtgctatgcatacagcacttacgggagccacagaaattcagatgtctagtggaaacttgctattcactggccatcttaaatgcagacttcgtatggacaaacttcaactaaaaggcatgagttattcgatgtgcacaggaaaattcaaaatagtaaaagaaattgcagaaacgcaacacggtacaatagtaatacgtgtgcaatatgagggagatggcagcccatgtaaaattccttttgaaatcatggatttagaaaaacggcatgtattaggaagactaataactgtaaatcctattgtagcggaaaaagatagcccagtgaacatcgaagcggaacctccattcggcgacagctatattattattggagtcgaacctgggcaactaaaattgaattggttcaagaaagggagctcaattggtcaaatgtttgagacaacaatgcgtggggccaaaagaatggcgattcttggggatacagcttgggattttggttcattgggcggtgtattcacaagtattggcaaagcattgcatcaagtattcggtgctatatacggagccgcatttagtggagttagctggacgatgaaaatcctcataggagtaatcataacttggatcggaatgaactcccggtccacctccctttctgtatcattagtattagttggagtcgtgacactctatttaggagcaatggtccaagcagattcaggatgtgtagtgagctggaagaacaaagaactgaaatgtgggagtgggattttcataacagataacgtgcacacgtggactgaacaatataaatttcagccagaatctccatccaaactagcatcggcgatacagaaagctcatgaagagggaatatgtggtattcgatcagtgacaagattagaaaacttaatgtggaaacaaattactccagaattaaatcacattctaagcgaaaatgaggtaaagttaacaataatgacgggagacataaaaggcataatgcaggctggaaaacgaagtctgcgaccccagcccacagaactaaagtactcatggaaaacttggggtaaagctaagatgctatcgactgaaagtcataatcagacatttctaattgatggaccagaaaccgccgaatgtcccaataccaatagggcgtggaacagccttgaagttgaagattatggatttggagtgtttacaacgaatatatggctaaagttaagagaaaaacaagacgtattttgtgacagtaaattaatgtcagccgcagtaaaagacaaccgagctgtgcatgcagatatgggatattggattgaatcagcattaaatgatacatggaaaatggaaaaggctagttttatagaagtaaagagttgtcattggcccaaaagccacacattatggtccaatggtgtgttagagagtgaaatgataattcccaaaaatttcgcaggacctgtaagccaacataactatcgaccaggatatcacacccaaaccgctggcccttggcacctgggtaaattagagatggacttcgacttctgtgaaggaacaactgtagtcgttaccgaggattgtggaaatcgaggtccgtctttaagaacaacaactgcctctggaaaattaataaccgagtggtgttgccgatcgtgtactttacctccactacgataccgtggggaagacgggtgttggtacggtatggagattaggcccttaaaggaaaaagaagagaacttagtcaattccttagtaactgccggacatggacaaattgataatttttcattaggtgtattgggcatggccttatttctcgaagaaatgctgagaacacgcgtaggaaccaaacatgccattctattagttgccgtttcatttgtgaccttaataactggcaatatgtcttttagagatctcggcagagttatggtgatggtgggcgctacaatgactgatgacattggtatgggtgtgacatatctagctttactcgccgcatttaaagtacggccgacctttgctgccggtttgttattacgaaaactaacaagcaaagaactaatgatggctacaattggtgtagctttgttgtctcaaagcacaattccagaaacgattctcgaacttacagatgcactggctttaggcatgatggcattaaaaattgtgaaaaacatggaaaagtatcaacttgcagttacgataatggcgatatcctgtgtccctaatgccgtaatacttcaaaatgcttggaaggtatcctgtaccattttagcagctgtgtctgtaagtcctttactactaacttcttcccagcagaaagcagattggattccacttgcgctgacaattaaaggattgaacccgacagctatttttctaactactctttctcgaacttccaagaaaagaagctggcctcttaatgaagccattatggctgtaggcatggtcagtatcttggcgagtagtttactcaaaaacgacataccaatgacgggaccattagtggcaggagggttgctaactgtgtgttacgtactgacagggcgctcggctgacttagagttagaacgtgctgcagacgtgaaatgggaagatcaggctgaaatttcaggatcctcaccaatcctcagtataactatttcggaagatgggtctatgtcaatcaaaaacgaagaagaggaacaaaccttaacaattcttataagaacaggactcctagtgataagcggggtgtttcctgtgtcaatacccataacagctgcggcatggtatctttgggaagtaaagaaacagagggcaggagtactctgggacgtgcctagtcccccaccagtaggaaaagctgaattagaagaaggggcttaccgtataaaacaacgtggtatactcggatattcccaaataggagcgggagtatataaggagggaacgtttcacaccatgtggcatgtgacccgcggtgcagtcctgatgcaccgaggtaagaggatcgaaccatcttgggctgacgtgaagaaagatctagtgagttacggtggagggtggaaacttgaaggggaatggaaagaaggcgaagaagtacaagtcttagcactcgaacccggtaaaaaccctagagcagtgcaaaccaaacctggtatctttaaaacgaacacaggaacgataggagcggtttcgttggacttttctcctggaacttcaggatcgccgatagtagaccgaaaagggaaagtggtaggcctatatggaaacggagtcgtcacacgatcaggggcatatgtttcagcaatagcacaaacagataaatctatagaggacaatccagaaattgaagatgacatttttcgcaagaaacgtttgactattatggacttgcatccaggagcgggaaagactaaaagatacttaccggctatagtgagagaagcaataaagaggggattgcgtacgttgatactagctccgacgcgtgttgtagcggctgaaatggaagaagcactacgtggactgccaattcgttatcaaacgccagcaattagagcggaacatactggtcgagagattgtagacttaatgtgccatgcaacgtttacgatgaggctgctctcaccggtaagagtacctaattataatttaataatcatggacgaagcacacttcacggatccagcttcgatcgcggcccgaggatatatatcaacgagagtagagatgggagaggcagcagggattttcatgacagcaacgcccccaggatcgcgcgatccgtttcctcagtccaatgcacctataatggacgaagaacgggagattcctgaaagatcttggaatagtggccatgaatgggtaacagatttcaaaggaaaaacggtttggtttgtaccaagcataaaagcaggtaatgatatagcagcatgtcttagaaagaatggtaagaaagtaattcagctatctcgaaagacgtttgattcagaatatgtcaaaacgcgcgccaacgattgggatttcgtggttacaacagacattagcgagatgggcgcgaattttaaagcagaaagagttatagatcccagaaggtgtatgaaaccagtgatattgactgacggagaagaaagagtaatcctagcaggaccaatgcctgtaacacacagctcagcagctcagagaaggggacgaattggtcgtaatcccaaaaacgagaatgatcagtacatttatatgggggaacctttagaaaatgacgaagactgcgcgcattggaaagaagctaaaatgctacttgacaatattaatacccctgaaggtataattcccagcatgttcgaacccgaaagggaaaaggtggatgcgatagacggagaatacagactgagaggcgaagcaaggaaaactttcgttgatttgatgcggcgaggagacctcccagtatggctggcctataaagttgcagctgaaggcataaattacgctgacaggagatggtgctttgatggaattaaaaataaccaaatattggaagaaaatgtagaagtggaaatatggacaaaagaaggtgaaagaaagaaattaaaaccacgatggcttgatgctagaatttatagcgaccctttagcactaaaagaatttaaagaatttgctgcgggtcgtaagtccttaacattaaatttgattactgagatgggaagactaccgacatttatgactcaaaaagcgaggaatgcacttgataacttagcagtgctgcatactgcagaagctggaggtaaggcatataatcatgcactttccgaactccctgagactctggaaaccctattactcttaactctcctggccacagttaccggaggtattttcctcttcttaatgtcgggaaaaggaattgggaaaatgacactcggaatgtgttgtataattacagctagtatacttctgtggtatgcacaaattcaaccacactggatcgcggcatctatcatactggagttctttcttatagtcctattgatacctgaacccgagaagcaaagaactccacaggataatcagttaacgtacgtggtaatcgctattttgaccgtggtagcggctacaatggcgaacgaaatggggttcttggagaaaaccaagaaagatctcggactgggcagcatcactacacaagagagcgaatcaaatattttggatatagacctccgccccgcctcagcttggactttatacgccgtagcaacaacattcgtaacccctatgttgaggcatagcattgaaaacagttcagttaatgtctcattaacagcgatcgctaaccaagcaactgtactaatgggcctgggaaaaggatggccgttatccaaaatggacatcggggtaccacttttagctataggatgctacagccaagttaacccaatcacccttacggctgctttattactcttggtcgcgcactatgcaataataggaccggggctacaagctaaagctacaagggaggcccagaagcgtgctgcagctggtattatgaaaaatcctacagttgacggcataacagtaatagacctggaacctataccgtatgatcctaagttcgaaaaacaattggggcaagtcatgctacttatattgtgcgtgacccaagttttaatgatgcgcactacgtgggcattatgcgaagcactaacattagcaactggacctatatctacgctgtgggaagggaacccaggtcggttttggaataccactatagctgtgagtatggcaaatatttttagaggttcctatctcgccggggcaggactattattctctatcatgaaaaacacgacgaacacgagacgaggtacaggaaatataggagagaccttaggagaaaagtggaaatcgagattaaatgcacttggaaaatcagagtttcaaatttataagaaatcaggtatacaagaagttgatcgtacattggcaaaagaggggataaaaagaggtgaaacagatcatcacgcggtatcgcgaggaagcgcgaaactaagatggttcgttgaacgtaacatggttacgcccgaagggaaggttgtggatcttggatgcggtagaggtggctggagttattattgtggaggcctcaaaaacgttagagaggtcaaaggattaacaaaaggaggaccaggtcatgaagaaccaattcctatgagcacgtatggttggaatctcgtaaggctacaaagtggcgtagacgtcttctttacaccaccagaaaaatgcgacacattgttatgcgatataggagaatcgtcaccaaaccctacgatcgaggcagggaggactcttagagtactaaacctagtagaaaactggttaaataacaacactcaattctgtattaaagtcttaaacccttatatgccgagtgtcatagagaaaatggaaactttacagagaaaatacggtggagctctggttagaaatccactatctagaaattcaactcacgaaatgtattgggtatcgaatgcaacgggaaatattgtgagtagtgtaaatatgatatcacgcatgttaattaatcgttttactatgaaacataagaaagctacgtatgagcccgacgtggatctaggaagcgggacaaggaatatcggcatcgaaagtgaagttccaaatttagatattataggcaaacgaatagagaaaataaaacaggaacatgaaacgagttggcactatgatcaagatcatccatataaaacatgggcataccacgggagctatgagacaaaacaaactggctcagcctcgagtatggttaatggagtggtgagactcctcacaaaaccttgggatgttgtaccaatggttactcaaatggctatgacggacactacaccttttggccagcaaagagtgttcaaggaaaaagttgacacacggacacaagaaccaaaagaagggacaaagaaattaatgaaaattacagctgagtggttatggaaggagctcgggaagaagaaaatacctaggatgtgtaccagagaagaatttacacgaaaagtacggtcaaacgcagcactaggagctatttttaccgacgaaaacaagtggaagtctgccagagaagcagtagaagacggtaggttttgggaattagttgaccgtgagaggaacttacatttggaagggaaatgcgaaacttgtgtatacaatatgatggggaagcgagaaaagaaattaggtgaatttggaaaagctaaagggtcaagagcgatatggtatatgtggttaggcgctaggttcctagagttcgaggcattaggttttcttaacgaagaccattggttcagccgcgggaacagtttaagtggggtagagggcgaggggttacatcggctagggtacattcttagagacgtaagcaagaaagaaggaggtgcaatgtacgccgacgacaccgcagggtgggatacccgtataactttggaggatttaaagaacgaagaaatgattactaaccacatgaaaggcgaacataaaaagctagcggaggcaatctttaaactaacgtatcaaaataaagttgttagagtccaacgtcccacaccgcggggaactgtgatggatatcataagtcgaagggaccaacggggcagtggacaagttggaacatatggtcttaacacatttaccaacatggaagcacaactgataagacagatggaaggagaaggaatatttaaaagtatacaacacttaactgtaaccgaggaaattgcggtacagaactggctggcgagagtaggaagagaaagacttacaaggatggcaatttccggtgatgactgcgtggtaaagccgatcgatgatagattcgctaatgcattgaccgctctaaatgatatggggaaagttcggaaagacatacaacagtgggaaccatctcgtggatggaatgactggacgcaagttccgttttgcagccatcattttcacgaactggttatgaaagacggcagggtgctcgttgttccgtgccgaaaccaagatgaactgataggacgtgccagaatatctcaaggcgcaggttggtcactaaaagagaccgcgtgtctagggaaatcttatgcccagatgtggactctgatgtacttccataggagagacttacggctggcagcaaacgcaatatgctccgccgtgccgagtcattgggtccctaccagtcgaacaacgtggtccatccacgctaaacacgaatggatgacgacagaggatatgcttgctgtatggaaccgggtctggattcaggaaaatccgtggatggaagacaaaacaccagtggaatcatgggaagaagtgccatatctcgggaaaagagaagatcaatggtgtggctcgcttataggtcttactagcagagcaacgtgggcaaagaacatccaaaccgcaataaaccaagtaagatcactcataggcaatgaaggctacacggattacatgccatcaatgaaaagatttagaagagaagaggaagaggctggcgtactctggtga

SEQ ID NO: 22274 - RNA, 9876 nt, synthetic construct
  misc_feature 1..9876: note = derived and/or modified CDS sequence (opt6) from DENV-2__FJ850088__SS-prME
  source 1..9876: mol_type = other RNA
accgcaggagtaatagtaatgttaataccaactgtcatggctttccatctaacaacaaggaacggagaaccacacatgatagtagggagacaggaaaaaggaaaaagtttattatttaaaactgaagatggtgttaacatgtgcacattaatggcaattgatttaggggaattatgcgaagatacaataacttacaaatgtcctctattacgacaaaacgaaccagaagatattgattgttggtgtaattccacaagcacctgggtaacatatggtacctgtacaactaccggagaacatagaagagagaaacggtccgtagcgctggttccccacgtaggtatggggctggaaacgaggacagaaacatggatgagcagcgaaggcgcgtggaaacatgtacaaaggattgaaacatggattctgcgacacccaggatttacaatgatggctgcaatattagcttataccattggcacaactcacttccagagggcgcttattttcattttattgacggctgtagcaccatcgatgacaatgaggtgcattggaatctcaaatagggactttgtggaaggtgttagcggaggaagttgggtagacatcgttcttgaacatggtagttgtgtgacaacaatggccaaaaataaacccacactggattttgaattaatcaaaaccgaagctaaacaaccagctacattacggaaatactgcgtagaagcaaaacttacaaacacaaccacagaatcgaggtgtccaacacaaggagaaccaagtttaaatgaagaacaagataaaagattcatatgcaaacatagtatggtagatagaggatgggggaacggatgcgggctctttggaaaaggtggtatagtaacttgcgctatgtttacgtgcaagaaaaatatggagggaaaagtcgtacaacccgaaaacttggaatatacaatagtaatcactccacactcaggtgaagaacacgcagtcgggaacgataccggtaaacatggaaaagaagtgaagattactcctcaatcatctataactgaagctgaattaactggatatggcacagtaaccatggaatgtagtccacgaactggccttgactttaatgaaatggtacttttgcaaatggaagataaggcttggctggtgcatagacagtggtttctcgacttgcctttgccctggttaccaggggctgatactcaagggtcaaattggatccaaaaagaaactctggttacattcaaaaatccacatgctaagaaacaggatgtggtagtgcttggtagtcaggagggagccatgcacacagcgttaacaggagcaacagaaattcagatgtctagcggcaacctactttttactggccatttgaaatgtagactgagaatggataaacttcagctgaaaggtatgtcttattcaatgtgcactggtaaattcaagatagtaaaagaaatcgcagaaactcaacatggaacaatagtaataagagttcaatacgagggagacggctctccttgtaaaataccttttgagattatggacttggagaaacgccatgtactcggaagattaattacagtaaatccgatcgttacggaaaaagattcgccagtaaatatagaggctgagcctcctttcggggactcctacattatcgtaggagtcgagccgggacagttaaaactcaattggttcaagaaaggatcgagcattggacaaatgtttgagaccactatgagaggcgcgaaacgaatggcaatactaggagatactgcatgggattttggttccctagggggtgtatttacaagtataggtaaagcactacaccaagtcttcggtgctatctatggagcagccttcaacggtgtctcttggacgatgaaaattctaattggcgtcattattacatggataggaatgaactcacgtagcacttcgttaagtgtttcattagtccttgtaggcgtagtaactctgtatttaggtgcaatggtacaagccgattcagggtgtgtagtttcgtggaaaaataaagaattgaaatgcgggtcagggatttttataacggacaatgttcacacgtggacagagcaatacaaattccaacctgaaagcccatctaaactcgccagtgccatacaaaaagctcacgaggaagggatttgtgggataaggtctgttactagattagaaaatcttatgtggaaacaaataacgcctgaattaaatcatattttaagcgaaaatgaagtaaaattaacaatcatgactggggacattaaaggcatcatgcaagcaggaaaacgatctttgagaccacaaccaaccgagttaaaatattcgtggaaaacttggggtaaggcgaagatgctaccaacagagtcacacaatcagactttccttattgacggccctgaaacagcggaatgtcctaacgcaaacagagcttggaactcactagaagtagaggactatggatttggggtatttacaacaaacatctggttaaaacttcgagaaaagcaagatgtattctgcgatagtaaattaatgtcagctgccattaaggacaatcgagcggtccatgcggacatgggttactggatagaatctgcgctaaatgatacgtggaaaatggaaaaggcatcatttatagaagtgaaatcatgtcattggccaaaatcccatacactttggagtaatggcgtgctggaatcagagatgattatacccaaaaactttgctggaccagtcagtcaacacaactaccgcccaggataccatacgcaaacggctgggccgtggcacttgggaaaattagagatggattttgacttttgtgaagggaccactgttgtagttacggaggactgcggaaaccgcggtcccagcttacgaactacgacagctagtggtaaattaataacggaatggtgctgtagatcttgcacacttcccccactgcgttaccggggtgaggacggatgttggtatggaatggaaataaggccgcttaaagaaaaagaagaaaacctcgttaacagtctagttacagcgggacatggacaaatcgacaactttagcttaggcgtattaggcatggctttattcctcgaagaaatgctaagaactagagtaggcacaaagcacgccattctattagttgcagtgagcttggtcactctaataactggtaatatgtcatttagagatttaggacgagtcatggttatggtcggcgcaacaatgactgatgacataggcatgggcgttacatacctcgctttactagcagccttcaaagtacgacccactttcgcagctggacttttattaaggaagttgactagcaaggaattgatgatggcaacaataggagtagcacttctttcccaaagtacaatccccgagacgatattagaactaactgacgcgttagcgttaggcatgatggccctgaaagtcgttaaaaatatggaaaaatatcaattagctgtgacaataatggcaatatcttgtgtccctaatgctgtgatcctccaaaacgcctggaaagtcagttgtacaatactagcggcagtatctgtaagtccactattactcacttcaagccaacagaaggccgattggatcccgttagcgttaaccattaagggcttaaacccgacagccatatttctaacaactctcagtagaacatcgaagaaacggtcgtggcccctaaacgaagccgtcatggcagtaggaatggttagcattttggcgagttctttactgaaaaacgatataccgatgacgggaccgctcgtcgccggaggtcttttaacagtatgctacgttcttactggaagaagtgcggacttagaattggaaagagcagcagatgttaaatgggaagaccaagcagagatttctggctcatccccgatattatcgatcacaatctcagaagatggaagtatgtcaattaaaaatgaggaagaggaacagaccttaaccatattgatacgcacaggactactcgttatttctggagtattccccgtaagcataccaattacagcagctgcatggtatctatgggaagtcaagaagcaaagagcgggcgtcttgtgggatgttccttctccaccacctgtcgaaaaagctgagttagaagatggcgcataccggattaaacaaagaggtatattaggttactcacaaataggagcaggggtttataaggaaggcacttttcacacgatgtggcatgtcacacgtggcgcggttctcatgcacagaggaaaaagaattgaacctagttgggctgacgttaagaaagatcttgtgagttatggtgggggatggaaattggagggtgagtggaaggagggcgaagaggtgcaggttttggccttagaaccgggcaaaaatcctagggctgtacagacaaaacctggcatttttaaaaccaacacgggtacaataggagcagtgagtttggacttcagccctggaacatctgggagtccaattgtggataggaaaggcaaagttgtggggctttacggaaacggtgttgtaacaagatctggggcttatgttagcgcaatagcccaaaccgaaaaatcaatagaagataatccagagatcgaggacgatatttttaggaagaagagattaacgataatggatttgcatccaggggcaggcaaaaccaaacgctatctacctgctatagtaagagaagcgataaaacgaggattaagaaccttgattctagcacctacgcgtgtagtagctgctgaaatggaagaagcgctaaggggtttgccaatcagatatcagacgccagcaatccgagcagaacacacgggacgagagatagtagacctaatgtgtcatgcgacattcacaatgagacttctttctccagttagagtaccaaactataacttgatcattatggacgaagctcacttcacagatccggcttctatagcagctcgcggatatatatccacacgcgtagagatgggggaggctgcaggcattttcatgactgctactccaccaggaagtagagacccctttccacaaagtaatgcaccaatcatggacgaagagagggaaatacctgaaagaagttggaactccggccatgaatgggtcacagattttaagggaaagacagtatggtttgtaccaagcattaaagctggaaatgatatagcagcttgtcttagaaagaatggtaagaaagtaatacagttgagtcgaaaaacatttgacagtgagtacgttaaaacccggtcgaacgactgggattttgtagttacgaccgatataagtgagatgggggcaaatttcaaagctgaacgagtgattgatcctagacgatgcatgaagcccgtaatccttacagacggggaagaacgtgtaattttagctggtcccatgcccgtaacacatagttccgctgcacaaaggcgcggccgaatagggcgaaatccaaagaatgaaaatgatcaatacatatacatgggcgagccattggaaaatgatgaagattgtgctcattggaaagaggcaaaaatgctcctcgataacattaacacgccagaaggcatcataccgagtatgttcgagccggaaagggaaaaagtcgacgcaattgatggagaatacaggctaaggggtgaagcaagaaaaacgtttgtagatcttatgcggagaggtgatttacctgtttggctagcttataaagttgcagcagaagggataaattatgctgataggagatggtgttttgacggcatcaaaaataatcaaatattagaagagaacgtagaggtagagatatggacaaaggaaggtgaacgcaaaaagttgaaacctagatggttggacgcacgaatatatagtgatcctttggcgttaaaagagtttaaagaatttgcagctggtaggaaatcattgactctaaacttaattacagaaatgggaagattgccaacgtttatgacacaaaaagctaggaatgccctcgataatctagccgtactacacaccgcagaagcagggggaaaagcatacaaccatgcactaagcgaattaccagaaacgctagaaacattgcttttgctcgcgttgctagctacagtcacaggaggaatattcctatttctaatgtcaggaaaaggaatagggaaaatgaccttaggcatgtgttgcattatcacagcatccatattactatggtacgcacaaatacaaccacactggatagcggcctctattatattagagtttttcttaatagtactcctgattcctgagccagagaaacaaagaaccccacaggacaatcaattgacctatgtggtaatagcaatactaacggtggtagcggctacaatggcgaacgagatgggatttttagagaaaactaagaaagatttaggattaggatcaataacaacgcaagaaagcgaaagtaacatactagatatagatttaagacctgcctctgcatggactctatatgccgttgcaacgacatttgtaacgccgatgctacgtcattcaatcgaaaattcatcagtgaatgtaagcctaactgccattgcaaatcaagcaacagttttaatgggattgggcaagggttggcctttaagtaaaatggacatcggcgttccactcttagcgataggttgctatagtcaagttaacccaattactctaactgcggcacttttactcctagtggcccattatgctataatcggtcccggtcttcaggctaaagcgacaagagaagcacagaaaagagctgctgcaggtatcatgaagaatcccacggtagatgggataacagtaatagatttagaacctattccttatgaccccaaatttgaaaaacaattgggtcaagttatgttacttattctatgcgtaactcaggtcctcatgatgagaacaacttgggcgctttgcgaagcattaaccttggcgaccggtccaattagtactttatgggaagggaatcccggcagattctggaatacaacgatagcggtatcaatggcgaatatatttcgaggttcttacctggctggggcagggctcttgttttccgtaatgaaaaataccacaaataccagacgtggaacaggaaatatcggagaaactttaggtgaaaaatggaagagtaggctaaacgcgttaggaaagagcgaatttcaaatctataagaaaagcgggatccaggaagtggatagaacgctggccaaagaaggtataaagaggggtgaaaccgatcaccacgctgtaagccggggaagtgcaaaacttagatggttcgtcgagagaaacatggtcacgccggaaggtaaagtagtcgacctgggttgcgggagaggtggatggagctactattgtggtggattaaagaacgtaagggaagtaaaaggactaactagagggggaccgggacacgaggaacctattccaatgtcgacttatgggtggaacttggtgcgactccagtctggtgtagacgtattctttaccccgccagagaagtgcgacacactcttatgtgatatcggtgaatcaagccccaatccaactatagaagccggtagaactttgagggtactcaatttggtagaaaactggctaaataacaacacccaattctgtataaaagttttaaacccttatatgccgtcagttatagaaaagatggagacgctacagagaacatacggaggagccctagtaagaaacccgctatcgagaaacagtacgcacgaaatgtattgggtctctaatgcaactggaaacatagtctctagtgtcaacatgattagccgaatgctaattaatagatttacaatgaaacataaaaaggctacttatgaaccagatgtagacctgggcagcggaacgagaaatatcggaatagaaagtgaaattcctaatctagacattataggaaagaggatagagaaaatcaaacaagaacatgaaacttcatggcattacgatcaagaccatccttacaaaacttgggcatatcacggtagctatgaaaccaagcaaacagggtcagcgtcttcaatggtaaacggagtagtaagacttctaacaaaaccatgggatgtagtaccaatggtcacacaaatggcgatgacagatactactccgtttggccaacaacgggtattcaaagagaaagtagatactcgtacccaagaaccaaaggaaggaacaaagaaattaatgaaaattactgcagaatggctatggaaagaactaggcaagaagaaaacacctagaatgtgtaccagagaggaatttactagaaaagtccgatcaaatgctgcgttaggagctatattcactgacgagaacaaatggaaaagtgcacgcgaagccgtagaagatgggagattctgggagctagtagacagagaaagaaacttacatctagaaggaaagtgcgaaacgtgcgtctacaatatgatgggtaaacgagagaagaaattaggtgagttcggaaaagctaaaggcagtagggcgatatggtacatgtggctaggagcaaggtttctagagttcgaggcactcggatttttgaatgaggatcattggtttagcagaggtaattctttgtcaggagtagagggagaaggattacatagattaggatatatactacgtgatgtaagtaggaaagaaggaggagctatgtacgcggatgataccgcaggctgggatacccgtatcacactcgaagatcttaagaatgaagaaatggtaaccaaccatatgaaaggagaacacaagaaattggctgaagcgatctttaaacttacgtatcaaaataaagtggtacgtgttcagcgtccaactcctagaggaactgtcatggacatcatttctcggagagaccaacgaggatctggacaagtcggtacatacggattaaacacatttactaacatggaagcgcaattaatacgacaaatggaaggtgaaggcatttttaaaagtatacaacacctaacagttaccgaggaaatagcagtgcagaattggttagcaagagtaggtcgagaaagattaacgagaatggctatctccggagatgactgtgtagtaaaacccatcgatgacagattcgcaaatgcacttacggcactaaacgatatgggaaaagtacgaaaagacatacagcagtgggaacccagcagagggtggaatgactggacccaagtcccgttttgcagtcaccattttcacgaattagtaatgaaagacggcagagtcctagttgtgccatgccgaaatcaggatgaattaatcggtagagcacggataagtcaaggcgctggttggagtttaaaagaaacggcctgcttaggtaaatcttacgcacaaatgtggacactgatgtactttcacagacgtgacttaagattggctgctaacgctatatgttctgccgttccttcacactgggtaccgactagcaggacaacctggagtatccatgcaaaacatgaatggatgactaccgaggacatgctagcagtttggaatagagtctggattcaagagaacccgtggatggaggataaaactcctgtagagagttgggaagaggtcccttacttaggaaagcgagaagatcagtggtgcggaagtcttatcggactcacaagtcgtgcaacgtgggcgaagaatatccagacggctatcaaccaagtacggtcactcataggcaatgaagaatatacagactatatgccaagcatgaagagattcagaagagaagaagaggaagccggggtgctatggtag

SEQ ID NO: 22275 - RNA, 9876 nt, synthetic construct
  misc_feature 1..9876: note = derived and/or modified CDS sequence (opt6) from DENV-2__FJ850091__SS-prME
  source 1..9876: mol_type = other RNA
actgcgggagtgatagtaatgctaataccaaccgctatggcatttcatttgactactagaaatggggaacctcatatgatagttggacgccaggaaaaaggtaaatcgcttttatttaaaactgaagatggggtaaacatgtgtaccctgatggcaatggacttgggtgaactatgcgaagacacgataacctataaatgtccattattacgccaaaatgaaccagaagacattgattgctggtgtaatagcacatcaacgtgggttacttatggtacgtgtacaaccacgggggaacatagaagagaaaaacgttcagtagcgttagtaccacatgtcggaatgggtcttgaaactcgtactgaaacatggatgtcgtcagaaggtgcatggaaacacgtgcagcgcatagaaacatggatacttagacacccaggttttacaataatggcagcgatattagcgtacactattggaacaacacatttccaaagagcattaatattcattttattaaccgcagtcgcaccgtctatgacaatgaggtgcataggcatctcaaatcgcgactttgtggaaggagtaagtggaggatcatgggtagatatagttttagagcacggcagctgtgtaacaactatggctaaaaataaacctacgcttgattttgagctaataaaaacagaagcaaaacaaccagcgacactgaggaaatactgcattgaagcaaaactaaccaatacgaccaccgaaagcagatgcccaacacagggagaaccgtcattaaatgaagaacaagataaacgatttatatgtaaacattcaatggtggacagaggatgggggaacggatgtggattgttcggcaaaggtggaatagtaacatgcgcgatgtttacgtgtaagaaaaatatggaaggcaaaatagtacaaccagaaaacttagaatacacaatcgtgatcactccgcattcgggtgaggaacatgcggtcggaaacgacacaggcaaacacggcaaagaaataaaaataacacctcagagttctactactgaagcagaactaactggctacggcacggtgactatggagtgctctccacgaacaggcctagatttcaatgaaatggtattacttcaaatggaggataaagcatggctcgtacatagacaatggttccttgatcttcctttaccatggttacccggtgctgacacacaaggttccaattggatacaaaaagagaccttagtgacgttcaaaaatccccacgccaagaaacaagacgtagtagtcttaggtagtcaagaaggggccatgcacactgccctaacaggtgctactgaaatccaaatgtccagcggcaatctgttgtttacaggccatctgaaatgcaggctccggatggacaagctccaattaaaaggtatgtcgtactcaatgtgtactggaaaatttaagatagtaaaagaaatcgctgaaacccagcatggaactattgtaatcagagtacagtatgaaggcgatggatcaccatgtaaaataccgtttgaaatcacagatttagagaaaagacatgtattggggcgattaataacagtaaatcccatagtaacagaaaaagattcacctgttaatatagaagcagaaccaccatttggagatagttacataattgtgggggttgagccaggacaactaaaattaaattggttcaagaaaggttcaagtataggtcagatgtttgaaacaacgatgaggggtgccaaaaggatggccatactaggcgacaccgcatgggattttggcagtctaggaggggtctttacaagtataggcaaagcattgcaccaagtgttcggagccatatacggcgcggctttttcaggtgtatcgtggactatgaaaatactaataggagttataataacatggataggtatgaatagcagaagcacatctctcagtgtgtcattagttctggtaggggtagtaacattatacctaggagcaatggtacaagctgattcggggtgcatcgtgtcttggaaaaacaaagagctaaagtgcggatcaggtatatttataacggataatgttcatacatggacagaacagtacaaatttcaaccagaatcaccttctaaacttgcttcagccatacaaaaagctcatgaggaagggatttgtggcattcgatctgtgactagattggagaatcttatgtggaaacagataacccccgaactaaaccatatacttagcgaaaatgaagtaaagttaaccataatgactggtgatatcaagggaatcatgcaagccggtaaaaggagcttgaggccgcaacctacagaactaaaatattcatggaaaacgtggggcaaagccaaaatgttaagtacagaatcccataatcagacattcctcatagatggccctgagactgccgaatgccctaacactaaccgggcatggaactcactcgaggtagaagattatggatttggtgtattcacaactaatatttggcttaaattaagggaaaaacaagatgtattctgtgactccaagttgatgagcgcagctataaaagataatcgtgccgttcatgcagacatgggctattggattgaatcagcccttaatgatacatggaaaatggagaaagcgtcctttattgaagtaaaaagttgccactggccaaaatcgcataccctttggagcaacggagttttggaatccgaaatgataatccccaaaaatttcgccggacctgttagtcaacacaattaccgacccggatatcatacgcaaacagctggtccgtggcatttgggaaagctcgaaatggattttgatttctgtgagggtacaacagtcgtagtaacagaggattgtggaaatcgcggcccgtctttgcgaacaacgactgcaagtggaaaattgattactgaatggtgttgcagaagttgtacactacctccattaaggtacagaggtgaagacgggtgttggtatggaatggagattcgaccattaaaagaaaaagaagagaacctagttaattcattggttactgcgggacacggtcagatagataatttctcattaggagttctcggaatggcgttatttttagaggaaatgctgaggacacgtgtcggaaccaaacacgcaatactcttagtagctttatcattcgtaacactaataacaggtaatatgtcattcagagaccttggtagagtgatggtaatggttggagcgaccatgactgacgatataggaatgggagttacatatcttgctctcttggcagccttcaaagtgaggcctacgtttgccgctggattacttctacgcaagttaacaagcaaagagttgatgatggcaacaataggtatagcacttttatcacaatctaccttacccgaaaccatattagagcttaccgatgcattagcattaggcatgatggcattaaaaatcgtgagaaatatggaaaaataccaattagctgtgacaataatggcaatttcctgcgtacccaacgcagtaattctacaaaatgcttggaaagtatcatgcactattctagctgctgtctcagttagccctcttctattaacgtctagtcagcagaaggcagattggatcccacttgcactgaccataaagggtttgaaccccacggccatatttcttacaactctgtcaagaacaagtaagaaaagatcttggccattaaatgaagcaataatggctgttggaatggtaagcattctagcaagtagtctactaaagaatgacatcccaatgacaggccctcttgttgctggagggctactaacagtatgctatgtactaacaggtcgagcagcagatttagagctggaaagagccgcagatgtgaaatgggaagatcaggcagaaataagtggcagttcaccaatattatccatcacaatcagtgaagatggaagtatgtcaatcaaaaatgaagaggaagaacaaacgctaacaattttgatccgcactggtttattagttattagtggagttttccccgtgtctattcccattactgcggcggcttggtatctgtgggaagtgaaaaagcaaagagccggtgtactttgggatgttccgtctccacctcctgttggtaaggcagagcttgaagatggtgcctatcgaataaaacaaagaggaatcctgggatattcgcagatcggcgccggtgtttacaaagaaggaacctttcacacaatgtggcacgtgacaaggggagctgtactgatgcatagagggaagaggatagagcctagctgggcagacgtcaagaaagaccttataagctatgggggaggatggaaattagaaggagaatggaaggaaggtgaagaagtacaggttttagcactcgaaccgggcaaaaaccctcgcgccgtacagactaaaccaggcatatttaaaacaaataccggtactataggagctgtatccttagatttctcacccggcacatcaggctctccaatcgtcgatagaaagggaaaggttgttggactatatggtaacggagtagtaactagatcgggcgcttatgtctctgcaatagcacaaaccgagaaaagcattgaagacaacccagagattgaggacgacatttttaggaagaaaagattaacaataatggaccttcatcccggtgcgggcaaaaccaaaagatacctaccagcgatagttcgcgaagcgattaaacgaggtcttagaacactgatactagcgccgacaagggtcgttgcggcagagatggaagaagccctccgtggtcttcctattagataccaaactcccgctataagagctgagcataccggaagagagatagtggacttaatgtgtcatgcaacatttacgatgaggctactaagtccagttcgagtaccaaattataatttaattatcatggatgaggcgcactttacggacccagctagtattgccgctagaggatacataagcacaagagtcgaaatgggtgaggcagcaggtatatttatgacagcaacgccacctggctcgagagatccttttccacaatcaaatgcacctattatggatgaagaaagggagataccggagcgaagttggaactcaggacacgaatgggttactgattttaaaggtaaaacggtgtggttcgttccctccataaaggcaggtaatgacattgccgcctgcctacgtaaaaacggcaaaaaggttatacagttatcacgcaaaacattcgattctgaatacgccaaaaccagggcaaatgattgggatttcgtggttacgacagatatatcagaaatgggggctaattttaaagctgaaagggtaatagacccccgtcgctgcatgaagccggtgatactaacagatggcgaagaacgagtcatattagctggtccgatgccagtgacacactctagtgctgcccaaagacgagggagaataggaagaaatcccaaaaacgagaatgatcaatacatctacatgggagagccgcttgagaacgacgaagactgtgcgcactggaaggaagctaaaatgttgttggataatattaatactccagaagggataattccctccatgttcgaaccagaacgcgaaaaagtagacgcgattgacggagagtacagactgcgaggagaagccaggaaaacatttgtggacttaatgagaaggggagaccttcccgtttggctggcctataaagttgcagcagaaggaattaactatgctgatcgtaaatggtgctttgatggaatcaaaaacaatcagatattggaggagaacgtagaagttgaaatatggacaaaagagggcgaaaggaagaaacttaaaccgagatggctggatgcccgtatctattctgatccattggcactaaaagaatttaaagaatttgcggctggacgaaaatcattaactctaaacttgattaccgaaatgggtcgcctgccaacgtttatgactcagaaagcccgtaacgcactagataaccttgcagtgttacatactgctgaggtcggaggaaaagcgtatacacatgccttaagtgaactaccagaaacactggaaactttactcttactaacactactcgcagctgtcacgggaggtatattcttatttctcatgtctggtaaaggcataggcaagatgaccctaggcatgtgctgtatcattacagcatctatacttttatggtacgcgcaaattcaacctcattggattgccgcatctattatcttggagttctttttaattgtactactgataccagaaccagaaaaacaaagaaccccacaggataatcagctaacttatgttgtaatagcgatactaaccgtggtagccgcaacgatggctaacgaaatgggattcctagagaaaacaaagaaagacttagggtttggttcgatcaccactcaagaaagcgaaagcaatatcttagacatagacctgagaccagcgtcagcttggacattatatgcagtggccactactttcgtgactccaatgttgcggcactctattgaaaactcatctgtaaatgtgagtttaacggcaatagcaaatcaagctactgtccttatgggtctaggaaaaggatggcctttatctaaaatggatataggagtaccactcctagctatcggatgttactcacaggttaatcccataacgctcactgctgcattgcttttattagttgcacactacgccatcataggcccaggacttcaagcaaaagctacacgggaagctcagaaaagagccgctgcaggcataatgaaaaatcctacagtagatggcataacggtaatagatctagaaccaattccatatgatccaaaattcgaaaaacagttaggtcaagtaatgctcctaattctatgcgtcacacaggttttgatgatgagaacgacatgggcactctgtgaagcactaacactcgcaacaggccccatctctacactatgggaaggtaatcctggacgattctggaacacaacaatcgcagtatctatggccaacatatttcgagggtcctatttagccggcgcaggattactgttcagtataatgaagaatactacaaataccagaagaggtacggggaacgtaggagaaacactgggagaaaaatggaaatctagattgaacgcgctaggaaagtcagagtttcaaatttacaaaaagagcggaatccaggaagttgatagaactttagcgaaagaaggcataaaacggggagaaacagatcaccatgccgtttctagaggaagtgcaaaattgcgatggtttgttgaaagaaatatggtaacgccagaaggcaaggtagtagacttgggatgcggacgtggaggttggtcgtactattgtggcggtctcaaaaatgtgagagaagtaaaggggctcacaaaaggaggaccaggacatgaagaacccataccgatgtctacgtatgggtggaacttagtgcgtttacaaagcggagttgatgtcttctttaccccaccggaaaaatgcgacacattattgtgcgatataggagagtcatccccaaatccaacgatagaagcaggcaggactttgcgcgtactcaatttagtagagaattggttgaataacaacacacaattctgtatcaaagtactgaatccctacatgccatccgtcattgagaaaatggaaaccctccaaagaaaatacggcggggcattagttcgtaatccattgagcagaaattccactcatgagatgtactgggtatccaacgcaaccggcaacattgtatctagcgttaacatgatatcgcgaatgttgatcaatagatttacgatgaaacataagaaagcgacatacgagcccgacgtagatcttggttcaggtacacgaaatattgggattgaatcagagattccaaatctggatatcatcggaaaaagaatagagaaaataaaacaagaacacgaaactagctggcactacgaccaagaccacccttataaaacatgggcttaccacggaagttatgaaactaaacaaactgggtcagcaagctcgatggttaatggtgtggttaggctcttaacaaaaccgtgggatgttgtaccaatggtcacccaaatggccatgactgacacaacaccattcgggcaacagagggtttttaaagaaaaggtcgacactagaactcaggaacctaaagaaggaactaagaaactgatgaaaataacagctgaatggctctggaaagaactaggaaaagagaaaacgccgagaatgtgtactcgagaagagttcacacgaaaagtacgatctaatgcggcactcggagcagtattcacagacgaaaacaagtggaaatctgctagagaggctgttgaagatggaagattctgggagctagtagatcgagaaagaaacctccatctagaagggaaatgtgaaacatgtgtatacaacatgatgggtaaaagagagaagaaactaggcgaatttggaaaagcaaaaggctcaagagccatttggtatatgtggctgggggcacgattcctagagttcgaagcattgggattcctgaatgaagaccattggttttcacgtggcaactctttgagtggggtggaaggagaaggacttcaccggttaggctacattctacgtgaagtaggaaagaaagagggtggggcgatgtacgcagacgatactgcagggtgggacacacgtattactttggaagatctcaaaaatgaagaaatggtgacgaatcacatgaaaggtgagcataaaaagctagcggaagcaatctttaaattaacgtaccagaataaagtagtccgagtacagagaccaaccccgcgaggcacagtaatggatatcataagtcgcaaagaccaacggggtagtggacaagttgggacttacggtctaaatactttcacaaatatggaagctcaacttatacgtcagatggaaggggaaggtattttcaaatctatacaacacttaaccgccaccgaagaaatagccgttcaaaattggctagccagggtaggcagagaacgattgagtagaatggcaatatcaggtgatgattgtgttgttaaacccatagatgaccgatttgcctcagccctaacggctctaaatgatatggggaaagtgcgaaaggacatacaacaatgggaaccatcaaggggttggaatgattggacacaagtacctttctgttcacatcattttcatgaacttgtaatgaaagatggccgtgtgttagtcgtgccatgcaggaatcaagatgaacttattggtagggctcgaatatcccaaggagcgggctggtcccttaaagaaacagcatgcctgggcaaaagctacgctcaaatgtggacgctcatgtattttcatagaagagatctaaggctggcggcgaatgcaatatgctcggcagtaccctcacactgggttccgacgagtagaactacttggtccattcatgcaaaacacgaatggatgacaaccgaagatatgttggcagtgtggaatcgagtatggattcaagagaatccttggatggaagataaaactccggtagaatcgtgggaagaagtcccgtatttaggtaagcgagaagatcaatggtgtggatctttaataggacttacatccagagccacatgggccaagaacattcaaacggcgattaaccaagtcagatcattaatcggaaacgaaggctacacagactacatgccgagtatgaagagatttcgccgcgaggaagaagaagctggggtcttatggtaa

SEQ ID NO: 22276 - RNA, 9876 nt, synthetic construct
  misc_feature 1..9876: note = derived and/or modified CDS sequence (opt6) from DENV-2__GQ199890__SS-prME
  source 1..9876: mol_type = other RNA
actgcaggagttatagtaatgttaatcccaaccgcaatggccttccacctaactactcgaaatggagaaccacacatgatagtgggtagacaagaaaaaggaaaaagtttgcttttcaaaacggaagatggtgttaatatgtgcactttaatggcgatagatctgggtgaattatgtgaagatactatcacatacaaatgcccgttattgcgacaaaacgaaccagaagatatagactgctggtgcaacagcacgagtacgtgggtaacatacggaacgtgtaccacaatcggtgaacacagacgagagaaacgatcagtagctttagtaccgcatgtaggaatgggtcttgaaacaaggaccgaaacgtggatgtcgtcggaaggagcctggaaacacgttcagagaatcgaaacatggatattaagacatcctggattcactatcatggcagctattctagcctatacaattggaacgactcattttcaacgagcgttaatattcattctgttaaccgcagtagcaccatcaatgaccatgagatgtatcggaatatctaaccgagatttcgttgaaggagtaagcggagggagctgggtcgacatcgttctagagcacggatcttgcgtaacaactatggccaaaaataaacctactctggattttgaattgatcaaaacagaagcaaaacaaccagcaacattaagaaaatattgcatcgaggcaaaactaactaataccactacagagagcagatgtcctactcaaggtgagccttctctaaatgaggaacaggataaacgatttatatgcaaacactccatggtcgatcgaggttggggaaatggatgtggactttttggaaaaggtggaatagtaacttgtgcaatgtttacgtgtaagaaaaatatggaaggaaaaattgttcaaccggagaatctagaatacacaatcgttattactccccattccggagaagaacgagcagtaggaaacgatacaggtaaacacggaaaagaaattaaaatcactccccagtcgtcaacaactgaagcggaattaactgggtatgggacagtaacaatggaatgtagtccaaggaccggactagactttaacgaaatggtattgctgcaaatggaagataaagcatggttagttcatcgacagtggttcttggatttaccactgccttggttaccaggagcagacacacaagggtccaattggattcagaaagagactttagtaactttcaaaaacccgcatgcaaagaagcaagatgttgtggttctgggctctcaagagggagcaatgcacactgctttgacaggggccacagaaatccaaatgagctctggaaacctactcttcacaggtcatctcaagtgtcgactaagaatggacaaactacaacttaagggaatgtcttattcaatgtgcactgggaaattcaaaatagtaaaagaaatcgcagaaacccaacacggtacgatagtcattagagttcagtatgagggggatggatcaccatgcaaaattccatttgagattacggatctagaaaagaggcatgtacttggtaggctaataactgtaaaccctatagtcacggaaaaagattccccagttaacatagaggctgaacctccctttggcgacagctacataattgtaggggttgagccagggcaattgaaacttaactggttcaaaaagggatcatcaatagggcagatgtttgaaactacaatgaggggagctaaacgaatggccatactgggagacacagcatgggattttggaagcctgggcggagtatttaccagtatcggcaaggcactgcaccaggtctttggtgctatctacggagcagccttttccggagtatcgtggacaatgaaaatactgattggcgttataataacctggataggaatgaatagccgtagtacttcattatctgtttctctagtcttagtaggtgttgttactttgtacctaggggccatggtgcaagcagattctggatgtatagtgtcatggaaaaataaagagctcaagtgcgggtctggtatatttattacagataacgtacatacatggactgagcaatacaaattccaacctgaatctccttcaaaactagcaagtgccatccagaaagcacacgaagaagggatttgcggcatacgatccgtcacgagactagaaaatctgatgtggaaacaaatcacaccagagcttaatcatatccttagtgaaaatgaagttaaattaactataatgacaggtgatataaaaggcattatgcaagcaggaaaacgctcactgcgtccacaaccaaccgaattgaagtactcgtggaaaacatgggggaaggctaagatgttatcaacagaatcacacaatcaaacattcttgatagatggccccgagaccgctgagtgcccaaacactaaccgagcatggaacagtttagaagtagaagactacggctttggcgtattcacaacgaatatatggctaaaattacgagagaaacaagatgtcttttgcgattcgaaactaatgtctgctgcaataaaggataatagagccgttcacgctgatatgggttactggatagaaagtgccctaaatgacacctggaagatggagaaagcatctttcattgaagtgaaatcctgccattggccgaaatcacatacactctggagcaatggcgttctagaaagtgaaatgataatacctaaaaacttcgccgggccggtttcgcaacacaactatcgaccaggatatcacacacaaacagcaggaccctggcatttgggtaaacttgaaatggatttcgacttttgcgaagggacaacagtggttgttacagaggattgtggaaatagaggaccttccttgagaaccacaaccgcatccggaaaattaataacagagtggtgctgcagatcgtgtacactaccaccactcaggtaccggggtgaggatggatgctggtatggcatggagatcagaccattgaaagaaaaagaagagaatttagtgaacagcttagtaacggctggacatggacaaattgataactttagcctcggagtactggggatggctctatttttagaggagatgctccggacacgtgtaggaacaaaacatgctattctattagtggctctcagctttgtgacacttataactggcaatatgtcttttcgtgatttagggagggtcatggtaatggtaggagccactatgactgatgacattggtatgggagtaacttacctcgcgcttttagctgcatttaaagtcagaccgacgttcgccgccggcctactcttaagaaagctaacatctaaagagctaatgatggctactatcggtattgctcttttatctcaaagtactctacctgaaacgatattagaactaaccgacgctctcgcacttgggatgatggctcttaaaatagttaggaatatggagaagtatcaattagcagtgacaataatggcgatctcatgtgtcccaaacgccgtgattcttcaaaatgcctggaaagtatcgtgcactatactagcagcagtatctgtaagtcctttgctattaacctcgtcacaacagaaggcagactggatacccttggccctgaccatcaaaggtttaaatcctacggctatatttctaacaaccctcagtaggacaagtaagaaacgcagttggcctctgaacgaagctataatggccgttggaatggtgagtatactcgctagttccttactcaaaaacgacatcccaatgacaggtccactggtcgccggaggattattgacagtctgttatgtattaactggacgttcagcggacctcgaactagaaagggccgccgacgtgaaatgggaagaccaagccgaaattagtggttcatccccgatactaagtataacaatatctgaggacggttctatgtcgataaagaatgaggaggaagaacaaactttaacgatactgatccgaactggtcttttagtgatatcaggagttttccccgtgagcatacctataaccgccgcggcgtggtatttatgggaagtcaagaaacaacgagcaggggttctatgggacgtaccttcaccgcctccagttggtaaagcagaattagaggatggcgcttatcgtatcaaacaacggggcattctaggatatagtcaaataggagcaggagtatataaagaaggaactttccatacaatgtggcatgttacacgtggtgcagtccttatgcatcggggaaaaagaattgaaccctcgtgggccgatgtcaaaaaggatctcatatcctacgggggaggttggaaattagagggtgagtggaaggaaggcgaagaagttcaagttctcgcattggaaccaggcaaaaatccaagagctgtccagaccaaacctggcatcttcaaaacgaacaccggcacaataggtgcagtttcacttgactttagtccgggaacaagtggaagcccaattgttgatcgaaaaggcaaagtagttggcctatatggcaatggagttgtgactagaagtggtgcgtacgtaagcgctatagcgcagacggaaaaatcaattgaggacaatcctgaaatagaggacgatatatttcgtaagaaaagactgactataatggacctacaccccggagctggaaagaccaaaaggtacctaccagccattgtgagggaagcaataaaaagaggcctacgcacgctgattctagcaccaacaagagtcgttgcagcagagatggaagaagcgctacgtggactaccaataagatatcaaactccagctattagggctgagcatacaggtagggaaattgtagacctaatgtgtcatgcaacatttactatgcgacttctatcaccggtaagggtacctaattataacttgattataatggatgaagctcattttaccgaccctgcatccatagcagctcgaggctacattagtacaagagtagagatgggagaagccgctggcatcttcatgacagctactccaccaggaagcagagacccttttccacaatcaaatgcgcctataatggacgaagaaagagagattcccgaacgaagctggaactccggccacgaatgggtaacggactttaaagggaaaacagtatggtttgtgccatccataaaagcagggaacgatattgcagcttgtctaaggaaaaacggtaaaaaggtaatacaactgagtagaaaaacctttgatagcgaatacgtaaaaacgcgcgcaaatgattgggatttcgtagtcactacggatatttccgaaatgggagctaatttcaaagctgaaagagttatcgatcctagaagatgtatgaagccagttatcctaacagacggagaggaaagagtaattcttgcgggccctatgccagtcactcactcatcagccgcacaacgtaggggtagaataggacgtaaccccaaaaacgaaaatgatcaatatatatacatgggggaacccctagagaacgacgaggattgcgcccattggaaggaagcaaaaatgttattagataatattaatacacctgaaggaataattcccagtatgtttgaaccagaacgagagaaagttgatgcaattgatggggaatatagattgcgtggcgaagcaagaaagacattcgtagatttaatgagacgaggcgacttgcctgtatggctggcgtataaagttgcggcagaaggaatcaactacgcagaccgtaaatggtgtttcgatggtataaagaacaatcaaattcttgaagaaaatgtggaagtagaaatatggacaaaagagggcgaaagaaagaaattaaaaccacggtggcttgatgctcgaatctacagcgatcccttggcattaaaagaatttaaggagtttgccgcaggccgcaagtcattaaccttaaaccttataactgagatggggagactgccaacattcatgactcaaaaagcacgaaatgcattagataatctagctgtcttacacactgcagaggtagggggaaaggcatacacccacgctttgtcagagttaccggagaccctagaaactcttctcttgttaacattactagcaactatcactggaggtatttttcttttcttaatgagcgggaaaggtataggcaaaatgactctgggcatgtgttgtataataacagcgtctattctactgtggtatgcacaaatccaaccccactggattgctgcttctataatcctagagttctttctaatcgtactattaattcctgaaccagaaaagcagcgaactccacaagataaccaactaacctatgtcgtaatagcaatcttaaccgtagttgcggccacaatggcaaacgaaatgggtttcttagagaaaaccaagaaagacctaggtttcggtaccattaccacgcaggagtcagaatcaaatatattggatatagatttgagacctgcaagtgcgtggacactttatgctgtagcaacaacatttgttacaccaatgttaagacattctattgaaaatagtagtgtgaatgtatcactaacggcaatagcaaaccaagcgacagtacttatgggcttaggtaagggatggccgctatctaaaatggatataggagtaccactcctagctataggatgttattcacaagtcaatccaataaccttaacagcagctttattactattagtagcacattacgcaataattggtcctggactacaagcgaaggcaacgagggaagcccagaaaagggctgccgcaggaattatgaaaaacccgacagtcgatggaataactgtaatcgacttagagcctatcccgtacgacccaaaatttgagaaacaactcggacaagtaatgctcctaatcctatgtgtcacgcaagtgctaatgatgaggacgacatgggcattatgtgaggcgctaactctagcaactggtcctatatctacactttgggaaggtaatccagggcggttctggaataccactatcgcagtatcgatggcaaatatatttcgcggcagctatttagctggagcaggactcctcttttctataatgaaaaatacaactaatacccgacgaggcacaggaaatgtcggagaaactcttggtgagaagtggaaaagccgtctgaacgcactgggcaagagtgaatttcaaatctacaagaaatccggcattcaagaagtggacagaacactcgcaaaagaaggaataaaaaggggagaaactgaccaccatgccgtaagtaggggaagtgcaaaactaagatggtttgtcgagagaaacatggtaactcctgaaggaaaagtcgtggacttggggtgcggacggggaggttggagttattattgcggtggattgaaaaacgtacgggaagttaaaggtctaacaaaagggggcccgggtcacgaagaaccaattcctatgagcacatatggctggaacctagtacggttacaatcaggtgttgatgttttcttcacacctccagaaaagtgcgatacactgctatgcgacattggtgaatcctcaccaaacccgactattgaagcaggtagaaccctacgtgtcttaaacctggttgagaattggctaaacaacaatacacaattttgtattaaagtattaaacccgtacatgccgtctgtaattgagaaaatggagacattgcaaagaaaatatggaggagccctcgttagaaatccgctctcacgaaattctacccatgaaatgtattgggttagcaatgcaacgggaaatattgttagttctgtgaatatgattagcagaatgttgataaacagattcactatgaaacataagaaagccacatatgagccagatgtagacttaggttccggaactcgcaacataggaatagaatccgagattcccaacttagacatcatcgggaaaagaatcgagaaaatcaagcaggaacatgagacttcgtggcactacgaccaagatcatccctacaaaacttgggcctatcatggctcatacgagaccaaacagaccgggagcgcttcatcaatggtaaacggagtggtgagactattgacaaaaccatgggacgtagtgccaatggtcacacaaatggcaatgacggatacaacaccgttcgggcaacagagagtattcaaagaaaaagtagatacacgcactcaagagcctaaagaaggtactaagaaattaatgaaaataacagctgagtggttatggaaagaattaggaaaggaaaagacacctagaatgtgcaccagggaagaatttacccggaaagtccgaagcaacgcggcgctaggagctatatttaccgatgagaataagtggaaaagcgcaagagaggcagtagaggatggaaggttttgggagctagttgacagagagagaaatttacatcttgaaggtaaatgcgaaacatgcgtgtataacatgatgggtaagagagagaagaaattgggggaatttggaaaggcaaaaggatctagggcaatatggtacatgtggttaggggcaagatttttagaatttgaggcactaggttttctaaatgaagatcattggttctcaagaggaaattctctcagcggagttgaaggcgagggcttacacagattaggttacatcctacgggaagtaggaaagaaagagggaggagcaatgtatgccgatgatacggctggatgggacactcggataacactggaggacctgaagaatgaagaaatggtaaccaatcacatgaaaggtgaacataagaaacttgcagaggcgatattcaagctaacctatcaaaataaagtggtaagagttcaaagacccacaccaagaggcacagttatggatataatatcaagaaaagaccagagaggctcaggacaagtcggaacatatggactaaacacttttacaaatatggaagcacaattgataaggcaaatggaaggagagggtatatttaaaagtatacaacacctgacagccacagaagaaattgcagtccaaaattggttagcacgagttggtagagaacgactaagtagaatggcaatatctggcgatgattgtgtggttaaaccgattgatgatcggtttgcatcagcactaacagcattgaatgacatgggaaaggtgaggaaagacatacaacagtgggagccaagtagaggatggaatgattggactcaagtacctttttgctcccaccattttcacgagttagtaatgaaggatggtcgtgttttagtcgtcccatgcaggaatcaggatgaattgataggacgtgcaagaataagtcagggagccggatggagcttgaaggaaacagcgtgtctaggaaaatcttacgcacagatgtggaccttaatgtatttccatcgacgagatctacgtttagctgcaaatgcaatatgctcagctgttccgagccattgggttcctacatcccgaacaacatggagtattcatgcaaaacatgaatggatgacaactgaagacatgctagcagtgtggaacagagtctggatacaagaaaatccctggatggaagacaagacacctgtagaatcttgggaagaagtaccatacttaggaaaacgggaggaccagtggtgcgggtcactgattggtttaactagccgtgccacatgggcaaagaacattcaaaccgctattaatcaagtgaggtcactgataggcaacgagggctatacagactatatgccttccatgaagcgatttagaaaggaagaagaggaagcgggcgtcttatggtga

SEQ ID NO: 22277 - RNA, 9876 nt, synthetic construct
  misc_feature 1..9876: note = derived and/or modified CDS sequence (opt6) from DENV-2__GQ868549__SS-prME
  source 1..9876: mol_type = other RNA
actgctggtgttatagtaatgctcatcccaacagccatggcattccatctaactactcggaacggagaacctcacatgatcgtaggaaggcaagaaaaagggaaatcgttgctatttaaaactgaagatggcgtaaatatgtgtacattaatggctatagacttgggcgaactctgtgaagatactataacatataaatgtcctctcttacgtcaaaatgaacccgaagacatcgattgttggtgtaactcaacttctacatgggtcacatacggcacatgtacaactacaggagaacacagacgcgagaaaagaagtgtagcgctagtacctcatgtagggatgggattagaaactaggactgaaacgtggatgtcgtcagaaggggcctggaaacatgttcaaaggattgaaacatggattcttagacatcctggatttacaatcatggccgcaattctagcttacacaattggtaccacacactttcagagagccttaatttttattctattgacagctgttgcaccatctatgaccatgagatgtataggaatttcgaacagggactttgtcgaaggggttagcggtggatcgtgggttgacattgtactagaacacggttcctgtgtaacaacaatggccaaaaataaacctaccctggatttcgaattgataaaaacggaagcaaaacagccggctacactgcgaaaatattgtatcgaagctaaactaacaaatactacaacggaatcaagatgcccgacacaaggagaaccctcattgaatgaagaacaggataaaagatttatatgtaaacattcaatggtcgatcgaggatgggggaatggttgcggactgtttggtaaaggaggaatagttacatgcgcaatgttcacttgtaagaaaaatatggaaggaaaaatcgtacaacctgagaatttagaatacacaatagtaataacacctcatagcggcgaagaacatgctgtaggaaacgatactggaaaacatggtaaagaaattaaaattaccccacaatcgtcgactactgaagcggaactaaccgggtatggaactgttactatggagtgctcaccacgaactggtttagattttaatgaaatggtgttacttcaaatggaagataaagcatggctagtacacagacagtggttccttgatctacctttaccatggttacctggtgccgatacgcagggatctaattggatacaaaaagaaacccttgttacgtttaaaaaccctcatgcgaagaaacaggatgtcgttgtcttaggtagccaagaaggagcaatgcacactgcgttaacgggagcaacggaaatacaaatgagctcaggtaacctattgtttacgggccatctgaaatgtcgcttacgcatggacaaacttcaattgaaaggaatgagttatagcatgtgcacaggcaaattcaaaatcgtaaaggagatagctgaaacacaacatgggacaatagtcataagagtacaatacgagggagacggttcgccttgcaaaataccttttgaaataacggacttggaaaagcgtcacgtattggggcggttgataaccgtaaatcctatagttacagaaaaggatagtccagtaaatatcgaggctgagcctccgttcggcgacagttatataatagtcggtgtcgagccgggacaactaaaactaaactggtttaaaaagggaagcagcataggtcaaatgttcgaaaccactatgagaggggcgaaacggatggccatacttggtgatacagcatgggattttggtagcttgggtggagtgtttacgtccatcggtaaagccctccatcaagtgtttggagcaatctacggtgcagcattttcaggtgtctcttggactatgaaaatactaattggtgtaatcataacatggattggtatgaacagcagatcaacaagtctaagtgtcagtttagtcttagtcggagtagtaacattatacctaggggctatggtgcaagcagacagcggatgtattgtatcttggaagaataaagagcttaagtgcggttcaggtatttttatcactgacaatgtacacacttggacggagcagtacaaattccaacctgagagtccgagtaaacttgcgtcagctatccaaaaggcacacgaagaaggcatttgtgggattcgttctgtaactcgactcgagaacctcatgtggaaacaaattacacctgaattaaaccatatattatctgaaaatgaagttaaactaactataatgacaggagatataaagggaataatgcaagcaggtaaaagatcattacggcctcaacccacagaactaaaatattcatggaagacttggggaaaagcaaaaatgctttctaccgaatcgcataatcaaactttcctgatagacggaccagagacagcagaatgtcctaatactaatagagcttggaactcgctagaagtagaagactacggattcggtgtatttaccactaatatttggcttaaactgagagaaaaacaagatgtattttgcgactcaaaacttatgagcgctgcaatcaaagataatagagccgtgcacgccgatatgggctattggatcgaatcggcacttaatgatacatggaaaatggaaaaggcttcattcattgaggttaaaagctgccactggccaaaatcacatacactttggagtaatggtgtacttgaaagtgaaatgatcatccccaaaaatttcgcaggaccagtatcacaacataactataggccaggatatcatacccaaacagccggaccctggcatcttggaaaattagagatggatttcgatttttgtgaaggaaccacagttgtagttacagaagactgtggaaacagaggtccctctctacgaacgacgacagcctcaggcaagctcatcacagaatggtgttgcagaagttgcacattgccaccactcagatataggggagaagatggatgctggtacggtatggaaatccgaccacttaaagaaaaagaagaaaatcttgtcaattcattagttacagctggtcatggacaaatcgacaatttttcattaggcgtacttgggatggccctgtttcttgaggagatgttacggacccgtgttgggacaaagcacgcaatcttgctagtagcacttagttttgtgacgttgattacaggcaatatgagttttagagatttgggcagggttatggttatggtaggagcgacgatgactgacgatattggaatgggagttacctatttggcactattggcggcatttaaagtaagacccacttttgcggctggacttttactaagaaaattaacttctaaagaattaatgatggctacgatcggaatagccctattatcacaaagtaccttacctgagaccattctcgaattaactgatgcccttgcgttaggaatgatggcacttaaaatagtaagaaatatggagaaataccaattggctgtcactattatggcaatctcttgtgtaccgaatgcggtaatattgcaaaatgcatggaaagtcagttgcactattcttgctgctgtttcggtaagcccactccttttaacatcatcacaacaaaaggcagattggataccactagcgttgacgataaagggactaaatcccactgctatattcctaacaacactatctcgtacaagtaagaaaaggagctggcctctaaatgaagcgataatggcggtcggaatggtcagtatattagctagttctcttcttaaaaatgatatacctatgaccggacctttagtagctggaggccttctcacggtatgttatgtattaactggcaggtctgctgatctggaactagaacgagcggctgacgttaaatgggaagatcaggctgaaattagcggatcgtcaccaattttatcaataacaatttccgaggatggctcgatgtctatcaaaaacgaagaagaagaacagacattaactattttaataagaacgggccttttagtaataagtggtgtgtttccggtaagcattccgataacagcggctgcttggtacctatgggaagtcaagaaacaacgggctggggtcttatgggacgtaccatcccctcccccagtcggtaaagcggagctagaagacggagcatatagaattaaacagagaggtatactaggttacagtcaaattggagcgggcgtatataaagaaggcacattccacacaatgtggcatgtaacacgaggggcggttcttatgcacagaggaaagaggatagaaccaagctgggccgatgtgaaaaaggatctcatatcttacgggggaggctggaaattagaaggggaatggaaagagggcgaggaagtgcaagtactagcattagaaccggggaagaacccaagagcggttcaaacaaaaccgggaattttcaaaaccaatactggcacaataggagccgtatcccttgacttcagcccaggaacatcgggaagtcccatagttgatcgtaaaggaaaagtcgtgggcctttacggtaacggagtagtaactagatcaggtgcatatgtttccgctatagctcaaacagagaaaagcatcgaagataatccggaaatcgaagacgacatattccgcaagaaaaggttaacaataatggacttacatccaggggctgggaaaacgaaaagatatctacctgcgatagttagagaagctataaaacgaggactgagaacactaatacttgcccctacacgagtcgtcgctgcagaaatggaagaagccttgagaggactcccaattaggtatcagaccccagccattagagccgaacatacggggagggaaatcgtggacctaatgtgtcacgcaactttcacgatgcggctactttccccagtaagagtaccaaactataatttaatcattatggacgaagcccactttactgacccggcgtcgattgcggccagagggtacatatcaactcgagtagaaatgggcgaagcagctggcattttcatgaccgccacaccgccaggatcgcgagatccattcccacaaagcaatgccccaataatggacgaagaacgagagataccggaaaggtcttggaactcagggcatgaatgggtaacggattttaaaggaaagactgtttggtttgttccttctattaaagcaggaaatgatatcgcagcatgtttaagaaagaacggaaagaaagttattcagctcagccgaaaaacctttgacagcgaatacgtaaaaacccgcgcgaacgattgggattttgtggttacaactgacataagcgaaatgggagccaactttaaagctgagagagtgatagatccacgcagatgcatgaaaccagtaattctcacagatggcgaagaacgagtaattttagcaggaccaatgccagtaacacatagcagcgcagcgcaaaggcgaggaagaattggaagaaaccctaaaaatgaaaatgaccaatacatatacatgggcgaacctttagaaaacgacgaagactgcgctcactggaaggaagcaaaaatgttactggacaacataaatacacccgagggtattataccatccatgttcgagcctgaacgggaaaaagttgacgcaattgatggcgagtacagattgcgtggtgaagcaagaaagacctttgtcgacttaatgagacgtggtgatcttccagtttggcttgcttacaaagtagcagctgaaggcataaattatgcagatcgtaaatggtgtttcgatggaattaaaaataaccagatattggaagaaaacgtagaggtagaaatctggacaaaggaaggcgagcgaaagaaactcaagcccaggtggcttgacgcacgaatatatagtgatccactagcgttaaaagagtttaaagaatttgctgctggcaggaaaagtttgacattaaatctgattacagaaatgggtaggctgcccacgttcatgactcaaaaagcaagaaacgctttagataacctggccgtattacacacggcggaggtaggaggtaaggcttacacacatgccctatcagagttacctgaaacactcgaaacgctgttactactaacccttctagcagctgtaactggcgggattttcctatttctaatgtctggtaaaggaatcggaaaaatgacattgggcatgtgttgtattataacggcgtctattcttctctggtatgcacaaatacaaccacattggatagcagccagtattattcttgagttcttcctaatagtacttttaattccagaacctgaaaaacaacgaactccacaagataatcaactcacgtacgtagtaattgcaattttaacggtcgtggcagcaacaatggcaaatgagatgggattcttagagaaaacgaagaaagacctaggttttggttcgataacaactcaagagtctgagagtaacatattagacatagacctcagaccagctagtgcatggacactgtatgctgttgcaactacttttgtgacacccatgttaagacatagtatagaaaactctagcgtaaatgtgagtctaaccgcaatcgcaaatcaagcgaccgtattaatgggactcggcaaaggatggcctctatcaaaaatggacataggtgtcccattgctggcaataggttgctattcccaagttaatccgataacactaacagcagcacttctcttgctcgttgcacattacgcgattataggacctggactgcaagccaaagcgactagagaagcacagaaaagagcggccgccggcataatgaaaaatcccacagtagacgggattactgtaatagacttagaacctataccttatgatcctaaattcgaaaaacaattgggacaagttatgctactcatactatgcgttacgcaagttttgatgatgcgaacaacatgggctttatgtgaagcattgacattagcgacaggacctatttccaccttgtgggagggaaacccgggacggttttggaatacgaccattgcagttagtatggccaatatattccgtggatcttatttggctggtgctggacttctctttagcataatgaagaatacaacaaatacgagaaggggcacagggaatgtcggtgaaaccctaggagagaaatggaaatcgagattgaatgctttaggaaaatccgaatttcaaatctataagaaaagcggtatacaagaagtggacagaacgttggctaaagagggtatcaaaagaggagagactgatcaccacgccgtctctagggggtctgcgaaactacggtggttcgtagaaagaaatatggtgacgccagagggaaaagttgtagatctcggatgcggaagaggtgggtggtcttattattgcggagggctgaaaaatgtaagagaagtaaaaggtctaacgaagggaggccctggacacgaagaacccattccaatgtcaacttacggttggaatctagtacgtttgcaatcaggagtcgatgtattctttacacccccagaaaagtgcgacactttactatgtgacataggggaatcaagtcctaatccgactattgaagcaggcagaactttgagagtattgaacctggtagagaattggttaaacaataatacgcaattttgcataaaggtcctgaatccttacatgccaagcgtaatagaaaagatggaaacactacaacgtaagtatggcggtgcgttagttcgaaatccactgtctcgaaacagcacacacgagatgtattgggtaagcaatgcaaccggtaatatagtgtcctcggttaatatgattagccgtatgctgataaacagatttacaatgaagcataaaaaggcgacttatgaaccagatgtagacctgggaagtggaactagaaacataggtatagaaagtgagattcctaaccttgatataataggtaaacgaatagagaaaataaaacaagaacatgagaccagttggcattatgatcaagatcacccttataaaacgtgggcgtaccacggaagctacgaaacaaaacaaacaggctcggcgtcaagcatggtcaatggagttgttcggctattaacaaagccttgggatgtagtacccatggttacgcaaatggcaatgacagatacaactccatttggccagcaaagggtgtttaaagagaaggttgatactagaacgcaagaacctaaagaaggcactaagaaactgatgaaaatcacagcagagtggttatggaaggagttagggaaagagaaaacacctagaatgtgtactcgtgaggagttcacgaggaaggttcgatcgaacgcggcgttaggagcagtcttcacagacgaaaacaaatggaaatcggcccgagaagctgtagaagatggcaggttttgggagctagttgacagagaaagaaatcttcatttagaaggtaagtgcgaaacctgcgtctataatatgatgggaaaacgagagaagaaattaggagaatttgggaaagcgaaaggcagcagagccatctggtatatgtggttgggtgcaaggttcctagaatttgaagccttaggattcctgaatgaagaccactggttttcacgggggaacagtttaagtggggttgagggtgaaggtctgcacagacttggctatatcctaagagaggtcggtaagaaagagggtggagcaatgtatgcagatgacactgctggttgggacacaagaataacacttgaagatttgaaaaacgaagaaatggtaacaaaccacatgaaaggagaacataagaagctagcggaagctattttcaaattaacttatcagaacaaagttgttcgggttcaaagaccaacaccacggggaacagtgatggatataatttcacgcaaagaccagcgggggagcggacaagtaggcacttacggccttaatactttcaccaatatggaagcgcaacttataagacaaatggagggagaaggaatattcaagagcatccaacatttaacagcaacggaagagattgcagtgcaaaactggttagctcgagtcggtcgtgaacgattaagtcgtatggctatttccggagatgactgtgttgtaaagccgatagatgacaggttcgcatcagctttaacggctttaaatgatatgggaaaggtacgaaaagacatccaacaatgggaaccgtcacgcggttggaacgattggacccaagttcctttttgttcacaccatttccacgaactcgttatgaaagatggtcgagtgcttgtagtaccttgtaggaatcaagacgaattgatcggccgtgcacgaatatcacaaggagctggttggagtctcaaagagacggcatgtctcggaaaatcatacgctcagatgtggacacttatgtattttcacagaagagatcttcgtttagcagcaaacgccatctgttctgcagtaccttcacactgggtaccaacgtccagaacaacgtggagcatccatgcaaaacatgaatggatgacgacagaagatatgctagccgtatggaaccgtgtatggatccaggaaaatccctggatggaggataaaacgccagtggaatcatgggaggaagtgccttacttaggcaaaagggaagaccagtggtgcggcagcttgataggattaacaagtagagcgacatgggccaagaatatccaaacagcaattaatcaagtcagatctttgatgggcaatgaaggatataccgactatatgcccagcatgaagagatttagaagagaggaagaagaagcgggtgttctatggtga

SEQ ID NO: 22278 - RNA, 9876 nt, synthetic construct
  misc_feature 1..9876: note = derived and/or modified CDS sequence (opt6) from DENV-2__GQ868551__SS-prME
  source 1..9876: mol_type = other RNA
actgcaggcgtaatagtcatgctaataccaacagcaatggccttccacctcacgactagaaacggggaacctcatatgattgttgggagacaagaaaaaggtaagtctcttctattcaaaactgaagatggggtaaatatgtgcacacttatggcaattgatttaggagaattatgtgaagatacaattacttataaatgtcctctcttaagacagaacgagccggaggatattgattgttggtgtaatagtaccagcacatgggttacatacggtacatgcacaactactggagaacaccgaagagaaaaaagaagtgtagcactagtgccccatgtcggaatgggtctcgaaacacgaacagaaacttggatgtcgagtgaaggagcctggaaacacgtacaaagaatagaaacctggatcctgagacacccaggatttacgattatggcagctatactggcgtacacaatcggcacgacacattttcaacgcgccttgatatttatattgcttacggccgtagcgccgtcaatgactatgaggtgtatcggtatatcgaaccgcgacttcgtagagggtgtaagtggggggagctgggtagacatagttctcgaacacggtagctgtgtaaccacaatggctaaaaataaacccacgttagactttgaacttataaagacagaagctaaacaaccagctactctaaggaagtattgcatcgaagcaaagttgaccaatactacaacagaaagtagatgtccaacacaaggcgagcctagtctgaacgaagaacaagataagcgctttatatgtaaacatagcatggtggatcgaggatggggtaacggatgtggccttttcggaaaaggaggtattgtaacatgtgctatgtttacttgcaagaaaaatatggagggaaaaatagtccaaccagagaatttagaatatacaatcgtaattacacctcactctggggaggaacacgcagtaggaaacgataccggtaaacacggtaaagaaataaaaataactccacagagcagtacgactgaagcggaactcacaggttacggcacagtaacgatggaatgcagtccgcggacaggtttagatttcaatgaaatggtattactacaaatggaagacaaggcatggctagtccataggcagtggtttctagatctccctttgccgtggctacccggggccgacacacaaggaagtaactggatacagaaagagaccctcgtaacttttaaaaaccctcatgctaaaaaacaagatgtagtagtattaggcagtcaagaaggagctatgcatactgctttaacaggagccacggaaattcagatgtcaagtggtaatttgttgttcaccgggcatttgaagtgcagattacgtatggataaacttcagctaaaagggatgagctactcaatgtgtacgggaaagtttaaaatagtgaaagagatagccgaaactcagcatggaacaattgttataagggtacagtacgaaggagacggatcaccatgcaaaataccatttgaaataacagacctggagaaaagacacgtactcggaagacttataactgttaatccaatagtaacagagaaagatagtcctgtgaatatagaggcagagccgccatttggggattcttacataatagtgggtgtggagccaggacaattaaaacttaactggtttaaaaaaggaagtagcatcgggcagatgtttgaaacgacaatgcgtggcgcaaagcgaatggcgatcttaggagatacagcatgggacttcggtagcctaggaggtgtatttacgagcatcggaaaagcactacatcaagtttttggcgctatctacggagcagcgtttagcggagtcagttggacgatgaagatactcatcggggtaataattacttggataggaatgaacagtagatcaacatcactctcagtgagtctggtattagtaggggtagtaacattatatttgggcgcgatggtacaggcagattctggatgtattgtttcatggaaaaacaaggaattaaaatgcggaagcggaatattcataacggacaatgttcatacatggacagagcaatacaaatttcaacctgagagcccttctaaattggcatcagcaatccagaaagcacacgaggaaggcatttgcggaatacgcagtgtaacacgactagaaaacttaatgtggaaacagataacaccagaactaaaccacatattaagtgaaaatgaagtcaaactgaccataatgactggagacatcaaaggaataatgcaagccggaaaaagaagtctgcgacctcaaccaactgaattaaaatattcctggaaaacgtggggtaaagtaaaaatgcttagtacagaaagtcacaaccaaacatttttaattgatggccccgaaacagctgaatgtccgaacacaaaccgcgcctggaactcacttgaagtggaagactatggctttggtgtctttactacaaacatatggttaaagctcagagagaaacaagatgttttttgcgactcaaaactaatgagtgctgcgataaaagataacagagccgttcacgctgatatgggatactggattgagagtgcgcttaatgacacatggaaaatggagaaagcatcattcatagaagttaaaagttgtcattggcccaaaagtcacacgctatggagcaacggtgtcttagaatctgaaatgataattccaaagaatttcgctgggccggtctcacagcacaactatagaccaggctaccatacacagaccgcaggaccatggcatttagggaaattagagatggactttgacttctgcgagggtacaactgttgtggtgaccgaagattgtggaaacagaggaccatcgctacgaaccacaacagcctccgggaaactcatcacagaatggtgctgtcgtagctgtacacttccaccattaaggtacagaggagaagacggttgctggtacggaatggaaatacgtcccttaaaagaaaaggaagaaaatttggtgaatagtctggtaaccgcaggtcatggtcaaatagacaatttttctcttggggtacttggtatggcactattccttgaagaaatgctacgaacaagagtaggtacaaagcatgcaatattgttagttgcactcagctttgtaacactaataacaggcaacatgtcctttagagacctaggtagagtaatggttatggtaggagccacaatgactgacgacataggaatgggggtaacatatctcgcccttctcgccgcattcaaggtgagaccgactttcgctgctggtttactactacgcaaactcacgtcaaaagaattaatgatggcaactattggtatagcgctattatcacaatcaacactaccagagacaatactggaactaacagatgctttagcattgggaatgatggcactgaaaattgtacgcaacatggaaaagtatcaactagccgtgacaatcatggcgatttcatgtgtaccaaacgcagtaatattgcagaacgcgtggaaagttagttgtactatcttagctgcagtcagtgtatcccccctattgctaacctcgagtcaacaaaaggctgactggataccactagctttaacaataaaaggactgaaccccacagcgatattcttaacaacattatcaagaactagcaaaaaacggagttggccacttaatgaggcaataatggctgtaggcatggtgagtatactagcatcgtctctcctgaaaaatgacataccaatgacaggacccctggttgccggtggtctactaacggtttgttacgtattaacgggtcgctcggctgatctcgaactagagagagctgcagacgtgaaatgggaagaccaagcggaaatatccggctcatccccaatattatcaattacaatttcagaagatgggagtatgtcaattaaaaatgaagaggaagagcaaacactaaccatcctaatccgcactggattgcttgtaatatccggcgttttccctgtatcaattccaataacagcagcagcgtggtatttatgggaggttaagaaacagagagctggggtactctgggacgtcccatcaccccccccagtcggtaaggccgaattagaggatggcgcttatagaataaagcaaagaggaattttaggctatagccaaataggcgctggtgtctacaaagaaggcacatttcacactatgtggcacgtaacgcgaggagctgtgctaatgcatagagggaaacgaatagagcctagctgggcagatgtgaaaaaggatctaattagttatggagggggttggaaactagaaggtgaatggaaggaaggagaagaagttcaagttttagctctagagcctggcaagaatcccagagccgtacagacaaagcctgggatattcaagactaatacgggtacaataggagccgtatctttagatttttccccgggtacaagtggatcgccgatagtagatcgaaaaggaaaagtcgtaggcctgtatggtaatggtgtagttacaagatcaggcgcctacgtgtcagcaattgctcagacagaaaaatctatagaggataatcctgaaattgaagatgatatattccgtaaaaagcgactgacaataatggatctacacccgggagctggtaaaacaaagcgctatctcccagctatagtcagagaagcaataaagagaggattaagaaccctaatcttagctccaacaagggtcgtagctgcagaaatggaagaagccttaagaggcttgccgatacgctatcaaacaccagcaatcagggcagagcatacaggcagagaaatagttgatctgatgtgtcacgcgactttcacaatgcgccttctcagtcctgttcgtgtaccaaactacaacttgattatcatggatgaagcacactttaccgacccggcatcaattgcagcaagggggtatattagcacacgggttgaaatgggagaagcagcgggtatatttatgacagcaacacctccaggatcccgagatcctttcccacaatcgaatgcaccaataatggatgaagaaagagagatccccgaaagatcttggaactcagggcatgagtgggtaacggactttaagggaaagaccgtttggttcgtccccagtataaaggcaggaaacgatatcgctgcctgcttacgaaaaaacggaaagaaagtcattcaacttagccgcaaaacatttgattctgagtacgtaaaaactagagcaaatgactgggattttgtagttacaaccgatattagtgaaatgggtgctaattttaaagcagaacgtgttatagaccctagaaggtgtatgaaaccagtaatattaactgatggtgaggaaagagttatattagcaggacccatgcccgttacccactcatctgcagcgcaacggcgaggcagaataggccgtaacccaaaaaatgaaaatgaccagtatatatacatgggagaacctctggaaaacgatgaagattgcgcccattggaaagaggcgaaaatgttacttgataacatcaatactccagaaggaatcataccatccatgttcgaaccggaaagggaaaaagtggacgcaatagatggtgaatacagattgagaggcgaggctcgaaaaacattcgtggacctaatgcgacgaggagatttgccagtgtggttagcgtataaagtggccgctgaagggataaactacgcagaccgaaaatggtgttttgatggtatcaaaaataatcaaatccttgaggaaaacgtggaagtagagatatggacgaaagaaggtgaaagaaaaaagctgaaacctcgctggctagacgcccgtatttactccgaccccctcgcattgaaagagtttaaagagttcgccgctgggcgtaaaagcttaacactcaatctaatcacggaaatgggtagactcccaacttttatgacacaaaaagcccgcaacgcgctcgacaacttagccgtcttacacaccgcagaagtagggggtaaggcttatacacacgctttaagtgaactcccagaaactttagaaacattattgttgctaactctactagctgcagtgacgggcggcatattcttatttttaatgtctggaaaaggcattgggaagatgaccttaggaatgtgttgcataattactgcaagtattctcttgtggtatgctcaaatacaacctcattggattgcggcgtccataatattggagtttttcctaattgtcttactgatacctgaaccggaaaaacaaagaacgcctcaggacaatcaactaacgtatgtcgtcatagccatcttaactgtagtggcagcaacaatggcaaacgaaatgggttttttagaaaaaacgaaaaaagatctaggatttggatcaattacaacacaagagagtgagtccaacatactagatattgacttaagacctgcaagtgcctggacactatatgcagtagcaactacttttgtaactcccatgttaaggcactcaattgaaaacagttccgtcaacgtatctcttacagctatcgctaatcaggccaccgtattaatgggtttgggaaaaggttggcccttaagtaaaatggacataggtgtgcctctactagcaattggctgttactcgcaagtcaaccctataacactaacagcagcattattactacttgtagctcattacgccattatcggtcccggattacaggctaaagcaactcgagaagcccaaaagcgagctgccgcgggcattatgaaaaacccgacggtagatggcatcacagtaattgatctcgaacctataccgtacgacccaaaattcgaaaaacaacttggacaagtgatgcttttaatcctttgtgtaacccaagtattaatgatgaggacgacatgggctttgtgcgaagcactaaccttagcaacaggaccaatcagcacactatgggaaggtaaccctggacgattttggaacaccaccatagctgttagcatggcgaacatattccgaggatcatacttagcaggcgccggactacttttctcaataatgaaaaacacgacaaatacgcgtcgaggtactgggaacgtaggagaaacattgggagagaaatggaaatctcgcttaaatgcacttggaaaaagcgaatttcaaatatataagaagtcagggatccaagaggttgatcgaaccctagctaaagaaggaataaaaagaggagaaactgaccatcacgcagtgtcaagaggatccgccaaattaaggtggtttgtagaacgtaacatggtgactccagaaggaaaggtcgtcgatttaggatgtggaagaggtggttggagttattattgcggtggattaaaaaatgtgagagaggtgaaaggattaacaaaaggcgggccaggacacgaagaacccattcccatgtcgacatatggttggaacctggtaagacttcaaagtggtgtcgatgtttttttcactcctccagaaaaatgtgataccttactatgcgacatcggagagtcaagtcctaaccctactattgaagctggcagaactcttagggtactgaacctcgttgaaaattggttgaataataatacacaattttgcataaaagtgctaaacccatatatgccgagtgtgatcgaaaagatggaaactttacagagaaagtatgggggagcattagtacgtaatccattgtctcgaaatagtacacacgaaatgtactgggtgtctaatgcaaccggcaatatagtcagctcagtaaacatgattagcagaatgcttataaacaggttcaccatgaaacataaaaaagcaacttatgaaccagatgtagatctgggatccggtacacgaaatataggaattgaatcagaaatacccaatttggatataatagggaagagaatcgaaaaaatcaagcaagagcacgagacttcgtggcattacgatcaagaccacccgtacaagacgtgggcttatcatggttcatacgagaccaaacaaacagggagtgcatcctccatggtcaatggcgttgttcgattactaacaaaaccgtgggacgtagtaccgatggtaactcaaatggcaatgacagacacgacgccgttcggtcagcaacgagtctttaaggaaaaagttgacacgaggacacaagaaccaaaagaagggacaaaaaaactaatgaagattactgcagaatggttatggaaggagcttggtaaagaaaaaacaccccgaatgtgtacacgggaagaatttacacgcaaggttcgatctaatgccgctctcggtgctgtgtttactgacgaaaataagtggaaatcggcaagagaagcagtcgaagacggacgtttttgggaattagttgaccgtgagagaaacttgcatttggagggtaaatgcgaaacatgcgtgtataacatgatggggaagcgagaaaaaaaacttggcgaattcggaaaggcaaagggatcaagggcaatctggtacatgtggctaggtgctaggtttttagaattcgaagcgctaggttttctgaatgaggaccactggtttagccgaggcaacagtctcagtggtgttgaaggcgaagggttacatcggctaggatatatcctccgagaagtaggtaagaaggaaggaggagctatgtatgcggacgatacggctggatgggatactcgaataactttagaagacctaaaaaatgaagaaatggtcacgaatcatatgaaaggagagcacaagaaactagcagaagcgatcttcaagttaacataccagaataaagtcgtgagagtacaaaggcctacgccaagaggaacagttatggatataatcagtagaaaagaccaacgcggatcgggacaagtgggtacatatggcttaaacacattcacaaacatggaagcacaacttataagacaaatggaaggagaagggatctttaagagtatacaacatctaactgctactgaagagatagcagtacaaaactggctagcaagggtaggaagagaaaggctgtcaagaatggcaatatcaggtgacgactgtgtcgttaaacctatcgatgaccggttcgcctccgctttgacggctctaaatgatatgggtaaagtccgcaaggacatccagcagtgggaacctagccgtggttggaatgattggactcaggtcccgttttgtagtcaccactttcacgaattggtaatgaaagacggcagagtattggttgttccgtgtcgcaatcaggatgaattaataggccgagctaggattagtcaaggcgccggatggtcattgaaggaaacagcatgtctcggcaaaagctatgctcaaatgtggactttaatgtattttcataggagagacctaagattggcagctaatgccatctgctctgcggtaccgagccattgggtaccaacaagtcgaacaacttggtcgatccacgcaaaacatgaatggatgaccaccgaagacatgctggctgtatggaatcgcgtatggatccaagaaaatccatggatggaagacaagaccccagtggaatcttgggaagaagtaccgtatttagggaaacgggaggatcaatggtgtggtagtctgattggtctgacaagtagagcaacatgggcaaaaaatattcaaacagcaattaatcaagttagatctttaatgggaaatgaaggttacaccgactacatgccttctatgaagcggttcaggagagaagaggaagaagctggagtcctctggtag

SEQ ID NO: 22279 - RNA, 9876 nt, synthetic construct
  misc_feature 1..9876: note = derived and/or modified CDS sequence (opt6) from DENV-2__HM181971__SS-prME
  source 1..9876: mol_type = other RNA
accgcaggggtaatagtaatgctaattcctaccgcaatggcttttcatctgaccactagaaatggggagccacacatgatagtaggaaggcaagaaaaagggaaaagtttattattcaaaacagaagacggggtgaatatgtgtactcttatggcaattgaccttggcgaattatgtgaagatacaattacatataaatgtcctctgttacgtcagaatgaaccagaagatatagactgctggtgtaattcaacttcaacatgggttacatacggaacatgtactacaacaggagaacacaggagagaaaaacgctcagtcgctttagttccgcacgttggcatgggcctagaaactagaacagaaacgtggatgagttcagagggagcatggaaacatgtgcaaagaatcgaaacatggatactccgacatccgggatttaccataatggctgcaattcttgcgtatactataggtacaacgcattttcaacgtgcgctaatattcattctactaacggcggtagcaccttcaatgacaatgagatgcatcgggattagcaacagagactttgtagaaggcgttagtggcggatcgtgggtcgatatagtcctagaacatggctcttgtgtaacgacaatggccaaaaataaaccgacattagactttgaacttataaaaacagaggcaaaacaaccggcaaccctacggaagtattgcatcgaagctaagttaacaaatacaacaacagaatcaagatgtccaacacagggtgaaccaagcctcaacgaagaacaggacaaaagatttatttgcaagcacagtatggttgatagagggtggggaaatggttgcggtctttttgggaaaggaggaatagttacctgcgcaatgttcacatgtaaaaagaacatggagggaaaaatagtgcaaccagaaaacttggaatatacaatagtaataactcctcattcaggagaagaacatgcagtaggaaatgatacaggaaagcatggaaaggaaataaaaattactccacaaagtagtacaacagaagcagaattaacaggttatgggacagtaacaatggaatgcagtccgcggacgggtttagatttcaatgaaatggtattattgcaaatggaagataaggcatggttggtccaccgacagtggtttctcgacttgccactaccatggcttccaggtgcggatacacaaggttcaaattggatccaaaaagagacattagttacctttaaaaatccccatgccaagaaacaagatgtcgtagtattaggtagtcaagaaggtgcaatgcatacggcgctcactggggctaccgaaatccaaatgtcaagtgggaatctcctattcacgggacatctcaaatgtagattaagaatggacaaactccaactcaagggtatgagttattctatgtgtactggcaaattcaaaatagtaaaggagattgcagaaacgcaacatggaacgattgtgatacgggttcaatacgagggggatggttccccatgcaagattccatttgaaatcactgatcttgagaaaagacacgtactaggaagattaatcacagttaacccgatagtcaccgaaaaagacagtcctgtaaacatagaggcagagccgccctttggagatagttacatcatagtcggggtagaaccaggacaattaaaattgaactggtttaagaaaggatccagtataggacagatgttcgaaactacgatgcgtggggcaaaaagaatggcaatattaggagataccgcatgggattttggaagtttaggcggtgtattcacttcaataggcaaggcgttacaccaagtattcggagcaatctatggggcagcgttttccggagtatcatggactatgaaaattctaattggggtgatcattacgtggataggaatgaactcgcgttcaacgtccctatccgtaagtcttgtacttgttggtgtagtaactctgtatttaggggctatggttcaagcagacagtggatgtattgtgagctggaaaaacaaggaattaaaatgtgggagtggaatttttataacggacaacgtacatacatggacagagcaatacaagtttcaaccagaatcccccagcaaactcgcaagtgctattcaaaaggcacacgaagaggggatttgcggtataagaagcgtcaccagattagagaatctcatgtggaagcaaataactccagaattgaatcacattttatcagaaaatgaagtgaaacttacgatcatgacaggagatataaaaggtattatgcaagccggtaaacgaagtttaagacctcaacccacagaactaaagtattcatggaagacttggggtaaagcgaaaatgttaagtacagaatctcataatcaaacgttccttatagatggacctgaaacagcggaatgtccaaacacaaacagagcctggaactcactggaagtagaggattatggcttcggcgtcttcactacaaatatttggttaaaactccgagaaaaacaagacgtgttctgcgactcaaaattaatgagtgcggcaattaaagataatcgtgctgttcatgccgacatgggctattggatagagtcagcgctaaacgatacttggaaaatggaaaaagcaagttttatagaagttaaaagttgtcactggccaaagtctcatacactatggtcaaatggtgttctcgaatctgaaatgataatccccaaaaatttcgctggtccagtatcccagcacaactatagaccagggtatcacacacaaactgcaggtccgtggcacttaggaaaactggagatagactttgacttttgcgagggaactactgtggtcgtgacagaggattgcggaaataggggaccaagtctccgtacgacgacagcttctggaaaattaataacagagtggtgttgcagatcttgcaccctacccccgctgagatacagaggagaggatggatgttggtatggaatggaaatacgcccattgaaggaaaaagaagaaaacctagtaaattctttagtaactgctggacacggccagatagataacttttcattaggtgtattgggcatggctctatttttagaagaaatgctgagaactcgtgtaggtacgaaacatgctatactcttagtcgccctatcctttgttaccttgattacagggaatatgtcgttcagagatctaggtagggtaatggtcatggtaggagcaactatgactgatgacataggcatgggtgtcacatatttggcactattagcagccttcaaagtcagacccacgtttgccgcgggcttactactgagaaaattaacatcaaaggaactcatgatggctacgataggtatagcactactttctcaaagcaccctgcctgaaacaatactcgaattaacagatgctctagctttagggatgatggcccttaaaattgtcagaaacatggaaaaataccaattggcggtaactatcatggcgataagttgcgttccgaatgcagtaatattacagaatgcttggaaagtttcctgcactatattagcagcagtctctgtgtctccacttttactgacaagttcacagcagaaagcggattggatccccttagccctgaccataaaagggctgaatccaacagctatcttcttaacaacattatcccggacgagcaagaaaaggtcttggccattaaatgaggctataatggcagtagggatggtttccatccttgcttctagcctgcttaaaaatgacatcccgatgactggacccctagtggccgggggactgttgaccgtttgttatgtgcttacaggaagaagtgctgatttggagctcgaacgtgcagcagatgtcaaatgggaggaccaagcagaaatatcaggatcatctccaattttgagtatcactatttctgaagatggatcgatgagtatcaaaaatgaggaggaagaacaaacgctaacaatacttattcggactgggctattagttatatcaggagtgttcccagtgtcaataccaattacagcggctgcatggtatctgtgggaagttaagaaacagagagccggcgttctatgggatgtacccagcccaccacccgtaggtaaggcagagttggaagatggcgcatataggattaaacagcgaggtattctcggttacagccaaataggagccggtgtatataaagaaggaacgtttcatacaatgtggcatgtaacaagaggggcagtcttgatgcacaggggtaagcgtatagagccaagctgggcagacgtcaaaaaggatcttatatcttacggaggtggatggaagctcgaaggtgaatggaaagaaggagaagaagtacaagttctagctttggaaccaggcaaaaatccaagagctgtgcaaacgaaaccgggcatattcaagacaaataccggtactataggtgccgtatctttagactttagccccggaacgagcggatcacctattgtagatagaaaaggaaaagtggttggtctgtacggaaatggagtggtcacccggagtggggcctatgtgagtgcaattgcgcagaccgaaaaatcaatagaagataaccctgaaatcgaggatgatatttttaggaagaaaagattaactataatggatttgcatccgggagctggcaaaaccaaaagatatctcccagctattgttcgtgaagccataaaaaggggactaaggacattaatattagcgccaactagagtcgtagcagcagagatggaagaagcactacgtggactaccgatacgataccaaacacccgcaatacgggcagaacatactggccgtgaaatagtggatctaatgtgccatgcgacattcacaatgcgattactaagccctgtaagggttccgaactacaatctgattattatggatgaagcacactttacagatcctgcttcaatcgcagctcggggatacatttcaacgagggtagagatgggagaggccgctggtatatttatgactgctacgccccctggatcgcgagacccatttccacaatccaatgcaccaataatggacgaggaaagagaaatcccggagagatcttggaactccggacatgaatgggttacagactttaaaggaaaaacggtctggttcgtgccatccattaaggcgggtaatgatatagctgcatgcctaaggaaaaacgggaagaaagtaatacaactatctcggaaaacattcgactcagaatatgtcaagacaagagcaaacgactgggactttgtcgtaacaaccgatatttcggaaatgggtgctaacttcaaggccgagcgagttattgatcctcgtcgctgcatgaaaccagtaatcctcaccgatggcgaggaaagagtcatacttgctggacctatgccagtaacacacagtagtgcagcacagcgtagggggagaatcggacgaaatcccaaaaacgaaaatgatcagtatatttacatgggtgaaccattagagaacgatgaagattgcgcgcattggaaggaggccaaaatgctcttagataatattaatacacccgaaggaatcataccgagtatgtttgaacccgaacgtgagaaagtagatgcaatagatggagaatatcgtttaagaggcgaagcacgcaaaacgttcgttgatctcatgaggaggggtgacttgcctgtatggcttgcatataaggtcgcggccgaaggtattaactacgccgacagaaaatggtgttttgacggaatcaaaaacaaccaaattctggaagaaaacgtcgaggttgaaatctggaccaaagaaggtgaacgtaagaaactaaaaccgcgttggctagatgcgcgaatttacagcgacccattggccttgaaggaatttaaagaatttgccgctggacgaaagtcattaaccctaaatttgatcacagagatgggaagacttcccaccttcatgacccagaaagcaagaaacgctttggacaatctggccgtacttcacacggctgaagtaggtggtaaagcgtatacccacgcactttcagaactgccagaaacgctggaaacactacttctattgacgttgctggctgcggtcacagggggaatattcttgtttttaatgtctggcaaaggaataggtaaaatgacgttaggaatgtgttgcatcattacagcaagcatactattatggtatgctcaaattcaaccacactggatagcagcaagtataattttagagttctttttaattgtactattaatcccagagcccgaaaaacaaagaacgcctcaagacaatcaactcacatacgtagtcatagctatattaacagtagtcgccgccaccatggcaaatgagatgggtttcctcgagaaaacgaagaaagacttaggattcggaagcataacgacgcaagaatcagaaagtaatatactcgatatagatctaagacccgcatcagcatggacattatatgcagttgcaacgactttcgtaacaccaatgttacgacactcgatagaaaactcaagcgtaaatgttagcttaacagccattgctaatcaggcaactgtgttaatgggactgggtaaaggttggccgctaagcaaaatggacataggcgtgcctcttcttgccatagggtgttatagtcaagtgaaccccataacattaacggcagcattgctattactggtcgcacattacgctataatcggaccaggactccaagcaaaggctaccagagaagcgcagaaacgtgcagcagccgggattatgaaaaatcccaccgtagatgggattacagtaatagatctagaacctataccatacgaccctaaattcgaaaaacaacttggacaggtaatgttattaattttatgcgtaacgcaagttttaatgatgcgtaccacatgggcactatgcgaggcattaaccctcgcaacgggtcctattagtactttatgggaggggaatcctgggagattctggaacactactatagcggtgtccatggcgaatatcttccgaggaagttacttggcgggggcgggcctattatttagtattatgaagaatacaaccaatactcgtcgcggaacagggaacgtaggggaaacccttggagaaaagtggaagtctcgactaaacgcccttggaaaaagcgaatttcaaatttacaagaaaagtggtatacaagaagtagatagaacgttagccaaagaagggataaaacggggagaaactgaccaccacgcagtgagtagaggaagcgctaaattacggtggtttgtcgaaagaaacatggtaactcccgaagggaaagtagttgatttaggatgtggaagaggaggatggagttactattgtggaggtttgaaaaatgtaagagaagtaaaaggactaacgaagggagggccaggtcacgaagaaccaataccaatgtcaacctatggctggaatctagtacgtttacaatccggtgtagacgtgttctttacgccacccgaaaaatgtgacacattattatgcgacatcggagagagctccccaaatcctacaatagaggctggccgaacgctcagggtcctaaatcttgtagaaaattggttaaataataatacccagttttgtattaaagtactgaatccatatatgccaagcgtgattgaaaagatggagacccttcaacggaaatacgggggagccttggtacgaaatcccctgagtagaaatagtacccacgaaatgtattgggtttcaaacgcaactgggaacattgtgtccagcgtaaatatgatttcgcgaatgcttatcaataggttcaccatgaagcataagaaagccacctatgaaccagacgtagacctcggaagtggcaccagaaacataggaatagaaagcgagatccctaatcttgatatcataggaaaaaggatagagaagataaaacaagagcatgaaacttcgtggcactacgaccaggaccatccatacaaaacctgggcctatcacggtagctacgaaactaaacaaaccggatctgctagtagtatggtcaatggagtagtaagactcctaacaaaaccttgggacgtcgtgccaatggtaacccaaatggccatgaccgacacaacaccttttggacaacagagagtttttaaagaaaaagttgacactagaacacaagagcctaaagaaggaacgaagaaactaatgaaaataacagcagagtggttgtggaaagaacttggtaaagagaagacaccgaggatgtgtacaagagaagaatttacaagaaaagtacgaagtaacgcggcgttaggggcagtttttacagatgaaaacaaatggaagtcggcccgtgaagcggttgaagacggaagattttgggagctcgtagatagggaacgaaacttacatctagaaggaaaatgcgagacttgtgtttataatatgatgggcaaaagagagaagaaactaggagaatttggcaaggctaagggcagccgggccatttggtatatgtggcttggcgctcgttttctagaatttgaagctctaggattcctaaatgaagaccattggttttctagaggcaattccttatctggggtggaaggagaaggattgcatcgcctgggatacatacttcgtgaagttggcaagaaagagggtggtgcaatgtatgcagatgacactgctggatgggacacccgaatcacacttgaagatctcaaaaacgaagagatggtaacaaaccatatgaaaggcgaacacaagaaacttgcagaagctatatttaaattaacatatcaaaataaagtagtacgagtacaacgtccgacaccacggggaacagtaatggacataatttcacgcaaggatcaacgtggaagtgggcaagtagggacttatggattgaacacatttacaaatatggaagctcaattaatccgacagatggaaggagaaggaatattcaaaagcatccaacatctaacagcaacggaagaaatcgctgtccaaaattggttagctcgagtaggccgtgaaagattgagtagaatggcaatttcaggtgacgattgtgtggtaaaacctatagacgatcgattcgcgagcgctctaactgctttaaatgacatgggtaaagtaagaaaagatattcaacagtgggagccctcacgaggttggaatgactggacgcaagttccgttctgctcccaccattttcatgaattagtaatgaaagacggaagagtcctcgtggttccttgcagaaaccaagatgaattgattggtagggcccgtatttcgcaaggagcaggttggtcattaaaagagaccgcatgtttgggaaaatcttacgcacaaatgtggacattaatgtactttcatagacgagacttgagattagcagcaaatgctatatgttccgctgtgcccagtcactgggtacctacaagtcgtaccacttggtcaattcatgctaaacatgaatggatgacaacagaagacatgctagcggtatggaacagagtgtggattcaagagaacccgtggatggaggacaagacaccagtagagagttgggaagaagtcccgtatttaggcaaacgagaggatcaatggtgtggttctttgattggattaacgagccgtgcaacgtgggccaaaaatattcagacagctatcaaccaagtgaggtcattaatgggaaacgagggatacactgattatatgccatccatgaagagatttagacgggaggaggaggaggccggtgttctctggtaa

SEQ ID NO: 22280 - RNA, 9876 nt, synthetic construct
  misc_feature 1..9876: note = derived and/or modified CDS sequence (opt6) from DENV-2__GU131881__SS-prME
  source 1..9876: mol_type = other RNA
acagcgggtgttatcgttatgttgattcccacggcaatggcattccacttaacaactagaaatggagaaccgcacatgattgtaggacgccaagaaaaagggaaaagtttgttatttaaaaccgaagacggggtgaatatgtgtacactgatggcaattgatttaggcgaactttgtgaagacactataacctataaatgcccactattacggcaaaatgaaccagaagatatagattgctggtgtaattcgacttcaacctgggtaacttacggcacatgcactactactggcgaacaccgtcgagagaaaaggtcagtcgcactcgttccgcatgtcggaatgggtctcgaaactcgtaccgaaacttggatgagttcagaaggtgcttggaaacatgtgcaaagaatagaaacctggatattacgacaccctggttttacgataatggcggcaatcttagcttacacaattgggacaacacacttccagagagctctaatcttcatactgcttacggcagtagcacccagtatgacgatgagatgcattggaatttcaaatcgagatttcgttgaaggagtatcgggcggtagctgggttgatatcgttctagaacatggatcttgtgttaccacgatggctaaaaataaaccgacccttgactttgaattaataaaaacagaagcgaaacagccagccacattaagaaaatattgtatagaagcaaaacttacgaatactacaacggaatctagatgcccaactcaaggagaaccgtcccttaacgaagaacaagacaaaagatttatatgcaaacattcaatggttgatcgcggatggggaaacggatgtggcctatttggtaaaggagggatcgttacatgtgctatgttcacatgcaagaaaaacatggaaggaaaaattgttcagcccgaaaatttagaatacactatagtgataacccctcatagtggcgaagaacacgcagtaggtaatgatacaggaaaacatggaaaagaaataaaaatcacaccacaaagctcaacaaccgaagcggaattaactggatatggaacagtaacaatggaatgctcacctaggacggggttggattttaatgaaatggtgctgcttcaaatggaggataaagcatggctggtacacagacaatggtttttagacctaccacttccctggttacccggtgcggacacacaaggaagcaattggatacagaaagagactttagtaacattcaaaaacccacatgcgaagaaacaagatgtagttgtactaggttcacaggaaggtgcaatgcatactgcactcactggggctacagagattcagatgtcaagtggcaatttgttatttacgggacatttgaaatgcaggttacgtatggataaattacaattaaaaggtatgagttattcgatgtgcacgggaaagtttaagatagtcaaggagatcgcagagacccaacatggcacgattgtaattagagtgcagtatgaaggcgacggttcgccttgcaaaataccctttgaaattaccgatctagaaaaacgacacgtcttaggacgtttgattaccgtgaaccccatagtaaccgagaaggattcaccagtaaacatagaagccgaacctcctttcggagattcctacattattgtgggcgtagaacctggtcaattaaagctcaactggttcaagaaaggttctagcattggacaaatgtttgagaccacaatgcggggtgctaaacgcatggctatactaggggatacggcatgggattttggcagtctaggtggcgtatttacgtcaattggcaaagcacttcaccaagtttttggagctatatatggtgcagctttctcaggggtctcttggacaatgaaaatcttaattggagtaattattacgtggatcggcatgaactcacgatctacatctttaagtgtttctttagtattagtaggtgttgtaaccttatatttaggagcaatggtacaagccgatagcggatgtatagtcagttggaaaaacaaggagttaaaatgtggttccggaatctttattactgataacgtgcacacatggacagagcagtacaagtttcaacctgaaagtcctagcaaattggcctcagctattcaaaaagctcatgaagagggaatatgcgggattcgctcagtgacaagacttgaaaacctgatgtggaagcaaataacacctgaactaaatcatatcttaagcgaaaatgaagtcaaattaacaatcatgacaggtgatatcaagggaattatgcaagcagggaaaagatccttaaggcctcaacctacagagttgaaatactcatggaaaacgtggggaaaagctaaaatgctaagtacagaaagtcacaatcaaactttccttatcgacggtccagagaccgcagagtgccctaacacaaatcgagcgtggaactcattggaagtagaagactacggattcggggtatttactactaatatttggctaaagctgagagaaaaacaagacgtattctgtgactctaaattaatgtcagcagcgattaagaataatagggccgtccatgctgatatggggtattggatcgaatcggcactaaacgacacttggaaaatggaaaaggcttctttcattgaagtcaaaagttgtcactggccaaaatcccacacgttatggtcaaatggtgtcttagaatccgaaatgataataccgaagaattttgctggcccagtaagccaacacaattatcggccgggctatcatactcagactgctggtccttggcatctaggaaaattagagatggactttgatttctgcgagggtaccacggtggttgttactgaagactgcggcaaccggggaccatcattacggacaacaaccgcaagtggcaaattgattacggagtggtgctgtcgctcatgcacattaccacccttgaggtacaggggagaggatggctgttggtatggaatggagataagaccgttaaaggagaaagaggagaacttggtcaactcattggttactgctggtcacggccaaattgataatttcagtctgggggttttaggaatggcactattcctagaagaaatgttaagaaccagagtcggcaccaaacatgcgattttacttgtcgctctttcattcgtaacactcatcacgggcaatatgtcattcagagacttaggaagagtaatggtaatggtaggagcaaccatgactgatgatataggaatgggtgtaacatacttggcccttcttgctgcattcaaagttagaccgacatttgcagctgggctgttacttcgaaaacttacaagtaaagaactcatgatggcaactattgggatagcacttctgagccaatctaccctaccagaaactatattagaattaacagacgcattagccttaggaatgatggcactaaaaatcgttaggaatatggagaagtatcagttagcggtaactataatggctatttcgtgtgtgccaaatgccgtaattctacagaatgcctggaaagtcagctgtaccattcttgcagcagtaagcgtgagtccgctattgctgacctcgtcacaacaaaaagcagattggatccctctcgctttgacgataaaaggattaaacccaacggcaatattccttactacgttatcgagaacgtcaaagaaaagatcatggcctttaaatgaagcgattatggctgtgggaatggtttcaatcttagcatcatcactactaaagaacgacattccaatgactggaccattggttgccggtggtttgcttactgtttgctatgtactcactggacgatctgcagatctggaactagagagggcagcggacgtgaaatgggaagatcaagcagaaatatcaggatcatcacccatcttaagtataacaatttcagaagacggtagtatgtctatcaaaaatgaagaagaggagcaaacgttgacaatccttataagaacgggattgctagtaataagcggggtatttcccgtgtcaataccaattactgcagcagcttggtacctctgggaagtaaagaaacagcgagcgggggtattatgggacgtaccctctcccccacctgtgggaaaagctgagctggaagacggtgcatacagaatcaaacaaaggggaatactaggttatagccagattggagccggtgtctataaagaaggcactttccatacaatgtggcatgtaacacgtggggctgtattaatgcaccgaggaaaacgcatcgagccatcttgggcagatgtgaagaaagacctcatatcgtatggaggtggttggaaacttgagggagagtggaaggaaggagaagaagttcaagtgttagctcttgaaccgggtaaaaatcctcgggctgtgcagaccaaacccggtattttcaagacaaatacaggtaccatcggggcagttagcttagacttcagccctggaacttccggctcccctattgtagatcgaaaaggaaaagtagttgggttatacggaaatggagtcgtaacccggagcggagcgtacgtgagtgctatcgctcaaacagaaaaatcgatagaggacaatccagagattgaagatgatatttttagaaagaagcgactcaccattatggatttgcacccaggagctggaaaaactaagagatatttgccggccattgtgcgtgaagcaatcaaaagagggttacgtactctaatattggcaccaacgagggttgttgcagccgagatggaagaagctctgagaggactgccgatacgatatcagacaccggcaatacgagcagaacacactggtagagagatagtggacttgatgtgtcacgcgacatttacaatgaggctgttatcacccgtacgcgtaccaaattacaacttgatcatcatggacgaagcacactttacagacccagcatcaatagcagcacgcggatatatctcgactagagtagagatgggtgaagcagcagggatttttatgaccgcgactcctccaggaagccgcgacccgtttccacaatccaacgccccgataatggacgaagaaagggaaattccagaaaggagttggaactcaggccatgagtgggttacggatttcaaaggtaaaacagtatggtttgtaccaagtataaaagctggcaatgatatagcagcatgtcttaggaaaaacggcaagaaagtaatacaactatcacgtaagacattcgactccgaatatgttaagacaagagcgaatgactgggactttgtagtaactactgacatatcagaaatgggagctaatttcaaagctgaaagagtgattgatcctagaagatgtatgaaaccggtaatcctaactgacggtgaagaaagggtaatactggcaggcccaatgcctgtaacacattcttcagcagcacagaggagaggccgaatcggaagaaatccaaagaacgaaaacgatcagtatatttatatgggtgagccattagagaatgacgaagattgtgctcattggaaggaagcaaaaatgttattagataacatcaatacgccggagggaataatcccctcaatgttcgagcctgaaagagagaaggtcgatgcaatcgatggagaatacagactaaggggagaagccagaaagacctttgtagatctaatgcgtagaggggatctaccggtctggctagcatataaagtggcggcggaaggaataaattacgcagatcgtaaatggtgtttcgatgggataaagaataaccagattctagaagagaatgttgaggtagaaatttggactaaagaaggcgaaaggaagaaactaaaacccagatggctagacgcaagaatttattcagacccacttgccttaaaagaatttaaagaatttgcggcaggacgaaaatcacttacgctcaacttaataactgagatgggacggcttcccacattcatgacacaaaaagcaaggaacgcattagataacctagcggtgttacacacggcagaagtagggggtaaggcatacacacacgctttaagtgaattaccagagactttagaaactttattgctccttactctattagccgcagttacgggcggcatttttctatttttaatgagtggaaaaggcatcgggaagatgacgttaggaatgtgctgtatcataactgcttctatcctactctggtatgctcaaattcaaccacactggatagctgcgagcatcatactagaatttttcctaatagtcttattgattcctgaacctgaaaagcagaggaccccgcaagataaccaattaacatacgttgtaatagctattttaacagtagttgcagcgactatggctaatgaaatgggatttctagagaaaactaagaaagaccttggatttggctcaataacaacccaagagagtgaatcaaatatattggatatagatctcaggccagcatccgcatggacactatacgcggttgctactaccttcgtcacaccaatgcttcgtcactcaatagagaatagctctgttaatgtatcacttactgcgatagcaaatcaagccactgtactgatgggattaggtaaaggctggccactttcaaaaatggacataggagtccctctattagccatcggttgctatagtcaggtaaatccaataacactaacggccgcgttgctattacttgtggcccattatgcaattattgggccgggtttacaagcaaaagccactagagaagctcagaaaagagcagctgccggaattatgaaaaacccgactgtcgacggaattacagttatagatttagaaccaattccctatgacccaaaattcgagaaacaacttggacaagttatgctgctgatattatgtgtcacccaagttctcatgatgcggacaacatgggcattatgcgaagccttaactttagcaacaggccctatcagtacgctatgggaaggaaacccaggcaggttctggaacaccacgatcgctgtttcgatggctaacatttttagaggttcatatctagctggcgcaggattactattttcaatcatgaagaacactactaatacgagaagaggaacgggaaacgtcggcgaaactctaggagagaaatggaaatcgagattaaatgctctcggaaaaagtgagttccaaatatacaagaaatcggggatacaagaggtagaccgaacgctggccaaagaagggataaaacgaggcgagactgatcaccacgcagtatctaggggaagtgcgaaattgcgatggtttgtagagagaaatatggttactcccgaaggaaaggtggtagacttgggatgtggccgcggaggttggagctattattgtggcggccttaaaaatgtacgagaggtaaaaggcttaacgaaaggtggaccgggtcacgaagaaccaatcccaatgtccacatatggctggaacttagtcagattacagtcaggagtagacgtgttctttacgccaccggaaaaatgtgacaccttactctgcgacataggagaatcaagcccaaaccctaccatagaggcgggtcggactctgcgggtgctaaacctcgtagaaaactggcttaataacaatactcaattctgtattaaagtgttaaatccgtatatgccgtcagtaatcgaaaagatggaaactctccaaaggaaatatggtggtgcattagttagaaatccgcttagtagaaatagcacacatgaaatgtattgggtttctaatgcaactgggaacatcgtttccagtgtaaatatgattagtcgaatgttaataaatcgattcacaatgaaacacaaaaaggcgacgtatgaaccagacgtggacttaggtagtggaacaagaaatataggcattgaatccgaaataccgaatctcgatataataggaaagcgaatcgagaaaataaaacaagaacatgaaacttcttggcactatgaccaagaccatccttataagacttgggcataccatggatcttatgaaacaaaacaaacaggctcagcaagtagcatggtcaatggggtagtgcgacttcttacgaaaccatgggatgtcgtaccgatggttacgcaaatggctatgacagatacaaccccttttggtcaacaacgggtttttaaagagaaagtagacacaagaacccaagaaccgaaagagggtacaaagaaattaatgaaaataactgcggaatggttatggaaggaattagggaaagagaaaacacctcgtatgtgtactagagaagagttcacacgaaaagttagaagcaacgctgctctgggtgcagtcttcacagacgaaaataaatggaagtcagctagggaggcggttgaagacggtagattttgggaattggtagacagggagagaaatctccacttagaaggtaagtgtgaaacatgtgtatataatatgatgggaaaaagggaaaagaaattaggcgagttcggaaaagcaaaaggatcacgagcaatttggtacatgtggttaggagcaaggtttctagagttcgaagctctaggattcctaaatgaggatcattggtttagtcgtggaaactcgctaagtggcgtggaaggtgaagggctccacaggttaggatatatactgagagaagtaggcaagaaagagggtggagcaatgtatgcagacgatacagcgggatgggatacaaggatcactttagaagatctcaaaaatgaggaaatggttacaaatcatatgaaaggagaacacaagaaattagctgaagccatatttaaacttacataccaaaataaagtcgtacgggtacaaagaccgacacctcgcggaacagtaatggatattataagtcggaaagatcaacggggatcggggcaagtaggaacttatggacttaatacatttacgaatatggaagctcaattaataagacaaatggaaggggaaggaatatttaaaagcatacaacatctaaccgcgactgaagaaatagctgttcagaactggcttgcgcgcgtaggtagggaacgtttatccaggatggccatatcgggagatgattgtgttgtaaaaccaatagacgacagattcgcgtccgccctcacagctttgaatgatatgggaaaggttagaaaagatattcaacagtgggagccctctcgtgggtggaatgattggactcaagttcctttctgcagccaccatttccatgaattggtcatgaaagatggccgagtactcgtagttccatgtagaaatcaagatgaattaataggacgggcaagaatcagtcaaggagcaggatggagtttgaaggagactgcctgtcttggaaagtcctatgcccaaatgtggacattaatgtattttcatcgacgagacttacgactagctgcgaacgctatatgttctgcagtcccaagccactgggtaccaacgtcgagaaccacttggagtatacatgccaagcacgaatggatgaccacggaagacatgcttgctgtatggaatcgtgtttggattcaagaaaacccatggatggaagataaaactcctgttgagtcatgggaggaagtcccttaccttggtaaaagagaagatcaatggtgcgggagtcttataggcctgacgtctagagcgacgtgggcgaaaaacattcagacagcgatcaatcaagttagaagtttaatcggaaatgaaggatataccgattatatgccttctatgaaacgttttcgccgtgaagaagaagaagcgggtgttttatggtga

SEQ ID NO: 22281 - RNA, 9876 nt, synthetic construct
  misc_feature 1..9876: note = derived and/or modified CDS sequence (opt6) from DENV-2__FJ898461__SS-prME
  source 1..9876: mol_type = other RNA
acagctggtgtgatcgtcatgttaatacccaccgcaatggcatttcacttaacaaccagaaatggcgaaccacatatgattgtaggaagacaagaaaaagggaaatcattattgtttaaaacagaagacggagtcaatatgtgtactcttatggcaattgatttaggcgaattatgcgaagatactattacttataaatgtcctttattacgtcaaaatgaaccagaagatatagattgctggtgtaattccacatccacatgggtaacttacggcacatgcacaacgactggagaacacaggagagagaaaagaagcgtcgctctcgtacctcatgttggaatggggcttgaaacccgcacagaaacgtggatgtcctcagaaggcgcatggaaacatgtacaacggatcgaaacctggatcctacgacatccaggcttcaccattatggcagcaatattagcatacactataggcacaacacattttcaaagagcactcatcttcattcttctaaccgcagttgcgccttcaatgacaatgcgttgcatcggaatcagtaaccgcgatttcgtagaaggtgtttcaggagggtcatgggtggatatagttttagaacatggtagctgcgtgactacaatggctaaaaataaacctactctagattttgaactcataaaaacagaagcaaaacaacctgctacgctacgcaaatactgtattgaagcaaaattaacaaatacgacaactgaatccagatgcccgactcagggtgaacccagcttgaacgaagaacaagataaaagattcatttgtaaacatagcatggttgatcgagggtgggggaatggatgtggtttatttggcaaaggaggcatcgtgacgtgcgctatgtttacctgtaagaaaaatatggaaggtaaagtggttcaacccgaaaatctagaatatacaattgtgattacaccacatagtggggaggaacatgcagttggaaacgacacaggaaaacatggaaaagaaatcaaaatcacaccacagtccagcataactgaagcagagcttacaggctatggaactgtaaccatggaatgtagccctagaacaggcttggatttcaacgaaatggttttgttacaaatggaagacaaagcgtggttggtacataggcaatggtttttagatttaccgttaccttggttacccggcgcagacacacagggatcaaactggatccaaaaagaaactttggtgacatttaaaaatccgcacgccaagaaacaagacgtagttgtactgggctctcaggagggagcaatgcacacagctctcacaggcgcaacagaaatacaaatgtcaagtgggaatcttctattcactggccacctcaagtgccgacttagaatggacaaattacaattaaaaggtatgtcctattctatgtgtaccggaaaatttaagatagtaaaagagatagcggagacacaacacggaaccatagtaattagagtccagtacgaaggcgacggatcaccctgtaaaataccctttgaaataacagatttagaaaaacgacatgtgcttggacgtctgatcacagttaatccaatagtgaccgaaaaagatagtccagtaaatattgaggcagaaccgccctttggtgattcatatattataataggggtagaaccagggcagttgaagttaaactggtttaaaaaggggagtagcataggacagatgtttcaaacaactgttagaggggctaaacgcatggcaattctaggggatacagcgtgggatttcggtagtctaggaggcgtgtttacttctatcggtaaagcgctacaccaagtattcggcgctatatatggagcggctttttccggagtatcatggacaatgaaaatattgattggtgttatcataacatggattggaatgaactcgcgttcgacctcactatcagtcagtctagtcttagttggtgtggtaacactatatttaggcgcaatggtacaagcagatagtggttgtgtagtaagttggaaaaacaaggagctaaaatgcgggagtggcatctttatcacggataatgtacacacatggacagaacagtacaaattccagccggaatcaccaagtaaactggctagtgcgattcaaaaagcgcatgaagaaggaatatgtggtataaggtccgttactcgtcttgagaacctcatgtggaaacaaataacgcctgagctaaaccatatattgtcagagaatgaagtaaagctgactattatgacaggtgatataaaagggataatgcaagcaggaaagagaagtttaagaccacaacccaccgaactaaaatatagctggaaaacatgggggaaagcaaaaatgctctctacagagtcccacaatcaaactttcttgattgacgggccagaaacagcggaatgccccaacactaaccgtgcttggaactcattggaagttgaagattatggctttggagtttttactacaaacatttggctaaagttaagagagaaacaggatgtattttgcgattctaaactaatgagtgcagcgatcaaggacaacagagcagttcacgctgatatgggctattggatagagtctgcgcttaacgatacatggaaaatggaaaaagcgagcttcatcgaagttaaatcctgtcactggccaaaatcacacacgttatggagtaatggagtactagaatcagaaatgattattcctaaaaatttcgccggccccgtttctcaacataactatagaccgggctatcacacgcaaacagcaggaccctggcacttaggtaagctcgaaatggattttgatttatgcgagggaactaccgtagtagtaacggaagattgtggcaacagaggcccgagcttacgaactacaactgcgagtggaaagctcattacagaatggtgctgtaggagctgtacgcttcctccactacgatatagaggtgaggatggatgctggtatgggatggaaattaggcccctcaaagaaaaagaagagaatcttgttaattcactggtaactgccggtcacggacagatcgataactttagtctcggagtattagggatggcattgttcctagaggaaatgttacgtactagaatagggacgaaacatgcaatattactcgtggtagttagctttgttaccttaatcaccgggaatatgtcatttcgggacttaggaagagtaatggtcatggtaggggcaaccatgactgacgacataggcatgggtgtcacatacctggccctactagccgcattcaaagtgagacccacattcgcagccgggttattgttacgaaagctcacatcaaaagaattaatgatggcaaccattggtattgccttgctctctcagtcaacaattccggagaccatactggaattaacagacgcgttagcactcggcatgatggttttaaagatcgtgcgcaacatggagaaatatcaactagcagttaccataatggcaatatcatgtgtcccaaacgcggtaattctacaaaatgcttggaaagtatcatgtacaattctggcagcagtatcagtatcaccactattattaacttcgtcccaacagaaagccgattggatacctctagcattgacgataaaaggtcttaatccaacggcaatcttccttaccacattatcacgcacaagtaagaaacggtcatggcctttaaacgaagcaattatggctgttggcatggtgagtattttagcaagcagtttgctgaagaatgacatcccaatgactgggcctctagtcgctggagggctacttacagtatgttatgtgttaaccggtagatcagcagatttagaactagagagggcagctgatgttaagtgggaagatcaggctgaaataagcggatccagcccaatacttagtataactatatcagaggatggaagtatgagcattaaaaacgaagaagaagaacaaacacttactatattgataaggactgggcttttagtcatttctggcgtgtttccagtatcgattcccattaccgctgccgcgtggtacttatgggaagttaagaaacagagagccggtgttctctgggatgtcccatcgcctccgccggtagaaaaagcagaattagaggatggagcatatagaattaagcaacgaggcatcctgggatattctcaaatcggcgctggtgtgtataaggaaggaacgtttcacacaatgtggcacgtaactaggggagcggtgttaatgcacagagggaaacgaatagaaccaagttgggcagatgtcaagaaagatttgataagttacggaggaggatggaagctagaaggtgaatggaaggagggtgaagaagttcaggtgctcgcgttggagcctggcaaaaatccacgagctgtccaaacaaagccaggtatattcaagacgaacacgggaacaattggagctgtatcactcgatttcagccctggaacatcaggctcgccgatagtagacagaaaaggaaaggtcgtcgggctatacggaaatggggtggtcacccgaagcggagcatatgttagtgcgatagcccaaacagaaaagtccatagaagataatccagaaatagaagatgatatattccgcaagaaaagattaacgatcatggatctacaccccggtgccggcaaaacaaaaagatacctacctgcaatagtaagggaagccataaagcgtggcttgagaacactaatattagcaccaactagagtcgtggctgcagaaatggaggaagctctccgaggattgccaattagataccaaacgcccgccatcaaaacagaacatacagggcgggaaattgtagacctaatgtgccatgctaccttcacgatgaggcttctatcacctgtacgagttccaaattacaatttaatcataatggatgaagctcactttactgatcccgcatccatagctgcacgtggatatataagcacaagagtagaaatgggtgaggctgccgggatattcatgacagcaacaccacccgggagcagggacccatttccgcaatctaacgcacccataatggatgaagaaagagaaatcccagaaaggagctggaactcgggccacgaatgggtaacagacttcaaagggaaaacagtctggtttgtaccgtccatcaaagccggtaacgatatagctgcctgtttacgtaagaatggtaagaaagtaatacaactatcaagaaaaacattcgatagcgaatacgttaaaacaagagcaaatgactgggatttcgtagttacaacagatatatcagagatgggtgccaactttaaagcagagcgggttatcgaccctagacgatgcatgaaaccagtcattttgacagacggagaagaaagagtaatccttgcaggtccaatgccagtgacacacagttccgcagcacaacgccgcgggaggattggacgcaatcccaaaaatgaaaatgatcaatacatctatatgggagaaccacttgaaaatgatgaagactgtgcacactggaaggaagccaaaatgttgttagataatataaatacacctgaaggaatcataccaagtatgtttgaacccgaaagagaaaaggtagatgctattgacggagaatacaggctgcgtggagaagcaaggaaaacgttcgtagatttaatgcgcagaggtgatttaccagtgtggcttgcttataaagtcgccgctgaaggaataaattatgcggatcgaaaatggtgtttcgacggcattaaaaataatcaaatattggaagaaaatatggaagtagaaatatggaccaaagaaggcgaaaggaagaaacttaagccacgttggttagatgctcggatatattccgaccccttagctctcaaagaatttaaggagtttgcagcagggcgaaagtcattaactctaaatctcataacagaaatgggaaggctacctacgtttatgacgcaaaaagcaagaaacgcgctggataatttagccgtccttcatacagcagaagctggtggacgagcatataatcatgctttatcagaactacccgaaacattggaaactctgttactacttactttactagccacagtcacagggggcatatttctctttcttatgagtggaaaaggcatagggaaaatgacacttggtatgtgctgtattataactgccagtatattactatggtacgcgcaaatacaaccacattggatagcggcttctatcatacttgaatttttcctaatagtcctactcataccagaaccagaaaaacaaagaaccccacaagacaatcaacttacttatgtggtaattgctatattgactgtggtggccgccacaatggctaatgaaatgggatttttagagaaaactaagaaagacctaggattaggatcaataacgacacaggaaccagaatcgaatattctggatatagacttacgaccggcctcagcgtggacactctatgccgtggcaacaacgttcgtaaccccgatgttgaggcattctattgaaaatagctctgtcaacgtatctctcactgcgattgcaaaccaagcaaccgtcttgatgggattgggaaaagggtggccattatccaagatggatataggagtaccgttattagcaattggatgttacagtcaggtcaatccaattacattgactgcggctttactattattagttgcacattacgccattatcggaccaggtctacaagctaaagccacaagggaagctcagaaaagagcggctgcaggcataatgaaaaaccccacagtcgacgggattactgtaatcgacttagagccaataccatacgatccaaaatttgagaaacaattagggcaagtgatgttactaatcttgtgcgttactcaagtactgatgatgagaacgacatgggccctatgtgaagcattaacactcgctaccgggccaatttccacactatgggagggcaacccaggaagattctggaacacgaccatagcagtttcaatggctaatatttttagaggatcgtacctagccggagccggtctacttttcagtatcatgaaaaatacaacaaacactagacgtgggacaggtaacatcggtgaaacccttggagaaaaatggaaatccagactaaacgcactaggaaaatctgagttccagatttataagaaatcggggatacaagaagtagatagaaccctggcaaaggaaggaataaagcgaggcgaaaccgatcaccacgccgtctcccgtggtagtgcaaaactacgctggtttgttgaacggaatatggttactcctgaagggaaagtggttgacttaggatgcggcagagggggctggtcgtattattgcggtggactaaagaacgtccgggaggtaaaaggtctaactaaaggagggccaggacatgaggaaccgataccaatgtctacttacggctggaatttagttagactgcaaagcggagttgatgtgttctttactcctcctgaaaaatgtgatacactattatgtgacatcggtgaatcctcaccaaatcccaccatagaagctggaagaacactaagggtgctaaatttggtagagaactggttgaacaacaacacacaattttgcattaaagtattaaatccgtacatgccatctgtcatagagaaaatggaaacattacaacgtaaatacggaggggcattggtacgtaatcccctgagccgaaattcaacccatgaaatgtattgggtatctaacgccacagggaacattgttagttccgtcaacatgatctctcggatgttaatcaaccgatttacaatgaaacacaagaaagctacatacgagcctgatgttgatctcggttcaggtaccaggaatataggtatagagtccgaaataccaaacttagacataattggaaaaagaatagagaaaataaaacaggaacatgaaacaagttggcactatgaccaagaccatccatataaaacttgggcgtaccacggctcatacgagacgaagcagactggtagtgcttcgagcatggtaaatggagtcgtaagacttcttaccaaaccctgggatgtggtacctatggtaacacaaatggcaatgacggatactacaccgttcggtcagcaaagggtattcaaagaaaaggtagatacaaggactcaagaaccaaaagaaggtactaagaaattaatgaaaattacagcagaatggttatggaaggaattagggaaaaagaaaacaccacgcatgtgcacacgcgaagaatttacaagaaaagtgcgctcaaatgctgccttgggtgctatttttacggatgaaaacaaatggaaaagcgcaagagaagctgttgaggatggtagattctgggagctagtagaccgagaacgaaatctacatctagaaggtaaatgcgaaacgtgtgtctataatatgatgggcaaaagagagaagaaattaggagagttcgggaaagcaaaaggctccagagccatttggtatatgtggctcggagctcgattcttagagttcgaagctcttgggttcttgaacgaagatcactggttttcaagaggaaattcattaagtggtgtagaaggagaaggactacatagattaggatatatcctccgtgatgtcgggaagaaagaaggaggagcgatgtacgcggatgatactgcgggttgggatacccgtataacattagaagacctgaaaaacgaagagatggtaacaaaccatatgaaaggagagcacaagaaacttgcagaagcaatatttaaacttacatatcaaaacaaagtagtaagggttcaaagaccaacacctcgtggtaccgtgatggatataatttccagaagggatcaacgaggctcaggtcaagtaggtacgtatggcttaaatacgtttactaacatggaagcacaacttataaggcaaatggaaggcgaagggatatttaaaagtatacaacatttaacggccacggaagagattgccgtacagaactggttagccaggttagggagagaacgactttcacggatggctatatcaggagatgactgtgtagtaaagcctattgacgatagatttgcatccgcgttaactgctctaaatgatatgggcaaagttagaaaggatattcagcaatgggagccttctagaggttggaatgactggacacaagttcctttttgctctcatcatttccatgagttggtaatgaaagatgggagggtcctggttgtgccatgcagaaaccaagatgaactaattggtagggcacgcataagtcagggcgctggttggtcactcaaagaaacggcctgtctaggtaagagttatgcacaaatgtggacattaatgtacttccacagaagagacttacgactagctgccaatgctatctgctcagcagttcccagccactgggtgccaacatcaagaacaacgtggagtatccatgcgaaacacgaatggatgacaactgaagatatgttagctgtatggaatcgagtatggattcaagaaaacccgtggatggaggacaaaacgccagttgaatcctgggaagaagttccatacttgggtaaacgagaagatcaatggtgtggttctttaattggactaacatcgagagccacatgggccaaaaacatacagacggcaataaatcaagtacgtagtttaataggcaatgaagaatacaccgattacatgcccagcatgaaacggtttagaagagaggaagaagaggcgggcgtgctatggtaa

SEQ ID NO: 22282 - RNA, 9876 nt, synthetic construct
  misc_feature 1..9876: note = derived and/or modified CDS sequence (opt6) from DENV-2__FJ024473__SS-prME
  source 1..9876: mol_type = other RNA
acagcaggggtgatagtgatgctaattccgacggcaatggcatttcatctcacaacccgcaacggagagccgcacatgatagtaggcagacaagaaaaaggaaaatcactactgtttaaaacagaagatggagtgaacatgtgcacacttatggcaatagatctaggtgagttatgtgaagatacaataacatataaatgtcctttattaaggcaaaatgagccagaggatatagactgttggtgcaatagtacaagcacatgggtaacgtatggaacttgtacaacaaccggagaacatcgacgagagaaaagatcagtggccttagtaccccacgtgggaatgggcttagagacacgaacagagacgtggatgtcaagcgaaggggcttggaaacacgtacaaagaatagaaacttggattcttaggcatccgggcttcacaattatggcagcaatacttgcctacaccatcgggacaacgcatttccagagagctctaatctttatactcctgacggcagttgcaccgagcatgacaatgaggtgtattggaacaagcaaccgcgactttgttgagggcgtaagcggtgggtcttgggtggatattgtgttagaacacggaagctgcgtaaccactatggccaaaaataaaccgactcttgactttgagctaataaaaacagaagccaaacagccagcaacactaaggaaatattgtatcgaagcaaaacttactaatacaacaacagaatccaggtgcccaactcaaggagaaccatcattgaatgaagaacaagacaaacgatttatttgtaaacactctatggtagatcggggttggggaaatggttgtggcttatttggaaaaggaggcattgtcacttgtgcaatgtttacatgtaaaaagaatatggaaggtaaggttgtgcaaccagaaaatctggaatacaccattgtcataacaccacattcgggtgaggaacatgccgtgggagatgacactggtaaacatggtaaagagattaaaataacaccgcaaagttcaatcacagaagccgaactaactggatacgggacagttacaatggaatgcagtcctagaacagggctagatttcaacgagatggtactcctccaaatggaggacaaagcgtggttggttcaccgccagtggtttcttgatctaccactcccgtggttaccaggggcggacacacaaggatcaaattggatacaaaaagaaactctggttacgtttaaaaatccacacgccaagaaacaagatgtagtagtcttagggtcacaagaaggagccatgcatactgcccttaccggagctaccgaaatccaaatgtcaagtggtaatttactctttacgggtcacctaaaatgccggcttagaatggataaactccaactgaaaggcatgagttatagtatgtgcacgggaaaatttaaaatagtgaaggagattgctgaaactcaacatggcactatcgtgatcagggtacaatacgagggagacggtagcccatgtaaaattcccttcgaaatcaccgatttagagaagcggcatgtcctaggtaggcttattactgtcaatccaatagtaatagaaaaagactcaccagttaacatagaagcagaaccgcccttcggggatagttacattattattggagttgagcccggacaactcaaactcaattggtttaagaaagggtcatctataggacaaatgtttgaaacaacaatgaggggagccaaacgaatggccatcctaggggacacggcttgggactttggttctttaggtggtgttttcaccagtataggtaaggctttacatcaagtcttcggggcaatatacggagctgcatttagtggtgttagctggacaatgaaaattcttatcggcgttgtaattacttggatcggaatgaactctcgatcaactagcctatcggtttctttggttcttgtcggcgtagttacattatatctaggagcaatggtccaagcagactcgggctgcgtggtgagttggaaaaacaaagagcttaagtgtggctcaggcattttcatcaccgataatgtacacacgtggaccgaacagtataagtttcaaccagaatcaccatctaagttggcgtcggccatacaaaaagcacatgaagaaggaatttgtgggattcggagcgttacacgactagagaatctcatgtggaaacaaattacacccgagttgaaccatatcttaagtgaaaatgaagttaaactaacaataatgacgggggacactaagggaattatgcaagcgggaaaacgatacttacggccacaaccaaccgagttaaaatatagttggaaaacatgggggaaagcgaaaatgttaagcacggaatcgcacaaccagacctttctgatagatgggccagaaactgcggaatgtcccaacaccaaccgggcttggaactcattggaagtagaagattacggctttggagtattcactactaatatatggttaaagctaagagaaaagcaagacgtattttgtgattcgaagctgatgagtgcggcaatcaaagacaatagagcagtacatgccgacatgggctattggattgaatcagcactgaatgacacatggaaaatggagaaagccagtttcatagaagtcaagagttgtcattggccaaaatcccacacgctttggtccaacggcgtactagagtcggaaatgattattcccaaaaatttcgcaggccccgtgtctcaacataattacagacctggttaccacacacaaacagccggaccttggcatcttggaaaattagaaatggactttgatttctgtgaaggaactacggtagtagtcacagaagattgcggtaatagaggaccttcactaagaacaaccaccgcaagtggcaaattaattacagaatggtgctgtagatcgtgcaccctcccgccgctaagataccgaggggaagatggttgctggtatggcatggaaattaggccgctaaaggaaaaggaagagaatttggtaaattcccttgtaaccgcaggacatgggcaaatagataactttagtttgggagttttgggaatggcgttattcttagaagaaatgctaagaacaagggtaggcacaaaacatgccattcttctcgtagcggtatcatttgttacattgataacaggtaacatgtcttttagagatttaggacgagttatggtcatggtaggagcaacaatgactgatgacataggcatgggtgttacttacttggctctactggcagcatttaaggtgcgacccaccttcgctgcaggattattactcagaaaacttacaagtaaagaactgatgatggccacaatcggtataacattgttatcccaatctactatacccgaaacaatactagaattgacagatgcactagcactaggtatgatggttttaaaaattgtaagaaatatggaaaaatatcagttggccgtaacgattatggcgatcagctgcgtacctaatgcagtaatcctaaggaacgcttggaaagtatcgtgcacaattcttgccgcggtaagtgtctcacctttacttttaaccagcagtcagcagaaagctgactggattccattggctttaaccattaaaggcttaaatccaactgcaatatttctcacaacgctgtcaaggacttccaagaaacgatcatggccccttaatgaagcgattatggcagttggaatggtctcaattttagctagctctttgcttaaaaatgatatcccaatgacgggaccactggtggcaggagggctattaacggtgtgttatgtattgacaggaagaagcgcagacctggaactggaaagggctgcagatgtaaaatgggaggatcaagcagaaatttcaggatcttcgccgatacttagcattactatcagcgaggacgggtcaatgagcattaaaaatgaagaagaagaaaccacgttgacaattcttattagaacaggacttctggttatatctggtgtatttcctgtgtcaatacccataaccgcggcggcatggtacctatgggaagtcaagaaacagcgagcaggagtcctatgggatgttccatctccacctttagtaggcaaggctgaattagaagacggagcgtacaggatcaaacaacgcgggattctaggctattcgcaaattggcgctggcgtttacaaagaaggcacatttcataccatgtggcatgtaacgcgaggtgcggtgctcatgcatcgaggtaaaaggatagaaccttcttgggctgatgtcaagaaagatttgatatcgtatggcggcggctggaaattagaaggtgagtggaaggaaggtgaagaagtacaagtactcgcattagagccgggaaagaatcccagagcagtacaaacaaaacctggaatatttaaaaccaacacaggtacaattggtgcagtatctttagattttagccctggtacaagtggatccccgatcgtagatcgaaaaggaaaagtcgtcggattatacggaaatggcgtcgtaacacgatctggtgcatatgtgtcagcaattgcccaaaccgagaagtctattgaagacaacccggaaatcgaggatgatatttttcgcaagaaacgactgactataatggatcttcacccgggcgcgggaaagactaaaagatacctacccgcgatagttcgtgaagcaataaaacgaggtctaagaacgctcattttagcacccactcgggtagtggcagctgaaatggaagaagcactccgaggcttaccaatcagatatcaaacaccagcgataaaggcggaacacacgggtagagagatagtagatctcatgtgtcatgcaacgtttactatgagattactctctcccgtaagagtaccaaattataacctaataataatggatgaagcccatttcacagacccagcttcgatcgcagcacgaggatatatcagtaccagagtagaaatgggcgaagcagcgggaatattcatgaccgctacaccacccggttctagagacccctttccacaatcgaatgccccaataatggatgaagaaagggagattcctgaacgcagctggaacagcgggcatgaatgggtgacagacttcaaagggaaaactgtatggtttgtgcccagtatcaaggcaggaaatgacatagccgcttgcttaagaaagaacgggaaaaaggtaattcaactatcaagaaaaacatttgactccgaatacgtcaaaacaagagctaatgattgggattttgtcgttacaacagatattagtgaaatgggagcgaacttcaaggcagaacgggtaatagatcctagaaggtgtatgaagccggtaatactaactgatggcgaggaaagggtgattctagcagggcctatgccagtaactcactcatctgcggcccaacgcaggggaagaattggcagaaatcctaaaaacgaaaatgatcaatacatttatatgggagaaccactagaaaacgatgaagactgcgctcactggaaagaagctaaaatgctcttggataatattaacacgccagagggcattataccttcaatgtttgagcccgaaagagaaaaggtagatgcagtggatggcgagtatcgcttacgaggtgaagcgagaaaaaccttcgttgatcttatgagaagaggagatctaccagtatggttagcctataaagtagccgctgaaggaataaattatgcagaccgtaagtggtgcttcgatggtatcaagaacaatcaaattttagaggaaaacgtcgaagtcgaaatatggaccaaagaaggagaaaggaagaaactcaaaccccgttggttagacgcacgcatttacagtgacccattagccctcaaggagtttaaagaatttgcagctggacgtaagagtctcacactaaatttgataactgagatgggcagactcccgacctttatgacacaaaaggcgcgaaatgcattagataatctagcggtactacatacagcagaagcaggagggagggcatataaccacgcattaagtgaactaccggaaacattagaaacattattactcctaaccctccttgccactgtaacaggtggcatatttctattcttaatgtctggaaagggaattggcaaaatgactctaggcatgtgttgtatcattacggcatctgttcttttatggtacgcgcaaattcaaccgcactggattgcagcgtcaattattctggagttctttttaattgtattattgataccggaaccagaaaagcaaaggacgccacaagataatcagcttacatatgtagtaatagcaatcttgacagtggtggcggcaacaatggcgaacgagatgggattcttagagaaaactaagaaagacctaggtttgggttcaatcacaacccaagaaagcgaatcaaatatactagacatagatcttcgcccagcctccgcttggaccctatatgccgtggcgactacatttgtaaccccaatgttgcgacactctatagaaaatagcagtgtaaatgtatctttaacggcaatcgccaatcaagcaacagtactaatgggattgggtaaaggatggcctttaagtaaaatggacatcggcgtgccactgttagccataggatgctactcacaagtgaatccgataaccctcaccgcagctttactactcctagtcgcacattatgcaatcatcggcccaggactacaagcaaaagcgacgagggaggcacaaaaacgcgcagcagcaggtataatgaaaaatccaacggtcgacggaataacagtaatagacctggaacctattccgtatgatccaaaattcgagaaacaactgggacaggtaatgttattaatactgtgtgtaacacaagtcctaatgatgcgtactacatgggcgttatgtgaagctctcaccttagcaactggaccaatctctaccctttgggaaggaaatccaggacgtttttggaacacaacgatagcagtaagtatggcaaatatatttagaggaagctatctggccggcgcgggactactgttttctataatgaaaaacactactaacacaagacggggaacgggaaacattggtgagacattaggggagaaatggaagagtcgacttaatgcattaggaaaaagcgagtttcaaatatataagaaaagtggtatccaagaagtagatcgtacgttggcaaaagaaggcataaagcgtggagaaacagaccatcatgctgttagcaggggaagtgcaaaactaagatggtttgtagaacgcaatatggtaactcccgaaggaaaagttgtagatcttgggtgcggcagaggaggctggagctattattgtggtggcctcaaaaacgtcagagaggtaaaaggtttaacaaagggaggacccggccacgaagaaccaatcccaatgtctacatatggttggaatctggtgcgactacaatccggagtagatgtgttctttacaccgccagaaaaatgtgacactttgctttgtgatattggtgaatcatcaccgaatccaacaatcgaagccggtcgcaccttacgagttctaaacctagttgaaaactggttaaataataacacacagttttgtataaaagtgctaaatccttacatgccaagtgttattgagaaaatggagacattacaacgaaaatatgggggtgctctagtaaggaatccgctatccagaaatagcacacatgaaatgtattgggtaagcaatgctacaggaaatatagtttcttctgttaacatgatttcaaggatgctaattaaccgattcacaatgaagcataaaaaggcaacatatgaggcagatgtggatttagggtcagggacacgaaatatagggatagaatcagaaatacccaatttggatataatcggaaaacgaattgagaaaataaaacaggaacatgaaacgtcctggcattatgatcaggatcatccctataaaacttgggcatatcacggatcgtacgaaacgaaacagacaggcagtgcatcatcgatggtaaacggcgtagtaagactattgaccaaaccgtgggatgtcgtgccaatggtgacccaaatggcaatgaccgatacaactcctttcggacagcaaagggtgtttaaagaaaaagtggatacgcgaacacaagaacccaaggagggcactaagaaactgatgagaattacggcggagtggctttggaaagaactggggaaaaagaaaacacccaggatgtgtaccagagaagaatttacaagaaaagttcgcagtaacgctgcccttggtgccatattcaccgacgaaaataaatggaaatctgcaagggaagcagttgaggacggacgattctgggaattagtcgatagagagcgaaatctacatttagagggtaaatgcgaaacctgtgtttacaatatgatggggaaaagggagaagaaacttggggagtttggtaaagcaaaaggaagccgggcgatctggtatatgtggctaggagccagatttctagaatttgaagcgctaggctttctgaatgaagaccattggttctcgagaggcaacagtcttagtggcgtagaaggagagggtttacatagacttggatacattctaagagatgttggtaagaaagaaggaggggcaatgtatgctgatgatactgcaggttgggatacaagaattacgttagaagatctgaaaaatgaagagatggtcacaaaccacatgaaaggcgagcataagaaactagctgaagcaatatttaaattaacctaccaaaacaaagtagtgcgtgtacaaagaccaactccaagaggaacagtaatggatataatctcacgacgtgatcaacggggaagcggccaagttggaacttatggtttaaacacatttactaacatggaagctcaactaataagacagatggagggagaaggtatattcaaatcgatacaacatctgacagccacagaagagatagctgctcaaaattggttagcgagagttggcagagaacgattgagcaggatggctatttctggcgatgactgcgtcgtaaaacctattgacgatcgatttgcttctgcactaacagcattaaatgatatgggcaaggttagaaaggacattcaacaatgggaaccgagtcgaggttggaatgactggactcaagtaccattttgtagtcatcatttccatgaactggtaatgaaagatggcagagtactcgtcgttccgtgcagaaatcaagatgagttgataggtcgtgcaagaataagtcaaggagcaggatggtcactgaaagagacagcctgtcttggaaaaagttacgctcaaatgtggaccctaatgtactttcacaggcgggaccttcgcctcgccgctaacgcaatatgtagtgccgtaccctcacactgggtgccaacaagtaggaccacttggagtattcacgctaaacacgaatggatgacaacggaagacatgttagcagtgtggaatcgtgtctggatccaagaaaacccatggatggaagacaaaacccccgtggagagctgggaggaagtcccttatttagggaaacgggaagaccagtggtgcggatccctcataggcctgacatctagagccacatgggcgaagaatattcaaacagccatcaatcaggtcagaagtcttataggtaatgaagaatacacggactatatgcctagcatgaaaagattccgacgggaagaagaagaagctggagttctatggtag

SEQ ID NO: 22283 - RNA, 9876 nt, synthetic construct
  misc_feature 1..9876: note = derived and/or modified CDS sequence (opt6) from DENV-2__FJ024474__SS-prME
  source 1..9876: mol_type = other RNA
actgcgggggtcattgtaatgctaatacccacagctatggcttttcacttaacaacacgaaatggagaaccccacatgattgttggacgtcaagaaaaaggaaaaagtctactatttaaaacggaagatggagtaaacatgtgtaccttaatggcaatagacttgggagaactctgtgaagatacaattacttataaatgtccattgttaaaacaaaacgaacccgaagatatagattgttggtgtaattctacttctacatgggtaacatacggcacatgtactacaacaggggaacatagaagagagaaaagaagtgtggccttagttccccacgtaggtatgggtctagaaacacgaacagaaacatggatgtccagtgaaggcgcatggaaacatgttcaacgaatagaaacatggatcctaagacatccaggtttcacgattatggcagcgatattagcatataccataggcacgacgcattttcaacgtgcattgatattcattcttcttacagctgtagcaccatcaatgacaatgcgctgtatcggcatatcgaaccgcgactttgtagaaggagtgagtggaggctcctgggtagatatagtcttagaacatggatcttgcgtgactacaatggctaaaaacaaaccaacgctagattttgaattaatcaaaacagaagcaaaacaacccgcaacactacgtaagtactgtatcgaagccaaattaactaacacaacaacggaatcaagatgccccacccaaggggaaccgtcattaaatgaagaacaggacaagcgatttatatgtaaacattcaatggtggatcgtggttggggtaatggttgtgggttatttgggaaaggcggaatcgttacttgtgcaatgttcacatgtaaaaagaatatggaaggtaaagtagtccaaccagaaaatcttgagtatactatagtaataacccctcattcaggtgaagaacacgccgtgggaaatgatattggtaagcacggcaaggagataaaaatcacaccccaatctagtattacggaggccgaattgacagggtatggaactgtaaccatggaatgttcccccagaactggcttagattttaacgaaatggtgctacttcaaatggaagacaaagcatggctagtacataggcaatggttcttagatctaccccttccatggctacccggagctgacacacaaggttctaattggatccaaaaggaaacgttggtaacatttaaaaaccctcatgccaagaaacaagatgttgtagtgctcggctcccaagaaggtgcgatgcacacagcgttaacaggagcaactgagatacaaatgtcatccggaaatctactatttactggacatcttaagtgtagactaagaatggataaattgcaactcaaaggcatgtcttatagtatgtgcacaggtaaattcaaaattgttaaggagatagcagaaactcagcatggaacgatagttatcagagtacaatatgaaggagacgggtcaccttgtaaaatcccgttcgaaatcacggacttggaaaagcgtcacgttttaggaagattaattacagtaaatcccattgtaatagaaaaggatagtccagtgaatattgaagcggagcctccttttggagatagctacattattatcggagttgaaccaggccaattgaaactaaactggtttaagaaaggtagtagtataggacaaatgttcgaaaccacaatgaggggagcaaagaggatggcgatacttggggatactgcctgggactttggctcattgggcggtgtctttacaagtataggaaaggctttgcaccaagttttcggcgcaatatatggagctgcgttttcaggcgtgtcttggacaatgaaaatactcataggagttgtaataacctggattgggatgaatagcagaagcacttccttaagcgtgtctttagtattagtgggcgttgttaccttataccttggcgcaatggtacaggccgattccggttgcgttgtatcctggaagaataaagaattaaagtgtggttcaggtatcttcatcacggataatgtacatacatggactgaacaatataaattccaaccagagtcaccgtccaaacttgcatcagctatccaaaaagctcacgaagagggaatatgcggaatacgatcagtaacaagattagaaaacttaatgtggaaacagattaccccagagcttaatcacattttaagtgaaaatgaagtcaaattaacaattatgaccggggacacaaagggtataatgcaagcaggaaagagatacttaagaccacagccaaccgagcttaaatattcctggaagacatggggaaaagcgaaaatgctatcaaccgagagccacaaccaaactttcttaatagacggtcctgagacagctgaatgtccgaacactaatagagcgtggaactcattagaagtagaggactatggattcggagtcttcacaacaaatatatggctaaaattaagagaaaagcaagacgtattttgcgattctaaattaatgtcagccgcaattaaagacaacagagcagtccatgcagatatgggttattggattgaaagtgccctcaacgatacgtggaaaatggagaaggcttcgttcatagaagttaaaagctgccactggcccaaaagccacacattatggtcaaatggagtattagaaagtgaaatgataatacctaaaaattttgctggaccagtatcacaacataattacaggccagggtatcacacacagacggccggaccttggcacctaggcaagctggaaatggattttgacttctgcgaagggactacggtcgtagttacagaagattgtggaaatcgaggacccagtttacgtacaacaacagctagtggtaaactaattacagagtggtgttgtcggtcctgtactttacctcctctacggtatcgaggggaagatggatgctggtacggaatggagatcagaccattaaaagaaaaagaggaaaacttagttaattcgttggtgactgcaggtcacggacaaatagataacttcagtttaggcgtcttgggtatggcattgttcctagaggaaatgttgcgaacacgagttggaacaaagcatgcaattctattagttgcagtatcatttgtaaccttaataacaggtaatatgtctttcagggatcttggtagagtgatggtaatggtaggggcaactatgacggatgacataggtatgggagtcacttatttagcattactggcagcgtttaaagttcgaccgacgttcgcagccggacttttactacgtaaattgacaagcaaagaactaatgatggcaacaatcggtattaccctcctatcgcaaagtacaatcccagaaacaatcttggaactaaccgacgcattagcattggggatgatggttctaaaaatagtacgtaatatggagaagtatcaattagccgtgaccataatggcaatctcttgtgtacctaatgctgtaatacttagaaatgcatggaaggtaagttgcactatattagctgctgcctcagtctctccactacttttaacctcaagccaacaaaaagcggattggatacccttagccttaactattaaaggattaaatccaaccgcaatatttctaacaaccttaagcagaacatcaaagaaaagatcctggccattaaatgaggcaattatggcagtagggatggtgagtatccttgctagctcattactcaaaaatgatattccgatgaccggtcccctagtggcgggtggactactaacggtgtgttacgtactcacaggtcgttctgcagatctagaattagaacgtgcagcagacgtcaaatgggaagatcaagcagaaattagtgggtcctcacctatactatccattacaatcagtgaagatggctcaatgagtatcaaaaatgaagaagaggaacaaatactaaccatattaataaggacagggctgctggtaatttctggagtattcccggtatctattccaatcactgcggcagcatggtatctgtgggaagttaaaaagcaacgggccggagtactatgggacgttccaagtccaccacctgttggtaaggccgaattagaagacggggcttatagaataaaacaaagaggcatcttaggatattctcaaattggagccggtgtatacaaagagggcacattccacactatgtggcacgtaaccagaggcgctgttctcatgcatagaggaaaaagaatagaaccatcgtgggccgatgtcaagaaagacttaatatcgtatggcggagggtggaaactggaaggcgaatggaaagaaggagaagaggtgcaagtacttgcattggagccaggcaaaaatcctcgcgcagttcaaactaaacccggaatctttaaaacaaacactggcactataggagcggtttccttagacttttcgccaggtacctccggatcaccgatagtggatagaaaaggcaaagtggtaggactgtacggaaatggagtcgtaacgcgcagcggtgcttacgtatcggccattgcacaaacggaaaaatcgatagaagacaatcctgaaattgaggacgatattttcaggaagaaaagacttacgatcatggatctccatccaggtgctgggaaaactaaaagatacttacccgccatagttcgcgaagcaataaagcgaggactaagaacgttgatattagctccaacaagggtggtagctgctgagatggaagaagcgctgagaggcctgccaatccgatatcaaactcccgcaataaaggcagagcacactggacgagaaattgtagaccttatgtgtcatgcaacattcaccatgcggctcttaagtcctgttagggtaccaaactacaatctaatcatcatggacgaagcgcattttacggatccagcgtcgattgctgctcgagggtatatttcgacgagagttgaaatgggcgaagcagctggaattttcatgacagcgaccccacctgggtctcgggatccatttccacagtcaaatgcaccaatcatggatgaagaacgggaaattcccgaacgatcttggaactctggccacgaatgggtcacagacttcaagggtaaaacagtatggttcgtacctagtataaaagctggtaatgacatcgccgcatgtctgcgtaaaaatggtaagaaagttatacaactctcgagaaaaactttcgactcagaatatgtaaaaacaagagcaaatgactgggacttcgtggtaactacagatatctcggaaatgggggcgaattttaaggcagaaagagtaatcgacccgagacgctgtatgaagccagttattctaacccacggtgaagaaagagttattttagcaggcccaatgcccgtgacacacagtagcgcagcacaacgccgtggaagaatcgggcgaaatcctaaaaacgaaaatgaccagtatatatatatgggggaaccactagaaaacgatgaggattgtgcgcattggaaggaggcgaagatgctattagacaacataaacaccccagaagggatcattccatccatgtttgaacctgaaagagaaaaagtcgatgcggtagacggtgaatatagactaagaggcgaggcaagaaagacctttgttgatttaatgagacgcggagatctcccggtatggttagcttacaaagtagccgcagagggaataaactacgcagatagaaagtggtgcttcgacggcattaaaaataaccagatactagaggagaacgtggaggttgaaatatggactaaagaaggagaaaggaagaaacttaaaccccgttggctggatgcgcgcatttattcagaccctttggctctgaaagagtttaaagagttcgccgcaggtcgaaagagtcttactctgaacttgataacagaaatggggagacttccgacttttatgacgcagaaagccagaaatgccttagataatctagcagtgttacatacagctgaagccggtggaagggcgtacaatcacgccctatcggaattacccgagactctagagacactactattattgacattactagccacagtgacagggggtatattcctatttcttatgtctggaaaaggtataggaaaaatgacattgggaatgtgttgcataattaccgcttcagttcttctatggtacgcacaaatacagccccactggattgctgcgtcgattatactagagttcttcttaattgtcttattgatccccgaaccagaaaagcaaagaacacctcaagataaccaacttacttacgtagtaattgcaatattaaccgttgttgcagcgacaatggcaaatgagatgggtttcttagagaaaacgaagaaagatctggggctaggatccattaccacccaagagtcagaaagtaatatactcgatatagacttgaggcctgcaagcgcatggacattatatgctgtcgcaactacctttgtgacccctatgctaaggcactctatcgaaaattcttcagtaaatgtgtcactaactgctattgcaaatcaagccacagtgctaatgggactaggcaaaggatggcccctatcgaaaatggacataggagtgcccctactagcaattggatgttatagtcaagttaatccaatcacattaacggccgcactgctattactcgtagcacattacgctattatagggccgggactacaggcaaaggcaacacgtgaagctcaaaaacgagccgctgctggaattatgaagaacccaacagtcgatggaataactgtcatagacctagaacctataccatacgatcctaaatttgaaaaacaacttgggcaagtaatgctcttaatactttgtgtaacccaagtattaatgatgaggacaacatgggcactgtgtgaagccctaactctagcaaccggaccgattagtacactatgggaaggtaaccctggaaggttttggaatactacgattgctgtgagtatggcgaatatctttagaggatcctacctagcaggcgcaggacttttatttagtataatgaagaacactaccaataccagacgaggaacgggtaacattggggaaactttaggggaaaaatggaaaagtcgcctaaacgcactaggaaaaagtgaatttcagatttataaaaagtctggcatccaagaagtggaccgcactttagccaaggagggaatcaaaagaggagagactgatcatcatgcagtcagccggggctcggcaaaactaagatggttcgttgaaaggaatatggttacacctgaaggaaaagtagtggatctaggttgcgggagaggagggtggagctactactgcggtggcttgaaaaacgttagagaggttaagggactaacaaaaggaggtcctggacatgaagaaccaatacccatgtctacctacgggtggaatctggtgaggctccagagtggtgtggacgtgttctttactcctcccgaaaaatgtgacacactactgtgcgacattggggaaagctccccaaatcctacaatagaagccggacggacgctacgcgtactcaatcttgtagaaaattggttaaataataatacgcaattctgcatcaaagtacttaatccatacatgccttcagtaattgagaaaatggaaacattacaacgaaagtatggaggagcattggttagaaatccattaagccgaaattcaactcatgaaatgtattgggtatcaaatgcaactggcaatatcgtaagttcagttaacatgataagcagaatgctcataaataggtttacaatgaaacataaaaaggcaacctacgagcctgatgttgaccttggttcgggaaccagaaatattggaatagaaagtgagataccaaatttagatataattggtaaaagaatcgagaaaattaagcaagaacatgagaccagctggcactatgatcaggatcatccatataaaacttgggcttaccatggtagttatgaaacaaaacaaacaggttcagccagctctatggtcaacggggttgtaagattattaacgaagccatgggatgtagtgcccatggttactcaaatggcaatgactgacaccactccattcggacaacaacgagttttcaaggaaaaagtcgacacaaggacacaggaaccaaaagaaggtacaaagaaacttatgagaataactgccgagtggctctggaaggaattagggaagaagaaaactccgagaatgtgtactcgagaagaatttacaaggaaggtaagaagcaacgcggcattaggagctatctttactgacgagaataaatggaaaagtgcccgagaagctgttgaagacgggagattttgggaattggtcgaccgcgaacgtaacctccacctagaaggaaagtgtgaaacctgcgtttataatatgatggggaagagagagaaaaagctgggcgaatttggtaaagcaaaaggcagcagggcaatctggtatatgtggttaggagctcgattcctagagtttgaagcattaggatttctaaatgaagaccattggttttccagaggcaacagtttgagtggcgtcgaaggcgaagggcttcacagattaggatacatacttcgcgatgttggtaaaaaggaaggaggtgctatgtacgcagatgatacagcaggttgggacaccagaataaccttggaggacttaaagaatgaggagatggtcactaaccacatgaaaggagaacataagaaacttgcggaagcaatatttaaattaacttatcaaaacaaagtcgttagggttcagagaccaacaccccgaggaacggtaatggatattatatcaaggcgagaccaaaggggttctggccaagtgggaacgtatggccttaatacctttacaaacatggaagcccaactcataagacagatggaaggtgaaggtatatttaaatctatacaacacctaaccgcaacagaagaaattgcagctcagaactggttagctagagttggaagagaacgcttatcacgcatggctataagcggtgatgattgcgtagtaaagcctatcgatgatcggttcgccagtgcactaactgctctcaacgacatggggaaagtaagaaaagacatccagcaatgggaacccagtagaggttggaatgattggactcaagtcccattctgttcacatcatttccatgaattagttatgaaagatggccgtgtcctagtagtaccatgccgtaaccaggatgaactcattggtagagctagaatatctcaaggagctggttggtccctgaaagaaacagcttgcctgggaaagtcatacgcacaaatgtggactttaatgtactttcacaggagggatcttaggttagcagctaatgccatttgctctgctgtaccttctcactgggtaccgacttctagaacgacatggtccatacacgctaagcacgaatggatgacaacagaagacatgctggcggtgtggaatcgagtgtggatacaggagaatccatggatggaagataaaacccctgtagagtcttgggaagaagtcccgtacttaggaaaaagagaagatcaatggtgcggcagcttaattgggcttacttcgcgagctacatgggctaaaaatattcaaaccgccataaaccaagtcaggtctttgatagggaatgaggagtacacagactatatgccctcaatgaaacgattcagacgagaagaggaagaagcaggcgtgctttggtaa

SEQ ID NO: 22284 - RNA, 9876 nt, synthetic construct
  misc_feature 1..9876: note = derived and/or modified CDS sequence (opt6) from DENV-2__FJ024475__SS-prME
  source 1..9876: mol_type = other RNA
actgctggtgttatagtaatgttaattccaacggcgatggcctttcatttaactacaagaaacggggaaccgcatatgatagtaggccgacaagaaaaagggaaatctttattattcaaaaccgaagatggagtaaacatgtgtacattaatggcgatagatttaggcgaactatgtgaagacacaataacatataaatgtcctctactacgtcaaaatgaacctgaagacattgactgctggtgtaacagcacaagtacatgggttacgtacgggacttgcacaacaaccggagagcatcgtcgagagaaaagatctgtagcattagtaccacatgtaggcatgggattagagacaagaactgaaacctggatgtcgagcgagggagcttggaaacatgtacaaaggatagagacttggatacttcgtcatccaggctttaccattatggccgctatcttagcatatacaattggaactacacatttccagcgcgcactaatctttattctacttaccgcagttgcgcctagtatgactatgagatgtatcggaatttctaaccgagactttgtggaaggagtaagcggaggttcgtgggttgatatagtgcttgagcatggttcttgcgttacaactatggctaaaaataaaccaacacttgattttgaactgataaaaaccgaagcaaaacagccagccaccttaagaaaatattgtattgaagcaaaactcaccaatacaaccacagaatcaagatgtcccacacaaggcgaaccatctctgaatgaagaacaagacaaaaggtttatatgcaaacattcaatggttgatcggggttggggcaatgggtgtgggctgttcggaaaaggaggcatagtaacatgcgccatgttcacctgtaagaaaaacatggaagggaaagtggtgcaaccggaaaatttagagtacactattgtgatcacaccacatagcggggaagaacatgccgtaggtgatgatacaggaaaacacggtaaagaaatcaaaataactcctcaaagctcaatcacagaagctgagttaactgggtatggtactgttactatggaatgctcaccaagaactggattagattttaatgagatggtattactacaaatggaagataaagcatggttagttcaccgacaatggtttcttgatttacccttaccatggctgccaggagccgatacacaaggaagcaattggattcaaaaagaaacattagttacctttaaaaacccgcatgccaagaaacaagacgtcgtagtcctagggtctcaagaaggtgcaatgcatactgcactaacaggagcgactgaaatccaaatgagttcaggcaacttattatttactggacacctgaaatgtagattaagaatggataaattacaattaaaaggcatgtcatactctatgtgtacagggaaatttaaaatagtaaaagaaattgcagaaacacaacacggtactatagtaattagagtacagtatgaaggcgatggaagcccatgtaaaatcccatttgagattacggatttggaaaaacgacatgtcttaggtaggttgattacagtaaacccgatcgtcatagaaaaagacagcccagtcaacattgaagccgagccgcctttcggggattcatacatcataataggagtcgaaccgggccagttaaaactcaattggttcaagaaaggttcatcaattgggcaaatgttcgaaaccacaatgcgcggagcaaaaagaatggctattttgggcgataccgcctgggactttggcagcttaggaggagtttttacaagtatcggaaaggctttacatcaagtctttggcgcaatatatggagctgcgttcagtggtgtctcttggacaatgaaaattttgattggcgttgtaattacctggattggaatgaactcgagaagcacgtctttaagtgttagccttgtcctagtaggcgtcgtgactctgtatctgggtgctatggttcaagcggactcaggatgcgtagtgtcttggaaaaataaagaattgaaatgcggaagcgggatatttattaccgataacgtacacacttggaccgagcaatacaaattccaaccagaatctccgagcaaattggcatcggcaatccaaaaagcacacgaagaaggaatttgtggtatcagatcagtaacaaggctggaaaacttgatgtggaaacaaataacacctgaactaaaccacatattatctgagaacgaagtgaaattaactataatgacaggtgatacaaaaggtattatgcaagcaggtaaacggtatctacggccacagcccactgagcttaaatactcatggaaaacatggggaaaagcaaaaatgttatcgacagaaagtcacaatcaaacatttctaatagatggcccggaaacagcagaatgccctaacaccaatagagcgtggaactctttagaagtagaggactatgggtttggtgttttcacaactaacatatggttgaaactacgggaaaaacaagatgttttctgtgatagtaaactaatgtcagctgcaataaaggacaacagagctgtacatgctgatatgggttattggatagaaagcgcattgaatgacacctggaaaatggaaaaggcaagttttatagaagtaaaatcgtgccattggcctaagtcacataccttatggagcaatggtgtgttagagtcagaaatgattatacccaagaactttgcgggtcccgtcagccaacataactataggccaggctatcatacacaaacggcgggtccatggcacttaggcaagttagaaatggattttgatttctgcgagggcacaaccgttgttgtaacggaggattgcggcaatagaggcccaagccttcggacgaccacagcatcaggcaaacttataactgagtggtgttgtagatcatgcacactacctcctctgagatacagaggtgaagacgggtgttggtatggtatggaaataagacctttaaaggaaaaagaagaaaacttagtaaattccctggtcacagccggacatggtcaaatagataactttagcttaggtgtattgggcatggccttatttctagaagaaatgttacgaacacgggtaggaacgaaacatgctatcctcctagtggctgtttccttcgttacactaataactggaaacatgtcatttcgagacttaggacgagtgatggtaatggttggggcaactatgaccgacgacatcggaatgggagttacgtatcttgctctgcttgcagcatttaaggttagacccacgttcgcggccgggcttttacttaggaaattaacatcaaaagaacttatgatggcaacaatcggaattacccttttatctcaatctacaataccagagacaattttggaacttacggatgccttagctctgggaatgatggttctaaagattgtcagaaacatggaaaaatatcagttggcagtaactatcatggcaattagctgcgtcccgaacgccgttatcctgaggaatgcatggaaagtaagctgcacaatactagcagcagtaagtgtatcccctcttctacttacgtcatcccaacaaaaagccgactggatcccgctagcactcacgataaaaggtttaaaccctaccgcaattttcttaacaacgctgtcacgtacgtctaagaaacgatcatggccacttaacgaagccataatggctgtaggaatggtttcaatcctagcatcgagcttgctcaaaaatgatatccctatgacgggtccattagtcgcgggtggcctattaacagtttgttatgtcttaaccggacgaagcgcggatctagaattagagcgtgctgcagacgttaaatgggaagatcaagctgaaataagtggaagttctcctatactcagcatcactatttcggaggatggatctatgtcgatcaaaaatgaggaagaagaaacgacattgacaattctcatcagaacaggattgttagtaattagtggggtctttcctgtatctattcccataactgctgctgcgtggtacctatgggaagtcaagaaacaaagagctggtgttttatgggatgtaccatctcccccacccgtagggaaagctgaacttgaagacggagcctacaggattaaacagagaggcatactgggctattctcagataggtgctggtgtgtataaagaaggtacatttcatacgatgtggcatgtcacgagaggggcagtgcttatgcacagaggaaagcgcattgagccttcgtgggccgacgtcaagaaagaccttatatcctatgggggtggctggaaacttgagggagagtggaaagaaggagaggaagtgcaagtcttggcgttagagccaggaaagaacccaagagccgtccaaacgaaaccgggaattttcaaaacaaataccggtacgattggcgctgtatctcttgatttctcaccaggaacttctggatcacccattgtcgatcgcaaaggtaaagttgtgggactatatggaaatggagtcgttactagatccggcgcatatgtaagtgctatagctcagacagagaagagtattgaagacaaccctgagatcgaagacgacatatttaggaagaaacgtctaactattatggatttacacccgggtgctggtaagactaagcggtatttaccagcaatcgttagagaagcaataaaacgaggtttacgtaccttaatactagccccaactagagtggtcgcggccgagatggaagaggcattaagaggtctaccaatccgttatcaaactccggcgataaaagccgagcatacaggacgagagatcgttgatctaatgtgccatgccacgtttacgatgcggctgttgtcgcctgttagggtgccaaactataacctgataataatggatgaagcacattttaccgatccagcgtccattgcagctagaggatacataagtactagagttgaaatgggtgaggcagcgggaatatttatgactgctacaccaccaggttcaagggacccttttcctcaatctaacgcccccataatggacgaagaaagggagattcctgagcgttcttggaatagcggacacgaatgggtcacagattttaaaggtaaaacagtatggttcgtaccttcaattaaagccggtaacgacatagccgcatgtctcagaaagaatggtaaaaaggtaatacagctaagtagaaaaaccttcgactccgagtacgtaaagactagggccaatgattgggattttgtagtaacaacagacatttccgaaatgggtgccaatttcaaagctgaaagagtgatagacccacgacggtgtatgaaaccagttatactaacggacggagaggagagagtgatcttagccgggccaatgccagtaacacattcgtcggctgcacaacgaaggggtagaatagggaggaatccaaagaatgaaaatgaccagtatatatatatgggagagccccttgaaaatgacgaagactgtgcacattggaaagaagcaaaaatgctgctagacaatataaatactcctgaaggaattataccatctatgtttgagcccgaacgggaaaaagttgatgcagtagatggtgagtatagattaagaggggaagcaaggaagacgtttgtagacctaatgcgacgaggagatctcccagtatggttagcatataaagtagccgcggaaggcataaactacgccgacagaaaatggtgttttgacggtattaagaataaccaaatcctagaagaaaacgtcgaagtagaaatatggacaaaggagggcgaaaggaagaaacttaaaccgagatggttagacgcaagaatatactcagatccgttagccctaaaggaatttaaagagtttgccgcgggacgaaaaagtctcactcttaatttaataaccgaaatgggcagactgccaacattcatgacgcaaaaagcacgtaatgcgttagacaacctagctgttctacatacggcggaagcgggcggacgcgcgtacaaccacgcactgagcgaattaccagaaaccctagaaacactcttattacttaccttgcttgctaccgtaacaggaggtattttcctcttcttaatgtccggtaagggaattggaaaaatgacattaggtatgtgttgtatcataacagcctctgtacttctttggtatgctcaaattcagccacattggattgctgcttcaattatcctcgaatttttccttatagtattattaataccagaacccgaaaaacaacggacgccacaagacaaccaactaacctacgttgtgatagccatactgacagtcgtagcagcaaccatggcaaatgagatgggctttttggagaaaacgaagaaagacttaggcctaggaagcattacgactcaagagtcagaaagtaatatcttggacattgatttaagaccagcttctgcgtggacattatacgcagttgcaaccacattcgtaacacccatgctacgtcactcgattgaaaactcgtcagtaaatgtcagcttgactgcaatagcgaatcaagcgacggtattaatgggtttaggaaaaggttggccactaagcaaaatggacataggcgtcccactattagcaatcggatgttattctcaagtcaatcccatgaccctaactgcagctttattgcttttagttgcgcattatgcaataattggaccgggactccaggctaaagccacaagagaagcccaaaaacgggcggctgccggaatcatgaaaaatcctacagtagatgggataacggttatagatttagaaccgataccttacgatcccaagtttgaaaaacaattagggcaagtgatgctactcatactatgtgtcactcaggtactcatgatgcgcaccacatgggcactctgcgaagcccttaccctcgcaacgggacccatatccactttgtgggaagggaatccaggacgtttttggaacacaacaattgcagtatcaatggccaacatatttagaggatcatatttagctggcgctggactattgttttcaataatgaaaaatactactaacacccgaagagggacaggaaacattggcgagaccctaggtgaaaagtggaaaagtcgactaaatgctctaggaaaaagtgaatttcagatatacaagaaatcgggaatccaagaagttgacagaactttagcaaaagaaggtattaaacgaggcgaaacagaccatcatgcggtaagtagaggatccgccaaacttaggtggtttgtcgagagaaacatggtgacacctgaaggaaaggtagtcgatctgggatgcggacgtggaggttggagttactactgtggtggtttgaagaatgttagggaggttaaaggactaacaaaaggagggcctggacacgaagaaccgataccaatgtccacctatggatggaacttagtccggctacagtcgggtgtagacgtgttctttacgccacctgaaaaatgtgataccttattatgcgacataggagaaagttcaccaaacccaacaatagaagcaggcaggacgctaagggtactcaatctcgtagagaactggctaaataataacacgcaattttgcataaaagtcttgaacccgtatatgccgagcgtgattgagaaaatggaaactttacagagaaaatacgggggagcactcgttcgaaaccccttatctcggaacagtacccatgaaatgtactgggttagcaacgccacaggaaacatcgtgagttctgtcaacatgatctcaagaatgcttattaacagattcaccatgaaacataagaaagctacatacgaaccggatgtagacttgggatcaggaactcgaaatatcggaatagagagtgaaattccaaatctagacataattggtaaaagaattgagaaaatcaaacaagagcatgaaacttcatggcattacgatcaagaccacccatacaaaacctgggcttatcatggctcctatgaaacaaagcagaccggcagtgcaagtagcatggtcaatggtgtagtgagattgctaacaaaaccttgggatgtagtccctatggttacccagatggctatgacagacactacccctttcggccagcaaagagtctttaaggaaaaagttgacacgcgtacacaggaaccgaaggagggcactaagaaactaatgcgaattacagcagaatggctttggaaagaattaggcaagaagaaaacaccacgaatgtgtacccgagaggagttcacaagaaaagtgagaagcaacgcagccttgggcgcaatattcactgatgagaataaatggaaatcagcacgggaagcggtagaagacggtagattttgggaactcgtcgatcgagaaagaaacttacatttagaaggtaaatgtgaaacttgtgtctataacatgatgggcaaacgggagaagaaattaggcgaatttggaaaagcaaaaggaagcagggccatatggtatatgtggttaggagcgagatttctggagttcgaggcactaggattcctaaatgaagatcactggttctcgagaggtaatagcttatcaggagtagaaggagaaggattacatagattaggttatattctaagggacgtgggtaagaaagaaggaggggctatgtatgccgatgacaccgcgggttgggataccaggattactttggaagatcttaagaatgaggaaatggttaccaatcacatgaaaggcgaacataagaaattagcagaagccatttttaaactcacgtatcaaaataaagttgtacgagtccaaagaccgactccacggggaacagttatggatatcattagcaggagagaccagaggggatctggtcaagtaggtacctatggcctaaacacatttacgaacatggaagcacaacttattagacaaatggagggggagggaatatttaaaagtattcaacatctcactgcaactgaagaaatagctgcacaaaattggctggctagagttggccgagagaggttatccagaatggcgatttcaggtgatgactgtgtagttaagccaattgatgatcgatttgcaagcgccctgacagccctaaacgatatgggtaaagtaagaaaagatattcaacaatgggagccttcacgcggatggaacgactggactcaagtacctttttgtagtcatcatttccatgaactggtaatgaaagacggaagagtcttagtggtcccgtgtagaaatcaggatgaattaattgggagggcacggatttctcagggggccggctggagcttaaaagagacggcttgtctgggaaaaagctatgcccagatgtggacattaatgtattttcaccgaagagatttacgactggctgccaatgcgatatgttcagcagtaccatctcactgggttcctacaagtagaacgacctggagtatacacgctaaacatgagtggatgactacagaagatatgttagctgtctggaatcgcgtttggatccaggaaaacccatggatggaggacaaaactcctgtagagtcatgggaagaagttccatacttaggaaaaagagaagatcagtggtgtggttctctcatcggcctaacatcccgcgccacgtgggcgaaaaatattcaaactgccataaaccaagtccggtcactaataggaaatgaagagtacactgattacatgccatcaatgaaaaggttccgaagggaagaagaagaggcaggggttctatggtag

SEQ ID NO: 22285 - RNA, 9867 nt, synthetic construct
  misc_feature 1..9867: note = derived and/or modified CDS sequence (opt6) from DENV-2__FJ182012__SS-prME
  source 1..9867: mol_type = other RNA
acagcgggagtaatagttatgctaattcctacagcaatggcattccacctgacaactcgaaatggagaaccacatatgatcgtaggacgacaagaaaaaggaaaatcattactatttaaaaccgaagatggtgtaaatatgtgcaccttaatggcaattgacctaggtgaactatgcgaagataccatcacctataaatgtcctctattaagacaaaacgaacctgaagatattgattgttggtgcaactcaacttcaacatgggtaacgtacggtacctgcacaacaactggggaacatagacgtgaaaaacggagtgtagcattagtcccacatgtgggtatgggattagaaacaaggacggaaacatggatgagttcggaaggcgcctggaaacatgtacaaagaatcgaaacttggatattaagacatccggggttcacaataatggccgcaatactggcatatactataggcacaacccatttccaacgagcgttaatctttatactattaaccgcagtagccccctctatgactatgagatgtatagggatttcaaatcgagactttgtcgaaggtgttagcggtggatcctgggtggacatcgtattagaacacggctcatgtgttaccactatggccaaaaataaaccgacattagatttcgaactaatcaaaaccgaagccaaacaaccagcgacgttgaggaaatactgcatcgaagcaaaattaacaaataccactaccgaaagccggtgtcctacgcaaggcgaaccaagtctaaacgaggaacaagacaaaaggttcatatgcaaacacagcatggtagatagaggatggggaaatggatgtggattgtttggaaaagggggaatcgtaacgtgcgctatgtttacatgcaagaaaaacatggaaggaaaagtggtacaaccggaaaatcttgaatacactatcgtaattaccccacattcgggcgaagaacatgcggtaggaaatgacaacggcaaagaaataaaaataacaccacaatcctcaattacggaagctgaactaacaggatatgggactgtaacaatggagtgttcaccgcgcacgggtctagatttcaacgaaatggtactgttacaaatggaagataaagcgtggttagtccatcgtcaatggttcctagatcttcccctaccttggcttccaggtgccgatactcaaggtagtaactggattcagaaagaaacgcttgtcacatttaaaaatccacacgccaagaaacaggacgttgtagtattaggttctcaggaaggtgccatgcacacagctcttaccggcgcgacagagatacaaatgagttcaggcaatttgttgtttactggtcacttgaaatgtaggcttcgtatggataaactacaactaaaaggaatgtcctactcaatgtgtacaggtaaattcaaaatagtaaaagaaatagctgaaacccaacatgggacaatagttattcgagttcaatatgaaggagatggatccccttgcaaaatcccattcgagattacggacctggagaaacgacatgtattaggtcgattaatcaccgtgaatccaatcgtaatagaaaaagacagtccggtgaacatcgaagcagagcccccattcggcgattcttacattataataggcgtagaacccgggcagctaaaactaaactggtttaagaaagggagctcgatcggacaaatgtttgaaaccactatgcgaggagctaaacgtatggccattttaggcgataccgcgtgggattttggttcactaggaggtgtctttacatctattggcaaagcactacatcaagtatttggggcaatatacggtgcggcattttccggagttagctggacaatgaaaatactaattggagtcgttatcacatggatagggatgaactctcgatccacatcgctatctgtatcgttagtacttgttggcgtagtaacattgtaccttggagccatggttcaggccgactccggttgcgttgtgagctggaaaaataaagagcttaaatgcggttctggtatttttataacggacaatgttcacacgtggacagaacaatataaatttcaacccgaaagtccttcaaaattagcgtcagctattcaaaaagcgcacgaagaagggatatgcgggattagatcggtcactcgacttgagaatttaatgtggaaacagataactcccgaattgaatcatatcttatcagaaaatgaagttaaactaacaattatgacgggagatacgaaaggaataatgcaagccggaaaacgttacctacgaccgcaacctaccgagctcaaatattcatggaaaacttggggaaaagcaaaaatgttgtcaacggaaagtcacaatcaaacattcctaatagacggcccagaaacagccgaatgccctaatacaaacagagcatggaacagtctggaagtagaagactacggattcggggtattcacaactaacatatggctaaaacttcgtgagaaacaagatgttttctgtgattctaaattaatgagtgcagctattaaagataatcgagccgttcatgcagatatgggttattggattgagtcggcgttgaatgacacatggaaaatggaaaaagccagtttcatagaagtcaaatcttgccattggcccaaatcacataccctatggtcaaatggtgttctagaatcggaaatgataattcctaagaatttcgccggaccagtttcacaacataattataggccagggtatcatactcagacagccggtccttggcacttaggaaaacttgagatggattttgatttttgcgagggaaccacggtggtagtaacagaagactgcgggaatcgagggccatcattacgcacaaccacagcaagtggtaaactaataaccgaatggtgttgtcgtagttgtactttacctccgctccgatacaggggagaagacggatgctggtatggcatggaaataagaccgttaaaagagaaggaggaaaacttagttaattcgctagtaacagcgggacatggacaaatagataattttagtttgggagtcttaggtatggcattattcctagaagaaatgttacgtacaagagtcggaacgaaacatgccatactactcgtagcagtttcattcgtaaccctaataacaggaaacatgtcattcagggacctaggcagagtaatggtcatggttggcgcaaccatgacggatgacatagggatgggggttacttatttggctctcttagccgctttcaaggtcagacctactttcgccgctggattattgctcagaaaactgacatcaaaagaactcatgatggcgacaatagggatcacattgttaagtcagagtaccattccagaaacaatattagagctaactgatgctctggcattaggaatgatggtattgaaaatagttagaaatatggaaaaataccaactagcagttaccatcatggccatcagttgcgtacccaatgctgttatacttagaaatgcctggaaagtttcgtgcacaatcctagctgctgtcagcgtaagtcctttgttgctgacatcatctcaacaaaaagcagattggattccactcgccctcaccattaaaggactaaatcctacagccatatttttaacaactctaagtagaacatcaaagaagcggagttggcccttgaatgaagccataatggcagttggtatggtcagcattctagcgtcatcactacttaaaaatgatatccctatgacaggtccacttgtcgcgggaggtcttctaacagtatgctatgtcctcacaggacgttccgcagacctcgaattagaaagggcggccgacgttaaatgggaagatcaagctgagataagtggatcaagtccgatcctaagtataaccatttcggaagatggatcgatgtcaattaaaaatgaagaagaagaacaaatcctaacaatcttgatacgaacagggctgctagttatttcgggagtatttccagtctcaatacctattaccgcggccgcgtggtacttgtgggaggtcaagaagcaaagagctggtgtattgtgggatgtaccaagtcccccgccagttggaaaggcagagctggaagacggcgcatataggattaagcaaagaggcatcctcgggtatagtcaaattggcgcaggcgtatataaagagggtacatttcatacaatgtggcatgtaacaagaggtgcagtgttaatgcatagaggcaagagaattgagccaagttgggcagatgtcaagaaagacttaataagttatggaggcggctggaagctggaaggagaatggaaagagggcgaagaagttcaagtactcgcacttgaacctggcaaaaacccgagggccgttcaaacaaaacccggaattttcaaaaccaatacggggactataggtgcagtctcactggatttttcaccggggacaagtggaagtccaattgtagatagaaagggcaaagtagtcggattgtatggcaatggagtagtaactagaagtggcgcatatgtaagtgccatagcgcagaccgaaaaatctatagaagataatccagagatcgaagacgacatatttagaaagaaaaggttaacaatcatggatctacatcctggtgcaggcaaaacaaaaagatatctacctgcaatagtgagagaagctattaaacggggtttacgtacattgatactcgcaccaacgcgcgtagtcgccgctgaaatggaagaagcactaagagggctcccaataagataccaaacaccggcaatcaaagccgaacatacaggcagggaaattgtagatttaatgtgtcacgcgacttttactatgagacttctgtcacccgtacgagtacccaattacaatctaataataatggatgaggcacactttacggacccagcgtcaatagcggccaggggatatatttcaacccgtgtcgagatgggggaagccgcaggcatatttatgactgcgactcctcctgggtcacgtgatccctttcctcaaagcaatgcgccaataatggatgaggagagagaaatacccgaaaggtcatggaatagcggtcacgagtgggtaactgacttcaaaggaaaaacagtatggttcgtgccgtcaataaaagccgggaatgatatagcggcctgtttaaggaaaaatggcaagaaagtaattcaactgtcaagaaaaactttcgactctgaatacgttaaaaccagagctaacgattgggattttgttgtcactacggatatatcagagatgggcgctaacttcaaagccgaaagagtcatagatccgcgaagatgcatgaaaccagtcattttgactcatggtgaagagagagttatcttagctggaccaatgcccgtaactcactcttcggcggctcaacgaaggggacgaatcggaaggaaccccaaaaatgaaaacgaccaatatatatacatgggagagcctttagagaacgatgaagattgtgcacactggaaagaagcgaagatgctactagataatattaatacacccgaaggcattataccatcaatgtttgagccagagcgagaaaaggtagacgcagtagacggagaatatcgtctacgaggagaagcccgaaaaacttttgtggatcttatgcgccgaggcgacctgcctgtatggttagcatacaaagttgctgctgagggcataaactacgcagatcgaaagtggtgttttgatggtataaagaacaaccaaatactggaggaaaacgtagaagttgaaatctggactaaggagggggaaagaaagaaactaaagccaagatggctagacgccaggatatacagtgatcctctcgcattgaaggagttcaaagagtttgcagcaggaagaaagtctttaactctgaatctaattactgagatggggcgattgcctacattcatgactcagaaggctagaaacgcgctagataatttagcagtattacataccgccgaggctggaggcagagcatacaatcacgccctctccgaattgcctgaaacactagaaactttactgttattaaccttgctagcaaccgtcacaggaggaatctttctatttttaatgtcagggaagggtattggtaaaatgactttagggatgtgctgtattatcacagcatcagtactactttggtacgctcaaattcaaccacattggatagctgcaagtataatattagagttcttcctaattgttttgttaatcccagaaccagagaaacaacgcacaccccaagataatcaattgacgtatgtcgttatagctatcttaacagtggttgccgcgacaatggcgaatgaaatgggcttcctcgagaaaaccaagaaagaccttgggttaggctcaataacaacacaggaaagtgagtctaacattttggatatagacttgcgacctgctagtgcctggactctatatgctgtagcgacaacgttcgtaacgcccatgctcagacatagcatcgaaaatagttctgtaaatgtgtcattgacagcgattgccaatcaagcaactgttttaatggggttgggaaaaggctggccactctcaaaaatggacataggagtacctctattagcgattggatgctattcacaagtaaatcccataactctcactgctgcactactcagtctagttgcacactatgctattataggcccgggccttcaagcgaaggctacgagagaagcccagaaaagggcagcagcaggaatcatgaaaaacccgacggtcgacgggattactgttatcgatttagaaccaattccgtatgatccaaaatttgaaaaacagttaggccaggtcatgttattaattttatgcgtcacacaggtgttaatgatgcgaacaacttgggccttatgtgaggccctcacgctagccactggtcctataagtactttgtgggaaggaaatccaggcaggttctggaacaccactattgcagtctcaatggcaaacattttccgcggcagttatttagcaggggcagggctattgttctcgatcatgaaaaacaccacaaatactagacggggaaccggaaacattggtgagaccttaggagaaaaatggaaatccaggcttaatgcattggggaagtcagagttccaaatatacaagaaaagtggtattcaagaagtagatcgaaccctcgccaaggaaggcatcaaacgaggggaaaccgatcatcacgccgtgtcaagaggcagcgcaaaattaagatggtttgtcgaaagaaatatggttacaccagaaggaaaagtcgtagatctcggatgtggcagaggaggatggagctactactgcggaggactcaaaaatgttagagaagtaaaaggtttgaccaaaggaggtcctggacacgaagaaccaataccgatgagtacatatgggtggaatttagtaagattacaaagcggggtagatgtattctttactcctccggaaaagtgtgatactttattgtgtgacatcggtgagagttcccccaatcccacaatagaagctgggcggaccctaagagtgctaaatcttgtggaaaactggcttaataacaatactcaattctgcatcaaagtattaaatccttatatgccgtcggtaatagagaaaatggaaactcttcaacgcaaatacggaggtgcccttgtacgaaatccactatcacgcaattcaactcacgaaatgtactgggttagcaatgctactggaaacattgtctcatcagtcaatatgataagtcgtatgctaataaatcgctttaccatgaaacataagaaagcaacctacgagccggatgtagatctaggttcaggtactaggaacattggaatagagtcggaaattccaaatctggatattattggaaaacgaatcgagaaaattaaacaagaacacgaaacatcctggcattacgatcaagaccacccatataagacttgggcatatcacggatcttatgagacgaagcagactggatcagcctcctccatggtcaatggagtagtcagattgctaactaaaccctgggatgtagtaccaatggtcacacaaatggctatgacagataccacaccatttggtcagcagagagtattcaaagagaaagtcgacactagaactcaagagccaaaagaaggtaccaagaaattgatgagaattacagcggaatggttatggaaagaattaggcaagaagaaaactcctagaatgtgtacaagagaggaatttacaagaaaagtaagaagtaatgcagcattaggagccatatttacagatgagaacaaatggaagagtgcccgtgaagcggtggaggatggaagattttgggagcttgtagacagggagagaaacttgcacttagaaggaaaatgtgaaacatgcgtatacaacatgatggggaaaagagagaagaaattaggggagttcggaaaagccaaaggatcgcgagctatatggtatatgtggcttggagcacgtttcctagagtttgaagcattaggatttttgaatgaagatcattggtttagtagaggtaatagtttgtcgggagtagaaggtgaaggattacacagactaggttatattttaagagatgtaggaaagaaagaagggggagctatgtatgcggacgacactgctggatgggatacaaggattactcttgaagacctcaaaaacgaagagatggtaacaaaccacatgaaaggtgagcataagaaattggcagaagcgatctttaaacttacataccaaaataaagtcgtcagagttcaaagacctaccccgcggggaactgtcatggacataatctcgcgaagagatcagcggggtagcggtcaggttgggacttacggattaaatacctttacaaatatggaagcccaattgattagacaaatggaaggagaaggaatattcaaatcaattcaacatctcaccgcaacagaagagatcgcagcccaaaactggctcgccagagtcggtagagaaagattatctagaatggctatatctggtgacgactgcgttgttaaaccgatagacgatcgattcgcatcggctttaaccgctctcaacgacatgggtaaggtgagaaaagatatccaacaatgggagccatccagaggatggaatgactggactcaggtccccttctgtagtcaccattttcacgaactggtaatgaaagacggtagagtattggtagtaccatgcagaaaccaagatgaattaattggcagagctagaataagtcaaggggcagggtggtcacttaaagaaacggcttgtttaggcaaatcatatgcacaaatgtggacacttatgtatttccatagaagagacctaaggttagctgcgaatgcgatatgttccgcggtaccgagccactgggtaccaacgtctaggacaacttggtctattcatgcgaaacatgagtggatgacaacggaagatatgttggcagtttggaatcgcgtgtggatacaagaaaatccatggatggaggataagaccccggtggaatcctgggaagaagttccataccttggaaagagagaagatcaatggtgcgggagtttaatcggtttaactagcagagctacatgggcaaagaacatacaaactgcaattaatcaagtaaggtcattaataggaaatgaagagtatacagattatatgcccagcatgaagcgcttccgaagggaagaagaagaagcaggcgtcctgtggtaa

SEQ ID NO: 22286 - RNA, 9876 nt, synthetic construct
  misc_feature 1..9876: note = derived and/or modified CDS sequence (opt6) from DENV-2__EU854293__SS-prME
  source 1..9876: mol_type = other RNA
acagcaggaatgataatcatgctgataccgacagtaatggcgtttcatctaacgacaagaaatggtgaaccacacatgatagtttcgaggcaagaaaaaggcaaatcgttattgtttaaaacaggagacggtgtaaacatgtgcaccctgatggcgatggacctaggggaactatgcgaagatacaataacatataaatgccctctactacgccaaaatgaaccggaagacatagattgttggtgtaactccacatcaacctgggtcacgtacggaacatgcacaacaacgggtgaacatagaagagaaaaacgcagtgtagcgttggtgcctcacgtaggtatgggactagaaacacgtacagaaacatggatgtccagtgaaggagcgtggaaacacgcacagcgtattgaaacttggatattacgacatccaggattcactatcatggcagcgattcttgcatacaccattggcacaacccactttcaaagagccttaatctttatcctattaacagccgtagctccatcgatgaccatgagatgtataggtatttcaaaccgagatttcgtggaaggtgtcagtggtggctcttgggtagacatcgttttagaacatggttcctgtgtcacaacaatggccaaaaataaaccgacgttagactttgaacttataaaaactgaagcaaaacaatcagctaccctacgaaaatactgcatcgaggcaaaacttactaatactacaacggaatctcgatgtcctactcaaggcgagccatcactgaacgaagaacaagataaaagatttgtctgcaaacactccatggtagataggggctggggaaacggttgcggtctttttggaaaaggaggtatcgtaacctgcgctatgtttacatgcaagaaaaatatgaaaggcaaagttgtacagccagaaaatcttgaatatacgattgtaataacaccacattcaggcgaagaacatgctgtcggaaacgatacagggaaacatggaaaagaaattaaaataactccacagagtagcattactgaagctgaactaacaggctatggtacagtaacaatggagtgttccccacgtactgggctagacttcaacgaaatggtattacttcaaatggaaaacaaagcgtggttagtccacaggcaatggtttttagatctaccactcccttggctacctggtgcagacacacaaggttcgaactggatccaaaaagaaaccttagtgaccttcaaaaatccacacgcaaagaaacaagatgtggttgtactaggctctcaagaaggtgcgatgcacacagccctaacaggtgcgaccgagatacaaatgtcaagtggtaatttactatttactggtcatctaaaatgtagattaagaatggataaattgcagttgaaagggatgagttattccatgtgtactgggaaattcaaagtcgtcaaggaaattgcagagacacaacatggaactatagttatcagagttcaatatgaaggagatggtagcccatgcaaaataccatttgaaataatggacctcgagaaaaggcatgtcttaggtaggttaattactgtgaatcctattgtcactgaaaaggattcacctgttaacattgaggcagagcccccatttggcgattcgtatatcataattggagtagaacctgggcaacttaagttaaattggttcaagaagggctcaagcatcggacaaatgttcgagacaacaatgcggggtgcaaaacgcatggcaattctaggagatacagcctgggattttggaagtctagggggagttttcaccagcattggtaaagcacttcaccaagtattcggagccatctatggtgcagcatttagcggagtaagttggacgatgaaaatactaataggggttataattacatggatcggcatgaatagcaggagtacatcattatctgtctctttagtcctcgtgggagttgtaacgctatacctcggggtcatggttcaagccgatagtggatgtgtcgtaagctggaaaaataaggaactcaaatgtggttctggtatatttatcactgacaacgtacatacatggacggagcagtacaaatttcaaccagaaagcccgagcaaacttgcctccgcaatacaaaaagctcacgaagaagggatctgtggaatccgtagtgtaacccgactagagaaccttatgtggaaacagattacaccagaactaaatcatatattgtctgaaaacgaagtaaaactaactattatgaccggggatataaaagggattatgcaagctggtaagcgttctctacgacctcaacccaccgaactcaaatactcctggaaaacatggggaaaagcaaaaatgctttcaacggaatcccataaccagacatttttgattgacggtccagaaacggcggagtgccccaatactaatcgcgcctggaactcgcttgaagttgaagattatggattcggagtatttactacgaacatctggttaaaattaagagaaaaacaagacgtcttctgtgatagtaagttgatgagcgcagctataaaagataatagagcagtgcacgctgatatgggttactggatcgaatctgctttgaatgatacatggaagatagaaaaggcctccttcatagaggttaaatcgtgtcattggcctaaatcgcatacattatggtccaatgaagtgctggagagtgaaatgataattccgaaaaattttgcagggccggtttcacaacataattatcgacccggttatcatacacaaacagcgggaccctggcatcttggcaagttggaaatggattttgacttctgtgagggaacaacagtagtcgtgacggaggattgcggtaatcgtggtccctcacttcgcacaactacagcgtcgggaaagctaattaccgagtggtgttgtagatcatgcacactcccgccgctaagatatagaggcgaagatggatgttggtatggaatggaaattcgcccactaaaagagaaggaggaaaatcttgttaatagcttagtaacagctggacatggccaaatcgacaattttagtcttggtgtcctaggaatggctctgttccttgaagagatgctacgaactagagtaggtaccaaacacgctatcctattggtagcagtctcgttcgtcacgctcatcaccggaaacatgtcattccgagacctaggacgggttatggttatggtaggagcaaccatgactgacgatataggaatgggagtaacatatctagccctgctagctgctttcaaagtacgcccaacattcgcggcagggttactccttcgtaaattaacttctaaggaattaatgatgacaactataggtatagttcttctatcccaaagcaccatacctgaaaccatattagaattaacggatgctctcgcactaggtatgatggtgttaaaaatggtaagaaaaatggagaaatatcaactagcagtgacaattatggctattctatgtgtaccgaatgcagtcatcctgcaaaatgcgtggaaagtcagttgcacgatacttgcagtggtaagcgtttcccctctattcttaacttcatcacaacaaaaagctgattggatcccgttggcactaacaataaaaggtttaaatcccactgcaatttttctaaccacattatcccgtacaaataagaaaagatcatggccattaaatgaagcaataatggccgtaggcatggtaagcatcttagcaagcagtctgctcaaaaatgatataccaatgaccgggccgctggttgccggaggactgctaacagtttgctatgtcttaacgggaagatctgcagatttagaacttgaacgcgctgcggacgtaaaatgggaagatcaagcagaaattagcggtagttcgccgatattatcaatcacaattagtgaggacgggagtatgagtatcaaaaatgaggaagaagaacaaatacttacaattcttataaggacaggattactcgtaatatcagggttatttcccgtaagcatgccaatcaccgcagctgcgtggtacctatgggaagtcaagaaacaaagagcgggtgtactttgggatgtacctagtccgcccccggtaggtaaggctgaattagaagatggagcctataggataaagcagaaggggattttgggatattcgcaaataggggcgggggtatacaaagaagggacttttcacacgatgtggcatgtaacccgtggcgcagttttaatgcataaagggaagagaatagaacccagctgggcagatgtcaagaaagacctaataagttacggaggaggatggaagctagaaggagaatggaaggagggtgaggaagtccaagtcctcgctctcgaacccggtaaaaacccacgagctgtccagactaaaccaggattgtttaaaaccaacgctggaacgataggtgcagtttctctagacttctctcccggcacatcaggaagtccgattattgacaagaaagggaaagtggtaggtctctacggaaacggtgttgttacacgtagcggagcttacgtttctgctatagcacagacggaaaaatccatcgaagataaccccgaaatagaagacgacatatttaggaaacgcaaattaacaatcatggatttacaccctggagcaggtaagactaaaagatacctacctgctatagtaagagaagcgataaaaaggggactacgtacactaatcttagctccaactagggtagtagccgctgaaatggaggaggctctaagggggctacccataagatatcaaacccctgcaataagagccgaacataccggccgagagatagtcgatttaatgtgtcacgcaacttttacaatgaggctactctcaccggtccgtgtcccgaattataacctaatcattatggatgaggctcattttacagatccggcaagtatagcggcacgaggttacatcagcacacgtgtagaaatgggcgaagcggctggtattttcatgactgcaacgccgcccggcagtagggacccatttccccagagtaatgcacctataatggatgaagagagagaaattcctgagcgatcatggtcatccggacatgagtgggttacagattttaaggggaaaactgtatggttcgtaccatcaattaaagccggtaatgacattgctgcatgtcttcggaagaatgggaagaaagtcatacaactatcaagaaaaacctttgactccgaatacgtcaaaactagaacaaatgattgggactttgtagtaactacggatatttctgaaatgggagcaaactttaaagccgaaagagtcatagacccacgaagatgcatgaaaccagttatacttacggatggtgaagaacgagtgatattggccgggcctatgccagtcacccatagtagcgcagcgcaaaggagaggtcggattgggagaaacccaaagaatgaaaacgatcaatacatttacatgggagaaccattagaaaacgacgaggattgcgcccattggaaggaagcaaaaatgctccttgataacataaatactcccgagggcattattccttctatgtttgaaccagaacgtgaaaaagtagacgctatagatggagagtaccgcttgcgcggagaagcgagaaagacgtttgtagatcttatgagaagaggagaccttcctgtctggctagcatatagggtagctgcagaaggtatcaattatgcagatagacggtggtgttttgatggaattaaaaacaatcaaatccttgaagaaaatgtagaagtagagatctggacaaaagagggagaacgaaagaaattaaaacccaggtggttagatgctcgaatatatagtgacccattggctctgaaagagttcaaagagttcgctgcgggccgtaagtctcttacactaaatctcataacagaaatgggcagactaccaacttttatgacgcagaaagccagagatgccttagacaatttggccgtactacataccgcggaggcaggaggacgcgcctataatcacgcactatcggaattacctgagactcttgaaacgttactattactgacactacttgccacagttaccgggggtatcttcctttttcttatgtcaggacgaggtatcgggaaaatgaccttgggcatgtgctgtattatcacggcttcaatcttattgtggtatgctcaaatccaaccacattggatagcagctagcataatactagagttctttttgatagtattgttgatcccagaaccggaaaaacagagaacgcctcaagacaaccaacttacttatgttgtaattgcgatactcactgtagttgcagccaccatggctaatgaaatgggatttttagagaaaacgaagaaagacttaggcctaggatcaataacaacacaacaaccagaatcgaacatactagacatcgacctaagaccagcctccgcatggactctatacgcggtagccactacgtttgtaaccccaatgcttcgacattcaatagaaaactcatcagtcaatgtcagcttaacggccatagcaaaccaggcgacggtattgatgggactaggaaaaggatggccattatccaagatggatataggagtaccattattagcaattggatgttatagtcaagttaatcccatcaccttaacagcagcacttttcttactggtggcccactacgccattattggaccaggattacaggcaaaagcaactagggaagcccagaaaagagcagctgcaggcataatgaaaaatcctaccgttgatggcattacagtaatagacttggaccctattccgtatgatccgaaatttgaaaagcagttagggcaagtaatgctattagtactatgcgtaacgcaagtgctaatgatgaggacaacgtgggcactatgcgaagctctgacgcttgcgacaggaccaataagcacactatgggaaggcaacccaggacgtttctggaataccactatagcagtctccatggccaacatttttaggggatcatacctagctggggctgggttattattctccatcatgaaaaatacaaccaatacaagacgggggaccgggaatataggagaaactctgggcgaaaagtggaaatcgcgattaaatgctttgggaaaatccgaatttcaaatttacaagaaatctggtattcaagaagtcgatagaacgttagcaaaagaaggaataaaaagaggtgaaaccgaccaccatgccgtctcaagaggatccgctaaactcagatggtttgtcgagcgtaatatggtaaccccagaaggtaaagtagttgatttaggttgtggtagaggcggctggtcatactactgcggaggactaaagaatgtacgtgaagtaaaaggattaaccaaaggaggacccgggcacgaagaaccgataccaatgtcgacatacgggtggaatttggtacgtcttcaaagcggagtagatgtgttctttacccctccagagaaatgcgacaccctactatgcgatattggagagtccagtcctaacccaacagttgaggcaggaagaacactaagagtactaaacttggtagagaactggctaaataacaacacgcagttctgcattaaggtattaaacccttatatgccttctgtcatagaaaagatggaggctctacagagaaaatatggaggggctctcgtaagaaatccactatcacgtaatagcacacatgaaatgtactgggtttccaacgccagcggcaacatagtttcatcagtcaacatgataagcaggatgttaataaatagatttacaatgagacacaagaaagcgacgtacgaaccggacgttgatctaggatcaggaacaagaaacatcggaatagaatcggagatacccaatttagacatcattggtaaaagaatagagaaaattaaacaggaacatgagacatcatggcattatgatcaagaccatccctataaaacatgggcttatcatggctcatacgaaactaagcaaacaggtagtgcatcatctatggtaaacggagtagtcaggttactaactaaaccgtgggatgtagtacccatggtaacccagatggcaatgacagacacaacaccgtttggacagcagagggtatttaaggagaaagttgatacaagaacacaagaaccaaaagagggtactaagaaattaatgaagataactgcagaatggctatggaaagaactaggcaagaagaaaacaccccgaatgtgcactagagaagagttcacaagaaaagtacgaagtaatgccgcgctaggagcgatctttactgatgagaacaaatggaaaagtgcaagagaagcagtagaagatagcagattctgggaactggtagataaagaacgaaatttgcaccttgaaggcaaatgcgaaacatgcgtatataatatgatgggcaaaagagagaagaaactaggagaatttgggaaagcaaaaggatcaagagcgatatggtatatgtggttgggagctaggtttttagagttcgaagctctcgggttcctcaacgaggatcactggttttccagagaaaactcgctaagcggagtagagggagaggggttgcataagttaggttacatcttaagggacgtatcaaagaaagagggcggtgcaatgtacgcagatgatacagccggttgggacactagaataacgttagaggacttgaaaaatgaggaaatggtaacgaaccatatggaaggggaacataagaaattagccgaagcaatcttcaaattaacgtatcagaataaagtagttcgggtccaaagacccacccctcgaggtacagtaatggatataattagcaggcgagatcaaagaggttcaggccaggttggaacctatggattaaatacattcactaacatggaagcgcagttgatcaggcaaatggaaggagaaggtgtgttcaaaagtattcagcatttaaccgtcacagaagagatcgccgtccagaactggctcgcccgagtaggtcgagagagattatctcgcatggcaatcagtggggacgattgcgttgtaaaaccgctggacgatagatttgcatcagcgttaactgcattaaatgacatgggaaaagtaagaaaagacatacaacaatgggagcctagtagaggttggaatgactggacccaagtccccttctgttcacatcattttcacgaattgatcatgaaagatggaagagtattagtagttccttgccgaaaccaagacgaacttatagggcgggcacgaatcagccaaggcgcgggttggtcgttacgcgaaactgcttgtctaggcaaatcttacgctcaaatgtggtcattaatgtactttcacagaagagatttgagacttgctgcgaatgcaatttgctcagcggtcccaagccattgggttcccacaagtaggaccacatggtcaatccatgcgaagcacgaatggatgaccacagaagatatgttaacagtttggaatcgcgtctggatacaagaaaatccttggatggaagacaaaacccccgtcgagagttgggaagaaattccgtatctaggcaaacgggaggatcaatggtgtggttctctaataggcttgacttcgagggcaacctgggcgaagaacatacagacagcaataaatcaggttcgtagcctaataggaaatgaagagtatactgattatatgccaagtatgaaaagatttaggcgagaagaagaagaagcaggagttctatggtga

SEQ ID NO: 22287 - RNA, 9876 nt, synthetic construct
  misc_feature 1..9876: note = derived and/or modified CDS sequence (opt6) from DENV-2__EU854294__SS-prME
  source 1..9876: mol_type = other RNA
actgctggtgttatcgtaatgttaattcctaccgcaatggcatttcacttaaccacaaggaacggagaaccacatatgatagttggacgtcaagaaaaaggaaaaagtttgttatttaaaaccgaagatggggttaacatgtgtacattgatggcaatagatctaggggaactatgcgaagataccattacatacaaatgcccactgttaagacaaaatgaaccagaagacatagattgctggtgtaattcaacgagcacatgggttacgtatggtacatgtacaactacaggagaacatagacgggaaaaacggtccgttgcattagtaccacatgtcggaatggggctggaaactcgtacagaaacatggatgtcttcagagggagcatggaaacatgtacaacgaattgagacatggatattgcgacatccggggtttacaattatggcagcaatactagcatatacgattggaacaacacatttccaaagggccttaatattcatcctactgactgcagtagctccttctatgacaatgagatgtataggaataagtaaccgcgatttcgtagaaggagtgtctggaggttcatgggtggacatcgtactagagcatggatcttgtgtgaccacaatggccaaaaataaacctaccctagactttgagttaatcaaaaccgaggccaaacagcctgctacgctccgaaaatattgcatagaagctaaactaaccaatacaaccacggagtctagatgccctacccagggagaaccaagtcttaatgaagaacaagataaaagatttatatgtaaacattcgatggtggacagaggatggggtaatgggtgcggcctttttggaaaaggcgggatagtaacgtgtgcaatgtttacttgtaagaaaaacatggaagggaaagtcgtacaaccggagaacttagaatatacaatagtaattacgcctcactcaggcgaagaacatgctgtaggtaatgacaccggtaaacatggtaaagaaataaaaatcacacctcaatcaagcataacagaagcagaattaacagggtatggcactgtaacaatggaatgctccccaagaaccggcttggactttaatgaaatggtgctattacaaatggaagataaagcgtggttagtacataggcaatggtttttagacttacccctaccatggttaccaggtgctgacactcaaggatcaaactggatccaaaaagaaacactggtgaccttcaaaaacccacatgccaagaaacaggacgttgttgtcttgggaagccaagaaggagcaatgcacactgcattaacaggcgctaccgaaatacaaatgagtagcggtaatttattgtttacaggacatttgaaatgcagattaaggatggataaattacaattaaaagggatgagctatagcatgtgcacaggcaaatttaaaatcgttaaagaaatagctgagacacagcatggaaccatagtcatcagggtgcagtatgaaggggatggcagcccatgtaaaatcccattcgaaattactgatctagaaaaacggcatgtcctgggacgattgataacagtaaaccccatagttatagaaaaagacagtccagtcaatatagaagcagaaccacctttcggtgactcctatatcataattggtgtagagccaggtcagctaaaactgaattggtttaagaaaggatcaagtattgggcaaatgtttgaaacaacaatgcgtggagcaaaacgaatggctatactgggagatacagcatgggattttggttcgttaggtggagtgttcacttcaattggtaaagctctccaccaagtgtttggggctatttatggagctgcatttagcggtgtctcttggacaatgaaaatcttgattggagtcgttattacatggataggaatgaactcacgatccacttcactatccgtcagcttagttctcgttggcgtggtaacattatatttgggagcgatggttcaagccgattcaggttgcgttgtgagctggaaaaataaagaattaaaatgcggttcaggaatatttattactgacaatgttcatacctggacagagcaatacaaatttcaaccggaaagcccaagcaaactagcatccgcaattcagaaagcacacgaagagggaatttgtggtatacgatcggtaactcgcttagaaaacttaatgtggaaacaaataactccggaactgaatcatatactgtcagaaaatgaggtgaagctcacgataatgacaggagacactaaaggaattatgcaggcaggtaagaggtacctgagaccacaacctactgaattaaaatattcttggaagacttggggtaaagccaagatgctttcaactgagtcccataaccaaacattcctcatagatggaccggaaaccgcagaatgcccaaatactaacagagcatggaatagcctcgaggtagaagattacggctttggagtttttacaacaaacatttggcttaagttaagggaaaaacaagatgtattttgcgatagcaaattaatgtcggccgcaatcaaagataatcgggcagtgcatgcagatatgggatattggattgaaagcgcgttaaacgatacttggaaaatggaaaaagcgagtttcattgaagttaaatcttgtcactggcctaagtcacatacactatggagcaacggagtcctggagagtgaaatgataatacccaaaaacttcgctggtccagtatcccaacataactaccgacccggataccatacacagacggcaggtccctggcatttaggaaaactagagatggacttcgatttttgcgaaggtacgaccgtagtagtaactgaagactgcggcaaccgaggtccatcgttacggacgacaaccgcgtctggtaagttaattactgagtggtgctgcagaagctgtacacttccaccactgagatacagaggcgaggatggatgttggtatggaatggaaatacgaccattaaaagaaaaggaagaaaatttagtaaacagtttggttacagcagggcacggccaaatagataattttagccttggtgtacttggcatggctttgttcctcgaagaaatgctacgaactcgagtcggaaccaaacatgcaattctactcgtcgccgtaagttttgtaacgctgattaccggcaatatgtcttttagagaccttggaagggtgatggtaatggtcggagctacaatgactgacgacatagggatgggagtaacttacttggccttactcgctgcttttaaagtccgaccaaccttcgcagcaggccttttacttcgaaaattaacttcgaaagaactgatgatggcaacaattggcataactttattaagccagtcaactatcccagagaccatattagaactaacggatgcattggcgttgggtatgatggtactaaaaatagtacgaaacatggaaaaatatcagctggctgttactataatggcaatatcatgtgtaccaaacgctgtaatattaaggaatgcttggaaagtttcctgtaccatcctcgcagccgtcagcgtgtctccactactcctaacttcgtcgcaacaaaaggcagattggatccctttggccttaaccataaaaggacttaaccccaccgctatttttctaaccactctatctagaacgtctaagaaacgaagttggcctctaaatgaggcaataatggcggtagggatggtgtccattctagcgagttcactattgaaaaacgatataccgatgacaggtcccctagtagccggtggcctattaacagtttgttatgttttaaccggtcgttccgcagacttagaacttgaacgcgcagcagacgtcaaatgggaagaccaagcggaaatcagcggttcttcaccaatattatcaataactatctctgaagatggcagcatgtcaatcaaaaacgaagaagaagaacaaactctgacaatattgatcagaacgggcctgttagtgataagcggggtattcccagtatctattccaataacagcagcagcatggtatttatgggaagtcaagaaacaaagggctggggttctatgggacgttccgagtccaccgccggtcggcaaagcagaattggaagatggagcttaccgaattaaacaaaggggcatcctaggatacagtcaaattggagccggtgtttataaggaaggcacgttccataccatgtggcacgttaccagaggcgccgtattgatgcatagaggaaagcgaatcgaaccaagctgggcagatgtcaagaaagatctgattagttacggagggggatggaaacttgagggagagtggaaagagggtgaggaggttcaagtacttgcactagaaccaggaaagaaccctagggcagtccaaactaaacccggaatattcaaaacaaacacaggaactattggggcggtcagtttagatttttcgcctggtacaagcggctcacctattgtcgacaggaaagggaaggtcgttggattatatggaaatggcgtggtgacacgatcaggggcctatgtatctgcaatagcacagacagaaaaatctatagaagataatcctgaaatcgaagatgatatattcagaaagaaaagattaacaataatggatttacaccctggagccggcaaaacaaaacgatacttaccggcaatagtgagagaagctataaaaagaggcttgcgtacattgattttagctcctacaagagttgtagccgctgaaatggaagaggcattacggggactaccaattagataccaaacaccagctataaaagcagaacacactggacgcgaaattgttgatttaatgtgtcacgccacgtttaccatgcgattgttatcaccagtccgagtccccaactataacttaatcataatggatgaggcacactttacagaccctgcatctatcgccgccagagggtatatatccactagagtagaaatgggagaggcagccgggatattcatgacagcaaccccaccaggaagcagagatccattccctcaatcaaacgcaccaattatggacgaagaacgagaaataccggagcgctcatggaactcagggcatgagtgggtgacagacttcaaaggaaaaaccgtatggtttgttccaagtattaaagcgggcaatgatattgcagcctgcctccgtaagaatggcaagaaagttatccaattaagccggaagacattcgatagtgaatatgttaaaacaagggctaacgactgggactttgtagtaaccactgacatatccgaaatgggggccaactttaaagcagaacgagttattgacccaaggagatgcatgaaaccagtcatactcacggatggcgaagaaagagtaattctagctggtcccatgccagttacacattcgagtgcagctcaaaggcgaggaagaattggcagaaatccgaaaaacgaaaacgatcaatacatatatatgggagaaccacttgaaaacgacgaagactgtgctcattggaaagaagcgaaaatgcttttagataacataaacaccccagaaggtattatcccttcaatgttcgaaccggaacgagagaaagtggatgccgttgacggcgaatatcggttaaggggtgaggcacgaaaaacatttgtagatctgatgaggagaggagatctaccggtttggttggcttacaaagtggctgcagaaggtataaattatgctgaccgcaaatggtgctttgacggaattaaaaataaccaaattttagaggagaacgtagaagtagagatatggacaaaggaaggtgaaagaaagaaactaaaacctcggtggttagatgctaggatctactctgaccctctagccttaaaagagttcaaggagttcgctgcgggtagaaaaagtttaaccttaaatctaataacagaaatggggcgtctgccaacctttatgactcaaaaggcaaggaacgccctggacaacttagcggtattacacacggcagaggcaggaggcagagcttataaccatgctctctccgaattacccgaaacattagaaacactactcttgctgaccttgctagcgaccgttacaggtggaatatttcttttcctaatgagcggtaagggaatcggaaaaatgactttaggcatgtgttgtataataacagcctctgttttgctttggtatgcacagatccaaccgcactggatagcagctagtataattctcgagttctttctcatagtactcttaatacctgaacctgaaaagcaacggacaccacaagacaaccagctaacctacgtagtaattgcaattttaacagtggtagccgcaacaatggccaatgaaatgggatttctagagaaaactaagaaagacttaggtctaggaagcataacaacacaagaatccgaaagcaacatcctcgacattgacttaagaccagctagtgcctggacattatatgcagtagccacaactttcgttacaccaatgttacggcattcaatagaaaatagttccgtgaacgtcagcttaaccgctatagctaaccaagcaacagtgctaatgggtctaggaaaaggatggccgttgtctaaaatggacattggagtccctctcttagcaataggttgttacagtcaagtaaatccaatcacgttaactgccgcactgctacttctagttgcacattacgcgattataggacctggactacaagcaaaggcaacgcgcgaagcgcaaaaacgggccgcggcaggcattatgaaaaatcctaccgtcgatggaatcacggttatagacttggagccaatcccatatgatccaaagtttgagaaacaactaggacaagttatgttgctaattctttgtgtaacgcaagttcttatgatgaggacgacatgggctttgtgcgaagccttaactcttgcaacaggaccaatatctaccttatgggaaggaaacccaggacgtttttggaatacaacaattgcagtgagcatggccaatatatttaggggcagctaccttgctggagccggcttactattctcaattatgaagaatacgacaaacacacgaagaggcacaggcaatataggggaaacactcggtgaaaaatggaaatcacggctaaatgcattaggcaaatctgaatttcagatatacaagaaatcgggcatacaagaggtagatcgtaccttggcaaaagaagggattaagcggggagaaactgatcatcatgccgtatctagaggatcggctaaactaaggtggtttgttgagagaaatatggtgactcccgaaggaaaagtagtagatcttggctgtgggcgtgggggttggtcttattattgtggtggactaaagaatgtccgggaagtaaagggtctcacaaagggtggtccaggacatgaagaaccaatacctatgtcgacttatggttggaatttagtcagattacaaagcggcgttgatgtcttcttcaccccaccggaaaaatgcgatacattgctttgtgatattggagaatcatctcctaatccaacaatagaagctggaaggacattacgtgtattaaacttagtagaaaattggttaaataacaatacacaattttgtatcaaagtcttaaatccgtatatgccgtcagtgatagagaaaatggaaactttacagagaaaatatggaggagcgttagtacgtaaccctctatccagaaactctacccacgaaatgtattgggtatccaatgctacaggtaatatagtaagcagcgtcaatatgatatctcgaatgttaattaaccgatttacaatgaaacacaagaaagcaacatatgaacctgacgttgacttaggttcaggaacaaggaacataggcatagaaagcgaaataccgaatttagatatcattgggaagagaattgagaaaataaagcaagaacatgaaacatcctggcattacgatcaagatcacccctacaaaacatgggcctatcacgggtcttatgaaacaaaacaaacggggtctgcatcatccatggttaacggcgtcgttcggttgttaacaaagccgtgggatgtggtccccatggtcacccagatggcgatgacggataccactccatttggacagcaaagagtattcaaagaaaaggtggacacacgcacacaagaaccaaaggaaggaactaaaaagttaatgaggatcacagctgagtggctttggaaagaactgggcaagaagaaaacacctagaatgtgtacccgggaagaatttactaggaaagtgaggagtaacgcggcgctcggagctatattcacagacgagaataaatggaaaagtgctagagaagcagttgaagacgggagattctgggaattagtggaccgggagagaaatctgcatctcgaaggcaaatgtgaaacctgtgtatataacatgatgggtaaaagagagaagaaactaggtgagtttggcaaagcaaagggaagtagagcaatttggtacatgtggttaggagctcgattcttagagttcgaagcattaggtttcttgaatgaagaccattggttttcacgaggaaacagtctttcaggagtggaaggagaaggtttacaccggttaggatacatattacgggatgtcggtaagaaagaaggtggcgcgatgtacgcagacgatacagcagggtgggacacgagaataacgttagaagatttgaagaacgaggaaatggtcacaaatcacatgaagggcgaacacaagaaactagccgaagcaatattcaagctaacgtatcagaacaaagtggtaagagttcaaagaccaacgccacgaggaactgtaatggacataatcagtcgtcgtgatcaaagaggaagcggccaagtaggtacatatggattgaacacctttacgaacatggaggcacaactgatccgccagatggagggagaaggaatatttaaaagtatacaacacttaacagctacagaagaaatcgctgcacaaaattggctagctcgagtagggagagagagactaagtcgaatggcaataagtggcgacgattgtgtagtgaaaccaatagatgatagatttgccagtgctctcaccgctctaaatgatatgggaaaggtccggaaggacattcaacagtgggaaccttctcgcggatggaatgattggactcaggtaccattttgcagtcatcacttccacgaattagtaatgaaagacgggagagtcctggtcgtgccttgccgtaaccaagatgagctgatcggccgtgcacggatttcacaaggtgcaggctggagcctaaaagaaacagcgtgtctaggaaaatcttatgcacaaatgtggacactaatgtactttcatagacgcgacttacgcttagcagcgaacgctatatgttctgcagtcccgagtcattgggtccctacgagccgcacaacctggtcaattcatgcaaagcacgaatggatgactactgaagatatgctagcagtatggaacagagtatggatacaggaaaatccatggatggaagataaaacaccagtagagtcttgggaagaagttccatatctaggtaaacgcgaagatcaatggtgcggatccttaataggtttaacctcacgtgccacctgggcgaagaatattcagacagcaataaatcaagtacgatcacttataggcaatgaggagtacaccgattacatgccatcgatgaagagattcaggagagaagaagaggaggccggagtactatggtga

SEQ ID NO: 22288 - RNA, 9876 nt, synthetic construct
  misc_feature 1..9876: note = derived and/or modified CDS sequence (opt6) from DENV-2__FJ024477__SS-prME
  source 1..9876: mol_type = other RNA
actgcaggggttatagttatgctaatcccaacggcaatggctttccacctgaccactcggaatggagaacctcacatgattgttggacgccaggaaaaagggaaatccctgctgttcaaaacggaagatggggtcaatatgtgtacattgatggcaattgatctaggagagttatgtgaagacacaataacttacaaatgtcctctactacgacaaaacgagcctgaggacatagattgttggtgtaacagtacgtctacctgggttacctatgggacttgcactaccacaggggaacatcgtagagagaaaagatcggtcgccttagttccccatgtcggtatgggattagaaacgagaaccgaaacttggatgagcagtgaaggggcatggaaacatgtacaaagaatcgaaacatggatactaagacatcctgggttcacaataatggcggctatattagcttacacaatcggaaccacacactttcaaagggcactcattttcatattgctaactgcagtggcaccgagcatgacaatgaggtgcatcggaatctctaatcgcgattttgttgaaggagtgtctggaggttcgtgggtagatattgtccttgaacatggttcctgcgtaaccactatggcgaaaaataaacctacacttgattttgaattgataaaaacagaagcaaaacaacctgcaacattaagaaaatattgcatagaggcaaaattaacaaatacaactactgaatcacgctgcccgactcaaggagaaccttctctaaatgaagaacaagataaaaggttcatctgtaaacattcaatggtggatcggggttggggtaatggatgtggtttgtttggaaaaggaggaattgtgacatgcgctatgtttacttgcaagaaaaatatggaaggaaaggtagttcaacccgaaaaccttgagtacacaattgtaataacaccacatagtggagaagaacacgcagtaggcaatgatacgggaaaacatggaaaagaaataaaaattacgccacagagtagtataaccgaggctgagttaacaggttatgggaccgtcacaatggaatgttctcccagaacaggtttggattttaacgagatggtccttctgcagatggaggataaagcatggttagttcatagacaatggtttctcgatttaccactaccatggttgccaggcgctgacacacaaggatcaaactggatacaaaaagaaacgttggttacgttcaagaacccgcatgccaagaaacaagatgtggttgtgcttggaagtcaagaaggcgcaatgcatactgcgctaactggtgcaacggaaattcagatgagcagtggtaatctactatttaccggacacttaaaatgtcggcttagaatggataaactccaactcaaaggaatgtcttattcaatgtgtacaggcaaattcaaaatagtaaaggaaatagctgaaactcaacacgggaccatagtaataagggtacaatatgaaggcgatggaagtccttgtaaaattccattcgaaataaccgatcttgaaaagcgacatgttctcgggcgattaataacagttaatccaatagttaccgagaaagacagtcccgtaaacatagaagcggaacccccattcggtgacagctacataataatcggtgtagaacctgggcagttaaagttgaattggttcaaaaagggttcgtcaattggacaaatgttcgaaactacaatgcggggcgcaaaaagaatggcaatactaggtgatactgcctgggattttggtagtctcgggggtgtcttcacgtcaataggaaaggcactacatcaggtattcggggcaatttatggcgctgcattttctggtgtgtcatggactatgaaaatattaataggagtgatcatcacatggatagggatgaactcacgatcaacgtctttgtccgtttctctcgtactggtcggagttgttacactctacttaggagccatggtgcaagccgacagcgggtgtgttgtcagctggaaaaacaaagagttgaaatgcgggtcaggaatttttatcaccgacaacgtacacacatggacggaacaatacaaatttcaaccggagagtccgtcaaaattagcttccgcaatacaaaaggcccacgaagaaggcatatgcgggataaggtccgcgacgaggttggaaaacctaatgtggaagcagattacgccggagttgaaccatatcctctcagaaaatgaagtcaaactaacgataatgactggtgacatcaaggggatcatgcaagcagggaaacgatcattacgtccccagccgacagaactaaagtattcatggaaaacatggggtaaagctaagatgttaagtacggaaagccataatcaaacattccttatcgatggacccgaaacggcagagtgcccaaatactaatcgtgcgtggaacagtctcgaagttgaagattatgggttcggcgtttttacgacaaatatatggcttaagctcagagagaaacaagacgtattttgcgactcaaaacttatgagtgcggcgattaaagacaatcgggcagttcacgctgatatgggatactggatagagtcagcattaaacgatacatggaagatggaaaaggcatcatttattgaagtaaaatcctgccactggcccaagtcgcacacactatggagtaacggtgtcttggaatcggaaatgatcatccccaaaaattttgctggtcctgtatcacaacacaactaccgaccggggtatcatactcaaacagccggaccctggcatttaggaaagctcgagatggattttgacttctgcgaaggtactacagtagttgtgaccgaagattgtgggaataggggaccttcactccgtactaccactgcctcaggcaagctaattacagaatggtgctgcagaagctgcacattaccaccacttcggtatcgaggcgaggatggatgctggtacgggatggaaataaggccactgaaagaaaaagaagagaacttagtaaattctttagtaacagcaggtcacgggcagattgataatttttctttaggtgttttgggcatggctttattcttggaagaaatgttgaggacaagagtaggtacaaaacacgcgatcttgcttgcggcggtatcgttcgttactttgattacaggaaatatgagtttcagagacttaggacgagtaatggtaatggtaggagcaaccatgacggatgacataggaatgggtgtaacctatttagcacttctagccgcttttaaggtgcgtccgacgtttgctgcaggtttactgttacggaagttaacctcaaaagaactaatgatggctacaattgggatagcacttctaagccaaagcacaataccagaaaccatacttgaattaacagacgcactagctctggggatgatggtactaaaaatagttaggaatatggaaaaatatcaattggcagttacaatcatggctatctcatgtgtaccaaatgctgttattttacaaaatgcttggaaagtcagttgtacaatacttgcagtagtctcagtgtcaccattgctccttacctcaagtcagcaaaaagccgactggatccccctagccctgacaattaagggactcaacccaacagccatatttttaactaccctatcacgaacaagtaagaaaagaagttggccacttaatgaggcaataatggcagtaggcatggtaagcattttagcatcctccctattaaagaacgatattccaatgaccggtccacttgtagccgggggattactgacggtatgctacgtcctaaccggaagaagtgctgatttagaattagaacgagctgctgatgttaaatgggaggatcaggctgaaatatccgggagttcccctattctctctatcacaatatcagaagatgggtctatgtctattaaaaacgaagaagaagaacaaactctaacgattctaataagaacggggctcctagttatctctggtgtttttccagtatcaatacccattaccgcagcagcgtggtatctatgggaagtgaagaaacagagagccggtgtcttgtgggatgtgccatctcctccaccggtaggtaaagctgaattagaggacggggcttatcgaattaaacagcgtggaatcctaggttatagccaaatcggagctggtgtatataaggaggggacatttcacactatgtggcatgtaacgcgaggtgcagtactaatgcatagaggaaaaaggattgagccgagttgggcggatgtcaaaaaggacctcatctcatacggtggaggctggaaactcgagggagaatggaaggaaggcgaggaagtgcaagtcttagctttagaacctggcaaaaatcctagagcagtacaaacaaaaccaggaatattcaaaaccaacactggaacaatcggagcagtatctttggattttagtccaggaacaagcgggtccccaatagtcgatagaaaaggcaaagtggtaggcctatatgggaatggagtagtaacacgatctggtgcatacgtgtcagcaatagcgcaaacagagaaaagtatcgaagataatcctgaaatagaagacgatatctttcggaagaaacgactgacaataatggatttgcatcccggtgcgggtaaaacaaaaagatatttgccggcaatagttcgagaagcaatcaaacggggattaaggaccttaattttggcccccactcgagtcgttgcagcagaaatggaagaggcactaaggggactaccaattagataccaaactccagctataaaagcagaacacacgggacgcgaaatagtcgatctaatgtgtcatgcaacatttacgatgagattgctatcacccgtacgtgtccccaattataatctaatcataatggacgaggcccattttaccgatcccgcttcgatagcggcaagaggttatatttcaacaagagtagaaatgggagaggccgctggaatattcatgaccgcgacaccaccaggcagcagagacccgtttccgcagtccaacgctccaataatggacgaagaaagggaaataccagagagaagctggaatagtggacatgaatgggtaacagatttcaaaggaaaaacagtatggtttgttccatcaataaaagctggtaatgatatagctgcatgcctccgaaagaatggcaagaaagtgattcaattatccagaaaaacttttgatagcgaatatgtcaagacccgagctaatgactgggattttgttgttacaacggacataagtgaaatgggagcaaattttaaagcagagagagtaattgatcccagaagatgcatgaaacctgtaatattaacagacggagaagagagagtaatactggcagggccaatgccagtaacacatagcagcgcagctcaaagaagaggtagaattggacggaatcccaaaaatgaaaatgatcaatacatttatatgggagagccactcgagaatgatgaagactgcgcacactggaaagaagccaaaatgctacttgataacataaatactccagaaggaataattccgagcatgttcgagcctgaaagggaaaaggttgacgctattgatggagaatacagacttaggggcgaagcgagaaagactttcgtagatctcatgagaagaggtgatttacccgtatggctggcatataaggtagcagccgagggtataaactacgcggatagaaaatggtgtttcgacggaattaaaaataatcaaattcttgaagaaaatgttgaagttgaaatttggactaaagagggagaaaggaagaaattaaaaccaaggtggcttgatgcacgtatatatagcgatcctcttgcgcttaaagagttcaaagagttcgctgcaggccgaaagagcctcactttgaatttaatcactgaaatgggtagattgccaacattcatgacacaaaaagcaagaaacgcattagacaacctggcagtgttacacacggcggaagccggtggcagagcatataaccacgccctttcagagttgcccgaaacattggaaactttgttactattaacactactggcaacagttaccggcggtatattcttattcttaatgtcgggaaaaggaataggcaagatgacattaggcatgtgttgtatcataacagcgagtgtcttattatggtatgcccaaatccaaccgcactggatcgcagcatcaatcattctagagttctttctaatagtacttttgatacccgagccagaaaaacagagaacaccacaagacaaccaactgacttatgtcgttatagcaattcttacggtcgtagcagcaacgatggcaaatgaaatgggatttcttgagaaaactaagaaggacttagggctaggatcaatcacaactcaagaatcggaatccaacattctggacatcgacctaaggccagcctcggcatggacattatacgctgtagctacaacatttgttacacccatgctaaggcactctatagaaaattccagtgttaacgtatctttgacagctatagcgaatcaagccacggtattaatgggattgggcaaaggatggcctttatcaaaaatggatataggtgtacctttgttagctataggttgctacagccaggtgaacccgataacgctaacagcggcattactgttattggttgcccactatgccatcataggcccaggactccaagcgaaggcgactagggaagcacaaaaacgagcagcggcgggtataatgaagaatccgactgttgatggaatcaccgtgatagatctggaacctataccatatgacccaaagttcgaaaagcagcttggacaggtaatgctcctaatattatgtgtaactcaagtattaatgatgcgtacgacatgggcgctatgtgaagctcttacattagctacaggacctatcagcacactctgggagggcaacccgggtcgattctggaatacaacaattgcagtatctatggcgaatatttttaggggatcatatctggcaggggccggacttcttttctcaataatgaaaaatacaacgaatactcgtcgaggtacagggaatataggtgagaccttaggagaaaaatggaaatccagacttaacgccttaggcaaaagtgaatttcagatttacaagaaaagtgggatacaagaagtcgacaggacattagcaaaagaaggaattaaaaggggcgagactgaccaccacgctgtttctaggggcagcgcaaagctacgatggtttgtagagcggaatatggtaactccggaaggtaaagttgttgacttagggtgtggcagagggggatggtcatactactgcggaggccttaaaaacgtacgagaggttaaggggctaacgaaaggtgggccaggccacgaagaacccataccaatgagcacatatggttggaatctcgtaagattacaaagcggcgttgatgtatttttcacacccccagaaaaatgtgacaccctattgtgcgatataggtgaatctagtccgaaccctactatagaagcggggagaaccttgcgtgttctcaatctagtagaaaattggttgaataataacacccaattttgtatcaaggtgctgaatccgtatatgccgagtgtaatagaaaagatggagacattacaaagaaagtatggaggagccctagtcagaaacccattatcaagaaatagcacacacgagatgtactgggtctcaaatgcaacaggtaacattgttagttcagtgaatatgattagcagaatgctcataaataggtttaccatgaaacataaaaaggccacatacgaacccgacgtggacttaggatcggggacacgaaatattggaatagaatcagaaatcccaaacctagacataataggcaaaaggatagagaagataaaacaagaacacgaaacttcatggcactatgatcaagatcatccgtataaaacttgggcctatcacggcagctatgagacgaaacaaactggatcagcatcgtcaatggtaaacggagtagtaagactcttaactaaaccatgggacgtagtaccaatggtaacgcaaatggctatgaccgatacgacaccttttggccaacagcgagtttttaaagaaaaagtagatacaaggacccaagaaccaaaagaaggtacgaaaaagctgatgaagatcacagctgaatggttgtggaaagaactaggcaagaagaaaaccccgcgaatgtgtactagagaagaatttacccgcaaggtaaggtcaaatgcagccctaggcgccatcttcacagatgaaaacaagtggaaaagcgctagggaagcagtagaggatgggcggttctgggagctagtcgatcgtgagagaaatctacatctagagggtaaatgtgaaacatgcgtttataacatgatgggaaaaagagagaagaaactaggtgagtttggaaaagccaaaggttcacgtgccatatggtatatgtggttgggtgcgagattcttagaatttgaagctcttgggtttttaaacgaagatcactggttctctagaggaaattcattaagcggtgtggagggagagggactccatagactaggatacatcttacgagacgttagcaagaaagaaggtggagcaatgtacgcagatgatactgccggatgggatacacgcataacactagaagatctcaaaaacgaggagatggtaaccaatcacatgaaaggggagcataagaaacttgctgaagctatatttaaactaacatatcagaacaaagtagtccgtgtacaaaggccaacccctcgcggaactgtaatggacatcataagtcggagggaccagaggggcagcgggcaagtcggaacctacggtttgaacacatttacgaatatggaagctcaattaataagacaaatggaaggagagggcatatttaaatctatacaacatttgacggccacagaagaaatcgcagtacaaaattggttggcaagggtcggaagagaaagattgagtaggatggcgatctccggtgatgactgcgtcgtcaaacccattgacgacagattcgcctcagcattaacagccctaaacgatatgggaaaggtgagaaaagatatacaacaatgggagccctctagaggctggaatgactggacgcaggtaccgttttgttcacaccatttccacgaacttgtaatgaaagatgggagagtccttgtggtaccgtgtaggaaccaggatgaactaatcggtcgagcgcggataagccaaggtgctggctggagcttaaaagaaacagcttgtttaggaaaatcatacgcacaaatgtggaccttaatgtatttccatcggcgggatctgagactggctgctaacgccatctgtagtgcagtaccttctcattgggttccaactagcagaaccacatggagcatacacgcaaaacatgaatggatgacgactgaggatatgcttgcagtctggaatagggtctggatacaagaaaacccatggatggaagacaaaacaccggtagaatcatgggaagaagtgccatacctcggaaaaagagaagaccaatggtgtggctccctaatcggcttaacatcacgagctacttgggccaaaaacatacaaacagctattaatcaggtccgaagtttgataggaaatgaagaatatacagattatatgccaagtatgaaacgtttccggcgagaagaagaagaagctggtgtactgtggtag

SEQ ID NO: 22289 - RNA, 9876 nt, synthetic construct
  misc_feature 1..9876: note = derived and/or modified CDS sequence (opt6) from DENV-2__GQ868552__SS-prME
  source 1..9876: mol_type = other RNA
acagcaggagtaataattatgttaattcctaccgcaatggcattccatctgacaactaggaatggagaaccacatatgatagtaggcagacaagaaaaaggtaaatctctcttattcaaaaccgaagatggagtgaatatgtgtacactgatggcaatagatttgggagaattatgcgaagacacaataacatataaatgtccattactcagacaaaacgaaccagaagacattgattgttggtgtaattcgacttctacatgggttacctatggaacatgcacgacgacaggagaacatcgtcgagaaaaacgcagtgtagcattggtcccgcacgttggaatgggattagaaacccgaacagaaacatggatgtcaagtgaaggagcgtggaaacacgtacaacgaatagagacctggatactacgacatccgggttttgcaattatggcggcaatactcgcatatacaatcggcaccacccactttcagagggcacttatttttattttattgacggctgtagcacccagtatgactatgagatgcataggcattagcaacagggactttgtcgaaggagtgtctggtggttcgtgggtagacatcgtcttggagcacggctcctgtgtaacaactatggccaaaaataaaccaaccttagatttcgagcttattaaaactgaagcaaaacaaccagctacccttaggaaatactgtatcgaagcgaaactaacgaataccacaacagaaagccgatgcccaacacagggggagccaagtcttaacgaagaacaagacaaaaggtttatatgtaaacatagcatggtagacagaggttggggaaacggatgcggattatttggcaaaggtggaattgtaacctgtgctatgtttacttgcaagaaaaacatggaaggaaaagtagtattgccggaaaacttagaatacaccattgtcataacaccccactctggtgaagaacatgcagtaggcaatgacacaggaaaacatggcaaagaaattaaaatcacgccacagtccagtattacggaagcagaattaacaggttacggaacggtaactatggaatgttcgccccgaactggcctagatttcaacgaaatggtcttgctacaaatggaagaaaaagcgtggttagtgcaccggcaatggttcttagatttaccactcccatggctaccgggtgcggatacacaaggatcaaactggattcaaaaagaaacattggttacgtttaaaaaccctcacgccaagaaacaagatgtagtagtgcttggaagccaagaaggagcgatgcatacggctctaaccggcgcaactgaaatccaaatgtcatccggaaatttattatttacgggacatctgaaatgcaggttaagaatggacaaattacaattaaaaggaatgtcatattctatgtgtacaggaaaatttaaaattgttaaagaaatcgcagaaactcagcatggtacaattgtaattcgggtgcaatacgaaggcgacggcagtccttgtaaaatccctttcgaaattatggaccttgaaaaacgacatgtacttggaagactaataacagtaaatcctatagtaacagaaaaagactcacccgttaatatagaggcagaaccgccatttggagactcctacataataataggagtagaacctggacagttgaaactcaattggtttaagaaaggatcttcaatagggcaaatgtttgaaacaaccatgagaggagcaaaacgaatggctatattaggagacacagcatgggactttggctcactaggtggtgtctttacctcaataggaaaggctttacaccaagtctttggcgcaatatatggggcagcttttagcggcgtatcgtggactatgaaaatactgataggagtaataattacttggataggaatgaactcaagatctacctccctcagtgtatctttagtactggtgggggtggtgacattatatctcggtgctatggtgcaagccgactctggctgcgtagtctcttggaaaaataaagaattaaaatgtggatcaggaatattcataaccgataacgtacatacctggacggaacagtataaattccaacctgagagtccctcaaaattagcatctgctatacagaaagctcatgaagaaggtatttgtggcataagatccgtcacaagactagagaatctcatgtggaaacaaatcactccagaattaaaccacatactatcagaaaatgaggtgaaactaacaataatgacaggtgatataaaaggaattatgcaagcaggtaaacgcagcctcaggccgcaacccacggaactaaaatattcctggaaaacatggggaaaagcaaagatgctgagtacggaaagtcataatcaaacttttctgatagacggaccagagacggcagaatgtccaaatacgaatcgggcatggaactcattagaagttgaagactatggatttggcgtatttacaacgaatatctggttaaaattaagagagaaacaagacgtattttgtgactcaaaattaatgtcggcagccatcaaagacaaccgagcggtacatgcagatatgggttactggatcgagtcagccctcaatgacacgtggaaaatggaaaaggcgtcgttcatagaagtaaaatcatgtcattggcctaagagtcatacattatggtccaatggtgtccttgaatccgaaatgataatccccaaaaactttgccgggcccgtttcacaacacaattacagaccaggttaccatacacaaacggccggtccctggcatctaggtaaactagaaatggactttgatttttgtgaaggtacaactgttgttgtgacagaagattgcggcaatagaggtccatcattacgaacgaccaccgcgagtggcaaactaataactgaatggtgttgtaggtcttgcacactacccccattgagatacagaggagaagatgggtgctggtatggcatggaaataagaccattaaaagagaaagaggagaatttagtcaatagcttagttacggctggtcacgggcagatagataacttcagtttaggcgtacttggtatcgcattatttttggaagagatgttacggacaagagtaggaaccaaacatgccatcctcttagtagctatatcattcgttacactcattacaggaaacatgagctttcgagatctcgggagagtcatggtaatggtaggcgctacgatgaccgatgacataggaatgggagtgacttatttagccttattagccgctttcaaagtaagaccaacatttgctgcaggcttattattacgaagacttacttcaaaagaattaatgatggcaacgattggtattgcactcctgtcacaatctacaataccggaaaccatcttagagttaacagatgccttggccctcgggatgatggtactgaaaattgttcgtaacatggaaaaatatcaattagcagtcacaattatggctatatcatgtgtccctaatgctgtaatactgctaaatgcctggaaagtatcatgtactatcttggctgctgtatcagtatcaccattactactgacgagctcgcaacagaaagctgattggataccattagcactcacaataaaaggcttgaacccgacggcaatatttttaacaacactttcacgcacctcaaagaaaaggtcatggccgttgaatgaggcagtaatggccgtaggaatggtatcaatattggcatcgtcgctcctgaagaatgatatcccaatgaccggtccattggttgctgggggattattaacggtctgctacgtccttacaggacgctcagctgatctagaactggaaagggcggcagatgtaaagtgggaagatcacgcagaaataagcggatcaagtccgatactttcaataaccatatcagaagatggttcgatgtcaatcaaaaatgaagaagaagaacaaacattaacaatattaatacgaactggactacttgtgattagtggcgtcttccccgtatccatccctataacagcagcagcatggtatttatgggaagtcaagaaacagcgtgccggtgtgctatgggatgtaccgagtccacctccggtagaaaaagcagaacttgaagatggcgcgtatcgaataaaacaaagaggcattctaggatatagtcaaataggagcaggagtttataaagagggaacatttcacacaatgtggcacgtaactaggggcgccgtactgatgcatagaggaaaacgaattgaaccctcatgggcagacgtcaagaaggatcttatttcttacggagggggatggaagctagaaggggaatggaaggaaggagaagaagtacaagtattggctctagaaccaggtaagaatcccagagcggtacagacgaaacctgggctttttaagacgaacactgggacgataggggcggtatcgctagatttctccccaggcaccagtggatcgccaattgtcgacaggaaaggcaaagtagtaggactatacgggaatggagtcgtaacaagatcaggagcatatgtttctgccatagcgcaaacagaaaaatcaatcgaaaacaatccggaaatcgaagacgacatttttcgtaagaaaagattgaccataatggacttacatcctggagccggtaagactaaacgataccttcctgcgatagttcgagaggcaataaaaagaggactgcgaaccttgattttagctcctacaagggtcgtagcagctgaaatggaagaagcactaaggggcttacctatacgttaccaaacacccgcaatacgagcagagcacactggtagagaaatagtagatctcatgtgtcacgcgacttttaccatgagattgttgtcacctgtgagagtacctaattacaatttaataataatggacgaagctcattttacggatcccgcaagcatcgctgcaaggggctatatatcgactagagtagaaatgggtgaagcagcaggcatatttatgactgcgaccccgcccggtagtagggacccatttccccagtcaaacgcaccaattatggatgaagaaagagaaataccagaaaggtcctggaatagtggtcatgaatgggttacagacttcaaaggaaaaacggtatggttcgtaccaagtattaaggcaggaaacgacatcgccgcatgcctacgtaaaaatggtaagaaagtaatacagttatctagaaagacgtttgactctgaatacgtcaagacccgagctaatgattgggactttgtcgtaacgacagatatatctgaaatgggagcaaattttagggccgaacgggtgattgatccaagaaggtgtatgaaaccggttatcctgacagacggcgaagaacgagtgatactagctggtcctatgccagtgacacattccagtgcagcccaaaggcgtgggcgtattgggaggaatcccaaaaacgaaaatgaccaatacatctacatgggagagccactagaaaacgatgaagactgcgcccattggaaggaggcgaagatgctattagataatataaatacacccgaaggaataatcccttccatgttcgagcctgagagagaaaaggtagatgcaattgatggagaatacagattgagaggggaagcccgaaaaacattcgttgatctcatgcgtcgtggtgacctcccagtatggttagcatatagagtagcggcagaaggcataaactatgcggatcgtcgatggtgttttgatggaatcaaaaacaatcagattttggaggaaaatgtagaagtggagatatggacaaaagaaggtgaaaggaagaaattaaagcctaggtggctcgatgctcgaatttacagtgatccattagctttaaaagaatttaaggagttcgctgctggtcgaaagagtttaactctaaatctaattacagagatgggacgactgcccaccttcatgacgcagaaagcgagggatgcattggataacctttcagtgctgcatactgcagaagccggaggtagagcttacaaccatgccctgtccgagttgcccgaaacacttgaaacgctattactacttactttattggcgaccgtcacagggggaatattcctatttcttatgtccgggaaaggtataggcaaaatgacattaggaatgtgttgtatcattactgcaagcatactattgtggtacgcacaaatacaaccgcactggatagctgcctcaattatactggagttctttcttattgttttgttaatacccgagccggagaaacagcgaacaccgcaagacaatcaactgacttatgtagttattgcaatattaacagtcgtcgcagctactatggccaatgagatgggcttcttggagaaaaccaagaaagaccttgggctgggttctattacgacacaagagcccgaaagcaacatccttgatattgacttgcgacccgcttctgcatggacactatatgcagtagcaactacctttgtcacacctatgctacgccacagtattgaaaatagttctgtcaatgtgtctcttaccgcgatagcaaatcaagcaactgtgttgatgggactagggaaaggatggccattaagcaaaatggacattggcgtgccactacttgctataggatgttattcacaggtaaatccaataacgttaacagctgctctgctgttactggtagctcattatgctatcattggccccggattacaagcgaaggccacaagagaagcacaaaaacgtgcagctgcaggtattatgaagaacccaacggtagatggcatcactgttatagatttggaaccgatcccatacgatccgaagtttgaaaagcagctaggtcaagtaatgcttctgatactttgcgtaacgcaagtcttaatgatgcgaacaacttgggctctgtgtgaggctttgacactagcaacaggacctataagcaccctatgggaaggtaatccaggtagattttggaacacaaccatcgctgtgagcatggcaaatatatttaggggtagttacctagccggtgcaggtctgctattttcaataatgaagaacactaccaacacaagacgggggactggaaacataggcgaaacattgggtgaaaaatggaaaagtcggctaaacgcgctaggcaaaagtgagttccaaatttacaagaaaagtggaatacaagaggtagaccgaacacttgcaaaagaaggaataaagcgaggagaaacagaccaccacgctgtgagtcgaggatctgccaagttaagatggtttgttgaaagaaatatggtaacacccgaaggtaaagtcgttgaccttggctgcggaaggggaggctggtcctactattgtggtggattgaaaaatgtcagagaagtaaagggacttactaaaggaggtccaggtcatgaggaacccattccaatgtccacatatgggtggaatttagtaagattacaatcgggtgtagacgtcttctttacaccgccagagaagtgtgacaccctgctatgtgatatcggagaatcaagtccaaatcctacaatagaggctgggcgaacattaagagtattgaatctggtagaaaattggttgaacaacaatactcagttctgtattaaagtattgaacccctatatgccatcagtgatcgagaaaatggaaacgttgcaaagaaagtacggaggtgccctagtccgtaatcccttaagtaggaacagtacacacgaaatgtactgggtaagtaatgcaacaggaaatatagttagtagcgtaaatatgatctccagaatgttgattaataggtttacaatgaaacataagaaagctacctacgaaccagacgttgatctagggtcgggcacccggaatattggaatagaaagtgagattccaaatctagatattattgggaaacgaattgagaaaataaaacaagaacatgagacttcttggcattacgaccaggaccacccatataaaacttgggcatatcacggctcatacgaaactaagcaaacgggtagcgcaagctccatggtaaatggcgtcgtcagattattaactaagccgtgggacgttgtcccgatggtgactcagatggctatgacagatactacaccctttggacaacagagagtatttaaagaaaaagtggacacgcgaactcaagagcccaaggaaggtacgaagaaattaatgaaaattaccgcagaatggctatggaaagaattgggtaagaagaaaacgccgcgtatgtgcacacgggaagaatttacccgcaaagtaaggtcaaacgcggcattaggtgctatatttaccgatgaaaataaatggaagtcagctagagaggcagtggaagatagcaggttttgggaattggtcgatcgtgaaaggaatttgcatctggaggggaaatgcgaaacttgcgtgtacaacatgatgggcaagcgagagaagaaattaggagagttcggcaaagctaaaggatctagggcgatctggtacatgtggctgggagcacgtttcctagaatttgaggccctagggttccttaacgaagatcattggtttagccgtggaaatagtctttcaggagtagagggagaaggtttacatagactgggatacatactacgagacgtgtcgaagaaagaaggtggagcgatgtatgcggacgacacagctggctgggacacccgaattactcttgaagatttgaaaaacgaagagatggtgacaaatcatatgaagggggaacataagaaactagcagaagctatattcaaactaacataccaaaacaaagtcgtaagagtgcagagaccaacacctagaggaacggtgatggatattataagtagacgcgaccaaagaggctcgggtcaagtcggaacgtacggattaaatactttcacaaatatggaagcgcaattaatccgacagatggaaggtgagggaatatttaagagcattcaacatctcacagttacagaagaaattgcggttcagaattggctcgcgcgtgtcggcagagagaggttaagtcgtatggcaataagtggtgacgactgtgttgtcaaaccattagacgacaggtttgcatctgcactaactgcattaaacgatatgggcaaagtgcgaaaagacattcagcaatgggaacctagcagaggatggaacgactggactcaagtaccgttctgtagtcatcatttccatgagctcgtaatgaaggatggtcgtgtattagttgtcccctgtagaaaccaagatgaattaattggcagagcacgtattagtcaaggagcaggatggagtctgaaggaaacagcatgtttaggaaaaagttacgcgcaaatgtggacgttaatgtacttccataggagggatctacggctagcagcaaatgctatctgttccgccgtaccatctcattgggttcctacgagtcggactacatggtcaatacacgcaaaacatgagtggatgacaacagaggatatgctagcggtatggaacagagtatggatccaggaaaatccgtggatggaagacaaaacgccggtagaaagttgggaagaggtcccgtatcttggtaaacgtgaagatcaatggtgcggatccttaataggtcttacctcaagagcaacatgggccaaaaacatacaaaccgcgataaatcaagtaaggagcctcataggaaatgaagaatatacagattatatgcctagcatgaagagatttcgcagagaagaagaggaagccggagtcctttggtga

SEQ ID NO: 22290 - RNA, 9876 nt, synthetic construct
  misc_feature 1..9876: note = derived and/or modified CDS sequence (opt6) from DENV-2__GQ868553__SS-prME
  source 1..9876: mol_type = other RNA
acagcgggggtaattgttatgttaatacctacagctatggctttccatttaacaacccgtaacggggaacctcatatgatagttgggaggcaggaaaaaggtaaatccttattgttcaaaactgaagatggtgtaaatatgtgtacattaatggcaatagacttaggggaattatgtgaagataccattacttacaaatgccctcttttgaggcaaaacgaaccagaagatatagattgctggtgtaactcaaccagcacttgggtgacatacggaacatgtacgacaactggtgagcatcggcgcgagaaaagaagtgttgctttagttccacacgtaggtatgggtttagaaaccagaactgaaacatggatgagctccgaaggagcgtggaaacacgtccagagaattgagacgtggatactcagacaccctggattcacaattatggcagcgatattagcatatacaataggtacgacacactttcaaagagcgttaatttttattttactgacagcagtagctccgagcatgactatgagatgcattggaataagtaatcgagatttcgtagaaggagtgtcaggtggtagttgggtcgacattgtcctcgaacatggtagttgtgtgactactatggccaaaaataaaccgacattagacttcgaactaattaaaactgaggccaaacaaccagctacattaaggaaatattgcatcgaggctaaactgacgaacactacaactgaatcaagatgtcctacccaaggagagccgtcgctaaatgaagaacaagataaaaggttcatatgtaaacattcaatggtagatcgcggatggggaaatggctgtgggttatttggaaaaggagggattgtaacatgcgcaatgtttacctgtaagaaaaatatggagggaaaagtggtacagccagaaaacttagagtacacaattgtaattacaccacatagtggggaagaacatgctgttgggaatgataccggcaaacatggcaaagagatcaaaataactccacagagttcgatcacggaagcagaacttacaggatatggaactgtgactatggaatgttcgcctcgtacaggattggattttaatgagatggttttattacaaatggaagataaagcctggttagtccataggcaatggtttcttgacctacctctaccatggttacctggtgcggatacgcagggctctaattggatccaaaaagaaactttagtgacattcaaaaatccacacgccaagaaacaagacgtagttgttctgggctcacaagaaggagccatgcatactgcccttacgggagctacagaaattcaaatgagtagtggtaacttgttgttcaccggccatctaaaatgtaggctcaggatggataaactgcaattaaaagggatgtcttactccatgtgtacaggaaaatttaaaatagttaaagaaatagcggagactcaacatggaacgatagtcattagagtacaatatgaaggcgatggaagcccttgcaaaataccatttgaaatcacagatctggaaaaacgacacgtacttggaaggcttataacggtgaaccccattgttacagagaaagattcgcccgtgaacatcgaagccgaacctccgttcggggattcttatataataattggtgtggagcctggccaacttaaattgaactggtttaagaaaggtagtagtataggacagatgtttgaaacgacaatgcgcggagcaaaaagaatggcgatactaggtgataccgcctgggactttggatctctgggaggtgttttcacttcaattgggaaagcacttcaccaagtatttggagccatatacggagcagctttttccggtgtaagctggacaatgaaaatactcataggagtaataattacttggattggtatgaacagtaggagtacttctttaagtgtctcattagtccttgtaggcgtcgtaaccctgtacttaggcgcaatggtacaggcagatagcgggtgtgtagtttcatggaaaaacaaagaacttaaatgcggatctggaatctttattaccgataacgtgcatacttggacggaacagtacaaatttcaaccagaaagcccaagcaaattagcatctgcaattcaaaaagcacacgaggaaggaatttgtggcatacgaagtgtgacacgactagagaatttaatgtggaagcaggttacgccagaacttaatcacattctaagcgaaaatgaagttaaactcacaatcatgaccggcgatataaaagggataatgcaggcgggaaagagaagtcttagaccccaaccaacagaattgaaatacagctggaagacatggggcaaagcaaaaatgctatcgacggaaagtcacaaccaaacattcttgattgatggcccagaaaccgcagaatgcccgaatacaaatagagcctggaacagcttagaagtagaagactacggattcggggtattcactactaatatatggctaaaactcagagagaaacaagatgtcttttgtgacagtaaactgatgtctgctgcaatcaaagataatagagccgtacatgcagatatgggatattggatagagtctgcgcttaacgatacctggaagatggaaaaggcttcctttattgaagttaagtcctgccattggccaaaaagtcacacattatggagtaatggagttctagaaagcgaaatgattatacctaaaaacttcgccggtcctgtcagccaacataactaccgaccaggataccatacacaaacggtgggaccttggcatttgggcaagctggaaatggattttgacttctgtgaggggactacagtcgttgttacagaggattgtgggaatcgaggtccttcgttaagaactacaacagcatcaggtaaattgatcacagaatggtgctgtcgatcatgtaccctgcctccgttacgttatagaggcgaggacgggtgttggtatggaatggaaataagaccattgaaagaaaaagaagaaaatttagtaaattcactggttactgcaggacatggacagatagataacttttccttgggcgttctaggcatggcattattcctagaagaaatgttaagaacaagagtgggaacaaaacacgctatacttctggtggcagtatcattcgtaacccttatcaccgggaacatgtcatttcgggatctcggaagggttatggttatggtaggagcaaccatgactgatgacatagggatgggtgtcacctatctagcacttctggcggcgtttaaagtaagacccacttttgctgctggactgttactacgaaaactcacttcgaaagaattaatgatggccacgattggcatcgcattattaagccaatccactatcccggaaacaatcttcgaactaacagatgccttagcattaggtatgatggtattgaagatcgtgcgtaatatggaaaaatatcagttggcagtaactattatggcgatcagttgcgtacccaatgcagtaatattacaaaatgcatggaaagtatcttgcacaatcttagctgctgtcagcgtaagcccgttactgttgacgagcagccagcagaaagcagattggattcctttggccttgacaattaaaggactaaatccgactgccatattccttaccacactttctcgcacaagcaagaaacgctcatggccacttaatgaggctataatggcagtcggcatggtatcaatcctggcttcttcgttacttaaaaacgacataccaatgacaggccccctagtagccggaggactattaactgtgtgttacgtactgactggacgatcggcagacctagagttggaaagagcggcagatgtcaaatgggaagaccaagctgaaatatcagggtcaagccccatattatccattactatctcagaagacggatctatgtctatcaaaaatgaagaagaggaacaaatattaacaatattaattagaactggacttttagtaataagcggtgtgtttcctgtatctattccaattaccgcagctgcctggtatttatgggaggtcaagaaacaaagagcaggagttttatgggatgtccccagcccaccaccggtcgaaaaagcagaattagaagatggtgcatacagaattaaacaaagggggattctaggttattcgcagataggagccggagtttataaggaaggaactttccacactatgtggcacgtaaccagaggggctgtattaatgcaccgaggtaagcgaatagagccaagctgggcagatgttaagaaagacctaatctcatatggaggcggctggaagttagaaggagagtggaaagagggagaagaagtacaagtattagcattagagccaggcaaaaaccctagggcggtacaaacaaaaccaggaatcttccgcacgaatacaggaactattggtgctgtatctcttgattttagccctggaacctcaggatcaccaatagtcgatcgtaaaggtaaggttgtcggactttatggtaacggtgtagttacgcgatcaggagcctacgtttcggcaattgcacaaacagaaaagtccatagaagataacccagaaatagaagacgatatatttaggaagaaacgactaaccatcatggatttacatcccggagctggtaagacaaaacgctacttaccagcaatagttagagaggccattaaacgtggattacgtacacttattctggctccaaccagggtagtagctgcagaaatggaagaagcactacgtggacttcctatcagatatcagacaccagctattaaagccgaacacaccggaagagaaatagtcgacttaatgtgtcatgccacattcactatgaggctattatcgcccgtgagagtcccgaactataatttaatcatcatggatgaggcacactttacggatcctgcttcaattgccgcacggggttatatttcgacccgggtcgaaatgggtgaagctgccggcatatttatgacggcaactcctccaggttcacgagatccatttccacaatcaaatgcaccaattatggacgaggaaagagaaataccggaacgcagctggaactcaggccacgaatgggttacagattttaaagggaagactgtgtggttcgtgcctagcataaaagcggggaatgatatagcagcttgcctaaggaaaaacggaaagaaagtaattcagcttagcagaaaaacattcgactcggaatacgttaaaactcgagcaaacgattgggattttgttgtaactacagatataagtgaaatgggagccaatttcaaggcagaaagagtaatagaccccagaagatgcatgaaaccagtgattctaacggatggtgaagaaagagtcatcttagcagggcccatgccagtaactcactctagtgcagctcaaaggagaggaagaattggacggaatcccaaaaatgaaaatgatcagtatatttacatgggagaaccgttagaaaatgacgaagactgtgcccattggaaagaggcgaagatgctactagacaacataaacactccagagggaataatcccttcaatgtttgaaccagagagagaaaaagtagatgcgatagacggagaatatcgactacgaggcgaagcccgaaagacatttgtcgatttaatgcgaagaggtgatcttcccgtttggcttgcttacaaagtcgcggccgaagggataaactatgccgatagaaagtggtgttttgacggaatcaaaaacaatcagattttggaagaaaatgtagaggtagaaatatggacaaaagagggtgagcgaaagaaattaaaaccaaggtggctagatgcgcgaatatattctgaccctcttgctttaaaagaatttaaagaatttgcggcgggaagaaaatctttaactttaaacttgattacagagatgggtagactccccacatttatgacacaaaaagctcgtaatgcccttgacaacctcgcagtattacatacggctgaagccggtgggcgtgcgtataaccatgctctaagcgaattgccagagaccctagaaaccctattattactaactttattagcaacagtaacgggcggaattttcttatttcttatgtcggggaaaggaattggtaagatgacattgggcatgtgttgtatcataactgctagcatcctcctctggtatgcgcagatacaaccacattggatagccgcatcaattatactagaatttttccttatcgttctattaatcccagaaccagaaaaacagcgtacccctcaggataatcagctaacatatgtggtgattgctattctgactgtggtggcagcgaccatggcaaatgaaatgggattcctagagaaaaccaagaaagatttaggtttaggcagcataacaacgcaagagtcagaaagtaatatacttgatatcgacctacgcccagccagcgcgtggacactttatgcagttgcgactacctttgtgactccgatgttacgtcacagtatcgaaaatagtagcgtaaacgttagtttaaccgcaatcgcgaatcaagcaacggtactaatggggctaggcaagggttggccactatcaaaaatggacattggcgtacctcttttggcgataggttgttactcgcaagtaaatccaataacgctgacagcagctcttttattgctcgtagcgcactacgctattatcggcccaggccttcaagccaaggccactcgtgaagcacaaaagagggcagccgccgggattatgaaaaatcctactgtagacggaataaccgtaatagatttggaacccataccatatgacccaaaatttgagaaacagttagggcaagttatgttattaatattatgtgtcactcaagtgctgatgatgagaaccacttgggcactttgtgaagcactaacattagcaactggccctatctcgacactatgggaaggaaatccagggagattttggaatactacaattgcagttagcatggctaatattttccggggaagctatctagccggtgcaggtcttttgttttcgataatgaaaaataccaccaatactcgtagaggcactggaaatataggggaaacgctaggagagaaatggaaaagtcgcctcaatgctttaggaaagtcggaatttcaaatatacaagaaatctgggatacaagaagtagaccgaacattggcaaaagaagggatcaaaagaggtgaaaccgaccatcacgcggtgtctcgaggatcagcgaaacttcgatggtttgtggaaagaaatatggtaactcccgaaggcaaagtggtggacttaggctgtggtcgcggtgggtggtcatactattgcggagggctaaagaatgtccgagaagtaaaagggttaacgaaaggaggtcctggacatgaagaacctatcccaatgagtacatacggatggaatctagtccgattacagagtggagtagatgtgttctttacgccgccagagaaatgcgacacactactatgcgatataggcgaaagttcgcctaatcctacaattgaggcagggagaacattaagagtactaaatcttgtcgaaaattggttaaacaacaatacgcaattttgtattaaggtactgaacccttatatgccatcagtcattgaaaagatggaaacattgcaaagaaaatacggaggggctctagtacgtaatccattatcaagaaacagtacccatgaaatgtactgggtttctaacgcaactggaaatattgtgtcttcagtaaatatgatttcgagaatgctgataaatagatttacaatgaaacataagaaagcaacttacgagcctgatgttgatttaggtagtggtacacgaaacataggcatcgaatctgagatcccaaacttagatataatcggaaaaagaattgagaaaataaaacaagaacacgagacatcatggcactatgatcaagaccacccgtataaaacgtgggcgtatcatggttcatacgaaactaaacagactggaagtgcatcctccatggtaaacggtgtagtacgtttgcttactaagccttgggatgtggttccaatggtaacgcagatggcaatgaccgacacaaccccattcggccaacaacgggtatttaaagagaaagttgacacacgtacgcaagagcctaaggaaggtacgaagaaattaatgaagatcaccgccgaatggttatggaaggaattgggcaagaagaaaacccctagaatgtgcacgagggaagagtttacaaggaaagtcagatcaaatgctgcgttaggggctatttttacagacgagaataagtggaagtcagcccgtgaagccgtagaagacggccgcttctgggaattggtcgatcgtgagcgaaatctacacttagaagggaaatgcgaaacttgcgtatacaacatgatggggaaacgtgaaaagaaattaggagaatttggaaaagctaagggatcaagagcaatctggtacatgtggttgggagcccgttttctagagttcgaggcactcggatttttaaacgaggatcactggttctcgcgaggcaacagcttgtcaggggtcgagggcgaagggcttcaccgactcggctacatattacgagacgtagggaagaaagaaggaggagctatgtatgcagatgacacagccggctgggacactagaataactttagaagatctcaaaaacgaagaaatggttacgaatcatatgaaaggcgaacataagaaactagcggaagcgattttcaaattaacatatcaaaataaagtagttcgagtacaacgtcctacaccaagggggacagtaatggatataatatctcgacgggaccaacggggaagtggacaggttggcacttacggattaaacacattcactaatatggaagctcagcttattagacaaatggaaggtgaaggaatttttaaatctatccagcatttaactgctacagaagaaatcgcagcacaaaactggctggccagagtcggccgagagcgtttatcacgaatggctatatccggtgacgattgcgtagttaaaccaatagacgatagattcgctagcgctctaacagccctaaatgatatgggtaaagtacggaaggatatacagcagtgggagccaagtcgaggttggaatgattggacacaggttccgttttgctctcaccattttcacgaactggtaatgaaagacggaagagtattagtagttccctgcaggaatcaggatgagttaataggaagggcgagaatctcgcaaggtgccggttggtcactcaaagagacggcctgtctggggaaatcttatgcacagatgtggaccttaatgtatttccacagacgagacttaagactcgcggccaatgccatatgctcagcagtcccatcacactgggtacccactagcagaaccacatggtcgatacatgcgaagcacgaatggatgactacagaagatatgttggccgtgtggaacagagtctggattcaagaaaacccatggatggaagacaaaacccccgtggagtcttgggaagaagtaccttacttgggcaaaagagaagatcagtggtgcggttcactaatcggattaacgtcgagagccacatgggcgaaaaatattcagacggcgataaatcaagtaaggtcattgataggaaatgaagaatacacagactacatgccatcaatgaaaagatttagaagagaagaggaagaagcaggagttctatggtaa

SEQ ID NO: 22291 - RNA, 9876 nt, synthetic construct
  misc_feature 1..9876: note = derived and/or modified CDS sequence (opt6) from DENV-2__GQ868554__SS-prME
  source 1..9876: mol_type = other RNA
acagcaggagtaatcgtaatgctcattccaactgcaatggcattccatttaacaacgaggaatggagaaccccatatgatagttggcaggcaagaaaaaggcaaaagtctgttatttaaaactgaagacggagtaaatatgtgtacgcttatggcgatcgatctaggggaactatgtgaagacacaataacctacaaatgtcccctactcagacaaaatgaacctgaagatatcgattgctggtgcaatagtaccagtacatgggttacgtatggaacttgtacaactacaggggaacatcgtagagaaaaacgaagcgtagcgcttgtaccacatgttgggatgggactggagacacgaacagaaacgtggatgtcttcagagggtgcatggaaacacgttcaacggattgaaacatggatcctaagacaccccggttttacaattatggcagcaatactggcgtataccataggaactactcatttccagcgggctctgatctttattttattaactgccgtagctccctccatgacgatgaggtgcataggaatatccaaccgagactttgtagaaggcgtgagtggaggctcatgggtagatatagtattagaacatggatcatgcgttacgacaatggcgaaaaataaacccactctagatttcgaattgataaaaactgaagcaaaacagccggccactctgaggaaatactgcattgaagctaaattgacaaacaccacaacagaaagtcgctgcccaacgcaaggagaaccatcattaaatgaagaacaggacaaaaggttcatctgcaaacattccatggtcgatagaggttgggggaatggttgcggattattcgggaaaggaggtattgttacgtgtgcaatgtttacctgcaagaaaaacatggaaggtaaagttgttcaaccagagaatttagaatatacaatcgttattacccctcattcaggtgaagaacatgcagtgggaaatgatacaggaaaacatggtaaagaaataaaaataacacctcagtcaagcatcacggaggcggaactaacgggttatggtacagtaacaatggagtgttccccacgcacgggactcgattttaatgagatggtgttgctgcaaatggaggacaaagcgtggcttgttcatcgacaatggttcttagaccttcccttgccatggctacctggagcggacacccaaggatccaactggatacaaaaagagacattagtaactttcaaaaatccgcatgccaagaaacaagatgtcgtagtccttggtagccaggaaggtgccatgcacaccgcactgactggcgctacggaaatacaaatgtcaagcggcaatcttcttttcaccggacatcttaaatgtagactcaggatggataaactgcagttgaaaggtatgagttatagtatgtgcacgggcaaatttaaaatcgtcaaagaaatagcggaaacacaacacgggacgattgtcatcagagtccaatacgaaggggacgggagcccttgtaaaattccattcgaaataaccgacctagagaaaaggcacgtgcttgggagactgataactgttaatcctatagtaatagaaaaagattctccagtaaatattgaagctgaaccgccattcggcgactcgtatataataattggtgtagaaccagggcaactaaaattaaactggttcaaaaagggcagtagtataggtcaaatgtttgaaacgacgatgcgaggagcaaagcgaatggctatcctaggtgatactgcatgggactttggaagtcttggtggagtatttacatcaatcggaaaagcgctacaccaagtatttggtgctatctatggggcagctttctcaggagtctcatggacaatgaaaattttgatcggggttgtaattacttggataggaatgaactcgagatccacctcactatcagtatctttagttcttgtaggtgtggtgactctatatttaggagccatggtacaagcagactcagggtgtgttgttagttggaaaaataaagagctcaagtgtggcagtggcatttttataacggacaacgtacacacatggaccgaacaatataagtttcaaccagaaagtccatcgaaactagcatcagccatacaaaaagcacacgaagagggtatctgcggtatccgatcagtgactaggctagaaaatctcatgtggaagcaaatcacaccagagcttaaccacattttgagtgagaacgaagttaaattaacaataatgactggagacacaaagggaatcatgcaagctggcaagaggtcacttagaccacaaccgactgaactcaaatacagctggaaaacttgggggaaagcaaaaatgttatcaacagaatctcacaatcaaactttcttaatagacggaccagaaacagtagaatgtcctaacacaaaccgtgcatggaacagtctcgaagttgaagactatggattcggagttttcacaactaatatatggctaaagttaagagaaaagcaagacgtattttgtgattcaaagttgatgtcggctgcaataaaggacaatagagcagttcatgcagatatgggttattggatagaatctgcattaaatgacacttggaaaatggagaaagcatcgtttatagaggttaaatcatgtcactggcctaaaagtcataccctatggtccaacggagtattggaatcagaaatgataatacccaaaaatttcgcgggtcccgtatctcaacataattacagaccaggatatcacactcagactgcgggcccatggcacctaggcaaactagagatggattttgatttttgcgagggaaccacagttgttgtaaccgaggattgtggtaatagaggtccctcacttcgtactactactgctagcggtaaacttataaccgaatggtgctgtcgtagttgcactctccctcctttacgttacagaggtgaagacggctgttggtatggaatggagataagaccactaaaagaaaaagaagaaaacttggtaaactctcttgtaactgcaggccatggtcaaatagataacttcagccttggcgttttgggaatggcattatttctggaagaaatgctcagaacacgtgtcggcacgaagcatgcaatcctcttagtagcagtgagttttgtcactttaattacgggtaacatgtctttccgagatcttgggcgcgtaatggtcatggtaggagctacaatgacagacgatataggcatgggtgtgacttatttagcgctactggcagcatttaaggtgcgaccaacgttcgcagctggcttgttactaaggaaattaacgagtaaagaattgatgatggcaactattgggataacactattaagtcaatccactatacctgaaacaatactagagcttacggatgcattggcgctaggaatgatggttttaaagattgtgagaaacatggaaaaataccaacttgcagtcacaataatggcaatatcgtgtgtcccgaacgcagtgatattaagaaatgcttggaaagtgtcgtgtacaatactagctgccgtaagcgtaagcccattacttttaacatccagccaacagaaggctgattggattccattagccctaactataaagggattaaatccgacagctatttttctgacaacgctaagtaggactagcaagaaacgatcttggcctctgaatgaagcaataatggcagtaggtatggtaagtattcttgccagttcacttctcaaaaacgatattcccatgactgggcctctggtagcaggagggttattaacagtttgctacgtattgaccggacgatcagcagatctcgagctagaacgagccgccgacgtcaaatgggaagatcaggccgaaataagtgggagttctcccatattgagtataactataagtgaagatggtagcatgagtatcaaaaacgaggaagaagaacaaacacttactatattaatccgtacaggccttttggttataagtggagttttccccgtgtctattccaataacagcagctgcatggtacttgtgggaagtgaagaaacaaagagctggggttttatgggatgtcccaagtccaccacctgtaggtaaagctgaattagaagacggagcgtatcgtataaaacaacgcggcattctcggctattcacaaataggcgctggagtatataaggaaggaacgtttcacacaatgtggcacgtaactcgtggagcggttttaatgcaccggggtaaacgaatcgagccctcgtgggctgatgtcaagaaagacctgatttcgtacggaggtggttggaagctcgagggtgagtggaaagaaggggaagaagttcaagtgttagcgttggagccaggaaagaatccaagggcagttcagacaaagccaggaatatttaaaaccaatactggcactatcggagcagtatcgctagatttctctccagggaccagcggaagtcctatcgttgacagaaaaggtaaggttgttggattatatggtaatggggtggttacccgctctggagcatacgtttcggcaatcgctcaaaccgaaaagtcaattgaagataatcccgaaatagaggatgatatatttagaaagaaaaggctaactattatggaccttcacccaggggctggaaaaactaaacgatatctaccggcgatcgtcagagaagcaataaagagaggactgcgcacacttatacttgcaccgacgagagtagtggcagctgaaatggaagaagcccttagaggcttaccaataaggtatcaaacgccagctatcaaagcggaacacacgggaagagagatagtggacttaatgtgtcacgctacatttacgatgcgattattatctcccgttcgagttccaaattataatttaataataatggatgaggcccacttcacggatcccgcaagcatagcagcacgagggtacatatcgacaagagtagaaatgggagaagctgcagggatcttcatgactgcgacacccccaggatcaagagaccctttcccacaaagcaatgccccaataatggatgaagaaagagaaattccggaaagatcctggaactcaggccatgaatgggtcacagacttcaaaggtaaaacagtctggtttgtcccaagcataaaagcgggtaatgatatagcagcatgtcttcgaaagaatggaaagaaagtaattcagttaagcagaaaaaccttcgattccgaatatgttaaaactagggctaatgactgggactttgttgtcacgacagatataagtgaaatgggtgccaacttcaaagcagagagagttatagatccacgaagatgcatgaaaccagtaattcttacggacggggaagaaagagtgatattagctggacctatgcccgtaacacactctagtgcagctcaaaggagaggaagaattggaagaaaccctaaaaatgaaaacgaccaatatatctatatgggagaaccattagaaaatgacgaagattgcgcgcattggaaagaggcgaaaatgctcttggataatataaacactccagagggaatcataccatccatgtttgaaccggaaagagaaaaggtagatgcaatcgacggcgaatatagactacgaggagaagcccgaaaaactttcgtggatctcatgagaagaggagatcttcccgtttggcttgcatataaagtcgcggccgagggaattaattacgcagaccgtaaatggtgctttgatggaattaagaataatcaaatactcgaggagaacgtcgaagtagagatttggactaaagaaggcgagcggaagaaactaaaaccaaggtggttagacgcgagaatatatagtgatccacttgctttaaaagaatttaaagaatttgcagccggccgcaaatcattaacactaaatctcataaccgaaatgggaaggttacctacgtttatgacacaaaaagctaggaacgcattagataacttagctgtcttacacacagctgaagccggcggtagggcatacaatcacgcactatcagaattaccagaaactctggagacattactcctcctcacattactagcaacagtaactggaggcatatttctattcttaatgagcggcaaagggataggtaaaatgacattaggtatgtgctgcattatcactgcatctgtactcctatggtacgctcaaattcagccacattggatagcagcgtcgatcattctcgagtttttcctaatagtcctattgattcccgagccggaaaagcaaagaactcctcaagataatcagttgacatacgtagtaatagcgatattgaccgtcgtagcagcgactatggcgaatgaaatggggttcctagagaaaaccaaaaaggatctaggcttaggctcaattactacgcaggaaagcgaatcaaatatactagatatagatctacgaccagcctctgcctggacattatatgccgtagccacgacctttgtaactccaatgctgcgacactcaatagaaaattcaagtgttaacgtttcattgacggctattgccaatcaagcgacggttttaatggggttaggaaaaggctggccattatcaaagatggatatcggggtaccgttgcttgcaataggatgttactcccaagtgaacccaattactctgacagctgctctgctactactcgtagcacactatgcgataattggccccggcttacaagcaaaggctactcgtgaagcccaaaagcgtgcggcagccggaatcatgaaaaatcctaccgtcgacggaataaccgttattgatttagagcccattccctacgacccaaaatttgaaaaacaactgggtcaagtcatgttactaatactatgcgtaacgcaagtgctcatgatgaggacaacgtgggcattatgcgaagcacttaccttagcgaccgggccaatttcaacactgtgggagggaaacccgggtcgcttttggaatacgacaatagcggtttcgatggccaatatatttaggggaagttatctcgcaggggccggactattgttctcaataatgaaaaatacaacaaacacacggcgcgggacaggaaatataggtgagacactaggtgagaaatggaaatcacgattgaatgccctaggaaagagtgagttccaaatttacaagaaatcgggcatacaggaagtcgatagaactttagccaaggaggggattaaaagaggtgaaacggatcatcatgcggtttcacgaggaagcgcgaaattaagatggtttgtggagcgtaacatggttacaccagaaggaaaggttgtagacttaggttgcggtcgaggaggctggtcatactactgcggaggattaaagaatgtcagagaagtaaagggtctcacaaaaggaggccctggacatgaggaaccgattcctatgagtacatacggctggaatctcgtcaggttacagagtggagtagacgtctttttcactccacccgaaaagtgtgatacgcttttgtgcgacataggtgaaagtagccctaatccgacgattgaagcaggacgaacactacgagtccttaatcttgtagaaaactggctaaataacaatacacaattttgcataaaggtccttaatccgtatatgccatccgtaattgagaaaatggagacattacaacgaaaatacggcggagccttggttcgaaacccattgagtagaaattctacccatgaaatgtattgggtcagtaatgccacaggcaacatagtttcttcagtcaacatgatcagtagaatgctaataaacagattcacgatgaaacacaaaaaggcgacctatgaaccggatgtagacctggggagcggaactagaaatatcggaatagaatcagaaataccgaatttagatataataggcaaacggatagagaaaataaagcaggaacacgaaacatcatggcactacgatcaagatcatccatataaaacttgggcttatcacggatcctacgaaaccaaacaaaccggctccgcatccagcatggttaacggagtggttagactcttaacaaaaccttgggatgtagtgccaatggtaactcagatggcaatgaccgacaccactccctttggtcaacagagagtatttaaagaaaaggtggatacacgaacgcaggaacccaaagaagggacgaagaaattaatgaggattacggcagagtggctttggaaagaactcgggaagaagaaaactccaaggatgtgtacgcgggaggagttcacaagaaaagtacgctcaaatgccgctctcggagcgattttcaccgatgagaataagtggaaaagcgcaagagaggcagtcgaggacgggcgcttttgggaattagtagacagggagaggaatctacatcttgagggaaagtgcgagacttgcgtatacaacatgatgggaaaaagagagaagaaacttggtgagttcggcaaagcgaaaggaagcagagctatatggtacatgtggctaggggcacgcttcctggagttcgaggcgctaggctttttgaatgaggaccactggttttctagaggaaacagtctttcgggggtcgaaggcgaaggtctgcacagattgggctatatactgagagatgtaggaaagaaagaaggcggtgcaatgtatgcagatgatacagcaggttgggatacccgaatcaccttagaagacctgaaaaacgaagagatggtgaccaaccacatgaaaggagagcataaaaagttagcagaagcaatatttaaattaacatatcagaacaaagttgttcgcgtgcaaagaccaaccccacgagggacagtgatggatataataagtagaagagaccagcgaggcagtggtcaagtaggaacatacggtctaaatacctttactaatatggaagcacaactgatcagacaaatggaaggggaaggtatctttaaatctatccaacacttaaccgccacagaagaaatagcagtgcaaaactggttagcacgggttggacgagagcgtttaagtagaatggcgatttctggagatgactgcgtggtcaagccaatagacgaccgatttgcttcagcactaactgccctaaatgatatgggaaaagtacgaaaagatatacaacagtgggaacctagtagaggctggaatgattggactcaagtaccattttgttcacatcatttccatgaattggtcatgaaagatggtagagtattagtagttccttgtcgaaaccaggatgaattgatcggaagggcacgaatatcacaaggagcgggttggtctttaaaggagacggcatgcttaggtaaatcatatgcacaaatgtggactctaatgtacttccatagaagggacctcaggctcgcagcaaatgctatatgctcggccgtcccttcgcactgggtaccaacaagtcgaacaacatggagtatacatgctaaacatgagtggatgacaaccgaagatatgttagcggtatggaatcgagtttggatacaagagaacccttggatggaagataaaacaccagtggagagttgggaggaagttccctacctgggaaaaagagaagaccaatggtgcggctccctaatcggacttacatcacgagccacgtgggcaaagaacatacagaccgctattaatcaagtaaggagcttaatcggaaacgaagaatacaccgactacatgcccagtatgaaacgttttagaagggaagaagaagaagcgggtgtactatggtaa

SEQ ID NO: 22292 - RNA, 9876 nt, synthetic construct
  misc_feature 1..9876: note = derived and/or modified CDS sequence (opt6) from DENV-2__GQ868555__SS-prME
  source 1..9876: mol_type = other RNA
accgcaggcgtaatcgttatgctgattccgacggcaattgcattccatttaaccacacgtaacggcgaaccacatatgatagtaggcaggcaagaaaaagggaaatctctattgtttaaaacagaagatggtgtgaatatgtgcactcttatggcaattgacttgggtgaactgtgtgaagacacgataacatataaatgtccactactaagacaaaatgaacctgaagacattgactgttggtgcaactcaacctcaacatgggtaacgtatggaacctgcacaacgacgggcgaacatcgacgtgagaaaagatcggtagccctagtaccgcatgtagggatggggctagaaactagaacggaaacatggatgtcatctgaaggggcatggaaacacgtacaaagaattgaaacctggatattgagacatccaggttttacaataatggcggctattcttgcatataccattggtactacacacttccaacgagcactaatattcatactattaaccgctgttgcaccctcaatgactatgcgttgcataggcataagcaacagagatttcgtagaaggagttagcggcgggagctgggtagatatagtactagaacatgggtcttgcgtgacaaccatggccaaaaataaacctacgttggattttgaactgataaaaacagaagctaaacaacccgcaaccctaaggaaatactgcattgaagccaaattgactaacacaacgaccgagtcaaggtgcccgacacaaggtgaaccgtcactgaatgaagaacaagacaaaaggtttatttgtaaacactctatggtagacagaggatgggggaacgggtgtggattatttggtaaaggaggtatcgttacatgcgcaatgtttacctgcaagaaaaatatggaagggaaagttgtacaacctgaaaacttagagtatacgattgtaataactccccacagtggcgaagaacatgcagtagggaacgatactggtaaacacgggaaagaaatcaaaattacacctcaaagttcaattactgaggccgagttaacagggtacggaaccgtaacgatggaatgttccccaaggacaggactggactttaatgagatggtattacttcaaatggaagataaagcatggttggtgcacagacaatggtttcttgacttacccctaccctggctacctggagcagacactcaaggatcaaactggatacagaaagaaaccttagtaacattcaaaaacccacatgcgaagaaacaagacgtagtagtactaggatcacaagaaggtgcaatgcacactgcccttaccggggccaccgaaatacaaatgagcagtgggaatcttttattcacgggacacttaaaatgtaggctaagaatggataaactccaactgaaggggatgagctactcaatgtgtacaggaaaatttaaaatagtaaaagaaattgcggagacccaacacggcacgatagttatacgagtgcaatatgagggcgatggttccccctgcaaaatccccttcgagataacagacttggagaaaagacacgtgttaggacgactgataaccgtaaatccaatagttaccgaaaaagattcccccgttaatatagaagctgaaccaccttttggagatagctacattattattggggtggaaccaggacaactaaagctcaattggtttaagaagggttcatcgatcgggcagatgttcgagactacaatgaggggagcaaagagaatggcaatattaggagataccgcttgggacttcggaagtctcgggggtgtattcacatccataggtaaagcgttacatcaggtatttggggcgatttacggagcagcctttagtggagttagttggactatgaaaatcttaataggagttgtcataacatggatcgggatgaactccagatctacatcgctttcagtttcgctggtcttggtaggagtagtaactctttaccttggggcgatggttcaagctgattcaggctgtgtagtcagctggaaaaataaggaactaaaatgtggctcaggaatatttataaccgataacgtccatacctggaccgagcaatataaattccagcctgaatcacctagtaaactcgcaagtgcaatacaaaaggcacacgaggaaggaatttgtgggattagaagtgtcaccaggttagagaatttgatgtggaaacaaataaccccggaactaaatcatatactatctgaaaacgaagtcaaactaacgatcatgactggcgatacaaagggcatcatgcaagccggaaaaaggtcactgaggccccagccaactgaattaaaatattcgtggaaaacatgggggaaggctaaaatgttgtcaacggaaagtcacaaccagacgtttctcatagatggcccagaaaccgcagaatgcccgaacacgaatcgtgcttggaacagtttggaagtcgaagattatggatttggggtcttcacaacaaacatctggttaaagctaagagaaaaacaagacgttttctgtgactccaagctaatgtccgcggctataaaggataatcgggcggtacacgcagatatgggatactggattgaatcagcattgaatgacacatggaaaatggaaaaagcatctttcatcgaagtaaagagctgtcattggccgaaatctcacaccctatggtcaaatggcgtcctagaatcagaaatgataatacctaaaaactttgcaggaccagtgtcacaacacaattataggccagggtaccatacacagactgcaggaccatggcacttaggaaagttagagatggatttcgacttatgcgaaggtacaactgtcgttgtaaccgaagactgtggtaacagagggccaagtctgcgcactaccacagcatcaggtaaattgataacagaatggtgttgtcgatcgtgcacattgcctcctcttagataccgtggagaagacggttgctggtatgggatggaaataaggcccttaaaggaaaaagaagaaaacttagtaaatagtttggtaacagctgggcatggccaaatagacaatttctctctaggcgttttgggtatggcattatttttagaagagatgctgaggacaagagttggaaccaaacatgccatattattagtggcggtaagttttgtaacccttatcacggggaatatgtcctttagagatctagggagagtcatggtaatggtcggagcaactatgaccgatgatatagggatgggcgtaacgtatctagcgttactagctgcgtttaaagtacgccctacattcgcagcaggactcttgttaagaaaattgacgtccaaagagcttatgatggctacaataggcatagcattactttcacaatccactataccggagaccatacttgagctgaccgatgccctcgccttaggcatgatggttttaaaaattgtcagaaatatggaaaagtatcaactcgcagtaacaattatggcaatctcatgcgtaccaaacgcagtaatcctgagaaatgcttggaaagtctcctgtaccatacttgcagccgtgtctgttagtccgctcttactaacaagttcccaacagaaggctgattggatcccattagctttaaccattaaagggttgaatcctaccgctattttcctgacaactttatctagaacaagcaagaaacgaagttggccacttaatgaagcaataatggcagtaggaatggtgagtattttagcttccagcttattgaaaaatgatataccaatgacagggcccctagttgctggcggattattaactgtctgttatgtactaactggaagaagtgcagatctagaacttgaacgagcggctgaagtaaaatgggaagaccaggcggaaatttcaggctcgtccccgatcctctcgattacgatttcagaagatggttcaatgtctatcaaaaacgaagaagaggaacaaactttaactatactaattcgaacaggcctacttgttatatctggagtgtttcctgttagcatacctattactgcggcagcatggtatttatgggaagtcaagaaacaacgcgcaggagtgttgtgggatgtaccaagtcctccacccgtagggaaagctgaattagaagaaggagcatatcggattaaacaacgtgggatattaggatatagccaaataggtgctggagtatacaaggaaggaacatttcataccatgtggcatgttacaagaggcgcagtacttatgcataggggaaagcgtatcgaaccatcatgggcagatgtcaagaaagatctgataagctacggcgggggatggaaacttgagggtgaatggaaagaaggagaggaagttcaagtgttggcattagagcctggtaaaaatccaagagctgtgcagacaaaaccgggaatctttaaaactaacacaggaaccataggagcagtgtcactagatttctccccgggcacatcgggatctccaatagtggatagaaaaggaaaagtagtgggactatatggaaatggcgtagtcacgagaagtggagcctatgtatcagccattgctcagacagaaaaatcaattgaggataacccagaaattgaggacgacatttttcgtaaaaagcgtctaacaattatggatctccatccgggtgcagggaaaacaaagcgttatcttccagccatcgttcgagaagccataaaaaggggcttaagaacacttatactagctccaacccgagttgtcgcagcagaaatggaagaagcgttgagaggattacctatcagataccaaactccagcaattaaagccgaacacaccggaagagaaattgtcgatctaatgtgccatgcgactttcacgatgagacttctttccccggtacgagttccaaactacaatttgataataatggacgaagcacatttcaccgatccagcatctatagccgctcggggctatatatcaactagggttgagatgggtgaagctgcagggatattcatgaccgcaacaccccctggtagccgtgatccgttcccgcaaagtaacgcccccataatggacgaggaacgagaaatcccagagcgcagttggaactctggacacgaatgggtgacagactttaagggaaagactgtgtggttcgtgccttcaattaaagctggaaacgatatcgcggcatgtttacgaaagaatggtaagaaagtaatacaacttagcagaaaaactttcgactcagaatatgttaaaacgagggccaacgattgggactttgtcgtaaccactgatatctcggaaatgggggccaactttaaagcagaacgagtgatcgacccgagaaggtgcatgaaaccagtaattttgacagacggagaggaaagagtgatcttagcaggaccaatgcccgtaactcatagttcggcagctcaacggagaggtagaatagggcgaaatcccaaaaatgagaacgatcaatatatatatatgggtgagccactagaaaacgacgaagactgcgctcactggaaagaggccaaaatgctattggataatataaacacgccagagggaataataccctcgatgtttgaaccggaaagagaaaaagtagacgcaattgatggtgaatataggctaagaggtgaagcccggaaaacgtttgtagacctaatgagaagaggtgacttaccagtatggttagcatataaagtggcagccgagggtattaattatgcggatagaaaatggtgttttgatgggattaaaaataaccaaatactagaagaaaatgtggaggtagaaatatggactaaagaaggagaaaggaaaaagttaaaacctcgttggctagatgctcgcatatatagtgatccactcgcattaaaggagtttaaggagttcgctgctggtagaaaaagtctaactttaaatttaattacagaaatgggaagattgcctacattcatgacccagaaggccagaaacgcgttagacaacttggcagtcctccacaccgcagaggcaggcggccgagcttacaaccacgctttatcagaattaccagagactttagaaactttgctactactgacccttttagcaacagtgactggaggaattttcctctttcttatgtcgggaaaaggtataggaaagatgacacttggaatgtgttgcatcataactgcaagcgttttattatggtatgcccaaattcagcctcattggatagcagccagtataattttggaatttttcttgatagtgttgttaatccccgaacctgagaaacagagaacaccacaggataatcaactaacgtatgtcgtaattgctattctgaccgtggttgcagccacaatggctaacgaaatgggattcttggagaaaactaagaaagacctcggccttggatctataaccacacaggaaagtgagtccaacatattggacattgaccttagaccagcaagcgcatggaccctttatgctgtggcaacaacttttgtaaccccaatgttacggcactctatagaaaattcaagcgtgaatgtttcgcttacggctattgctaatcaagctaccgtgctaatgggtttaggtaaaggatggcctttatcgaagatggacataggcgtacctttattagctataggttgctatagccaagtaaacccaattactcttacggctgctctattgttacttgtggcacattatgcaataattggaccgggtttgcaagcaaaagctacaagagaggcacagaaaagggccgccgcaggaatcatgaaaaatccaacagtagatggcataactgtcatagacttagaaccaattccttacgatcccaaattcgaaaaacaacttggacaggtaatgcttctaattctctgtgtaactcaagttctgatgatgcgaacgacatgggccttgtgcgaagccttaacactcgcaacgggacctatctcaaccctatgggagggtaatccaggacgtttttggaatacaacaatcgcggtttcaatggccaatatattccgtggatcttatttagctggtgcagggctgctctttagtataatgaaaaatactacaaatacaaggcgtggaactggtaatataggtgaaacattaggagagaagtggaaatcaaggttaaacgcccttggaaaatctgaatttcagatatataagaaaagtggtattcaggaagttgatagaactcttgctaaagaaggtattaaacgtggagaaactgaccatcatgcggtaagccgaggatccgctaaacttaggtggtttgtagagcgtaatatggttaccccagaagggaaagtagtagacttgggatgcggtcgaggaggttggtcgtactattgtggcggactcaaaaacgtacgtgaagtcaaaggtcttacaaaagggggacccggccatgaagaacccattccaatgagcacatatgggtggaacctagtaaggttgcagtcaggagtagatgtcttctttacccctccggagaaatgtgacacactactgtgcgatattggagaatccagtcctaatccaacgattgaagccggaagaacgctacgagtattgaacttggtcgaaaattggctcaacaataacactcaattctgtataaaagtactaaatccgtatatgccatcggtgatagagaaaatggaaacgttacaacgtaaatacggaggagcactggtaagaaacccccttagcagaaatagcactcatgaaatgtattgggtatccaacgcgactggaaacatagtgtcctcagttaatatgatctcaaggatgctgataaatagatttactatgaaacataagaaagcaacatatgaaccagatgtagacttgggcagtgggacgcgaaatatcggaatcgaaagcgaaattcccaatttggatattatagggaaacgaatagaaaagataaaacaagaacatgaaacgtcatggcactatgatcaggaccatccctataaaacatgggcttaccatggcagctacgagacaaaacaaacagggtctgccagctcaatggttaacggtgttgtcagattattgactaaaccatgggatgtggttccaatggtaacacaaatggccatgacagacacaacaccatttggtcaacaaagagtatttaaggaaaaagtggatacacgaacacaggaaccaaaagaaggtacgaaaaagttaatgaagatcactgccgagtggttgtggaaggaactcggaaagaagaaaacacctcgtatgtgcacacgtgaagaatttactcggaaggtacgcagcaatgctgccttaggtgcaatttttaccgacgaaaacaaatggaagtcagcgagggaagctgtagaagatggccgattttgggaattagtagatagagaaagaaacttacatctcgaaggtaaatgtgaaacttgtgtatataatatgatggggaagcgggaaaagaaactgggtgagtttggtaaggctaagggatccagagcaatatggtacatgtggcttggtgcaagatttctagaatttgaggcgttgggatttttaaatgaagatcactggttttcaagaggaaactcgctttctggagtagagggggaaggcttacatcggctcggatatatattacgagatgtaagcaagaaagaaggaggtgcgatgtatgcagacgacacagctggttgggatacgaggatcactttggaagacctgaaaaacgaggaaatggtaacaaatcacatgaaaggagagcataagaaactcgctgaagcaatttttaagttaacttaccaaaataaggtagtaagagtgcaacgaccaactcctcggggtacggtaatggatatcatttctcgccgagaccaaaggggttccgggcaagtagggacctatggtttaaacacatttacaaacatagaagcacaacttataagacagatggaaggagaggggatatttaagtcaatccaacacttaaccgcaacggaggagatcgctgtacagaattggctagcaagagtaggacgggaacgtttaagtaggatggcgatctcaggggatgattgtgtagttaagccaatagatgatagatttgcttcggccctgaccgcactaaatgacatggggaaggtgaggaaagacatacaacaatgggaaccctcgagaggctggaatgattggacacaagtacccttttgctcgcaccactttcatgaacttgtcatgaaagacggccgcgtattagtagtcccttgtcgaaatcaagatgaattaattggtagagcacggataagccaaggggccgggtggtcgttaaaagaaacagcatgcttaggtaaaagctacgctcaaatgtggactctaatgtattttcaccgacgcgatttaagacttgcggcaaatgcaatatgtagtgctgtaccatctcactgggtacccacttcacgcaccacgtggtctattcacgcgaaacatgaatggatgacaacagaagatatgctagctgtatggaatagagtatggattcaagaaaatccatggatggaggataaaactccagtagagagctgggaagaagtaccatacctcggtaagagagaagaccagtggtgtggtagtcttataggtctaacatctagagcaacatgggccaaaaatatacaaactgctataaatcaagttagatcgttaattggaaacgaggagtatacagactatatgccatcaatgaaacggttcagaagagaagaagaagaagcaggagtattatggtag

SEQ ID NO: 22293 - RNA, 9876 nt, synthetic construct
  misc_feature 1..9876: note = derived and/or modified CDS sequence (opt6) from DENV-2__GQ868556__SS-prME
  source 1..9876: mol_type = other RNA
actgcaggcgttattgtaatgctaattccgacagcaatggcttttcaccttacgacacgaaacggggaacctcacatgattgttggacgacaagaaaaagggaaatcgttattatttaaaacagaagatggagtaaacatgtgtaccctcatggctatagacttaggagaactctgtgaagacactattacttacaagtgtcctctgctgaggcagaatgaaccagaagacattgattgctggtgtaactccacgagtacttgggtaacttacggaacgtgtacgactactggtgaacacagacgagaaaaacgatccgtggcgctggtgccacatgtaggaatgggcttagagacacgaactgagacttggatgtcatcggaaggagcctggaagcatgtacagaggatagaaacgtggatattacgacatcctggattcacgataatggccgccattctagcctataccataggaactactcacttccaacgtgccttaatatttattctgctaacggcagtagccccatccatgacaatgcggtgcataggcataagcaatagagactttgttgaaggagtgtcaggtggttcatgggtagatatagttttagagcacggatcctgcgtaacaacaatggctaaaaataaaccaacactagacttcgaacttataaagacagaagctaaacagcctgcgaccctaagaaaatattgtatagaagcaaaacttacaaacacaactactgagtcccgatgcccaacacaaggtgaaccaagtcttaatgaagaacaagacaagaggtttatctgcaaacacagtatggttgatcggggatggggaaacggttgtggactattcggtaaaggtggtattgttacgtgtgcgatgtttacatgcaaaaaaaatatggagggtaaagtggtccaaccagaaaatcttgaatatacgatagtaataacgccacactcaggagaagagcatgcagttggaaacgatacagggaagcatggaaaagagataaaaatcaccccacaaagttcaattacagaggcagagctcacaggttacggaacggtgaccatggaatgcagtccacgtacaggtctcgactttaacgaaatggtattgttacaaatggaggacaaagcatggctggtacatagacaatggtttctggatttgccactaccatggcttccaggggcagatacccaaggatccaattggatacaaaaagaaacgctcgtaacgtttaaaaatccgcacgcgaagaaacaagatgtagtagtattgggtagccaggagggggcgatgcatactgcattaactggagcaacagaaatacagatgtctagcggtaatttactatttacaggtcatttaaaatgccgactcagaatggataaactgcagctcaaaggtatgagctattctatgtgcaccgggaagtttaaaatagtgaaagaaattgcagaaactcagcatggaacgatcgtaattagggttcaatacgaaggtgacggtagcccgtgtaaaataccgtttgagataaccgatttggaaaaacgacacgtacttggtcgactcataacggtgaatccgatagtaatcgaaaaagatagtcctgtgaacatagaggcagagcctccattcggggactcgtatatcataataggagtagaacctggacaattaaaacttaactggtttaaaaaaggatcctctataggacaaatgtttgaaacgacaatgcgaggtgcaaaaagaatggctatattaggagacaccgcctgggatttcggatctctcggcggagtttttacttctataggaaaggcgctccatcaagtattcggtgcgatttatggcgctgctttcagtggcgtatcttggacgatgaaaattcttataggagtggtcataacctggataggcatgaatagccgctcgacatcactgtcagtatcattagtgttagtaggggtagtaacattgtatttaggtgcaatggtacaggcggactcgggttgtgtggtatcctggaaaaacaaagaactaaaatgtggatccggaatatttataacggataacgttcatacatggacagaacagtacaaattccaaccagagtcaccctcgaaactcgcgtcagcgatccagaaagctcatgaagaagggatttgtggtattcgaagcgtcactaggctagaaaacctaatgtggaaacagatcacaccggagcttaaccacatcttatccgaaaacgaagtcaaacttacaataatgacaggagatactaaagggatcatgcaagcgggcaagaggagtctcagaccgcaaccgaccgaattaaaatattcgtggaaaacttggggcaaagcaaaaatgctgagtactgaatcacacaatcagactttcctaattgatggacccgaaactgctgaatgtccaaacacaaatagggcctggaatagtttagaagtcgaagactatggatttggcgtattcacaacgaatatatggttaaaattaagagaaaaacaggatgttttttgcgacagtaaacttatgagcgccgctataaaggacaatcgagcagttcatgctgacatgggttattggattgagagtgcactaaatgatacctggaaaatggaaaaagcatcatttatagaagtaaaaagctgccactggcccaaatcgcatactttatggagcaatggagttcttgaaagcgagatgataataccaaaaaactttgcgggtccagtaagtcaacacaattatagaccaggttatcatacacaaacggctgggccttggcatcttggaaagctagaaatggattttgatttctgcgagggaactactgtagtagtaactgaagattgcggtaatcgtggacctagcttaaggactaccacagcctctggaaaattgataaccgaatggtgttgccgtagctgtaccctaccacctctccgctatcgaggagaagacggatgttggtacggaatggagataagacccttaaaagaaaaggaagagaatttagttaattcactggttaccgccgggcacggtcaaatagataacttctcattaggagtattgggaatggccttattcttagaagagatgctgcgaacccgagtaggaacaaaacacgccatcttactcgtcgctgtatctttcgtaactctaataacagggaatatgagctttagagatctcggaagggtaatggtaatggttggtgccactatgacggatgatatcggtatgggggtcacatatttagctttacttgcagcatttaaagtacggcccacttttgcggctggtttactattgagaaagctaacttcaaaggaattaatgatggcgacaatcggaataacactactcagtcaatctacgattccggagaccatattagaattgacagatgcgttagcgctaggaatgatggtcctaaaaattgtgcggaacatggaaaaatatcaactagctgtcacaataatggcaattagttgtgttcccaatgcagtaattttaagaaatgcctggaaagtatcttgtacaatattggctgcagttagtgtgtcgccacttttattgacatcttctcaacaaaaagcagactggataccactagcactaacgattaaaggtctcaatccgacggcaatctttctaactacattgagtaggacatcaaaaaagcggtcttggcccttgaatgaagcgattatggcagtaggaatggtaagtatattagcatcttctttgttaaaaaatgacattcccatgacgggtccactagttgctgggggtttgctgactgtatgctacgttttgactggaagaagtgctgacttagaattagaacgagcagctgatgtcaaatgggaagatcaagctgaaatatcgggcagttccccaattctcagtataacgatctccgaggatggatccatgtcaataaaaaatgaggaggaagagcaaacgttaactatactaataagaactggtctgttagtaatatctggtgtttttccagtcagtatacctataactgcggctgcttggtatctatgggaagtaaagaagcaacgtgcaggagtactttgggatgtcccaagtccaccaccggttgggaaggcagaattagaagatggcgcctatcgaataaaacagagaggaattctcgggtattcacagataggggccggagtatacaaagaagggacatttcacacgatgtggcacgtaactagaggagccgttctcatgcaccgaggcaaaagaatagaaccaagttgggccgatgtcaaaaaagatttaatatcatacggtggaggctggaaactagagggtgaatggaaagaaggagaagaggttcaggtcctcgccctagaacctgggaagaatccgcgtgcagtacagacaaaaccaggaatcttcaagacaaatacaggtactataggtgcagtttctcttgatttttcccctggtactagtggtagtccaattgttgaccgcaagggaaaagtggtagggttatacggtaatggagtagtaactcgatcaggcgcgtacgtctctgcaatcgcgcaaacggaaaaatcgatagaggacaaccctgagatagaagatgatatatttcggaaaaaaagattgacaataatggacttacatcctggggctgggaagacgaagcgctacttaccagcaattgtccgcgaggcaattaagagaggattacggacattaatactagccccaacgagagtcgtagcagcagagatggaggaggcgttaagaggccttccgatccggtatcaaacccctgcgatcaaagcagagcatacggggcgagaaatagtcgacctaatgtgccacgcgacattcacgatgaggttactttcgcccgtacgagtgcccaattataacttaattataatggacgaggcacacttcacagaccctgccagtatagcagcaagaggatatatttctactagagtggaaatgggagaagcggccggcatattcatgaccgctactccccctggtagtagggatccgttcccccaaagcaatgcgcccatcatggacgaagaaagggaaatacctgaaagatcttggaattcaggacacgagtgggtgactgacttcaagggaaaaacagtctggtttgtgccgtcaattaaagctggcaatgacatagcggcatgtttaagaaaaaatggaaaaaaagttatccaattatcaaggaaaacatttgatagcgaatatgtcaagacaagggcaaatgattgggattttgtagtgactacagatataagtgaaatgggcgcaaactttaaagcggaacgcgtaatagatcctcgtagatgcatgaaaccagtaatccttactgatggggaagaacgggtaattctcgccggaccaatgccagtaacccatagcagcgctgcccaaagaagaggccgtataggaaggaaccctaaaaacgagaacgatcagtatatctatatgggagaaccactagagaatgatgaggattgtgcgcactggaaggaagcgaaaatgttactcgacaacatcaataccccagaaggaataatcccgtcaatgtttgagccagagcgtgaaaaagtcgacgcaatagacggagaatataggttgcgtggcgaggcgagaaaaactttcgtagatcttatgaggcgaggagatttaccggtatggttagcttataaggtagctgcagaaggtataaattatgcagacaggaaatggtgtttcgacggcatcaaaaacaatcaaattctagaggaaaacgtagaagtagagatttggacaaaagaaggagaaagaaaaaaattaaaaccccgctggttggatgctcgaatctattcagacccattggctcttaaagagtttaaagaatttgcagccgggagaaagtccttgaccttaaatctcatcaccgaaatgggtagattacctacctttatgactcagaaagcccgaaacgctttagataaccttgccgtcctacatacggccgaagctggaggcagagcttacaatcatgcactgtcggaactcccagaaactttagaaaccctattactattaacattactagccactgtgactggcggaatctttctatttttaatgtcaggtaaaggaataggaaagatgacattaggtatgtgctgcataatcacagcatctgtgttgttatggtacgcacaaattcaacctcattggatagctgcctccataatcttggaattcttcctaattgtactactaataccagaaccagaaaaacaaagaactcctcaggataatcaactaacgtacgtagtcatagcaatacttaccgtagtagcggcaaccatggcaaacgaaatgggatttctagaaaagactaagaaagatttaggattgggcagtataacaacgcaagaatccgagagcaatattcttgatatcgaccttaggccagctagtgcttggacgctttatgcggtagcaaccacttttgtaactccgatgctacgacattcaatagaaaactcatctgttaatgtatctttaacagccatcgcaaaccaggccaccgttctaatgggattaggcaaaggatggcctttatccaagatggatatcggggttcccctactagcaattgggtgttattcacaggttaacccaataactctgaccgctgcactcctgttgctcgtggcacactacgcaataatcgggccggggctgcaagccaaagcaacacgagaagctcagaaaagagcggccgcagggattatgaagaatccaacagtggatggtataactgttatagacttagaacctattccctatgatccgaagttcgaaaagcaattaggacaggtgatgctccttatcctttgcgtcactcaggttctgatgatgagaacaacatgggccctgtgcgaggccctaacgttagcaactggcccgatatccactctctgggagggtaatccaggtaggttttggaatactacaatagcagtaagtatggcaaacatttttagaggatcttatttagcaggggctggactgttatttagcataatgaagaacacaacaaatacaagacgaggaacaggcaatatcggcgaaacgcttggtgaaaagtggaaatcacggttgaatgctttagggaaatcagaatttcaaatatacaaaaagagtggcatacaagaggtagataggaccctagctaaagaaggcataaaacgcggcgaaaccgaccaccatgcggtcagtagaggttcagcgaaacttagatggttcgtagaacgcaatatggttactccagaaggaaaagttgttgatctaggatgtggaagaggcggatggagctactattgtggcgggctaaagaacgttagggaggtcaaaggacttaccaaaggcggtcctggacatgaggaacctattccaatgtcaacctacggctggaatttagtacgactacagtcaggggtagatgttttttttacgccccctgaaaagtgtgacacattattatgtgatattggcgaaagcagtccaaaccctacaattgaagctggaagaacgctaagggtcttaaatttagttgaaaattggttgaataataatacacaattctgtataaaagtcttaaatccgtatatgcctagtgtaatcgaaaaaatggaaacactacaacgtaaatatggcggagcattagttagaaaccccttatctagaaattcaactcatgaaatgtactgggtgtcaaacgcgactggaaatatcgttagtagtgtaaatatgattagtcgtatgcttatcaatcgttttaccatgaaacacaaaaaagccacgtacgaaccagacgtcgacttgggcagcggcacaagaaatataggcatagagtctgaaattcccaatttagacatcataggaaaacgcatagaaaaaatcaaacaggaacacgagacctcatggcactatgatcaagatcatccttataaaacatgggcttatcacgggtcatacgaaacgaaacaaactggctctgcctcatctatggtaaacggtgtggtaagacttctaacaaaaccttgggacgtagttcctatggtcacacaaatggcgatgacagacactacgccgttcggacaacaacgcgtcttcaaagaaaaagtcgacacaagaactcaagaacctaaagaaggaacgaagaaattaatgagaataaccgctgaatggttatggaaggaacttggaaaaaaaaaaactccacgcatgtgtacccgagaagagttcacacgtaaggtaagatctaatgcggcactgggcgcgattttcacagatgaaaataaatggaaaagcgcaagagaagcagtagaagatggaagattttgggagctagtagatagggaaagaaacctgcatctagaaggaaaatgtgagacatgcgtatataatatgatgggaaaaagagagaaaaaacttggtgagtttggcaaagccaaaggctcgagagcgatatggtacatgtggttaggagccaggttcctggaatttgaagcactgggattccttaacgaggatcattggttcagtaggggaaacagcttatccggcgttgaaggtgagggtctgcatagacttggttatatcctacgggatgtcggtaaaaaagaaggcggagccatgtatgctgatgatacagctggttgggatactcgaataactttggaagatttaaaaaatgaagaaatggtaacaaatcacatgaaaggggaacacaaaaaactagctgaagccattttcaaactaacttaccaaaataaagttgtacgtgtacaaagaccaaccccacgtggaaccgtaatggatattatatcacgacgagatcaaagaggtagtggccaggtaggaacatacggcttaaatacattcacgaacatggaagctcaattgataagacaaatggaaggtgaaggaatttttaagagtatacaacacctaacagcgacagaggaaatagctgtacaaaactggctagcaagagtggggcgagaaagactgtcaagaatggccataagcggcgatgattgcgtagtgaaacctatcgatgacagatttgcgagcgcattaacagctttaaatgatatgggaaaagtaaggaaagacattcaacagtgggaaccgtctcgaggctggaatgattggactcaggttccattttgctcccatcattttcacgagctcgttatgaaagacggacgagtgttagtagtaccttgcagaaaccaagacgagttgataggtcgagcccgtattagccaaggtgctggctggtcgttaaaagaaacggcttgcttgggcaaaagctacgcacagatgtggacattgatgtattttcaccgccgagacctgagattagctgccaatgccatatgttcagcagtcccatcgcattgggtaccgacttcaagaacaacgtggtctatccacgctaaacacgaatggatgacgacagaagacatgttagctgtatggaatcgagtatggatacaagaaaatccatggatggaagacaaaacgccagttgagtcatgggaagaagtaccctatctgggtaagagagaagaccaatggtgtggatctctgattggattgaccagtcgcgccacatgggctaaaaacatccagacagcaataaatcaagtacgttccttaatcgggaatgaggaatatactgattacatgccatctatgaaacgctttcgacgcgaagaagaagaagcaggagtcctatggtaa

SEQ ID NO: 22294 - RNA, 9876 nt, synthetic construct
  misc_feature 1..9876: note = derived and/or modified CDS sequence (opt6) from DENV-2__GQ868557__SS-prME
  source 1..9876: mol_type = other RNA
accgcaggggtcatagtgatgttaattccaacagctattgcctttcacttaacaaccagaaatggggagcctcacatgattgtgggaagacaggaaaaagggaaaagtctactgttcaaaacagaagatggggttaatatgtgtactttaatggcgattgatctaggagaattatgtgaagacactataacatataaatgcccgttactccggcaaaatgaaccagaagatatagactgctggtgtaacagcacgtcaacatgggttacgtatggtacctgtaccacaacaggggaacacagaagggagaaaagaagcgtagctttggtaccccacgtcgggatgggtctagaaacaaggacagagacttggatgtcatcagaaggcgcgtggaaacacgtacaacgaatagagacttggatcttgagacatcctggatttacaattatggctgctatattagcatacactatcggcaccactcacttccaaagagcactaatctttatcttactgactgcagttgcaccttctatgactatgaggtgtattgggatatccaaccgagattttgtcgaaggtgtatcgggaggctcatgggtagatatagtacttgaacacggctcttgcgttaccactatggcaaaaaacaaaccaactttagactttgaacttatcaagacggaggccaagcaacctgcaacgctaagaaagtactgcatcgaagcaaaactaacaaacactactacagaatctcgctgcccaactcaaggtgaaccatctctaaatgaggaacaggataaaaggtttatatgcaaacactctatggtggatagagggtggggcaacgggtgcggattgtttgggaaaggcggtatagtgacatgcgctatgtttacttgtaaaaaaaacatggaagggaaagttgtacaacctgaaaatctggaatatactatcgtcattacacctcatagtggagaagaacacgctgttggtaatgacaccggaaaacatggaaaggaaataaaaataacaccacaatcaagtatcacagaggccgagttgactggttatggaacagttacaatggaatgcagcccaagaaccggattagacttcaatgaaatggtcttacttcaaatggaagacaaagcgtggttagtgcaccggcaatggttcctggatcttccactaccatggttacctggagctgatactcaaggatccaactggatacagaaagagacattagttacatttaaaaacccacatgccaaaaaacaggacgtggtagtcttagggtctcaggagggcgctatgcacactgccttaacaggagcgacagagatacaaatgagttcaggtaatttgttgttcacagggcatttgaaatgtcgactccgaatggataaactacaactcaaaggtatgtcatacagcatgtgcacaggaaaattcaaaattgtaaaagagatagcagaaacacaacatggtactattgtaataagagttcaatatgagggagatggctcaccttgtaagatcccatttgaaataactgacctagaaaaacgtcacgtattgggacgattaatcacggtaaaccctatagttactgagaaagattcacctgtgaatatagaggcagaaccaccctttggagactcatacataataattggagtggaaccgggtcaattaaaactaaattggttcaaaaaaggctcctctattggacaaatgtttgagacaacgatgagaggagcaaaacgcatggctatactaggagatacagcatgggactttggttctctgggcggtgtcttcacttctatcggaaaagcactccaccaagtgtttggagctatatatggcgcagcatttagtggagtgtcatggacaatgaagattctaatcggagttgtaataacgtggattggcatgaatagtaggagtacaagtttgtcagtatctcttgtccttgtaggcgtagttactctctatcttggtgcgatggtacaagctgatagcggatgtgtagtatcttggaaaaataaagaattaaagtgtggatctggcatctttataactgataatgtacatacttggacagaacaatacaaatttcagccggagtctccaagcaagcttgcctctgctatacaaaaagcgcatgaagaaggaatatgcggcatcagaagcgtaacaagactagagaatctcatgtggaaacaaataacgcccgaattaaaccacatactatcagaaaacgaagttaagttgacaattatgacgggggacacaaaaggcataatgcaagcaggaaaaagaagcctgcgtccccaacctacggaattaaaatactcttggaaaacttggggaaaagcgaagatgttaagcactgaatcacacaatcaaacgttcttaattgatggaccagagacagccgaatgtcccaatacgaaccgtgcatggaatagtcttgaggtagaagattacggattcggagtcttcaccactaacatttggcttaaattaagagaaaaacaggatgtattttgcgatagtaaattgatgtctgcagctataaaagacaatcgagccgtgcatgcggatatgggatactggattgaatcagctctaaatgacacatggaagatggagaaggccagttttattgaagtgaaatcctgccattggccaaaatctcatacgttatggagtaatggagtcttagaatcagaaatgattatccctaaaaactttgccggacctgttagtcaacataactatagacccggataccatacacaaacggcagggccctggcatctaggcaagctcgaaatggactttgacctatgcgaaggaactactgttgttgtgacagaagactgcggcaatcgcggtccctctttaagaacaacgacagcttcaggcaaattgataacagaatggtgttgtcgctcctgcactttgccaccgctgcggtacaggggagaagacggatgttggtatggtatggagataaggccactaaaagagaaagaggaaaatctagttaattcactagttactgcaggacatggacaaattgacaacttttcattaggtgtgctaggcatggccttatttctagaagagatgctaagaacacgcgtaggaactaagcacgctatactattagtagccgtgtcgtttgtaaccctaattacaggaaatatgagcttccgagatttaggaagagttatggtcatggtaggcgcaacaatgacagatgatataggaatgggagtaacatatttggctcttcttgcagcctttaaagtacgcccaacattcgcagccggattgctactaaggaaactcacatcaaaggaattgatgatggcaacaatagggatagccttgctttcacagagtacgatcccggagacaatactagaactaacggacgccttagccttgggaatgatggttttaaaaatagttagaaacatggaaaaataccaattagcagttacaattatggctataagctgtgttcccaacgcagtaatactaagaaacgcatggaaagtgagttgtacgatacttgccgcggttagcgtatcgcctctgcttctaacctcaagtcaacagaaagctgattggattccactcgccttgacaataaaaggtttaaatccaacggctattttcctgacgaccctgtcaagaacaagcaaaaagagatcctggccccttaacgaagcaataatggcagttgggatggttagcatacttgcatcgagcctccttaagaacgatattcccatgactggccccctggtcgcaggaggtttactaacagtatgctatgtgcttacaggaagatctgctgacttagaacttgaacgagcagccgaagtaaaatgggaagaccaggcagaaatctcaggctcgagtccaatcctgagcataacaattagtgaagatggatcaatgtccataaagaacgaagaggaagaacagacactaacaatcttgatccgaacaggattactcgtaatatcgggcgttttcccggtttcaatacccataacggcagcggcatggtatctttgggaggttaagaaacaaagagcaggtgttctgtgggatgtcccttccccacccccagtaggaaaggcggaactggaagatggcgcgtatagaataaagcaaagaggaatcttaggctatagtcaaataggagctggtgtatacaaagagggcaccttccataccatgtggcacgtgactagaggtgcagttctcatgcataggggaaaacgtatagaaccctcttgggccgacgtcaagaaagatctaatttcttatgggggaggatggaagttagaaggagaatggaaagagggcgaagaggtacaggtccttgcgctggaaccgggcaaaaaccctcgcgcggtacaaaccaaaccaggtatcttcaagacaaacacaggcacaatcggtgcggtgtcattagatttttccccgggaacgtcgggaagcccaatagtggatagaaaaggtaaagtggtaggtctttacggcaatggagtagtaacaagaagcggtgcatacgtatccgcgattgctcaaaccgaaaaatccatagaagacaatccagaaatcgaagacgacatttttagaaaaaaacgtcttacaataatggatctacacccaggagctgggaaaacaaaaagatatcttcccgcgatagtaagagaagcgataaaacgtggtttgcgaacactaattttagctccaacacgagttgtagcagctgagatggaggaagcattacgtgggttacccatccgttaccaaacgcccgccatcaaagcagagcatacaggacgagaaatagtggacctaatgtgccatgctacattcactatgagactactcagtcccgttcgcgtgccgaattacaacctgataatcatggacgaagcccacttcactgatcccgcgagtatcgcggccaggggttacataagcacacgagtggaaatgggggaggcagctggtatattcatgacagcaacgcctccggggagcagagatccatttccgcaaagcaatgcacctatcatggatgaagagcgagaaatacccgagaggagttggaattccggacatgagtgggttactgactttaaagggaaaactgtatggttcgttccatcgatcaaagccggtaatgatattgcagcctgcctaagaaaaaacggtaaaaaggtcatccagctatcgagaaaaacatttgatagcgaatatgttaaaacaagggctaacgattgggattttgtagtgactacagatataagtgaaatgggcgcgaattttaaagccgaacgtgtaatcgaccccagaaggtgtatgaagccggtcatactaacagatggcgaagagagagttatcttagccggacccatgcctgtaactcactcatcagcggcccagaggagaggacgcatcggtcgaaatccaaaaaatgaaaatgaccaatacatttacatgggtgagccgttggaaaatgacgaagactgtgctcattggaaagaggcaaaaatgttactcgacaatatcaacacaccagaaggaattataccatcaatgttcgagcccgagcgcgagaaagtagatgcgatcgatggagaataccggctgaggggagaagccagaaaaacttttgtagatctaatgagaagaggtgacttaccagtatggttggcttataaagtggctgcggaaggaataaattatgccgatagaaaatggtgtttcgatggcattaaaaataaccaaatattagaagaaaacgtagaggtcgaaatctggaccaaagagggagaaagaaagaaactaaaaccccggtggctcgatgccagaatttatagtgatccactagcattaaaagaatttaaggagtttgccgcaggaagaaaatcactaactttgaatctaataacggaaatgggtagattaccaacatttatgacccagaaagcgcgtaatgcgttagataacttagcagtcctccacacagctgaagccggaggacgagcatacaatcacgcattgtcagagcttcctgaaactctagaaacattattattgctgacgttactagcaacagtgaccgggggaatttttttattcctaatgtcaggcaaagggattggaaaaatgacattaggaatgtgttgtatcattactgctagcgtattattatggtacgcccagatccaacctcattggattgcggcttccataatacttgaattcttccttatcgtactactgattccagaacctgaaaaacagaggacacctcaagacaatcaattgacctatgtagttatagccattcttaccgtagtagcagctacaatggccaacgagatggggttcctagagaaaaccaaaaaagacttgggactcgggtcaataactacacaggagtcagaaagtaacattttagacatagacctccgtccagcgtccgcgtggacgctttatgctgtcgctactaccttcgttactccaatgctccgtcatagtatagaaaatagtagtgtcaatgtatccctaacggccatagctaatcaggcaaccgttctgatgggcttaggcaaaggttggccgttatccaaaatggatattggtgttcccttacttgcaataggctgttattctcaagtgaatccaataacacttacggcggcgctcttactcttagtggcacactatgcaataataggtccagggcttcaagcaaaagccactagagaagcgcagaaaagagcagccgccggcataatgaagaatccgaccgtagacggaattacagtaatagaccttgaacccatcccctatgatccaaaattcgaaaagcaattgggacaggtgatgttattaattctatgtgtgacccaagttctgatgatgcgaacaacatgggccctttgtgaagcattaacactagcaaccggccctattagtacattatgggaagggaatcctggtcgattttggaatactaccattgcagtatccatggctaacattttcaggggatcttacttagcaggggcaggtttactatttagcattatgaaaaataccaccaatacccgacgaggaactggaaatattggtgagacactcggggagaaatggaaatctagattaaacgcattaggcaagtcagaatttcaaatatataaaaagagtggaattcaggaagtagatagaacattggctaaagaaggaataaagagaggtgaaacggaccaccacgcagtttctcgaggctcagctaaactccggtggtttgttgagagaaacatggtcactcctgaagggaaagttgtagacttgggttgtgggagaggtggttggtcgtattactgcggtggcctaaaaaatgttagggaagtcaaaggacttacgaagggaggtccaggccacgaagagcctatacccatgagtacctatggttggaatcttgtcagacttcaatccggagtagatgtattctttacccccccggaaaaatgtgatacccttctatgcgatataggtgagagttcaccaaatccaacaatagaagcaggccggacccttcgggtattgaatctcgtggaaaactggttaaacaataatacacaattctgcatcaaggtcctaaacccgtacatgcccagtgttattgagaagatggaaacgctccagaggaaatacggcggggcattagttcggaatccactgtctcgtaattccactcatgaaatgtactgggtaagtaatgctaccggtaacatagtatctagcgtgaatatgatcagtcggatgcttataaatagatttacaatgaagcacaaaaaagccacatatgaaccagacgtagacctaggaagtggaacgagaaatatagggatcgaaagtgaaatcccgaatctggatatcataggtaagcggatcgaaaaaataaagcaagaacatgaaacgagctggcactatgatcaagaccacccctataaaacatgggcttatcacggcagttacgaaactaagcagacagggagtgccagttctatggtcaatggagtggtacggttattaacgaagccgtgggacgtggtcccaatggtaacacaaatggctatgactgatactactccatttggtcagcaaagggtttttaaagaaaaagtagatacgcgtacccaggaaccaaaagaaggcaccaagaaattaatgaaaattactgcagagtggttatggaaagaactaggtaaaaaaaagactccgcggatgtgcacacgtgaagagtttacacgaaaagtacgctctaatgcggctctcggagctatattcacagatgaaaacaaatggaaaagcgcacgcgaagcagttgaggatggccgattttgggagctagtcgacagggagcggaacttacacttagagggtaaatgtgaaacatgtgtgtacaacatgatgggtaagcgagaaaaaaaactgggagaattcggtaaggcaaaaggaagtagggctatttggtacatgtggctaggagcacgatttctagaatttgaagcccttggctttttaaatgaagatcactggtttagtagagggaattcattgagtggagtagaaggagagggtttacatcgtcttggatacatcttgcgagacgtgagcaaaaaagaaggaggagcgatgtacgcagacgacactgccggctgggatacaagaatcacattagaagatttaaaaaatgaggaaatggtgacaaatcatatgaaaggcgaacataaaaaattagcagaagcgattttcaaactaacatatcaaaacaaagttgtacgagtgcaacgaccaacaccacgaggtacagttatggatataatctcaagaagagaccagcgaggttctggccaggtaggaacctatggactaaatacattcactaatatggaagcccaacttattagacagatggagggtgagggtatatttaaaagtatacagcacttaacggccacagaggagaatgcagttcaaaattggcttgctagagtgggtcgggaaaggctaagcagaatggcaatcagtggagatgactgcgttgtgaaacctatagacgataggttcgctagtgcactaacagcacttaatgatatgggaaaagtaaggaaagatatacagcaatgggaaccttcaaggggatggaacgattggacacaagtccccttctgcagtcatcattttcatgagctcgtaatgaaggacggacgagtattggtagtgccttgtaggaaccaagatgaacttataggaagggcaaggatttcacaaggagctggttggagtctaaaagagaccgcttgcttagggaaaagctacgcacaaatgtggacattgatgtatttccaccgaagagacctaaggctagcggcaaacgcaatatgttctgccgtaccaagccactgggtcccgacgtcacgaacgacttggtcaatacacgcaaagcatgaatggatgacaacagaagatatgctcgcagtatggaacagagtatggattcaagagaacccgtggatggaagacaaaacgccggttgagtcatgggaggaagtaccttatttaggcaaaagagaagatcagtggtgcgggtcactaataggactcactagcagggccacatgggcaaaaaatatacaaacagcgataaatcaggttagaagtttgattggaaacgaagaatatacagactatatgccaagcatgaagcgttttcgacgagaagaggaagaagccggagtactttggtag

SEQ ID NO: 22295 - RNA, 9876 nt, synthetic construct
  misc_feature 1..9876: note = derived and/or modified CDS sequence (opt6) from DENV-2__GU131947__SS-prME
  source 1..9876: mol_type = other RNA
actgcaggagtaattgtaatgcttattccaactgccatagctttccatctaaccactcgtaacggagaaccgcacatgatcgtggggcggcaagaaaaaggaaaaagtctactatttaaaactgaagacggagtaaacatgtgtacgctgatggcgatagacctaggagaactctgtgaagacactataacgtataaatgcccgctcttaagacaaaacgaaccagaagacatagactgttggtgcaatagtacctccacttgggttacatatggaacttgtacaaccactggtgaacatcgaagagaaaaacgttcggtagccttagtgccacacgtaggaatgggtctcgaaacaagaacggaaacctggatgtcatctgaaggggcatggaaacacgtacaaaggatcgaaacgtggatattaagacatccaggattcaccataatggcagctattcttgcatatacaattggtaccacacatttccaacgtgccttaatattcattttactaacagccgtagcaccgtcaatgaccatgagatgtattggaatctcaaatcgtgatttcgtcgaaggtgtttcgggaggaagctgggtagatatagtccttgaacatggaagttgtgttactactatggccaaaaacaaaccaacgttagatttcgaactcattaaaaccgaagctaaacagcccgctactttaagaaaatattgtatagaagcaaaactaaccaacactactacagaatcccgatgcccaacgcagggtgaaccgagcttaaacgaagaacaggataaacgatttatatgcaaacattctatggtagatcgcgggtggggaaacggctgcggtctcttcggaaaaggaggcatagtaacctgtgcaatgttcacatgtaagaaaaatatggaaggtaaagtagtgcagccagaaaacttggaatacacaatagtaattaccccacattctggagaggagcatgcagtaggaaatgacactgggaaacacggaaaagaaattaaaataacaccacaatcaagtatcacagaggctgagctcaccggatacggaacggttactatggaatgctctccccgtactgggttagatttcaacgaaatggttctgttgcaaatggaagacaaagcgtggcttgtacacaggcaatggttcctagatttgccgttaccttggttgcctggggcagacacacaaggcagcaactggatccaaaaagaaacgttagtgacttttaaaaacccacacgctaagaaacaggatgtggtagttctcggtagtcaagaaggagctatgcataccgcgttgaccggagcaacggaaatacaaatgagttcgggaaacctcctattcactggacatcttaaatgcagattgagaatggacaaattgcaattaaaagggatgtcttactctatgtgcactgggaaattcaaaatcgtgaaagaaattgccgaaacccagcacggtacaatagtaattagagtgcaatatgaaggagacgggagtccttgtaaaattccttttgaaataacggacttagagaaaagacacgtgctcggtagactaatcactgtaaaccctatagtgacagaaaaagattcaccagtaaatattgaagcagaacccccattcggagactcatacattatcataggtgtagagccggggcaactaaaattaaattggttcaagaaagggtcatcgattggccaaatgtttgagactacaatgcgaggggctaaaaggatggcgattcttggtgacacagcatgggatttcgggagtttgggtggcgtgttcacaagtataggaaaagctctacatcaagtatttggagctatttatggtgctgctttttccggcgtaagttggacaatgaaaatactgattggtgtggtcataacgtggattgggatgaacagtagatcaacaagtttatcagtaagtctagtcttagtaggtgtagttacattgtatctaggagcaatggtccaagctgattcggggtgcgttgtcagctggaaaaataaagaactaaagtgcggatcggggatttttataacggacaatgtacatacatggacagaacaatataaattccaaccggaatcgccctccaagctagcctcagcaattcaaaaggctcacgaagaggggatatgcggtattagatcagtgacacggctggaaaacctgatgtggaaacaaataacaccggaactaaatcatatattatcagagaacgaagttaagctgactatcatgaccggggacactaaaggaataatgcaggctggaaaaagatctcttagacctcaacccactgaattgaagtattcttggaaaacatggggaaaagcaaagatgctatcaactgagtcacataatcaaacatttttgattgatggaccggagactgcggagtgtcctaacaccaaccgagcctggaatagtctggaagtggaagactacggctttggtgtgtttacaacaaatatatggttgaaattacgagaaaaacaagatgtattttgtgactcaaagttaatgagcgctgcgattaaagacaatagagctgttcacgccgatatgggatattggatcgagtcagctttaaatgatacgtggaaaatggaaaaggcatcttttattgaagtaaaatcatgccactggccaaaatcccataccttatggtcaaatggcgtattggaaagcgagatgataattcctaaaaactttgcaggtcccgtgtctcagcacaattaccgccccggttaccacacacaaactgctggtccctggcatctagggaaactagagatggacttcgacttgtgcgagggtacaactgtggttgtaacggaggattgtgggaatagaggacccagcttacgtacgacgactgcttcgggaaaactcatcacagagtggtgttgtcgttcctgtacgttaccaccattaaggtatagaggtgaagacggatgttggtacggaatggaaattagaccgttaaaggagaaagaggagaatttagttaactcactggttacagctggacacggacaaatagacaacttttccctgggtgtattaggcatggcactatttcttgaagaaatgctaagaacaagggtgggcactaaacatgcgatccttttagttgcagtctcttttgtaacgttaataacggggaacatgagctttagagaccttggcagagtaatggttatggtcggagcaacgatgacggatgacattggaatgggcgtcacttacttagcacttctagcagcgttcaaagtcagaccaacgttcgcagcgggtttactacttagaaaacttacatcaaaggagttgatgatggccacaatcggaattgcattactatcacaaagtaccataccagaaacaatcttagaattaacagatgcgttagctctaggaatgatggtccttaaaatagtgcggaatatggaaaaatatcagctggctgtcacaattatggctataagctgtgttccgaatgctatgattctaagaaatgcctggaaagtcagttgcactatcctggcggcagtctctgtttctccacttttgttaacatctagccaacaaaaagctgattggattccattggcactgacgattaagggtttaaacccaacagcaatatttttgacaaccttaagtagaacaagcaagaaacgctcttggcccttgaacgaagcaataatggcagtgggaatggtaagtatactcgcgtcaagtctacttaaaaacgacataccaatgacaggtcccctagtggcgggagggctactgaccgtatgctacgtattgactggccgcagcgctgatctggaacttgaaagggctgcggaggtcaaatgggaagaccaagcggaaattagcggaagctctccaatcttgtcaatcacaataagcgaagatggatcaatgtccatcaaaaatgaggaagaggaacaaacgcttacaatattaattaggacgggactcctcgtaatctccggagtatttccagtatcgattccaattacagcagcggcctggtacctatgggaagtaaagaaacaacgggcaggcgtcttgtgggacgtcccttcaccgccaccagtaggccgcgcagaattagaagatggggcgtatcgtataaaacagcgagggatactaggctatagccaaatcggagcgggtgtttataaagaaggaacctttcatacgatgtggcatgtaaccagaggtgctgtacttatgcaccggggcaaacgaattgaaccctcgtgggcagatgtcaagaaagatctgatatcatatgggggaggctggaagttagaaggggagtggaaggaaggagaggaggtacaggtgcttgcgttagaaccggggaaaaatccacgtgcagttcaaactaagcctggaatattcaagacaaacacagggactattggagccgttagtctagacttctctcctggaacctctggctctcctatagtagaccgaaaagggaaagttgtagggttatacggcaatggggtagtgacgcgctccggcgcctatgtttcggcaatagctcaaacagaaaagagtatagaagataatccagaaatagaagacgatattttcagaaagaaaagactaaccataatggatttacaccccggtgcggggaaaactaagagatatcttcctgctatagttagagaagcaataaaacgaggactgagaactctgatattagcacccacgagagtcgtagcagcagaaatggaagaggcattacgagggttacctatacgttaccaaaccccagcaatcaaggcggaacataccgggagagaaattgtagatctaatgtgccacgctacattcactatgcgcttattatctcccgttcgagtaccgaactataatctaatcataatggatgaggctcattttacggacccagcttcaattgcagcgcgaggatacatatcaacacgagtcgaaatgggggaagcggccgggattttcatgactgcaacacccccaggctccagagacccctttccccagtcaaatgcaccaataatggatgaagaaagagaaattcctgaacgttcttggaactcaggccatgaatgggtaacagatttcaaaggaaagactgtatggtttgtcccatcaataaaagctggtaatgatatagctgcatgtcttaggaaaaatggcaagaaagtaatacaactatcccgcaagacgttcgatagcgaatacgtgaaaacacgtgcaaatgattgggactttgttgtaacgacagacattagcgaaatgggcgctaactttaaagcggaacgagtaatagatccccgacgctgtatgaagccagttatacttacagacggagaagaacgcgtcatactagctggacccatgccagtaacccatagtagtgccgcacagagacgcggaagaatcggaaggaatcccaaaaacgagaacgaccaatatatttacatgggagaaccgttggagaacgacgaagactgtgctcattggaaagaagctaaaatgctactggataatattaatactccagaagggatcataccttctatgtttgagcccgaacgcgaaaaagtagatgcaatagacggagaatatcgtttaagaggcgaagctcgaaaaactttcgtggacctaatgagaaggggagatctaccagtttggctagcatacaaagtagcagctgaaggaattaattatgcggatagaaaatggtgtttcgacggcatcaaaaataaccaaatactagaggaaaatgtggaggtggaaatttggaccaaagaaggagaaagaaagaaattaaaaccgaggtggctcgacgcaaggatttactcagacccgttggcactaaaagagtttaaggagttcgccgccggaagaaaaagccttacgttaaatttaataacggaaatgggtagattgcctacattcatgacccaaaaagctcgaaatgcgctggataatctggctgtcctgcatacagcagaagctggtggtcgtgcgtacaatcatgccttaagcgaactcccagaaacgttagaaacattattactattgacactattagctactgttacgggtggcatattcctattcttaatgtcaggcaagggcataggaaaaatgacgctgggaatgtgttgcataatcacagcaagtgtattgttgtggtacgcacagatacaaccgcattggattgcagctagtataatactagaatttttcctaatagtactattaataccggagccggagaagcaacggacgccgcaagataaccaactaacctacgtagtaatagcaatcttgacagtagtggccgccaccatggcaaatgaaatgggatttttagagaaaaccaagaaagatttagggttgggcagcataactacccaagaatctgagtcgaatattttagatatagacttaaggcctgcaagtgcgtggactctctatgcagtagcgacaactttcgtgacgccaatgctaaggcatagtatagagaacagtagtgttaatgtttctttaacagcaattgcaaatcaagcaacggtcctaatgggactaggaaaaggttggccgttatcgaagatggatataggagtccccttgctagcgataggttgctattcacaagtaaaccctatcactttaactgcagctttacttttattggtggcacattatgcgataataggtccaggtttacaagcgaaagcaacgagagaggctcaaaaacgggctgcagccggaataatgaagaatccgactgtagacggtataacagtaatagatttagaaccaattccctacgatccaaaatttgaaaagcaattaggacaagtaatgttattgatactttgtgttacccaagtgttgatgatgcgtacaacatgggccctatgcgaagcgcttacattggccacaggaccaatatcaactctatgggaaggtaatccaggaaggttctggaacacgacgatcgcagtctctatggccaacatatttagaggtagctaccttgcaggcgcaggcttactattttcgattatgaagaacaccacaaatacaagacgtggtacaggtaacattggagagactctaggcgagaaatggaagagtaggttgaatgcattgggcaaaagtgagttccaaatatataagaaaagcgggatacaggaagtcgatagaactttagctaaagaaggcataaaaagaggggaaacagatcatcacgcggtaagtcgaggaagtgctaaattaagatggtttgtagagagaaacatggtcacaccagaaggaaaggtagtggacttgggttgtggcaggggtggttggagttactattgtggaggcctcaaaaacgtcagagaggtaaaaggattaacgaaagggggacctgggcacgaagaacccatacccatgtcaacttacggatggaatttagtcagactccaatcaggagtagatgtgtttttcacacccccagaaaaatgtgatacgttgctatgcgatataggagagagctcccctaatcctaccatagaagcaggaagaactctccgagttctcaatttggttgagaactggctaaacaacaatacccagttttgcataaaggtattgaatccatatatgccaagtgttatcgagaagatggaaactttacaaagaaagtatggaggagcgttagtgcgaaatcccctatctagaaatagtacacacgaaatgtattgggtgtccaatgcgacaggaaacatagtctcaagtgtaaacatgattagccgaatgttgataaatagatttactatgaagcacaaaaaggcaacttatgaaccagacgtggatttaggatccggtacaagaaatatcggcattgaatctgaaattccaaacttggatataatagggaaacggatagagaaaataaagcaagaacatgaaacaagttggcattatgaccaagaccatccctacaaaacttgggcgtatcatggaagttatgaaaccaaacaaactggtagtgcatcttctatggtaaatggtgtagttcgactactgacgaagccatgggacgttgtaccaatggttacacagatggcaatgacggatacaacaccatttggacaacaaagagtatttaaagaaaaggtcgatacaagaacgcaggaaccaaaagagggcacgaaaaagctaatgaagataaccgcggagtggctttggaaggaattaggcaagaagaaaactccacggatgtgtactagagaagaatttacaagaaaagtacgttccaacgcggcactaggagccatattcacagatgaaaataagtggaagagtgcacgagaagcggttgaagatggcagattttgggagctagttgatcgggaacggaacttacacttggaaggcaaatgcgagacgtgcgtgtataatatgatggggaaacgagagaagaaattaggtgagttcggtaaagccaaaggtagccgagcaatctggtatatgtggctaggagccagatttctcgagttcgaggcactaggatttttgaacgaagatcactggttttctcgaggtaattcactaagcggtgtcgaaggagaaggactacaccgattgggctatatcttaagagatgtcagcaagaaagaaggaggagccatgtacgccgacgatacggcaggttgggatactaggataacattggaggatttgaagaatgaagagatggttacgaaccatatgaagggtgaacataaaaagctagcagaggctatttttaaattaacttatcaaaataaggtagtaagggtacaaagacctacacctcgcggaacagtaatggatatcattagtcggagagatcaaagaggctctggacaagtaggtacgtacggactaaatacgtttacgaatatggaagcacagctaataagacagatggagggggaaggtatatttaaatcaattcaacatttgaccgccatagaagaaatagcggtacaaaactggttagcgagagtgggtagagagaggttgtctcgcatggcgattagcggagacgactgtgtagtgaaacccattgacgatagatttgcatctgccttaacagcgttaaacgatatgggcaaggtccgaaaggatatccaacagtgggagccaagtagaggatggaatgattggacacaggtcccattctgtagtcatcatttccacgaattagtgatgaaggatggcagggtgctcgtagtaccatgtaggaatcaagatgaattaattggccgagctcgaatatcccaaggagcaggttggagtttaaaagaaactgcatgtttagggaaatcctatgcacagatgtggactttgatgtactttcataggcgagatctccggctagcagctaatgcaatttgctcggcagttccaagtcattgggtaccaacgagtaggactacatggtctatacacgctaaacatgaatggatgactactgaagacatgttagcagtgtggaaccgtgtgtggattcaagaaaatccgtggatggaagataagactccagtggagagttgggaagaggtaccctacttgggaaaaagagaagaccagtggtgtggatcattaatcggactgacaagtcgcgcgacatgggccaagaacatacaaacagcaatcaatcaggttaggtcattaatcggaaacgaagaatacactgactacatgccgagcatgaaacgattcagacgggaggaggaggaggcaggcgtcttgtggtga

SEQ ID NO: 22296 - RNA, 9876 nt, synthetic construct
  misc_feature 1..9876: note = derived and/or modified CDS sequence (opt6) from DENV-2__GQ868558__SS-prME
  source 1..9876: mol_type = other RNA
acggctggtgtaattgttatgttaatacctactgcaatagcatttcacttaacaacgagaaatggcgaaccacatatgatcgtaggaagacaggaaaaaggaaaatcacttctgtttaaaactgaagatggggttaatatgtgcacactgatggcaattgatctaggagaactttgtgaggacactattacatacaaatgtccacttttaaaacaaaatgagccagaggacatagattgctggtgtaattctacatccacatgggtgacttatggaacgtgtacaacaacgggagaacaccgccgagagaaaaggagtgtagcattagtgccacacgtcggcatgggactagaaacaaggacagaaacctggatgtcaagtgaaggtgcatggaaacatgtgcagagaatagaaacctggatactaagacacccaggctttacaataatggcagctattctagcatatactataggaacaactcatttccaaagagcattgatattcatcttgttaacggctgtcgccccatccatgactatgaggtgcattggtatatcaaatagggattttgtagaaggagtctcaggaggttcctgggttgatatagtattagaacatggatcgtgtgtcaccaccatggcgaaaaataaaccaacgttagattttgaattaattaaaacagaagcaaaacaacccgcgactttaagaaaatactgcatagaagcaaaactgacgaacacaacaaccgagagcagatgtccaacgcaaggtgagcccagtctcaacgaggagcaagacaaaagatttatatgtaaacacagcatggtggatcgcgggtggggaaatggatgtgggttatttgggaaaggcggaatagtaacgtgcgcaatgttcacatgtaagaaaaatatggaaggaaaagtcgtacaaccggaaaacttagaatatacaattgttataacgccacactctggcgaagaacacgcagtaggtaatgacacagggaaacatggaaaagaaataaaaattacacctcaatcctcaataactgaagctgagttaaccggatatggaacagttaccatggaatgcagtcctagaacaggattagattttaacgaaatggtacttctgcagatggaggacaaagcctggttagtgcatcgacagtggtttttggatttacctttaccttggttaccaggggctgacacacagggaagtaattggatacaaaaagagactctcgtgacattcaaaaacccgcatgccaagaaacaggatgtagtagtcctaggatcccaagagggcgctatgcacacagcacttacgggcgctaccgaaatacaaatgagcagcggaaatctgctctttactggacacttaaaatgccgtcttagaatggacaaacttcaacttaaagggatgtcctatagtatgtgtaccggcaaattcaaaatagtgaaagagatagcagaaacacagcatggaacaattgtaattagggttcaatatgaaggtgatggtagtccgtgcaaaatcccattcgaaataacggacttagaaaagcgtcatgttctaggaagattgatcacagtaaacccaatagtcacggaaaaggattcacctgtaaacatagaagcagaacctcctttcggtgatagctatattataataggagtagaaccaggacaactaaaattgaactggtttaagaaaggatctagcataggtcagatgtttgagacaaccatgaggggtgccaaaagaatggcaatattgggcgatacggcatgggattttggctctcttggtggagtattcacatcaataggtaaagcacttcaccaagtgtttggtgccatttatggagcggcattctccggagtgtcttggactatgaaaatactaataggtgttgtaataacgtggatagggatgaactccagatctacaagtctttctgtttcattggtattggtcggagttgtaacactctatcttggagcaatggtgcaggctgattcagggtgtgtagtaagctggaaaaataaggagctaaaatgtggaagtggaatttttattacagacaatgtccacacatggaccgaacaatataaatttcaaccggaaagtccgagcaaactagcgagtgctatacaaaaagcacatgaagagggtatttgcggtattagatcagtaacacgattagaaaatcttatgtggaaacagattaccccagaacttaatcacatattatctgaaaatgaggttaagttgacaataatgacgggagatactaaaggaattatgcaagcggggaaacgttcacttaggccccaaccaacagaattaaaatactcttggaaaacatggggtaaagcaaagatgcactccacggaatcgcataaccaaaccttcttgatcgacggccctgaaactgcagaatgccccaacacaaatcgcgcctggaatagtttggaagtagaagattatggttttggcgtattcactacaaatatatggcttaagttaagagaaaagcaagatgtgttttgtgatagcaaactaatgagcgctgcgataaaagacaatcgtgcagtccatgccgatatggggtattggatcgagagcgccctaaatgacacttggaaaatggaaaaggcttcatttatagaagttaagagttgccactggccgaagtcgcacacattatggtcaaacggggtattggaatcagagatgataatccctaaaaatttcgcgggcccggtttcacaacataactaccgtccaggataccacacgcaaacggctggtccttggcatctaggaaaattggaaatggacttcgatttatgcgaaggaactaccgtagttgtcactgaagactgtggcaatagaggcccatcactcaggaccaccacagcttcaggaaaactcattacggaatggtgttgtcgttcctgtactttgcctccattacgttatcgaggggaagacggttgctggtacgggatggagattcgtccgctcaaggagaaagaagaaaatctagtgaacagcctagtgacagcaggtcatggccaaattgataacttctcattgggagtattaggaatggcattattcctagaagaaatgctcagaacacgtgtaggaacaaaacacgcaatattgcttgtcgcagtgtcatttgtaactttaataactggtaatatgtcttttcgggacctgggacgagtaatggttatggtgggagccaccatgacagacgacataggtatgggagtaacgtacttagctttattagccgcattcaaagtcagacctactttcgctgcgggtctacttctacgaaagctaacctccaaagaactaatgatggccacaattggaatcgctttgctatctcaatcaacgataccagaaactatcttagaattaacagatgcattggccctgggaatgatggtactgaaaatagtacggaacatggaaaagtatcaattggcagtaacaattatggctataagctgcgtacccaacgcagttattttaagaaatgcatggaaagtctcatgtactatattagccgctgtgtccgtctctcccctactactgaccagctcacagcagaaagcggattggatacccttagtgttaacaattaaaggattaaatcccacagcgatatttcttaccaccctcagcaggacaagcaagaaaagatcatggcctttgaatgaggcaataatggcagtaggtatggtaagcatactcgcgagtagcttgctaaagaatgatatccctatgacgggaccattagtagcaggcggactattaactgtttgctatgtgctaactggaagaagtgcagatctagaattggaacgcgctgctgaagttaaatgggaagatcaagctgagataagtggcagctcccctatacttagtattacgattagcgaagacggttcaatgtctatcaaaaatgaagaagaagaacaaacattaaccatcctaatacgaaccggcctcctagtaatttctggagtattccctgtaagcataccaattacagcagccgcatggtatctatgggaagtgaaaaagcaacgggcaggggtactatgggatgtaccgagcccaccaccggtagggaaagccgagctagaagacggcgcatataggatcaaacagcgcggcatcttaggctactctcaaataggggctggtgtgtacaaggaaggtacatttcatacgatgtggcatgtaacgagaggggctgttttaatgcatcgaggaaaacgcattgaaccatcatgggctgatgtgaagaaagatctaataagctatggtggtggctggaaactagagggcgaatggaaagagggggaagaagtccaagtgttggcactggagcctggtaagaacccgagagctgtacaaactaagccgggaatatttaaaacaaacgcgggcaccatcggcgcagtctcactggacttctctccgggaacatccgggtcacctatcgtggataggaagggtaaagtggtaggactgtacggaaatggagtcgtaacaagatccggtgcgtacgtaagtgcaatagcgcaaacagagaaatccattgaagacaatccagaaattgaggatgatatttttagaaagaaaaggctcactataatggatctacatcctggtgccggaaagactaagcgttacttacccgccatagtaagagaagccataaaacggggtttgagaacattaattctcgctccaacacgcgtagttgccgcagagatggaagaagctctaagagggttgcctatacgttaccagactccagccataaaggcagaacacaccggaagagagattgtagaccttatgtgtcacgcgacttttacaatgcggctcctatcaccagttcgtgtaccaaactataatttaataataatggatgaggcacacttcaccgatcctgccagtatagcagctcgtggatatattagtacgagagtagaaatgggagaagccgctggtatctttatgactgctacaccaccaggatctcgcgatccattcccacaatcgaatgcaccaattatggatgaagaacgtgaaataccggagagatcatggaatagtggtcacgaatgggtaacggatttcaagggaaagacagtgtggttcgtaccttcgatcaaggcaggtaacgacatagctgcatgcctgaggaaaaatggaaagaaagtgatacaactatccagaaaaacgtttgatagcgagtacgttaaaacacgagcgaatgattgggatttcgtggttactacagatatcagtgaaatgggggcaaacttcaaggctgagcgagtaatagaccccagaaggtgcatgaaacctgttatcctaactgatggtgaggagcgtgttattttagcaggtcctatgccagtgacccacagttcagccgcacagaggcgaggtcgcattggtaggaatcccaaaaatgagaacgaccagtatatatatatgggtgaaccactggagaatgatgaagattgtgctcactggaaagaagcaaaaatgttattagataacataaatacaccagaaggaattattccttcaatgtttgaacccgagcgagagaaagtagatgccatagatggagaataccgacttagaggagaagcacgcaaaacatttgtggacttaatgagacgaggagatctcccagtatggttagcctataaagtagcagcggagggaataaattatgcagatagaaagtggtgtttcgacggtatcaaaaataatcaaatattagaagaaaatgttgaagtagaaatatggacaaaggagggggaaaggaagaaactgaaaccacgatggctggatgcgcgtatctactcagatccattagcattaaaagagtttaaggagtttgcagctggaaggaaatcccttacgctaaaccttattactgagatgggaaggttacctactttcatgacacagaaagccagaaacgctttggataatttagccgttttgcatacagctgaggccggagggagggcatacaatcatgcactaagcgaactaccggaaactttagagactctcctattactgacactactagcgactgtaacgggaggcatatttttgtttctaatgtcggggaaaggcataggaaaaatgacactgggtatgtgttgtattataactgcaagtgtattactttggtacgcacagatccaaccgcactggatcgcagcatcaataatcttagagttctttctgatcgtcctactaatccccgaacccgaaaaacaaagaacaccccaagacaatcagctcacgtacgtagtcatcgcaatcttgactgtagtcgcagcaacaatggccaatgaaatgggatttttggaaaagaccaagaaagatctaggcttaggatcaataactactcaagaatctgaatccaatatacttgatattgatctacgaccagcaagtgcgtggacgctttatgccgtagcaacaacatttgtaacgcctatgttaaggcactcaattgaaaattcttcggtcaatgtatctctcaccgcaatagccaaccaagcaaccgtacttatgggactaggcaagggttggccattatcaaaaatggatataggagttccgttactagcaataggatgttatagccaagttaatccaataaccctcacggcagcgttactccttctcgtggctcactatgcaataatcggacctggcctacaagcgaaggccaccagagaagctcagaagagagctgcagccgggatcatgaaaaaccctaccgtagacggaataactgttatcgatctagaacctataccatacgacccgaaattcgaaaaacaattaggtcaagtaatgctgctcattctttgcgtgacccaggtattaatgatgagaactacatgggctctatgtgaagcattgacgctggcgacggggcccatctccacattgtgggaaggaaacccgggaagattctggaatacaaccatagctgtatcaatggctaacatatttagaggatcttacttagcaggagcaggcctcctgttctcaatcatgaagaatactacaaacactcgcagaggcacggggaacataggagaaacactaggagaaaagtggaaatcaaggctaaatgccttggggaaaagtgagtttcaaatatataagaaatccgggatccaggaagtagatcgaacattagctaaagaaggcatcaaaagaggagaaactgaccaccatgctgtatctcgaggatcggcaaaactgcgatggtttgtagaaaggaatatggtaacaccagagggtaaagttgtagatctcggatgtggtcgtggcggatggagctattactgcgggggcctaaagaacgtgagagaggttaaaggcttgacaaaagggggtccagggcacgaggaacccattcctatgagtacatacggatggaacctagtaaggctacaaagcggagtcgacgtcttctttacaccccctgaaaaatgtgacacgctgctatgtgacattggagaatcatcaccaaacccaaccatagaagcggggagaacactacgcgttttaaatttagtcgaaaactggttaaataataatacacaattttgtataaaggtactcaacccgtatatgccttcagtaattgagaaaatggagacactacaaagaaaatacggaggagctctcgtcagaaatccacttagtaggaactcaacacatgaaatgtattgggtctcgaacgccacaggtaatatcgtcagctcagtaaatatgatttcgagaatgcttataaacagattcactatgaaacataagaaagcaacatatgaaccagacgttgatttgggtagcggaacacgtaatatagggatcgaaagtgagattcctaatttggacatcataggaaaaaggatcgagaaaataaaacaggaacatgaaacctcctggcactatgaccaggaccatccctataaaacttgggcttatcacgggtcttatgaaactaagcaaacgggaagtgctagctcaatggtaaatggtgtggttagattacttactaaaccatgggacgtcgtccctatggttacccaaatggcaatgacggataccacacccttcggtcaacaaagggtctttaaggaaaaagtcgatacaaggacacaagaaccgaaagaaggcactaagaaattaatgaagataaccgcagagtggttatggaaagaactcggcaagaagaaaactccgagaatgtgcacgagagaagaatttacgagaaaagttaggagcaatgcggcattaggtgcaatttttactgacgagaataaatggaaatcagcgagggaagctgtagaagatggccgtttctgggaattggtagatagggagaggaatctccacctagaagggaagtgtgagacgtgcgtatacaatatgatggggaaaagagagaagaaattaggcgagttcggaaaagcaaaaggttcgagagctatctggtatatgtggctaggagcaaggtttctagagttcgaagcactagggtttttaaatgaagatcattggttcagtcgaggaaactcgttaagcggcgttgaaggcgaaggattacatagactaggatatatcttaagagatgtctccaagaaagaaggaggagcaatgtatgccgacgacaccgcaggctgggacaccaggatcacgctcgaagaccttaaaaatgaggaaatggtaaccaatcatatgaaaggagaacataagaaattggcggaagcaatcttcaaactgacataccagaataaagtagtcagagttcaacgacctaccccaagaggtacagtaatggacataatatcaagaagagatcaaagagggagtggccaagtaggaacttatggacttaatacttttacaaacatggaagcccagctgattaggcaaatggagggcgaaggcatatttaaatcaatccaacacctaaccgcaattgaagaaatagctgtgcagaattggctggccaaagtcggtcgagagaggcttagccggatggccatctctggtgatgactgtgtagtaaagcctatagatgatagatttgcgagtgcgctaacagcccttaatgatatgggtaaagtacgaaaggatatacaacaatgggagccgtccaggggatggaatgactggacccaagtcccattctgtagtcaccactttcacgaattagtaatgaaagatggcagagttctggttgttccatgccgaaatcaggacgaactaattggcagggcacgtataagtcagggcgcagggtggtcgctaaaagaaacggcttgcctaggaaaaagctacgctcaaatgtggacgttgatgtattttcatcgccgagatttgcggttggccgcaaacgctatctgtagcgctgtgccttctcattgggttccaacgtcaagaacaacctggtcaatacacgccaaacacgaatggatgactacagaagacatgttagcggtatggaatcgtgtttggattcaagaaaatccatggatggaagataagactccagttgaatcttgggaagaggtaccgtatctcggcaaacgtgaggaccaatggtgcggttctctaatagggcttacaagtagagccacatgggcgaaaaacattcagaccgcaataaaccaagtcagatcgctaattggaaatgaagaatacactgattacatgccctccatgaaaaggtttcgtcgagaagaagaagaagctggagttctgtggtga

SEQ ID NO: 22297 - RNA, 9876 nt, synthetic construct
  misc_feature 1..9876: note = derived and/or modified CDS sequence (opt6) from DENV-2__KJ189305__SS-prME
  source 1..9876: mol_type = other RNA
accgcgggtgtaatagttatgctgataccaactgcgatggcatttcatctgactactcgaaatggagaaccgcatatgatcgtaggaagacaagaaaaaggaaaaagtctcttgtttaaaacagaagacggggttaatatgtgtacattaatggcgattgatctaggtgagctttgcgaagatactataacttataaatgtcctctactacgacaaaatgaaccagaagatatcgattgttggtgtaatagtacttctacatgggtaacctacggtacctgtactactacaggagaacacaggcgagagaaaagaagtgtagcattagttccacatgtaggaatgggtttagaaacacggacagaaacctggatgtcatccgaaggagcatggaaacatgtacaacgaatagaaacatggattctacggcacccgggattcacaataatggctgcaatattagcgtatacgatcggaacaactcacttccagagagctctcatattcatattattaacagcagtagctccatcaatgacgatgagatgcataggaatttccaatcgagatttcgtagaaggagtaagcggtggatcctgggtggatatcgttttagaacatggaagttgcgtaacgacaatggccaaaaacaaaccaacattagacttcgaactaataaaaacagaagcaaaacaaccagcaacgctacgtaaatactgtatagaagcaaaattaacgaatacgaccactgaatccagatgtccgactcagggcgagccttcactgaacgaggaacaagacaaacgattcatatgcaaacactcaatggtagacagaggctggggaaatggatgtgggctatttggcaaaggagggatcgtgacctgcgcaatgttcacctgtaaaaagaatatggagggcaaagtggtacagcccgagaatcttgaatacacaattgttatcaccccacactcgggtgaggaacatgcagtaggcaatgatactggaaaacatgggaaagaaataaaaattaccccacaatcatcgattaccgaagctgaactaacaggttatggtacagttaccatggaatgtagcccaaggacaggcctggactttaatgaaatggttttattgcaaatggaagataaggcttggttagtacatagacaatggttcttagaccttcccctgccatggcttccaggagctgacactcaaggatctaattggattcaaaaagagactctcgtgacttttaaaaacccacatgccaagaaacaggacgtagtagtcttaggaagccaggagggtgcaatgcacaccgctcttactggagcaactgagatacaaatgagcagtggtaacctgcttttcacaggtcacttaaaatgtagattgagaatggataaacttcagttaaagggtatgtcgtattctatgtgcactggaaaatttaaaattgtaaaagaaattgcagaaacacaacatggaacaattgtcatacgagtgcaatatgaaggagacggtagtccatgcaaaataccattcgaaataacagacttggaaaaacggcatgtcctgggaagactcataactgtcaatccaattgttacggaaaaggattccccagtgaatatagaggctgaacctccctttggtgactcgtatattatcataggagtcgagcccggacaactaaagctgaattggtttaagaagggatcctctataggacagatgtttgagactaccatgagaggggcaaaacgaatggctatacttggagatacagcttgggattttggatcgttaggcggcgtttttacgagtatcggtaaagcacttcaccaggtgtttggtgctatctatggcgcggcattttcaggcgtgagctggaccatgaaaattctaatcggtgttataataacatggattgggatgaactcacgctctacttcactaagtgtttcattagttctcgtgggagtagtcactctatacttaggtgcaatggtacaggcagattccggttgtgtcgtctcctggaaaaacaaagaactaaaatgtggtagcggaatttttataaccgacaatgtccacacttggacggaacagtacaaatttcaaccggaatctcccagcaaattagcctcagcaatacaaaaagcacacgaagaaggaatttgtggaatccggtccgtaacacgattagaaaatctaatgtggaagcaaataacgcctgaacttaatcacatactctccgaaaatgaggtaaaactaaccataatgacgggtgacataaaagggattatgcaggctgggaaaaggagtttgagaccgcagccaacagagttgaaatattcatggaaaacctggggaaaagccaagatgttatctacggagtcacacaaccaaacatttttgatagacggccctgaaacagcagagtgccccaacacaaatcgagcgtggaactcgcttgaagttgaagattatggattcggtgtatttactacaaatatctggctaaagctcaaagaaaagcaagacgtattttgtgatagtaaattaatgagtgcggcaattaaagataatagagccgtacatgcagacatgggatattggattgagtcagctttgaacgacacctggaagatggaaaaggctagctttatagaagttaaatcttgccattggcccaaatcccataccttatggagtaatggcgtcctagaaagtgaaatgattataccaaagaattttgctggtcctgcaagccaacacaactatagaccaggatattacactcagacagccgggccttggcatttagggaaacttgaaatggacttcgatttttgcgaaggaacaacagtagtagtaacagaagattgtggaaatcgaggacctagcctaagaacaacgaccgcatcgggcaaactgattacagaatggtgctgtcgcagctgcactctgccgccactacgttataggggagaagatggatgttggtacggtatggaaattcgacccctcaaggaaaaagaggaaaatctagtaaactctctcgtaactgctggacatggtcaaattgacaacttctccttgggggtgttaggtatggcattatttttggaagagatgcttagaacaagagtaggcacaaaacacgccatactacttgttgctgtctcatttgtaacattgataactggaaacatgagtttccgggacctgggtagagtcatggtcatggttggcgctacgatgacagacgatataggcatgggagtcacatatttagcattactagcagcctttaaagtcaggccaacattcgccgcaggattacttttaagaaaattaacgtcaaaggagctgatgatggccactatagggatcgctctattatctcaatcaacaattccagaaaccattctggagctgactgacgcacttgcgctaggtatgatggttctgaaaatagttagaaacatggaaaaataccagctagcagtcactatcatggcaatttcttgtgtacccaacgcagtaatactacaaaacgcttggaaggtatcttgtaccattttggctgcggtatcagtatcacctctattattaacgtcttcgcaacagaaagctgactggatccccctagcactcacaattaaaggtctcaatccaacagcaatatttttaacgacgttatcaagaacaagtaagaaacggtcctggcctctcaatgaagcaataatggcagtgggtatggtatcaattctagcaagctcccttctcaaaaatgatattccaatgactggtcccttagtagcgggaggtctgcttaccgtctgttatgtgttaactggaaggtcagcagacttagaattagaacgagcagcggacgttaaatgggaagatcaagcggaaatttcaggttcctctccgattttatcaattacgatttcagaagacgggagcatgtcaatcaaaaatgaagaagaagaacaaactctaacaatactaatccggaccggactattagttatatcaggagtttttcctgtttcaattccaattacagccgctgcgtggtatctatgggaagttaagaaacagagggccggtgttttatgggacgtaccgtctcctccacccgttggaaaagctgaactggaagatggggcatatagaataaaacaacgtggaatacttggttatagtcagataggcgctggggtatataaagaaggtacatttcatacgatgtggcacgtaactagaggggccgtccttatgcataggggcaagaggatagaaccatcatgggctgatgtcaagaaagatttgatttcgtatggaggagggtggaaactggaaggcgagtggaaagaaggagaggaagtccaagtactggctctagaacccggcaaaaatccccgtgcagtacaaacgaaacccggaatatttaagacaaatacaggtactatcggagcagtgagcttggacttttcacctggcacgtccggatctccaatagtggataagaaaggcaaagttgttggtttgtatggtaacggcgtagtaaccaggagcggtgcttatgtgtcggcgattgctcaaacagagaaaagtattgaagataatccagaaatagaggatgatattttcaggaagaaaaggttaaccataatggacctgcatccaggtgcgggtaaaacgaaacgttacttgcctgcaatcgtcagagaagcaataaagagaggattgagaactctcattttggcgccaaccagagtagtcgctgctgaaatggaagaagcattaagaggacttcccatacgataccaaaccccagcaataaaggcggaacatactggcagggaaattgttgatctgatgtgccacgcaacctttactatgcgtcttttaagcccagtgcgtgttccgaactataatctaataattatggatgaagcacactttacggatcccgcctcgatcgcagccagaggttatatatctacaagagtcgaaatgggtgaagcggctggaatatttatgacggcaactcctccaggctcccgcgatccatttcctcaatcaaacgcaccgataatggacgaagaacgagaaataccagaaagatcttggaactctggacatgaatgggtgaccgacttcaaagggaagacagtgtggttcgtgccttctatcaaagctggcaatgacatagccgcatgcttgagaaagaatggcaagaaagtgatacaattatcacgaaagacatttgactcagaatatgtgaagacgcgtgccaacgactgggattttgtagtaacaacagacataagtgagatgggggccaattttaaagccgaacgagtgatagacccgagacgatgtatgaagcctgttatactcacagatggagaagaaagagtgatactcgcagggccgatgccggttacccacagctcagccgcccagaggagaggccggataggacggaatcccaaaaatgaaaatgatcaatacatctatatgggagaaccattagagaatgatgaggactgtgctcactggaaggaggcaaagatgcttctcgataatattaatacaccagagggaattattccaagtatgtttgaacctgaaagagaaaaagtagatgccattgatggggagtatagacttagaggtgaagctcgtaagacttttgtcgacttaatgcgtagaggcgacctcccggtctggctagcctacaaagtggcagcagaggggattaattatgctgacaggaaatggtgttttgacggtatcaaaaacaatcaaatattggaagaaaacgtagaggtcgagatctggacaaaagaaggtgaaagaaagaaactgaaacccagatggctggatgcacgaatttactctgatcccctggcgcttaaagaatttaaagaatttgcagcagggcggaaatcactaacattaaatcttatcactgaaatggggaggttgcctacatttatgacacaaaaggcacggaatgcccttgacaatcttgcagtgcttcatacagcagaagcagggggcagagcatacaaccatgcattgtcagaactccccgaaactttagaaactttacttctacttacattactcgccactgtaaccggaggcattttcctgttcttgatgtcaggtaaggggataggtaaaatgactctcggaatgtgttgtataataacagcctctatattattatggtatgctcaaatacaaccacactggatcgcagctagtataatcttagagttctttttgattgtattgcttatcccagaaccagaaaaacaacgcacacctcaggataatcagttaacttacgtggtaattgctatactaacagtggtagccgcaacaatggctaatgagatgggtttcttagaaaagacgaagaaagacctaggtctaggatcgataactacacaggaaagtgaatccaacatactagatatagacttacgaccggcatccgcctggactctatatgcagtggcaacgacatttgtaactcctatgctacgacattccatagagaactcatcagttaatgtgagtctcacagctattgccaaccaggctactgtactgatgggactagggaaaggttggcctttgtcgaaaatggatatcggagtcccattactagctataggttgctactcccaggtaaatccaattacgcttacggcagcattactgctattagttgcccattatgcaatcattggccccggtctacaagcgaaagctacaagagaagctcaaaaacgagctgcagctggaataatgaaaaatcctacggttgatggaataaccgttatagatctagagcctataccctacgatccgaaattcgaaaagcagttgggacaggtaatgttactaatattatgcgtaacacaagtattaatgatgaggacaacttgggcactctgtgaagcactcacattggcgacaggccccattagtacactatgggaaggcaaccctggaagattttggaacaccacaatagccgtctctatggccaacatctttcggggctcgtatcttgctggggctgggttattattttcaataatgaaaaatactaccaatacacgaagaggtacaggtaatattggagaaacacttggggaaaaatggaagtctcgtctaaacaccttaggaaaatcggaatttcaaatatataagaaatccggtatacaggaggtagatagaacattagcgaaagaaggcattaagagaggagaaacggatcatcacgcggtaagtaggggttcagccaaacttcgatggtttgttgaacggaatatggtaacaccggaggggaaagtcgtagatctcggatgtggccgtggtggatggtcatattactgtggcggattgaaaaacgtaagagaggtaaaaggactaacgaagggaggaccgggacatgaagaaccgataccaatgagtacatatggttggaatcttgttagactacaatcaggtgttgatgttttctttacgcctcctgagaagtgtgatacattactctgcgacataggcgaatcaagtccaaaccctactattgaagcgggtcggacactgagagtgttgaatctagttgaaaactggttaaataacaatactcaattttgtataaaagtgttaaatccatatatgcctagcgtaatagagaaaatggaaacacttcaaagaaagtatgggggagcacttgtccgaaatcccttatctagaaattccacacatgagatgtattgggtatcgaatgcgacaggaaacatagtgagtagtgtaaacatgataagccgcatgcttataaaccggttcacaatgaaacataaaaaggctacctatgagccagacgtagacttgggatccggaacacgcaacataggtatagagagcgaaattccgaatttagatataattgggaaaaggatagagaaaataaaacaagaacatgaaacaagctggcactacgatcaagatcacccttataaaacatgggcataccacggaagctacgaaacaaaacaaacaggctcggcaagttcaatggttaatggtgtcgtgagattgttaacaaaaccttgggacgtggtcccaatggtaacacagatggcaatgacagatactactccatttggacaacaaagggttttcaaagaaaaagtcgatactagaacccaggaaccgaaagaagggacaaagaaactaatgaaaatcacagcagagtggctatggaaagaattggggaaaaagaaaacgccaaggatgtgcacaagggaggaatttacgagaaaagtcaggtccaacgctgcgctaggtgccatattcacagacgagaacaaatggaaatccgcacgcgaggctgtggaagacggtaggttctgggagttggtggaccgtgaacgtaatctacacttagagggtaaatgtgaaacatgcgtatataatatgatgggaaaaagagagaagaaacttggagaatttggaaaagctaaagggtcacgcgctatatggtatatgtggttgggagcacgtttcctggaatttgaagcgctcggattcttaaatgaagaccactggttctcaagaggaaattcgttatcaggggtcgaaggcgaaggattacataggttgggttacattctgcgagatgtcgggaagaaagagggaggggcgatgtatgccgatgatacagcgggttgggatactcgaataactctagaagatctcaaaaacgaagaaatggtaacaaatcatatgaaaggggaacataagaaattggcggaggcaatattcaaattaacataccagaataaggtcgtacgagtccaaagaccaactcctcgtggtacagtcatggatataatatcacgcagagaccaaagaggttcaggacaagttggcacatacgggttaaataccttcacaaatatggaagctcagcttatccgtcaaatggaaggtgagggcatttttaaatccatacaacacctcacagcaactgaagaaatcgcggttcagaattggcttgcgagggttggacgggaacgactgtcaaggatggccatatctggagacgactgcgttgtaaaaccaattgatgacagattcgcaagtgcgttaactgcgctaaacgacatgggaaaagtacgtaaagatattcaacaatgggaaccctcgcgcggctggaacgactggactcaggtaccgttctgtagccaccattttcacgaacttgtaatgaaagatggtagagtgttggttgtcccttgccgaaaccaggatgaactaatcggtagggcaagaattagtcaaggagctggctggtcgttaaaagaaacagcatgtctcggaaaatcatatgcacagatgtggacgttaatgtactttcatagacgtgatttaagattagccgctaatgcgatctgctccgcagtgcctagtcattgggttcccacctcccgtacaacttggagtattcatgccaagcacgaatggatgacgacggaagacatgttagccgtatggaatagggtatggatacaggagaacccttggatggaagacaaaaccccagtagaatcatgggaagaagtaccctacttaggaaaacgagaagatcaatggtgcggatctttgattggattgactagccgggctacatgggccaaaaatatacagacggcaataaaccaagtgcgtagtctgatcggaaatgaagaatatacggattatatgccatcaatgaagcgttttcgacgtgaagaggaagaggcaggcgtgctttggtag

SEQ ID NO: 22298 - RNA, 9876 nt, synthetic construct
  misc_feature 1..9876: note = derived and/or modified CDS sequence (opt6) from DENV-2__FJ898451__SS-prME
  source 1..9876: mol_type = other RNA
actgcgggggtaatagtcatgctaatacctactgccatggccttccacttgacaacacgaaatggagaaccacacatgattgttggaagacaggaaaaagggaaatcattactttttaaaactgaagatggagttaatatgtgtactcttatggctattgacttgggggaactatgtgaagacacgataacatataaatgtccactgctacgccaaaatgaaccggaagatatagattgttggtgcaattctacttccacatgggtgacatatggaacatgcacgactactggagaacaccgtagggagaaaagatcggttgccctagtacctcacgtaggaatggggttagaaacacgtacggaaacatggatgtcaagtgaaggagcgtggaaacatgtacaaagaatagagacctggatattaagacatcctggatttacgattatggccgcaatcttagcatacacaattggaaccacccattttcagagagccctgatattcatacttttaacagcagtagcaccaagtatgacgatgagatgcatcgggatatcaaatagagacttcgtagaaggggtaagtggaggatcgtgggtagatattgttttggaacatggttcgtgtgtaaccacaatggctaaaaataaaccaactctcgattttgaattaataaaaactgaagccaaacaaccggctacgctgagaaaatactgcatagaagcaaaacttacaaatactacaacagaaagtcgatgtccaactcagggcgagccttctttaaatgaagaacaggacaaacgattcatatgcaaacactccatggtagatagggggtggggaaatggctgcggtctatttggaaaaggtggcatagtcacatgcgccatgttcacttgcaagaaaaatatggagggaaaaattgtacagccggagaatctagaatatactattgttataaccccacacagtggggaggaacatgcagtaggaaacgatacgggtaaacatggaaaagagattaaaattactccgcaaagcagtactacagaagctgaattgacaggatacggaacagtaacaatggaatgttctccccgaacgggccttgacttcaacgaaatggtacttttacagatggaagataaagcctggcttgttcatcgacaatggtttctcgacttgccactcccttggttaccaggggcagatacgcaaggtagtaactggatacaaaaagaaactctagtgacctttaaaaatccacatgcgaagaaacaggatgtagtagtccttggatcacaagaaggtgcaatgcatactgctctcacaggcgcaaccgaaatacaaatgagcagtgggaacttactattcacagggcatttaaaatgtagattaaggatggacaaactccagcttaaaggtatgtcgtactcaatgtgcactggaaaatttaaaattgtcaaagaaattgctgaaacacaacatggtacaatagttataagagtacaatacgagggagacggatccccctgcaaaataccattcgaaatcacggacctcgagaaacgtcatgtattgggcagactaataaccgtaaaccctatcgtaacagaaaaagattcaccggtaaatatcgaggccgagccaccttttggagattcatacataatagttggagttgagccaggtcaactaaaattaaattggttcaagaaagggtcatccattggccagatgttcgaaacaacaatgagaggcgcgaaacgcatggcaattttgggagatacagcatgggatttcgggtcattaggaggcgtattcacttcaataggaaaggccttgcatcaagtatttggagcgatatatggtgctgctttctcaggtgtgtcgtggaccatgaagatattaataggcgtaatcataacttggattggcatgaactcacggtctacaagcctttcagttagtttagtcctagtgggggtggtaaccctatatctaggagtgatggtacaagcagactcaggctgcattgttagctggaaaaacaaagagttgaaatgtgggagtggtatattcatcaccgacaacgtccacacatggacagagcaatataaatttcagccggagagtccatcaaaactagcatcagctatacaaaaagcacatgaagaaggaatctgtggaataaggtccgtcacaagactggagaacttaatgtggaaacaaataacacctgaacttaatcacatattgagcgaaaatgaagtaaaattgactataatgacgggagatattaaggggataatgcaagcggggaagcggtcattacgtcctcaaccaacggaattaaagtatagctggaaaacatggggtaaggctaagatgctatctaccgaatcacacaaccaaacctttcttatagatggacccgaaacagcggagtgtcctaacacgaatcgggcatggaatagtttagaagttgaagattacggatttggtgtattttccacaaatatatggctaaagttacgagaaaaacaggatgtattttgcgattcgaaacttatgagtgctgcaattaaagacaatagagcagtacatgctgatatgggctattggattgaaagtgtactaaacgatacttggaaaatggaaaaagcatctttcatagaagtgaagagttgtcattggccgaaatctcatacactatggtcaaacggcgtgcttgagagtgaaatgattatacccaaaaattttgcaggaccggttagtcaacataactatcgaccaggatatcacacccagactgccggtccctggcaccttggaaaattagagatggattttgatttttgcgaagggacaacagtagtcgtaaccgaagactgtggaaatagagggcctagtttacgcacgactactgcttcgggcaaattaatcaccgagtggtgttgtcgttcctgcactctaccacctctaagatatcgaggagaagatggatgctggtatggtatggagatacggccactaaaagaaaaagaagagaatttggtaaattcactggttacagccggtcatggacaaattgacaactttagtctgggtgttctagggatggctttatttctggaagaaatgctaaggactagagtaggaaccaaacatgcaatattgttagtggccttaagttttgtaactttaattacaggtaatatgagttttcgagacttagggcgggtgatggttatggtcggcgccacaatgactgatgatattgggatgggggttacttatttagcactattagcagcatttaaagtgagacccactttcgcagccggattactattgagaaaactaacaagtaaggaactgatgatggccaccataggtattgctttacttagtcaaagtaccttaccagaaacaatactagagctgactgatgcactagcactgggaatgatggtcttgaaaatagttaggaacatggaaaaataccagttggctgtgaccataatggcaatctcctgtgtacccaacgcagtgattctgcaaaacgcttggaaagtcagctgcactatacttgcggcagttagtgtctctccgttgctattaacgtccagccaacagaaagcagattggattccgttagctctaacaattaaaggactgaatcctacagcaattttcctcaccaccttaagtcgaacaagtaagaagagaagttggccactaaatgaggccataatggcagtcggtatggtaagcatacttgctagttcgttgttaaagaacgatatacctatgacgggcccgcttgtagcgggaggtttgctgactgtatgctacgtactaacgggcagaagtgccgacctagaattagagagagcagcagacgtaaaatgggaagaccaagcagaaataagcggatcgtcgccaattttatcaataacaatatcggaagatggtagcatgagtattaagaatgaggaagaggaacaaacattaacgatactaattagaactggtttactcgttatatcgggagtattcccggtcagtatccctataacggctgctgcgtggtatctgtgggaagtcaaaaagcaaagagccggtgtactctgggatgttccctcgcctccacctgtcggtaaggctgaactggaagatggagcataccgaataaagcaaagaggcattctaggttactcacaaattggagccggggtttacaaggaaggaacttttcatacaatgtggcatgtaacgagaggggcagttctaatgcacagagggaaacgtatcgagccatcatgggctgacgtgaagaaagacttgataagctatggtggtggttggaaattggaaggagaatggaaagagggagaggaagtacaggtcctagctctggaacccggcaaaaatccaagagcagtacagacaaagccaggtatatttaaaaccaacactggtacgataggagcagttagcttagacttctcgccgggtacttcaggatcaccaatcgtagataggaagggaaaagtagtcggcctgtatggtaatggcgtggttacaaggagtggcgcgtatgtgagtgctatagcacaaacggagaaaagtattgaagataatcccgaaatcgaagacgatatattcagaaagaaacgtcttacaatcatggatctacatccaggagcaggtaaaacgaaacgctacttacctgctatcgtgcgagaagcgattaagcgtgggctgcgaaccttaattcttgcacctactcgagtggtagcagcggaaatggaagaggctctcagggggctacctatacgttatcaaacaccggccatacgagcagagcatacaggtagagaaattgtggacttaatgtgccatgccacattcacgatgcgattacttagcccagtcagagttccgaactacaatttgatcatcatggacgaagcccactttactgatccagcaagtatcgctgccagagggtacattagcactcgcgtcgaaatgggagaggctgcaggaatatttatgacagccacaccacctggctcgagggatccattccctcaaagtaatgcacctattatggatgaagagagggagattccagagcgaagttggaactccggacatgaatgggtaactgactttaaagggaaaacagtatggttcgttcccagtattaaagccggcaatgacattgccgcttgcttgcgaaagaacggcaaaaaggttatacaattatcgagaaaaacatttgattcggaatacgttaaaacaagggcaaatgattgggattttgttgtaacaacagacataagcgaaatgggcgccaactttaaagcagaacgtgtaatagatcctagacgctgtatgaaacctgtaattctcactgatggggaagaacgggtcattttagcaggccctatgcctgtgacgcactcaagcgccgcacaacgacgaggtagaataggaagaaaccccaaaaatgaaaatgatcaatacatatatatgggcgaaccattggagaacgacgaagattgtgcacattggaaagaagcaaaaatgctcttagataacattaacactccggaaggtattatcccaagcatgtttgaaccagaaagagaaaaggtggatgctattgacggggaatatcgtctacgaggtgaagctcgaaaaacatttgttgatctaatgcggcggggagacttaccagtatggttagcctataaagtcgcagctgagggtattaactatgcggaccgcaaatggtgctttgatggcataaagaataatcagatattagaagaaaatgtagaagtggagatttggacaaaagaaggagaacgtaagaagctcaaaccgcggtggttagatgccagaatatattcagacccacttgcacttaaagagttcaaagaatttgctgcgggacgtaaatcgctgaccctgaacttgataacggaaatgggtagattacccacattcatgacacaaaaagcaagaaatgcactagacaatctcgctgtcctacatacagcagaagtagggggacgagcatataatcatgccttatctgaactaccagaaactcttgaaactttactactacttacattattagcaacggtgaccggaggcatctttctatttctaatgtctggaaaaggtataggtaagatgacccttgggatgtgttgtataattacggcctctatactgttatggtatgcacaaatacagccgcactggatagcagcatcaatcattctggaatttttcttgatagttttgttgataccagaaccagaaaagcagaggacaccacaagacaatcaattaacctatgtagtaattgccatacttactgttgtcgcagcgacaatggctaatgaaatgggtttcttagagaaaactaagaaagatctaggctttgggtctataacgacacaagagtcagaatcaaatattctagacattgacttaagaccagcctcggcctggactttatatgccgtcgcaacaacatttgtcacacctatgctccgacactcgatagaaaactcttcagttaacgtaagtttgacagccatagcaaatcaagctacggtcctcatgggtttagggaagggatggccattgtctaaaatggatataggggtaccgttgcttgctattggttgctactcgcaggtcaatccgataacactaaccgctgcattactactgttagttgctcactatgctataataggtccaggacttcaggcaaaagctacacgtgaagcacaaaagcgagccgcagccggtataatgaaaaatcctacagtcgacggtataacagtaatagatttagagccgataccctacgatccaaaattcgaaaaacaattgggtcaagttatgttgttaatactgtgtgttacacaagtacttatgatgcggactacatgggccttatgtgaagcattaacccttgctactggtcctatttctactctttgggaaggtaatcccggaagattttggaacaccactattgcagtatcaatggcaaatatcttcagaggatcttatctggcaggagccggactactattttcgattatgaaaaatactactaacactagaagaggtactggaaatgtaggtgagacactaggagaaaagtggaaaagtagactaaatgcacttgggaaaagcgaatttcaaatttacaagaaaagtgggattcaagaagtggataggaccctagcaaaagagggtataaaaaggggagaaacagatcaccacgcagtaagtagaggatctgcaaaattaagatggttcgtcgaacgtaatatggtcacaccggagggaaaagtggtagatctaggatgtggacgaggaggatggtcctattattgcggtggactcaaaaatgtaagggaagtaaaaggcctcactaaaggagggccggggcacgaagaaccaataccgatgagtacatatggatggaatctggtaagattacagagcggagtagacgtattctttacgccgccagaaaaatgcgacacgttactttgcgatataggtgaatcttcaccaaatcctactattgaagccggcagaacattaagagttctgaacctggtggaaaattggcttaacaacaacactcaattttgcataaaggtacttaacccttacatgccatcagtgattgaaaagatggaaaccttacagcgcaagtacggcggagcgctggtgcgaaatccgttgtcaagaaattcaacacatgaaatgtattgggtaagcaacgcgacgggaaatattgtctcgagcgtaaatatgatatcaagaatgctaataaatcgattcaccatgaaacacaagaaagcaacatatgagccagatgtagatttaggctcaggcacgcgaaacattgggattgagagtgaaataccaaacctcgacataatcggaaagcgaatagagaaaattaaacaagaacatgaaacaagctggcactacgaccaggatcatccatataagacttgggcatatcacgggagctatgagaccaaacaaaccggttcagcttcatcaatggtaaacggcgtcgtaagactgctcacgaaaccttgggatgtagtgcccatggtcacacagatggccatgactgacacaactcctttcggacaacagagagtgtttaaggagaaggtagatactagaactcaggaaccaaaggaaggaaccaagaaacttatgaaaataacggccgaatggctgtggaaagaactaggtaaaaagaaaacgccgagaatgtgcacgagagaagagtttacacggaaagtaagaagcaatgcagcactaggagctattttcacagacgaaaataaatggaaatctgcccgagaagctgtcgaggatggtaggttctgggaacttgttgatcgagaacggaatctccatttagaaggaaagtgtgaaacatgcgtctataatatgatgggcaaaagagagaagaaactaggggagtttggtaaagcaaagggttcacgagcaatatggtatatgtggctgggagccaggtttctagaatttgaggctttagggtttcttaatgaggatcattggttctctagaggaaattcactatcaggagttgaaggggaagggctgcatagattaggctacatactgcgggaggtaggcaagaaagaaggtggcgccatgtatgctgatgacactgcaggatgggacacaagaatcacattagaagaccttaagaacgaagagatggtaacaaaccatatgaagggggagcataagaaactcgcggaggcaatatttaaattaacgtatcaaaataaagtcgtcagggtacaacgaccaactccaagaggtaccgtgatggatattattagcagaaaagaccagagaggtagcggccaagttggaacgtatggattgaacacttttaccaacatggaagcacagttaatcagacagatggaaggtgagggaatatttaaatctatacaacatctaactgccacggaagagattgcagtgcagaattggttggcacgcgtcggtagggaacgtttaagccgcatggctatttcaggtgacgattgtgttgtgaaacctatagatgatcgatttgctagtgcacttacagcgctcaacgatatgggaaaggtcagaaaagacatccaacaatgggaacctagtaggggatggaatgattggactcaggttcctttctgtagtcaccatttccatgaattagtgatgaaggatggaagggtattagttgttccttgtcgtaatcaagacgaattgattggtcgagcacgaataagccagggagcggggtggagcttaaaggaaacggcctgcttggggaaatcatacgctcaaatgtggaccctaatgtacttccaccggagagacctacgtctagctgccaatgcaatctgctctgcagtcccaagtcattgggtcccgacatcaaggactacgtggtctattcatgcgaaacacgaatggatgacaaccgaggatatgctcgctgtttggaatcgagtctggatacaagaaaatccatggatggaggacaaaacaccggtagagtcatgggaggaagtaccatatcttggaaaaagggaagatcaatggtgtggctctcttatcggtcttacaagccgagcaacctgggccaaaaacatccagacggctataaatcaagttaggtcactcattggaaacgaagagtacacggactatatgccaagcatgaaacgctttcgaagagaagaggaggaggcgggagtattgtggtaa

SEQ ID NO: 22299 - RNA, 9876 nt, synthetic construct
  misc_feature 1..9876: note = derived and/or modified CDS sequence (opt6) from DENV-2__HM488257__SS-prME
  source 1..9876: mol_type = other RNA
actgcagggatcataataatgatgattccgacggtgatggcttttcatctaactacacggaacggcgaaccacacatgatagttagccggcaagaaaaaggaaaatcattactatttaaaaccgaaaatggagtgaatatgtgtactctgatggcaatggacttaggcgaactatgtgaagacactataacctataattgcccattgctacgacagaatgaaccagaagatattgattgctggtgtaattcaacgtcaacgtgggtaacatatggtacctgcacagtaaccggcgaacatcggagagagaaacgatctgtagcattggtaccacacgtaggaatgggtctagaaacaagaacggaaacatggatgtcaagtgaaggggcatggaaacatgctcagagaattgaaacttgggtattgcgtcatccaggatttactataatggcagcaatactagcctacacaatcggaacaacctactttcaaagagtattaatttttatcttgctaacagccgtggcaccaagtatgaccatgagatgtatcggtattagtaaccgtgattttgtagaaggagtttccggcggttcgtgggtagatatagtacttgaacatggaagctgcgttacgacaatggctaaaaataaaccaactcttgattttgaactaattaaaactgaagcaaaacatccggcaacactaagaaaatactgtatagaagctaaattaacgaacacaacaacggcttcccgatgcccaacgcagggtgaaccatcactcaacgaggagcaagataaacgattcgtttgtaaacacagcatggtagacagagggtggggcaatggatgtgggttgttcggaaaaggcggaatagtgacatgtgctatgttcacttgtaagaaaaatatggaaggtaagatagtgcagccagagaacttggaatatacaatagtcataactccacattcgggtgaagaaaatgctgtaggaaatgacacaggtaaacacgggaaagaaattaaagtaacccctcaaagctcaataaccgaggcagagctaacgggatacgggactgtaacaatggaatgttctcctaggacaggacttgattttaacgaaatggtactattgcaaatggaaaataaagcatggttagtgcaccgtcagtggttccttgatcttccacttccttggttaccaggggcagatacgcaagggtcaaactggatacaaaaagaaacgctcgtaacatttaaaaacccccacgccaaaaagcaagatgttgtagtcttgggcagtcaagaaggagcaatgcataccgcactaacaggagcaacagaaatacaaatgagtagtggaaatttactttttacgggacatttaaaatgtagactgagaatggacaaattacaactgaaaggcatgtcctatagtatgtgcacgggcaaatttaaagtcgtaaaggagattgctgaaacacaacatggtacaatagtgatacgggtgcaatatgaaggtgatggctccccatgtaaaatccctttcgaaattatggacttagagaaaagacatgtcttaggcagacttataaccgtgaacccaattgtaacagaaaaggattcacctgttaacatagaggcagaaccgccgttcggggatagttacattattgtcggtgtggaacctggtcaacttaaactaagctggtttaagaaagggagttcaatcggacaaatgtttgaaacaacaatgaggggagcaaaaagaatggcaatactaggggacactgcgtgggactttggaagtctaggaggggtgtttacttctataggtaaagccttacaccaagttttcggtgcaatatacggagctgccttttcaggggtcagttggacaatgaaaatactaataggcgttgtaataacgtggatcgggatgaacagcagatcaacttctctcagcgtcagcttagtcctggttggggtagtcacactgtatttaggagtgatggttcaagctgacagtggatgtgtagtatcctggaaaaacaaagaattaaaatgtgggagtggcatatttattactgataatgtacatacctggactgaacaatacaaatttcaaccagagagtccatctaagttagctagtgctatacaaaaggcccatgaggaaggcatatgtggaatccgttctgtcactcggctagaaaacctaatgtggaaacagataactccagagctaaatcacattcttagtgaaaacgaggttaagctgacaattatgaccggagatattaaaggaataatgcaggctgggaaaagatcacttagaccacaaccgacagaattaaagtattcgtggaaggcttggggtaaagcaaaaatgctatctacggagttgcacaatcatactttcttgatcgatgggcccgaaacagcggagtgtccaaatactaaccgagcctggaactcattagaagtagaagactacggatttggagtattcactacaaatatatggcttaagttgaaggagagacaagacgtattttgtgatagcaaacttatgtctgcagcaataaaggataatagagcggtccatgctgatatgggttactggatagaaagcgctcttaatgatacatggaaaatcgaaaaagctagcttcatagaagtcaaatcttgccattggccaaaaagtcacactctctggtctaatggtgttctagaaagtgaaatgataatacccaaaaattttgcaggcccagttagccaacataattaccgaccaggttatcacactcaaaccgcaggaccgtggcacctaggacgactcgaaatggacttcgatttttgcgaaggaactacagtagtagttacggaagattgcggtaatagaggaccgagtctaaggacgacgactgcttctggaaagttaattactgagtggtgttgtagatcctgtactctaccaccactaagatacagaggagaagacggttgctggtacggtatggaaataagacctttaaaagaaaaggaagaaaatcttgtaaatagccttgtgactgcaggacatggccagatcgataactttagtctaggtgtcttgggcatggctctatttctagaagaaatgctgaggactagggtggggacaaaacatgcaattctccttgttgctgtctcctttgtaacattgatcacaggcaatatgagctttcgagatttaggaagggtaatggtaatggtaggcgcaacaatgactgacgatataggaatgggagtaacatatctagcgctactggccgcttttaaagtccgaccaacatacgctgcagggctacttcttcgtaaactgacatccaaggagttaatgatgacaactataggtattgttctattatcacagagtacaataccagaaaccattttagagcttacggatgcattggcattgggtatgatggtattgaaaattgtacggaacatggaaaaatatcaattggccgtaacaattatggctatactatgtgtgccaaacgcagtaatcttgcaaaacgcttggaaagtttcttgcactactcttgccatggtctcagttagtccattgttgttgacaagttctcagcaaaaagccgattggatacctttggcattaacaataaaaggattaaatcctaccgctattttcttaacaacactctcacgcacgtcaaagaagcgatcatggccactgaacgaagcaataatggctgtcgggatggtatccatattagcatccagtctattgaaaaacgatattccaatgacgggtccgttagtagctggcggacttttgacggtgtgttatgtcttaacaggtcgaagtgctgaccttgaactagaaagagcagctgatgtccggtgggaagaacaagcagaaatcagcggtagttcaccgattctctctattacaatttctgaagatggcagtatgtctattaaaaacgaggaagaagaacaaacgcttaccatactcataaggactggactgctggtaatatcagggctatttcccgttagtattccgataacagcagccgcatggtatctctgggaggttaaaaagcaacgagcaggcgtactttgggacgtaccaagtccgccaccagtcggaaaagccgaattagaagacggggcatacagaataaaacaaaaaggcatacttgggtattctcagataggcgctggggtatataaggagggaacatttcacacaatgtggcacgttactagaggagcggtattaatgcacaagggaaaaagaatagagccaagttgggcggacgtcaagaaagacttaatatcgtatggaggcggatggaagctagagggagagtggaaagagggcgaagaagtccaggtgcttgcattagaacctggtaaaaatccaagagctgttcaaacgaaacccggcttgttcaaaacaaacactggtacaataggagcagtcagtttagatttttctcccggaacaagtggatcgcccatagtagataagaaaggaaaagttgtaggtctttacggaaatggagtagtaacacgttcaggaacctacgtgtccgctattgcacaaaccgaaaagtccattgaggataatccagaaatcgaggacgatatattcagaaagaaaagacttactataatggatctccacccaggagcgggaaaaacaaaaagatatttgccagccatcgtaagagaagctataaaaagaggactgaggacactaatacttgctcctaccagagtagttgcagcagaaatggaagaagcgctcaggggtctaccaataagataccagacaccagcaattagagctgaacacacgggaagggagatcgtcgatctaatgtgtcatgcaacttttacaatgcggctactatcacctataagagtaccaaattataaccttataataatggacgaagcgcactttactgatccagcaagcattgcggctaggggttatatatcaactagagtggaaatgggcgaggctgcaggaatattcatgacggctacaccacccggttcaagggatccttttccacaaagtaacgcacctataatggatgaagaacgagagatacctgagaggtcttggaatagtggtcatgagtgggtcacagatttcaaaggaaaaaccgtatggttcgtcccttccatcaaggctgggaacgatatagcagcatgcctgaggaaaaatggcaagaaagtaattcagttgtcgagaaagacctttgattccgaatatataaaaaccagaacaaacgactgggattttgtagtaacaacggatatatcagaaatgggagcaaactttaaagctgaaagagtaatagatcccagaagatgtatgaaaccagttatattaacagatggagaggaacgagtgatattagcaggtcctatgccagtaactcatagttcggccgcacaacgtcgaggtcgagtcgggcgtaacccgaaaaatgagaatgaccaatatatctatatgggtgagcctcttgaaaatgacgaagattgtgctcactggaaagaggctaaaatgttactggataatattaatacacctgaagggataataccatctatgtttgaacctgaaagagaaaaagtagatgctatagatggagagtaccgacttcgtggtgaagcgcggaaaacatttgtggatctaatgagaagaggcgatttacccgtctggctggcctacagagtggcagcagaaggtatcaattatgctgatagacgttggtgttttgatggtgtcaaaaataatcagatcctagaagaaaatgtagaagttgaaatttggacaaaagaaggcgagagaaagaaattaaaacctcgctggctggatgcgcgtatttatagtgacccattggcactaaaagaatttaaggaatttgcagctggtcgcaaaagtttaacgttaaatttgataactgaaatgggtaggctaccgactttcatgacgcaaaaggccaggaacgccttagacaaccttgcagtcctacacacagcagaagcaggagggagagcatacaatcatgctctgtccgaattaccagaaaccttggaaacattactacttctaaccctgcttgctaccgtaacaggagggatatttttatttctcatgtctggaaagggcatcggtaagatgacattaggtatgtgctgtattataacagcatctatcctgctatggtacgcccagatccagccacattggattgctgcatcgataattttagaatttttcttaatagttttactaataccagagcccgagaaacagaggacaccgcaggataatcaacttacatacgtagttatcgcaatacttacggttgtagcggccacaatggcgaacgagatgggttttctagagaaaaccaagaaagatttcggactgggatcaattacaacacagcaaccagagagtaacattctagatatagatttaagacctgcatcggcatggacactgtatgcggtagctacaacattcattaccccaatgctaagacattcaatagaaaattcatccgttaatgtaagtctcacagcgattgctaaccaagctacagtacttatggggctaggcaaaggatggcctctaagtaaaatggacattggcgttcctttactagctataggatgttatagtcaggttaatcctataacgcttaccgcagctttactattactcgtcgcccattacgctattatcggacccggactccaagctaaagccacaagggaagctcaaaagcgggcagcggctggaatcatgaagaatccaactgtcgacggcattactgtcatagacctagatccaatcccctacgatcctaagttcgaaaaacaattgggtcaagtcatgctactcgttctatgcgtaacccaagtactcatgatgcgaacaacttgggctttatgtgaagcattgacactggcgacgggtccgatatcgacactctgggaggggaatccaggtcggttttggaataccactatcgcggtatccatggcaaatatcttcagaggctcgtatctcgcgggcgcaggactactattttctatcatgaagaacacagctaatacaaggagaggtactggcaacacaggcgaaacattaggtgaaaagtggaaacatcgactaaatgcgttaggtaaaagtgagttccagatatacaagaaatcgggcatacaagaagtggataggacattagcgaaggagggaattaaacgtggagaaaccgatcaccatgctgtttcaaggggctccgcaaaactgaggtggttcgtggaaaggaatttagtaacaccagagggcaaagtagtagatttgggatgcggccgcggaggttggagctattactgcggaggactcaaaaacgtgaaagaagttaagggactcactaaaggcggaccagggcacgaagaaccaataccgatgagtacatacggctggaacctggtgagattacagagtggagtagatgtatttttcacacctccagaaaaatgcgatacattactatgtgacattggcgaaagttcgccgaatcctactgtggaagccggtcgtactctaagggtgctaaatttagttgaaaactggttaaataacaacactcagttctgtatcaaagtattaaatccatatatgccgtcggtgattgaaaagatggaagcattacaacgcaagtatggcggagccttagtaagaaatccattaagtagaaattcaacgcacgaaatgtactgggtctcaaacgcaagcggaaatatcgtatcttctgtaaacatgatctcacgaatgttaatcaaccgatttactatgcgtcacaagaaagcaacgtacgaaccagatgttgacctgggttcagggacccgcaacataggaattgaatccgaaaccccaaacctggatataattggtaaaagaattgagaaaattaaacaagagcatgaaacatcttggcattacgaccaagatcatccttacaagacatgggcctatcacggatcatacgaaactaagcagaccggatcggcttcctctatggtgaatggggtggtaagactactaacaaaaccatgggatgttataccaatggtaactcaaatggcgatgacagatacaacccctttcggccagcaacgggtttttaaggaaaaagtagatacgaggacgcaagagccaaaagaaggtactaaaaagctaatgaaaataacagcagaatggttatggaaagagctgggtaagaagaaaacacccagaatgtgtacacgcgaagaatttacacgaaaagtacgaagtaacgcagcattaggcgcaatatttacagatgaaaacaaatggaagtcagcacgagaggccgttgaagacagtggtttctgggagctagtggacaaagaaagaaacctgcacttggaaggcaaatgtgaaacgtgcgtgtataacatgatgggcaaacgagagaagaaacttggtgagtttgggaaagcaaaaggctccagagcgatatggtatatgtggctaggtgcaaggtttctggaatttgaagcattaggcttcttaaacgaagaccattggttttcgaggaaaaattctcttagcggcgttgaaggagaagggctccataaactagggtacatactaagagatgttagcaagaaagaaggcggagcaatgtatgctgacgacacagctgggtgggatactagaatcactctagaggacttgaaaaatgaggagatggtgaccaatcacatggaaggtgaacataagaaacttgctgaggccatctttcgattgacatatcaaaacaaagttgtacgtgttcaacgtcctacaccaaggggaactgtaatggatataatctctcgacgagaccagagaggtagtggtcaagttgtaacatatggactgaatacttttacaaacatggaggcacagttgattcgacaaatggaaggtgagggggtatttaaatcaatccaacacttgacagcaactgaggagatcgcagtaaaaacttggttagtaagggtcggcagggaaagactgtctcgtatggcaatatccggtgacgattgtgttgtgaaacctctcgacgatcgctttgccagtgcattaacagcactaaatgacatggggaaagtgagaaaagacatacaacaatgggaaccgtcgcggggatggaatgactggacacaagtcccgttttgttcacatcacttccatgagctaattatgaaagatggccgagtattagtcgttccctgcagaaatcaagatgagttgatagggcgagccagaataagccaaggtgcgggctggagtttaagagaaacagcatgcctagggaaatcatatgcacaaatgtggagtcttatgtattttcaccgacgggatctccgactagcagcaaacgcaatttgttcggccgttccatctcattgggttccgacatcccggacgacctggtcaatacatgcgacacatgaatggatgaccactgaagatatgttaacggtgtggaaccgtgtttggatccaggagaatccctggatggaggataaaactccggttgaatcttgggaggaaataccctatttgggcaaacgtgaagatcaatggtgcggctctttaattgggttaacttctcgagccacatgggcgaaaaacatacagaccgcaataaaccaggtaagaagcctgatcggaaatgaagaatatacggattacatgccttcgatgaaacgctttcgaagggaagaggaagaagcaggagtactgtggtaa

SEQ ID NO: 22300 - RNA, 9876 nt, synthetic construct
  misc_feature 1..9876: note = derived and/or modified CDS sequence (opt6) from DENV-2__HQ999999__SS-prME
  source 1..9876: mol_type = other RNA
acagctggggtaatagtaatgcttatcccgacagcgatggcatttcatttaaccacaaggaacggagaaccacatatgattgtcggaagacaagaaaaggggaagtcattacttttcaaaaccgaggacggtgtaaacatgtgtacgctaatggctatcgacctgggggaattatgtgaagatacaataacatataaatgtccattgctccgacaaaacgagccagaagatatagattgttggtgtaattctacatcaacttgggtaacttatggcacgtgtactactacaggagaacatcgacgcgaaaaaagaagcgtagcacttgttccccatgtaggaatgggacttgaaaccaggacagaaacatggatgtcctcagagggcgcgtggaaacatattcaaaggatagaaacttggattctaagacatcctggcttcacaataatggccgcaatactggcatacactataggaactacacattttcaacgggctctaatttttattttattaactgctgtagcgcccagtatgactatgcgttgcataggtatatcaaatcgcgattttgtggaaggtgtatccggaggaagttgggtagatattgtcttagaacatggctcatgtgtaacgactatggcaaaaaataaaccaacattagatttcgaactaatcaagacagaagcgaaacaacctgcaacacttagaaaatattgcatagaagctaaactaaccaacactacaaccgagtcgagatgcccaacgcaaggagaaccctctctgaacgaagaacaggacaaacgatttatatgcaaacacagtatggtagatagaggctgggggaacggttgtggactcttcggaaaaggaggaattgttacatgcgcaatgtttacatgcaaaaaaaatatggaaggaaaagttgttcagcctgagaaccttgaatacaccattgtgattactccacattctggtgaagaacatgcagtaggtaatgacactggtaaacatggtaaagaaattaaaataacaccccagagttccataacagaagcagaattaactggttacggaacagtaaccatggaatgctcacccagaacgggattagattttaatgagatggtcttattgcagatggaagacaaagcatggctagtccatcggcaatggtttttagatcttcctctcccatggcttcctggtgcggacactcaaggatcaaattggatacaaaaagaaactttagttacttttaagaaccctcatgcaaaaaagcaggatgttgtcgtcctaggttcccaggaaggtgcaatgcacaccgctctaactggcgcaacggaaatccagatgtcatccggtaacttattgtttaccgggcacttgaaatgtcgtctacggatggacaagttacaactaaaaggcatgagttattcaatgtgtaccggaaagtttaaaatcgtaaaagagatagctgaaactcaacacgggacaatagtgatccgagttcaatatgaaggagatggttcgccgtgtaagattcccttcgaaataacagatctagagaaacgacacgtcctaggtagacttattacagtaaatcctatagtaactgaaaaagattctccaataaacatcgaagctgaaccgcccttcggtgactcttacattatcataggagtagaacccggccaactaaaactcaactggtttaagaaaggatcatccatcggccagatgttcgagaccacgatgcgtggagcaaaaagaatggctatattaggtgacactgcatgggattttggaagcttggggggagtatttacatctataggaaaggcccttcatcaagttttcggtgcaatatacggtgcagcatttagcggtgtttcatggacaatgaaaatactaataggggttatcataacttggataggaatgaacagtcgcagtactagtctcagcgtaagcctagtacttgtcggtgtcgtcaccttatatttgggggcaatggtacaagcagactcaggttgtgtagtcagttggaaaaacaaagagcttaagtgtggtagcggtatattcattacagataatgttcacacctggacagagcagtataaattccaacctgaaagtccgagtaaattagcatcagcaattcagaaagctcatgaggaagggatctgtggaatcagatctgtcacaagacttgaaaacctaatgtggaaacaaattactcctgaactaaatcatattctttcagaaaacgaagttaaactgaccatcatgacaggtgacataaaaggtataatgcaggcaggtaaaagaagtcttcgaccacaaccaactgaattaaagtattcatggaaaacgtggggtaaagccaagatgcttagcaccgaaagccataatcaaacatttctaatcgacggacctgaaactgctgagtgtcctaacaccaatagagcgtggaatagtctagaagtcgaggactatggcttcggtgtattcaccaccaacatttggctaaaactaaaggaaaaacaagatgtattctgcgattcgaaattaatgagcgcagctatcaaagataatagggctgtgcatgctgacatgggttattggattgaatcagccctcaatgacacatggaaaatggaaaaggcatcttttatagaagtaaagtcctgccactggccgaaatcgcatactctatggtcaaatggcgtattagaatctgaaatgataattccgaaaaacttcgcagggcccgtatcgcaacataactatcgtccaggttatcatactcaaacagccggtccctggcacctggggaaattagaaatggacttcgatttatgcgaagggactacagtagtcgtaacggaagactgtggaaacagaggaccttctttaagaacaacaactgcatcaggaaaattgatcacagaatggtgttgtagatcttgcacattaccgccactacgataccggggcgaggacggttgctggtatggaatggagataaggccattgaaggaaaaagaagagaacttggtgaattctctagttacagcagggcatggccagatcgacaactttagtttaggtgttttgggtatggcattgttccttgaggaaatgcttcggacacgtatcgggacaaagcatgcgattctccttgtagctgtatcatttgtgacactaattactggtaacatgtctttccgtgatttaggacgcgtgatggtaatggtgggagctaccatgacagatgatataggcatgggagtaacttatttggcattactagcagcgttcaaggtacgaccgaccttcgcggcagggcttcttttaaggaaacttacgtcaaaagaactaatgatggcaactattggaatagccttactaagccaaagcaccataccagagaccatcctagagctgactgatgctttagcattaggaatgatggtactaaaagtcgttagaaatatggaaaaataccaactagcggtaacgatcatggcaattagttgtgtgccaaacgcagtaatattacaaaacgcatggaaagtcagctgcacaatacttgctgcagtatctgtgtctccgcttcttttaacgtcttctcagcagaaagcagattggataccactagcactaaccatcaaaggactaaatcctactgccattttcctcactacattaagccgtacgtctaccaaacgctcgtggcctcttaacgaggcaataatggcagtgggtatggtaagcatattagcctcttcactattgaagaatgatattccaatgactggccctttagttgcaggtggccttctcactgtatgttatgtgctaacaggtcgttcggcagacctggaacttgaaagagcagcagacgtaaagtgggaagaccaagctgagatcagtggtagtagcccaatcctctctattacgatcagcgaagatggatcgatgtccattaaaaacgaggaggaagaacaaacattaactatcctcattaggacaggtcttttagtaattagcggggtttttccagtaagcataccaattacggccgcagcgtggtatctatgggaagttaaaaagcaaagagccggagtactctgggacgtaccaagtccaccacctgtagagaaagctgaattggaagatggcgcgtacagaataaagcagcgaggcattcttgggtattcgcaaataggagccggtgtatataaagaagggacgtttcatacgatgtggcacgtaacgcgtggtgcagtactaatgcaccgtgggaaaaggattgaacccagttgggctgatgttaagaaggatctaataagttacggtggaggatggaaactagagggagagtggaaagagggagaggaggtccaagttctagcactcgaacccggaaaaaatcccagagcagtacaaaccaagcccggtatctttaaaacaaatactggaacaattggtgcagtaagcctggactttagcccagggacttcaggcagtcccatagttgacagaaagggtaaggtcgtcggattatacggaaatggcgttgtaactaggtcaggggcatatgtctctgctatagctcaaacagaaaaatccattgaagataatccagagatagaagacgacattttcagaaagaaaagattaacaattatggatttacaccctggagcaggaaagaccaagaggtatctacccgcaatcgttagagaggcgattaagagggggttaaggactcttattctagctcctacaagagtcgtagccgcagagatggaggaggcccttcgtggtctacctattcgatatcaaacacccgcaataaaaacagaacatacaggcagggaaattgtggaccttatgtgccatgcaacttttacaatgcgacttctcagccctgtgagagttcctaactacaacctaataattatggacgaagcacatttcacggatccggcatcgattgcagctcgaggatatataagtacacgtgttgaaatgggggaagcggcgggaatattcatgacagcgacacctcctggcagccgagatccgttccctcaaagtaatgccccaataatggatgaagaacgagagatacctgaaagaagttggaactcggggcatgaatgggtgactgatttcaagggaaaaacagtatggtttgtaccatcaatcaaggctggcaatgatattgcagcatgcctcagaaaaaatggtaagaaggtaatacaactttctcgcaaaactttcgatagtgaatatgttaagacgcgagcaaatgactgggatttcgtagttacaacggatataagcgaaatgggagccaatttcaaagcagagagggtcatagatccacgaaggtgtatgaaaccagtaattctaacagatggtgaggaacgcgtaatacttgctggaccaatgccagtaacacactcatcagccgcgcaaaggagaggacgcattggtagaaatccaaaaaatgagaatgatcagtatatctatatgggtgagcctctagaaaatgatgaagattgcgcacactggaaggaggcaaaaatgttgctcgacaacataaacacaccagagggaattataccatcaatgtttgaacccgagcgtgagaaggtggatgctatagatggagagtataggttaaggggagaagctagaaaaacctttgtcgatttaatgcgccgaggtgatctacctgtatggttagcatacaaagtagcagcagagggaataaattacgcagataggcgttggtgctttgacggaattaaaaacaaccaaatcttggaggaaaacatggaagtagaaatctggactaaagaaggcgagaggaagaagttaaaacctcgttggttagatgcccgcatctactctgatcccttagccctaaaagaatttaaagagtttgcagcaggtaggaaaagccttaccttgaatctaataactgaaatgggaaggctcccaacatttatgactcagaaagcacgtaatgctttagacaatttggcagtcttacatactgcagaagcggggggacgagcctacaatcatgcgttaagcgaactaccagagacgcttgaaactcttttattactgaccctgctagcaaccgtaactggggggatttttttgtttttaatgtctggaaaaggaattggaaaaatgacgttgggaatgtgttgcataatcactgcttcgattctgctatggtatgcacaaatacaacctcactggatcgcagcgtccataatcctagaattcttcctaatagttcttctaattccggaaccagaaaaacaaagaacgccacaagataatcaattaacttacgtggtaatcgcaatattgactgtagtcgcagcaacgatggcaaacgagatggggtttctagaaaaaacgaaaaaagatttaggactaggaagtatcacaacccaagaaagcgaatctaacatccttgatatagatttgcgcccggcgtctgcttggaccctatatgcggtagctaccacattcctgacaccaatgttaagacacagtattgaaaatagttcagtaaacgtaagtctaactgccattgcaaatcaagcgacagtcctaatgggtttaggaaaaggctggccactttcgaagatggatattggagcaccattattagcaataggttgctattctcaagtcaatcctataacactaaccgctgctttactattactggtagctcattacgcaatcattggaccgggacttcaagcgaaggcaacacgagaggcacaaaaaagggcggcagccggcattatgaaaaatcctactgttgatggaataacggtcatagacctagatccaataccgtacgatccaaaatttgaaaaacaacttgggcaggtaatgctattgatattatgtgtgacacaagtcctgatgatgcggacaacgtgggcattatgtgaagcattaaccttggcaacaggacccatcagtacattgtgggaaggtaacccagggcgtttctggaacactacaattgcagtcagcatggcaaatattttcagaggttcttaccttgcaggagcgggactattattctcaattatgaagaataccaccagtacccgtagaggcacgggtaatatcggcgagacattaggagagaaatggaaaagtagattaaatgcattgggtaaaagcgagttccaaatatacaaaaaatctggaatacaagaagttgataggaccttggcaaaggagggtataaaaaggggagagacagatcaccacgcagtttcgagaggcagtgctaaattacgctggttcgttgaacgtaatatggtgaccccggaagggaaagtcgtggatctggggtgtgggcgcggtggctggagctattattgtggtggacttaagaatgtaagagaggtgaagggtttgacaaaaggcggcccaggacatgaggaaccaataccgatgagcacctacggctggaatttggtacgacttcaatctggggtggacgtgttctttacaccccccgaaaaatgtgacaccttgctatgtgacattggagagtcaagtccgaaccctacaatcgaagcaggacggactctaagggttttaaaccttgttgaaaactggcttaataacaatacgcaattctgcataaaagtactaaatccctacatgccaagcgtcatcgaaaaaatggaggctctgcagaggaaatatgggggtgctctagtacgtaatccattgtcgcgcaattcaacacatgaaatgtactgggtatcaaatgcaactggaaatattgtttcatctgtaaatatgatctctcgaatgcttataaacagatttaccatgaagcacaaaaaagccacgtatgaaccggatgttgacttaggcagtggaacacgaaatattggtattgaaagtgaagtccctaatctagatattatagggaaaaggattgaaaaaatcaaacaagaacatgaaacaagttggcattatgatcaagaccacccatacaagacatgggcataccacggaagttacgagacaaagcaaacgggatccgcgtctagtatggttaacggagttgtacgactccttacaaaaccatgggatgtcgttccgatggttactcaaatggcaatgacagatacaacaccatttgggcagcaaagagtctttaaggaaaaagtagatacaagaacccaggagccgaaagaaggaaccaaaaaactaatgaaaatcacagccgagtggttgtggaaagagttaggcaaaaaaaaaacaccacgtatgtgtactcgagaggaatttacaagaaaagtacgtagtaatgccgccttgggcgctatattcactgatgaaaataagtggaaatcggctcgagaagctgttgaagacggacgcttctgggaactggtagatagagaaagaaacctccatctggaagggaaatgtgaaacgtgtgtctataatatgatgggtaaaagagaaaaaaaactaggtgaatttggaaaagccaagggcagccgtgcgatttggtatatgtggctgggagcacgttttttagaatttgaggcattaggtttccttaatgaagaccattggttctctagaggaaactcactaagtggcgtagagggcgaaggtttacacaggctaggatacatcttgcgagaagtatcaaaaaaagaaggcggggcgatgtatgcggacgacacagcaggctgggacaccaggatcacacttgaagacttaaaaaatgaagaaatggtaactaaccacatgaaaggcgagcacaagaaattagccgaagccattttcaaattgacttaccagaacaaagtggttcgcgtacaaaggccaacaccccgcggaactgttatggatatcataagtcgacgggatcagcgaggaagtggtcaggtaggtacatacgggctaaatacatttacaaacatggaagcacaattaatcagacagatggaaggagaaggaatattcaaatcaatccaacatttgacagcaacggaagagatcgccgtccaaaattggttagcacgcgtcggcagagaaagattgtctcgcatggcgataagcggagatgactgtgttgttaaacccatagatgatagattcgctagtgcacttacagcactaaacgatatgggtaaggtaagaaaagatattcaacaatgggagccatctcgtggatggaacgactggacacaggtacctttctgttcccatcactttcatgaattagttatgaaagacggtcgagtcttggtagttccgtgtaggaaccaagatgaactaattggtcgagctagaatttcccaaggagcaggatggagcttaaaagaaacagcctgtttgggtaaatcttatgcgcaaatgtggacgctgatgtactttcacagaagagacctaaggttagctgcaaacgctatctgtagtgctgtgccatcccactgggtgccaacatcaagaactacttggtcaatacatgcaaaacatgaatggatgacaacagaagatatgttagcggtatggaatcgagtttggattcaggaaaatccttggatggaagataaaacacccgtggagtcctgggaagaagtaccatacctggggaagagagaagaccaatggtgtggatcgttgataggtttaacaagcagagccacttgggccaaaaatattcaaaccgctataaaccaggtaagaagcttaatagggaatgaagaatacacggattacatgcctagcatgaaaagattcagaagagaagaagaagaggcaggtgtactgtggtag

SEQ ID NO: 22301 - RNA, 9876 nt, synthetic construct
  misc_feature 1..9876: note = derived and/or modified CDS sequence (opt6) from DENV-2__FJ898449__SS-prME
  source 1..9876: mol_type = other RNA
actgcaggcatgataataatgctcatacctactgtaatggcatttcatctcacgactcgaaacggtgaaccacatatgatcgtaagcaggcaagaaaaaggtaaaagtctactctttaaaactaaagacggaactaacatgtgtacacttatggcaatggacttaggagaactttgcgaagatacaataacttataaatgtccatttctcaaacaaaacgaacccgaggatatcgattgttggtgcaatagcaccagtacctgggtaacatacggcacttgcacgaccacgggagagcaccgaagagaaaaacgctcagtagcacttgttcctcacgtaggaatgggtttagagactaggactgaaacatggatgtccagcgaaggagcatggaaacacgcgcaaagaattgaaacgtggatcctaagacatccggggtttacgatcatggccgccatcctagcctatacaataggaactacgcatttccaaagagttttaatttttattctattgacagcgatagcaccttcaatgaccatgcgatgtataggtataagtaatagagattttgtagaaggagtaagcgggggttcctgggtcgacatagtattggaacatggttcatgtgtaacaacaatggccaaaaacaaaccaacgttagactttgaactcataaaaacagaagcgaaacaacctgcaactcttagaaaatactgtatagaagctaaattaacgaatactacaacagattcaagatgtcctacacaaggcgaacctacccttaacgaagaacaagacaaaagattcgtatgcaaacatagtatggtcgatagaggatgggggaacggttgtggcttattcggaaaaggagggatcgtgacctgtgcaatgttcacatgtaagaaaaacatggaaggaaaaattgtccaaccggaaaatctagaatacacggtagtaatcacaccacactccggtgaggaacatgccgtcggaaatgacacaggcaaacatggaaaagaggtgaaaattacaccccaatcgtccattaccgaagcagaactaacggggtatggaacggtaactatggaatgctcaccacggactggacttgatttcaatgaaatggttttactacaaatggaggacaaagcatggctagtgcaccgacaatggtttctagatttacctctaccatggttacccggcgcagatacacagggttcgaattggatccaaaaagaaacattagtcacgttcaaaaatccccacgcaaagaaacaagacgtggttgtacttggatcgcaagaaggagctatgcataccgccctaactggagctacagaaatccaaatgagctccggaaatttattatttacaggtcacctaaaatgtagacttcggatggataaactgcaactaaaaggaatgtcgtatagcatgtgcacaggcaaatttaaaatcgttaaagagatagcagaaacccaacatggcactattgtaattcgtgttcaatacgaaggtgatggatcgccttgcaaaataccattcgaaataatggatctggagaaacgacatgtactggggcgattaattactgttaatcctatagttacagaaaaggatagtcctgtgaacatagaagctgagccaccattcggtgacagctatataataataggggtagaacctggtcaattaaaattggactggtttaagaaaggtagttcaattggccaaatgtttgagacaacaatgcgtggtgctaaacgtatggcaattttaggtgatacggcttgggatttcggttcactgggaggcgttttcacatcaatagggaaagcacttcaccaagtttttggagcaatatacggagcagctttttccggagtctcctggacaatgaaaatattaataggagtgatcatcacatggattgggatgaacagcagatctacatccctgtctgtatcacttgttctcgtaggcatcgttacactttacctcggagttatggtacaagcagactccggatgtgttgtcagttggaaaaataaagaattaaaatgcggttcagggatcttcgtaactgataatgtacatacatggactgagcaatacaaattccagccagaatccccatctaaacttgcgagtgctatacagaaagctcatgaagaaggaatctgtgggatccgctccgttactaggctagaaaatttgatgtggaaacaaataacaagtgagctaaatcacatactgtcggagaacgaagtaaagttaacaattatgactggagacatcaagggaataatgcaagtaggtaaaaggagcctacggccccagcccaccgagttaaggtattcatggaagacctggggcaaagctaaaatgctaagcacagaactccataaccaaacgtttttgatagacggtccagaaactgcagagtgtccaaacacaaaccgagcgtggaactcactagaagtggaagactatggcttcggggtatttactaccaatatttggctaagacttcgggaaaaacaggacgtattttgtgattcaaaattaatgtctgcagccataaaagataacagagcagtacacgcagacatgggttattggattgaatcggcactaaatgatacatggaaaattgagaaagctagttttatagaagtaaaaagctgtcattggcccaaatcacacactttatggtcgaatggggtattagaatctgaaatgattataccgaaaaattttgccggaccggtatcacaacataataaccgacctggctaccacacgcaaaccgcaggaccgtggcacctagggaaactcgaaatggattttgacttctgtgaaggtacaacagttgtagtaacagaggagtgtggaaaccgaggaccatcgctacgaacgacaactgcaagtgggaaattgattacagaatggtgctgtaggagctgcacacttcctccgcttaggtaccgaggggaagatgggtgttggtatgggatggaaattcgaccccttaaagaaaaagaagaaaacttagtatcaagtctagtaactgccggccatggacagatagacaacttttcattgggtatactagggatggctctgttcttggaggaaatgttgcgtacacgggtcggcactaaacatgctatattgcttgtggcggtatcctttgtcacattaattacaggaaatatgtccttcagagacctaggtcgcgttatggtgatggtcggtgcaacaatgacagatgacataggcatgggggtcacatacttagcgctactcgccgctttcaaagtcaggccaacattcgcagccggcctactacttagaaaattgacaagtaaagaattgatgatgacaaccataggaattgtccttctgtcccaaagctccatcccagaaacaatattagaactaacagatgcattagctttaggaatgatggttcttaaaatggttaggaatatggaaaaatatcagcttgctgtaaccataatggccatactttgtgttccgaacgccgtgattctgcaaaatgcatggaaagtatcttgtacgatcttagcggtggtctcagttagtccattgctgctgacctctagccagcaaaaagcagattggattccgctcgcactgacgataaaaggattaaatcccacggcgatatttctaacaacgttgtcaagaacctcaaagaaaagatcatggcctctaaatgaggcgatcatggcagtgggcatggtatcaattttagcttctagtctactgaagaatgatattcctatgacaggtccattagttgccggtggcttgctaacggtctgctacgtacttacaggaagatcagcagatctagagttagagcgagcaacagatgtgaaatgggacgaccaggcagaaatctctggatcatccccgattttatcaataaccatctcagaagacggaagcatgagcattaagaacgaagaagaagaacaaactttaactatcttgataagaacaggtttacttgtgattagcgggttgtttcctgtaagcatccctataacagcagcagcttggtacctttgggaagtcaagaaacaacgcgctggcgtattatgggacgtaccatcaccgcccccggtaggaaaagcagaactagaagatggagcatatagaataaagcaaaaaggaatcctcggttacagtcaaataggtgcaggggtatataaggaaggcacttttcatacaatgtggcacgtgactaggggtgcagtattaatgcacaaaggcaaacgaatagaaccctcttgggcagacgtcaagaaagatttaataagctatggagggggctggaaattggaaggcgaatggaaggaaggcgaagaggtccaagtgctagctttagaaccaggcaaaaacccgagagcagtacaaaccaaaccgggtctgtttcgaacgaatacgggaacaataggagctgtttcgctggacttttcgccaggaacgtcgggtagtcccatcgtagataagaaaggaaaagtagtcggattgtatggcaacggtgtagtgacacgcagtggggcttatgtgagtgcaatagcacaaacagaaaagtcaattgaagataatcctgagattgaggatgatatatttaggaaaagacgccttacaattatggatctgcacccaggtgcaggcaaaactaagaaatacctaccggctatagtaagagaggctattaaaagaggactacgaacactaattttagcgccaacgagagtggtagctgccgaaatggaggaagcgttgcgaggattacctatcagatatcaaacccctgctatccgagctgaacacactggaagggaaatcgtcgatttaatgtgccacgcaactttcacaatgagactgttgagcccaatacgtgtacctaattacaacctaatcataatggatgaagcccactttaccgaccctgcatctatcgcagctcgaggttacatcagcacacgagtggaaatgggagaagcagccggtatattcatgactgccacaccgccgggatcaagagacccattcccgcaaagcaacgctccgattatggatgaggaaagagaaattccagaaagaagttggaactcaggacacgaatgggtgaccgatttcaaaggaaaaacagtgtggttcgtcccctcaattaaaaccggaaatgacatagctgcctgtttaaggaaaaatggcaaaagggtcatacagctaagtcgtaaaaccttcgattcagaatatgtaaaaacaaggactaatgattgggatttcgtggtcacaactgatatcagtgaaatgggagccaattttaaagctgaaagagtaattgatccacgtagatgcatgaaacctgtaattcttactgatggcgaagaaagagtaatcttagccgggccaatgccagtaacacattcgagtgctgcacagcgcaggggaagaatcggtcgtaatccgagaaatgagaatgatcagtatatatatatgggtgaaccattagaaaatgatgaagattgtgcccactggaaagaggctaagatgctcttagacaatataaacacacctgaggggattatcccttcaatgttcgagcctgaaagggagaaagtagatgctatagacggagaatatcggttacgtggagaagctagaaaaacatttgtagaccttatgcgacgtggggatttaccagtctggttagcctataaagttgcaagtgaaggtatcaattacgcagatcgtagatggtgctttgatggaacgagaaacaaccaaatactcgaggaaaacgtcgaagtagaaatatggacaaaagaaggagaaagaaagaaactaaagccacgttggttagacgctcgcatatactcggacccgttagctctaaaagaatttaaagaatttgccgccggtcgaaaatctctgacattaaatttaataacagagatgggacgactccctacttttatgactcaaaaggcgagagatgctctagacaacctagcagtattacacacggcagaagcagggggaaaagcatataaccatgcgttatctgaattaccagaaacattggaaacacttctcctattaactttacttgccaccgtaaccggaggcatctttttatttttgatgagtggaagagggataggcaagatgacacttggtatgtgttgcatcataactgcttcaattctactgtggtatgcacagatacaaccccattggatagcagcctctattatcctggagttctttctcatagtactcttaatcccagaacccgaaaagcaaagaactccacaagataaccaactaacttatgtaattatagcaattttaacagtggtagccgctaccatggcgaacgaaatggggtttttggagaaaacaaagaaagatctagggttagggcatatagctacccagcaacccgaatcaaatattttagatatagatctccgcccagcttctgcgtggacattatacgctgttgcaacaacgtttataacaccgatgctaagacattcaatagaaaattcatctgtaaatgtcagcctaaccgcgatagctaaccaagcaacggtattgatgggtctaggtaaaggctggccactatcgaagatggatataggtgtcccattactagcgataggttgctattcacaagtgaaccctataacgttaactgccgctcttttactgttagttgctcactacgcgattataggcccagggttacaagctaaggcaacaagagaagcacagaaaagggcagcggctggaataatgaaaaatccaacggtggacggtataaccgttatcgatttagatccaatcccatatgaccctaaattcgagaagcaattaggacaagtaatgttattggtactctgtgtaacccaggtgcttatgatgcgaacaacatgggcattgtgcgaagcactaacacttgctactggtccggtttctactctatgggaagggaatccgggacgtttctggaatacaactatcgctgtctcaatggcaaatatttttagaggatcgtacctagcgggggcaggccttctcttttccataatgaaaaatacaacgtcaacacgtagaggaacaggaaacattggagaaacattaggagaaaaatggaaaagcagattaaacgcattaggaaaaagcgaatttcaaatttacaagaaatcagggatccaagaggtagatcgaacgttagcaaaggaaggtataaagcgtggcgagacagatcaccacgcagtatctcgaggaagcgccaaattaaggtggtttgtagaaagaaatcttgttactcccgaaggcaaggtcgtcgatttaggatgtggacgtggcggttggtcatactattgtggtgggttaaagaatgtgcgtgaggttaaaggactaacaaagggcggaccaggccatgaagaacccatacccatgtcaacatatggttggaatcttgtgcggctgcaaagtggagtagatgtattctttgttccgccggagcgatgcgacacacttttgtgcgatattggcgaatccagtcctaatccaaccgtagaagctggaagaacactaagagtattgaaccttgtcgaaaactggttaaataacaatactcaattctgcgtcaaagtcctaaatccatatatgcccagcgttattgaacgtatggaaacactacaaaggaaatacggaggagccctggtaagaaatcccctgtcaagaaattcaacgcatgaaatgtactgggtaagcaatgcatcaggaaatatcgtaagttcagtaaacatgatatcaagaatgttgataaataggtttacaatgagacataagaaagccacctacgaacccgatgttgatttaggctctggcacgagaaacatcgggattgaaagcgagacaccaaatctcgatataattggcaagcgaatagagaaaataaagcaagaacatgaagcaagttggcattacgatcaggatcacccatacaagacctgggcctatcacggtagttacgagaccaaacaaaccggaagtgcaagttcaatggtaaacggagttgtacgactcttgaccaaaccatgggacgttgttcctatggtaacacaaatggcaatgacggatacaacaccatttggacagcaacgagtctttaaggaaaaggttgatacgagaactcaggaaccaaaggaggggacaaagaaattaatgaaaattacagctgaatggttatggaaagaattaggaaaagagaaaacgccccgtatgtgtactcgagaagagttcactaagaaagttaggtcaaatgctgcccttggtgcaattttcacagatgagaataaatggaaaagcgccagggaagcagtagaagataacaggttctgggaattggtagataaagaacgcaacttacatctagaaggtaaatgtgaaacgtgcgtttacaatatgatgggaaaaagagaaaagaaactaggcgagtttggaaaggctaaaggttcaagggctatatggtatatgtggcttggtgctcgatttctagagtttgaagcgctaggcttcctcaacgaagatcattggttcagcagggagaacagtttgtcaggtgtagaaggagaagggctgcacaaacttggatacattttaagggaagtttcgaagaaagaaggtggtgccatgtacgcggatgacaccgcgggatgggataccagaattaccatcgaagacctaaagaatgaagaaatgattactaaccatatggccggagaacataaaaagctagcggaagctatttttaaattaacatatcagaataaggtagttagagtgcaacgtcctacgcctagaggtaccgttatggacataataagtcgcagagatcaacggggaagcggccaggtcggcacatatggacttaacacattcaccaatatggaagcccaactcatacgtcaaatggaaggtgaagggattttcaaaagtattcaacacttgactgcgtcagaggagattgcagtgcaagattggctcgttagggtcggtagggaaaggctctcccgaatggccatatcaggggacgattgcgtagtaaaacctctagacgaccgtttcgctagggctcttaccgcactgaatgatatgggcaaggtacggaaggacatccagcaatgggagccatctagaggatggaatgattggacacaagtacccttttgctctcaccatttccacgagcttataatgaaagacggccgaactctagttgtaccatgtagaaaccaggatgaactaatagggagagctagaatctctcaaggtgctggatggagcttacgtgaaactgcatgtttaggtaaatcctacgcacagatgtggtcactaatgtatttccataggcgcgatttgcgtttagctgccaatgcgatttgttcagcagttcccagtcattgggtcccaacaagtagaacgacatggagtattcatgcatcgcacgaatggatgaccacagaagacatgctcacggtgtggaacagagtatggatcctggaaaatccatggatggaagacaaaacaccagttgaaagttgggaagaaatcccataccttggaaaaagagaagatcaatggtgcggaagtttgattggactcacaagtagagctacgtgggctaaaaatatacagacagcgataaaccaagtaagatcactaatagggaatgaagaatacactgattatatgccaagcatgaagagatttagaagagaagaggaagaagcgggggttctctggtag

SEQ ID NO: 22302 - RNA, 9876 nt, synthetic construct
  misc_feature 1..9876: note = derived and/or modified CDS sequence (opt6) from DENV-2__FJ906966__SS-prME
  source 1..9876: mol_type = other RNA
acagctgggatgataatcatgctaattcctactgttatggcatttcacttaacaacaaggaatggtgaaccacatatgatagtttcccgtcaagaaaaagggaaatcattattgtttaaaacagaagatggggtgaacatgtgtacattaatggctatggacttaggcgaattgtgtgaagataccataacctataaatgtccgttccttaaacaaaacgaacctgaagatatagactgttggtgtaacagtacttccacatgggtaacgtatggcacatgtactacgactggagaacacagaagagagaaaagatcagttgcactggttccgcatgtaggaatgggactagaaacacgaactgaaacatggatgtctagcgaaggagcatggaaacatgcgcaacgaattgaaacttggatactgagacaccccggcttcacaataatggctgcaatcctagcatacaccatcggaacaactcacttccaaagggctctaatatttatcttacttacagcagtagcaccctcaatgacaatgaggtgtataggtatttcaaacagagatttcgtagaaggcgtatctgggggcagttgggtagatatcgtacttgaacacggctcatgtgttacaacaatggcgaaaaacaaaccaaccttagatttcgaactaataaaaaccgaagcaaaacaaccggcaacccttagaaaatactgtatagaagcaaaacttacgaatacgacaacggatagtagatgtccaacccagggtgaaccttctttgaatgaagaacaagataaaaggtttgtatgcaaacatagtatggtggatcgaggttggggaaatggttgtggtttgtttggaaaaggagggattgtcacctgtgcaatgtttacgtgcaagaaaaatatggaaggaaaagtcgtccagcctgaaaatctagaatatacaattgtgatcacaccccacagcggagaagaacatgctgtagggaacgacacaggaaaacatggaaaagaaataaaaataacaccccagtcgagtattacagaagctgaattaactggatatggaactgtaaccatggaatgctctcctaggactgggttagattttaacgaaatggtattactacaaatggaaaacaaagcgtggttagtacaccgacagtggttccttgatttacccttaccatggctgcctggagctgacacacagggccttaattggatccaaaaagaaaccttagtaacatttaaaaatccccatgccaagaaacaagatgtagtagttttaggcagtcaagaaggagcaatgcacactgcgctaacgggtgcaacagaaatacaaatgagcagtggtaatctactctttactgggcatctcaaatgcagattacgcatggacaagttacaattaaaagggatgtcatatagcatgtgtacaggtaaatttaaagtagtaaaggagatagcagagacacaacatggcacaatagtaatacgagtacaatacgagggggatgggtccccttgtaagataccatttgaaataatggacctagaaaaacgtcacgttctgggccgattgattacagtcaatccgatcgtcaccgaaaaagattccccagttaatattgaggcagagccgccctttggtgacagctacataataataggggttgaaccaggccaattgaaattaaactggttcaagaagggatcaagcataggtcaaatgattgaaaccactatgagaggagcaaaacgaatggcaatattgggagatacagcttgggatttcggtagcttgggaggtgtatttactagcatagggaaagctctccaccaggtatttggggcgatctatggcgccgcgtttagcggtgttagctggattatgaaaatactaattggtgttataataacatggataggtatgaactctcgatccacatccttgagtgtgtcacttgtgctagttggcgtagttaccttgtatttaggagtaatggtccaggcagactctggatgtgttgtcagctggaaaaataaggagctgaaatgcggaagtggaatattcataacagataacgttcatacgtggacagaacaatacaagtttcaaccagagtcaccatctaagctagccagtgccattcagaaagcacacgaagaaggtatatgtggaattagaagcgtgactaggctagaaaacctgatgtggaaacagattactcccgaattaaaccatatcttaagtgaaaacgaagtgaaattgacaataatgaccggagacataaaaggaataatgcaagctggcaaaagatcgctacaaccgcaacccacagaattaaagtactcttggaagacctggggaaaagctaaaatgctaagtaccgagtctcataaccaaacttttctaatagacgggcccgagacggcagaatgtccaaataccaaccgcgcttggaactcattagaagtcgaagattacggctttggtgtcttcactacaaacatttggttaaagttaagagaaaaacaagatgtattttgtgattcgaaattgatgtcagcggccataaaagataacagagcagtccacgctgatatgggctattggatagagagcgcactcaacgatacctggaaaatcgagaaagcaagttttatagaagtgaaatcgtgtcattggccgaagtcccacacgttgtggagtaatggggtgttggagagtgaaatgattataccgaaaaatttcgctgggccagtttcccagcataattatcgtccaggatatcatacacaaaccgccggaccctggcatttaggaaaattagaaatggacttcgacttttgcgaggggacaactgtggttgtgacagaagattgcggaaacagaggacctagtttaagaactaccaccgcaagtggaaaattaatcacggagtggtgttgtcgatcgtgtacattaccacccctacgatatcgcggtgaagacggttgctggtacggcatggaaataagaccgctaaaagagaaagaagaaaatctagtaaattccctagttacggcaggacatggacaaattgataatttctctctaggtgttctaggtatggcattgtttctggaagagatgctacggacacgggtaggaactaaacatgcaatactcttggtcgcagtcagctttgtaactttgatcactgggaatatgtcattcagagacttaggcagagtgatggttatggtaggagccacgatgacagacgatattggaatgggggtaacgtatctggcgcttctcgctgcgttcaaagttagaccgactttcgccgcaggactactactgagaaaattgacttctaaagaactgatgatgacaaccatcggaatagtattgttatcacaatctacaataccggaaaccattcttgaattaaccgatgcactagcattaggaatgatggtattaaaaatggtcagaaagatggaaaaataccaactcgctgttacaattatggcaatcctgtgtgtacctaatgcagttattttacagaatgcatggaaagtcagttgtaccatattggccgttgtgagtgtttccccactcttcctgacgtcttcacaacagaaagcagactggataccactagcgttaactataaaaggtctaaatcctacggctatatttcttacaactttaagtcgcacgaacaagaaaaggtcgtggccattaaacgaggcaataatggcagtcgggatggtaagtattttagcatcatcattgttgaaaaacgacattcctatgactggcccgctagtggctggtggcctactaacggtatgttatgttttaaccggtcgctctgcggacctagagttggaacgagctgcagacgttaagtgggaagaccaagctgagatatccggaagttctccaatacttagtatcacaataagtgaagacggaagcatgagtatcaaaaatgaagaagaagaacaaacattaaccatcttaatacggacaggtttattagttatatcaggcttattccctgtatccattccaataacagctgctgcgtggtatctatgggaagttaaaaagcaaagagctggagtgctatgggatgtgcccagtcctccaccagtaggcaaggcggaattagaagacggtgcatacagaattaaacagaagggcattctagggtactcgcaaattggtgctggagtatataaagaaggcacctttcacacaatgtggcatgtcacacgaggtgcagttctcatgcacaaaggtaagagaatagaaccgagctgggctgatgtcaagaaagatcttatttcgtacggagggggttggaaattggagggggaatggaaagagggggaagaagtacaagtattagctttagagccaggtaaaaacccaagagctgtgcagacaaaacccggccttttcaaaacgaatgcgggtacgattggggccgtgtcattggatttctctccagggacgtccggaagtccgataatcgataaaaagggcaaagtcgtgggactgtacggtaatggagtagtgacaagatcaggtgcttacgtatctgcaattgcacaaactgagaaatcaatagaggataaccctgaaatagaggacgatatttttcgaaagaggaaactcaccataatggatttacatcccggagccggcaaaactaaaagatatctgccggctatagttcgagaagcaattaaacgcggactgcggaccctaatactcgcaccaactagagtagtcgccgcggagatggaggaagccctccgcggactaccaattagataccaaacgccagcaatacgagcagaacacacgggcagagaaattgtagatttgatgtgccacgctacattcactatgaggctactttcaccggttcgagtaccgaattataacttaataattatggacgaggcacattttacagatcccgcaagcattgccgctcgtggctatattagtactcgtgtcgaaatgggcgaagcagcaggaatatttatgacagcaaccccacccggaagtagagacccatttccgcagtcaaatgcgccaataatggacgaggaacgagaaattccagagagatcttggtcatctggtcatgaatgggtcacagattttaagggaaagacagtgtggtttgtcccatcaataaaagctgggaatgatattgcggcatgtctgaggaaaaacggcaagaaagtgatacaattatcacgaaaaacgtttgattcagaatacgtaaaaactcgcaccaatgattgggattttgtagtgactaccgatataagcgagatgggtgcaaacttcaaagcggagagagttattgaccctaggaggtgtatgaaacccgtcattctaactgatggcgaagaacgagttatactagcaggaccaatgccggtaactcatagtagcgcagcgcaaagacgagggcgaattggaaggaacccgaagaatgagaatgaccaatacatctacatgggagaacctttggaaaacgatgaagattgcgcacactggaaagaagcaaaaatgctcttagacaacattaatacgccagaaggaatcataccctcaatgttcgagccggagagagaaaaggttgacgcaatagacggagaatatagactaagaggagaagcacgaaaaacatttgtcgatctcatgaggaggggagacctgccagtgtggctagcttatagagtagctgctgagggtatcaattacgctgatcgacgatggtgctttgatggaataaagaacaaccaaatattagaagaaaacgtagaggtagaaatatggactaaagaaggcgaacgtaaaaagttaaaaccaaggtggttagacgcacgaatctacagtgacccattagctttaaaagagttcaaggagttcgctgcgggaaggaaatccctaactctaaatttaataactgaaatgggtaggctaccaacttttatgacacaaaaagcacgagatgccttagataatctagcagtattacatactgcggaggccgggggtcgagcatataaccatgcgctaagtgaattacctgagaccttggaaaccctattattattaactttattagcgactgtcaccggaggaatctttcttttcctcatgtccggacgaggaatagggaaaatgacactaggaatgtgctgcatcattacagcctcgattctcttatggtacgcacagatccaaccacactggattgccgcctcaattattttagaatttttccttatcgttctactaatcccggaacctgagaagcaaagaacaccccaggacaatcaattaacgtatgtagtaatagcaatactaaccgtggttgcagccaccatggcaaatgaaatgggtttcttggagaaaactaagaaagatttaggactgggatctataaccacccaacaaccagaatcaaacatactagacatcgatcttcgacccgcttcggcctggacactttatgcagtagcgaccacatttgtgacgccgatgctgcgacacagtattgaaaactcaagcgtgaacgtttcactgacggccatagctaatcaagctacagtattaatgggtctaggaaaggggtggccattatccaaaatggatataggtgtgccattgctagcaattgggtgctacagccaagtcaatccaattacgttaacagctgcactctttctcctagtggcacattatgctattattggacctggattgcaagctaaggccacacgggaggcgcagaaacgggcagcagctggaattatgaagaatccaacagtagatggtataaccgtcatagacctggacccgatcccgtatgaccccaaatttgaaaagcaacttgggcaagtgatgttgctcgtactatgcgttacccaagttctaatgatgagaactacttgggctttatgcgaagcgctaacattagcgacagggccaatttccaccttatgggagggaaatccaggtcgattctggaacaccacgatagccgtgtcaatggctaatatctttagaggttcataccttgctggagcgggtctgctattctctataatgaaaaataccacaaatacgagaagaggaactggcaatataggagaaacacttggggagaaatggaaatctcgactgaatgcactcgggaaatcagagttccaaatatataaaaagtcgggaatacaagaagtagatcgtacgctagccaaagaagggataaagagaggggaaactgatcatcacgctgtgtcaagagggtcagcaaaattacgatggtttgtagaaagaaacatggtaacacctgaaggaaaagtcgttgatctaggctgcggtcggggtgggtggagctactactgtgggggactcaaaaatgtcagagaagtaaaaggattgacaaaaggaggtccgggacacgaagaacccataccaatgagtacatatggttggaacttagtaagactacaaagtggtgttgacgtattctttacacctcctgaaaaatgcgacacactcctttgtgacattggggaaagttcacctaaccccacggtcgaagcaggtcgcacgctacgtgtgttaaacttagtcgagaattggttgaacaacaatacacaattttgtatcaaggtcttaaatccctatatgccaagtgttatagaaaagatggaagcactacaacgtaaatatggaggggccctagtgagaaaccccctatcacgtaattctacacatgaaatgtattgggttagtaatgcatcggggaatatcgtatcaagtgttaacatgatatcaaggatgttgatcaacaggtttacaatgagacacaagaaagctacatacgaaccggatgtggatttgggaagcggcacaagaaatattggcattgaaagtgaaatccctaatttggacattattggcaagagaatcgaaaagattaaacaagaacatgaaacatcatggcattatgatcaagaccatccatacaaaacctgggcgtatcacgggagctatgagacaaagcaaacgggttcagcaagtagtatggtgaatggagttgttcgtttattgacaaaaccgtgggatgtagttccaatggttactcaaatggccatgaccgacacaacgccgtttggtcagcaaagagtatttaaagagaaagtagatacaagaactcaagaaccaaaagagggaaccaaaaagctcatgaaaatcacagcagagtggttatggaaagaacttggcaagaagaaaacaccacgaatgtgtaccagacaagaatttactagaaaagttcggtcaaacgccgcccttggagcaatatttactgatgaaaataaatggaagagtgcccgtgaggcagtagaagactcgcgattctgggaattggtagacaaagagcgaaatctccatttagagggcaaatgcgaaacttgtgtatacaacatgatgggaaagagagagaagaaacttggagagtttgggaaagcaaaggggagccgagcaatatggtatatgtggttaggagctcgcttccttgagtttgaggcgttgggattcctaaatgaagatcactggttttcaagggaaaattctttaagtggcgtagagggagaaggacttcataaacttggctatattttaagggatgtgagcaagaaagaaggaggagcaatgtatgctgacgatacagctgggtgggacacaagaataactttagaggatctgaagaatgaagaaatggtgaccaatcacatggaaggtgaacataaaaagttggctgaagcaatattcaagctaacgtatcagaacaaggtcgtgagagtccagcgaccaactccacgaggcacagttatggatatcatctccagaagagatcaacgcggttctggacaagtagggacttatggattaaatacgtttacgaatatggaagcccaattaatacgtcaaatggaaggggaaggcgtattcaagtccatacaacatctaactgtcactgaggaaattgcagtgcaaaattggctagccagggtaggtcgcgaaagactcagccgaatggccatttctggagatgactgcgttgtaaaacctcttgatgatcgctttgcgtcagcactcactgctctgaacgatatgggtaaggttagaaaagacatccaacaatgggagccgagcagaggttggaatgactggacacaagtaccattttgttctcaccacttccacgaactcatcatgaaagatggaagagtactggtagtaccatgtcgcaaccaagacgaacttataggaagggcaagaatttctcaaggggccggctggagtctcagggagacagcatgcttaggaaaatcatacgctcaaatgtggagtcttatgtactttcacaggcgtgatttacgattagcagcaaacgcaatctgttcagcagtcccatcgcactgggttccaacatctagaactacatggtctatacatgcaaagcatgaatggatgactactgaagacatgcttacggtatggaatcgcgtttggatccaggaaaatccttggatggaggataaaactccagtagaatcctgggaggaaataccttatttagggaaacgagaggaccaatggtgcggatctttaataggtttgacaagtagggcaacgtgggccaaaaatatacaaacagcaattaatcaagtacgaagccttattgggaatgaagagtatacagattacatgccgtcaatgaagagatttaggagagaagaagaagaagccggtgtgctatggtaa

SEQ ID NO: 22303 - RNA, 9876 nt, synthetic construct
  misc_feature 1..9876: note = derived and/or modified CDS sequence (opt6) from DENV-2__FJ906968__SS-prME
  source 1..9876: mol_type = other RNA
acagcaggaatgattataatgctaattcccacggtcatggcattccaccttacaacaagaaatggagaacctcatatgattgttagcagacaggaaaaaggaaaaagtctcctttttaaaactgaagatggtgttaatatgtgtactcttatggctatggatttgggcgaactttgcgaagataccataacatacaaatgtccatttctgaaacaaaacgaacccgaagatatcgactgctggtgcaactctacatcaacgtgggttacatacggtacctgtacgacaacaggagaacatcgacgtgaaaaacgatcagtagctctggttccccatgtgggaatgggcttagaaacaagaacagaaacatggatgagctctgaaggagcatggaaacacgcacaaagaattgaaacgtggattctgagacatccaggcttcaccattatggcagcaattttagcgtatactataggtacaacacactttcaacgagctttaatttttatactactcaccgccgtagcgccctcgatgactatgagatgcattggaatctcgaatagagacttcgtggaaggggtcagtggagggtcatgggtagacatcgtattagaacatggaagttgtgtaaccaccatggctaaaaacaaacctaccttagattttgaactgattaaaactgaggcaaaacaacctgcaacattgagaaaatattgcatcgaagcaaaactaacaaataccacgactgactcacgttgtcctacacaaggagagccaagcctcaacgaggagcaggataaacgcttcgtatgtaaacacagcatggtagatagaggatggggcaatggatgcggtcttttcggaaaaggtgggatcgtaacctgtgcaatgtttacttgcaagaaaaatatgaaagggaaagtcgttcaaccagagaacctagaatacactatagtcataactccacattccggcgaagaacacgctgtcggaaatgatactggaaaacatggtaaagaaataaaaataacacctcaaagtagcataacagaggctgagcttacagggtacgggactgttaccatggaatgttcacccagaactggtctcgactttaatgaaatggttttactccagatggaaaataaagcatggttagttcaccgacaatggttcctagatctaccactaccatggcttccgggagcggatacccaaggaagtaattggatccaaaaagaaacattggtgacgttcaaaaacccacacgccaagaaacaagacgttgttgtactaggatctcaggaaggtgccatgcatacggctttaacaggcgccacggagatacaaatgtctagcggcaacttactcttcactggccatttaaaatgtagattacgaatggataaattacaattaaaaggcatgagctactcgatgtgtacaggcaaatttaaagtcgtgaaagagattgcagaaactcaacacggtacgattgtaataagggtccaatatgagggagacggatcaccgtgcaaaatacctttcgaaattatggaccttgagaaaagacacgttctgggtaggttaattacagttaatcctatagtaactgagaaagattcaccagtgaatatagaagcagagcccccttttggagactcatacataattatcggcgttgagcccggacagcttaaacttaattggttcaagaaaggcagcagtatcggacaaatgatagaaacgactatgcggggagcaaaaaggatggcgattttaggtgatacagcatgggattttggtagtctaggaggtgtattcacaagtatagggaaagcgctacatcaggtttttggtgcaatctatggagccgcgttttcaggagtcagttggatcatgaaaatattaatcggagtaataataacatggattggtatgaactcaagaagcacatctttaagtgtctcgttggtcttagtaggagtagtaaccctttatttaggagtaatggtccaggcagacagtggttgtgtagtaagttggaaaaacaaagaattaaaatgcggaagtggcatttttattacagacaacgttcatacatggacagagcaatataaatttcagcctgaaagtccttcaaaattggcatcagctatccagaaagctcacgaagaaggaatatgtggaataagatcagttacacgtttagaaaatcttatgtggaaacaaattacacccgagttaaatcatatattatctgaaaatgaagttaaactaactatcatgacaggggacataaagggcattatgcaagcgggaaaaagaagtcttcaaccgcaaccgaccgaattgaagtactcttggaaaacatggggaaaagctaagatgttatcaacggaatcccacaaccagacatttttaatagacggaccagaaacagcagaatgtccaaatacaaatagagcgtggaactcactagaggtggaagattatgggtttggagtatttactacgaatatatggctcaagttacgggagaagcaggatgtattctgcgacagtaaactaatgtcagctgcgatcaaagacaatagggccgttcatgcagatatgggatattggattgaatccgcattaaatgacacctggaaaatagaaaaagcgtcgttcatagaagtaaaatcttgtcactggcctaagagtcacacattatggagcaatgaagtgctcgaaagtgaaatgattatacccaaaaactttgcgggacctgtgtctcaacacaactacagacctggctatcatacacaaacggctgggccatggcatttgggaaaattagaaatggatttcgatttttgcgaaggtacgacagtagtggttaccgaggattgcggaaataggggaccttcgctaaggacaacaactgcgtcaggaaaactcataactgaatggtgttgcaggtcgtgcacattacccccattgcgataccgaggagaagatggatgttggtacggaatggagatacgacctctgaaagaaaaagaagaaaatttagtgaactcgctagtcacggctggccatgggcaaatagataatttctcactaggagttctaggaatggcgctgttcctcgaagaaatgctaagaacgagagttggcacgaaacacgctattctgctcgtagcggtgtcctttgtaaccctaataactggcaacatgtcattccgcgacctcgggagagtaatggtaatggtcggagcaacgatgacagatgacataggcatgggcgtaacatacttagctcttttggccgcatttaaagttaggccgacattcgcagctggattactactaagaaagctgacaagcaaagagttaatgatgacaacgatcggtatcgtactattatcacaatcaactataccggaaacaatactagaattaacagatgcattagccctgggaatgatggtattaaaaatggtgagaaaaatggaaaagtatcaattagcggtcacaataatggcgatcctttgtgtgccgaacgcggtaatcctccaaaacgcttggaaagtatcatgtacaattctagcagtagtatctgtgtcccccttatttctaacctcatcgcagcaaaaggccgattggatcccattagcactaacgattaaaggactaaatcctacagccattttcttaacgacattatcacgtacaaacaagaaaagaagctggccactaaatgaagcaataatggcagtgggcatggtaagtattttagcaagttcgcttttaaagaatgacataccaatgactggcccactggtagctggtgggttgctaaccgtatgctatgtattaaccggtagatctgcggacttagaattggaaagagcagctgacgtaaaatgggaggatcaggcagagataagtggaagctctccaatcttgagcattacaatctcagaagacggatcgatgagcatcaaaaacgaagaagaagaacagatcttaacaattcttatacgcacgggattattagttatatccggcctatttccggtatcgataccgatcacggcagcagcatggtgcttatgggaggtcaagaaacaaagagcgggtgtactatgggatgtaccaagtccgcctccagtaggaaaagctgaattagaggatggagcatatcgaattaagcaaaagggcattttgggatattcgcaaataggcgcaggagtttataaggaaggaacattccataccatgtggcatgtaacaagaggagcggtactaatgcacaaaggcaaacgaatagaaccttcttgggcagatgttaagaaagatttgatatcctacgggggtggctggaaattagaaggggaatggaaagaaggagaagaggttcaagtattagctctagagcctggtaaaaatccaagagccgtccaaaccaagccaggattatttaaaacgaatgcaggaacaatcggagcggtttctctggacttctctcccggcacaagcggatctcctattatcgataagaaagggaaagttgtaggtctctatggaaatggagtggtaacacgaagcggagcttatgttagtgccatagctcagacagagaaaagtattgaagataatccagaaatagaagacgatatttttcgaaagcgtaagttaacaatcatggatttacatcctggagcaggaaagacaaaacggtatcttcccgctatcgttagagaggcgatcaaacgaggacttcgaacattaatactagccccgacgagagtggttgccgcagagatggaggaagcattaaggggcttacccatcagatatcaaacccctgcaattcgtgcagagcatacggggagagagatcgttgatttaatgtgccatgcaactttcacaatgcgattgttgtctcctgtacgagtacccaattataacttaattataatggatgaggctcattttacagatccagcatcaatagcagcacgagggtatattagtacccgcgtcgaaatgggagaagcagcaggaatctttatgactgctaccccacctgggagtagagacccctttccccaaagcaacgccccaattatggacgaggagagagagataccggaacgaagttggtctagtggacatgaatgggttacagactttaaaggaaaaacagtctggtttgtacccagcataaaggccgggaatgatattgcagcgtgcctaagaaagaacgggaagaaagtaatccaactctcccgaaagaccttcgatagtgaatatgtgaaaacaaggacaaacgactgggatttcgtagtaactactgacatctcagaaatgggtgcgaattttaaagcagaaagagtaatcgaccctaggcgatgtatgaagcctgttatattaacagatggagaggaacgggttattctagcaggtccaatgccagttactcattcctctgcagcacaaaggcgagggagaatcggacgtaatcctaagaatgaaaacgaccagtatatttatatgggtgaaccacttgaaaatgacgaagactgtgcgcattggaaggaggctaaaatgcttttagataacattaatacacccgaaggtatcatcccttcaatgttcgaaccggaacgcgaaaaagtcgacgccattgatggcgaataccgtctacgtggcgaggcgcgaaagacattcgttgatttgatgagacgaggcgatttaccagtatggcttgcttatagagttgccgctgagggaattaactatgcagacagacgttggtgcttcgatggaattaaaaacaatcaaatactggaggaaaacgtcgaagtagagatctggacgaaagaaggcgagcgtaagaaactaaagccaaggtggcttgacgctagaatatattctgatcctctcgcactgaaagagttcaaagagtttgctgctggtaggaaatctttaacgctaaacttaataacagaaatgggaagactacccacatttatgactcagaaagcccgagacgcccttgataacctggctgtattacataccgcagaagccggtggaagggcctacaatcatgcccttagcgaacttcctgaaacattagaaacactgcttctgctcaccctcttagccactgtaaccggaggtatcttcctatttttaatgagcgggagaggaataggtaaaatgacccttggaatgtgctgtattataactgcatcaatattgctatggtatgcgcagatacaacctcattggatagctgcgtcaataatcctggagttctttctaatagtcttgctaattcctgaaccagaaaaacaaagaacgccgcaagataatcaactgacatatgttgtgatagccattctcactgttgttgcagctacgatggctaacgaaatgggattcttagagaaaacaaagaaagatctcggcctgggatcaatcaccacacaacaaccagagtcaaacatattagatattgacctaagacctgcatcagcttggaccctatacgctgttgcaacgacttttgttacgcctatgctacgccattctatagaaaatagttcagttaatgtttctttaaccgcaattgcgaatcaagctacagtcttgatgggtttaggcaaaggttggccgttgagcaaaatggatataggagttccactgctagcaataggatgctacagtcaagtcaatcctataaccctcaccgccgccttattcctacttgtggctcactatgcaatcatagggcctggattacaagcgaaggcgacgagagaagcgcagaaaagggcagctgctggaattatgaagaaccccactgtagatggcataacggtaatcgatctggatccaattccctacgatcccaagttcgagaagcaactaggacaggtaatgttgctagttctatgcgtaactcaggtactaatgatgagaacaacttgggcgctatgtgaggctttaacattagcgaccggtccgatctctacattatgggagggtaaccccggcagattttggaatacaacaattgccgtatctatggcgaacatattcaggggttcatatttggccggtgccggattattatttagtataatgaaaaatacgactaatacaagaagaggtacaggcaacataggggaaactttgggagaaaagtggaaatcacgcctaaatgccttaggaaagtccgaatttcagatatacaagaaatctggaatacaggaagtggatcgtacattagcaaaagaaggcataaagcgtggtgaaacggatcaccacgcagtttcacgtggaagtgcaaaattacgttggttcgttgaacgaaacatggtaacaccagaaggaaaggttgtagatttaggttgcggcaggggcgggtggtcgtactactgtggaggactaaagaacgtccgcgaagttaaaggattaaccaaagggggccctggacatgaagaacccattcctatgagtacttacggatggaacttagtgcgattgcaaagcggtgttgacgttttctttacaccaccagagaaatgcgatacacttctttgcgacatcggagagtctagtccaaatcccactgtagaagctggtagaacattacgcgtcttaaatctagttgaaaactggctgaataataatacccaattttgcattaaagtactaaatccttacatgccatccgtaatagaaaagatggaagcactccaaaggaaatatggtggtgccttagtgaggaaccccctaagtaggaatagtactcacgagatgtattgggtttcaaatgccagcggaaatatagtatcgagcgtaaacatgatatcaagaatgctgataaataggtttacgatgagacacaagaaagcaacttatgaacccgatgttgatcttggctctggtacccgcaatatcggcatagagtcagaaataccaaatttagacattatcggaaaacgcattgagaaaattaaacaagaacacgagactagctggcactatgatcaagaccacccctacaagacatgggcgtaccatggctcatacgaaaccaaacaaacaggcagtgcttctagcatggtaaatggagtcgttcgcttattaacaaaaccgtgggacgtggtaccaatggttacccaaatggcaatgacagatactacacccttcggacaacagagggtgttcaaggaaaaagttgacactcgaactcaagaacctaaagaaggtacgaagaaacttatgaaaattacggccgaatggctctggaaagagttagggaaaaagaaaactccgagaatgtgtaccagggaagaatttacacggaaagtgagaagcaatgcagccttgggggcgatattcacagacgaaaacaaatggaaaagcgccagagaagcggttgaagatagtagattctgggagctagtagataaagaacgaaacctacatctcgagggtaaatgtgaaacatgtgtctacaacatgatggggaaaagagaaaagaagttaggcgagttcggtaaggcaaagggatctcgagcaatatggtatatgtggctaggcgcacgctttctcgaatttgaagcactaggattcctaaatgaggatcattggttttcacgtgaaaacagtttatcaggagtagagggtgaaggtttgcacaagttaggctacatactgagagacgtttccaagaaagaaggtggagccatgtacgcagatgatacagcgggatgggacacaaggataactctagaagacttgaaaaatgaggaaatggtaacaaaccacatggaaggagaacacaagaaactagctgaagctatcttcaagttaacataccagaataaagttgtccgcgtgcaacgaccaactcctagaggaacagtaatggacataatttctagaagagatcagaggggctcaggacaggtaggaacatatggactaaacacttttaccaatatggaagctcagcttattcgtcaaatggaaggtgagggagtgttcaaaagcatacaacacttaacagtaaccgaagaaatagcagtacagaactggttagctagagtagggcgcgaacgactgagtcggatggctattagtggcgacgattgcgtagtaaagccgctcgatgatagattcgcatcagcacttaccgccctaaatgatatgggaaaagtaagaaaagatatacagcaatgggagccaagtcggggatggaatgactggactcaggtccctttttgtagtcatcactttcatgagctaataatgaaagatggacgtgtgctagtagttccatgtcgcaaccaagatgaactaataggacgggcacggatttctcaaggagctggctggagtcttcgagaaacagcttgtttaggtaaatcctatgctcagatgtggtccttaatgtattttcaccgtcgcgatttgcgacttgcagcaaacgctatatgttctgccgttccaagtcattgggtaccaacaagtaggacaacatggtctatccatgcaaagcatgagtggatgactacagaggatatgcttacagtctggaaccgggtgtggatacaagagaacccctggatggaagataaaactccagtggaatcttgggaggaaattccttacttaggcaaacgcgaggaccaatggtgtggttcgctgataggtttaacatcaagggcaacctgggccaaaaatatacaaactgcaattaaccaagtcaggagcttaatcggtaatgaagaatacacagactacatgccgtccatgaaaagatttcgaagagaagaggaggaagcgggtgtgctatggtag

SEQ ID NO: 22304 - RNA, 9876 nt, synthetic construct
  misc_feature 1..9876: note = derived and/or modified CDS sequence (opt6) from DENV-2__FJ906969__SS-prME
  source 1..9876: mol_type = other RNA
actgcaggtatgattataatgctaataccgacagttatggccttccacttaacaacacgaaatggtgaacctcatatgatagtatctagacaagaaaaaggaaaatctttgcttttcaaaacagaagacggcgtaaatatgtgcacactgatggctatggatttaggcgagctatgtgaagatacaattacttacaaatgcccctttctaaaacaaaacgaaccagaagatatagattgttggtgtaactcgacgtctacctgggtgacctatgggacatgtaccacaactggggagcaccgacgcgaaaaacgtagtgtagccttagtaccgcacgttggaatgggtcttgaaacaagaacagaaacatggatgtcatctgaaggtgcatggaaacatgcccaacgaatagaaacatggattctaagacatccaggattcaccataatggcagccattcttgcatatacaatcggtacaacgcactttcaaagagcactcatatttatcctactaactgcagtggcccccagcatgaccatgcgatgtataggaatatcaaatagagattttgtagaaggcgtttcaggcgggtcgtgggtggacatagtcctcgaacatgggagctgtgtaacaacgatggccaaaaacaaaccgacattggacttcgaattaatcaaaacagaagcaaaacagccagctacactaagaaaatattgtatcgaggcaaaattaacaaatacaacaaccgattcaagatgtccgacacaaggggaacccagcctaaacgaggagcaggataaacgatttgtctgtaaacatagcatggtggaccgaggctggggaaacgggtgtgggttattcggtaaagggggaattgtaacatgtgcaatgttcacgtgcaagaaaaacatgaaaggtaaagtagtccaaccagagaacctggaatatacaatagtaataacacctcatagtggagaagaacatgccgtaggtaatgacaccggaaaacatggcaaagagataaaaataacaccccaaagtagcattactgaagctgaactaacgggctatggtacagttactatggagtgcagcccaagaacggggctggattttaatgaaatggtgctattacagatggaaaacaaagcatggcttgtacatcgccaatggtttctagatttacccctcccatggcttccgggtgcagacacacaaggctcaaattggattcaaaaagaaactcttgtaactttcaaaaatcctcacgcaaagaaacaagatgtggtggtacttgggagtcaggaaggagctatgcacactgctttaaccggcgcaactgaaatccaaatgtcgtcgggaaatctgcttttcacaggccacctaaaatgccgtttaagaatggataaattacaactcaaaggaatgtcttactcaatgtgtacaggcaaatttaaagtggtaaaagaaatagcagaaactcaacacgggaccatagtcatacgagttcagtacgaaggcgacggatctccatgcaaaataccatttgaaattatggaccttgagaaacggcatgttttaggtcggctcataactgtaaatccaatcgttacagaaaaagactcacccgtaaacatcgaagcagagccaccttttggtgattcatatataataattggggtcgagccgggtcagctaaaactaaattggtttaagaaaggatcatccataggacaaatgtttgaaacgactatgcgaggcgcaaaaagaatggcaatactcggagataccgcatgggacttcggttctttaggcggtgtctttacctctataggaaaagcgttacaccaagtatttggtgctatttacggcgccgcattttctggagtcagttggatcatgaaaatattaattggcgttattatcacatggataggtatgaatagccgttctacatcactttctgttagcttagtattggtaggtgtagtaacattatatctaggagtaatggtccaagcagacagtggatgcgttgtgtcgtggaaaaataaagaactaaaatgtggatccgggatatttatcaccgataatgtacatacctggaccgaacagtataaattccagcccgagagtccttcaaaactcgcatcggcgatccaaaaagcacatgaagaagggatatgtggtatacgatcagtcacgagacttgaaaatttgatgtggaaacagattactccggaattaaatcatatactgtcagagaacgaagtgaaactcacaattatgacaggcgatataaaaggcatcatgcaagctggcaaacgatcgttacagcctcaacccacggagcttaaatattcttggaaaacatggggaaaagctaaaatgctaagcacagaaagccataatcaaacatttctaatagatggaccagaaaccgctgaatgcccaaatacaaaccgcgcatggaactccttagaagttgaggattatggattcggggtatttacgacaaatatttggctaaaactcagggaaaaacaagatgtcttttgtgattcaaaactaatgtctgctgcgataaaagataatagagcggtccacgcagatatggggtattggatagagtccgcattaaatgatacgtggaaaatagaaaaagcatccttcatagaagtaaaaagctgccattggccaaaatcacacacattgtggagcaatggagttctagaatcagaaatgatcatacccaagaatttcgcaggacccgtatctcaacacaattacaggcctggataccacacacagacggctggtccgtggcacttgggaaaactagaaatggactttgatttctgtgaagggacaacagttgtagttactgaggactgcgggaatcgtggacctagtttacggaccacaacagcctcaggaaaattaattactgaatggtgctgtcgatcgtgtacgcttcctccattaagatatagaggcgaggacggttgttggtacggaatggaaatacggccacttaaggaaaaagaagaaaatttagtaaacagtcttgttacggcagggcatggacaaatagacaatttttcactgggcgtactgggtatggccttatttttagaggaaatgctacgaacacgagtaggtacaaaacatgcaatattacttgtcgcagtatcattcgtaactcttattactggaaacatgagctttcgagatctgggtagagtaatggttatggtcggagcaaccatgacagatgatataggtatgggagtaacatatctagcgttactagcagcttttaaggttaggcctaccttcgctgctggattattattacgaaaactaacgagcaaggaattgatgatgactactatagggatagtattgttgtctcagagtacaatcccagagactatattggaattaacggacgcattggccttggggatgatggttttaaaaatggtaagaaaaatggagaaataccaactagctgtgacaataatggctatattatgtgtacccaatgcagttatactacaaaatgcttggaaagtaagttgtaccatattagctgtggtatcagtttcaccccttttcctaacttcaagtcagcaaaaagcagattggataccattagcgttgactataaaaggactaaaccccacagccatttttctcaccactctaagtagaacaaataagaaaagatcctggccactaaacgaagcaataatggctgtcggtatggtaagtattttagcatcctctctcctcaagaacgatatacctatgactggtcccttggtagcagggggcttactaacagtttgctacgtactaacaggacgcagtgctgatttagaattagaaagagcggcagatgtaaaatgggaagaccaagcggaaatttccggctcctctccaatcctgtcaatcactataagtgaagacggttcaatgagtatcaaaaacgaggaagaagaacaaatcttaacaatattaataagaacaggtttattagtcataagtggcttattcccggtatccatacccataaccgctgcagcgtggtgtctgtgggaagtcaaaaagcaacgggccggagttctatgggacgtcccaagcccacctcccgtaggaaaagctgaattagaagatggagcataccgcataaaacaaaaaggcatcttgggatattcgcaaataggggccggagtctacaaagagggcacgttccatactatgtggcacgttactagaggggcggtgctaatgcataagggcaaaaggatagaaccaagttgggcggacgttaagaaagatctgataagttatggtggtggatggaaactggaaggtgaatggaaggagggtgaagaagtacaagtgttagcgctcgagccagggaagaaccctcgagctgtacaaacaaaacctggtcttttcaaaacgaatgctggaacaattggcgcagtatccctagatttttctcctgggacaagtggaagcccgattatagataagaaaggtaaggtagtagggttgtatggcaatggagttgtcaccagaagcggagcttatgtcagtgcgatagcacaaacagagaaatccatagaagataatcccgaaattgaggatgatatatttagaaaaagaaaactaacaataatggatttacacccgggcgcaggtaaaaccaagcgatacttacctgcaattgttagggaggccattaaaagaggtttacgcacactgatactagcccctacccgagttgtggcagcggagatggaagaagctctacgcggtctacccattaggtaccaaaccccagcgatacgagcggaacacacagggcgagaaatagtagatttgatgtgtcatgctaccttcacaatgagactattatcacctgttcgtgtacctaattacaatctgataatcatggacgaagctcatttcacagatcctgcctcaatagcagcccgtggttatatatcaactcgcgtggagatgggagaagcagcaggtatattcatgacagctacaccacccggttccagagatccttttccgcagtcgaacgcgcctatcatggacgaagaacgtgaaataccggaaaggtcgtggagttcaggacatgaatgggtaaccgactttaaaggcaagactgtgtggttcgtgccatcaattaaagcaggcaatgatatcgcagcatgcctccggaaaaacggtaagaaagttatacaactctcacggaaaacatttgatagtgaatatgtaaaaacccgaacaaacgattgggattttgtggttacaacagatatatcagaaatgggcgcaaatttcaaagccgaaagagtgatcgaccctagaaggtgtatgaaaccagtaatcctaacagatggtgaggaacgtgttatattagccggaccgatgcctgtaacacactcatcggctgcccagagaagaggtcgaataggtagaaaccctaaaaatgaaaatgaccaatatatatacatgggtgaacccttagaaaatgatgaagattgtgctcattggaaggaggcaaaaatgctgctcgacaatatcaatacccccgaaggaataatcccatcaatgtttgaacccgaacgtgagaaagttgatgccatagacggggaataccgactgaggggtgaagcacgcaagacattcgttgatctaatgagaaggggagacttgccagtctggctagcctatcgagttgccgccgagggaattaactacgccgatcgcagatggtgctttgatggtattaaaaataaccagattttggaagaaaatgtggaagttgaaatatggactaaagaaggtgaaaggaagaaactaaaacctcgatggttagacgcgagaatttactcggatccattggcattaaaagaatttaaagagttcgcggctggacgcaaaagtcttactctcaatctgataacggaaatggggcgccttcccaccttcatgacacagaaggcccgtgacgcgctggataatttagccgtactacatacagcagaggcaggaggtcgggcctataaccatgccttgtccgaattgccagaaacactcgaaacgttgctattattaactttactagctacggttacgggaggaatttttcttttccttatgagtggccgtgggataggtaaaatgactttaggtatgtgctgtataataacagcaagtattttactttggtatgctcaaatccagccacattggatcgcagcctcaattattttagagttctttctaatagtgctattaattccagaacctgaaaaacaacgtacaccgcaagataatcaattaacctacgtggtaattgctatattaacagtcgttgcggccactatggccaatgaaatgggatttctagagaaaacaaagaaagatctaggactgggatcgattacaacacaacaaccggaatcaaatattctagatattgacttaagacctgcttcggcatggactctctatgcagtcgcaacaacttttgtaacacccatgctgagacatagcattgaaaatagctcagtcaatgtgtctttgacagcaatcgccaatcaggcaactgtgctaatgggtttaggcaaaggatggccattgtccaaaatggatataggagtgcctcttttagcgataggctgctattcacaggtgaaccctataacactgacagcagcattatttctattagttgcccattatgccataatcggtcccggactacaagcaaaagcaacaagagaagctcaaaagagagctgcagctggtataatgaaaaatccaactgtggacggtattacagtcatagacttagatcccataccctacgacccaaaatttgagaagcagttaggacaagtaatgttgttagtactgtgcgttacacaggtcctaatgatgagaactacatgggcactatgcgaggccctaactctcgcgacaggacctatctctacgctatgggaaggaaatcctggccgattctggaatacaacaatagctgtatcaatggcaaatatattcagaggaagttatctagctggagctggactactattcagtataatgaaaaatactactaatactcgccggggaacaggtaacataggcgaaactctgggagagaaatggaaatcccgactgaatgctcttggaaaaagtgaatttcagatatataagaaatcaggaatacaagaagtagatcgtactcttgcaaaagaaggaatcaagagaggagaaactgatcaccatgcggtttcacggggtagcgctaaattgcgctggtttgttgagcgtaacatggttacaccagaagggaaagtcgtagatctcggatgtggaagaggtggctggtcatattactgcggcgggctcaaaaatgttcgggaggttaaagggctaacaaagggtggaccgggtcatgaagaacccataccgatgtcaacatatggctggaacctcgtcagattgcaaagtggtgttgatgtgttcttcacacctccagaaaaatgtgacacccttctatgtgatatcggagaatcatccccaaaccctacagttgaagctggcagaacactaagagtactaaatttagttgaaaactggctaaataacaacacacagttttgtattaaggtattaaatccatatatgccatccgtgattgagaaaatggaggccttacagcgaaagtacggtggggctttggttcgaaatcctcttagtagaaattcaacacatgaaatgtactgggtatcaaacgcttccggtaatattgtttcttcggtaaacatgataagtcgaatgttaataaaccgattcacgatgagacacaagaaagctacatacgagccagacgttgacttaggaagtggaacccgaaatataggaattgaatcagaaattcctaaccttgatatcatagggaaacgaatcgagaaaataaagcaagaacatgaaacgtcatggcattacgatcaagaccatccttataaaacatgggcctaccatggaagttacgaaacgaaacagacaggttcagcaagttcgatggtgaacggagtcgtaagattattaacaaaaccatgggacgtcgtcccaatggtaacgcaaatggctatgacagatactacaccgttcggtcaacaaagagtattcaaagaaaaagtggatacccgaactcaagaaccaaaggaaggcactaagaagttaatgaagataacagcagagtggctatggaaagaattaggcaagaagaaaacacctagaatgtgcacacgcgaggaatttacacgcaaggtacggagtaatgccgctttgggcgcgatattcacagatgagaataagtggaaaagcgcacgagaagcagtagaagattctagattttgggaacttgtggataaagaacgtaacctacatctggagggaaagtgtgagacatgcgtatacaatatgatgggcaagagagaaaagaagttaggggaatttggaaaagcaaaggggtctagagcaatttggtacatgtggctaggtgcaagattcctagaatttgaagcgttagggtttctaaacgaggaccactggttttcaagagaaaattcactcagtggtgtcgagggtgaaggactacataaattaggatatatattacgtgatgttagcaagaaagaaggaggagcaatgtatgctgacgatacagcgggctgggatacacgtatcacactagaggatctcaaaaatgaggaaatggttactaatcacatggaaggagaacataagaaactcgctgaagctatttttaaacttacttatcaaaacaaagtagtaagggttcaacgcccaactccaagaggaaccgtgatggatataatatctcgtagagaccaaagaggatctggacaagttggaacctacggcttaaatacgttcactaacatggaagcacaactaataagacagatggaaggcgaaggtgttttcaagtctattcaacatctaactgtaaccgaagaaattgctgtacaaaattggttagcacgggtaggaagagaacgtctcagtcgcatggcaatttcaggagatgactgtgttgttaaaccactagacgatagattcgctagtgcactcacagcactgaacgatatgggcaaagtgcggaaagatattcaacagtgggaaccgtctcgcggttggaatgattggacgcaggttcccttctgctcgcatcactttcacgaactaataatgaaagatggaagggttctggtagtcccttgcagaaaccaagatgaactgattggtagagcaagaatatcacaaggtgcaggatggtctctccgggaaactgcgtgtctggggaaaagttatgctcaaatgtggtcacttatgtatttccataggagagatcttcgattagcggctaacgcaatatgtagtgccgttccttcacactgggtaccaacatcaagaacaacgtggtccatacatgcaaaacatgaatggatgacaaccgaggatatgttgacagtatggaatcgagtatggatacaagaaaatccatggatggaagataaaacccctgtggagagttgggaggagattccctaccttggaaaacgcgaagatcaatggtgtggaagtttaataggcttgacttcacgagccacttgggccaaaaatattcaaactgcaattaatcaagtcaggtcacttatcgggaatgaagaatataccgattatatgccaagcatgaaaaggttcaggagggaagaagaagaagccggagttctctggtaa

SEQ ID NO: 22305 - RNA, 9876 nt, synthetic construct
  misc_feature 1..9876: note = derived and/or modified CDS sequence (opt6) from DENV-2__FJ898454__SS-prME
  source 1..9876: mol_type = other RNA
accgctggagtgataataatgcttattccaacagcgatggcttttcatctaacgactcgaaatggagagccacacatgatagtaagtcgacaagaaaaagggaaatcacttctatttaaaactgaggatggagtaaatatgtgcacactaatggcgatggatttgggtgagttgtgtgaagatactatcacgtacaactgcccacttttacggcaaaacgagcccgaggatattgattgctggtgtaactcaacatcaacatgggtaacttatggaacttgcacagcaactggggaacaccgacgggagaaacgttcagtagctttagtaccacacgtaggtatgggtcttgagaccagaacggagacatggatgagctcagaaggagcatggaaacatgcacaaagaattgaaacatggattttaagacacccaggatttacaattatggctgccatcttagcgtatactatcggaactacttattttcaacgcgtgttaatattcatattactgacggcagtggctccatcaatgacaatgcgatgtatcggaatcagtaatagggattttgtggaaggtgtaagcgggggatcttgggtagatatagttcttgaacacgggtcctgtgtgactacaatggcgaaaaacaaacccacattggacttcgaactaataaaaaccgaggcgaaacaacctgcaactcttaggaaatactgtattgaagcaaaattaacaaatactacgactgcatcacgatgtccaacccagggtgaaccatctctaaatgaagaacaggacaaaaggtttgtatgtaaacattccatggtcgatcgaggatgggggaacggttgtggactttttggaaaaggaggcatagtaacatgtgccatgttcacttgcaagaaaaacatggaaggaaaaatagtacaacctgaaaatttggaatatacaatagtagttactccccatagtggagaggagaacgctgtcgggaacgatacgggcaaacatggtaaagaaataaaagtcaccccacaaagctcaattaccgaagctgaattgacgggttatgggacagtcacaatggagtgtagtccgaggaccggactagattttaatgagatggtgttgttgcaaatggagaataaagcctggttagtacaccggcaatggtttttagacttaccactaccttggctaccgggggctgatacccagggtagtaactggattcaaaaagagacgcttgtcacctttaaaaatccacatgccaagaaacaagacgtagtagtactcggcagtcaagaaggagccatgcacacagcgttgactggcgccacagagatccaaatgagtagtggtaatttacttttcacgggtcacttaaaatgtagacttaggatggataaactgcaactaaaaggcatgtcatattccatgtgtacaggaaaatttaaagtggtgaaagaaatagcggaaacacagcacggaacaatagttgtacgagtccaatatgaaggtgacggtagtccgtgcaaaatacctttcgaaatcatggatttagagaaacgacacgttttaggcagattaatcactgtgaacccaatagttacagaaaaagactctcccgtcaatatcgaagcagaacctcctttcggagattcatatataattataggcgttgagccaggacaattgaaactctcgtggttcaagaaagggagctcaataggacaaatgttcgaaactacgatgagaggggctaaaagaatggccatactaggagacacagcgtgggatttcggcagcttaggaggcgtttttacaagtatcggcaaagctctacatcaagtatttggggccatatatggggcggcgttttcaggtgtatcatggactatgaaaatcttaataggggttgttattacttggattggaatgaatagtagatctacatcattgagtgtctcactggtcctagttggtgtagtaactttatacttgggggttatggtacaagccgactcggggtgtgttgtttcatggaaaaacaaagagctaaagtgtggttccggaatatttataacggacaacgtacacacttggacagaacaatacaaatttcaacccgaaagtccgagcaaactagcttcagcaatacaaaaggcctatgaggaaggaatatgcggcattcgttcagtcaccagattggaaaatctaatgtggaagcagatcaccccagaattaaatcatatacttagcgaaaatgaagcgaaattaactataatgaccggagacatcaagggaattatgcaagcaggaaagcgtagcttaagaccgcaacccactgaattgaaatattcttggaagacttggggaaaagctaaaatgctgtcaacagagccacataaccaaacatttctaatcgacggacctgaaactgcagaatgtccaaacactaatcgtgcttggaatagcttagaagtggaagattacggattcggcgtttttacaaccaacatttggctcaagctcaaagaacgtcaagacgtgttttgcgacagtaaactaatgtcagctgctattaagaacaacagggctgtacacgctgacatgggttactggatagaatctgctctaaatgatacatggaaaatagaaaaagcgtcatttattgaagtcaaaagttgccattggccaaaaagtcataccctatggtccaacggagtactcgaatctgaaatgataattcctaaaaattttgcaggaccagtatctcagcataattatcgcccaggctatcatactcagacagctggtccctggcacttaggaaaactagaaatggatttcgatttttgcgaaggaactactgtagtagtcacagaggattgtggcaatagaggaccatcattgcggactaccacagcttcagggaaactaattacagaatggtgttgcaggtcgtgcacattaccaccattacgttatcggggtgaagacggatgctggtacgggatggaaattagacccctaaaggagaaagaagagaatttagtaaatagcttggtaacggcaggtcatgggcagatcgataatttcagcttaggtgtcttaggaatggctctcttcttagaagaaatgctacgcacaagagttggaacaaagcacgcagtcctactcgtagcagtatcttttatgactttaataactgggaacatgtcctttcgcgatttagggagagttatggtaatggtgggtgctgctataacagatgacataggaatgggggtgacatacctagccttactagcagcattcaaagtacgcccaacgtttgctgccggcctgctattacgtaaattaacatctaaagaactcatgatgactaccataggaattgtcttgttatctcaaagcacaatacccgaaacaattcttgagttaaccgatgctctcgcgctcggaatgatgatactaaagatagtacgtaatatggaaaaataccaattagctgtgacaatcatggcgactctatgtgtacctaatgctgtaatattacaaaacgcatggaaagtaagctgtacgatactggcagtagtaagtgtcagtccactgctattaacttcttcacaacaaaaagcagactggattccattagcattaactatcaaaggtctcaatccaacagctatatttttgactaccttatctagaaccaataagaaaagaagttggccgttaaacgaggccataatggcagtaggaatggttagtatattggctagtagtttactgaaaaatgacatcccaatgactggcccattagttgccggcggcttattaacagtttgctatgttcttacgggacgatcagctgacttagaactagaaagagccgcagatgtgagatgggaagatcaagctgaaatatcaggatcatccccaatactttctataacaatcagtgaggatggatctatgtcgattaaaaatgaggaagaagaacaaacgcttacgatactcatcagaaccgggctgttagtaatttccgggttgttcccagtttctataccaataacagcggctgcctggtatttatgggaagtcaagaaacaaagggcaggcgtattatgggatgtgccatccccgccgccggtcggaaaggctgaactagaagacggcgcgtatagaattaaacagaagggaatattaggatacagccaaattggagctggcgtatacaaggagggaacattccacacaatgtggcacgttaccagaggagcagtactcatgcataagggaaaaagaatagaaccaagttgggcagatgtccgaaaagacctaatttcgtacgggggtggttggaaattagaaggagagtggaaagaaggagaagaagtacaagtcctcgccttagaaccgggtaaaaatcctagagctgtacaaacaaaaccaggtctgtttaaaacaaacacgggaacgatcggtgctgtatctctcgatttctctccaggcacgagtggatctcccattgtagataaaaagggaaaggtagtcggattatatggtaatggggttgtaacaagatccgggacttatgtttcggccattgcacaaaccgagaaatctatcgaagataacccagaaattgaagacgacatatttagaaagaaacgccttactataatggatttacacccaggagcaggaaaaactaaaagatacctaccagctatagtaagagaagccatcaaaagaggactaagaacgttaattttggcacctacgagggtagtcgcagccgaaatggaagaagccctaagaggattaccgataaggtatcagacccctgctatacgggcggaacatacagggagggaaatagtggatttaatgtgccatgcaacatttacaatgcgcctactcagcccagtgagagtacccaactacaacctaataataatggatgaagcccatttcacagacccagcatctatagctgcaagaggatatatctcaacacgagtagaaatgggagaggcagcaggtattttcatgaccgcaactcctccgggttcaagagacccatttccacaatccaatgcaccgatcatggatgaggaacgtgaaatacccgaaagatcctggaactctggacatgagtgggtcaccgattttaaagggaaaacagtctggttcgtaccctcgatcaaagcagggaatgacattgcagcatgtttaaggaaaaatggaaagaaagtcatacaactttcaaggaaaacttttgatagcgaatatataaaaacacgtacaaacgactgggatttcgttgttacaacggacattagcgaaatgggagcgaatttcaaagcggaacgagtgattgacccaagaaggtgcatgaaaccagttatcttaactgatggcgaagaacgtgtaatactagcaggccccatgccggttacccattcttcagcggcccaaaggagaggccgtataggtcggaatcccaaaaacgagaacgatcaatatatatacatgggagaaccactcgaaaatgatgaagactgtgcacactggaaagaagccaaaatgcttttagacaacattaatacgcctgaagggataattccaagtatgtttgagccagaacgcgaaaaagtggacgcaatagacggagaatatagactacgaggcgaggcaagaaaaacgttcgtcgacttaatgcgaagaggagacctacctgtgtggttagcatacagggttgcagcggaaggtataaattatgcagacagacggtggtgttttgacggaattaaaaacaatcaaatactagaagaaaatgtagaagtcgaaatttggactaaagaaggagaaaggaagaaactaaaaccgagatggcttgatgctagaatttacagcgacccattagcattgaaagagtttaaagagttcgcagctggtagaaagagcttaacgctaaatttaattacggagatgggcagattaccaacatttatgacccaaaaagcacgtaacgcattagataatttagcggtgttgcacactgcggaagcgggaggacgagcatataatcatgcactctctgaactccccgaaacactagaaacattattattattaacattactcgcaactgttacgggcggaatctttttatttctaatgagtggaaaaggaattggtaaaatgactctaggtatgtgctgcattataactgcatcaatactactatggtatgctcaaatccaaccacattggatcgcggctagtataatactagagttctttcttatagttctattgataccggaaccagaaaaacagaggacaccacaagacaatcaattaacatatgtagtaatagcgattcttacggtcgtcgccgcaacgatggcaaatgaaatggggtttctagagaaaacaaagcgcgattttggactgggctcaatcgctacccaacaacctgaatcgaacatcctagacatagatttaagaccagcttccgcctggactttatacgcggttgccacaacctttattacgccaatgctgaggcattcaatagaaaattcatcagtcaatgtctcattaactgcgatagccaatcaagctactgtcttaatgggattaggaaagggttggccactctcaaaaatggacatcggagtacctttattggcaatcggttgttacagtcaggtaaatccaatcaccctaacggccgccctacttttgctagtagctcattacgcaataataggccctggcctacaagcgaaagcaacaagggaagcccaaaaacgagcggccgcaggtataatgaaaaatcctacggtcgacggaataacagtaatagatttagaccctataccatacgacccgaagtttgaaaaacagttagggcaagttatgctgttggtgctttgtgttacacaagtacttatgatgagaactacttgggccctatgtgaagcgctgactttggcaacaggaccaatttcaactttatgggaaggtaatccaggtcgattctggaataccacgattgccgtaagtatggcaaatatctttcgagggtcctatctcgcgggtgccggtttactatttagcataatgaaaaataccaccaacacccgaagaggtacaggaaacactggagaaacacttggtgaaaagtggaagaataggctaaactcgttaggcaagagtgagtttcaaatttacaaaaggtctggcatccaagaagttgacagaactctagctaaagaaggtataaagagaggagagacagatcatcacgctgtttccagaggatcagcaaaactgcgctggtttgtcgagcgaaatctcgtaacaccagagggtaaggtcgtcgacttaggctgcgggcgtggaggctggtcttattactgtggtggactcaaaaatgtaagggaggtaaaagggctcaccaagggaggccccggccatgaagaacctatcccaatgtctacttacggttggaacctcgtgcgcttgcaatcgggagtcgacgtattctttactcctccagaaaaatgtgacacactcctatgtgatataggagaatcctctccaaatccgacagtggaggcgggtaggacattaagggtacttaatctagtcgaaaattggttaaataacaatacacaattttgcataaaagtactgaacccatatatgccgtcggtaatagagaaaatggaaacgctgcaacgaaaatatggaggtgccctggtaaggaatccattgagcagaaattctacgcacgagatgtactgggtgtcaaatgcgtcgggcaatatcgtttcatctgttaacatgatatcgcgcatgctcataaatcggtttacgatgcgccacaagaaagcaacctatgaacccgacgtggacttaggtagtggaacaagaaacataggaattgagagtgaaacgcctaaccttgacatcatcggaaaaagaatcgaaaagattaagcaagagcatgaaacttcatggcattatgaccaagatcatccatataaaacatgggcctatcatggatcttacgagactaaacaaactggctccgctagctcgatggtcaatggagtagttaggttactaactaaaccatgggatgtaatacccatggtgacgcagatggcaatgacagacacaaccccattcggccaacaacgtgtcttcaaagagaaagtagatacaaggacccaagaacccaaagagggtaccaagaaattaatgaaaatcaccgctgaatggctttggaaagaacttggcaagaagaaaacaccaagaatgtgcactagagaagaatttacaagaaaagttcgaagtaatgcagctttgggagccatcttcacagatgaaaacaagtggaaatctgcaagagaggcagttgaagactctagattttgggaattagtagataaagaacgaaatctgcatctagaagggaaatgcgaaacatgcgtctacaacatgatgggaaaaagagagaagaaaataggtgaatttggtaaagctaaggggagcagagcgatatggtacatgtggcttggtgcaagattcctcgaatttgaagcactagggtttttaaacgaagatcattggttttcgcgcgaaaattccttatcaggtgttgagggagaaggcttgcataaattaggatatattcttagagaggtgtccaagaaagaaggaggagccatgtatgcagacgacacagctggttgggacactcgcataaccttagaagatctcaaaaatgaggagatggttacaaatcacatggaaggagagcacaagaaattagcagaggctatcttcaagctaacttaccagaacaaagttgtaagagtacaacgcccaacacctagagggacggtgatggacatcatttccaggcgagatcaaagaggcagtggacaagttggcacctatggactaaatacttttactaacatgggagcccaacttattcgtcaaatggagggggaaggggtgttcaaaggcatccaacatctaacagctacggaagaggtagctgtacaagactggctcgctagagtaggcagagaaagactttcaagaatggcgataagtggggatgattgtgtagtaaagccattagatgaccgatttgcgagcgccttaaccgcattaaatgatatgggcaaaatccgaaaggatatacagcagtgggaaccgagtcgcggctggaatgattggacacaagtaccgttttgttctcatcatttccacgagcttatcatgaaagatggtagagtactggtcgtaccgtgccgtaaccaagacgaactaatcggccgtgccaggatatcccaaggcgcaggctggtctttgcgcgagacagcatgtctagggaaaagttatgcacaaatgtggtcactcatgtattttcacaggagagacctaagattagcagcaaatgctatttgcagcgcagtcccctcacattgggttccaactagccgaactacttggtcaatacatgcgaggcatgaatggatgacaacagaagatatgcttacagtatggaatagggtatggatacaggaaaatccatggatggaagataaaacgccggtagaatcatgggaagaaatcccgtacctaggtaaaagggaagaccaatggtgtggctcacttataggtctaacttcacgagcaacctgggccaaaaatatacaaacagcgataaatcaagtacgttcactaatcggctcagaagaatacacagactacatgccatccatgaaaaggtttaggcgcgaagaagaagaggcaggagtcctctggtga

SEQ ID NO: 22306 - RNA, 9876 nt, synthetic construct
  misc_feature 1..9876: note = derived and/or modified CDS sequence (opt6) from DENV-2__JQ922551__SS-prME
  source 1..9876: mol_type = other RNA
acagtaggaatgataattatgttgatcccaacagctatggctttccatctaaccacacgtaatggtgaaccccatatgatcgtatcacgacaagaaaaaggaaaatcgttactctttaaaacagaagacggagttaatatgtgcacgttaatggcgatggatttgggggaattatgcgaagatacaattacgtacaactgccccttactcaaacaaaacgaacccgaagacatagattgttggtgcaatagtacatccacatgggttacttacggaacatgtacggcaacaggagaacatcggcgagaaaaacgcagcgtcgcattagttcctcatgtagggatggggctagaaacaagaaccgaaacatggatgtcgtcagaaggagcctgcaaacatgcacagcgcatcgaaacatggatattaagacatccatcatttacaattatggcagcaatcttggcgtataccattggtactacttactttcagcgggtcgtgttcctaatggtcctaacagccgtggctctttcaatgactatgagatgcatcggtatctcaaaccgtgattttgtcgaaggagtctcgggaggatcatgggttgacatcgttttagaacatgggtcatgtgtaactaccatggctaaaaataaacctaccctagattttgaacttataaaaactgaagcaaaacaacccgctacacttcgaaaatactgcatagaagccaaactcaccaacacaactaccgcaagcagatgtcctacacaaggagaaccaagtctgaatgaagaacaagataaaagatttgttagaaaacattcgatggtggaccgagggtggggaaatggatgtggactttttggaaaaggtggtattgttacgtgtgcaatgttcacctgtaagaaaaatatggaggggaaaatagtccaacccgaaaatttagaatatactttagtgataacgccccactctggcgaagaaaatgcagtcggtaacgatacaggcaatcatggaaaagaaattaaagtaacaccgcaaagtagcattactgaagctgcactcactggctacggcactgtcacaatggaatgtagcccaagaactggtttaaacttccatgagatggtaagtcttcccatggagaacaaagcgtggatggtccatagacaatggtttcttgacctacccttaccttggctcccaggcgcagatacacaaggaagcaattggatccagaaagaaaccctcgtcacatttaaaaatccgcacgctaagaaacaagacgttgtagtgttaggatcacaggagggcgcgatgcatacagcactaacaggtgcaactgaaatacaaatgtcgagcggcaatttattattcaccggtcatctgaaatgccgactacgaatggacaaattacagcttaaaggaatgtcgtattccatgtgtacgggcaaattcaaagtggtatggggaatagcacgtactcaacatgggacaatcgtacatcgagtacagtacgaaggagacggctcaccatgtaaaattccgttaaacatcatgggtttagagaaaaggcatgttttaggaaggccgataacagtaaatcctatagtcacaggtaaagattcaccagtaaacatcgaagcagaaccacctttaggggactcgtatataataatcggagtagaaccaggccaggtcaaactgacatgttcgcaaaaaggtagctcaatagggcaaatgtttgaaactaccatgcgaggcgccaaaaggatggccattttaggggatacagcttgggactttggcagcttaggaggagttttcacttcgattggaaaagcattacaccaagtatttggagcgatctacggtgcagcattttcaggggtatcgtggaccatgaaaatcttaataggtgtagtaataacatggataggaatgaacagcagatccacttctctgtccgttagcttagtattagtaggggtggtaacgctgtatttaggagtgatggtacaagctgactcaggttgtgtcgtatcctggaaaaacaaagaactgaaatgtggaagtggaatattcgtaacagataatgttcacacctggacggagcaatataaatttcaaccagaaagtcccagcaaacttgcatcggcaatacaaaaagcccacgaagaaggaatctgtggtatccgaagcgtgactaggctagagaatttaatgtggaaacaaatcactcccgaattgaatcatatactctctgagaatgaggtaaaattaactatcatgaccggcgatataaaaggaatcatgcaggcgggaaagcggtcacttcgcccgcaacccactgaactaaagtactcatggaaaacctggggtaaagcgaagatgctaagtacagaaccacacaaccagacgttcttaatagatggaccagagacagctgaatgcccgagtactaacagagcttggaactcgctcaagggaggggattatggattcggtgtattcactactaacatatggcttaaattaaaagaaagacaggacgtttcatgtgacagcaagttaatgagtgcggcaattaaggacaaccgggccgtgcatgcagatatgggttactggatagaaagcgctcttaatgatacatggaaaattgaaaaggcttcgtttatagaggtgaaaagctgtcactggcctaaatcacataccttatggtcgaacggcgtattggaaagcgagatgatcattcctaaaaacttagcagggccagtatcccaacacaattatcgacccggatatcacactcaaacagctggaccttggcatttaggcaaactagaaatggattttgatctatgcgaaggaacaacagtagtcgtgactgaagactgtgggaatcgtggacccagtctacgaacaacaacagcttccggtaagctaataactgaatggtgttgcagatcgtgcacactaccaccactaaggtaccgaggcgaagatggatgttggtacggaatggaaattagaccattaaaagagaaggaagaaaatttagtaaattccctggttacggcagagcatgaacaaatagacaacttcagcctgggagtcttaggaatggctctgtttctagaagaaatgctgagaactcgcgtcgggacaaaacacgcagtactgctagtggcggtatcctttatgacactaatcaccgggaacatgtcatttagagatttaggaagagttatggtaatggtgggggcggcaatgacagacgacataggtatgggagtaacatacttagccttactggcagcgtttaaggtaaggccaacatttgccgcgggattactactccgaaaactcacgtctaaagaactaatgatgacaacaataggaatagtcttactcagtcaatcgactatcccggaaacaatattagaactgacagatgcgttagcattgggtatgatgatcctaaaaatcgtaagaaatatggaaaaatatcaactcgctgttacaataatggcaattttgtgtgtacctaatgcaatgatactacagaacgcatggaaggtgtcctgcactattttggcggtagtatcagtgtctcccctattattaacaagttcgcagcaaaaggcagattggattccattagcgttgacgataaaaggactcaacccaaccgctatatttcttaccaccctaagtcggacaaacaagaaaagatcctggccccttaatgaagcaataatggcagtaggtatggtttccatactagcgtcgtcacttctaaagaacgatatcccaatgacaggaccattagtagcgggaggtttactcacagtttgctacctgttaccggggagaagcgctgacctagaattagagcgggcagcagatttaagatgggaagaccaggcggaaattagcgggtccagcccaattttatcaattactatttccgaagacggatctatgtcgattaaaaaccaggaagaaaaacaaaccttgactatattaattaaaaccggtctgttagtaatttcagagctatttcctgtccaaattcctatcacggctgccgcatggtatttatgggaagtaaagaaacaacgcgctggagtattatgggatgtcccatctcccccaccggtaggaaaagcagaactagaagacggagcctatggcataaaacaaaaaggcattcttgggtatagtcaaataggtgcgggagtatataaagaagggacatttcatacgatgtggcatgtaacacgcggcgctgtattaatgcataaaggaaaaagaatagaaccatcatgggcagacgtaagaaaagatttgataagttatggtggaggatggaaattggaaggggagtggaaggaaggggaagaggttcaagtcttagcgttagaacccgggaaaaaccccagagcagtacagacgcggccaggactttttaaaacgaacacaggtactattggcgcagtttccctagacttctcccctggtacatccggaagcccaatcgtagacaagaaaggaaaagtggtaggattatatggcaacggagtcgtaacacggtcaggtacttatgtatctgcaatagcgcaaacagaaaaatcaatagaagataatcctgaaattgaagacgacattttcaggaagaaacgactaaccattatggacctccatcctggagcaggtaaaactaaaaggtacttgcctgctattgttagggaagccattaaaagggggttacgaacattaatattagcaccaactagagttgttgcagctgaaatggaagaggccctgagaggcttaccaattagatatcaaacccctgcgataagggccgaacatactgggagagaaatcgtggacctaatgtgtcatgccacatttactatgagactactaagtccagtgagagtacctaactacaatttaatcatcatggatgaggcccatttcacagatcctgcatcaatagcggcgaggggctacatttccacacgggttgagatgggagaggcggcaggtatatttatgacggcaactccacccggatcaagagaccctttcccgcaaagtaacgcgccaatcatggacgaagaacgggaaataccagaacgtagctggaactcaggtcatgagtgggtgacggatttcaaaggcaaaaccgtatggtttgtccctagcataaaagctggtaatgatatagcagcatgtttacgtaaaaatggtaagaaagtaatccagttgagcagaaagacctttgattctgaatatataaaaactcggaccaatgattgggatttcgttgtaacaaccgatataagcgaaatgggggcaaactttaaagctgaacgagtcatcgaccctagacgttgtatgaagccagttatactgaccgatggagaagaacgggtaattttagcaggtcctatgccagttactcatagttccgcagctcaacggagagggcggataggccgaaacccaaagaatgaaaacgatcaatatatttatatgggtgaaccacttgagaatgacgaagactgcgcccattggaaggaagccaaaatgttgttagataatattaataccccggaaggaataatcccatcgatgttcgaacctgaaagagaaaaagtagacgcaatagacggagaatataggttaagaggcgaagctcgcaaaacgttcgtagatctcatgagaagaggagacctacctgtatggttggcgtacagagttgcggctgaagggataaattacgcagacagaaggtggtgcttcgacgggatcaaaaataatcaaatattggaagaaaatgtagaagtcgaaatatggaccaaagaaggtgagaagaagaaactgaagccaaggtggctcgacgcacgaatctatagtgatccgctggcacttaaggagttcaaagagttcgcagcggggagaaaatcacttaccttaaatcttataactgaaatgggccggctaccaacttttatgacgcaaaaagcaagaaatgcacttgataacctagcggtactccacacagctgaagctggcggacgagcgtacaatcatgccctctccgaactaccggagacacttgaaactctcctgctcttgactttattagcaacagtcacgggaggaatattcctttttctcatgtcaggaaaaggaataggaaaaatgactctaggaatgtgttgtattatcacggcgagtattttgctctggtatgcccaaatacagccacactggattgccgcctcgataatactagagttctttttgatcgtgttactcataccggaacctgaaaaacaacgtactcctcaagacaatcaactaacctacgtagttattgccattctcactgctgttgcggcaactatggctaatgaaatggggtttttagagaaaacaaagaaagactttggtctaggatcaatcgctactcaaccacctgaatctaacatacttgacatcgatttacgaccggcaagtgcttggaccctatacgcagtcgctaccacttttataacatcaatgttaaggcattctattgaaaacagctctgttaatgtctcactcactgcaattgctaatcaagcaacagtcctcatggggttgggtaaaggatggcccttatcaaaaatggacattggtgtcccactactagctataggatgttactctcaagtcaaccctataactctaacggccgcattactactcttagtagcacattatgctataattggaccaggattacaagcgaaggctacacgtgaagcacaaaaacgagccgcagctgggattatgaaaaatccgactgtggatgggataacagtaatcgatttagatcctatcccgtacgatccaaagtttgaaaaacaattaggtcaagtcatgctattagtcttatgcgtcacacaagttttaatgatgaggacaacatgggcattgtgtgaagctctaacactagcgacgggaccaatatcaactttgtgggaaggtaatcccggtaggttttggaacaccacgatagccgtaagcatggccaatattttcaggggatcatatctagcaggcgccggcttactattcagcataatgaaaaacaccacgaacactaggagaggtactggtaatacgggtgaaacacttggcgaaaaatggaagaataggctaaatgcgctcggaaaaagtgaatttcaaatctataagaaatctggaatacaagaagttgaccgtaccctagcaaaggaaggcattaaaagaggagaaaccgaccatcacgccgtgagtagaggaagcgctaaattgagatggttcgttgaaagaaatctagttacccccgaaggtaaagtcgttgacttaggatgcggaagaggaggatggagttactattgcggaggtctgaagaacgtacgagaagtcaagggtctcactaagggcggccctggacatgaagaaccaatcccgatgtcaacgtacgggtggaacttggtcagacttcagtctggcgtagatgtattcttcactccaccagaaaagtgcgacacactgttgtgcgacataggtgaaagctcacctaacccgactgtggaagcaggcagaacgcttcgagttcttaacttagttgaaaattggttaaataacaacacccagttttgtgttaaagttcttaacccctacatgccctcagttatagagaaaatggaaacactccagcgaaagtacggtggtgcattagttagaaatcctttatcaaggaatagtacgcacgaaatgtattgggtatctaatgcgtctggtaacatcgtctcttcagtcaacatgataagccgtatgttaatcaacagatttacaatgagacacaagaaagcgacttatgaaccggacgttgatctgggctcagggacgcgaaatataggaattgaatcggaaacaccaaacctagacattattggcaaaagaatcgagaagataaaacaagaacatgaaacatcctggcattacgatcaggaccatccatataaaacgtgggcatatcacggaagttacgagacaaagcagacgggatcagcttcatcgatggttaacggagtagttcgcttattaactaaaccttgggacgtcataccaatggtaacccagatggctatgacagacacaactccatttggacaacaaagagtattcaaggagaaaagtgatacaagaactcaggaaccaaaggaagggaccaagaaacttatgaaaataacaccaaagtggctatggaaagagttaggtaagaagaaaactccgcgaatgtgtacacgggaggagttcactagaaaggtacgatctaatgcagcgcttggcgctattttcactgatgagaataagtggaaatccgcaagagaggcagtagaggactcaaggttttgggaactcgtcgataaagagcgtaacttacacctagaaggaaaatgtgaaacatgtgtatacaatatgatgggaaaaagagagaagaaattaggggagttcgggaaagctaaaggcagcagagcgatatggtacatgtggcttggagccagattcttagaatttgaagcattgggatttctaaacgaagaccattggtttagtcgagaaaattcactctcaggggttgagggtgaaggcctacataaattaggctacatccttcgtgacgtatcaaagaaagaaggaggcgcgatgtatgcagacgacacagcgggctgggatacgagaataactttagaagatctgaaaaacgaagaaatgggtgcaaatcatctggagggggagcccaagaaattatatgaggctatatttaaacttacataccaaaataaaggggttcgagttcaacggccaactccaagaggaccacttatggatattatcctaagacgagatcaagggggttcgggacaggtaggaacctacgggctaaatacatttacaaatatgggagcacagctaattagacaaatggaaggagagggggttttcaaaggtatacagcacttaattgcaacagaagagatcgcagtccaagactggctagcccgagtgggcagggaaagattttccagaatggctatttctggagatgactgtgtagtaaaaccgctagatgatagatttgcgtctgctttaacagccttaaacgatatgggtaaggaaaggaaagttcttcaacaatgggaaccctcaagagagtggaatgattggactcaagtacccttctgttcgcatcattttcatgaattaattatgaaagatggaagagtgctagttgtaccatgcagaaaccaggacgagttaataggtcgagcgcgaataagccaaggagcaggatggagcctaagagaaacggcctgcctaggaaaaagttatgcacagatgtggtcgcaaatgtacttccatagaagggatctacgattagcagcaaatgctatatgctctgcagtcccatcacattgggtacctacaagcaggactacttggtcgatacatgcacgtcatgaatggatgactactgaagatatgctaacagtctggaaccgtgtgtggatacaggaaaacccgtggatggaagataaaacacctgtcgaaagttgggaagaaatcccatacctaggcaagcgtgaagatcaatggtgtggatcgctcatagggctcactagcagagcaacttgggcgaaaaatatacaaacagcaataaaccaggtaagaagtcttataggaaacgaagaatacacagattatatgccctcaatgaaacgcttccgtcgtgaggaggaagaagcgggcgtgctatggtaa

SEQ ID NO: 22307 - RNA, 9876 nt, synthetic construct
  misc_feature 1..9876: note = derived and/or modified CDS sequence (opt6) from DENV-2__JQ922550__SS-prME
  source 1..9876: mol_type = other RNA
acggttggaatgataattatgttaatcccgacagttatggcttcacacttaacgactcgcaatgggggtccgcatatgatagttataggacaacagaaacgtaaaacgagcttctttaaaaccaagaaaggacacgatatgtgcacactaatggcgatggccttcggggaattttgtgaaaacactatcacatataaatgtccattcctcaaacaaaatgaaccagaagacatagattgttggtgtaattcaacatcaacgtgggttacttatggaacctgtacaacaacaggtgaacatagaagggagaaaagaagcgtcgccctagtcccacatgtaggaatgggattagaaacgagaaccgaaacctggatgtcgagcgaaggagcctggaaacatgcccaaaggatagaaacgtggattctgaggcatccgggttttacaatcatggcagcaatattggcttacacgataggaacaactcattttcaacgagtcctcatatttatactacttactgccatcgcaccaagcatgacaatgcgttgtattgggatttccaatcgcgatttcgttgaaggtgttagtgggggttcctgggttgatatagtgttggaacacggtagctgtgtcacaacaatggccaaaaataaaccaacattggactttgaattaataaaaactgaagcaaaacaaccggcaacattacgcaaatactgtatcgaagcaaaacttaccaacaccacaacggatagtaggtgtccaacacaaggcgaaccaacattaaacgaagaacaggacaaaagattcgtttgtaaacatagcatggtcgatcgtgggtggggtaacgggtgtgggttatttggaaaaggtggcatagtgacctgcgcaatgtttacttgtaagaaaaatatgaaaggaaaaatcgtccaacctgagaatctagaatatacggttgtaataactccacattcaggagaagaacatgctgtgggaaacgacaccggcaaacacggtaaagaagtaaaaattacaccacaaagtagtataactgaagcagaattaactggatacggtacggttaccatggagtgtagcccaagaacaggcctggactttaacgaaatggtactcttacaaatggaagataaagcatggctagtacaccggcagtggtttctagatctgccactaccctggcttccaggagctgacacacagggcagcaactggatccagaaagagactctagttacttttaagaatccacatgcaaagaagcaagatgttgtagtattaggctctcaagaaggagcaatgcacacggccttaaccggcgccactgaaatacaaatgtcgagcgggaatttattatttacaggtcatttaaaatgcagattacgaatggataagctgcaactgaaaggtatgagttacagcatgtgtacgggaaaattcaaggttgtgaaggagatcgccgaaacccagcacggaactatagtaataagagttcaatatgaaggagacggtagtccgtgcaaaataccattcgaaattaaagatttagaaaagcgacatgttctcggaagattaatcactgttaatccaatagtgacagaaaaagactcacctgtaaatatagaggcagaaccgcccctgggcgactcatatataataattggagttgaaccaggacagttgaagttggactggtttaagaaaggctcaagtattggacaaatgttcgaaaatacgatgagaggagctaagcggatggcgattttaggcgatacagcatgggactttggcagtttgggaggcgtattcaccagtataggcaaggcgctacaccaagttttcggtgcaatctacggcgcagctttctccggagtgagctggactatgaaaattttaatcggggtaatcataacatggattggtatgaacagcagaagtacaagtctatctgtatcccttgtattggtcgggatcgtaaccctatatctcggtgtcatggtccaagcagattctggatgtggcggatgtgaacgcaaaacgaaaacaaaatgtggctctggcatattcgtgacggataatgtacatacatggaccgaacagtataagttccaaccagaatcgcccagcaaattagcttcggcgattcaaaaggcgcatgaagagggtatttgtgggattcggtcagtaactcggttagagaacttaatgtggaaacaaattactcctgaacttaatcatatactatcagaaaatgaagttaagttaaccattatgacaggagacataaaaggtataatgcaagccggaaagagatccctaaggccccaacccacagaattaagatactcctggaaaacatggggcaaggcaaaaatgttatcaactgaattacataatcaaacgtttttaatcgacggtcccgaaacagcggaatgtcccaacacaaatcgagcttggaactcactcgaggtagaagattatggatttggtgtgtttactacaaacatttggcttcggctacgagaaaaacaagatgtcttttgtgattcaaaattaatgtcagcagctataaaagacaacagagcagtacacgctgacatgggttactggattgaatccgctcttaacgatacatggaaaatagaaaaagcaagtttcatagaagtgaagtcatgccactggccaaaaagtcacacactttggggaaatggcgtgttagaaagtgaaatggttattccgaaaaattttgcaggaccagtatcccaacataataacagaccaggttactatacacaaaccgcgggaccctggcacttaggtaaactggaaatggacttcgacttttgcgaaggaacgactgtcgtggtaaccgaggattgtggcaataggggtccttcactaaggaccaccacagcttcaggtaaattaataacagagtggtgctgcagaagctgcactttaccaccacctaagtacagaggagaagatggatgctggtacggcatggaaatacggccactgaaagaaaaggaagaaaatttagtttcaagccttgtgacagccggtcatgggcaaatagataacttctcattaggcatacttggtatggcactgttcttagaagaaatgttaaggactagagtaggaactaagcacgccatattattggtagcggtatcattcgtgacactaataacaggaaacatgagctttagggatttgggtcgagtaatggtaatggtgggagcgacgatgacagacgatataggcatgggtgtaacatacttagcactcttagcagccttcaaagttcgaccaacatttgccgcaggacttttacttcgtaaactaactagcaaagaactcatgatgacaacaataggaattgttctctcatcacaatcctcaattccagagacaatactagagttaacagatgcacttgccctaggaatgatggttctcaaaatggtgaggaacatggaaaaatatcaacttgcggtaacgataatggccatattatgtgtacccaacgcagtaatactccaaaatgcatggaaggtttcatgtactattttagctgttgtatcggtgagtcctttactactaacatcctcacagcaaaaagctgattggatacccctagcattaaccattaagggacttaatccaactgcaatatttttaactacccttagcggaacgtccaaacgaagaagctggcctttaaacgaagcaataatggcggttggcatggtgagcatattagctagcagcttacttaaaaacgacattcctatgaccggcccgttggttgccggaggattgttaactgtatgttacgtgttgacgggacgatcggcagatctcgaactagaaagagcaactgacgttaaatgggatgaccaagccgaaatatccgggtcgtccccgattttaagcatcactataagtgaagacggctcgatgagtattaagaacgaagaagaagaacaaacgctgactatactaattagaacaggcctcttagtcatttctgggctattcccggtgagtatacccatcactgcagctgcatggtatttatgggaagtcaagaaacaaagggccggtgttctatgggatgtaccctcacccccattggtcggtaaagcggagctagaagacggagcttacagaataaagcaaaaaggaatactagggtacagccaaataggagcgggcgtatataaagaagggacctttcatactatgtggcatgtcacccgtggtgctgttttaatgcataaaggaaaaaggatagaacccagctgggcagatgttaagaaagacttaattagttacggaggagggtggaaattagaaggcgagtggaaagaaggtgaagaagtccaagtgttagccctcgaaccaggtaagaatccccgagcagtccaaacaaaacctggattgtttcgaaccaatacaggaactatcggggcagtttctctcgactttagccccggcacatctgggtctccaatcgtagataagaaagggaaagtagtaggtctttatggaaacggtgttgtcactaggtctggagcatacgttagtgctatagcacaaactgaaaaatcaatcgaggacaacccggaaatcgaagacgacatcttccggaaaagaaggcttactataatggatcttcaccctggcgccggaaaaacaaaacgatatttgccagctatagtacgagaggcaatcaagcgaggactccgaactttaatactcgcaccaactagagtagttgcagcagaaatggaagaggccttgaggggattaccgataagataccagactccagccattagagctgaacataccggtcgagagatagtagaccttatgtgtcatgctacatttactatgagactattgagtcctattagggtaccgaattacaatttaataattatggacgaagctcattttacggaccctgccagcatagcagccagaggctacatcagtactagagtagagatgggggaagcagcaggtatatttatgacagcaacacctccaggatctagggatccatttccccagagcaacgcaccaataatggatgaagaaagggagatacctgaaaggtcatggaactctggccacgaatgggtcacagacttcaaaggcaagacagtctggttcgtaccctcaataaagactggtaacgatatagccgcatgtttacgtaaaaatggtaaacgagtgatacaactcagtcgcaaaaccttcgatagtgaatatgtaaagacaagaacgaatgactgggacttcgttgtaaccactgacatatcagaaatgggagcaaacttcaaagccgagcgcgttatagacccgcgccgatgtatgaaacccgtaatactaacagatggtgaggaaagggtgatcctagctgggcctatgccagttacgcacagtagcgctgcacagaggagaggcagaataggccgtaaccctaaaaacgaaaacgatcagtacatatacatgggtgaacctctagaaaatgacgaagattgcgcacattggaaagaagcaaaaatgctgcttgataatataaacacgcctgagggtatcataccttctatgtttgaacctgaaagagagaaagtggacgcaatcgatggagagtatcgactcaggggtgaagcaagaaagacattactcgaattgattagaggcggccctatccctgtatatctcggctacaaatggccaggtgagggcataaactatgcagacagccgtttatgtgtcggtcgcacgcaaaacaaccaaatattagaggaaaacgtagaagtagaaatatggaccaaagaagggaagggaaagaagttaaaaccaagatggcttgacgccagaatatactcagatccgttagcactaaaagaatttaaagaatttgctgctgggagaaaatcactaactttgaatctgataacagaaatggggagacttccaacttttatgactcaaaaagctagggatgctctagacaatttagccgtgttacatacagcggaggctggagggaaagcatataaccatgcactttccgaattaccagaaactttagaaactctgttgctccttacgttattggcaacagttactggagggatcttcttatttttaatgtccggccgtggaataggaaaaatgactctaggaatgtgctgcatcattaccgcatctatcttactatggtatgctcaaatccaacctcactggatagcggcttcaataatccttgaatttttcctaatcgtattattaatcccagaaccggaaaagcaacgaactccccaagacaaccagctaacatacgtaattattgcaatactcaccgttgtcgcagccactatggcaaatgaaatgggatttctcgagaaaaccaagaaagacctaggactaggaaacatcgcgacccaacagcctgaatctaatatattagacatagatcttagacctgcaagcgcatggacactatatgccgtagctaccacatttatcacaccaatgctccgacatagcatagaaaacagcagtgttaacgtatcgctaacggcgattgctaatcaagcaactgttctaatgggactaggaaaaggttggcctttatcaaaaatggatattggggttcctctactcgcaataggttgttactcccaagtaaacccaattacactgactgctgcacttttgctattagtagcacattatgccatcattggaccaggattgcaagccaaagctactagagaagcccagaaacgggccgcagcgggaattatgaaaaatcctacggtcgatggaatcactgtgatcgacttggaccctattccttatgatccaaaatttgaaaaacagctcggacaagtaatgctacttgtcctatgcgtgacccaggttctcatgatgcgcacaacctgggccttgtgcgaggctttgaccctcgctacaggtcctgtctcaacactgtgggagggaaacccaggtagattttggaacactactatactgatacaaatggcaaatattttgagaggcagttatttagcaggcgcgggacctttgtttagcataatggagaatacaactggacctagacgtagaaccggacagttaggtcgagagttgttgaggaggtggaaaagtagattaaatgcgttaggaaaaagtgaatttcagatatataaaaagagtggaatacaggaagtagaccgtacactagcgaaagaaggaattaagcgtggagagactgaccaccatgcagtaagtagaggctccgcgaaattacgttggttcgtagaaaggaatttggttactcctgaaggcaaagtggtcgatcttggttgtggaagaggtggttggtcatactactgcggaggattgaaaaacgtaagagaagtgaaggggttaactaaaggaggtccggggcacgaagaacctatacccatgtctacgtacggatggaacttggtaagattgcaatcaggcgtagacgtattctttatacctccagagaggtgtgatacacttctctgtgatattggagaatcgtctccaaaccctacagtagaagcaggtaggacattgagggtccttaacctagtagaaaactggctaaataataatactcaattctgcatcaaagtgctaaacccctatatgccctccgttattgaaaagatggagacattacagaggaaatacggtggtgctttggttcgtaaccccctttcgaggaactcgacacatgaaatgtactgggtttccaatgcaagcggaaacattgtgtcttcagtcaacatgatatctcgcatgttaataaacagatttactatgagacacaaaaaggcaacttacgaaccagatgttgatttaggatccggtacacggaatattggaatcgaaagtgaaatacccaacctcgacataatagggaaaaggatagagaaaattaaacaggaacacgaaacaagttggcattatgatcaagaccatccatataaaacctgggcctaccatggctcctacgaaacaaaacaaacaggttctgcatcatccatggtaaatggggtcgttcgtttattaactaaaccctgggatgtagtgccaatggttacacagatggcaatgactgataccacaccgtttggacaacagcgggtatttaaagaaaaagtagatacacgtatccaagaaccgaaagaaggaacaaagaaattaatgaaaatcatggcagagtggctatggaaagaattaggcaagaagaaaacgcctcggatgtgcactagggaagaatttacgaagaaagtacggtctaatgctgcactaggtgcaatatttacagatgagaacaagtggaaatcggcacgtgaggcggtagaggatggaagattttgggaattagtagacagggaacgtaacttacacttagaagggaagtgcgaaacatgtgtctacaacatgatgggtaagcgggaaaagaaactaggtgaatttgggaaagctaaaggatctagagcgatatggtacatgtggttgggggcgcgatttctagagttcgaggcccttggatttttgaacgaagaccattggttcagtcgagaaaattctctttcaggcgtagagggagaaggcttacataaacttggatatatactaagggaagtgagcaagaaagagggcggagcaatgtatgcggatgatacagctggatgggatacgagaataactctaggggctttaaagaatgaaagaaaatgtacagaacatatggagggggaaccgagaaaaccgggaagaggtcactttaaatggagaaatcaaaacagagtagtaggggttcaaggcccaacacctggagggactgtaatggacataatctcccgtaaaaatcaaaggggcagcggacaagtagggacctacggattgaacacctttactaatatggaggcccaattaataagacaaatggaaggtgaaggcttctttattgaacaccaacatctcactgcatcagaagaaaatgcggtacaggactggctagcacgtgttggaagagaaaaagtctcaagaatgccaatatcaggagatgactgcgtagtaaagccactagatgaccgttttgcgagagcactaaccgcactcaatgatatgggtaaagtccgtaaggacatccaacaatgggaaccgtctcgagggtggaacgattggacacaagtacctttctgttcccatcattttcatgaactaattatgaaagatggtagaactctagtagtcccgtgcaggaaccaagatgaactaatagggcgcgcaagaattagccagggagcaggctggtcgttcggtgaaacagcatgtctggggaaaagctacgcacaaatgtggagtttaattaatttcaggattcccgatttacgcctagcagccaacgtaatatgtagcgtagttccgtcacattgggtcccaacatctcgtaccacatggtctattcatgctaaccacgagtggatgacgacagaagatatgttaacggtatggaatagagtctggatactagaaaacccatggatggaagataaaacaccggtggaatcgtgggaagaaattccgtatttagagaaaagggaagaccaatggtgtggaagtttgatagggttgacaccacaacccccttgggccaaaaacatagagaccgcaataaaccaagtaagaagtttaattggtaatgaggaatatattgattatcttccgtcaatgaaaagattcaggatcgaagaagaagagtctggcttcctatggtaa

SEQ ID NO: 22308 - RNA, 9876 nt, synthetic construct
  misc_feature 1..9876: note = derived and/or modified CDS sequence (opt6) from DENV-2__JQ922553__SS-prME
  source 1..9876: mol_type = other RNA
acagcaggaatgattataatgttaatacctacagtaatggcatttcacttgacaaccagaaatgttgaacctcctatgatattttcaagacaagaaaaaggaaaaagtttcctttttaaaacaaaagatggtcacgatatgtgcactttcatggcaatggatttaggtgaactgtgtgaagatactattacatataaatgtccgtttctgaaacaaaacgaacctgaagacatagattgttggtgcaatagtaccagtacttgggttacatatggaacatgtactacaacaggcgaacatagaagggagaaaagatcagttgccctagtaccgcacgtaggcatgggattagaaactagaaccgaaacatggatgtcatccgaaggagcatggaaacatgtacaaaggatcgaaacatggatacttcgtcatccaggattcaccataatggctgcaattctagcttacacgattggtactactcatttccaaagagttttaatatttattctgctaacgggagtcgcgccctcaatgagaatgagatgtatagggataagcaatagggactttgtcgaaggagtgtcaggcggttcctgggtagatatagtgttagaacacgggtcatgtgtaaccacaatggccaaaaacaaaccaacactcgatctagaactaatcaaaaccgaagcaaaacaacctgccaccctcagaaaatattgtatcgaagccaaattaacaaatacgacaaccgatagtagatgtccaacacaaggagaacctaccttgaacgaggagcaggacaaacgtttcgtctgcaaacactcgatggttgatagaggttggggtaatggctgtggattatttggaaaaggtgcaattgtaacatgtgcgatgtttacatgtaagaaatcgatgaaaggaaaaattgttcagccagagaaccttgaatatacagtagttattacaccacactccggcgaagaatatgcagtaggtaatgatacgggtaaacatgggaaagaggtaaagattactccccaaagcagcataacagaagcagaactaacggggtatggaactgtaaccatggaatgttcccctcgaactggattagactttaatgaaatggtattattacagatggaggataaagcatggctggtacacagacagtggtttttagatctccccttaccgtggttacccggcgctgatacacaaggctcaaactggatacaaaaagagactctggtcacgtttaaaaacccccacgcgaaaaagcaagatgtcgtcgtattagggagccaagaaggtgcaatgcacactgcacttacaggtgccactgaaatccaaatgtcctcaggaaacctgcttttcacgggacacttaaaatgccgattaagaatggacaaattacaactaaaaggaatgtcttacagtatgtgtaccggaaagtttaaagtggtaaaagagattgcggaaacacagcatgggacaatagtaataagagtgcaatacgaaggtgacggaagtccttgcaaaataccgttcgagataatggatcttgagaaaagacatgtgcttggaagattaataacagtgaatccgattgtcacagagaaggatagtccagttaatatagaagctgagccaccctttggcgacagttacataataataggagtggaacccggacagttaaaactagactggtttaagaaaggatcaagtataggacagatgcttgaaacaacaatgcgcggagccaaacgaatggctatcttaggcgacacagcttgggattttggttcattaggtggagtattcacgagtattggaaaagcactacatcaggtttttggagccatttatggcgccgccttttccggagtatcatggacaatgaaaattttaattggagtcatcatcacatggattggaatgaactctcgaagtacctcgttatccgtaagtcttgtattagttggtatcgttacactgtatttaggtgtaatggttcaggctgatagcggatgtgtggtgagctggaaaaacaaagaattaaaatgtggatccggtatattcgttactgacaatgtccatacttggactgaacagtacaagtttcaacccgagtcaccctctaaactggcatccgcaattcagaaagcccacgaagagggtatttgtggcattcgcagtgtcacgagattggagaacctaatgtggaaacaaattacactagaattgaatcacattctgagcgagaatgaagtaaagctaaccattatgacaggagatataaaaggaattatgcaagtcggcaagagatcattacgaccgcaaccaactgaattaaggtattcctggaaaacatggggaaaggcaaaaatgctaagtactgagctccacaaccagaccttcctcattgacggaccagaaactgccgagtgtccaaatgcaaatagagcatggaacagtctggaggtagaggactacgggttccgtaaatataaaactaagatttggcctacattaaaagaatggaggaaggtattctgtgatagtaaattaatgtccgctgccatcaaagataacagagcagttcacgccgatatgggttactggattgagtccgccttgaacgacacctggaaaatagagaaagcatcattcattgaagtcaagagttgccactggccaaaatctcacaccctgtggggtaatggagttcaagaatcagaaatggtaatcccgaaaaacttcgcgggtcctgtatcccaacacaacaacagaccaggatactatacacagactgcgggtccctggcatcttggtaagctcgagatggatttcgacttttgtgaaggtaccacagtggtagtcacagaagattgtggaaaccgaggaccgagcttgaggacgacaactgcctcagggaagttgatcacagaatggtgctgtagaagctgtaccttacccccattacggtacagaggcgaagcgggttgttggtactggatggacatcagaccacttaaggaaaaagagaaaaatctagtgagcagtctagtgaccgcaggacatgggcaaatcgataactttagtttgagaatattaggaatggctttgttcctcgaaaagatgcttatgacacggctaggaactaaacacgctatattactcgttgccgtcagcttcgttactttaataacaagaaatatgagttttaaggacctaggacgtgttatggtaatggtgggtgccacaatgacagacgacatgaggatgggcgtgacttacctagcattgctgccagcttttaaagtacggcccacatttgctacaggtctcttattgagaaaactaactagcaaagaattaatgatgacgacgataggtatagtactattttcacaatcctctatacctgaaaccatactagagttaactgatgcacttgcgttaggaatgatggtattaaaaatggttcggaatatggaaaaatatcaattggccgtgaccataatggcaatactatgtgttccaaacgcagtcatattgcaaaatgcttggcgagtcagctgtacgatacttgcagttgtatctgttagtcccttattcttaacaagtagtagacaaaaagcagactggataccattagcactgactattaagggccttaatccaaccgcgatcttcttaacaacactatcgagaactagcaaaaagcgaagttggccattaaatgaagcaataatggcggttggcatggtgagcatactggcctcaagtctactcaagaatgatataccgatgactggtccattagttgcaggaggccttttaacagtctgctatgttctcacaggcagatcagccgacttagaattggaacgagcagctgatgtaaaatgggatgaccaagccgagatatctggcagtagtccgatactgagtatcactatatctgaagatggaagcatgtccataaagaacgaggaggaagaacaaacgttaactattttaatacgtacaggattgcttgtaatttcaggactgtttcccgtgagcatccccataaccgcagcagcttggtatttatgggaggtcaagaaacaaagagccggcgttttgtgggacgttccaagtccaccgcccgttgggaaagcggaattagaggatggtgcatataggattcaacaaaaaggaattttcggatactcacagataggtgccggggtatacaaggaaggaacattccctactatgtggcatgttacaaggggagcagtcctaatgcataaaggaaaaagaatagaaccttcatgggcagacgtcaagaaagatctaatttcatatggaggcggttggaagctagagggagaatggaaagaaggtgaagaggtacaagttctcgcgctagaaccaggaaagaaccctagagccgtacaaactaagcccggactattcaaaacaaatactgggacaattggcgctgtgagtctcgactttagtccgggcacctctggctcaccaatagtggataaaaagggcaaggtagtaggcttgtatggcaatggcgttgtaacaagatcaggtgcatatgttagcgcaatagcccagactgagaaatcaatagaagattatccagaagttgagatggacatatttaggaaaaagcggctaacaataatggattttcaccccggcgctggcagacagaaaagatactttccggcaatcgtaagagaagcaattaaaagagggttaagaactctaattctcgcccccacacgagtagttgcagctgagatggaagaagcattgcgcggattgccaattagataccaaacgccggcaataagagcagaacacaccggaagggaaatagtggacttgatgtgtcacgcaaccttcacgatgcgtctactaagcccaatccgagtcccgaattataatttaattattatggacgaggcacatttcacagacccagcctccatcgctgcaagaggatatatcagtacgagagtagaaatgggcgaggcggctggaatattcatgactgccactcctcccggatcccgagatccgttcccacaatcaaacgcgccaattatggacgaagaaagagaaataccggagcgaagctggaactcaggccacgaatgggtgacagactttaaaggtaaaatagtttggttcgttccaagtttaaaaacaggcaaatatattgctgcgtgcttgaggaaaaatggaaaacgcgtaatccaactctcaagaaaaacctttgattcagaatatgttaagacaagaaccaacgattgggatttcgttgtaactacggacataagtgaaatgggcgcaaactttaaggctgaaagagtaatagatcccaggcgatgtatgaagccagtgatactgactgatggggaagaaagagttatcctcgcaggaccaatgccagttacacattcaagcgcagcgcaacgacgggggcgaattggtcggaatccgaaaaacgaaaatgatcaatatatatatatgggagaacccctagagaatgatgaagattgtgcgcattggaaagaagctaaaatgttactggataatatcaatactcccgaaggaatcataccttcaatgttcgagcctgaaagagaaaaagtagatgcgatcgacggcgaatacaggttaaggggtgaagcgcgaaaaactctcttagaactcataagaggtgggccaatacccgtatacttaggatataaatggccaggtgaaggaattaattacgcagactctaggttatgtttcgacgggattaaaaacaaccaaatattagaggagaatgttgaggtagaaatatggactaaggaaggagaacgaaaagaattaaaacctcgttggctcgatgcccgaatatacagcgacccgcttgcgcttaaagaatttaaggagtttgccgcgggtagaaaaagcctaacccttaacttaattaccgaaatgggtaggctccccaccttcatgacacaaaaagcgagaggggcacttgcaagcctcatggtgttacacacagccgaagccggtggacgagcttacaatcatgcgctcagtgaactacctgaaaccctggaaaccttattgctattaacattattggctacagtaactggcggtatctttctgtttttaatgtctggtaggggtataggtaagatgactttgggtatgtgctgcataataacggcctctatacttctgtggtatgcacaaatccaaccacactggatcgccgcttctataatattagagttctttttaacagtactgttaatacccgaacccgaaaaacaaaggacaccacaagacaatcaactaacttacgtcattatagctattttaacagtagttgcagcaacaatggcgaacgaaatgggattcttagaaaagactaagaaagatcttggactaggtaacattgctacccaacagagttgtaagaaaattttagatatctacttgggaccagcactaccttggaaactctacgcaggcggaaccacattcataacaccaatgctaagacatagtatagaaaactctagcgtaaacgtttccttgaccgcaatagctaatcaggctacagtgcttatggggttaggtaaaggttggcctctgtcaaaaatggatatcggagtaccgcttttagctattggatgctattcacaagtaaacccaattacgcttactgccgcgctatttttattagtagctcactatgccattataggaccaggactacaagccaaaccaacacgagaagcacaaaagcgtgcagctgctggaataatgaaaaatcccactgtagacggcattacagtcatcgacttagacccaataccttatgatcctaaatttgaaaaacagctaggccaagtaatgcttttagtactatgtgtgacacaagtgttgatgatgagaacaacatgggcattatgtgaagctctcacccttgcgactggacctgtatcaacactgtgggagggcaaccctggacgcttctggaacaccaccatagcagtttcgatggctaatatatttagaggctcatatctagcaggagcaggtcttctcttcagtatcatgaaaaacactacgagcacgaggcgtggcaccggaaacataggtgaaactttaggggaaaaatggaaaagtcgactcaacgcattaggaaagtcggagttccaaatatacaagaaatcaggaatacaagaagtcgataggaccctagctaaagaaggaatcaaaaggggcgagactgaccatcacgccgtaagtcgcggttccgctaagttgagatggtttgacgaaagaaatctagttacgccagaaggaaaggtagtcgatctagggtgcggtcgaggcgggtggtcgttcttttgcggcggactgaaaaatgtaagggaggttaaggcactaacaataggaggtccaggtcacgaagaacctatcttaatgtccacctacggtcgaaacctggtacgcagccaatctggcgttgtagtgtttcatactccaccagaaaaatgtgacacatcattaagagatataggagagtcaagtcctaatcctaccgtagaagctggaaggactttaagggtactaaacctcgtggaaaattggcttaataataatacacaattttgcatcaaagttttgaatccgtatatgccatcagtaatcgagaaaatggaggcattgcaacggaaatacggaggcgcacttgttcgaaaccctctaagccgaaattccacccacgaaatgtattgggtctctaatgcatcaggaaacatcgtttctagcgtgaatatgatatcccgtatgttaataaaccggttcactatgagacacaagaaagctacatacgagccagacgttgatctaggaagtggaacgagaaatattggaatagaatctgaaacgccaaacctagatatcataggtaaacgaatagagaaaataaaacaagaacacgaaacctcgtggcactatgaccaagatcatccttacaaaacttggggttctcatggctcgtatgaaacaaaacagacaggttcagctagttccatggtcaatggagtagtacgtctattaacaaaaccatgggatgttgttccaatggtgacccaaatggccatgactgataccactcccttcgggcaacagcgtgtgtttaaagagaaggtagacactcggacgcaagaacctaaagaaggtactaagaaacttatgaaaattacagcagaatggttatggaaagaattaggaaagaagaaaactccacgaatgtgcacaagagaagaatttataaagaaagttcggtcaaatgccgcattaggagcaatatttacagatgaaaacaaatggaaaagcgcgagagaggcagtcgaagacggacgtttttgggagttagttgacaaagaacggaatttacatcttgaaggaaaatgtgaaacatgcgtttacaacatgatggggaaacgagagaagaaactgggggaatttggtaaagctaaaggaagtagggcgatttggtacatgtggctgggagcaagattcctggagttcgaagccctaggtttcctaaatgaagaccattggttttcaagagaaaatagtctaagtggcgttgaaggggaaggattacacaaattgggctatattctcagagaagtaagcaagaaagaagggggagctatgtatgctgacgacacggcaggttgggacacaaggataacacttgaagacctcaaaaatgaagaacgcaagacgaaccacatgggaggagaacatcggaaattggcgaggggaatattcaaaatgaatcttacaaacaaagttgtacgagtgcagagaccgacaccgggaggcacactgatggacataatatctcgaaaaacacaaagaggatcagaacaagtagggacatacgggttgactacactcacaaatctcgaggcgccaccaataagacaaatggaagggaagggggtcttcaagggccaccaacatagaactgctagcgaagaaaatgcagtgcaggattggttagctagagttggcggagaaagattgtcgcgattagctatttctggtgacgattgcgtagttaaaccattggatgatcggtttgctagggccctaaccgctttaaatgatatgggaaaagtcaggaaagacattcaacaatgggagccatcaagagggtggaacgactggacacaagtaccattctgtagtcatcacttccatgagttgattatgaaagatggaagaacattggttgtaccatgccgtaatcaagacgaacttataggacgagcaagaatatcacagggagcgggatggtcattaagggaaacagcatgccttggtaaattttatgcccagagatggtcactaatgtattttcatcgtagagatcttaggctggcaccaaacgcgatatgttcagcagttcgcacacattgggttccaacatcacgaaaaacatggcccattcatgcaagccatgactggatgactactgaagtaatgttaacagtttggaataaactgtggttccaagaaaatccttggatggaagacaaaacaccagtcggattttgggaagagatcccattcttagaaaaagggaaagatcaatggggcggaagtttaataggcttgacttctaggccaccatgggccaaaaattttcagccggcaattaatcaagtgcggtcattgctatgtaacgaggaaagcgcggatttcatgccaagcatgaagcgctttcgacgagaagaagaggaagctggtgtactatggtag

SEQ ID NO: 22309 - RNA, 9876 nt, synthetic construct
  misc_feature 1..9876: note = derived and/or modified CDS sequence (opt6) from DENV-2__JQ922549__SS-prME
  source 1..9876: mol_type = other RNA
acggctggagtcataattatgctgataccgactgctatggcatttcatcttaccactcgaaacggggaaccacatatgatagtatcaagacaagaaaaagggaaaagtctcctattcaaaacggaagatggtgtaaatatgtgcaccctaatggctatggacttaggtgaactgtgtgaagatactattacatataactgtcctcttctgagacaaaacgaaccagaagacatagactgttggtgtaattccaccagcacatgggtaacgtatggtacatgtaccgccccgggggaccaccgaagggaaaaacggagtgtggcccttgtaccacacgtagggatgggtctcgaaacacgaacagaaacatggatgtcatcagaaggagcatggaaacacgcacaaagaattgaaacatggatattaagacaccctggattcactataatggccgcaatcctagcatataccattggaaccacatacttccaacgggttctaattttaatattactaactgcagtcgctccctcaatgaccatgcgatgcataggcataagtaatcgtgattttgtggaaggagttagtggcggttcatgggttgatattgtactcgaacacggatcatgtgtaaccactatggcgaaaaataaaccgacgttagactttgaacttattaaaactgaagctaaacagcccgccacccttacaaaatattgtatagaagcgaaattgacaaacaccacaacggcttcaagatgccccacgcaaggagaaccgtcattgaatgaagaacagcataaaagattcgtatgcaaacactcaatggttgaccgtggatggggtaatggttgcggtttattcggcaaaggtggtattgtgacgtgtgctatgtttacgtgcaagaaaaatatgaaagggaaaatagtgcaacctgaaaatcttgaatatacaatagtagtgacaccccattcaggcgaagaaaacgccgttggaaacgacacaggaaaacacggaaaagaaataaaagtgcgccctcagagctcgatcaccgaagctgaactgacagggtatggtaccgtaacaatggaatgtagtcccaggacaggctttgcgttcaatgaaatggtcctattacaaatggaaaataaagcatggctggtccacagacaatggttcttagatcttccattaccttggctacctggagcggacacacaaggctcaaattggatccagaaagaaacactggtaacttttaaaaatccacacgcgaagaaacaagatgtcgtagtattgggatcgcaagaaggtgcaatgcatacagctctaactggtgcgactgaaatacaaatgagtagtggcaatctactttttacaggacacttgaaatgtagattgagaatggacaaattacaactcaaaggtatgagttattcaatgtgtaccggtaaatttaaagtcgttaaagaaattgccgagacacaacacggtactatagtaattcgagtccaatatgagggggatgggagtccgtgcaaaattccatttgaaataatggatctagagaaacgattagttttaggaagactgataaccgtaaatccgatagtaactgaaaaagatagcccagtaaatatagaagcagagcctccctttggtgactcctatataataattggtgtcgaacctggccagttgaaaccctcatggttcaagaaaggtagtagcataagacagatgtttgaaactactatgagaggggcaaaaagaatggctattctaggcgatacagcatgggactttggatcattaggaggtgtttttacgtccataggaaaagcactacatcaagtctttggggccatatatggtgccgcctttagtggagtttcgtggacgatgaaaatactcattggcgtcgtaataacgtggataggaacaaactctaggtcaacatcattatccgtatccctagtcctagttggcgtagtaacgctctatctaggcgtgatggtgcaagcagacagcggttgtgtagtatcctggaaaaataaagaattgaaatgtggttccggaatcttcatcacagataacgtacatacctggaccgagcaatacaaatttcaaccagaaagcccatcaaaactagcttctgccatccaaaaagcacatgaagagggaatatgtggaattagatcagtcacacgactcgaaaatctgatgtggaaacaaatcacacccgaactaaaccacatactatcagaaaatgaggtaaagctaacgattatgacaggcgacataaaaggcataatgcaagcgggcaaaagaagtttacgtccacaaccaacagaactaaaatatagttggaaaacatggggaaaagccaaaatgttgtcgacggaaccccataaccaaactttcctcatcgggggcccagaaacagcagagtgtcccaataccaatagagcgtggaactctttggaggtggaagactatggttttggcgtcttcactacgaacatatggttaaaattaaaggaacgacaagatgtattctgtgactctaaattaatgagtgcagcaattaaagacaatagagctgtacatgctgatatgggttattggattgaatctgcactaaacgatacgtggaagatcgagaaagccagtttcatagaagtaaaaagttgccattggccaaaatcccatactttatggtcaaatggcgttctagaatcagaaatgataatacctaaaaacttcgcggggccagttagtcagcataattacaggccaggttatcacacacaaacagccgggccatggcacctggggaaactagaaatggactttcatttttgtgaaggcacaactgtcgttgttactgaggactgtggaaaccgtggcccttcattaagaaccacaacagctagcggtaaactaataacagaatggtgttgccgatcctgcacactcccacccttgagatatagaggagaggatggctgttggtacgggatggaaattaggcctttagaaggagaagaaggagacttggttcattcccttgtcacagctggacacggccaaatagacaacttctccttgggtgttctcgggatggcgttgttcctggaagagatgttaaggacccgagtgggaaccaaacatgcagtcctcttagtagcagtatcatttatgacactaataaccgggaacatgagctttagagatctagggagggtaatggttatggtgggtgcagcaatgactgacgatattggtatgggcgtaacatatctggcacttctagcagcattcaaagtacgacctacatttgctgcaggactcttactccggaaattaacatctaaagaactaatgatgactacaatagggattgtactcctatcacaaagcactatacctgaaacaattttagaattaacagatgccttagcactaggtcgcatgattctaaaaatagttaggaatatggagaaatatcaattggcagtcactattatggcaatcttatgtgtaccaaatgctgttatactccaaaacgcctggaaagtatcctgcacaatattagcagtagtttcagtatcaccactgttactgacgagcagccaacaaaaagcggactggataccattagctcttactattaagggattaaacccaactgctatattcttaactacgctaagtagaacaaataagaaaagaagttggccgttaaacgaagctattatggcagtagggatggtttctattctggctagtagcttgttagaaaatgatataccgatgaccgggccattagtagcgggtggattattaactgtatgttatgtactcacaggaaggtctgctgatttggaattggaaagggctgccgatgtacgttgggaagatcaagcggagatctcgggctcaagcccgattctcagtattaccatttcagaagatggaagcatgtccataaagtatgaagaagaggaacctaccctcaccattctaattcgaacgggcttgcttgtaatatccggattgttcccagtttccattccaattacagctgctgcctggtacctttgggaagtgaagaaacaacgggctggtgtactctgggacgtccccagccctccaccagttggaaaagcagagttagaagacggagcttataggataaagcaaaagggtatactaggatccagtcaaattggagctagagtctataaagaaggaacattccatactatgtggcatgtgactcgaggagcagttctgatgcataaaggaaagaggatagaaccgtcctgggcagatgtaagaaaggatctaatttcgtacggaggtggctggaagttagaaggtgaatggaaagagggtgaagaagtgcaggtcttggcattagaaccaggcaaaaatccaagagcagtacagacaaaacctggactcttcaaaacaaatacagggacaataggtactgtaagcctagacttttcgcccggtacatcagaatcaccaatagttgataaaaagggaaaagtagtcggactgtatgggaatggcgtagtaacaagatcgggaacatatgtttctgctatagctcagacagagaaatcgatagaagataacccagaaatcgaggatgacatatttaggaagaaacgactaacgatcatggatcttcacccaggggctgggaaaaccaaaagatacctaccagccatcgtacgcgaggcgataaaacgcggattacgcacattaatattggctcctacacgagtagtagcagcagaaatggaagaggcattgcgaggactaccaatacgatatcaaacaccagccataagagccgaacacaccggaagagaaatagtagatctaatgtgtcacgctacgtttacaatgcgtttattatcaccagttagagtgcccaactataaccttataataatggatgaagcgcattttactgaccccgcatccattgcagcaagaggatacatatctactagagtggaaatgggtgaagcagcaggtatattcatgacagcaacacctccaggttcgagagatcctttcccccaaagtaatgcacctattatggatgaagagagggaaataccagaacgaagttggaatagcggacacgaatgggtgacagactttaaaggaaaaacagtttggttcgtaccttcaattaaagcaggaaacgatattgcggcctgcttaaggaaaaatggcaaaaaggtaattcaactatcgagaaagacttttgactctgaatatattaaaacacgcacaaatgattgggattttgttgtaaccacagatatctcagagatgggtgccaacttcaaagcagaacgagtcatagacccgagaagatgtatgaaacccgtcatattaactgacggagaagagagggtaatcttagctggacccatgccggtcacacactcttccgctgcacaacgaagaggaagaatcggtcgaaaccctaaaaacgagaacgaccaatatatttacatgggtgagcctctagagaatgatgaggattgcgcccactggaaggaagctaagatgctactagataatattaatacgccggagggtattattccgagtatgttcgagccggagcgcgaaaaggtagacgctattgatggagaatacagacttagaggtgaggccagaaagacgtttgtagacttaatgagaaggggagacctacccgtatggttagcatatagggtcgcagctgagggaatcaattatgcggaccgacgatggtgtttcgatggcatcaaaaacaaccaaatactcgaagaaaatgtagaggtggaaatttggacaaaagaaggcgaaagaaagaaattaaagccccgttggttggatgcacgaatctatagtgatccgctagcactcaaggagtttaaggagtttgctgcaggaagaaaatcactaaccttaaacctaataactgaaatgggaagactaccgacatttatgactcaaaaagcacgaaatgcactagacaatctagcggtccttcacacagctgaagcaggagggcgagcatataaccacgcactcagtgaactaccggaaacattagaaacccttctactattaacattactagcgacggttacaggagggatatttctattcttgatgtcgggaaaaggaattggcaagatgaccctcggtatgtgctgtataataaccgcttcgatactactttggtatgcacaaatacaaccccactggatcgcagcaagtattatacttgaatttttcttaatagtattactcataccagaaccggaaaaacaacggaccccacaagacaaccaacttacatatgtagtaattgcgatcctcacagtagtagccgctacaatggccaatgagatggggtttctagagaaaaccaagaaagacttcggattggggtcaatagctacacaacagccagaatctaatattcttgacattgaccttcgtccagcctcggcgtggacactatatgcagttgcgaccaccttcataacacccatgttaaggcattcaatcgagaacagtccagtgaatgtctcgttaacagcaatcgccaatcaagcaacagtccttatgggtctcgggaaggggtggccactgtccaaaatggatataggcgtacctcccctagctatcggatgctattcccaggtgaaccccatcactctaaccgcagctcttttgctacttgtagcccattatgcgataataggaccaggattacaggtaaaagctacacgtgaagcgcaaaaacgagcggccgccggaataatgaagaatccaacggtcgatggaataacagtaatagacctcgatccaattccctacgatcctaagtttgaaaaacaactaggtcagataatgcttagggtactctgcgtaacacaggttttaatgatgcgaacgacttgggcattatgtgaagctctaactcttgcaaccggacccatatcaaccttatgggaaggaaatccaggaaggttaggaaacaccacgattgctgtatcaatggcaaatatctttcgaggaagttacttagctggtgcagggttactatttagtattatgaaaaatacgacgaacactcgcagaggtacaagtaatctgggcgaaacgttaggtgaaaaatggaaaaaccgacttaatagtcttggtaaatccgaatttcaaatatacaagaaaagtggaatacaagaagtagatcgtacactcgctaaggaagggatcaagaaaggagaaacagaccaccacgccgtttctagaggaagcgcgaaactaaggtggttcgttgagcgaaatctagtgaccccagagggtaaggtcgtagatttgggctgcggaaggggaggatggagttattattgtggtggattaaagaatgttcgagaagtcaaaggtttgactaaagggggtccagggcacgaagaacccattccgatgtcgacttatggctggaatttagtcagactacaatctggcgaggatgtattctttacaccccctgagaaatgcgataccttattatgtgacataggggaaagcagcccaaatccaacggtagaggcgggcagaactctaagagtgttaaatatggtcgaaaattggttaaacaacaatactcaattttgcattaaagttttaaatccttatatgccatcggttatagagaaaatggaggcacttcaacgaaagtatggaggagcattagtgagaaatccactttctaggaacagtactcatgaaatgtactgggtaagcaacgcctcgggtaatatcgtatcttcagttaatatgataagtcgtatgttaataaatagatttaccatgagacataagaaagctacgtatgaaccagacgttgacctaggttcgggaacaaggaatatcggcatcgaatcagagacgccaaatttagatatcatagggaaaagaattgagaaaataaaacaggagcacgaaacatcatggcactacgaccaggaccacccgtataaaacatgggcttatcatggatcgtacgagacaaagcaaacaggaagcgcctcttcattagttaacggtgtcgttagattactcacaaaaccatgggatgtgataccgatggtaacgcaaatggcaatgaccgatactactccgtttggccagcaaagagtattcaaggaaaaggtagatacgaggactcaagaaccaaaagaaggtaccaagaaattgatgaaaatcactgcagagtggctttggaaagaactgggcaagaagaaaacccctcgaatgtgtactagagaggagttcagcagaaaagtccgctcgaatgctgccctgggagcaatttttacagatgaaaacaaatggaaatcagcacgcgaagctgttgaagatggcagattttgggaactggtagataaagaaaggatcttacacttagaaggaaaatgcgaaacttgtgtatataatatgatgggcaaacgcgagaagaaaataggagaatttggaaaagctaaaggttcccgagctatctggtacatgtggttgggagccaggtttttggagtttgaggctttaggatttcttaacgaggatcactggttttcacgagaaaattccttgtcaggcgtagaaggggaaggacttcataaactagggtacattttgcgagaagtaagcaagaaagaaggcggtgctatgtatgcagatgacacggcaggttgggatactcgaataactttggaagatcttaaaaatgaagaaatggtaaccaaccatatggaaggcgagcataagaaactggctgaagcaatttttaaactcacataccaaaataaagtagttcgagtgcaaagacctacacctcgagggaccgtaatggacataatatcaagaagagaccaaagaggtagtggtcaagtaggcacttatggattaaacacttttactaacatgggcgcacaactaattcgtcaaatggaaggagaaggcgtattcaaagggatccaacacctaacagccacggaggagatagcagttcaagattggttagctagagtgggtcgagaacgactatctaggatggcgatttcgggtgacgattgcgttgttaaaccattagatgatcgcttcgcctcagcactaactgcactcaatgatatgggtaaggttagaaaagatatccagcaatgggaaccatcccgaggatggaatgattggacccaagttcccttttgttcacatcatttccacgaactaattatgaaagatggtcgcgtgctagtggttccttgtaggaatcaggatgagctaattggacgagctcgtatctcacaaggggcaggctggtcacttagagagactgcatgtctagggaaatcttacgctcaaatgtggagtcttatgtattttcacagaagggatctcagacttgccgcaaatgcgatatgctcagcagtacctagtcactgggtcccaacatctcgaacgactagatccatacatgcgcgccaagaatggatgaccaccgaagttatgttaacagtttggaacagggtatggatacaggaaaacccgtggatggaagacaaaacgccagtagagagttgggaagaaattccgtatttaggtaaacgagaggatcaatggtgtggaagtctaataggattgacaagtagagcgacgtgggccaagaacattcaaacagctattaatcaagtaagatcactgataggatccgaagaatatactgactatatgcctagcatgaaacggttcaggcgagaagaagaagaggctggtgtactctggtag

SEQ ID NO: 22310 - RNA, 9876 nt, synthetic construct
  misc_feature 1..9876: note = derived and/or modified CDS sequence (opt6) from DENV-2__JQ922552__SS-prME
  source 1..9876: mol_type = other RNA
actgctggaatgataataatgctaattccaacggttatggcgttccatttaacaacaagaaatggtgaaccaccgatgattgtgtcccggcaagaaaaaggcaaatccttgctatttaaaaccgaagatggtgtcaatatgtgcgctcttatggcgatggacctgggtgaaagatgcgaagacacaataacatataattgtccgctattgaaccagaatgaaccagaagatatagactgctggtgcaactcaacctctacttgggtgacatacggaacgtgtacaactacgggagaactaagacgggagaaaattagcgtcgcactcgttccgcatgttggaatggggctagaaactagaaccgagacgtggatgtcttcggaaggagcctggaaacatgcacagagaatagagatttggatactacgacacccgggttttactattatggccgcaattttagcatatacaattggtacgagtcacttccagcgggtattaatatttattttactaacagcgattgcaccatctatgacaatgagatgtatcggaatatcaaatcgtgattttgtcgaaggtgtcagtggcgggtcttgggtcgacatcgttttagaacacggaagctgcgttacgacaatggcgaaaaataaaccaacgttggattttgaattaatcaaaacggaagctaaacaaccggccactcttaggaaatattgcatagaagccaaactaacaaacaccactacagatagtagatgccctacccagggcgagccaactctaaacgaggagcaagacaaaaggtttgtgtgtaaacatagcatggtagatagaggatggggcaacgggtgcggtctctttggtaaaggaggaatcgttacttgtgcaatgttcacatgtaagaaaataatgaaaggcaaaatagtccaaccagagaatttagaatatacagtagtaatcacacctcactctggtgaagaacatgcagtcggaaacgatactggtaaacacgggaaggaagtaaaaataacacctcaaagttcaatcactgaggccgaattaacgggatacggcaccgttactatggagtgtagcccccgaaccggtctggattttaatgaaatggtattactacaaatggaggataaagcctggttagtacatcgtcaatggtttttagatctgccgttaccatggttgccaggcgccgatactcagggcagtaactggattcaaaaggagacacttgtaacatttaaaaatcctcacgctaagaaacaagacgttgtagttttaggaagtcaggaaggagctatgcataccgcattgacaggagcaaccgaaattcaaatgtctagcgggaacttattatttacggggcatctgaaatgtcgattaagaatggacaaacttcaactgaaaggcatgagctactccatgtgtactgggaaatttaaggttgtaaaagaaatagcagaaacacaacatggcacgattgtaattagagtacagtatgagggtgatggttctccgtgtaaaataccttttgaaattatggatctggaaaaacggcacgtattaggtagattaataacagtaaatccaatagttactgaaaaagattcaccggttaatattgaagctgaacctccgttcggcgactcttatatcataattggcgtcgagcccggtcaattaaaacttaactggtttaagaagggatcaagtataggtcagatgctggaaacaactatgagaggcgcaaaaagaatggctatcctaggtgataccgcctgggatttcggatcactcggtggagtatttaccagtattggaaaagcattacaccaagtatttggagcgatctacggagccgcatttagtggcgtatcgtggactatgaaaatcttaacgggagttatcatcacgtggattggcatgaacagtcggtccactagcctgtccgtctctctagtgctagtcgggatcgtaacattatatctaggtgtaatggtccaagctgatagtggatgtgtagtttcatggaaaaacaaggaacttaagtgtggttcaggaatatttgtaactgacaatgtccacacatggacagaacaatacatgttccaacccgaatccccctcaaagttagcttcggcaatacaaaaagcacacgaggaaggtatatgtgggattcggtcagtaacaaggctagaaaacttaatgtggaaacaaattacacctgagctcaaccacatactcagcgaaaatgaagtaaagctaacaataatgactggagatataaaaggaataatgcaagtaggtaaacgttcattaagaccacaaccaacagaactaagatactcttggaaaacatgggggcagccaaagatgttatcacccgaattacaccaccaaactttcctaatcgacggaccagaaactgcagaatgcccaaacaccaatcgtacttgggattcgttagaagtagaagattacggatttggtgtattcacaacaaaaatttggctacgtcttcgcgagaaacaagatgtattttgtgattctaaattgatgtccgcagctattaaggataatagagcagttcacgcagatatgggttactggattgaatctgctctaaatgacacctggaagatcgagaaggcttcttttatcgaagtaaaaagctgtcactggccgaaatcacatacattgtggtctatgggggtattagaatcagagatggtcataccaaagaattttgctggtccagtgagccagcacaatcatcgacccggtatcccaacacaaacagcaggtccatggcatctgggcaaacttgaaatggactttgacttctgcgaagggacaacagtggttgttacggaggactgtggaaatagaggtccatcgctaagaacttctacggcttcaggtaagttgataaccgagtggtgttgtaggtcatgcacacttcctccattgaggtacagaggggaagacgggtgctggtatggtatggaaattagaccactaaaggagaaagaggaaaacttagtcagctcactggtaactgccggacatggacagatagacaactttagtctaggaatattaggtatggcattgtttttagaagaaatgttaagaacaagagttggtactaagcacgcaatactcttagttgccgtatccttcgttactttaatcacaggaaatatgagtggtagagatctcggaagagtcatggttatggtgggcgccacgatgaccgatgatatcggcatgggagtaacttatttagcattattggctgcctttaaagtaagacccacattcgcagcaggactcctactaagaaaattaacaagtaaggaactcatgatgacaactattgggatcgtactgttgagtcaaagctctatcccagaaacaattctagaattgaccgacgcactagctcttggaatgatggttttaaagatggtgcgaaatatggaaaaataccagctggcagttacgataatggcaattctatgtgttccaaatgcagttatacttcagaacgcctggaaagtatcctgtacaatactggcgttagtatcggtcagccccctgtttctcacttcatcacaacaaaaagctgactggatacccctagcgctaacaataaaaggcctaaaccctacagcaatctttttaacaacactatcacgcacctccaagaaacgttcctggcctctaaatgaagcaataatggcagtcgggatggtatcgatactagcgagttcacttttaaagaatgacatacctatgactggtccgttagtagcaggaggattactgacggtttgctatgtattaacaggtagatcagcggacttagaactagaacgagccgcagacgttaaatgggatgaccaagctgaaatttcaggatcgtcccccatattgtccataactatatcggaagatggaagtatgagcatcaagaacgaagaggaagaacagactctaacaattctcatacggactgaattacttgttataagcgggttattccccattagtattcctataacagcggccgcatggtacttatgggaagttaagaaacagagagcaggagtactatgggatgtacctagtccaccacccgtaggaaaagcagaattggaagatggagcttacagaatcaaacaaaaaggcattctcggatatagccaaattggcgcgggagtatacaaggagggtacttttcatacaatgtggcacgtaacccgaggcgcagtattgatgcataaaggaaaaaggatagaaccatcatgggcagacgtcaaaaaggatttaatttcctacgggggcggatggaaattggaaggcgagtggaaagagggagaagaagtccaagtcttggcactagaacctggaaagaatccccgagctgtacagacaaaaccgggattatttaaaacaaacactggcacgataggtgccgtaagtttagacttttcaccggggacaagcggaagccctatagttgataagaaaggaaaagtagtcggtttatacggcaacggcgttgtaactagaagtggtgcctatgtatctgcaattgctcagactgaaaaatccatagaagataatccggaaatcgaagatgacatatttaggcggaagaaattaactatcatggacttacatcctggagcgggaaagacaaagcgttacttgccagcaatagtacgagaagccattaaaagaggacttagaacattaattctagcacctacaagggtagttgcggccgagatggaagaagcgctgagggggttaccgataaggtaccaaacaccagcaattagggccgagcatacaggaagggaaatagtagatttaatgtgtcatgcaactttcacaatgcgtctcctaagtcctatcagggtacctaactacaacctcataataatggatgaggctcacttcacagatcctgcaagtatagcagctcgtggatatataagcactcgagtcgaaatgggggaggcagctggtatattcatgaccgcaacacctccaggatcccgagatccttttccacagtccaatgcaccaataatggatgaagaaagggagataccagagagatcttggaactcaggacacgaatgggttaccgattttaagggaaaaaccgtttggtttgttccaagtattaaaactggtaacgacattgcagcatgcttacgcaaaaatggaaaaagagtaatacagttaagtagaaaaacttttgactctgagtatgtaaaaactaggactaacgactgggatttcgtagtgacaaccgacataagcgaaatgggagcaaattttaaggctgagagagtaatagatccacgacgatgcatgaaaccggtcatattaacagacggagaggagagggttatcctggcaggacccatgccggtaacccattccagcgctgcgcaaagaagaggtaggatcggcaggaatcctaaaaacgagaacgaccaatacatctatatgggagaaccattagagaatgacgaagattgtgcgcactggaaagaagcaaagatgttgctcgataatataaacacacccgaagggatcattccatcgatgttcgaacctgaaagagaaaaagtagatgctatagacggtgaatacagattaaggggagaggctcggaaaacattcgtggacctgatgagaagaggtgacctgcctgtatggcttgcatacaggggtccagcggagggtataaattatgcagaccgccgatggtgttttgatggaatcaaaaattcccaatttttagaggaaaacgttgaagttgaaatatggccgagcggaggcgaaaggaaagagcttaaaccaagatggcttgatgcaaggatatacagcgacccattagcattgaaagagttcaaagagtttgcggcaggccgcaaatctctcactttaaatttaataactgaaatgggtcggctacccacattcatgactcagaaagcaaggaacgctcttgataaccttgctgtactacatactgcagaagcagggggacgcgcgtataatcatgcattatctgaattaccagagacactagagacacttctcttgttaactctgcttgctaccgtgacagggggtatttttcttttcctaatgtcagggagaggaatagggaaaatgactctgggaatgtgctgtattataacggcaagtatattactctggtacgcccaaatacagccacattggattgcagctagcataatattagagttctttttaattgtactcttaattcctgaaccagaaaaacagagaactccgcaagataatcaattaacttacgtaattatcgctatattaacggtcgtagcagcaacgatggcaaatgaaatgggattcttggagaaaactaagaaagatctaggcttaggaaacatagtcacacaacaacctgagtctaatatattagatatagaccttaggccagcatcagcatggacgttatatgcagccgcaaccaccttcatcacaccaatgttaagacactcgattgaaaatagttcagttaacatgtcactaacggcaatcgccaatcaggctaccgttctcatggggttaggcaaagggtggcccctaagtaaaatggatataggagtaccattgttagcaatcggatgttatagccaagtaaatccgattaccctgactgcagcgctttttcttttagtagctcactacgcaatcaaaggccccggattacaggcaaaagcaactagggaagctcaaaagcgtgcggccgcgggtataatgaaaaatccaaccgtagatggaataacggtcattgatctagatccaataccatatgatccaaagttcgaaaaacaacttggccaggttatgctattagtactctgtgttactcaagtcttgatgatgagaacgacatgggcactctgtgaagcactcacactggccaccggtccagtatcaacactctgggagggcaatccaggtagattctggaatactacgatagcagtttctatggcgaacattttcagaggctcgtatttagcgggatcaagtcaggtgtggccatcaataaacaatttaaaaggtgggaggcgcggtactggtgctcaaggagaaacattaggcgaaaaatggaaacggcaacttaatcagttgtcgaaatctgagttcaatacatataaaagatctggaataatggaagtagatagaagtgaagcaaaagaaggtctcaaacgtggcgaaacaactaaacacgccgtaagtcgaggcactgcgaaactcagatggtttgtggaacgaaatttggtgaaacctgagggaaaagttattgatctaggctgtggccgaggaggttggagttactattgtgccggacttaaaaaggttacagaagtcaagggatacactaaaggtgggcctggacatgaagaacccatacctatggctacatatgggtggaatcttgtaaaacttcatagtggaaaagacgtatttttcacaccgcctgaaaaatgcgatacgttgctatgtgatatcggggagtcgtctcccaacccaacagtagaggcagggaggactctgagggtattaaatctagttgaaaactggctgaataataatacccaattctgcattaaagtattgaacccctacatgcccagtgtcattgagaaaatggaaacgttacagaggaaatatggcggcgcgttagtacgcaatccattaagcagaaatagtactcatgagatgtattgggtctctaatgccagtggtaatattgtatctagcgtaaacatgataagtcgaatgctgattaacagatttactatgagacacaagaaagcgacatacgagccggatgttgatttaggcagtggcacacgtaacatcgggatagaatcagaaacaccgaatttagatataataggaaaacgaattgagaaaattaaacaggagcacgaaaccagttggcactatgatcaagaccacccttacaaaacttgggcttaccacggatcctacgaaacaaaacaaaccggctctgcttcttcaatggtaaacggtgttgtaaggcttttaacaaaaccatgggacgttgttcctatggttactcagatggcaatgacagatacgactcctttcggacaacaacgcgtattcaaagaaaaagtcgatacgcgtactcaagaacctaaggagggaacgaagaaattgatgaaaataactgctgaatggttatggaaagaattaggtaaaaagaaaacgccgaggatgtgcccaagagaagaatttacgaaaaaggtcagatcaaacgctgctttgggtgcaatctttacggatgcaactaagtggaaatcagcgagggaagctgttgaagatggaagattttgggagcttgtagataaagaaagaaatcttcatctcgagggaaaatgcgaaacatgcgtatacaatatgatgggaaaacgtgagaagaagctaggagagttcggaaaggcaaaaggcagccgagcgatatggtatatgtggctaggagcaagattcttagagtttgaagctctcggatttttaaatgaagatcattggtttagccgagaaaattcattaagcggtgtagaaggcgagggactgcacaaattgggttacatactaagagaagttcgtaagaaagaaggtggagcgatgtatgccgatgattcagccgggtgggataccaggattacgcttgaagatttgaaaaatgaagaaagaataacgaatcatatggaagtggaacacaaaaagctggcagttggccattttatcctaacctatccaaacaaagtagtaagggtacagagacccacaccagtagggaccgtaatggatataatatccaggaaaagtcaaaggggttcgggacaagtagggacgtacggattaaacacgtttaccaacttagaaggacctcgcataagacaaatggaaggtgaagagtctttcaagtcccaccaattacaaacagctactgaacgaaatgcggtccaagattggcttgcaagagtcggtcgagaacggttatcgcggatggcaataagtggagatgactgtgtagtaaaacctttagatgaccgatttgcgcgcgctctcacagccctgaatgatatgggtaaagtgagaaaagacattcaacagtgggaaccgagcagaggttggaatgactggactcaagtgccattttgctctcatcatttccatgagttgattatgaaagatggaagaacacttgtagttccctgcagaaaccaagacgagcttattggcagagcaagaatttctcagggtgccgggtggtctctaagagaaactgcctgtttaggaaaatcgtacgctcagatgtggtcattaatgtatttccataggagggacctccgattagcagccaatgctatatgttcagctgtgccgtcccattgggtaccgaccagcagaacaacttggagtatacacgcatcacatgaatgggttgctacagaagatatgcttactgtatggaaccgagtctggattcaagaaaatccgtggatggaagacaaaactccagttgagagttgggaggaaataccatatttagggaaacgggaagatcaatggtgcggctccttaatagggttaacttcgagagccacttgggccaaaaatatacaaactgcaatcaaccaagtgagatcgctaattggaaacgaggaatacacagactatatgccatccatgaaaagatttagaagagaagaggaagaagcaggagtcttgtggtaa

SEQ ID NO: 22311 - RNA, 9876 nt, synthetic construct
  misc_feature 1..9876: note = derived and/or modified CDS sequence (opt6) from DENV-2__GU131896__SS-prME
  source 1..9876: mol_type = other RNA
tcagcaggaatgatcatcatgttaattcctactgtaatggcttttcacttaacaacccggaacggagaacctcatatgatagtaggcatacaagaaaaagggaaaagccttctgtttaaaacagaagatggcgtaaacatgtgcacactaatggcaatggacctcggcgaactatgtgaagatactattacgtacaaatgtccactactgcgtcaaaacgaaccagaagatatagactgctggtgtaattcaacatcaacatgggttacttatggaacttgcaccactacaggggaacatagaagggagaagcgatccgtcgctctcgttccacatgtaggaatgggcctcgaaactcgaactgaaacctggatgtcttcagaaggagcgtggaaacacgcgcagagaatcgaaacttggatattaagacacccaggctttacaataatggctgcgattctggcctatacaatcgggacaactcactttcaacgagcacttattttcatacttctgacggccgtggcgccaagtatgactatgaggtgtatcggtatctctaatcgtgactttgttgagggagtaagtggcggaagctgggtggacatagtactggaacacggatcatgcgtaacgacaatggcgaaaaataaaccgacgttagattttgaactgataaaaaccgaagctaaacagcctgcaactctccgaaaatactgtattgaagcaaaacttactaacacaactaccgaatcaaggtgccccacgcagggagaaccaagtttaaaagaggagcaagataaacgattcgtttgtaaacactctatggtagatagaggttggggaaacggatgcggactttttggaaaagggggtatagtaacctgtgcaatgtttacgtgtaagaaaaatatggaaggaaaaattgtacaacctgagaacctggaatatacaatcgttgttacacctcacagcggtgaagaacatgcagtagggaatgatacaggtaaacacggtaaagaaataaaagtgacacctcagagcagcatcaccgaagccgaactaacaggctacgggactgtaaccatggaatgttcacccaggacagggttggactttaatgaaatggtgttacttcaaatggaaaacaaagcatggctggttcacagacaatggttcctagacttgcctttaccttggttacctggagctgataaacagggatctaattggatccaaaaagaaacactggtgacttttaaaaatccccatgccaagaaacaggatgtagtagtccttgggtcccaagaaggtgcgatgcatacagctctaacgggcgcaacagaaatacagatgtcaagtggaaatttattatttactggacacttaaaatgcagattaagaatggacaaactacaactaaaaggcatgtcatattccatgtgtactggaaaatttaaagtggtaaaagaaatagccgaaacccaacatggtacgatagtaattaggctacaatacgaaggagatggatctccgtgcaaaattccatttgaaataatggatcttgaaaaacgttatgtactgggtagactgatcacagtaaatcctatagttacagaaaaagatagcccagtcaatatcgaagctgagccaccttttggagactcatatataataataggcgttgagcctggtcaactaaagttaaactggtttaaaaagggaagctccataggccagatgtttgaaacaacaatgcgtggtgcgaaaagaatggcgattttaggagacacagcatgggatttcggatcattaggaggggtattcacatccgtaggaaaggccctccatcaaatctttggagcgatctatggtgcagcttttagcggtgtttcttggaccatgaagatattaataggagtcattattacatggatcggaatgaactcgcgatcaacttctctaagcgtcagcttggtactggttggtattgtgaccctctatcttggtgttatggtacaggctgacagtggatgtgtcgtaagttggaagaataaagaactaaagtgtggatcaggcatatttatcaccgacaatgtccatacgtggacagagcagtataaatttcaaccagaatcaccttcaaaacttgcatccgccattcagaaagcgcaagaggaaggaatatgcggtatacgttctgtaactcgactagagaacctcatgtggaaacagataacacctgagttgaatcacatcttggcagaaaacgaagtgaaactaaccataatgacaggcgatataaaaggaataatgcaagctgggaagagatctctacgtccacaaccgacagaattgaaatattcatggaaaacatgggggaaagctaaaatgctatcaacagagagtcacaatcagactttcttaatcgatggcccagaaactgctgagtgcccgaacactaacagggcatggaatagtcttgaagttgaagactatggattcggcgtgtttacaacaaacatatggttgaaattaaaagagaagcaggacgcattttgtgactcaaaactcatgtcagcagcgattaaagacaaccgtgctgttcatgctgatatgggctattggatagaatctgccttgaatgacacttggaaaatagaaaaagcgagttttatagaagtgaaaaattgtcactggccaaaatcacacacactatggtccaatggggtactggaaagcgaaatgataatccctaaaaacctagctgggcccgtgagccaacataattatcgaccaggctatcacacacaaacggccgggccctggcacttaggtaaattagaaatggatttcgacttttgcgatggtactacggtaatagttactgaagattgtggcaatagaggtccatcactaaggactactacggcttcaggaaaactaataaccgaatggtgctgtcgtagctgtacactcccaccacttcgttatcggggagaagacgggtgctggtatggaatggaaattcgcccgctgaaggaaaaagaggaaaatcttgtaaattctttagtaacagcgggacacggccaggttgataatttttcgttaggcgtattaggtatggctttgttcctggaagaaatgttgaggacacgcgtcggaacaaaacatgccattctattagtagccgtcagcttcgtaacgctaattactggtaatatgtctttcaaggatttaggccgagtcgtcgtaatggttggagcgactatgaccgacgacatcggtatgggtgttacttaccttgctctattggctgcgttcaaagttcgtccaaccttcgcagcaggattattactcagaaaactgacctcaaaggagctcatgatgacaacaatagggatcgtattattatcacaatcgacgatacctgaaacaatactagaattaacagatgccctagcactgggaatgatggtattaaaaatagtgagagatatggagaaatatcaactagcagtgaccataatggcaatactatgtgtgccgaatgcggtaattctccaaaatgcttggaaggtaagttgcacaatactcgcagtagttagtgttagtccattgctgctaacaagttcacaacagaaaaccgactggataccattagctcttacaataaaaggcctaaatccaactgcaatattcttaaccacattgtcgcgtaccaataagaaacggagttggcccttaaacgaagcaatcatggcagtgggaatggtatccattttagcgagtagcttactaaagaatgatatacctatgacaggaccactcgttgccggaggccttcttacggtctgttacgtgttgacgggacggagcgcagacctggaactagaacgcgcaacagatgtaaaatgggaagaccaagctgagatttcaggatcaagcccgatcttatctattacaataagtgaagatggatccatgagtattaaaaacgaagaagaagaacaaacattgacaatactgatccgtacaggtttattagtaatatcaggactgtttcccgtgagcatacccatcacggctgctgcgtggtacctatgggaggtcaagaaacaacgagccggtgtattatgggacgtgccctcacctccaccaatgggtaaggcggaactagaagacggagcatatagaataaaacaaaagggcatcttaggttacagccaaattggcgcgggggtctataaagaaggaacatttcacactatgtggcatgtcacaaggggagctgtattgatgcataaaggaaaaagaatagagccgtcatgggcagacgttaagaaagatttgatctcttatggagggggatggaagttagaaggagagtggaaagaaggtgaagaagttcaggtgttagccttagaaccgggcaaaaatccaagagcggtccaaacaaaacccggtctatttaagactaataccggaaccataggtgcagtaagtctggatttcagtcctggaacatctggctcacctattatagataagaaaggtaaagttgtaggcttatacggtaatggggtagtaactcgctccggagcatatgtatctgctattgcgcaaactgagaagtcgatagaagataatccagaaatcgaagacgatatattccgaaaaaggagactcaccataatggaccttcacccaggagcaggaaaaactaaaagatatctaccagcaatagtgagagaagcgattaagagaggtttacggactctaatcttggcacccacaagggtagtagctgcagaaatggaagaagctctacgtggtttacccatccgctatcaaaccccagcaatcagggccgaacatacgggacgggagatagtcgacctaatgtgccacgccactttcactatgcgtctgctttctcctgtgagggttcccaactacaatctaatcattatggatgaagcccattttacggaccctgccagcatagctgcaagaggatatataagtacgagagttgaaatgggagaagctgcaggtattttcatgacagcaaccccgcccggtagcagagatccatttccacaatctaacgctcccataatagacgaagaacgggaaatacccgaacgaagctggaactcaggccacgagtgggtaaccgatttcaaggggaaaacagtttggtttgtaccttcaataaaagctgggaacgacatcgcagcctgtttaaggaaaaatggcaagaaagttattcaactatctcgtaaaacgttcgatagcgaatacgtgaagacaagaacaaatgactgggatttcgtcgttacgacagacataagcgaaatgggagcaaactttaaggctgatagggtcatagacccaagaagatgcatgaagccagtcatattgacagacggcgaagaacgagttatcctcgcgggccctatgccagtaacccattctagtgcagcccaacgaaggggaagaataggaaggaatccgaaaaatgagaatgatcaatatatatatatgggagaacctctagagaatgacgaagactgcgctcattggaaagaagcaaaaatgttattagataatataaacacgccggagggtataataccaagtatgtttgaaccagaaagagagaaggtcgacgctattgacggtgaataccgtttgcgtggcgaagccagaaagacgttcgttgacttaatgagaagaggggacttacccgtctggttagcatacaaggtagcagctgaaggaataaactatgctgatagacgatggtgtttcgatggcattaaaaataaccaaattctagaagaaaatgtagaggttgaaatctggacaaaagaaggcgagcgtaaaaagttaaaaccgaggtggctagatgctcgaatatattccgatccattggcactaaaagaatttaaagaatttgcagcagggcgtaagagcttaactctaaatttaattacagaaatgggtcgtctccccacatttatgactcagaaaacgagagatgccttagataatttggcggttttacatactgcagaagccggtggacgagcatataatcatgcgctcagcgaattgccagagactttagagacattacttctactgacattattagctaccgttacaggaggaatttttctgtttctaatgagcggacgcggtatcggtaaaatgacgttgggaatgtgttgcataattactgcctcaatattactatggtatgcgcaaatacaacctcactggattgcagcatcgataatactagagttctttttgatagtattattaatcccggaacccgaaaaacaaaggacgccacaagataaccagttaacttacgtggtaatcgcgatcctcacagtagtcgctgccaccatggcgaatgagatggggtttctagagaaaaccaagaaagatttaggattaggctcaatagcaacacaacaaccagagtctaatatattagacattgatttaaggccagccagcgcttggacgctgtacgcagttgcaacaacttttgttaccccaatgctcagacacagcatagaaaacagtagtgtaaacgtgagtctaactgcaatagcaaaccaagctacggttctaatgggcctaggaaaggggtggccactaagcaaaatggatataggtgtgccgctgttagcgattggatgttacagccaagtaaatccgataacgctaacagctgcactcttattattagtcgcacactacgctatcataggtccaggattgcaagctaaagctacaagagaagcacaaaaacgtgcagctgcaggaataatgaaaaatccgactgtcgatggtattacggtaatagacttagatcctattccatatgatccaaagttcgaaaagcaattaggccaagtgatgcttttaatactgtgcgttacccaagtcctcatgatgcgtacaacttgggcattatgcgaagcattaaccctagccactggtccaatctcaacactatgggaggggaatccagggagattttggaatacgacaattgcagtttcgatggctaacatcttcagaggatcgtatctagctggtgcaggacttttgttcagcataatgaaaaatactacaaacacacgcagagggacaggtaatataggtgaaaccttaggggaaaaatggaagagtcgactaaacgctctgggcaaaagcgagttccagacgtacaaaaagagcggaatacaagaagttgatcgaactttggcaaaagaaggaattaaacgaggtgaaacagaccaccatgcggtgtccagggggtctgcaaaactaagatggttcgtcgaaagaaacatggtcacgcctgaaggcaaagtggtcgacttaggttgtggacgaggaggatggtcatattactgtggagggcttaaaaatgttagagaagttaaaggattaaccaaaggaggaccgggacacgaagaacctattcctatgtctacatatggatggaacttagtaagattacaatcaggcgttgacgtattctttataccaccagaaaaatgtgacacactcttgtgtgacatcggtgagtcaagcccaaatccgacagttgaggcaggaagaaccctcagggtactaaatttagtcgaaaattggctaaataataacacccaattttgtatcaaagtactgaatccgtacatgccttcagtcatcgaaaagatggaagcattacaacgtaagtatggaggtgcactggtgagaaacccgctcagtagaaactcaactcatgaaatgtattgggtttcgaatgccagtggaaacatagtaagctccgttaacatgattagcagaatgttaataaaccgttttacaatgagacacaagaaagctacttatgaaccagatgttgacctaggttcgggtaccagaaatataggtattgagtcagaaattcctaacttagatataataggtaaaagaatagagaaaataaagcaagagcacgaaacgagttggcattatgatcaggaccatccatacaagacatgggcgtaccacggctcatatgaaacaaaacaaacggggtcagcgtcgtcaatggtaaacggtgttgtaagactactaacaaaaccttgggatgtcttacctactgtgacgcaaatggcaatgaccgacaccactccttttggtcagcaacgggtatttaaagaaaaagtagacacaagaacacaagaacccaaagagggtacgaagaaactaatgaaaattacagcagaatggctctggaaagaactcggcaaaaagaaaaccccaagaatgtgcacccgagaagagttcacacgtaaggtcagatcaaacgcagccctgggagcaatttttacagacgagaataaatggaaaagcgcgagagaagccgttgaagatagtaggttctgggagctagtggataaagaaagaaacctacacctagaaggtaaatgcgaaacatgcgtctataatatgatgggaaaaagggagaagaaacttggcgagttcggaaaggctaaaggaagcagagcgatttggtacatgtggctgggtgcaagatttttggaatttgaagcacttggtttcttgaatgaggaccattggttttcaagagaaaattcactctcaggggtagaaggggagggtctacataaattgggctatatattaagagatgtgtccaagaaagaaggaggagcaatgtatgcagacgatactgcgggctgggatacacgtatcacattagaggatctcaaaaatgaagagatggttactaatcacatggaaggggaacacaagaaactagcagaggctatttttaagctgacctaccaaaataaagtagttagggtacagaggcctacacctcgtggaaccgttatggacataatatcgaggagagatcaacgaggaagcggccaagttggaacgtatggattaaatacctttaccaatatggaagcgcaactgataagacaaatggagggagaaggtgtttttaaaaatattcaacatcttaccgctacagaagaagtagccgtacagaattggttggcccgagtaggacgagagcgtctgagcagaatggctataagtggagacgattgcgtagtaaaacctttggatgacagatttgcgaatgcactaacagcattaaacgatatgggaaaaattcgcaaggatatacaacagtgggaaccaagcaaaggatggaatgactggacccaagtgccattttgcagccaccatttccatgaattaataatgaaagatgggcgagtactcgtcgttccatgcaggaaccaagatgagctaataggacgcgcaagaattagccagggagcaggatggagtcttagagaaacagcttgtctaggaaaatcgtacgcccaaatgtggagcctgatgtattttcatcggagggatttacgattagcagctaacgctatatgctccgctgtcccatcacactgggtaccaacatctagaactacgtggtctatacacgctaaacatgaatggatgacaactgaagacatgctgactgtgtggaatcgagtttggatccgtgaaaatccctggatggaagataaaacacctgtggaaagctgggaagagattccttatctaggcaaaagagaagatcagtggtgcggaagtctcataggacttaccagtcgtgcgacttgggccaaaaatattcaagcggcaataaaccaagttagaagtctaataggcaatgaagaatatacggactatatgccaagtatgaagagattcagaagggaagaagaagaagctggggttctatggtga

SEQ ID NO: 22312 - RNA, 9876 nt, synthetic construct
  misc_feature 1..9876: note = derived and/or modified CDS sequence (opt6) from DENV-2__GU131897__SS-prME
  source 1..9876: mol_type = other RNA
tcagcagggatgataattatgctcattccaaccgtaatggcttttcatctgaccacccgcaatggtgaaccacacatgattgttgggatacaagaaaaaggtaagagcttattatttaaaaccgaagacggagtaaatatgtgtacgttaatggcaatggacctaggagaattgtgcgaagacacgataacatacaaatgtccactattacgtcaaaatgaacccgaagacatagactgctggtgcaatagtacttcaacatgggtaacttacggaacctgtactacaacgggggaacaccgtcgcgaaaaacggtcagtcgcattagttccacatgtagggatgggtcttgaaactagaaccgaaacctggatgagttccgaaggggcatggaaacacgctcaacgaatagaaacatggattttgagacatccaggctttacaatcatggcagctatactagcatacacaataggaactacacactttcagcgggttctaatatttattttactcacagccgtagcacctagcatgacaatgcgctgcatagggatatcaaaccgagattttgtagaaggagtgtcgggcggaagttgggttgacattgtattagaacatggctcctgcgtgactacaatggcgaaaaataaacccactttagacttcgaacttataaaaaccgaagcaaaacaaccagctaccctaagaaaatattgtatagaagccaaattaacaaacaccacaaccgaaagccgttgtccaactcaaggcgaaccatccctgaaagaagaacaagacaaacgatttgtatgtaaacacagtatggttgatcgagggtgggggaacggatgtggtctattcgggaaaggaggaatagtaacttgtgccatgtttacgtgtaagaaaaatatggaaggaaaaattgtccagccggaaaatctcgaatatacaatagtggtaaccccacatagtggagaagaacatgccgtaggaaatgacacaggtaaacatggaatggaaattaaagtgacaccacaaagttcaattacagaagctgagttaactggatatggtactgtaactatggagtgcagtcctcgaactggactagactttaatgaaatggtattgctacagatggagaacaaggcttggctagtacatcgacaatggttcttagatttacccctaccctggttgccaggagccgataaacaagaaagtaactggatacaaaaagagacgttagtcacatttaaaaacccgcacgctaagaaacaagacgtagtggtactaggttcacaagagggtgctatgcacacagcactaacgggcgcgacagagattcagatgagttcaggaaaccttctgtttactggccatctaaaatgtagactaagaatggataaattacaactcaaaggaatgtcatattctatgtgcactggtaaatttaaagtagtgaaagaaatcgcagagacccaacatggcacaatagtcattcgcgtccagtatgaaggagatgggagcccttgtaaaatccctttcgagataatggacctggagaaaagatacgtattaggaagacttataacggttaacccaattgtcaccgaaaaagattcaccagttaatattgaagcagagccaccttttggagactcctatataataattggagtagaacccggccagctaaaattaaactggtttaagaaaggatcaagcatcgggcaaatgttcgaaacaacgatgagaggtgctaaaagaatggcaatattaggagataccgcatgggatttcgggagcttaggaggcgtttttaccagcataggtaaagcactacatcaagtgtttggagcaatatacggagctgcgttttcaggtgtttcatggacaatgaaaatcctcataggtgtcataataacatggattggaatgaactcacggagcacctccctatctgtttctctagtcctagtaggcatagtcacattatatcttggcgttatggttcaagcggactcgggatgtgtggtgagctggaaaaataaagaactcaaatgcggttcgggcatctttattacagataatgtgcacacatggactgaacaatataaattccaaccagaaagtccttccaaattagctagtgcaattcaaaaggcccaggaggaaggaatttgcggcatacgcagtgtaacacgattagaaaatttaatgtggaaacaaatcacaccagaactaaaccatatattggctgaaaacgaagtaaaactgactataatgaccggcgatatcaaaggtataatgcaagctgggaagaggtcacttcgacctcaaccaactgaattaaaatacagttggaagacctggggcaaagctaaaatgttaagtacagaaagttacaaccaaacatttctaattgacggacccgaaactgcggaatgtcccaatacaaacagagcgtggaactccctagaagtcgaagactacggtttcggagtattcacaactaatatttggctaaaactaaaagagaaacaggatgcgttctgcgactccaaactaatgagtgcggccatcaaagataaccgagcagttcatgctgatatgggatattggatagagagtgcactaaatgacacatggaaaatagaaaaagccagcttcatagaggtcaaaaattgtcattggccgaaaagtcacactctttggagtaacggagtattggaatccgaaatgataatacccaagaatttagcaggtccggtaagccaacacaattatcgacctggataccatactcagattgccggaccctggcatcttggaaaactggaaatggactttgatttttgcgatggtactacagttatagtaacagaagactgtggcaacagaggaccgtctctgagaacaacaacagcttctgggaaactaataactgaatggtgctgtcgatcctgtacattgccaccattacgataccggggtgaagacggatgctggtatggaatggaaataagacccctaaaggaaaaagaagaaaatctgataaattcgttagtgacagcagggcacggacaagtagataacttcagtttaggagtactaggaatggcattatttctggaagagatgttaaggactcgagtgggcaccaaacatgcgatactcctagtagcagtttccttcgtcacactaattactggaaacatgtcctttaaagatcttggacgggtcgtagtgatggtgggagctacaatggcggatgacataggcatgggagtcacatatttggctctattagcggcgtttaaggttaggcccacatttgctgcgggactattattgcgaaaactcacaagtaaagaattaatgatgactactataggaattgtattgctctcacaaagtaccattcccgagacagtgctagaattgacggatgcgttagcattgggtatgatggttctaaaaatagttagaaatatggaaaaataccaactggcagtcactataatggcaatactttgtgttccgaacgctgtcatactgcagaatgcatggaaagtaagttgcacaattctcgcagtcgtatcagtgtcacctctgctacttacaagtagtcaacagaaaactgattggattcctttagcgctaacgataaaagggctaaaccctactgcaatctttcttacgaccctgagccgaactaataagaaacgatcttggcctcttaacgaggccataatggctgtaggaatggtatcaattttggcatcgtcgctcctaaagaatgacatacccatgacaggccccctagtggccggagggttattgacagtatgctatgtgttaaccggccgaagtgctgatttagaacttgagcgagcaacagacgtaaaatgggaagaccaagcagaaataagtggtagctcacctatcttaagcattactataagcgaggatggatcgatgtctattaagaatgaggaagaagaacaaacactaactatactaataagaacgggtctcttagttatatctgggctatttcctatcagcattccaataactgccgccgcttggtatttatgggaagtcaagaaacaaagagcaggggtcttatgggacgtgccaagccctccgcccatggggaaagctgaactagaagatggcgcttatcgaataaaacaaaaagggattctaggatattcgcaaataggggctggagtatataaagaaggaaccttccataccatgtggcacgttacccggggcgccgttctaatgcataaagggaaacgtatagagccatcttgggccgatgtaaagaaagatttaatatcatatggaggaggatggaaattggaaggagagtggaaagaaggggaagaggtacaagtccttgcattagagccaggcaaaaatccgagagcagtacaaactaaacccgggctctttaaaacaaatactggcacaatcggagcagtgtctttggattttagtccagggacgagtggatcacccattatagacaagaaaggaaaggtggttggattatatggcaatggagtggttactagatccggagcatatgtgagcgctatagcgcaaactgagaagtccattgaagacaaccccgaaatagaagatgatatatttaggaaacgtaggctcacaatcatggatctgcaccccggtgccggaaaaactaagagatacctcccagccatagttagagaagcgataaaaagaggcttacgtacactaatcttggccccgacaagagtagtagcggctgaaatggaagaagcattaagaggtttaccaattagataccaaacccctgcgatacgagcggaacatactggaagggaaatagttgaccttatgtgtcatgcgaccttcacaatgcgattacttagcccagtgcgcgttccaaactataacctcataatcatggacgaagcgcattttacagatcctgcatccatcgcagcaagagggtatatatccactcgcgtagagatgggtgaagcggctggcatcttcatgacagcaacacccccaggctctcgcgacccattcccacagagtaatgctccgatcattgatgaagaaagggagataccggaaaggtcatggaactcgggacatgaatgggtaatggattttaaaggcaaaacagtatggtttgtaccaagtataaaagctggcaatgatattgcagcttgtttgaggaaaaatggaaagaaagtcattcaactttcacggaaaacatttgattctgaatatgtcaaaacaagaacaaacgactgggattttgtagttacaacagacatctcagagatgggtgcaaactttaaagcggaaagagtaatagaccctaggcgatgtatgaaaccagtgatcttgacggatggcgaggaaagagtgatcttagccggacccatgccagtaacacactcatcagccgctcaaagacgcggtcgcatagggcgaaatcccaaaaacgaaaatgatcaatatatatatatgggagaaccactcgagaatgatgaagattgtgcacattggaaagaagcaaagatgctattagataatatcaataccccagaaggaatcatacccagcatgttcgaacccgaacgagaaaaagtagatgcgatagacggggagtatcggttaagaggggaagcccgaaaaacttttgtagatttaatgagaaggggagacttaccagtatggctagcgtataaagtcgcagcggaaggcattaactatgctgatcggcgatggtgcttcgacggaattaaaaataatcaaatacttgaagaaaatgtagaagtagaaatttggacgaaggagggcgaaaggaagaaattaaaacctcgctggttagacgctagaatatattcggaccccttagcacttaaagagtttaaagaatttgcggcagggcgaaaatctttgacactgaacttaattaccgaaatgggaagactgccaacattcatgacacaaaagacacgtgacgctttggacaatttggcagtcctccacacagcagaagccggtggtcgtgcatacaatcatgcacttagtgaacttccggaaactcttgaaaccctattgctcttaacgttgcttgcgacagtcacgggtggaatatttttgtttttaatgtctggccgtgggataggtaaaatgactttaggaatgtgctgtatcataacagcgtctatactactatggtacgctcaaatccagccacactggatcgcagcatcaataatcttggaatttttcctgattgtgttacttattccagaaccggaaaagcaaagaacaccacaagataaccaattaacttacgtggtaatagcaatactaactgtagttgcagcaaccatggccaacgaaatgggatttttagagaaaacaaagaaagatcttggattggggtccatcgcaacacagcaaccagagagtaatatcctagatatagacttaagacctgcctcagcatggactctttatgccgtagcaacaacattcgtcacacctatgttgagacattcaatcgaaaactcctcagtaaacgtcagcctcactgccatcgcaaatcaagctactgtattaatgggattaggaaaaggttggccattgtctaagatggatataggcgtccccttactagcaataggttgttatagtcaagtaaatccaataactctaactgctgccctgttgcttctcgtcgcacattatgcgataatagggcctggtctacaagctaaggctacccgtgaggcgcagaaaagagccgccgctgggataatgaagaacccgaccgtcgacggaataacggtaattgacctggacccgatcccctacgaccctaagtttgagaaacaattagggcaagttatgttattaatcttatgtgtaacccaagttctcatgatgcgtacaacctgggcattgtgcgaagcgcttacactagctaccggaccaataagtacactatgggagggaaatccaggaaggttttggaatactacgatcgccgtgtcaatggcaaatatctttagaggaagctaccttgccggtgcgggactattattcagtatcatgaaaaatacaaccaatacacgtcgagggacaggcaatattggtgagaccttaggagagaaatggaaaagccgacttaacgcactcggaaagtctgagttccaaatatacaagaaaagtggcatacaagaagtagatcgaacattggccaaagagggaattaagcggggagagaccgaccaccatgctgttagccgaggatcggctaaattacgatggtttgtagagagaaatatggtcactccagaaggaaaagtggtagatctaggttgcggccgaggaggctggtcatactattgtggtggattaaagaatgtgcgagaagtaaaaggattaactaaaggaggcccaggtcacgaagaaccgataccaatgagcacgtatggttggaatctcgttagacttcagtcaggtgtagacgttttcttcatacctccagaaaaatgtgacaccttactgtgtgacataggagaaagctcaccaaatcctacagtcgaggcaggtagaacactccgagtactgaatctggttgaaaactggctcaacaataatacgcaattttgtataaaagtgctgaacccctatatgccctcagttattgagaaaatggaggctttacagaggaaatatggaggtgccctagttagaaatccgctgagtcgaaacagtacacacgaaatgtactgggtatcaaatgccagcggaaacatagtctcatccgtcaacatgatttccaggatgttaataaataggtttaccatgaggcataagaaagcaacgtatgaaccagatgtagatctcggttcaggaacacgcaatataggcatcgaatctgaaattcctaatttagatatcataggtaaaagaattgagaaaattaaagaagaacatgaaacatcttggcactacgaccaagaccatccctacaaaacgtgggcttatcacggctcttacgagactaaacagacgggtagtgcatcatcaatggttaatggtgtcgttagattattaaccaagccttgggatgttcttcctaccgtaacacaaatggctatgactgatacaacacctttcggccagcaacgtgtatttaaagaaaaagtagatacaaggacgcaagaacccaaagagggaactaagaaactaatgaaaataacagccgaatggctgtggaaagaattaggtaaaaagaaaacaccgagaatgtgtacaagagaagagttcacacggaaagtaagatctaatgcagcgctaggagctatctttacagatgaaaacaaatggaaaagcgcaagagaggctgtagaagattcaagattttgggaacttgtagataaggaaagaaatttacacctcgaggggaagtgtgagacatgtgtctataatatgatgggaaagcgtgagaagaaactcggagagttcggaaaagccaaggggtctagagcaatttggtacatgtggttaggagcgcgatttcttgaatttgaggctttgggtttcctaaatgaagaccactggttctcgagagaaaactcactatccggagttgaaggggaagggcttcacaaattagggtatatcctacgggacgtgagcaagaaagaaggaggtgcaatgtacgccgatgacaccgcaggatgggacactagaataactcttgaagacctcaaaaacgaagagatggtaacaaaccacatggaaggagagcacaagaaactagcagaagcaatcttcaagttaacataccaaaacaaagttgttcgcgttcaaagaccgacgcctagaggaacagtaatggacataatttcacgtcgggaccaacggggcagtggccaggttggaacttacgggttaaatacatttacaaatatggaggcacaactaatcaggcagatggaaggggaaggggtatttaagaacatacaacaccttacggttaccgaagaggcagctgtccaaaattggctagcaagggtcggaagagaaaggttgtcaagaatggctatatcaggagatgattgtgtagtaaaacccttagacgaccgatttgcaaatgctctcacggctctaaacgatatggggaaaattcgaaaggacatccaacaatgggaaccctccaaaggctggaatgactggactcaagtgcccttttgtagccatcacttccacgagctaatcatgaaagacgggcgtgtattggttgtcccttgtcgaaaccaagatgaacttataggacgagcaaggatatcgcaaggcgccggttggtcactaagagagactgcttgtttaggaaaatcttatgcacaaatgtggtcacttatgtacttccataggcgagatttgcgactagccgctaatgccatttgctctgcggttccctcacactgggtgccaacatccagaactacatggtcgatccatgccaaacatgagtggatgacaacagaagatatgctaactgtctggaatcgggtatggatccgagagaatccttggatggaagataaaacacccgtggaaagctgggaagaaattccctacctagggaaaagagaagatcaatggtgtggcagtttaatagggctcaccagtagggcgacatgggctaaaaatatccaagctgcaattaaccaagtaagatcgttaataggaaatgaagaatacacagattacatgcccagtatgaaaagatttaggagagaagaggaggaagcaggagtcctatggtag

SEQ ID NO: 22313 - RNA, 9876 nt, synthetic construct
  misc_feature 1..9876: note = derived and/or modified CDS sequence (opt6) from DENV-2__GQ868631__SS-prME
  source 1..9876: mol_type = other RNA
agtgcaggaatgataataatgctaatacccacagtaatggcatttcatcttacaacgagaaacggagaacctcacatgatagttggtatacaagaaaaaggaaaatcgcttctatttaaaactgaagatggagtaaatatgtgtacacttatggcaatggatctcggtgaattgtgcgaagatacaattacgtataaatgcccactactaagacaaaacgaaccggaagatattgactgttggtgtaattcaacatcaacatgggttacctatggaacatgtacaactaaaggtgaacacagacgagaaaaacgaagtgtagcacttgttccacacgttggaatgggtttagaaacccggacagaaacatggatgagctcggagggagcgtggaaacatgcacaaaggatagaaacgtggatactaagacaccccggatttaccattatggctgcaatcttagcttatacgataggtacaacccatttccagcgcgttctaattttcatattactgacagcagtagcacctagtatgacaatgcggtgcattggtatatcgaatagagattttgtagagggggttagtggcggcagctgggttgatattgttctcgagcacgggagctgtgtcacgacaatggccaaaaataaaccaaccttggatttcgagctgatcaaaacggaggccaaacagccagcgacgcttagaaaatattgtattgaagcgaaactgacgaacaccactacggaatccagatgccctacacagggtgaaccaagtctaaaagaagaacaagataaacgatttgtatgcaaacattctatggtcgatcggggatggggaaatggatgcggattgtttggcaaaggtggaattgtaacttgtgccatgttcacttgcaagaaaaacatggagggtaaaatagttcagccagaaaatctagaatatacaatcgtggtcacaccacatagtggagaggagcacgcggtaggaaacgatacaggtaaacatggaatggagataaaagtgacgccccaaagctcgattactgaggccgagttgaccggctacggaacagtaacgatggaatgttcgcccagaacaggactggatttcaatgaaatggttctactccaaatggaaaataaagcgtggctagttcatcgccaatggtttctagaccttccgctaccttggctacccggagcagataaacaagaatctaactggatacagaaagaaaccctagtaacatttaaaaacccacacgccaagaaacaggatgtagtcgttctaggctcgcaagaaggtgcaatgcatactgctctcacgggtgcaaccgagatacagatgtcaagcggaaatctactctttactggacacctgaaatgccgattaagaatggacaaactacagttaaaaggaatgtcatactccatgtgtacaggaaaatttaaagtagtcaaagaaatagcagagactcaacacggtacgattgtaataagagtacaatatgaaggagacggttctccttgtaaaataccattcgaaatcatggacctagagaaaagatatgtattgggacgtctaattacagttaatccaatcgtaacagagaaagatagccctgttaacattgaggccgaaccacctttcggagactcgtatataatcattggcgtagaacccggccaattaaaattaaattggttcaagaaaggttcgagcattggtcaaatgtttgaaacaacaatgagaggagcaaaaagaatggctattttaggtgacacggcatgggatttcggttctctaggaggcgtatttacctccataggaaaagcactacatcaagtgttcggcgccatttatggagtcgccttcagtggcgttagttggactatgaaaattcttatcggtgtaattattacttggatcggtatgaactctcgatcgaccagtttgagtgttagtttagtgttagtaggtattgtgacactatatctaggagtaatggtccaagccgacagtggatgtgttgtctcgtggaaaaataaagagctaaaatgcggatcgggtatattcatcacagacaatgttcatacatggaccgaacaatataaatttcagcccgagagtccgtcaaaactcgctagtgcaatacaaaaggcccaagaagagggtatttgcggaataaggagtgtaactcgactggaaaatttaatgtggaagcaaataacaccagaattgaaccatattctagccgaaaatgaagtcaaacttacgattatgacaggagatatcaaaggaataatgcaggcaggaaaacgtagccttaggcctcaacctacagaattaaagtacagttggaagacatggggtaaagccaaaatgctctctaccgagagttataatcaaacatttctaatcgacgggcccgaaactgccgaatgtccaaacacaaatcgcgcatggaactcgcttgaggtcgaagactatgggtttggtgtctttactactaacatatggcttaaactaaaagagaaacaggatgcgttctgtgatagtaaacttatgtccgccgcaattaaagacaacagagcggtacatgccgacatgggctactggatagagagcgcgttaaacgatacgtggaaaatagagaaagcaagtttcattgaagtaaagaattgtcactggcccaagagtcacaccttatggtccaatggggttctagagagcgaaatgatcatacccaaaaatcttgcgggacctgtgtcgcagcataattacaggccgggctatcacacacaaatagctggcccctggcatctgggaaaactggaaatggattttgatttttgcgatggtaccacagtaatagtcacagaggattgtggaaaccggggtccatcattacgaaccaccacagcatcaggtaaacttataaccgaatggtgttgtagatcttgtacattacccccgttacgataccgaggagaggatggctgctggtacggcatggaaatacgacccctaaaggaaaaagaagaaaatcttgtaaattcattagtaactgcggggcacggtcaagtggataatttcagcctaggagttttaggcatggctttgtttttggaggaaatgctcagaactagagttggaacaaaacatgccatattacttgtggcggttagttttgtaactttaatcaccggaaacatgtcttttaaggaccttggtagggtcgtagtaatggtaggtgctacaatggctgatgacattggaatgggtgtaacatatctagcactgctagctgcgtttaaggtacggcctacatttgcagccggtctgctacttagaaaattaacatcaaaagagcttatgatggcaacaataggcattgtcctattgtcccaatcaactattccagagactgtcctcgagttgactgatgcattggcacttggcatgatggcgttaaagatcgtaagaaatatggaaaaataccaattagcggtcacaattatggcaatactttgcgtgccgaacgcggtgattctacaaaatgcttggaaggtctcttgtactatacttgcagtagtgtctgtatccccactccttcttacaagctcgcagcagaagactgattggattccactggcattaaccattaaaggactaaacccgacagccatatttttaacgaccctatccagaacaaataagaaacgaagctggcctctaaacgaagcaattatggcagtcggaatggtatctatattggcttcgtcacttttaaagaacgatatacctatgacgggacctttagtggctggtggacttctaactgtatgttatgttttgaccggaaggtcagcagacttagagctagaaagagcgacagatgtgaaatgggaggatcaggcagaaatttcagggtcgagtccaatacttagtataaccataagcgaagacgggtcaatgtctatcaaaaacgaagaggaagaacaaacattgacaatcttaataagaacgggactattagtaatatcaggactcttccctattagtattcctattactgccgcagcctggtatctttgggaagtcaagaaacagagagcgggagtattatgggatgtaccctctcctcctccgatgggaaaagctgagctcgaagatggggcatacaggattaaacaaaaaggtatactcgggtactctcagataggcgccggtgtatataaagaagggactttccatacaatgtggcacgtcactagaggggcagttcttatgcataaaggcaaacgaattgaaccgtcatgggcggatgttaagaaagatctgatatcgtatggagggggctggaaactcgagggagaatggaaggaaggcgaagaagttcaagtactggcactagaaccaggcaaaaatcctcgcgcagtacaaactaaaccaggtctcttcaaaaccaatacaggcacaattggagcggtatcgctagactttagtcctggtacatcaggaagcccaattatagataagaaagggaaagtagtagggttatatggaaatggcgttgtaacaaggagcggagcatatgtgtcagctatagcgcaaaccgaaaaatccattgaagataacccggaaatagaagacgacatattcagaaaaagaaggctaacaataatggatttacatcctggcgcgggcaagacgaaaaggtacctaccagcaattgtacgcgaggcaataaaaagaggtctacgtacactcattttagctccaacaagagtagtagcggcagaaatggaggaagccctaagagggttgcctatcaggtatcaaacgccagccataagagcagaacacacaggaagagaaattgttgatttaatgtgccatgctacatttaccatgagacttctttcaccggttagagtgcctaattataacctcatcataatggatgaagcgcactttactgatcctgcatcaatcgctgcaagaggatatataagcacaagagttgagatgggtgaagcagcaggcatttttatgacagcaaccccacctgggagcagggatccttttcctcaatcgaatgcccccattatagatgaagaacgggaaatacctgaacgatcctggaactcaggacatgagtgggtgaccgattttaagggaaaaactgtatggtttgtgccttctatcaaagcaggaaatgacatcgcggcatgtcttcgcaaaaatgggaagaaagttattcagctcagtagaaaaacgttcgactcagaatacgtaaaaacaaggaccaatgactgggacttcgtcgttacaacggacataagcgaaatgggggcgaacttcaaagccgaaagagtgattgaccctagacgttgtatgaaacctgttatccttacggatggtgaggaaagggtcattttagcaggaccaatgccagttacacactcctctgcagcccaacgaagaggtagaataggcagaaaccctaaaaacgagaatgatcaatatatctatatgggggaaccactagagaatgatgaagactgtgcccattggaaggaagcaaaaatgctattagataacataaacacgcctgaagggataataccgtccatgtttgagccggaaagagaaaaagtggacgcgattgatggcgagtatagattaagaggggaagccagaaaaacttttgtagacctaatgcgacggggcgacttaccagtttggttagcttacaaggttgcagcagaaggtatcaattacgctgataggcgatggtgctttgacggaatcaaaaataaccaaattcttgaggagaatgtggaggtggaaatatggactaaggaaggcgaaagaaagaaactgaaaccaagatggttggacgcaagaatctactccgatccgttagcgttaaaagaatttaaggagtttgcagcaggtaggaagtcattaactctcaatttgataaccgaaatgggaagactaccgacatttatgactcagaaaacaagagacgctttggacaaccttgcagtactccacacagcagaggcgggcggtcgagcgtacaaccatgcattaagcgaacttccagaaacgttagaaacgcttttgttattaactcttttagcgactgtgactggcggaatatttctatttttgatgtcaggaagaggaattggaaagatgacactgggaatgtgttgtattatcaccgcgagtattttgctttggtatgctcaaatacaaccccattggatcgcagcaagtattatattagaatttttcctaattgtgctactcataccagagcctgagaagcagaggacgccgcaagacaaccaattgacatatgtcgtgattgcaatcctcacggttgtagcagcaaccatggcaaatgagatgggattcctcgagaaaaccaagaaagacctcggcttgggaagtatagcgacccagcaaccggagtccaatatcttagacatcgacttaagaccggcaagtgcctggactttatatgccgtagctacaacatttgttacaccgatgctaagacactcaatagaaaattcaagcgtaaacgtaagcctaaccgcaatcgcaaaccaagccaccgttctaatgggactaggaaaaggctggccgttaagtaagatggacatcggtgtcccattactagcaatcggatgttacagccaagtaaacccgataacgcttaccgccgctttgttgttactcgtagctcactatgcaattatcggccctgggctccaagcgaaagcaactcgagaagcgcaaaagagagcggcagcaggaataatgaagaatcctacagttgatggaataacagtaattgatttggatccaatcccatatgacccaaaattcgaaaagcaattaggacaggtaatgttattaatcttatgtgtaacccaagtcctaatgatgagaactacttgggctctttgtgaagctctgacattagcaactggaccaatatcgacactctgggaaggaaatccgggtagattttggaacacaactatagctgtctcaatggctaacattttcaggggaagttacctggcaggagctgggttattgttttcaataatgaaaaatactacaaatacacgacggggcaccggaaatataggagagaccttaggagaaaagtggaaaagtcgtctaaatgctctaggcaaaagtgaatttcaaatctacaagaaatctggcattcaagaagtggatagaactctagctaaagaaggaataaagagaggagagactgatcatcatgcagtttcaagaggaagtgcaaaactaagatggttcgtggaaaggaacatggtaacaccagaaggaaaagtagtggatttaggatgcgggcgaggtggctggtcatactactgcggcggtcttaagaacgtacgtgaggtgaaggggctaacaaagggaggtcccggtcacgaagaaccaatacccatgagtacatatgggtggaacttagtaagactacaatcaggtgtagatgtattctttataccaccggaaaagtgcgacacacttttatgcgacataggagagtcttcacccaatcccactgtagaggccggaaggacactacgcgtcctaaacttagtcgagaattggcttaacaataatactcaattttgcatcaaagtccttaatccctatatgccgagcgttatcgagaaaatggaagcaatgcagcgcaaatatggtggtgccctagtgagaaatccattgagccggaatagtacacatgaaatgtactgggtttcgaatgcaagtggaaatattgttagtagcgtgaacatgatatcaagaatgcttattaatcgattcacgatgagacataagaaggccacctatgaaccagatgtggatttaggctctggtacacgtaacataggtatcgaaagcgaaattccaaatttggatataataggaaaaagaatagagaaaataaaagaggaacatgaaacatcatggcattacgatcaagaccatccgtacaaaacgtgggcttaccacggctcttatgagacaaaacagacgggaagtgcatcaagcatggtaaacggagtcgtaagacttttaaccaaaccatgggacgttttacccacggtcactcaaatggcaatgacagatactactccgttcggacaacaacgggtttttaaagagaaagtagatacaagaacccaggagccgaaagaaggaacgaagaaattaatgaaaatcacagcagagtggctatggaaagaattaggcaagaagaaaacaccgcgaatgtgtacaagagaggaatttacccgtaaggtacgatctaatgcagcacttggggcaatctttaccgacgagaataaatggaaatcagcaagagaagctgtggaggactcccgtttctgggagctagttgataaagagcgtaatttacatttagaaggaaaatgtgagacctgcgtatataacatgatgggaaagagagagaaaaagctaggtgagtttggcaaagcaaaaggatcaagagcaatctggtatatgtggcttggagccagatttctcgagtttgaggccctcggatttttaaacgaagaccattggttttctagggaaaattccttatcaggagtggaaggtgaaggattacacaaacttggttatatcttaagagatgtaagcaagaaagaaggaggagcaatgtacgcagatgacacggcgggatgggacactcggattaccctggaagatttgaaaaatgaggagatggttactaatcatatggaaggtgaacataagaaactagcagaagccatttttaaattaacataccaaaacaaggtcgttagagttcaaagaccgactccacgtggaactgtaatggatattatttcaagacgagatcaacgtggctcaggacaggtgggtacatatggtcttaacacatttacaaacatggaggcacaattaattcgccaaatggaaggtgaaggggttttcaagaacatccagcatctaacagtgaccgaggaagcagctgttcaaaactggttagcaagagtaggtagggagaggctttcaaggatggcgatatccggtgatgactgtgtagtaaaacctcttgacgatcggtttgcaaacgcattaaccgccttaaacgacatgggaaaaattcgtaaagatatacagcaatgggagccgtcaaaaggttggaacgactggacacaagtacccttttgctcgcatcattttcacgagcttatcatgaaagatggtagagttttagtagtgccatgtcgtaaccaagatgaactcatagggcgagccagaatttctcaaggagcaggctggtccttaagagagactgcatgtctcggaaaatcttacgctcagatgtggtcactaatgtatttccaccgacgcgatctcaggcttgcggccaacgctatatgtagtgcagtaccgtcgcattgggttccaacgtctcgaacaacttggagcatacatgcaaaacacgagtggatgacaactgaagatatgttaaccgtttggaacagagtctggattcgcgagaacccttggatggaagataagacgccggtagaaagttgggaagaaataccctacttaggaaaaagagaagaccaatggtgtggaagtctaatcggattaacttcgagagccacttgggccaaaaacatacaagcggctataaatcaagttcgatcactaataggtaatgaagaatatactgattatatgccaagcatgaaaagattccgacgggaagaagaagaggcaggagtcttatggtag

SEQ ID NO: 22314 - RNA, 9876 nt, synthetic construct
  misc_feature 1..9876: note = derived and/or modified CDS sequence (opt6) from DENV-2__GU131899__SS-prME
  source 1..9876: mol_type = other RNA
agtgctggtatgatcataatgctaatacccacggttatggctttccacttaaccacccgcaatggtgaaccgcacatgattgtaggtatccaggagaagggcaagtcactactattcaagacagaagacggagtaaatatgtgtacgttaatggctatggatcttggagagttgtgtgaagacactattacatacaaatgtccactattacgccagaatgaaccagaagatattgactgttggtgtaattcaacgagtacttgggtcacttatgggacctgcactactacaggcgaacatagaagagaaaaaagatctgtcgcactagtaccacacgttggcatgggactggagacacggacagagacctggatgtctagcgaaggggcttggaaacatgcccaacgtatcgaaacgtggatattaagacatccaggatttacgataatggcggcaatcctagcttatacgataggaactactcatttccaacgggttttaatcttcatcttacttacagccgtcgcaccaagtatgactatgcgatgtataggaatatcaaatagagacttcgtagaaggtgtcagtggagggagttgggtagacatagtattggaacatggctcatgcgtgacgacaatggcgaaaaataaaccaacactagacttcgaattaatcaaaaccgaagcgaagcaaccagcgacactgagaaaatactgtatagaagcgaaactaacgaacacaactacggaaagccgatgccccacccaaggagaacccagtctaaaagaggagcaggataaaagattcgtatgtaagcactcaatggtggatagaggatggggaaatggctgcggtctattcggtaagggaggaattgtgacgtgcgcaatgtttacatgtaagaaaaatatggaagggaaaatagtgcaaccggaaaatttagaatatacaatagtagtaacacctcattcaggggaagagcacgctgtagggaatgatactgggaagcacggaaaggaaataaaagtcactccccaaagctcgataacggaagccgaactcaccggttacggtactgtcactatggagtgctctcctagaacggggttagattttaatgagatggtattgctccagatggaaaacaaagcatggctagtacataggcaatggtttcttgatcttccgcttccgtggctaccaggtgcagacaaacaagaatcgaactggattcaaaaggaaactttggtaacatttaagaacccgcatgcgaaaaaacaagatgttgtagtccttggttctcaagagggagcaatgcatactgcccttactggtgcaacagaaattcaaatgtcgtcaggaaatttattattcaccggtcatttaaaatgccgcttgcgaatggataagctacaattaaagggtatgtcctacagtatgtgcacaggaaaattcaaagtagtaaaagaaatagcagaaactcaacatggcactatagtcataagagtgcagtatgaaggagacggttctccgtgtaaaattcctttcgagataatggacttagaaaagcgatatgtccttgggagattaataacagtcaatccaattgtcactgagaaagacagtcccgtaaatattgaggctgaaccccccttcggagattcatatataattataggggtcgaacctggtcaactaaaactaaattggtttaaaaaaggctcaagtataggccaaatgtttgagactactatgaggggtgctaaaagaatggctatactcggcgatacagcgtgggattttggttccctaggcggagtgttcacaagcatcggtaaggcgctccaccaagtatttggagcaatatatggtgctgcatttagcggtgtatcatggacgatgaagatattgataggtgtaattattacatggattgggatgaatagcagatcaactagtttgtcagtgtcacttgtacttgtagggatagtgacgctgtatttaggcgtaatggtacaagcagattctgggtgcgttgttagctggaaaaataaagaattaaaatgcggaagcggtatttttataacggacaacgtccatacttggaccgaacaatacaaattccaaccagaatccccgagtaagctagcatcagcaattcaaaaggcccaagaagagggcatatgtggcataaggagtgtaaccagactagaaaacctgatgtggaagcaaataactccagaactaaatcacatcttagcagaaaatgaagtaaaattaaccattatgacaggagacatcaaaggtataatgcaagctggaaaaaggtcattacgtccgcagccaacagaactaaaatactcgtggaaaacttggggcaaagcaaaaatgttgtcaactgagtcatataatcaaacatttttgatagatgggccagaaacagcagaatgtcctaatacaaatagagcatggaattcattagaggtagaagactacggatttggtgtatttacaacaaatatttggctgaagctcaaggaaaaacaagatgcattctgtgatagtaaactaatgtctgcagcgattaaagacaatagagccgttcacgccgatatgggatactggatagagtcagcgctgaatgatacatggaaaatagaaaaagctagctttatagaagttaaaaactgtcactggccaaaatcccatacactatggtctaatggagttttagaatcggaaatgattattccaaaaaacttggctggccctgtctcacaacataattatcgccctggataccatacccaaatagcgggtccatggcacctaggaaaactagaaatggactttgacttctgcgacggcacgacagtcatagtgacagaggattgtggtaatagaggtccttcacttaggacgacaacagcttcaggcaagctcattacagaatggtgttgtcggagttgtacgttaccacccttaagatatagaggagaggatggttgctggtatggaatggagatccgacctttgaaagaaaaggaagagaacttagtgaatagtttagtgacagcaggacatggtcaagttgacaactttagtttaggtgttctcggcatggcattattcctggaagagatgctccgaactagggtcggcacgaaacacgctattctattagtagcagttagttttgtgactttaattactggcaacatgtcttttaaagatctgggcagggtggtagtaatggttggtgcgacgatggccgatgatataggaatgggagtcacatatctggcattattagctgcgtttaaagttaggccaacatttgcagccggattactattgaggaaactgacctcgaaagaactgatgatgacaactattggtatagttttgttaagccaaagcactatcccagaaaccgtattagaacttactgatgcacttgccctaggaatgatggtattaaaaattgtaagaaatatggaaaaatatcagttagcagtaactataatggccatcctttgtgtcccaaatgcagtaatactacaaaatgcatggaaggtgtcctgcactatattagccgtagttagcgtgtctcctttacttctaacatcttcacaacaaaaaacagattggataccactagctctaacgataaaaggcctaaacccgactgccatattcttaaccaccctttctcgtactaataagaagagatcatggccacttaatgaagctataatggcggttggaatggtttcaatactagcttctagcttacttaaaaatgatatcccaatgacaggaccattagttgccggaggacttttaacagtttgttatgtattaacaggccgatctgcagatcttgaactagaaagagcaacggacgttaaatgggaagatcaagctgaaataagtggcagctctcccattttaagtataaccatttcagaagatgggagtatgagcattaaaaacgaagaagaagagcaaactctgaccatattaataagaaccggattattagttatatctggactatttcctatttctatcccagtgacggcagcagcgtggtatctttgggaggtaaaaaaacagagagcaggggttttatgggacgtgccctcaccccccccaatgggtaaggccgaactcgaagacggggcctacagaattaaacaaaagggtatactcggttactcccaaataggcgcaggggtatataaggaaggcacgtttcataccatgtggcatgtcactaggggggcggtactcatgcataagggtaagagaatagagccctcttgggctgatgtaaaaaaggatttgatatcatacgggggtgggtggaaattagaaggcgagtggaaagaaggagaagaagttcaagtcttagcactcgaacccggtaagaatcctcgtgcagtacaaactaagccaggcctttttaaaacaaataccggtactataggggcagtaagcctcgacttcagtcctggaacatcaggtagtcccatcatagataaaaaagggaaagttgttggtctgtatggcaacggagtcgtaacgcgttcaggtgcttatgtgtcagccatagcccaaactgaaaaatcgattgaagataatccagaaatagaagacgatatttttaggaaacgacgcctaacaataatggatttacatccaggagcaggcaaaacgaaaaggtatttacccgctatcgttagagaggcaattaaaagaggccttcgaactcttatactagcacctacccgcgtagtcgctgctgagatggaggaagctctacggggtttgccgataagatatcagacaccggcaattcgcgcagaacacactggtagagaaatagtagatcttatgtgtcacgccaccttcacaatgaggctgttgtcaccagtcagagtccctaactataacttaataattatggacgaagctcatttcacagatccagcttctattgcagcaaggggatatattagtacaagagtagaaatgggagaggcggccggcatattcatgacagcgactccacctggtagccgggacccatttccacaaagtaatgctcctataatagacgaggaaagggaaattcccgagagaagctggaactccggtcacgaatgggtaacagacttcaaaggaaagaccgtatggttcgtaccttccataaaagcagggaacgatatcgccgcatgcctaagaaaaaatggaaaaaaggtaatacagttatcgagaaagacattcgatagcgaatatgtgaaaactaggacaaatgactgggattttgttgtaactacagatattagtgaaatgggagcaaactttaaggcagaaagagtgattgaccctaggcggtgtatgaaacccgtgattctaactgatggagaggagagagtaattcttgctggtcctatgccggtgacacactcttctgccgcgcaacgcagaggaaggataggaagaaatccaaaaaatgaaaatgaccaatatatctatatgggtgaacccttagaaaacgatgaagactgtgcacattggaaagaagccaagatgctactagataatataaacacaccagaaggcataattcccagtatgtttgagccagaaagagaaaaagtagacgctattgacggagaatatagattaaggggggaagctcggaaaacattcgttgacctcatgcgaagaggtgacttgccagtatggttagcttacaaagttgcagcagagggaataaattacgctgacagaagatggtgcttcgatggaatcaaaaacaatcaaatcctggaagaaaatatggaagtcgagatatggacaaaagagggagagcgtaagaaattaaaaccgcggtggttagatgcaagaatttacagtgatcccctagccttgaaagaattcaaagagttcgctgcgggaaggaaaagtttgacgttgaacttaataacagaaatgggtagattaccaactttcatgacgcaaaaaacgagagatgctctagataatctagcagtcttgcataccgccgaagcggggggccgcgcgtataatcatgcattaagcgagttaccagaaactttggaaacgctgctattactaacgctattagcaactgtgaccggcgggatatttttattcttaatgagcgggcgagggattggcaaaatgaccttgggaatgtgctgtataataaccgcatcaatactgttatggtatgcacaaattcaaccacattggatagcagcaagcataatactagagttttttttaatagtactattaattccggaacctgagaaacaacgaactccacaagataatcaattgacttacgtcgttatagccatactcacagttgtagccgcgacgatggcaaacgagatgggttttttagaaaaaacaaagaaagacctcggactaggaagcatagcaacacagcagcctgaatcaaacatactcgacatagacctcagaccggcgtcagcatggactctctatgccgtagcgactacgttcgtaactcctatgctcagacatagtattgaaaatagtagcgtaaatgtaagcctaacagcaatagcaaaccaggccacggtattaatgggtttgggaaagggttggcctctatcaaagatggatattggcgtacctcttctggccatagggtgttactcacaagttaatccgattacacttaccgcagcgttactgttgctagtagcacattatgcaattataggacctggcctgcaagcgaaagctacccgagaagcacagaaaagagctgccgcagggattatgaagaacccaacggtagacggtataacggtgatagacttagatcccatcccatacgatccgaaatttgagaaacagctgggacaagtaatgctattgattctgtgtgtcacacaagtccttatgatgcgaactacctgggcactatgcgaagccctaacccttgcaacaggcccaatatcaacgctctgggaaggaaatcccggccgattttggaatacgactattgcagtatcaatggcaaacatattccgaggatcctatttagccggggctggacttttatttagcataatgaaaaacacaacaaatacacgaagaggtactggaaatatgggcgaaacgcttggagaaaaatggaagagccggctaaatgccctgggcaaaagtgaattccaaatatacaaacgatctggaatccaagaagtcgacaggacactggccaaggaaggtataaaacgaggagaaactgaccatcatgcggtgtccagaggttcagcaaagttaagatggttcgttgaaagaaacatggttacgcctgaaggaaaggtagtagatttaggctgtggtagaggggggtggtcttattattgcggtggtttaaaaaatgtaagagaagttaaaggcctaacaaaaggtggaccaggacatgaggaaccaatacccatgtcgacatacggatggaatttagttcggctacagtcgggagttgacgttttctttatcccacccgaaaaatgtgatacactcttatgtgacattggagaaagttcaccaaacccaactgtagaagcgggtaggacattaagagtcctaaacttagttgaaaattggcttaacaataacacacaattttgtatcaaagttttaaatccctatatgccaagtgtaattgaaaaaatggaggcattacagcgtaaatatggaggtgcgctagtgaggaacccactatcgaggaatagtacacacgaaatgtattgggttagcaacgctagcggaaacatagtatcgtctgttaacatgataagtcgtatgctcataaacagatttacgatgcggcataagaaagccacgtacgaaccggacgtagatttggggagtggtacaagaaacataggtattgaatctgaaatacctaatttagatatcattggaaaaagaatcgaaaaaattaaacaagaacacgaaacaagctggcactatgatcaagatcatccatacaagacctgggcttatcatgggagctatgaaactaagcaaactggctcagctagtagtatggtcaatggtgtagtccgactattaactaaaccatgggacgtactcccaaccgtaactcaaatggcaatgacagatacgacacccttcggacaacaacgcgtctttaaggaaaaggtagacacacgaacccaagaaccgaaagaaggtacaaaaaagctaatgaaaattactgcagaatggctgtggaaagaattgggtaagaaaaaaacgccaagaatgtgtacaagagaagaatttacccgcaaagtaaggtcaaatgcagctttgggcgcgatattcactgatgaaaataaatggaaaagtgctcgtgaagccgtagaggactccagattttgggaactggttgacaaggaaaggaatttacatctcgaagggaaatgtgagacgtgtgtttacaatatgatgggaaaaagagaaaaaaagttaggagaattcggaaaagcaaaagggagtagagccatatggtatatgtggttaggagcgcgcttcttagagttcgaagccttaggtttccttaacgaagatcattggttctcgagagagaacagcttgagcggggtagaaggtgagggtctacataaattgggatatatactcagagacgttagtaagaaagaaggtggtgctatgtacgccgacgataccgcggggtgggatacgaggataacacttgaggatttaaaaaatgaagaaatggtaacaaatcatatgaaaggtgaacacaaaaagctagctgaggctattttcaaactaacctatcagaataaagtagtccgggtgcagagaccgacgccccggggcacggtaatggatataatatcccggagagatcaacgtggctctgggcaagtggggacctacggtctcaatacattcaccaatatggaggcccaactgattaggcagatggaaggagaaggcgtgtttaaaaacattcaacacttaacagttacagaagaagtcgcggtacaaaattggctcgcaagagtaggtcgcgaacggttaagcagaatggccatttctggagatgattgtgtagtaaaaccgttggacgaccgttttgctaatgcccttaccgcgttgaatgacatggggaaaattagaaaagatatacaacaatgggagccttctaagggttggaacgattggactcaagtacctttctgttcgcatcatttccatgaacttataatgaaagatggaagagtattggtcgtcccatgccgaaaccaagacgaactgataggcagagcacgtataagccaaggggcaggttggtcactccgtgaaacagcttgcttgggaaagagttacgcccaaatgtggagccttatgtattttcatagacgagacttgcgtttagccgcaaatgcaatctgttctgctgtcccttcacattgggtacctacatctcgaaccacttggtcaatacacgcaaaacacgaatggatgacgacagaagatatgttaacagtctggaatagagtgtggatacgtgaaaatccgtggatggaggacaaaactccggtggaatcctgggaagaaatcccatacttgggtaagcgtgaagatcaatggtgtggaagtctaataggattaacatccagggcaacatgggcgaaaaatatccaagcagccattaatcaagtacgaagtttaataggcaatgaggaatatactgattacatgcccagtatgaaaagattcagaagggaggaagaggaagcaggcgttctatggtga

SEQ ID NO: 22315 - RNA, 9876 nt, synthetic construct
  misc_feature 1..9876: note = derived and/or modified CDS sequence (opt6) from DENV-2__GU131900__SS-prME
  source 1..9876: mol_type = other RNA
tccgcaggtatgataataatgttaatacctacagtaatggcgtttcacctgactacaagaaacggagaaccacatatgattgtaggaatacaggagaaaggaaagtctctcctttttaagacagaagacggggtaaatatgtgtactctgatggcaatggatttaggagaactgtgtgaagacaccataacctacaaatgtccattactacgtcaaaatgaacctgaggacatcgactgctggtgtaattcgacaagtacctgggttacctacggcacgtgcacaacgactggcgaacataggcgtgaaaaacgaagcgtcgcgcttgtacctcatgtaggtatgggattggaaactagaaccgaaacatggatgtcaagtgaaggtgcctggaaacatgcgcagcgaatagaaacttggatcctgagacatccgggatttactattatggccgctatactggcgtacacaataggtaccacacactttcaacgcgtattaatattcatattgctgaccgcagtagcgcccagcatgacaatgcgatgtattggaatttcaaaccgggattttgtggaaggagtatcaggcggaagctgggtcgatatagtactagaacatggaagctgtgttactacaatggctaaaaacaaacctaccttagacttcgaactgattaaaacagaggccaaacagcccgccacgctgagaaaatactgtattgaagctaagctcacgaacaccactactgaaagtagatgcccaacgcaaggagaaccgtcactcaaagaagagcaagacaagagatttgtttgcaaacactctatggtggaccgaggctgggggaatggatgcgggctgttcggcaagggaggaattgtgacatgtgcaatgtttacttgtaagaagaatatggaaggcaaaattgttcaacccgaaaatctcgaatatacaattgtagttacacctcactctggagaagaacacgctgtaggaaacgataccggaaaacacggaatggaaattaaagtaactccgcaaagttctataacagaggctgaacttacaggatatggtacagttacaatggagtgtagccctaggaccggtttagatttcaatgaaatggtattactgcaaatggagaataaagcatggctagtacacaggcaatggtttctggacctcccactcccttggttaccaggagctgataaacaggaaagtaactggattcagaaagaaactctggtaacattcaaaaacccacacgctaaaaagcaagacgttgtcgttttaggatcacaagaaggagctatgcatacggccctcacaggagcaacagagatacaaatgtcatcgggaaacctcctcttcacggggcatttaaaatgcaggttaagaatggataagcttcaactaaaaggcatgagctactcaatgtgcaccggtaaattcaaagtggtcaaagaaatagccgagacacaacatggaacgatcgttattcgggtacaatatgagggcgatggatcgccatgcaaaattccttttgaaatcatggacctagaaaaaagatatgtcctaggccgactaataactgtcaacccgatagtcactgaaaaagatagtccagtgaacatcgaagcggagccaccatttggtgatagttacattataatcggggtagaacctggtcaactaaaactaaattggtttaaaaaaggcagtagcataggacaaatgttcgagacgaccatgcgaggagcaaaaagaatggccatcttaggcgatacggcatgggattttggcagcttgggaggggtcttcacatccatcgggaaagcattacatcaagtgtttggtgcaatatacggtgcagcatttagtggtgtatcatggacgatgaaaatactcattggagttattataacatggataggcatgaattcaagatccacaagtttaagcgtatcgctcgtactagtaggaatagtaacactctatctcggagttatggtgcaggcggactcgggatgcgtagtgtcgtggaaaaataaagaactcaagtgcggtagtggaatcttcattactgataacgttcatacctggacagaacagtataaatttcaacctgagagccccagcaaattagccagcgccattcaaaaggcacaagaggaaggaatatgcggaataagaagcgtcactaggctggaaaatctcatgtggaaacaaataacgcccgagcttaatcatattttagctgagaatgaagtaaaacttactataatgacgggtgacataaaaggcattatgcaagctgggaaacgcagtcttaggccgcaaccaaccgaacttaaatactcatggaaaacgtgggggaaagcaaaaatgctgagtacagagtcgtacaaccaaacattcctcattgatgggcccgaaacagcagaatgtccaaatactaaccgggcgtggaattctttggaagtagaagattatggatttggtgtttttacgactaatatatggttaaagttaaaggaaaaacaagacgctttctgcgattccaaattgatgtcagccgctattaaagataacagagccgtgcatgcagacatgggatattggatcgaaagcgctctgaatgacacctggaagatcgagaaagcttcattcatagaggtgaaaaactgtcactggccaaaaagtcataccttatggagcaacggagtattagaatccgaaatgatcataccaaagaatttagccggccccgtgtctcagcataattatcgtcctggataccatactcaaattgctggaccgtggcatctaggaaagctcgaaatggatttcgacttctgcgacggcacaacggtgattgtcacagaagattgtgggaaccgtggaccatcactgcgtaccactacagcgtcggggaagttgataacagaatggtgttgcagaagctgtacacttcctccgctgcggtaccggggcgaagatggctgctggtacggtatggagatccgaccattgaaagagaaagaagaaaatcttgtgaatagcttagtaacagctggtcatggccaagtcgataactttagtctaggggtccttggtatggcattatttctagaggaaatgttacgtacaagagtgggaacaaaacacgcaattcttttggtcgctgtatctttcgttacattaattacgggcaacatgtctttcaaggatctcggtagagtagtagttatggtcggcgctacaatggctgacgatattggcatgggtgttacctatttagcattattggccgcatttaaggtacgcccaacatttgccgcgggattattacttcgcaaactgacgtcaaaagagctaatgatgacaaccataggaatagtccttttgtcgcaaagtactataccagaaactgtactggagctaacggacgcactagccctaggaatgatggtactcaaaatagtacgaaacatggaaaagtaccagttagctgtcactattatggcgatactttgtgtacctaatgcggttatattacagaacgcctggaaagtttcatgcacaatactggccgtagtaagcgtgtcgccacttctactgacctcatcgcagcaaaagacagactggatacccctcgcgcttacaataaaaggattgaatcccacggcgatattcttaactacgttaagtcgcacaaataaaaagagaagctggcctttgaacgaagcaattatggcagtgggaatggtgtcaatacttgcttcttctctcctaaaggatgacattcctatgaccggaccgctagtggcggggggtctactcacagtttgttatgtactcactggacggagcgcagatcttgagttagaacgagcaactgatgtcaaatgggaggatcaagctgaaatcagcggatcgagtccgattctaagtattaccatatccgaagatggaagcatgtcgataaaaaacgaagaagaagagcaaacgttaactatattaatacggacgggtctattagttatcagtggcttattccctatctcaatacccataacagcagcagcttggtatttgtgggaggtcaaaaagcaacgagcgggagttctgtgggacgtaccctcaccacccccaatggggaaagcagaattagaggacggggcatatcgcatcaaacaaaaaggaattttgggctactcacagatcggagcaggagtttacaaggaaggaacgttccacactatgtggcacgtgactagaggagccgtcctaatgcataaaggtaagagaatagaacctagttgggctgacgtaaagaaggatctaatttcgtatggtggaggttggaaactggaaggagagtggaaagaaggtgaagaggtacaagttctagctttagaaccaggaaaaaatcctcgagcagtacaaacaaaaccagggctatttaagacaaatacaggaaccataggcgcggtttcgctggatttttcacctggtactagcggttcaccaataatagataaaaaggggaaagtagtgggattatacggcaatggcgtagtgactcggtccggagcatacgtatcagctatagcacagactgagaagagtatcgaagacaaccctgaaatagaagatgatatatttaggaaaagacgtttaactatcatggacctacacccaggagcaggaaaaacaaaacgttatcttccagctatcgtgcgcgaagctatcaaaagaggacttagaacactaatccttgcaccaacgcgagttgttgctgctgaaatggaggaagctttacgcggattaccaataaggtatcaaacacctgcgattagagccgaacacacggggcgcgagatagtagacttgatgtgtcacgcaacatttaccatgagattactctccccagttcgtgtcccgaactataatctaattataatggacgaagcacattttacagacccagcaagtattgcagcaagagggtacataagtactagggtagaaatgggggaagcggctggaatttttatgacagccaccccacctggaagcagagatccgtttccccaatcgaatgcccctataattgatgaggaaagggaaattccagagaggtcttggaactcaggacatgagtgggttacagatttcaaaggcaagacagtatggtttgtgccttctataaaggccggaaatgatatagccgcctgtttgagaaaaaatgggaaaaaggtaatacaactttcaagaaaaactttcgactcagaatatgtaaaaactcgaacaaacgactgggactttgtggttactactgatatcagtgaaatgggagcaaactttaaggccgaacgagtaattgatccaagacgatgcatgaaacccgtaatactcaccgatggggaggaaagagtcatattagccggcccgatgcccgtaacacacagcagtgccgcacaaagacgaggtcgaataggccggaatcccaaaaatgaaaatgatcaatacatatatatgggggaaccattggaaaacgacgaggattgtgcccattggaaggaagctaaaatgttactcgacaacattaacacgccagagggaattattccttcaatgttcgagcctgaaagggaaaaagtcgacgcgatcgacggggagtacaggctaaggggggaggcaagaaagaccttcgttgacctgatgagaagaggcgaccttcccgtatggctagcgtataaagtggctgcagaaggaatcaattacgccgatcgaagatggtgtttcgacggaataaagaacaaccaaatactagaagaaaatgtagaagttgaaatttggactaaagagggtgaacgcaaaaaactaaaaccgcgatggttggacgctcgaatatactccgatccactagcgctaaaagagtttaaagaatttgcagccggaagaaaatcattaactctaaatctgataactgaaatggggagacttccaacattcatgacccaaaaaacccgagatgcgttggataacttagctgtgttgcacacagctgaagcaggcggtcgagcttacaaccacgcgctaagcgaattacctgagaccctcgaaacattactgttattgacattattagcgacagtgaccgggggcatatttctctttttaatgtcgggccgaggaataggtaaaatgaccctaggaatgtgctgcataataacggcaagtatacttttatggtatgcacagatacaacctcattggatcgcagcgtctataatccttgaattttttcttatagtgttactaatccccgaaccagaaaagcaaagaacgcctcaagacaaccaattaacgtatgtagttatagcaatattaactgtagtagctgcaacaatggcgaacgaaatgggatttctcgaaaaaacgaaaaaggacctgggcttaggttctatagcaactcaacaaccggaaagtaatatactcgatattgatttacgaccagcgagcgcatggacactatatgccgtggcaacaacctttgtaactcctatgcttagacatagtatcgagaatagttcggtaaatgtatcgcttaccgctatagctaatcaagcaacagtattaatgggtctaggaaaaggatggccattatcaaaaatggacataggtgtacctctcttagccataggatgttatagtcaggtaaatccaataacattaacggccgccctcttgttacttgttgctcattacgcgataatcggcccaggattgcaggctaaagcaacacgagaagcacagaaacgagctgcggcaggaattatgaaaaatccaactgtcgatggaattacagtgatcgacctagacccgattccgtatgatcctaaatttgaaaaacagctaggccaagtcatgctattaatactgtgtgtaacacaagttctcatgatgagaacgacatgggcattatgtgaagccctcactttagcaacgggcccaatctcaacattatgggaaggaaatccgggaagattctggaacacaacaattgctgtaagcatggctaacattttcagaggatcatatttggcaggtgctgggctactgtttagtataatgaagaacacgaccaacactagacgagggacgggaaacataggggagacgctgggcgaaaaatggaaatccagattgaacgctcttggtaaatcagaattccaaatatacaaaaagagcggtattcaagaagttgaccgaactttagcaaaagaaggaattaaaagaggggagacagaccaccacgccgtgtcaagaggatcagcaaaacttagatggtttgtcgagcgtaacatggtgactccagaagggaaagtcgtagatctgggatgtggacggggaggttggagttattactgcggaggattaaagaatgttagagaagtaaaaggtctcactaaaggaggccctggccacgaagagccgatacccatgtcaacctacggttggaatttggtaaggttacaaagtggagtagacgtattttttataccaccagaaaaatgtgataccctactgtgtgatataggagaaagcagccccaaccccacagttgaagctggaagaacgttacgagtgttaaaccttgtagaaaattggcttaataataatacgcagttttgtataaaagtactaaacccgtatatgcccagtgtgattgaaaaaatggaggccttacagagaaaatatggaggcgcacttgtgagaaatcccttatcaagaaattcaacccacgagatgtattgggttagtaatgcatcgggcaatatcgtttctagcgtaaatatgatttctaggatgttaataaacaggtttacgatgcgtcacaaaaaggcaacgtatgaaccagacgtcgacctggggtcaggcacgagaaatatcgggattgaaagcgaaataccaaacctagatataataggaaaacgaattgaaaaaattaaagaggaacatgaaacttcgtggcactatgatcaagaccatccatataaaacttgggcctatcatggcagctatgagaccaagcaaacgggatcggcctcatctatggtgaatggagtcgtaaggttgttgaccaaaccttgggatgtgcttcctacagttacacaaatggcaatgaccgatactactccatttgggcagcaaagagttttcaaagaaaaagtagatacaaggacacaagagcctaaggaaggtacaaaaaaactaatgaaaataacagctgaatggctatggaaggaactgggaaaaaaaaaaacaccaagaatgtgcacacgtgaggagttcacaagaaaagtccgttccaacgctgctttgggtgcaatatttactgatgaaaacaagtggaaaagcgccagagaagcagtggaagattcgagattttgggaactagtagataaggaaaggaatttacatttagaaggtaaatgtgaaacatgtgtttacaatatgatgggtaagcgcgaaaaaaaattaggagaatttggcaaagctaaaggatctcgagcgatatggtacatgtggctgggcgcccggtttttagaatttgaagctctagggtttttaaacgaagaccattggttttcacgtgaaaacagcctaagtggagttgaaggagaaggtctgcataaattaggctatattctaagggatgtaagtaagaaggagggtggtgctatgtatgcagatgataccgccggttgggatactagaataacactcgaggatttaaaaaacgaagaaatggtgacaaatcacatggaaggagaacacaaaaaattagcggaggcaatttttaaactaacatatcaaaacaaagttgtgagagttcaacgaccaacaccaaggggtacagttatggatataatatctcgaagagatcagagaggctccggccaagtaggaacgtatggattgaacacgtttacgaatatggaagcgcagcttatcagacaaatggaaggagagggagtttttaaaaatatacaacacttaacagttactgaagaggcagctgttcaaaattggttggctcgagttggccgcgagaggttatctagaatggcgatatctggtgatgattgcgttgtgaaacctctcgacgatagattcgcaaatgcattaacagcattaaacgatatgggaaaaatacgcaaagacattcaacagtgggaaccctccaagggctggaatgattggacacaggtaccgttctgcagtcatcatttccatgagttaataatgaaagacggtagagttctggttgtaccgtgtagaaaccaggacgaactaattggaagagccagaattagccaaggggctggctggagtctgagagagacagcgtgtctcggaaaaagttatgctcagatgtggagtttaatgtatttccaccgacgggatcttaggctagccgcaaacgcaatatgttctgcagtaccaagtcactgggttccaacttcaagaactacttggagtattcatgctaaacacgagtggatgacaacagaggacatgttaaccgtttggaatagggtatggattcgtgaaaacccatggatggaggacaaaacaccagtagaatcatgggaagaaataccatatttaggaaaacgagaggaccaatggtgtggtagcttaattggacttacatcgcgagcaacttgggcaaaaaatatacaagcagcaataaatcaagtgagatcattaatagggaacgaagaatacaccgattatatgcctagcatgaagcgattccgaagagaagaagaagaggcaggagtgttatggtaa

SEQ ID NO: 22316 - RNA, 9876 nt, synthetic construct
  misc_feature 1..9876: note = derived and/or modified CDS sequence (opt6) from DENV-2__GU131901__SS-prME
  source 1..9876: mol_type = other RNA
agcgcaggtatgatcatcatgttaatcccaacagttatggcatttcacctaacaacaagaaatggagaacctcacatgattgtgggtattcaagaaaaagggaaaagtcttctatttaaaacagaagatggggtgaacatgtgtacattaatggcaatggaccttggtgaactttgtgaagatactatcacatataaatgccctctactacgtcaaaatgaaccggaagacatcgattgctggtgtaactctacatcgacgtgggtcacttatggaacttgtaccacgacaggagaacatagaagagagaaaagaagcgtagctcttgtcccgcatgttggtatgggattggaaacaagaacggaaacctggatgagctcagaaggggcatggaaacatgcacaacgaatagaaacatggatactccgacatccagggtttacgattatggccgctatattagcatatacaatcgggacaacccactttcaacgagtcctgatattcattctcttgacggcagttgctccgtccatgactatgcggtgcattggaatttccaaccgagattttgtagaaggagtatctggtggctcatgggttgatatagtcctggaacacggttcctgcgtgactactatggccaaaaataaacctacgttggattttgaattgataaaaaccgaagccaaacaaccagcaactttacggaaatattgcattgaagccaaactaacaaacaccacaactgaaagtcgctgcccaactcaaggggaaccgtcgttaaaagaggaacaagacaaacgatttgtatgtaaacacagcatggtagacagaggatggggtaatggatgcggattattcgggaaaggtggaatagtaacgtgtgccatgtttacttgcaagaaaaatatggaaggcaaaatagtacaaccggaaaatctcgaatacactatcgtagtaaccccacacagcggggaagaacatgcagtcggcaatgatacgggtaaacacggaatggaaatcaaagtaacgccacaaagctccattacagaggcagaactgactggatacggtacagtaacaatggagtgcagtccacgtacggggttagattttaatgaaatggtcttgttgcaaatggaaaataaagcctggctggtacatcgtcaatggtttttagatctcccacttccttggttacctggcgctgacaaacaagaatcaaactggatacagaaagaaaccctcgtaaccttcaaaaaccctcacgctaagaaacaggatgttgtcgtattaggatcacaagaaggggcaatgcacacggccttgacaggagcaactgaaatccaaatgtcttctggaaatttactttttacgggtcaccttaaatgcagattaagaatggataaactacaacttaaggggatgtcatattcgatgtgcactggcaaatttaaagtggtaaaggagattgcagagacacaacacggcaccattgtaatacgcgtacaatacgagggggatgggtctccgtgtaaaatcccatttgaaatcatggatctggagaaacgttatgtgctcggaagattaataacagttaatcctatagtaactgaaaaggactccccagttaatatagaagcggagccaccatttggagacagctacattattatcggcgtagagccgggacaattaaaactcaactggtttaagaaaggatctagtataggacaaatgtttgaaacgacgatgagaggagcgaagaggatggctatcctaggagacacggcgtgggattttggaagtctaggtggggtattcacttcgattgggaaagccttacaccaagtatttggggcaatctacggagcagcgttttctggagtatcgtggaccatgaagatattaataggagttataattacatggattggcatgaactcccgaagtacgtctctttcggtttcattagttctagttggaatagtaacattatatctcggagtgatggttcaagcagatagcggctgtgttgtctcatggaagaacaaagaacttaaatgtgggagcggtattttcattaccgataatgttcatacatggacagaacaatataagttccaaccagaaagcccatcaaagctggcatcagcaatacaaaaagcacaagaagaagggatatgcggcatccggagcgtaactcgattagaaaatctgatgtggaagcaaataacacctgaattgaatcacatccttgctgaaaatgaagtgaaactaaccatcatgacaggtgatatcaagggcattatgcaggccggcaaaagaagtctacgaccacaacccacagaacttaaatactcctggaaaacgtggggtaaagctaaaatgttatcgacggaatcatacaatcaaacctttctaatcgatggaccagaaacagcagaatgtccgaacacgaatcgcgcctggaactcgcttgaagtagaggattacggcttcggcgtgttcacgacaaacatatggttaaaattgaaagaaaagcaggacgcattctgcgatagtaaattaatgagcgcagcaataaaagataacagggcagtgcatgcggacatgggctattggatagaatcagcgcttaacgatacttggaaaatcgaaaaagctagtttcatagaagtgaaaaactgtcattggccaaagagtcatactttatggtcgaacggggtattagaatcagaaatgataatacccaaaaatctagcaggtccggtgtctcaacataactacagaccaggatatcatacacagatcgctggaccatggcacttaggaaaactagaaatggactttgacttttgtgatggcacaactgtaattgttacagaagattgcggcaacagagggccttctctacgaaccacaacagctagtggcaagttaataactgagtggtgctgcaggtcttgtactcttccaccactaagatatcgcggagaagacgggtgttggtatggtatggaaattcgacccttgaaggaaaaagaagaaaatcttgtgaactctttggtgactgcgggacatggacaagtagataacttttccttaggcgtgttaggaatggcattatttctagaagaaatgttacgaactagggttggcacaaaacatgcgatactgttagtagctgtaagttttgttactctgataaccggtaatatgtcgttcaaagatttgggacgtgtagtagttatggtcggtgcgacaatggcggatgatattggcatgggcgtgacgtatttagcgttattagccgcctttaaagttagaccgacattcgcagccgggctactattaagaaaactcacatctaaagaattgatgatgacgacgatagggattgtactactttcccaatcaactatccctgaaacagttctggaactaacagatgcattggcattaggtatgatggtattgaaaatagttaggaatatggaaaaatatcaattagcagttactataatggcaattctatgtgtaccaaacgcggtaatcctacaaaatgcatggaaagtaagttgtacaatactagccgtagtgagcgtgagtcccctcttattgaccagtagccaacagaaaactgattggatccctcttgccttaaccataaagggacttaacccgacagcaatattcctaactactcttagcagaactaacaaaaagaggtcatggccactaaacgaggcaataatggccgtcggtatggtaagcatacttgcctcttcgttacttaaaaatgatatacctatgaccggaccactcgtagcaggaggactactgacggtgtgttacgttttaaccggccgtagtgctgatcttgaattagagcgtgccactgatgtcaaatgggaagatcaggcggaaatttccgggtcatcacccatactaagtatcactattagtgaagacggatctatgtcaattaaaaatgaagaagaagaacaaacactgaccatccttataagaacaggattattagtcatatcaggattatttcccatttcaatccctataacggcggctgcttggtatctgtgggaagttaaaaagcaaagggcgggtgtcctttgggatgtccctagtccgccgccaatgggaaaggccgaactcgaagacggagcctatcgaatcaaacagaagggcatcctcggttacagtcaaatcggcgctggggtgtataaagagggcacgttccacacgatgtggcatgtaacgcgaggagcggtactcatgcacaaaggtaagagaatcgaacctagctgggctgatgtgaaaaaggacttgatctcatatggagggggatggaaacttgaaggtgaatggaaagaaggggaagaagtgcaggtactagcattagaaccgggtaagaatcctagagccgtgcaaacaaaaccaggactcttcaagactaacacaggtactattggggccgtttcgttagactttagcccgggtacaagtggttccccaataattgacaaaaagggaaaagtagttgggctgtatggtaatggggtcgtaacaagaagtggtgcttacgtaagtgctattgcacagactgaaaagtctattgaagataacccagaaatagaggacgatatatttcgcaaacgcagacttaccataatggatttacatcctggagccggaaagacaaaacgctatttaccggcaatcgtaagagaggctataaaacgtgggttgagaactttaatacttgctcctacccgtgtagtagcagccgaaatggaggaagcactacggggtctaccgatccgttatcagacgcccgcaatccgagcagaacataccgggagagaaatcgtcgacttgatgtgccacgcaacgtttacaatgcgtcttttaagtcctgtaagagtacctaactacaacctcataattatggacgaagcacattttactgatccagcatcgatagctgcaagaggatacatatccacaagagtggagatgggagaagcggcgggtatatttatgacggcaacgccacctggcagtcgagatccctttccacaatcaaatgcgccaattatcgacgaagaacgagaaattccagagagaagttggaactcaggacatgagtgggttactgatttcaaagggaaaacagtatggtttgtacctagcataaaagcaggcaatgatattgccgcctgtttacgaaagaatggcaagaaagtaatccaactatcacgaaagacattcgatagtgagtatgtgaaaactagaaccaatgactgggattttgtggtaactacggacatttcagaaatgggtgctaattttaaagcagaaagagtcattgacccaagacgatgtatgaagcccgtgatcttgacagacggagaagaaagagtcatactagctggacctatgcccgttactcacagcagcgctgctcaaagaaggggtagaattgggagaaaccccaaaaatgaaaacgatcagtatatttacatgggagaacctttagagaatgatgaagattgcgcacactggaaagaggctaagatgcttcttgataatataaacacaccggaagggattataccatcaatgttcgagcctgaaagagaaaaagtagatgccattgatggagaatacagactacgaggagaggccagaaaaacctttgttgatttaatgcgtcgtggagacttaccggtatggctagcatataaagttgctgcggagggtatcaattacgctgatcgaaggtggtgctttgatggcattaagaataaccaaatccttgaagagaatgtagaagtagaaatatggacaaaggagggggaaaggaagaaactaaaaccaagatggttagatgcacggatctattcagatcctttagcactaaaggaatttaaagaatttgcggcagggcgtaaatcattaacattaaaccttattactgaaatgggtcgtcttccgacattcatgacccagaaaactagagacgctttagacaatttagccgtactgcataccgcggaagcaggaggtagagcttacaaccatgcgttaagtgaactacccgagacattggaaactctcttacttcttaccttgctagcaactgtcacaggaggaatatttttattcttgatgtctgggagaggcatcgggaaaatgactttaggaatgtgttgcataattacagcgtctattctcctatggtatgcacaaatacaacctcactggattgctgcaagtattatcctggagttctttctgattgtccttttaataccagaaccggaaaaacaaagaacacctcaggacaatcaacttacctacgttgttattgcaattctaaccgtagtagcagctacgatggcaaatgaaatggggttcctagagaaaaccaagaaagatttgggattagggtcaatagctacccaacagcccgaatcaaatatactagatatagatctgcgaccagcatcagcttggaccttatatgctgtagcgacgacgttcgtaacaccaatgctgcggcattctatagaaaacagttccgtgaatgtttctttaaccgcgatagcaaaccaagcaacggtccttatggggcttggaaaaggatggcctttatcaaaaatggatataggtgtaccgttattggcaatcggctgctactcgcaagttaacccaattacactcaccgcagcattgcttttgcttgtagctcactatgcaattatcggtcctggattacaagcgaaagcaacacgagaagcgcaaaaacgggcagcagctggaattatgaaaaacccaacagtagacggcataacggtaatagatttggatcctataccttatgatccaaaatttgagaaacaattaggacaagtaatgctactgatcctatgtgtaacacaagtattaatgatgagaacaacatgggcattatgtgaggctttaacactagccacgggaccaatatcaactctgtgggaaggtaaccccgggagattctggaacactacaatagcagttagcatggccaatatctttcgaggaagttatttagcaggggctggacttttgttttcgattatgaaaaatacgacaaacacacggcgcggaactggaaatgtaggggaaacactaggcgaaaagtggaagtcaagattgaacgcattaggcaaaagtgaatttcaaatttataaaaagtctggtattcaggaagtggatcgaaccctagcaaaagagggcataaaaagaggagagaccgatcatcatgcagtaagtaggggatccgcaaaactacggtggtttgtagaacgtaatatggtaactccagaagggaaagtagtggacttaggatgtggacgaggaggatggagctattactgcggtggtctcaaaaacgtacgcgaagtgaaaggactgactaaagggggacctggacatgaagaaccgattccaatgtcaacttatggatggaatttagttaggctccaatccggtgtagatgtattctttattccacctgaaaagtgcgacacattgctatgtgatataggagagagcagtccgaatccgaccgtcgaagcagggaggactctccgagtactaaacctagtagaaaattggcttaataataatactcaattctgtataaaagttctaaatccttatatgccgtcagtaatcgagaaaatggaagcattacaacgtaagtatgggggcgctctagtaaggaacccactcagccgaaacagcacacatgaaatgtattgggtgagcaacgcatcaggaaatattgtgtcaagcgttaacatgataagcagaatgttaatcaatcgcttcacaatgagacataagaaagcaacatatgaaccagatgttgatttaggaagtggaactcgtaatataggcattgagagtgaaattcctaatttagacattattgggaaaagaatagagaaaataaaagaagaacatgaaacatcatggcactacgaccaagatcatccctacaaaacttgggcatatcatggctcttatgaaacaaagcaaacgggatccgctagttcaatggtaaatggtgttgtacggctactaacaaagccatgggacgtcttgccaactgtaacacaaatggcaatgacggacacaactccatttggtcagcagagagtttttaaagagaaggtcgacacaagaacacaagaacctaaagaagggactaagaaactaatgaaaattaccgctgaatggctatggaaggaacttggaaagaagaaaactccgagaatgtgcacacgagaagagttcacaaggaaggttaggtccaacgcagctctaggcgccatattcacagatgaaaacaaatggaaatctgctagggaagccgttgaagacagtcggttctgggagcttgttgacaaagagaggaacctccatctggagggcaagtgtgaaacttgtgtatataatatgatgggcaaaagggaaaagaagttaggtgaatttggaaaggctaagggttcaagagctatatggtatatgtggttaggagcacgattcttagaatttgaagcactaggatttttgaacgaagatcactggtttagtagggagaatagtctttccggcgtagagggtgaaggtctacacaaattaggttatatactcagagacgtaagcaagaaagaaggtggagcaatgtacgcggatgacactgcagggtgggatacaagaattacactcgaagacctaaagaatgaggaaatggttacgaaccatatggaaggggaacacaagaaactcgccgaagctatatttaaacttacatatcagaataaggtcgtgcgggtacagcgcccaactccgagagggactgtaatggacataatatcaaggagagatcagaggggtagcggacaagtgggcacatacggtcttaacaccttcaccaatatggaggcccagctaatccgtcagatggaaggcgaaggggtattcaaaaacatccaacacctaacggtaacagaagaggcagcagttcaaaactggttggcaagggtcggcagagaacgactcagccggatggccatatcgggggacgattgtgtagtcaaaccgttagatgatcgatttgctaacgctctaactgcattaaatgatatgggaaaaatcagaaaagacattcagcaatgggaaccgagcaagggttggaatgactggactcaagtgcccttttgttctcaccactttcacgaactgataatgaaagatggaagagttttagtcgtaccctgcagaaatcaagatgagttgatagggagagcaaggataagccaaggagcgggatggtcattaagagaaactgcatgtcttgggaaatcatacgcccaaatgtggagcttaatgtatttccaccgaagggatctaaggttagcagcgaatgcgatctgctctgcagtaccaagccattgggttcctacttcacgaacaacatggagtattcacgcgaagcacgaatggatgactactgaagatatgttgaccgtgtggaatagagtatggatcagggaaaacccatggatggaagataaaacaccagtggaaagctgggaggaaatcccgtatctaggaaaaagagaagatcaatggtgtggctccctcattggtctcacaagccgagcaacctgggccaaaaatatacaagctgcaataaaccaagtgcgatcgttaattgggaacgaagaatatacagactacatgcccagtatgaaaagattcagacgtgaggaagaagaagctggcgttctgtggtga

SEQ ID NO: 22317 - RNA, 9876 nt, synthetic construct
  misc_feature 1..9876: note = derived and/or modified CDS sequence (opt6) from DENV-2__GU131902__SS-prME
  source 1..9876: mol_type = other RNA
tccgctggcatgataataatgctaattccaactgtaatggcgttccaccttactacaagaaacggcgaaccacacatgatagttggcatacaagaaaaaggaaaatcactgctgttcaaaacagaagatggagttaatatgtgcacactgatggcaatggatcttggagaattatgtgaagatacaatcacctataaatgcccactactaagacaaaacgaaccggaagatattgactgctggtgtaattctacatcaacttgggttacatacggaacgtgcacaactacaggtgaacatagaagagaaaagaggtccgtagcattagtaccacatgttggaatgggtctagaaacacgaaccgagacgtggatgtcatccgagggagcgtggaaacatgctcaaaggatagaaacatggatactacgacacccaggtttcacaataatggcagcaatactggcatacaccataggcaccactcactttcaaagagtactaatattcatactactgactgcggtcgcaccttccatgacaatgcggtgtataggtataagtaacagagattttgtggagggagtaagtgggggaagctgggtggacattgtattagaacatggtagctgcgtaacgacaatggccaaaaataaaccaacattagatttcgaactaatcaaaacggaggcgaaacaaccggcaactttaaggaagtactgcattgaagcgaaacttacaaatacaactactgagagtaggtgtccaacccaaggagaacccagcttaaaggaagaacaagacaaaagatttgtatgtaagcattctatggtagataggggttggggaaacggctgtggtctattcggaaaaggcggtatagtgacctgtgcaatgtttacctgcaaaaagaatatggaagggaagatagtgcaaccagagaacctagaatatacgattgtcgtaacacctcattcaggggaggagcatgcagttggaaacgataccgggaaacacggtatggaaatcaaggtgacaccgcaaagctcaatcactgaagccgaattaacaggctacggaactgttactatggaatgtagccctaggactggtctagactttaatgaaatggtattgctgcaaatggaaaataaagcatggcttgtccatcggcaatggtttctagacttacctttaccctggttaccaggggcagataaacaagagagcaactggatccaaaaagaaacccttgtaacgttcaagaaccctcatgctaagaaacaggacgtagtcgtacttgggtcccaggaaggagcaatgcatacagcactcacaggggctacagaaattcaaatgtcaagcggtaatctgctttttaccggtcatttaaaatgcagattaagaatggacaaactgcaattgaaaggcatgtcctactcaatgtgcactgggaaattcaaagtagtaaaggagatagctgaaactcaacacggaacaatcgtgataagggtacaatacgagggagacgggtcaccttgtaaaattccctttgagattatggatctagagaaacgatacgtattaggaaggttgatcacagttaatccaatagtaacggaaaaagactcacctgtgaatattgaagcagagccacctttcggtgattcatatatcatcattggagtagagccaggacaattgaaactgaactggttcaagaaaggatcatctataggtcaaatgtttgaaacgacaatgagaggggcaaaacgtatggccatacttggcgacacagcatgggatttcgggtcacttggaggcgtatttacgtctattggaaaagctctccatcaagtgttcggagccatctatggcgctgctttctcaggagtatcttggactatgaaaattctcataggtgttatcattacatggatcggaatgaactcccgatcaacctccctgtcagtaagcctagtgctagttggaatagtaacactttatctaggagtaatggtccaagctgattccggttgtgttgtttcgtggaaaaataaagagttaaaatgcggatccggtatatttataacagataacgttcatacatggacagaacagtacaaatttcaacccgaaagtccatctaaattagctagcgctatccaaaaggcacaagaagaaggaatatgcggcattcgttcggtaacacgactagaaaatttaatgtggaaacaaatcacacctgaacttaatcatatactcgcagaaaatgaagtgaagctaacgattatgactggcgatataaaaggcattatgcaagccggaaagcgtagcttaagaccacaacctacagaattaaaatattcctggaagacttggggcaaagccaagatgctaagcaccgaatcgtataatcagaccttcttaatcgacggcccagaaactgcggaatgtccaaacacgaatagagcttggaacagcctagaagtcgaagactatggttttggggtatttaccaccaacatatggctcaaactgaaagaaaaacaagacgctttttgtgatagtaaactgatgtcagccgcaattaaagataaccgagctgtgcatgcagatatgggctattggatagagtccgccctaaatgatacctggaaaatagagaaagcatcttttatagaagtcaaaaactgccattggcctaagtcgcatactctctggagtaacggagtactagagagtgaaatgataatacccaaaaatcttgcgggcccagtgtcccaacataactacaggccaggttaccatactcaaatcgcaggaccatggcatttaggaaaattagagatggatttcgatttttgcgacggcacaacagtaatagtgaccgaagattgtggtaaccgaggaccttctcttagaactacgactgcgtctggtaaactgatagctgaatggtgctgtagatcctgtacattaccacccttgcgttataggggtgaagacggctgctggtacggaatggagataagacctctgaaagaaaaagaagaaaacctggtaaatagcctagtaaccgcaggacatggacaggtagataatttttccttaggagtcttagggatggcactcttccttgaagaaatgttaagaacgcgtgttggtactaaacacgctatactgttggtcgctgtttcatttgtaactttaataacaggtaacatgagtttcaaagatttaggtagagttgtcgttatggttggggcaaccatggccgatgatatagggatgggagtaacttatctagctctgcttgctgcgttcaaagttagaccaactttcgcagccggccttctcctaaggaaattaacatccaaagaattaatgatgactaccataggaatcgtccttttgtcacaatctaccataccagaaactgttcttgaattaactgacgctctggcactaggtatgatggtcttaaaaattgttagaaacatggaaaaatatcaactcgcagtcacaataatggctatactatgcgtccctaatgcagttatattacagaatgcgtggaaagtgtcatgcactattctagcggtagtctcggtcagccctttactcctaacatcaagtcaacagaaaacagactggatacccttagcacttacgataaaaggattgaatccaacagctatctttttgacgacactctctcgtaccaacaagaaacgatcatggccattaaacgaagctataatggcagtaggaatggtatctatacttgcctccagcctactcaaaaacgacatccccatgacgggaccattagttgcaggaggattacttacagtttgctacgttttaactggaaggagtgctgatctagaactagagagagcgacggacgttaaatgggaagatcaagctgaaatctccggatcttcacccatcctgtccataacgataagcgaagatggaagtatgtctattaaaaacgaggaagaagaacagacactaacaatattaatcagaacaggactacttgtaatctctggattatttccaataagcataccaataacagcagcagcatggtatctatgggaggtcaagaaacagcgagccggggtactctgggacgtgccgtcgccgccgcctatgggcaaggcagaacttgaagatggcgcttaccgaataaagcaaaagggtattttaggatactcgcaaattggggcgggagtatataaagaagggacttttcacacaatgtggcacgtaacacgaggtgcagtcttaatgcataagggcaaacgaatcgagccaagctgggctgatgtaaagaaagatctgatatcgtatggcggcggctggaaactcgaaggtgaatggaaggaaggcgaagaagttcaagtattggccttagaaccaggtaaaaacccccgagctgtccaaacaaaacctggattattcaaaacaaacactggaaccattggagcagtatccctcgatttcagtcctggaaccagtggatcaccaattatcgacaagaagggaaaagttgtaggtctatatggtaatggtgtcgtaacaagaagcggggcttacgtaagtgctattgctcaaacggagaaatccattgaagataacccagaaatagaagatgacatatttagaaagaggagattaacaataatggacttacatccaggtgcaggtaagacaaaacggtatttgcccgctattgtaagagaagcgatcaagagaggtcttagaacgctaattctggcacctactagagtagtggctgccgaaatggaagaggcactaagagggctacctatccgataccaaactcccgcaatcagggcagaacacacaggcagggaaattgtggatttaatgtgtcatgccacatttacaatgcgtttactaagtccagtaagagtcccaaattataatcttataataatggatgaagcacatttcacagatccagcatccattgctgcccggggatacatttcgacgcgtgtagagatgggtgaagctgccggcatctttatgactgccacgcctccaggttcaagagacccattcccacagtcaaacgcgcccataatcgacgaagaacgagaaatacccgaaagaagttggaacagcggccatgaatgggtgacggatttcaagggaaaaacagtatggttcgtaccaagtatcaaagcgggaaatgacatagctgcctgcctaagaaagaatgggaagaaagttatccaattatcaaggaagacctttgattccgagtacgtgaagactagaacaaacgattgggattttgtagtaaccacagacatcagcgaaatgggagccaattttaaagctgagagagtaatcgatccccgaagatgcatgaaacctgtaatcttaaccgatggagaagaaagagtaatcctcgcaggaccaatgccagttacgcattcgtcggctgcacaacgcaggggtagaatcgggcgcaatcccaaaaatgaaaacgaccaatatatatatatgggagaaccgctagaaaatgatgaagactgtgcacattggaaagaggccaaaatgttacttgataatatcaatacaccagaaggaataatcccaagtatgtttgaaccagaaagagagaaagttgatgcgattgatggcgagtaccgtctgcgcggagaagcccgcaaaactttcgttgatttaatgaggaggggcgatctacctgtttggttagcttataaagtagcggcggaaggcatcaattacgcagatcgcagatggtgttttgatgggatcaaaaacaatcaaatattagaggaaaatgtggaggtagaaatatggaccaaagaaggagaaagaaagaagttaaaacctaggtggctagacgcgaggatctacagtgatccattagcacttaaagagttcaaagaatttgcagcaggcagaaaaagcctaacattaaatcttatcacagagatgggcagactgccgacattcatgacacagaaaacacgtgatgcgttagacaacttagccgtattacacacagccgaagccggtggtcgcgcttacaaccacgcactgtccgaactccccgaaaccttggaaactctactattattaacactcttagcgacagtaacaggaggaatatttttatttctaatgtctggaagaggtattggaaaaatgacacttggaatgtgctgcatcattacagcctcaatactgttgtggtacgcccaaatacaacctcactggatagctgcttccataatattagagttcttcttaatagtactacttataccggagccagagaaacaaaggacaccccaagacaaccagttgacctacgttgtgattgcaatcttgactgtagtggctgcgacgatggctaacgagatggggttcctggagaaaactaagaaagacctcggactgggcagcatagcaacacaacaacctgaatccaatatactagatatagatttgagaccggccagtgcctggaccttatacgcggttgcaacaacatttgtcacacccatgttaagacatagtattgaaaattcatcagtaaacgtgtcactaacagctatcgccaaccaagcaactgttctcatggggctaggaaagggatggccattatccaaaatggatataggagtaccactgttagctattggatgttattcccaagtaaatcccataaccctgacagccgcacttttactacttgtagcgcactatgcaataatcggaccaggcttgcaagctaaagccacacgtgaggctcaaaaacgggcagctgctggtataatgaaaaaccccacagtggacgggatcacagtaatcgacctagatccaatcccatatgatccaaaatttgagaaacagctaggccaagtaatgttgctaattttatgtgtgacgcaagttctcatgatgcgcacaacatgggccctttgcgaggctctcacattagcgacaggtcctatatcaacattatgggagggaaatccaggcagattctggaacaccaccatagcagtatcaatggcaaatattttccggggatcatacctagcaggagctgggttactattttcaatcatgaagaatactactaacactcggcgtggaacgggtaacataggggaaactctaggcgaaaagtggaaatcgcgacttaatgcactaggaaaaagcgagtttcaaatatacaaaaagtcaggcattcaagaagtagatagaacactagccaaagaagggataaaaaggggcgaaaccgaccaccatgctgtatcaagaggatctgcaaaattgcgctggtttgtggaaagaaatatggttacccctgaaggcaaagttgtggatctcggttgtggacgagggggttggtcctattattgcggtggactcaaaaacgtaagggaagttaaagggctgactaagggtggccctggtcatgaggaacccataccaatgagtacgtatggatggaatctagttcgtctacaatcaggggttgacgtcttctttattccaccggagaaatgtgacacgctactatgcgacataggagagtcttccccaaacccgacagtagaagcaggtaggacactccgtgtcctcaaccttgttgaaaattggttaaacaataacactcaattctgtatcaaggtattgaatccatacatgccttccgtcattgagaagatggaagccttacaacgtaagtatggtggtgcattggtacgaaatcctttatcaagaaactcgactcatgaaatgtattgggtgtctaacgctagcggtaacatagtgagcagcgttaatatgatttcccgtatgctcattaatcgattcaccatgagacataaaaaggcgacttatgagcccgacgttgaccttggctctggaacacggaatataggcattgaaagtgagataccgaatttagacattataggcaaaagaatagagaaaattaaagaagaacatgagacctcttggcactacgaccaagaccacccttataaaacatgggcataccatggatcgtatgaaactaaacaaacaggttcagcttcgtcaatggttaatggtgtagtgagactccttacaaagccgtgggacgttttacctaccgttacacagatggcgatgactgacaccacacccttcggacaacagagagtatttaaagaaaaggttgacacacgcacgcaagaacccaaagaagggacaaagaaattaatgaaaataacagcagaatggttatggaaagaacttggtaaaaagaagacgccccgaatgtgcacgagggaagaatttacaagaaaagtacgatccaatgctgccctcggtgcgatttttacggatgaaaataaatggaagagtgcaagagaagccgtagaggattcacgattctgggagctagtagacaaggaaagaaatctacaccttgaaggcaaatgcgaaacatgcgtgtacaacatgatggggaaacgagaaaagaaattgggagaatttggaaaggcaaaaggcagtcgcgccatatggtatatgtggctaggagccaggttcctggaatttgaagcactaggatttttgaacgaagatcattggttctcgcgagagaacagcttatcaggagtagagggagaaggtctacataaactaggttatatcttgagagatgtctcaaagaaagaaggcggagcaatgtatgcggacgatacagcggggtgggatacacgcataaccctagaagatctcaaaaatgaggagatggtaacaaatcacatggaaggtgagcataaaaagttagcagaggcaatattcaaattaacatatcaaaataaagttgtccgtgtacaaaggcctacccctaggggaacagtcatggatataatatctcgacgggatcagagagggtcaggacaggtaggaacctatggacttaatacgttcacaaacatggaagcgcaactaattaggcaaatggaaggcgaaggagttttcaaaaacatccaacatctaaccgttaccgaagaagccgcagttcaaaattggctagctagggttggaagagaaagactgtcaagaatggcaatttctggcgatgattgtgtcgttaaaccattagacgaccgcttcgcaaacgcactgactgcgctaaacgacatgggaaaaatccgcaaggacatacaacagtgggaaccgagtaaaggctggaatgattggacgcaggttccattttgttctcatcacttccacgagttgattatgaaagacggccgggtattggttgtcccttgtagaaaccaagacgaattaattgggcgcgctagaataagtcagggtgcaggctggagtttaagagaaactgcatgcctagggaaatcatatgcacaaatgtggtcactaatgtactttcatcgaagagacctgaggctggctgcgaatgcaatatgctcggcggttccaagtcactgggttcctaccagtaggacaacatggtccatacatgcaaagcacgaatggatgaccactgaagacatgttaactgtatggaatagagtgtggatcagagaaaatccgtggatggaagataaaacgccagttgagtcatgggaggagatcccatacctcggtaaaagagaagatcaatggtgcggttctctgataggtctaacatcaagagcaacctgggctaaaaatatacaagctgcgattaatcaagtgagatcgctaataggtaacgaagaatacacagattatatgccctcgatgaaaaggttcagaagggaagaagaagaagcgggtgtgttatggtga

SEQ ID NO: 22318 - RNA, 9876 nt, synthetic construct
  misc_feature 1..9876: note = derived and/or modified CDS sequence (opt6) from DENV-2__GU131924__SS-prME
  source 1..9876: mol_type = other RNA
tcagctggtatgataatcatgttgataccaacagtaatggcatttcacctcacaactcgaaatggtgagccgcacatgatagtaggcatacaagaaaagggaaaaagtctcctgtttaaaacggaggacggtgtaaatatgtgcacacttatggcaatggacttaggagagttatgcgaagacacgattacatacaaatgccctctacttcgtcaaaacgaacctgaggatatagactgttggtgcaactccacatcaacttgggtaacttatggaacttgcactactaccggagaacatagaagagaaaagaggtcggtagccttggttccccacgtaggcatggggctagaaacaagaacggagacttggatgtcatcggaaggcgcttggaaacatgcgcaacggatcgaaacctggattttaaggcatccaggttttacaattatggcagctatcctcgcatacactatagggacaacacattttcagcgagtcttaatctttatactgctaaccgctgtagcaccatcaatgacgatgaggtgtataggaataagcaatcgggattttgtagaaggtgtatcaggaggctcctgggtagatatcgttttggagcacggatcatgcgtcacaaccatggcaaagaacaaacctacacttgattttgagttaatcaaaaccgaggcaaaacaaccggctacactaaggaaatactgtatagaagcgaaactaacgaatacaactacagagtcaaggtgcccgacacaaggagaacctagtctaaaagaggaacaagataaacgattcgtgtgcaaacactcgatggttgatagagggtggggtaatggatgtggcctgtttggaaaaggaggcatagttacgtgtgcaatgttcacatgtaagaagaatatggaaggaaaaattgtacagcccgagaatttagaatacactattgtcgttacgccacactcaggtgaagaacacgcggtcgggaatgacacaggaaaacatggtatggaaataaaagtaaccccccaaagctcgattacagaagcagaattaactggatatggtacggtgacaatggaatgctcaccgaggacaggactagacttcaatgaaatggtcctgttacaaatggaaaacaaagcctggttagtgcatcgccagtggtttctcgatctaccgctgccctggctgcctggtgctgataaacaagaaagcaactggattcaaaaggagacactagtaacattcaagaatccgcatgcaaaaaaacaagacgttgtagtcctcggatcacaagaaggcgccatgcataccgcactgaccggtgcaacggaaatacaaatgtcatcaggtaatttattatttacgggccacctaaaatgcaggttacgaatggataagctacaactcaaaggaatgtcatactctatgtgtacaggtaaatttaaagttgttaaagaaatagccgagactcaacatggtacgatcgtcattcgcgtacaatatgaaggagatggttctccatgtaagataccattcgagataatggatttagaaaaaagatatgtactgggaagactaataacagtgaaccctatcgtgacggagaaggactcaccggtgaacatagaagccgaacctccatttggtgacagctacataatcataggggtagaaccaggacagctaaagctaaactggttcaagaagggctccagtatcggccaaatgttcgaaactacaatgcgcggagctaaaagaatggctatattaggggacaccgcgtgggattttggctctttaggaggagttttcacaagcataggaaaagcactccatcaggtattcggagctatatatggagctgcgtttagcggggtatcgtggactatgaagatacttatcggtgtaatcattacgtggataggaatgaatagcaggtcgactagtctgtctgtatcgctcgtactagtaggaatagtaactttatatctaggagtaatggtacaagccgacagcggatgtgtagtatcatggaaaaataaagaactaaaatgtggatccggcatatttataacagacaacgttcacacatggacagaacaatataagtttcagccagaatctcctagtaaactcgctagcgctattcagaaagctcaagaggagggtatctgtggtatacgtagtgtcacacgtcttgaaaacctcatgtggaaacaaataacgccagaacttaatcatatattagccgaaaatgaagtgaagctaacaattatgacaggagatatcaaaggcattatgcaggcaggcaaacgaagtttacgtcctcaacctacagaattaaaatattcatggaaaacttggggcaaagctaaaatgctgagtacagaatcatacaatcagacatttcttatcgatggaccagagactgcagaatgtccaaatactaacagagcctggaatagcctagaggtagaagattatgggtttggagtatttactacaaatatttggttaaaactcaaagaaaaacaagatgctttctgcgatagcaaacttatgtctgccgcaattaaggacaatagagcagtccatgcagatatgggatattggatagagagcgcacttaatgatacatggaaaatagagaaagcgagttttatcgaagtcaaaaactgtcactggccaaagtcacataccctatggagcaatggcgtactagagtcagaaatgataattccaaaaaacctcgcgggtcccgtgtctcaacataattataggccaggctatcatactcaaatagcaggcccttggcaccttgggaagctagaaatggactttgacttttgcgatgggactaccgtaatcgtcacggaagattgtggaaacagaggacctagtctcagaactacaaccgccagcggaaaattaattacagaatggtgttgtaggtcctgcacacttcctccactcagatatagaggtgaagacggatgctggtatggaatggaaataaggcccctgaaagaaaaggaagagaatttggtaaattctctagtaactgcaggccatgggcaggttgataacttctctctaggagttttaggtatggcccttttcctcgaagagatgctaaggactagagtaggcaccaaacatgctatattactggttgcggtatcttttgtcactcttatcaccggaaacatgtcatttaaggatttgggcagggttgttgtaatggtaggtgctacaatggcggatgacataggtatgggcgtaacatacctagccctattagccgcatttaaagttagaccgactttcgctgccggactacttttaagaaagttgacttccaaagagctaatgatgacgacgatcggaatagtcttacttagccaatcgacaatacctgaaacagtcttggaactaactgatgcgcttgctctgggtatgatggtgctaaaaattgtacggaacatggaaaaatatcaattagcagttacaataatggccatactatgtgtacccaatgctgtgatccttcaaaacgcttggaaagtatcatgtacaatcttagcagtggtcagcgtatcacccctacttctcacctcgtctcagcaaaaaaccgattggatccctttagcgctaactataaagggattaaacccaacagccatttttttaacaacattaagcagaacaaacaaaaagagatcttggccgttaaatgaagcaataatggcagtgggaatggtcagcatactcgcatcaagcttacttaaaaacgacatacccatgaccggcccactagtagcgggcggactgttaactgtatgctacgtattgacgggccgatctgctgatttggaattggaacgagctacagatgtaaagtgggaagatcaagctgagatcagtgggtcgagccccattttatctattacgatctccgaagatgggtcaatgtctatcaaaaatgaagaggaagaacaaacgctaacaatattaatcagaactggtcttttagtaattagcggtttgttcccaattagtataccgataaccgctgctgcttggtatctatgggaagtaaagaaacaaagagccggtgtgctatgggacgtcccatctccccctccaatgggaaaagcagaactcgaagacggtgcatatcggataaaacaaaaaggcatactaggatactcgcagataggagctggagtatataaagagggaacttttcatacaatgtggcacgtaactcgaggtgcagtactcatgcataaaggaaaaagaatagaaccttcatgggctgatgtcaaaaaagacctaatatcatacggtggtggctggaaactagaaggagaatggaaggaaggtgaagaagtacaagtgctagccctcgaaccgggcaaaaatccccgagctgtacagactaagccaggactcttcaaaacaaacacgggtactatcggagcagtatcactagacttctctcccggcacaagtggcagcccaataattgataagaaaggaaaagtagtaggattgtacggaaacggggtcgtcacccgcagtggagcctacgtttcggcaatagcacaaaccgaaaaatcaatagaagacaatccagaaatcgaagacgatatatttagaaaacgacggcttactattatggacttacacccgggtgctgggaaaactaagaggtatttacctgctatagttagagaagcaataaaacgaggtctacgaacgttaatattagcgccaactcgagttgtagcagccgaaatggaagaagctttacgtggtcttccgattagatatcaaacgccagcaatacgcgcagagcacaccggaagagaaatagtcgatttaatgtgtcacgccacatttaccatgcgattattaagtcctgtacgggtcccaaattataacttaataattatggatgaggcgcactttactgatcctgcgtcaatagccgcaagaggttatatctccaccagagttgagatgggcgaagccgcaggtattttcatgacggcaacaccaccaggatccagggacccatttccacagagtaatgcacccataattgatgaagaacgagaaataccggaacgaagttggaatagcggccacgaatgggtgacagatttcaaaggaaaaacagtatggttcgttccctcaataaaagcgggcaacgacattgccgcgtgccttaggaagaacggaaaaaaagtaatacaactaagtagaaaaacctttgattcagagtatgtaaagacaagaactaatgattgggattttgttgtaacgacagacatatctgaaatgggagcaaattttaaagcagaaagggtaatagatccaagaagatgtatgaagcctgtgatcttaacagatggagaagaaagagtgatcctagcaggtccaatgccagttactcattcttcagcggctcagaggcgaggaagaataggaagaaatccgaaaaatgagaacgatcaatatatatatatgggagaacctctagaaaatgatgaggattgtgctcactggaaagaggctaagatgctactagataacataaatactccagaaggtatcataccatccatgttcgaaccagaaagagaaaaagtagatgcaatcgatggcgaatatagattgagaggtgaagctcgcaaaacattcgtcgatttgatgaggaggggagacttaccggtgtggcttgcatataaggtggcagctgaaggaattaactatgcagatagacggtggtgttttgacggtataaaaaataaccagattttagaagagaacgtggaggtagaaatttggaccaaagaaggcgaacgtaaaaaactaaagccgcgttggttggatgcaagaatatactcggacccgctagcattgaaagaattcaaggagtttgcagctggacgcaaatccttaaccctcaaccttattactgaaatgggccggctaccaacgtttatgacacagaaaactcgagacgctttggataatttagctgttctgcatactgcagaagcaggtgggagagcgtataaccacgctcttagcgaattacctgaaacactcgaaaccttgttgttacttacacttctagcaacagtcactggcggaatcttcctgtttctaatgagtggtcgaggtataggtaagatgaccttaggaatgtgctgcataattacggccagcatactcctgtggtacgctcagatccaaccacattggattgctgcatcaattatactagagtttttcttaatcgttttattaatccctgagccggaaaaacagagaacaccgcaagataaccagttaacctacgtcgtgattgcgatattgacggttgtagcggctactatggccaacgaaatggggtttttagaaaaaactaaaaaagacttaggactgggttctatagctactcaacaacctgagtccaacattcttgacattgatctaagacctgcatctgcttggactctctatgcggtagcaacaacttttgtcacaccaatgttgcgacactcgattgagaattctagtgtgaacgtcagtcttaccgctatagcaaatcaagctacggttctcatgggactaggcaagggttggccattaagcaaaatggatataggagttccgctcttagccatcggctgttattcacaagttaatcctataaccctcacagctgccttgttgttacttgttgctcattatgcgatcataggacctggattgcaagcaaaagccacccgcgaagcacaaaaacgggcagcagccggcataatgaaaaatccaacagttgacggaattacggtcatagacttagacccaatcccatatgatcccaaattcgaaaaacaactaggccaggtcatgcttttaatcttgtgtgtcacacaagtcctaatgatgagaacaacttgggcactatgcgaagcactaactctagccacaggacctatctcaacgttatgggaagggaacccaggtagattctggaacacgacaatagcagtcagtatggctaacatattccgaggatcctatcttgcaggggcgggtctgctattttcgattaagaaaaacacaacaaacactcgtagaggaacaggcaacatcggagaaacgctaggagaaaaatggaaatctagactgaacgcactcggcaaaagtgaatttcagatttacaaaaagagcgggatacaggaggttgatagaacactggctaaggaaggtattaaaagaggagaaactgatcatcacgctgttagtcgaggcagtgcaaaactaagatggtttgtcgaaaggaatatggtgaccccagaaggtaaagtggtagaccttggatgcgggcgaggcggctggtcatattattgtggaggtctaaaaaatgtgcgagaggtaaagggattaactaaaggaggacccggacatgaagaaccgataccgatgagtacatatggctggaacctcgtacggcttcagagtggagtagatgtattcttcataccgcccgaaaagtgcgacacactgctttgtgacataggagagagtagcccaaacccgacagtagaagcaggaagaactctccgagtattaaacttggtggaaaactggttaaacaacaacacacagttttgtatcaaggtacttaacccatatatgccaagcgtaatcgaaaagatggaagccttacagagaaaatatggtggagcactcgtgagaaaccccttgtccagaaacagtacacacgaaatgtattgggtgtccaacgcgtctggcaatattgtaagtagtgttaacatgattagcagaatgttaataaataggtttacaatgagacataaaaaagccacttatgagcctgacgtagatctaggcagcggaacgcgaaacataggcattgagagtgaaatcccgaatttagacataatcggtaagagaatagagaaaataaaagaggaacatgaaaccagctggcattacgatcaagatcacccctacaaaacatgggcatatcacggttcctatgaaacaaaacaaactggtagtgccagttcaatggttaacggggtagttcgcttattaactaaaccatgggacgtccttcctacagtaacccagatggctatgactgatacaaccccgttcgggcaacagcgagtattcaaagagaaggtagatacgagaacccaagaaccaaaagaaggaacaaaaaagctaatgaagataactgcagaatggctatggaaagaactcggtaaaaaaaagacaccgagaatgtgtacacgcgaagaatttacgagaaaggttagatccaatgcagcactcggagccatttttaccgacgaaaacaaatggaaaagtgcgcgcgaagctgttgaagatagtcggttttgggagttagtggataaagaacgtaatcttcaccttgaagggaagtgtgagacctgcgtatacaacatgatgggcaagagagaaaaaaaattaggcgagtttgggaaagcaaaaggttcccgggcaatttggtatatgtggctaggtgcgagatttctagagtttgaagccctcggttttctgaatgaagatcattggttttcaagagaaaattcgttatctggagtagaaggtgaaggactacataagttgggttatatcttaagagatgtctcaaaaaaagaaggaggtgctatgtacgcagatgatactgctggttgggacacacggataacgttagaggacttaaaaaatgaggaaattgtaacaaatcacatggaaggagaacataaaaaactagcagaagccatttttaaattaacatatcaaaataaagtagttagagttcaaagacccacacctcgtggcacagtgatggacatcatttcgcgcagagatcaaagaggaagtggacaagtaggaacatatggattgaacaccttcacaaatatggaagctcagttgattagacaaatggaaggggaaggagtgttcaaaaacatacaacatctcactgtaacagaagaggcagctgttcaaaattggctagcaagagtaggtcgtgaaaggctttcacgaatggcaataagtggggacgactgtgtagtgaagccattggacgatagattcgccaatgcccttacagcgttaaatgatatggggaaaattcgaaaagatatccagcaatgggaaccttcaaaaggatggaatgactggacccaagttcccttctgttcgcatcactttcatgagctgataatgaaagatgggagagtgctcgtcgttccctgtcgaaatcaagatgaattaataggtcgtgcacgcatatcacaaggagctggttggagtttaagggaaacggcttgtctaggaaaaagctatgcacaaatgtggtctttgatgtactttcatagaagagatttgcgactagcggctaatgctatatgtagtgcagtcccaagccactgggtgccaacgtctcgtactacttggtcaattcatgccaaacacgaatggatgaccactgaagatatgttaactgtctggaatagagtgtggatccgtgaaaatccatggatggaagataagacccccgtcgaaagttgggaagaaataccttatctaggcaagcgcgaggatcaatggtgtggatcactcataggcctcacaagcagggcgacctgggcaaaaaacattcaggccgctatcaatcaagtacgatccttgataggaaatgaagaatacactgattacatgccgagcatgaagaggttcaggcgggaagaagaagaggcaggcgtcctgtggtag

SEQ ID NO: 22319 - RNA, 9876 nt, synthetic construct
  misc_feature 1..9876: note = derived and/or modified CDS sequence (opt6) from DENV-2__GQ868638__SS-prME
  source 1..9876: mol_type = other RNA
tcagctggtatgataattatgctaattccaacagtaatggcatttcatttaacgacaagaaatggtgaaccacacatgatagtagggattcaagaaaaaggaaaatcactattatttaaaactgaagacggagttaatatgtgtacccttatggcaatggatttgggagaattatgtgaagataccataacctataaatgtccattgctacgtcaaaacgaaccggaagacatcgactgctggtgcaatagtacctcaacatgggtaacctacggaacctgtaccaccactggagaacacagacgcgagaaaagaagcgtggcattggtaccacatgtaggaatggggctagaaactcgtacagaaacctggatgtcatccgaaggagcatggaaacatgctcaaagaatagaaacttggatcttgcgacatccaggattcacaatcatggcggccatactggcctacactataggaacgacacattttcaacgagcgttaatattcattcttttaaccgccgtggctccttctatgacgatgcgatgcataggtatttccaatagagactttgtggagggagtgtccggagggtcatgggtggacattgtattagaacatggatcctgtgtgacgaccatggctaaaaataaaccaactctagattttgagttgataaaaactgaagcgaaacaacctgctactctcagaaaatattgtatagaggcaaaattaacgaatacaacgactgagtctagatgcccaactcaaggtgaaccatcactaaaagaggagcaagacaaaagatttgtatgcaaacattcaatggttgatagaggttggggaaatggatgcgggctatttggaaaaggcggtatagtaacatgcgctatgttcacatgtaagaaaaatatggaggggaaaatagtacaacccgaaaacctagaatacacaatagtagtcacgcctcatagtggagaggaacatgcagtaggcaacgatacaggtaaacatggtaaagaaataaaagttacaccacagtcctcaattacagaagcagaactgacgggatatggaaccgtaaccatggaatgctcgccgcgaacagggttagactttaacgaaatggtcctgttacaaatggaaaacaaagcatggctagtacaccgacaatggtttttagaccttccattgccctggttgcctggtgcagataaacaaggatcaaattggatccagaaagaaactttagtgacattcaaaaatcctcatgcaaagaaacaagacgtagtagttttagggtctcaggaaggggctatgcataccgcgttaactggagccacagaaattcagatgtcttcaggcaatcttttatttacaggacacctgaaatgtaggttacgtatggataagctacaattgaaaggaatgagttattcaatgtgcacgggtaagttcaaggttgtaaaagaaattgcagaaacccaacatggaacaatagtaataaggctccagtatgaaggagatggcagtccatgtaagatcccattcgaaataatggacctagagaaaaggtacgttttagggcggttgataacggtaaacccgattgtcactgaaaaagattcaccagtaaatattgaagccgaaccgccctttggagactcctatataatcattggagtagagccaggtcaattaaaattaaactggtttaagaaaggaagctcaattggtcaaatgtttgaaacgacaatgcgcggagcaaagagaatggcaatactaggggacacagcttgggattttggatctttaggtggagtttttacgagcgttgggaaagcacttcaccaaatcttcggagcaatttacggggctgcattctccggggtatcgtggacaatgaaaatactaataggagtaataataacatggataggtatgaacagtcgatcaacaagcctgagcgtatctctagtactggtaggaatcgtcaccttgtacctaggagtaatggtccaagctgatagtggatgtgtagtatcatggaaaaacaaagaattgaaatgcggaagtgggatcttcataactgacaatgtacatacctggacagagcaatacaagtttcagccagaatcaccttcgaagttagcttcggcgatccaaaaggcccaggaagaaggcatatgtggaatccgctctgtaacaagacttgaaaacctaatgtggaagcaaattacaccggaattaaaccatatactagcagagaatgaagtaaaacttacgatcatgacaggcgacataaaaggcatcatgcaagctgggaaacgctcactacgtccacaacctacagagcttaaatactcctggaaaacatggggcaaagcgaaaatgctaagtactgaatctcataaccagacatttctaatcgacggaccagagactgctgaatgtccgaataccaatagagcatggaactcgctagaagtagaagactatggatttggcgtgttcacaacgaatatatggttgaaactgaaagagaagcaagacgctttttgtgactccaagctaatgtctgctgctattaaggacaacagagcagtccatgcagacatgggatattggattgaatccgcgttaaacgatacctggaaaattgaaaaagccagttttattgaagtcaaaaactgtcattggccgaaaagccacaccttgtggtcaaatggagtcctggagagcgaaatgattattcccaagaatctcgccggacccgtttcccaacacaactatagaccaggttatcatactcagaccgcgggcccttggcatttaggtaaactagaaatggacttcgatttttgtgatggaactacggtaatcgtaacagaagactgcggtaatagaggcccaagtttacgaacaaccacggcctcagggaaattaataacagaatggtgctgcagatcctgtacacttccaccattaagatacagaggtgaagatggttgttggtacggtatggaaattaggcccctcaaggagaaagaggaaaatttagtaaatagtttagtcacagctggacatggccaagtcgacaatttttccctcggagttctaggaatggcactgttcctcgaagaaatgcttcggactcgagttggaacaaaacacgcaatcctattagtagcggtctcatttgtaacactaatcacaggaaacatgtcttttaaagatctaggcagagtggtcgtcatggtcggagcaacaatgaccgatgatattggcatgggggtcacctacttagccctactggcagcctttaaggtgagacccacattcgcagcgggattactactaagaaaattgacaagtaaagaattaatgatgactacgattggtatcgtactcctatcccaatcgacaatacccgaaacaatcttagaactgactgacgcattggcccttgggatgatggtattgaaaatcgtgagagatatggaaaaataccaattagcagtaacaataatggccatattgtgcgtacccaacgctgtaatattacaaaatgcatggaaagtgtcctgtacaatattagcggtagtaagtgtatcgcctttattgcttacgtcaagtcaacagaaaactgattggataccactggcgcttactataaaaggactgaatcctactgccattttcctcacaacactatcaagaaccaacaagaaacgttcttggcctttaaatgaagctatcatggcagtcggtatggtttcaatattagcaagctcactacttaaaaatgatataccaatgactggaccgctagtagccggtggactattaactgtgtgttacgttttaacagggcgaagtgcagatttagaattggaacgagccaccgacgtcaagtgggaagaccaagctgaaatatctggaagcagtcctatattatccattacaatatcagaggacgggagtatgtcaatcaagaacgaagaagaagaacagactctcactattctcataagaaccggcctattagttatttcaggtctgtttcctgtgagtattcccatcactgctgcagcttggtatttatgggaagttaagaaacaacgggctggagtgctctgggacgtaccatcaccaccgccaatgggaaaagcagagttagaagatggtgcctatcgcatcaagcaaaagggaatactagggtatagtcagatcggagccggtgtatataaagagggaactttccatacaatgtggcacgttactagaggcgcagtattaatgcataaaggtaagcgaatagaaccttcatgggccgacgtaaagaaagaccttataagctatggaggaggatggaaacttgaaggagagtggaaagaaggtgaggaagtccaagttttagcactagagcccggtaaaaatcccagagcagtacaaaccaaacccggattatttaaaacaaacacaggcacaatcggcgcggtcagcttagacttttctcctggaacaagcggtagccctataattgacaagaaaggaaaggttgtcggtttatacgggaacggagtagtaacccgcagtggcgcgtatgtaagtgcaattgctcagacagaaaaatcaatagaagataatccagaaattgaagatgacatatttcgaaagaggaggcttactataatggaccttcacccaggagcgggtaaaactaagcgatacttacccgcaattgtacgagaagctattaaacgaggattacgaacgctaattcttgctccaacaagagtagtagctgccgaaatggaggaagcattaagaggattgcctataagataccaaacgccagcaatacgagcagaacacacaggacgtgagattgtagatttaatgtgccacgcaacatttacaatgaggctgttaagcccggtcagagtacctaactataacctgataatcatggacgaggctcatttcaccgatccagctagcatagcagcaaggggatatataagtacgcgtgtagaaatgggcgaagccgcaggaatctttatgacagccaccccgccgggatcgcgtgatccatttccgcaatctaacgctcccatcattgacgaagaaagagaaataccggaacgctcatggaacagtgggcacgaatgggttacagatttcaaaggcaagacggtttggtttgttccaagtatcaaagcaggaaacgatatagctgcatgtttaaggaaaaatggaaagaaagtaatacagctcagtagaaagacttttgactcagaatatgtcaaaacgagaactaatgactgggactttgtagttacaaccgatataagcgaaatgggcgcaaattttaaagctgacagggtcatagaccctcgacggtgtatgaaaccggttatactaacagacggagaggaaagagtaatattggctggaccaatgcctgtaacgcattcatcggcagcacagcgtagaggacggataggcagaaatcccaaaaacgagaacgaccaatacatctatatgggtgaacctctagagaacgacgaagactgtgcgcattggaaggaagctaaaatgcttttagacaatataaacacccctgaagggattattccaagtatgttcgagcccgaaagggaaaaggtggacgcgatagacggagaatatagattaaggggagaagcgagaaaaacatttgttgatctaatgaggagaggggaccttccagtctggttagcttacaaagtggcagcggaaggtatcaactacgcggaccgacgttggtgcttcgacggaataaagaataaccagatacttgaagagaatgtggaagtcgaaatttggaccaaagagggcgagcggaagaaactcaaaccacgttggttagacgcgaggatatatagtgatccattagcattaaaagaatttaaagagttcgcagcgggaaggaaatcactaacactaaatttaataactgaaatgggaaggttaccgacattcatgactcagaaaacgcgagatgcattagataacctagctgtactccatactgcagaagctggagggagggcttataatcatgcactaagtgaacttccagaaacactagaaacactcttactattaactttgcttgcaacggttaccggtggtatctttcttttcctaatgagtggccgaggaataggaaaaatgacgcttggaatgtgttgtataataacagcatcaattcttttgtggtatgctcagattcaaccccattggatcgcagcaagtatcatattagaatttttcctaatcgtcctattaataccggaaccggaaaaacaacgcacaccccaagataaccaattaacatatgtcgttatagcaatcttaactgtagtagcggcaactatggcaaatgaaatgggttttcttgagaaaactaaaaaggacttagggctaggaagtattgccacccagcagccagagagtaatatcctagacattgacttacgacctgcttcagcttggacgttatacgcagtagcgactacattcgtaactccaatgttgagacatagcatcgaaaattcctcagtgaacgttagcctaacagcaattgcaaatcaagcgacggtgcttatggggttagggaaaggttggccactatcaaaaatggatataggagtaccactactcgcaatcggctgctattctcaagtgaatcctataacattaacagctgctttgctcctactcgtggcgcactatgcgataataggcccagggttacaagcaaaagctactcgtgaagcacagaaaagagcggcagctggtattatgaaaaatccaacggtcgatggcataacagtcattgacttagaccccataccttatgaccccaaatttgaaaaacaattggggcaagtaatgctcttaatactttgtgttacgcaagtattgatgatgagaaccacatgggctctttgcgaggcgctaaccctagctacaggacctatttctactttatgggagggtaatcctggtagattctggaataccaccatagcggtgagcatggctaacatatttcgaggaagctacttagcaggagccggacttttattctccataatgaaaaacacaaccaacactaggcgcggtactggaaacatcggagaaacgctcggggaaaagtggaaatcacgcttaaatgcactgggaaaaagcgagttccaaacttacaaaaagagtggaatccaggaagtggacagaaccttagccaaggaagggataaaacgaggtgaaacggatcaccatgctgtttccagaggttcagctaagttacgctggtttgtagaacgcaatatggtaacacccgaaggaaaagttgttgatcttgggtgtggtagaggaggatggtcctattactgcggcggtcttaagaacgttcgggaggtgaaaggtttaacgaaagggggacctggccacgaagaaccaatcccgatgtccacttatgggtggaacctcgtacggcttcagagtggagttgacgtgttctttattccgcctgaaaagtgcgataccctactgtgcgatataggagaaagttctccaaatcctacggtagaggcaggcaggacactaagagtcttaaacttagtggaaaattggctaaacaacaatacacaattttgcataaaagtattaaatccatatatgccgagcgttattgagaaaatggaagcccttcaacgaaagtatggaggtgcactcgtgagaaatccgttatcacgaaattcgacgcacgagatgtactgggtttctaatgcaagtggaaacatcgttagtagcgtaaacatgattagtaggatgcttatcaatagattcacaatgagacataagaaagctacatatgagccggacgtagatctcggatcagggacaagaaatataggaatagaatcagaaatacccaacttagatataatagggaagcgcattgaaaagatcaagcaagaacatgaaacgagctggcactacgatcaggaccatccctataaaacatgggcataccacggatcatatgaaacgaaacaaactggatcggccagttcgatggtaaacggagtagttaggttactgacaaaaccatgggacgtactcccgacagtgacgcaaatggctatgaccgacaccaccccatttgggcaacaacgagtttttaaggagaaagtagacacaagggcacaagagccaaaagaaggcacaaagaaactgatgaaaattactgcggaatggttatggaaagaacttgggaaaaagaaaacaccgaggatgtgcaccagagaagaatttacacgtaaagtccgcagtaatgcagcattaggagcaatctttacagacgaaaacaagtggaaaagcgcgagagaagcagttgaagacagccggttctgggagttagttgataaagagagaaatctccatctcgaagggaagtgcgaaacttgcgtgtataacatgatgggaaaaagagagaaaaagctgggggagtttgggaaagcaaaaggatctcgggctatttggtatatgtggttaggagctaggtttctggagttcgaagcccttggatttctgaacgaggaccactggtttagtcgagaaaattcactatcaggggtggaaggcgaagggctgcataaattagggtatatcttgcgcgatgtaagcaagaaagaaggaggggcaatgtacgctgatgatacagcaggatgggatactagaattacgctagaagatttaaagaatgaagaaatggtaacgaaccacatggaaggcgagcacaagaaattggccgaagcgatattcaagctaacctatcaaaataaagtagttagagtgcagcgaccaactccaagagggaccgtaatggatattatttcaaggagagaccaacgaggatctggacaggttggtacatatggattaaatacatttacaaacatggaagcccaactcattcgacaaatggagggagaaggtgtatttcgtaatatacagcatttaaccgccactgaggaagtggcagttcagaattggctagcgcgcgtaggtagggaacgattatctagaatggcaatatctggcgacgattgtgtcgtaaagccccttgatgatagatttgcaaatgcactaacagcgctaaatgacatgggcaaaattagaaaagacatacaacaatgggagcccagtaagggctggaatgattggacgcaagttcctttttgtagccatcactttcatgagctcataatgaaggacggtcgcgtcctagtagttccctgtcggaaccaagatgaactcatcggcagagcaagaatatctcaaggagcgggttggtccctgcgagaaacagcatgcttaggtaaatcatacgctcagatgtggagtttaatgtacttccaccgcagagacctacgtctcgcagcaaacgcaatatgctctgcggtaccatctcactgggtgcctacaagtcggacaacatggagcattcacgcaaaacacgagtggatgacaacggaggatatgttgacagtatggaacagggtttggattagagagaacccctggatggaggataaaactccagtagaaagctgggaagaaataccttatcttggcaagcgagaagaccaatggtgtgggagcttgattggcctaacctcacgcgctacgtgggctaagaacattcaagcggcaattaatcaagttcgttccttgataggtaatgaggaatacacagactatatgccaagtatgaaacgattcaggagggaagaagaggaggcaggcgtgttatggtaa

SEQ ID NO: 22320 - RNA, 9876 nt, synthetic construct
  misc_feature 1..9876: note = derived and/or modified CDS sequence (opt6) from DENV-2__GU131927__SS-prME
  source 1..9876: mol_type = other RNA
tcagctggtatgataataatgttgataccgactgtaatggcatttcatttaaccactaggaatggcgaaccccacatgatagttggaattcaggaaaaaggcaaaagtctattattcaagacagaggatggtgtcaacatgtgtaccttaatggctatggacttaggagaactttgtgaagatactattacgtacaagtgccccctattaagacaaaacgaacccgaggatatagattgttggtgtaattcgactagcacgtgggtcacatacggcacgtgcaccactacaggagaacatagaagagaaaaacgatccgttgcgctagtaccacatgtgggtatggggttagaaacaagaactgaaacctggatgagcagtgagggagcatggaagcacgctcaacgaatcgagacttggatactacgacacccaggatttactataatggcagcaattctcgcgtatacaataggaaccactcattttcaacgagcattgatttttattttattgacagcagtagctccctccatgacaatgagatgtataggaatatcgaatcgagatttcgtcgaaggagtgagcggtggaagctgggttgatatagttctggagcatggttcatgtgttacaactatggctaggaacaagccgaccttagattttgaacttattaagacggaagccaagcaacctgcaacactaaggaagtactgcattgaggctaaactaactaacacaacaactgagtctagatgccctactcagggagagccctctttaaaggaagaacaagataaacgttttgtgtgtaaacatagtatggtagatcgaggatgggggaacggttgcggtttattcgggaaaggcggaattgtaacgtgtgcaatgtttacttgtaaaaaaaatatggaaggaaaaatagttcaaccagagaatttagagtatactatagttgtcactcctcactccggggaagagcacgcagtcggcaatgatacggggaaacatggaaaggaaatcaaagtcacaccgcagagttctattacagaagctgagctgactggctatgggacagtaacgatggaatgttcacctaggactggactagactttaatgagatggtattattacaaatggaaaacaaggcctggttggtacaccgacaatggttcctcgacctgccattaccgtggctgcccggcgccgacaagcaagaaagcaattggatccagaaagaaaccctggtaacttttaaaaacccccacgctaagaaacaagatgtcgtcgttctaggcagtcaagagggcgccatgcatactgcattaacaggcgcaacagaaatccaaatgtccagcggaaacctattatttacgggtcatttaaaatgtcgactaagaatggataagctacaacttaagggcatgtcttactcaatgtgcactgggaagttcaaagtggtgaaggagatcgcagaaactcaacatggtaccatagtaattagagtgcaatacgagggagacggatcaccttgcaaaataccatttgaaataatggatttggaaaaaaggtatgtattgggtagacttataactgtgaatcctatcgtcactgaaaaagactcacctgttaacatcgaagccgaacctccatttggggacagttacattatcataggggttgaaccaggacaactaaaattaaactggttcaaaaaggggagtagcatcgggcaaatgtttgagacaactatgagaggggctaaaagaatggcgattttaggagacactgcatgggactttggaagcctggggggtgtctttacgtcagttggcaaagctctgcatcaagtttttggcgcgatatacggtgccgcattcagtggcgtaagctggactatgaaaatcttgataggcgtcattattacgtggataggtatgaattcacggagcactagtttgtcagtttcattagtcctagtcggtattgtcactctttacctaggagtcatggtccaagctgactctggatgcgtagtttcgtggaaaaacaaagagttgaagtgtgggagcggcatattcatcacagataacgtacacacttggacagaacaatataaatttcagccagaatccccttccaagctggcttcagcaattcaaaaagcacaggaagaaggaatttgcggtattcgatccgttacacgtctagagaatttaatgtggaagcaaattacaccagagttaaatcacatcctcgccgaaaacgaggtaaaactaacaataatgacgggggacattaagggcatcatgcaagcgggacggagatcattgagaccccagccaactgaactcaaatactcatggaaaacctggggtaaggcaaagatgctatcgaccgaaagttataaccaaacttttttaatcgacggtccggaaacaacagaatgtccgaatgcaaaccgcgcatggaacagtctggaggtagaagactacgggtttggagtgttcacaacaaatatatggctaaaactaaaagaaaaacaagacgcgttttgtgatagtaagctcatgagcgctgctataaaggataatagagcagtacacgcagatatgggatactggatagaatccgcattgaatgacacttggaagatcgaaaaagctagttttatagaagtaaagaactgtcattggccaaagtcacatactctctggtcgaacggagtgcttgaaagtgaaatgataattccgaagagcttagcgggcccggttagtcaacacaattatcgaccaggttatcatacacagatcgctgggccatggcatctcgggaaattagagatggacttcgatttctgcgacggaactaccgtaatagtaactgaggattgcgggaatagagggccatcactcagaaccaccacggctagtggcaaactaataacagaatggtgctgtcgttcttgcaccttacctccattaagatatcgcggagaagatggttgttggtatggtatggagataaggccgctaaaagagaaggaggagaacttggtaaactctctggttaccgccgggcatggacaagtggataacttcagcttaggcgttttaggcatggcgttgtttttggaagaaatgttaagaaccagagtaggaaccaagcatgctattctcttagtcgcggtctcttttgtaacacttataacagggaatatgagttttaaggatctaggacgggtagtagttatggtcggagccaccatggcagatgacataggaatgggtgtaacatacttagctttactagctgcttttaaagtgaggccaacatttgcagctggcttgctactacgaaagttaactagtaaagaacttatgatgactacaataggaatagttctattatcgcaaagtaccatcccagaaacaatactagagttaactgacgcattggccctaggcatgatggtcctcaagatagtaagaaacatggagaagtatcaacttgctgtaaccataatggccattctttgtgtgccaaacgcggttatattacaaaatgcgtggaaagtgtcttgcacaatactcgcagttgtaagcgtatcgccacttctactaacctcatcacaacaaaagacagattggattccattggctttaaccatcaaaggcctgaaccctacggcaatattcttaactacattatcacgcacaaacaagaagcgatcctggccattaaatgaagcaattatggcagtaggaatggtatcaattcttgcatcctcactactaaaaaatgacatacccatgactggcccactagtggctggaggactgcttactgtatgttacgtattaacaggtcgctcagccgatttagaactagaacgtgctaccgatgttaagtgggaggagcaagcagaaatatctggctcaagcccaatattgagtataacaattagcgaagatggtagtatgtcaattaaaaacgaagaagaagaacaaactttaactatccttataagaacaggacttctcgtgatctctggactatttcctataagtatacctataacagcagctgcatggtacttgtgggaagtaaaaaaacaaagggctggtgtgctgtgggacgtgccatccccgccaccgatgggaaaggctgagcttgaagacggtgcgtaccgaataaagcaaaaaggcatacttggatacagccagatcggagccggcgtatacaaggaaggaacatttcacactatgtggcacgttacacgcggtgcagtgttgatgcataaaggaaaacgtattgaacccagctgggcggatgtgaaaaaagatcttataagctacggaggtggatggaaattggaaggagagtggaaggaaggtgaagaagtacaagtattagcactagaaccaggtaagaacccaagggcagtgcaaactaagcctggtctatttaaaacaaatacagggaccataggtgcagtcagtctagatttttcgcctgggacatcagggagcccaataatcgataaaaagggtaaagtagtcgggttatatggaaacggagtcgtaacacgatcaggagcttatgtgtcagcaattgcacaaaccgaaaaatctacagaggataatccagaaatagaagatgatatctttagaaaaagaagattaaccattatggacttacatccaggagccggaaaaactaagaggtacctgcctgctatagttagagaagcaataaaaagaggtcttagaaccttaatcctagcaccaacaagagttgtagccgcagaaatggaggaagcgttaagaggactaccaataagatatcaaactccagcaatacgcgcggagcacacgggacgagaaatagtggacttaatgtgccatgctactttcacaatgcggctattaagtccagtaagagtacccaattacaatctaataattatggatgaagcccattttacggatcctgcatctatagcagctcggggctatatatccactagggttgaaatgggagaagctgccgggatcttcatgactgcaacaccccccggtagtagagatccttttcctcaatcaaatgcgccaattatagatgaagaaagagagattccagaacggtcgtggaacagcggtcacgaatgggtaaccgatttcaagggaaaaacagtgtggttcgtaccatcaataaaagctggaaatgacattgcagcctgtcttcgaaagaatgggaagaaagtaatacagctatccagaaaaacctttgacagcgaatatgtaaaaacacgaacaaatgactgggatttcgttgtgactacagacattagtgagatgggtgctaacttcaaagcagaaagggtcattgaccccagaagatgtatgaagccagtaattctaacagatggcgaagaacgagtaatactcgccggccccatgccagtaacacattccagcgccgcacaacggagaggtcggatcggcagaaatcccaaaaatgaaaacgaccaatatatctatatgggggagcctcttgaaaacgacgaagattgcgctcattggaaggaagctaaaatgttgctagacaatattaatacaccggaaggcattataccatcgatgttcgaacctgaacgtgagaaagtcgacgcaatcgacggagaatacagattaaggggcgaagccagaaaaacttttgtcgatctcatgagaagaggtgacctaccagtttggctcgcctacaaagtcgctgctgaaggcataaattacgctgacagacgttggtgcttcgacggtatcaaaaataatcaaattttggaggagaatgtagaggtagaaatttggactaaggaaggggaacggaaaaagcttaaaccacgctggttagatgctcgtatttactctgaccccctagccttgaaagaatttaaagagttcgccgcgggacgaaaatcgcttacattaaatctgataaccgaaatggggcgactcccaacatttatgacgcaaaagacaagagacgctctagacaatctagcagtgttacataccgcagaagcaggaggtagagcctacaatcacgctctaagtgaactacccgaaactctagaaacattacttttactaacgttattggcaactgtaacagggggaatattcttgtttttaatgtcagggagaggcataggaaaaatgacattgggtatgtgctgtattattaccgcctccattctattgtggtatgcccaaatacaaccacattggatagcggcgtcgattatactagaattctttctaatagtcctgttaataccggagcctgaaaaacaaagaactccacaggataaccaactaacctacgtcgtgatagctatactaaccgttgtagcggctaccatggcaaatgaaatgggttttctagagaagaccaaaaaggacttaggattaggctctatagccactcaacaacccgaatccaatatactagacatcgacttaagaccagcttctgcctggacactgtacgcggtagcaacaacattcataacaccaatgttacgtcatagtatagaaaattcatcggtaaatacatctttaaccgcaatcgctaaccaggcaaccgttctgatgggcttgggcaaaggatggcctttatcaaaaatggacataggagttcctctcttggctattgggtgttattctcaggtaaatccaattactttaactgctgctttattactcttggtagcacattatgcaataataggccccggactgcaggccaaagcaactcgtgaagcgcaaaaacgcgcagctgccgggataatgaaaaatcccactgtcgatgggataacagtgatagacttggatcctataccatatgaccccaaatttgaaaaacagcttggacaagtcatgctattgattctctgcgtaacacaagtattaatgatgcgaacaacatgggcgctgtgcgaggctttaacgttagcaactggaccaataagtaccttgtgggaaggcaaccctggacgtttttggaacaccaccatagcggtaagcatggcgaatatatttcgtggttcctacctagcaggagcgggactactattttctatcatgaaaaatactacaaatacacgaagaggtacagggaatatcggcgaaactttaggagaaaagtggaagagccggttaaatgcactagggaaaagcgaattccaaatctataaaaaatctggtattcaagaggtagatcgcactttagccaaagaaggaataaaaagaggcgaaaccgatcaccacgccgtatcaagaggatccgctaaacttagatggttcgtagaaaggaatatggtaactccggaaggaaaggtggtcgatttagggtgtggtcgaggcgggtggtcttattattgtgggggactaaaaaatgtaaaagaagttaagggtttaacgaaaggtggcccgggtcacgaagaacccattccaatgagtacgtatgggtggaacctagttcgcttgcaatcgggtgttgacgtattttttattcctccggaaaaatgcgatacattactatgtgatattggagaatccagtcccaatccaaccgtagaagcaggtcgaacgttgagagtactcaacctagtagaaaattggctaaataacaatacacaattttgtatcaaagttttaaatccgtacatgccatctgtaatcgagaaaatggaagcattacaaagaaaatatggcggagcacttgtacgaaatcccctctcaaggaacagtacacacgagatgtactgggtgtcaaatgcttcaggaaatattgtcagcagcgttaatatgatttccaggatgttgataaaccggttcaccatgagacataaaaaagcaacctatgaacccgatgtagatctaggatcaggtacacgaaatatagggatagaaagcgaagtccccaacttggacattattggaaaaagaattgaaaaaattaagcaggaacatgaaacgtcgtggcattacgatcaagatcatccgtacaaaacctgggcctaccatgggtcgtatgaaactactcagactgggagcgcatcatctatggtaaatggggttgttagactgttaactaaaccctgggatgtcctcccaaccgttacacagatggcaatgacagacactacaccatttggtcagcaaagggtttttaaagaaaaagtggacacacgcacacaagagccaaaagagggaactaagaaattaatgaagatcaccgccgaatggctgtggaaagaactaggtaaaaagaagacaccccgtatgtgtacaagagaagaatttacacgtaaagtaaggtccaatgccgcacttggagcaatttttacggacgaaaacaaatggaaatcagctagagaagcggtagaagatagtagattctgggagcttgtagacaaagagagaaatttgcatcttgaaggcaagtgtgagacttgtgtatacaatatgatgggtaaaagggagaaaaaactaggggaatttgggaaggcaaagggctccagagcgatttggtatatgtggttgggcgcaaggtttttggaattcgaagcgttaggatttcttaatgaagatcattggtttagcagggaaaattcactatcaggagtcgaaggcgaaggacttcataaattaggatatatactacgtgatgttagcaagaaagaaggaggggcgatgtacgcagacgatacagctggctgggacacgagaataactctggaagacttaaaaaatgaagaaatggtcactaaccacatgaaaggggaacacaagaaattagcagaagctatatttaaattaacgtatcaaaataaagtagttagagtacagcgcccaacaccgaggggaacggtgatggatataatatcaagacgagaccaacgcgggagtggacaagttggtacttatggactgaacactttcactaacatggaagctcaattaattagacaaatggagggtgagggagtattcaaaaatatacagcacctcacagttacagaagaagtcgctgttcagaactggttagcaagggttgggcgtgagagattatcccggatggcaattagtggtgacgattgtgttgttaaacctttagatgatcggtttgcgaatgctttgaccgcactaaatgatatgggaaagataaggaaagacatacaacaatgggaaccttcaaagggatggaatgactggacacaggttccattttgtagtcatcactttcatgagctaattatgaaggatggtagagtattagtagttccctgcagaaatcaagacgaattaataggacgggcacgtatatcccaaggggccgggtggtctttaagagaaacagcttgcctagggaaaagttacgcgcagatgtggagtttgatgtatttccatagacgggacctacggttagccgcaaacgctatatgtagtgcagtgccatctcactgggtccctacatccagaacgacttggagcattcatgctaagcatgaatggatgacaacagaggatatgcttaccgtatggaatagggtgtggatacgtgaaaatccttggatggaagataagactcctgtagaatcatgggaagaaatcccttatttgggcaaaagagaggaccaatggtgtggcagcttgatcggattaaccagtagagctacatgggctaaaaatattcaagcggcgattaaccaagttaggtccctaatcggtaacgaagaatatacggattacatgccatccatgaaaagatttagaagggaagaagaagaggctggtgtgctatggtga

SEQ ID NO: 22321 - RNA, 9876 nt, synthetic construct
  misc_feature 1..9876: note = derived and/or modified CDS sequence (opt6) from DENV-2__GU131928__SS-prME
  source 1..9876: mol_type = other RNA
agcgcgggtatgataattatgttaatcccaacggtgatggcttttcatttaacaacgagaaatggtgaaccgcatatgattgtaggtatacaagaaaaaggtaaatcactattatttaaaacagaagatggtgttaacatgtgtacattaatggcgatggatctaggagaactttgtgaagacacgataacctataaatgtccattactaagacaaaatgaaccagaagacatagactgttggtgcaatagtacctccacctgggtaacatatgggacttgcacaactacgggcgaacacagacgagagaaaaggtctgttgcgctagtgccacatgtgggtatgggattagaaacgcgaaccgaaacatggatgtcgtcagaaggtgcatggaaacatgcacaaagaattgaaacatggatcctaagacatccaggcttcactataatggcggctatcctggcatacacaatcgggacaacacacttccagagggttctaatatttatacttctcaccgctgtagcgcctagtatgactatgaggtgtattggaatttctaaccgtgattttgtagaaggggtatcaggcggatcctgggttgatatagtgttggaacatggaagttgtgtcacaacgatggccaaaaacaaacccacattagattttgaattaattaaaacggaagctaaacaacccgccactttacgtaaatattgtatagaagccaaattgacaaacacgacgactgaaagcagatgtccaacacaaggtgaaccctctctaaaagaagaacaagataaaaggttcgtatgcaaacactcaatggtagataggggatggggaaacggctgtggactttttgggaaaggagggatagtaacgtgcgcaatgtttacatgcaagaaaaacatggaaggcaaaatagtgcagcctgaaaatctagaatatacaatagtcgtgacgccacacagtggggaagaacatgctgtcggaaatgacaccggaaaacacggaatggaaattaaagttacaccacaaagttcaataacagaagctgaattaacggggtacggaacggtaaccatggagtgcagtccgcgaacaggtttagattttaatgagatggtgcttttacaaatggaaaataaagcgtggctagttcatcggcaatggtttctagatttacctttaccctggttacctggcgccgataagcaagaatcaaattggattcagaaagaaaccctagtaacgtttaagaacccacatgctaagaaacaagatgtagttgtgttgggatcccaagaaggcgcgatgcatactgcattgacaggcgctacagaaatccaaatgagctcaggaaacttattattcacgggacatctaaaatgtcgcttgaggatggacaaactccaattaaaaggaatgagctatagtatgtgtactggtaagtttaaagtagtgaaggaaatcgccgaaacacaacacggaaccatagtcataagagtacagtacgagggagatggttctccgtgtaaaatacctttcgaaataatggacctagagaaaagatacgtattaggaagattgataaccgtcaatccgatagtaacagaaaaagacagtccggttaatattgaagcagaaccacctttcggggactcttatatcataattggagtggagcctggacaattaaaactcaactggtttaagaaagggtcatctataggacagatgttcgagactacaatgagaggagccaaacggatggctatattaggggatactgcatgggactttggtagtttaggaggagtatttacttcaattggtaaagcactccatcaagttttcggagctatttatggtgtagctttcagtggagtgtcgtggaccatgaaaatcctaataggcgtaattatcacatggattggtatgaactcgcgatctacaagtttatctgtgtcgttggtactcgttggaatagttacactatatttaggtgtcatggttcaggctgatagcggttgtgttgtctcatggaaaaataaggaactaaaatgcggttcaggcatatttatcacggataatgtacacacctggacagaacaatataaattccagccagaatccccatccaaactagcgagtgcgattcagaaggcacaagaagaaggaatttgcggaattagatccgtgactcgacttgaaaacctaatgtggaaacaaataactcccgagcttaaccacattctagccgagaatgaagtaaaattaacaataatgaccggagatatcaaaggaataatgcaggctggcaagagatctttacgtccacaacccactgaattaaagtacagttggaaaacatgggggaaagccaagatgctgtctactgaaagctataatcaaacatttctaatagatggaccagagaccgcagagtgccctaacactaatcgtgcttggaactccttagaagtagaagattatggtttcggagtatttacaacaaacatctggcttaaattgaaagagaaacaggatgctttttgtgactcaaagctaatgtcagcggcaataaaagataatagagcagtacatgcagacatgggctactggatcgagtctgccctaaatgatacgtggaaaatagaaaaagcatcatttatagaagtaaagaattgtcactggccaaaatcacacacattatggtccaatggagttctcgaaagtgaaatgattatccccaaaaaccttgcaggaccagtatcacagcacaattatcgacctggatatcacacgcagatcgccggaccatggcacttaggaaaacttgaaatggattttgatttttgcgatggaactacagtcatagtaacggaagattgcggtaacaggggaccgagcttaagaacaacaactgctagcggaaaactaattactgagtggtgttgtcgttcctgcacattacccccattacgttatagaggggaggatggttgctggtatggcatggaaatccgaccccttaaagaaaaagaagagaatctagtaaattcgctcgtaaccgcagggcacggacaggtggataacttctcactgggagtgttaggaatggcgttattcctcgaagaaatgctgcgtactagagttggtacaaaacatgcgatactcttagtggctgtttcatttgtcaccttaataactggaaacatgagttttaaggacctaggaagagttgtcgtaatggtcggtgcaacaatggcagacgatatcggtatgggagtaacatatttggcgttactggcagcgtttaaagttcgaccaacgttcgcagctggactattattaagaaagctcacgtcaaaagaattaatgatgactacaattggtatagtgctcttatctcaatcgactatacccgaaaccgtattagagctaacagatgcactagctctagggatgatggttcttaaaatcgtgcgtaacatggaaaagtatcaattagcagtgacgataatggccatactctgcgtcccaaatgctgtcattctccaaaatgcatggaaggtatcttgcacaatactggcagttgttagcgtatccccattactgctaacatcgtcacagcagaagactgattggataccactcgcgctcacaatcaaaggcttaaatccgacagcaatatttttaacgaccctatcccggacaaataaaaagcgatcttggcccttaaacgaagcaatcatggcagtgggaatggtatctatcttagcatcctctttactaaagaacgacatacccatgacgggtcctttagttgcgggaggccttctaacagtatgttacgttttaacgggccgcagtgcagatctagagttagaaagagctacggatgtaaaatgggaagatcaggccgaaatttcggggagctcgcccattttaagcattacgattagtgaagacgggagcatgtcaatcaaaaacgaggaggaagaacaaacgttgacaattctaattagaacaggactattagtgatatcaggcctattcccaatatcaatccctattacagctgccgcttggtacctctgggaagttaagaaacagcgtgctggggtgctttgggacgtcccaagtccgcctccaatgggaaaggcagagttagaggatggagcatacaggatcaagcagaaaggaatacttggatactctcaaataggagcgggtgtctataaagaaggtacgtttcatacaatgtggcatgtaacacgtggagcggtgttgatgcataaaggtaaaaggatagaacctagttgggctgacgtcaagaaagatctcatttcttatggcggtggatggaaactggagggtgaatggaaagaaggtgaggaagtgcaagtgctagcgttggaaccaggtaagaatccccgtgcagtacaaaccaaaccaggcctgttcaaaactaatactggtactatcggagctgtgtcattagatttctcgccaggaacatcaggatctccaatcattgacaagaaaggcaaagttgtcggtttatacgggaatggagtagtgacacgttcgggtgcatatgtgtccgcgatcgcacaaacagaaaaatcaatagaagataatcctgagatcgaagatgacatctttagaaaaagacgactaactataatggacttacatcctggggctggaaaaactaaaaggtatcttcctgctatagtaagggaggcgattaaacgcgggttgaggacactaatcctggctccaactcgggtagtggccgcggaaatggaagaggcattacgtggcttgccaattagatatcaaacgccagcaattagggcggagcacacaggaagagaaatagtcgatttgatgtgccatgcgactttcactatgcgtctactcagtcctgtgcgtgtacctaactacaatctaattattatggacgaggcgcattttacagaccccgcatcaattgctgcaagaggatatatttccactcgtgtagaaatgggtgaagcagcgggcatatttatgacagcgactccgccggggtcaagagatccctttcctcaaagtaatgcccctataattgatgaggaacgtgagatacccgaaaggagttggaatagcggccatgaatgggtgaccgatttcaaagggaaaactgtatggttcgtgccctcaataaaagctggtaatgatatagcagcatgtttaaggaaaaatggtaagaaagtcatccaattatcgcgaaaaacatttgattcagagtatgtgaaaactagaactaatgattgggactttgtagtaaccacagacatttccgaaatgggagctaactttaaggcagaaagagtaatagatccacgaagatgcatgaagcctgttatcctaacagatggagaagaaagagtaatcttagcaggaccaatgccggttacacattcatcggcggcacagagaaggggacgaataggacgcaaccccaaaaatgaaaatgatcaatacatatacatgggagaacccctagaaaatgacgaagattgtgcgcactggaaagaagctaagatgcttttagataacattaatacgccggaaggtatcataccttcgatgtttgaaccagaaagagaaaaggtagatgccatagatggggaatatagactcaggggtgaggcaagaaagaccttcgtggatctaatgcgccgaggagatttaccagtatggcttgcttacaaagtagcggccgagggcataaattacgcggatcgtagatggtgtttcgatggaattaaaaataatcagatactagaagaaaatgttgaagtcgagatatggacaaaagaaggagaaagaaagaaactaaaacctcgctggctcgacgcaagaatctatagtgacccactagccttaaaggagttcaaagaatttgctgccggtagaaaaagtcttactttgaacctcataacagagatgggaagattgccaacgttcatgactcagaaaacgagagatgcccttgacaaccttgctgtactacatacagcagaagcagggggtcgcgcatataatcatgcgcttagcgaattaccagagactctcgagacactactactgctaaccctcttggcaactgttaccggaggaatattcctctttttaatgagcggtagaggaataggaaaaatgaccttaggtatgtgttgtataataacagcctcaattctcctctggtacgcacaaatccagccgcattggatagcagcaagcataattttagagtttttcctaatagtgctattaattccagagcctgaaaaacaaagaaccccgcaagataatcaactaacctacgtagtgatagcaattttaacggttgttgcagcgaccatggcgaacgagatgggattcttagagaaaaccaagaaagatctgggactgggaagcatagcaacgcaacagcctgaaagtaatatattagatatagatctcagaccggccagtgcttggacattgtatgctgtagctacaaccttcgtgacaccaatgcttagacatagcatagaaaattcgagtgtcaatgttagcttgaccgcgatcgcaaatcaagctacagtattaatgggcctcggaaaaggatggcctttaagtaaaatggacataggcgtaccgcttctcgcaataggatgttatagtcaagtgaatccaatcacattgacggcagccttactgttgttggttgctcattacgcaatcattggcccaggtctgcaagctaaagcgactagagaagctcagaaaagagcggcagcgggaataatgaaaaatccaactgttgatgggataactgtaatagaccttgatccaataccctatgatccaaaattcgaaaagcaattaggccaagttatgttgctaatactatgtgtaacacaagttcttatgatgcgtacaacatgggctctatgcgaggccctcacgctagcaactgggccaatcagtactttatgggaaggaaatcccggtagattctggaatacaacaattgcagtctcaatggcaaacatatttcgaggcagttatctagcaggagcaggattactattctcaataatgaaaaacactacgaacactcgaaggggaacaggaaacatcggggaaacattaggcgaaaaatggaaatcacgactaaatgccctgggtaaatcggaatttcaaatttacaagaaatcaggaatccaagaagtagatcggacattggccaaagaaggcattaaacgaggtgaaacagatcatcatgccgtgtcaaggggaagcgcaaaactacggtggtttgtagaacgcaacatggtgacgccagagggaaaggtcgttgacttaggatgtggcagaggtggatggtcgtactattgcggaggattaaagaacgtacgtgaggtaaaaggattaacaaaaggaggccccgggcatgaggaaccaatcccaatgagcacatacggatggaacttagttcgtttacagtctggcgtcgatgtattctttataccacctgaaaaatgtgatacgttgctctgtgatataggagaatcatctcccaatcccacggtcgaggccggacggacattgagagtccttaacttagtcgaaaattggctcaataacaatacacaattctgtattaaagtccttaatccatatatgccctctgttattgagaaaatggaggctttgcagaggaaatacggcggagcattagtaagaaacccgttatccagaaattcgacacatgaaatgtattgggtgagtaatgcatcagggaacattgtaagcagcgtaaatatgatatcacgtatgttgataaaccgatttacgatgaggcataaaaaggcgacatacgaacctgatgtcgatctcggtagcggtactcgtaacatcggaatagaaagtgaaacaccaaacctagatataataggtaaaaggattgagaaaataaaggaagaacatgagacgtcatggcattatgaccaagatcatccatacaaaacttgggcatatcatggcagttatgaaaccaaacaaaccgggagcgccagctcaatggtaaatggggtagtaagactcctgactaagccttgggacgtattacctacagtaacgcaaatggcaatgacagacacgacaccgttcggtcaacaacgagtattcaaagaaaaagtggatactcgaacccaagaaccaaaagagggaacaaagaaattgatgaaaataacggctgaatggttatggaaagaacttggtaaaaagaaaactcctcgaatgtgtacgagagaggaatttaccaggaaagtacgtagtaacgcggcactaggagctattttcactgacgaaaataagtggaaatctgcacgggaagcggtcgaggactcacgcttttgggagttagtagataaagagaggaaccttcatttggaaggcaagtgtgagacctgcgtttataacatgatggggaagcgtgagaagaaattaggcgaatttgggaaagcaaaaggatcaagagccatttggtacatgtggctaggagcaagattcctggaatttgaagccttaggctttcttaacgaagaccattggttctctagagaaaacagcttatcgggtgtagaaggtgaagggctacataaactaggttacatccttcgggatgtgtccaaaaaggagggtggagcaatgtatgctgacgatacagccggatgggacaccagaatcaccttagaagacctcaaaaacgaagagatggtaacaaatcacatggagggagaacacaaaaagctagcggaagccatattcaaattgacatatcaaaataaagtcgtaagagtgcaacgacctacaccaagagggacagttatggacattataagccgaagagatcaacgtgggtccggccaggttggtacttatggtttgaatacattcacaaatatggaagcccaacttatccgccaaatggaaggcgaaggcgtttttaaaaacattcaacacttaacagtaactgaagaagcagcagtccaaaactggctagctagggttggacgagaaagattaagccggatggcaatatcgggggacgactgtgtggtcaaaccgctagacgacagatttgctaatgcacttacagcattaaatgatatgggtaaaataaggaaggacattcagcagtgggaacccagtaaaggctggaatgattggacacaggtccctttctgttcacaccactttcatgaattaatcatgaaggacggcagagtgctggtagttccatgccgaaatcaagacgaattaattggacgtgcgcgaattagccaaggggcaggatggtcactaagagaaacagcgtgtttgggcaaatcttacgctcaaatgtggtcattaatgtattttcatcgacgtgatctcaggctagcggctaatgcaatttgttcggctgtgccaagtcattgggtaccaaccagcagaacaacatggagtatacatgcaaaacatgaatggatgactacagaagacatgcttactgtatggaatagagtatggatcagagaaaatccttggatggaggataagaccccagttgaaagttgggaagaaattccttacttaggaaagcgtgaagatcaatggtgtggaagcctgattggactgacaagccgtgccacatgggctaagaatatacaagcagccataaatcaggtccgatctcttataggaaacgaggagtatactgattatatgcctagcatgaaacgatttcgacgagaagaggaagaagctggagtcctatggtag

SEQ ID NO: 22322 - RNA, 9876 nt, synthetic construct
  misc_feature 1..9876: note = derived and/or modified CDS sequence (opt6) from DENV-2__GU131929__SS-prME
  source 1..9876: mol_type = other RNA
tctgcaggaatgattataatgttaattccaactgtaatggcatttcacttgaccacaagaaacggtgaacctcacatgattgtgggtattcaagagaaaggaaaatccctattattcaaaacggaagatggagttaatatgtgcactctaatggctatggatctaggagaattgtgtgaagatacaattacgtataaatgtccactactacgacaaaatgaaccggaagacatcgactgttggtgcaattcgacctctacttgggtgacatatgggacttgtactacaacaggagaacacaggcgtgaaaaacgctccgtggctttagtgccacacgtgggtatgggacttgaaacacgtaccgaaacctggatgagcagcgagggagcatggaaacatgctcaaaggatagaaacttggattctgagacacccaggtttcacaataatggcagctattctggcgtatactattggaactacacacttccaaagagtacttatttttattctactcactgcggttgctccctcaatgaccattcgttgcatcggaatttcaaaccgagactttgtggaaggagttagtggaggaagttgggtagatatcgtcctagaacatggttcctgcgtgacaactatggccaaaaataaacctacgttggattttgagttaataaaaacagaagcaaaacaaccagccaccctaagaaaatactgtatagaagcgaaactgacgaatacaacaacggaaagtagatgtcctacccaaggtgaaccctcgctaaaagaagaacaagacaaacgtttcgtatgcaaacattcaatggtggaccgcggatgggggaacgggtgtggactattcggaaaagggggtatagtcacttgcgcaatgtttacctgtaagaaaaacatggaagggaaaattgtccagcctgagaatcttgaatatacaatagttgtaaccccacatagcggagaagaacacgcagtgggaaacgacactggaaaacacgggatggaaataaaagtaacaccacaatcatcaatcactgaagcagaattaacgggatatggaacggtcaccatggaatgctcacctagaactggtttagacttcaacgaaatggtattacttcagatggagaacaaagcatggctggtccatagacagtggtttctagacttaccattaccgtggctaccaggtgcagataaacaagaatctaattggatccagaaagaaactttagtcacgttcaaaaatcctcacgccaagaaacaggacgttgttgtattagggagccaggaaggcgctatgcacactgccttaaccggagcaactgaaatacaaatgtcctcaggaaacctattatttactgggcatttaaaatgtcgcttacgcatggacaaattgcaattaaaagggatgtcttactcaatgtgtactggaaaattcaaagttgttaaagaaatagcagaaacccaacatggaaccatagtaataagagtacagtatgaaggggatggctcaccttgtaaaattccctttgaaattatggatctcgagaaaaggtatgtcctgggtagattaatcactgtaaatccaattgtaacggaaaaagatagcccggtaaacatagaagctgaaccgccctttggtgattcatacataataattggggtagaaccaggccagttaaaattaaactggtttaagaaaggatcgtcaattggtcagatgtttgaaaccaccatgcgcggagctaaaagaatggccatccttggagacactgcatgggattttggatcattaggcggagtctttacatccataggaaaagctctacaccaggtctttggtgctatatacggagtagcattttccggtgtgtcatggaccatgaaaatattaataggggtgataataacttggataggcatgaactcacgcagcacgtcactttccgtcagcctagttctagttggcatagtgacactatacttaggagtaatggtacaagctgattctggttgtgtagtatcctggaaaaataaagaactaaaatgtgggtcaggaatttttataactgacaatgtacacacctggacagagcagtacaagttccagcctgagtcaccttcgaaattagcttcggcgattcagaaagcccaagaagaagggatctgtggtataagaagcgtaaccagattagaaaatttaatgtggaaacagataacgcccgagttaaatcatattcttgcagaaaacgaagttaaattgacaattatgacaggagatataaaaggcattatgcaagcaggtaagaggtccttaagaccacaacccacagaacttaaatattcttggaaaacttgggggaaagctaaaatgttatttacagaatcctataatcaaacatttttaattgatggcccagaaacagcggaatgtccaaatacaaatagggcgtggaactcactagaagttgaggactacggttttggggttttcactacgaacatctggttaaaacttaaagaaaaacaagacgctttttgtgattcgaaattaatgtcggcagcgattaaagacaaccgcgcggtacatgcggatatgggctattggatcgagagtgccttaaacgatacctggaagatcgagaaagcatcattcattgaagtgaaaaactgtcattggccgaaatcccatacactatggagcaatggtgtccttgaatcagagatgataataccgaaaaaccttgctggaccggtatcacaacacaattatagaccaggctaccacacgcagatagcaggaccttggcacctaggaaaactggaaatggattttgacttctgcgacggaacgactgttatcgtcacagaagactgtgggaatagaggaccaagtctccgaacaaccacagcatcaggcaaactaataaccgaatggtgttgcagaagttgcacacttccgccattacgttatagaggagaggacgggtgttggtatgggatggaaattcgaccattaaaggaaaaagaggagaatttggttaactcattagtaacagctggccacggacaagttgataattttagcctaggagtacttggaatggcattatttcttgaggagatgttaaggacgcgcgttgggaccaaacatgctatattattagtagccgtgagttttgtaactctaattaccggaaacatgtcttttaaagatttagggcgtgttgttgtaatggtgggcgctacaatggctgacgatataggtatgggagtaacatatttggcactccttgctgctttcaaagttcgtcccacatttgctgcgggcttacttctacggaaactgaccagcaaagaattaatgatgacgactataggtatagttttactttcccaaagtacgataccagaaacagtgctggaattaacagatgcacttgcacttggaatgatggtcttaaaaattgttagaaacatggaaaaataccaacttgctgtgacgatcatggcaatactttgtgtaccgaacgccgtcatattacaaaatgcatggaaggtatcgtgtacaatactagcagtggtgtcagtaagcccattactattaacatcatcgcaacagaaaactgattggatcccgctggcattaaccataaagggcctcaatcccactgccatctttctgaccacactatcaagaacaaacaagaaaagatcatggcctctcaacgaagcaattatggcagtcgggatggtaagtattctcgcatctagtctactcaaaaacgatataccaatgactggacctctagttgcgggtggacttcttacggtgtgttatgtactaacaggccgatcagcagatctagagctagagcgcgcgacggacgtaaaatgggaagatcaagccgagattagtggaagttcgccaatcctctctatcactataagtgaggatggcagtatgtccattaaaaatgaagaagaagaacagacattaacaatactaattcgaaccggactgttagtaatatcaggactttttccaatatctattccaataacagccgcagcctggtacctctgggaagtcaagaaacaacgcgccggggtattgtgggacgtgccttcaccgccaccaatgggaaaagccgagctagaagatggagcatatcgcattaagcagaaaggcattcttggttactcacagattggagcaggggtatacaaagaaggcacattccatacgatgtggcacgtaacaagaggagcagtgttaatgcataaaggcaaacgaatagaaccatcgtgggccgacgtcaagaaagatcttatctcgtacggcggcggatggaaactcgaaggagaatggaaagaaggcgaagaagtgcaagttcttgcgctggaaccaggcaaaaatcctagagcggttcaaactaaacccggcttatttaaaactaatactggcacaatcggagctgtttcacttgacttttccccaggaacaagtggctcacctattatagacaagaaaggaaaggttgtggggctatatggcaatggcgttgtaacaagatccggagcatatgtatccgcaatagctcaaactgagaaaagtatagaggataatccagagatcgaagacgacatcttccgtaaacgacgactcacaataatggatttacatccgggtgccggaaagacgaaaaggtatttaccggcgatcgtaagggaagcaataaaacgaggactaagaacactgattttagctccaacgagagtcgttgcagcagagatggaagaagcgttacgcggactaccaataagatatcaaactcctgcaatacgagcagaacatacagggcgcgaaattgttgacctcatgtgtcatgcgacattcaccatgagacttctgagccctgttcgagtcccaaactataacctcattataatggatgaagcgcacttcacagatccggccagtatagctgcgagaggttatataagtacccgtgtggagatgggagaagcagcgggcatattcatgacagcgactccaccaggatctcgagacccttttccacaaagcaatgccccaattatagatgaagaaagggagattccggaacgtagctggaacagtggtcacgagtgggtgactgatttcaaaggaaaaacagtatggtttgtaccatccataaaagcaggcaacgatatcgcagcttgcctcaggaaaaatggcaagaaagtaatacaactttctaggaagacattcgatagcgaatatgttaaaacgaggaccaacgattgggattttgtagtgactacagacataagtgaaatgggtgctaactttaaagcagaacgtgtgatagacccaagacgttgtatgaaacccgttatcctaacagacggcgaagaaagagttatattagcagggccgatgcccgtaacccactcatcagcggcccaaaggcgagggaggataggccgtaatcccaaaaatgagaatgatcaatatatatatatgggagaaccgctagaaaacgatgaagactgcgcgcactggaaagaggccaaaatgttattagacaatataaacacacccgaaggaatcataccctcaatgtttgaacctgaacgcgagaaagtggacgccatagatggagaatacaggctaagaggcgaagcaagaaaaacattcgtagatctcatgaggcgaggagatttacctgtatggttagcatacaaagtcgctgccgaaggtatcaactatgctgaccgacgatggtgctttgatggcattaaaaacaaccagatattagaagaaaacgtggaagtagaaatttggactaaagaaggagaaaggaaaaagttaaaaccgaggtggttagatgcaaggatctattccgatcctttggccctgaaagagtttaaagaatttgcagctggacggaagagtttaaccctaaatttgataacagaaatgggtagacttccgacattcatgacacaaaagacgcgagatgcattagataatctggcagtattacacactgctgaggccggtgggagagcgtacaaccatgctctgtcagaattaccggaaacccttgaaacactcctacttttgaccttattagccacagtaactggaggtatatttttattcctaatgtcaggaagaggcattggaaaaatgaccctaggtatgtgctgcataataactgcttccattttactatggtacgcacagatacaaccacactggatcgccgcatcaatcatactagagttctttctaattgttctacttatcccagaaccagaaaaacagcgaactccacaagataatcaacttacttatgtagtaatagcaatcttgacagtagttgcagctaccatggcaaatgaaatgggctttttggagaagaccaagaaagatctagggctaggtagtatagcaacgcaacaacctgagagcaacattctcgacatcgaccttagaccagccagtgcatggacactctatgcagtggcgaccacattcgtcactccgatgcttcgccacagcattgaaaattcgtctgtaaatgtcagtttaacagcaattgctaaccaggccacagtgttgatgggactcggtaaaggctggccactcagtaagatggatatcggtgttcccttgttagcaatcggatgctactcacaagttaatcccatcactctaacagcggcactactattgctcgtggcacattacgcgataataggaccagggttacaagcaaaagctacaagagaagcacagaaaagagcagcagcggggataatgaagaacccaaccgttgatggaataacagttatcgacttagatcctataccctacgatcctaaatttgaaaaacaactgggacaagttatgttgctaatcctttgcgtaactcaagtattgatgatgaggacaacgtgggctttgtgtgaggctcttacgctagccacagggccaatttctacattatgggaaggcaacccaggtcgtttctggaacacaacaatagcggtctctatggccaacatatttcgcggtagctacttagcaggagcaggcctattgttctccataatgaagaataccactaacactcgaagaggaaccggtaatattggagaaacactgggagaaaagtggaaaagtagacttaacgctcttggcaaatcagaatttcagatttataagaaatcaggtatacaggaagtagataggacactagcaaaagaaggaattaaacggggagaaacagaccatcacgcagtttcgagaggatcagcgaaattaaggtggtttgtcgaacgaaacatggtgactccggaaggaaaagtagtagacttaggctgtggtagaggaggttggtcgtactactgtggaggtcttaaaaacgttagagaggtaaaggggctgactaaaggaggtccgggacatgaagaaccgattcccatgagcacatatggttggaacctcgtcagattgcaatccggggtcgacgtgttctttatcccaccagaaaaatgcgacacactattgtgcgatataggagaaagttccccaaacccaacagtagaagcgggccgaactctaagagttctcaatctggtcgaaaattggttaaataataatacacaattttgcattaaggttctaaacccttatatgccaagtgtcatcgagaaaatggaagcgttgcaaagaaaatacggtggtgcgttagttaggaacccattgagtagaaattcgacacacgaaatgtactgggtatcaaatgcctccggcaatatagtttcaagtgtcaatatgatctcaagaatgttgatcaatcgcttcactatgagacataagaaagctacctacgaacccgatgtagatttaggttcagggacccgaaacatcggcatcgaaagcgaaactccaaacctggacataattggtaaacgcatcgagaaaataaaggaagaacatgaaacaagttggcactacgatcaggaccacccgtataaaacatgggcatatcacgggtcatacgagactaaacaaacgggatctgcatcgtctatggtaaatggcgtagtgcgattgttaaccaaaccatgggacgtgttaccaactgtcacccaaatggcgatgacggacacaacaccgtttggacaacagagagtttttaaagaaaaagtagacacaagaacacaagaaccaaaagaaggtacaaagaaacttatgaaaataactgctgaatggctgtggaaggaactcggtaagaagaaaacccctcgaatgtgcactagagaagagtttaccagaaaggttagatcaaatgcagctctgggagctatatttactgatgaaaataaatggaaatccgcgcgagaagccgttgaagactcaaggttttgggagttggtagataaggagcgaaatctacacttagagggcaaatgtgaaacatgtgtatataatatgatgggcaagagggagaagaaactaggagaatttggcaaagctaaaggctcccgtgcgatttggtacatgtggctgggagctcgctttttagaatttgaggctttaggatttttaaacgaagatcattggtttagtcgtgagaatagcctatctggcgtcgaaggagaaggactgcataaactgggctatatactacgcgacgtgagcaagaaggagggtggcgctatgtatgctgatgacacggcaggatgggataccagaatcacattagaagatttaaagaatgaagaaatggtcactaatcatatggaaggagagcacaagaaattggcagaggcaatattcaagttgacatatcaaaataaggtcgtacgtgttcaaagacctacacctcgaggaacagtgatggatataatcagccgcagagaccagagaggaagtggacaggtaggaacatacgggttaaatacgtttacgaacatggaggcccagctaattagacagatggagggggaaggcgtatttaagaatatacaacacttaacggttaccgaggaagcggccgttcaaaactggttggctagagtcggacgggaaagattaagccggatggctatcagtggcgatgactgtgttgtcaaaccgctggatgatagatttgcgaacgcccttacagcactcaatgatatgggaaaaattcgaaaggatatacaacaatgggaaccctcaaagggttggaacgattggactcaggtaccattctgtagccatcattttcatgaacttatcatgaaagacgggagagttttggtggtgccatgccgcaatcaagacgaacttatcggtcgagccaggatctctcaaggcgccggatggtcgttaagagaaacagcgtgtttgggaaaatcatacgcacaaatgtggagcttaatgtacttccaccgaagagatttgcgattagcagcaaatgctatatgcagtgcagttccttcacattgggtccccacatcccgtacaacctggtctatccacgccaagcatgaatggatgactacagaagatatgcttactgtctggaaccgagtatggattagagaaaatccctggatggaagacaaaacccctgtggagtcatgggaggaaattccgtaccttggcaagcgcgaagaccaatggtgcggcagtttaataggactaacctccagggctacgtgggctaaaaatatacaggctgcaatcaatcaagttcggtcacttataggaaatgaagaatatacagactatatgccgtcgatgaagagatttcgaagagaagaagaagaagctggtgtcctttggtga

SEQ ID NO: 22323 - RNA, 9876 nt, synthetic construct
  misc_feature 1..9876: note = derived and/or modified CDS sequence (opt6) from DENV-2__GU131930__SS-prME
  source 1..9876: mol_type = other RNA
tcggcaggtatgataattatgttgataccaaccgtaatggcatttcatttgaccacaagaaacggggaaccacacatgatagttggtattcaagaaaaaggaaaatccctattgttcaaaacggaagacggagtgaacatgtgcactttaatggctatggacttaggtgaactatgcgaagacacaattacctacaaatgccccctcctacgacaaaatgaaccagaagatatagattgttggtgtaattccacaagcacttgggtaacttacggtacatgtacaaccaccggggaacaccgtagagagaaaaggtcagttgccctagtaccgcacgtaggtatgggtctcgaaacaaggacagaaacatggatgtcgtcagaaggggcatggaaacatgctcaaagaatagaaacatggatacttcgacatccgggtttcacaataatggcagcaatactggcatacactattggaacaacccatttccaaagggcactcatatttatactcttaacagctgtagcaccatcgatgaccatgagatgtatcggtatctcaaatcgagacttcgtggaaggagtatctggaggaagttgggtagatatcgtccttgaacacggatcgtgcgtcaccacaatggccaaaaacaaacccacgttggacttcgaactgatcaaaactgaagcaaaacaaccagctacattacgtaaatattgtatagaggcgaaattaacaaatacaacaacagaaagccgatgccccacacaaggagaaccgagtcttaaagaagaacaagataaaagattcgtatgcaaacacagtatggtcgatagaggatgggggaatggatgcggccttttcggtaaaggaggaatagtaacttgcgcaatgtttacctgtaagaagaacatggaaggcaagatcgtgcagccagaaaacctcgagtacacaattgtggttactcctcattctggggaagaacacgcggtaggcaatgacacaggtaaacatggaaaagaaataaaagtaacaccgcaaagcagcattacagaagcagaactaaccgggtacggaaccgtaacaatggagtgtagccctagaactgggttagattttaatgaaatggttctcctgcaaatggaatccaaagcatggctagtacatcgccaatggttccttgatcttcctctgccatggctacctggcgcagataaacaagggagtaattggatacaaaaagagacattagtaactttcaaaaatccccatgccaagaaacaagatgtcgtagtcttgggaagtcaagaaggggctatgcacacagctttgacaggggcgactgaaatacaaatgtcgtcaggtaatttattgtttactggacacttgaaatgtagactgcgtatggataaattacaattaaaaggcatgtcctactcaatgtgcacaggaaaattcaaagtcgtgaaagaaatagctgaaacgcaacacggtactatcgtcattcgagtacaatatgaaggagatggaagcccatgtaaaataccatttgaaataatggatctggagaaaaggtatgtgttaggcagattaatcacagtaaaccccatagtgacagaaaaagactcacctgttaacattgaagcagaaccaccattcggagactcatatattattataggggttgagccagggcaactcaaactaaactggttcaagaaaggttcgtcaatcggtcaaatgtttgaaacaacgatgagaggggccaaacgaatggcgatattaggagataccgcctgggatttcggctcattaggtggggtgttcacatcgatcggaaaagcattacatcaagtcttcggggcaatttatggagctgcattcagcggggtctcatggacgatgaaaattctaattggagtcattataacgtggatcggcatgaatagcagatctacttcattaagcgtgtctctcgtattagtcggtatagtgacactttatcttggggtaatggtgcaggcagatagcgggtgtgttgtttcgtggaaaaacaaagaattaaaatgtggaagtggtatatttattactgacaatgtccatacatggactgaacaatataaattccaaccagagtccccttccaaattagcctccgctattcaaaaagcacaggaagaaggcatatgtggtataagatcagtgacacgcttggaaaaccttatgtggaaacaaatcacaccagagttaaaccacattttagcagaaaacgaggtaaaacttactataatgacaggtgatataaaaggaattatgcaagccggtaaaagatccctaaggccgcagcccaccgaattaaaatacagctggaaaacatggggaaaagcaaaaatgctgagtacagaaagtcataaccagacattcttaatagacggcccagaaacagcagagtgtcctaacaccaatcgagcctggaatagtttagaagttgaagattatggattcggtgtatttacaacaaatatttggctaaaattaaaagaaaaacaagacgctttctgtgacagtaaactaatgtctgcagcaataaaagacaaccgtgcagtgcatgctgacatggggtactggatcgagtcagcactaaatgatacatggaaaatcgagaaagcgagctttatcgaggtcaaaaattgccattggccaaaaagccacactctatggagtaatggcgtactcgagtcagaaatgataataccgaaaaatctagcaggaccggttagtcaacacaattatagacccggctatcatacccaaacggcaggcccgtggcatttagggaaactcgaaatggacttcgacttctgcgacggtacgacagtcatcgttaccgaagattgtggaaatcgcggcccaagtctacgcacaacaactgcatcaggaaaacttataactgaatggtgttgccgatcttgtacactaccgccactgagatatcggggcgaagacggatgctggtatgggatggaaatcagacctcttaaagaaaaggaagagaacctcgtcaatagcctagtaactgcgggacacggacaagtggataatttctcacttggggtcttagggatggccctatttctagaagagatgctacgcacgcgtgtaggaactaaacacgcaatcctcttagtcgcggtctcttttgttacgctaattactggaaatatgtcatttaaagacctaggtagagtcgttgttatggtcggcacaaccatgacagacgacataggaatgggggtcacatatctggctttacttgcggcttttaaagttagaccgacttttgcagcgggcctattacttagaaaactaacatctaaagaattaatgatgacaactattggtatcgttttactaagccaatccacaattccagaaactattctagaactcactgatgcactcgctctaggcatgatggtacttaaaatagtcagggacatggaaaaatatcagctcgcagtcacgatcatggcgatactttgcgttccaaatgcagtaatactgcagaacgcttggaaggtgagctgtacaatattagccgtcgtaagcgtaagccctctactattaacatcctcacagcagaaaactgactggattcctctagccttaacaataaaaggtttgaacccaacagcaatttttctaaccacattgagtcgtacgaataaaaagcggtcatggcccctcaacgaagctataatggctgtcgggatggtgtcgatcttggccagtagtttacttaagaatgacattcccatgaccggcccgttagtcgccggaggtttgctaaccgtgtgctatgtgctcacaggacgcagcgcagacctagaacttgaaagggcgactgatgttaaatgggaagaccaagcagaaatcagtggatcttctcctatattaagcataaccatttcggaagacgggagcatgtcaataaagaatgaagaagaagaacaaacacttacgatactgatacgtacaggattacttgtaatatccgggctattccctgtgtctattccgattactgccgcagcatggtacctgtgggaagtcaaaaagcaaagagccggtgtattatgggatgtaccgagcccaccaccaatggggaaagcggaactagaagacggtgcgtatcgaataaagcaaaaaggcattctaggatatagccaaattggggcaggagtttataaagaaggaaccttccacactatgtggcatgttactcgaggcgcagttttaatgcataagggaaagaggattgaaccgagttgggccgatgtcaagaaagacttaatttcgtacggagggggttggaaactagagggagagtggaaagaaggtgaggaggtacaagtgctggcacttgaacccggtaaaaacccacgagcagtccaaacaaaacctgggttgttcaaaactaacacgggaaccattggagccgtgagccttgatttttctcccggcacaagtggttccccaattattgacaaaaagggaaaagtagtcggcctttacgggaatggggtagtaacccgtagtggggcctacgtgtcggcgatcgcgcagacagaaaagtctatcgaagataatcctgaaatagaagatgacatatttagaaaaagacgactgactataatggacctacatccaggtgccggaaagacgaaaaggtacttgccagccatcgtcagagaggcaataaaaagaggcttacggaccttaatacttgctccaacaagggtggttgctgcagagatggaagaagcactaagaggcctaccgatccgttaccaaacaccagcaatcagagctgaacatacaggaagggaaatagttgacttgatgtgtcacgccacatttactatgcggctcctaagccctgtcagagtcccaaattacaacttgattattatggacgaagcgcattttacagatcctgcaagcatagccgcgaggggctacatatccactcgagtggaaatgggggaagccgctggaatatttatgaccgccacacctcccggaagcagagatccttttccacaatctaatgcacctattatagatgaagaaagggaaattcccgagagatcctggaatacaggacacgaatgggttactgatttcaaaggaaaaacagtatggttcgttccatcaatcaaagcaggcaatgatatagcagcatgtctcaggaagaatggtaagaaagtcatccaattgtcgaggaaaacgttcgattccgaatacgtgaaaaccagaacaaatgattgggattttgttgtaactacagatatttctgaaatgggcgcaaatttcaaggcagaaagggttattgatcctagaagatgcatgaaaccagtaatcctgactgatggggaagaacgagttatcctggcaggacccatgcctgtcacacacagcagtgccgcacagagacgaggaagaataggacgaaatcccaaaaacgaaaacgatcagtatatttatatgggcgaaccattagaaaacgatgaagattgtgcccattggaaagaggcaaaaatgttactagacaacataaacacacctgaaggaataataccatctatgttcgaaccagaaagagagaaagtggacgcgatcgatggggaataccgattaagaggggaggctagaaaaactttcgtagacctaatgcgaagaggagacctaccggtatggttagcttacaaagttgcagccgaaggtatcaattacgctgaccgaagatggtgctttgatggcatcaaaaataaccaaatacttgaagaaaacgtagaagtagaaatatggacaaaagagggagaaagaaagaaactaaaaccgagatggcttgatgcacgaatttattctgacccactagcgctaaaggaatttaaagaatttgctgcagggcggaaaagtttaacactcaatctcataacagaaatgggtagattaccaacattcatgacacagaaaacgagggacgcacttgataatctagccgtcctccatacggctgaagcaggcggacgagcttataatcacgcactttccgaattaccagagacgctcgagactttgctcctcctgactctactagcaacggtcacaggcggaatattcctatttttaatgagcggccgaggaatcggtaaaatgaccctcggcatgtgttgcatcataacggcatctatactactatggtacgctcaaatacagccacattggattgcggcatctattatcttggaatttttcctaatagtcttgctgatccccgagcccgaaaagcagagaacccctcaagacaatcaattaacgtatgtcgtgatagctattttaactgtagtagcagccacaatggcaaacgagatgggctttctagaaaagactaagaaagacctcggactgggatcgatcgctactcaacaaccagaatccaacatattggacattgaccttaggcccgcctccgcctggaccttgtatgccgtagctacaactttcgtaactccaatgctcagacatagcatagaaaatagctctgtaaatgtctctctaacagctatcgccaaccaggccacggtactaatgggattgggaaaaggatggccactgagcaaaatggatattggtgtacctttactagccattggatgttactctcaagtgaatcccattacattaacagccgctttattacttctagtagcgcattatgcaataataggcccaggtttacaagcgaaagcaactagagaagctcaaaaacgagcagcagcaggaattatgaaaaatcctacagtagacggaataactgtaatagatttggacccaataccttatgatccgaaattcgagaaacaacttggacaagtgatgttactaatcctgtgtgtcacacaagtactaatgatgcgcacaacatgggccttatgtgaagcactcactttagcaactggcccaataagtacattatgggaaggaaatccaggaagattctggaatacaactatagcagtgagtatggcaaacatatttagaggatcctatttagctggtgctggacttctattcagtatcatgaagaacactactaacacacgacgaggaaccggcaacataggtgaaactcttggggaaaaatggaaatcgagactaaatgctctaggtaagtccgagttccaaacttacaagaaaagtggcatacaagaagtagaccgcacattggctaaagaaggtattaagagaggcgaaactgaccatcacgctgtgagtcgaggaagcgcgaagctaaggtggtttgttgaaaggaatatggtaacaccggaaggaaaagtcgtagatttaggctgtggccgaggtggatggagctattactgcggtggtttgaagaacgttagagaagtaaaaggactcacgaaaggagggcctgggcacgaagaacctataccaatgtctacctatggatggaacttagtaagacttcaatcaggtgttgacgtgttctttattccaccggaaaaatgcgatactttattatgtgatattggagaatccagccctaacccgactgtcgaagcaggtcgtaccctaagggtattaaacttagtggagaattggttgaataacaatacacaattttgcattaaagtccttaatccgtatatgcctagtgtaatagagaaaatggaagcgctacagcgaaagtacggcggagccctagtaagaaatccactcagtcgaaattctactcatgaaatgtactgggtgagcaatgcttcaggtaatatagtttctagtgttaacatgataagcagaatgttaataaataggtttacaatgcgacacaaaaaggcaacatatgagcctgatgtggacttaggatcgggaactcgaaacatcggtatagagagtgaaatacctaatctggatataataggaaagagaatagagaaaatcaaacaagaacatgaaacatcgtggcactatgatcaagatcacccatataaaacatgggcttatcacggaagctacgaaacaaaacaaacaggatctgcgtcaagtatggttaacggggtagttcgtcttctaacaaaaccttgggacgtcctaccaacagtgacacagatggcgatgacagacaccacaccttttggacagcaacgggtatttaaagagaaagtggataccagaactcaagaaccaaaggagggaacgaagaaattaatgaaaattaccgctgaatggctatggaaggagttagggaagaagaagacgccacgtatgtgcacaagagaagaatttacacgtaaagtaaggtcaaatgccgcccttggagctatctttacagatgaaaataaatggaaatcagccagagaggccgtggaggactcacgattttgggaattggtagataaggaaagaaaccttcacctagaaggcaagtgcgaaacatgcgtatacaacatgatggggaaaagggagaagaaattgggagaatttggaaaagcgaagggatcgagagcaatatggtatatgtggttgggggcacgatttctagaatttgaagcactcggatttcttaacgaagaccattggtttagtcgtgaaaactcactatctggagttgaaggagaggggctgcacaaattaggctatatccttagggatgtcagtaaaaaggaaggtggagcgatgtatgctgacgatacagcgggatgggatactagaataactttagaagatcttaaaaacgaggaaatggttactaatcatatggagggggaacataagaaactcgcagaagccattttcaaattgacatatcaaaataaagtcgtgagggtccaaaggcctactccaagggggacagtcatggatataatatctaggcgcgatcaaagaggctctgggcaagttggaacctacggacttaatacttttacaaacatggaagcacaactcataagacagatggagggggaaggggtattcaaaaatatacaacatctcacggcaacagaagaggtagctgtgaaaaactggctagcaagagttgggagagaaaggctgtcgagaatggcgattagtggggacgattgtgtggtcaaacctttagatgaccggttcgcaaacgcactcacagctttaaatgatatgggtaaaattagaaaagacatacagcagtgggaaccgagtaaaggatggaacgattggacgcaagtgccattctgcagtcatcattttcacgagctgataatgaaggatggacgagtcctggttgtaccttgtcgtaatcaagatgaactcatcggtcgagcgcggatatcgcaaggagcgggatggagtctcagggagactgcatgtttaggaaagagttatgcacagatgtggagtcttatgtattttcacagaagggacttaagacttgcggccaacgcgatatgctctgctgtacccagccactgggtaccgacaagtagaacaacttggtcaattcacgcaaaacatgaatggatgaccacagaggatatgctaacggtatggaatcgagtgtggatcagagagaatccgtggatggaagataaaacaccagtcgaatcttgggaagaaattccgtatctagggaaacgggaagaccaatggtgcggcagcttaattggattaacaagtcgggcaacctgggccaaaaacatccaagccgcaattaatcaggtgaggagcctcataggcaacgaagaatacacagactacatgccgtccatgaaacggtttaggcgcgaagaagaagaagcaggggtgctatggtaa

SEQ ID NO: 22324 - RNA, 9876 nt, synthetic construct
  misc_feature 1..9876: note = derived and/or modified CDS sequence (opt6) from DENV-2__GU131931__SS-prME
  source 1..9876: mol_type = other RNA
tcagcagggatgattataatgttaattccaacagtaatggcgttccatctaacgacccgaaatggagaaccacatatgattgtaggcatccaagaaaaagggaaatcattgctattcaaaacagaagacggagtaaatatgtgtactctaatggcaatggacctcggagaactgtgcgaagatacaatcacttataaatgtccgttactcaggcaaaatgaaccagaagatatagactgctggtgtaactcaaccagtacatgggtaacatatggaacatgcacgacaactggtgaacatagacgcgagaaaagatctgtagcacttgtaccccacgtcggcatgggcctagaaacacgaaccgaaacatggatgagttcagaaggtgcttggaaacatgcacaacgaatagaaacatggatactacggcacccaggatttacaatcatggcagccattctggcacacaccattggaaccacacactttcaaagagtcttgatatttatactattaacagcggtcgcaccaagtatgacaatgcgatgtataggcatatcaaacagagattttgtcgaaggggtatctggcggttcctgggtcgacatcgtattagaacacggatcatgcgtaacaacaatggcgaaaaacaaacctacattggactttgaattaatcaaaactgaagcaaaacaaccagcaactctcagaaaatattgtatagaagcaaaattaacaaacaccacgactgaatctagatgtccgactcaaggtgaacccagtctaaaagaggaacaagataaaagattcgtttgtaaacacagcatggtggaccgaggatggggaaatggttgtgggctatttggaaaaggtggtatcgtaacctgcgcgatgtttacatgtaaaaagaatatggaaggtaaaatagtacaacctgaaaaccttgaatacacaatagttgtgactccacacagtggagaagaacatgctgttggcaatgacaccggaaaacacggaatggaaataaaagtcacacctcagtcctccatcacagaagcagaattgacaggatatggcaccgtcacaatggaatgttcccccagaacaggcttggactttaacgaaatggtattattgcagatggaaaacaaagcctggctagtccaccgacaatggtttttagatttgccactaccgtggctaccgggagcagataaacaggaatccaattggatccaaaaagaaaccctcgtgacatttaagaatccacacgccaagaaacaagatgtcgtcgtattagggagtcaagaaggagccatgcataccgctcttactggtgctacagaaatccaaatgtcatcaggaaacttgttatttacaggtcatctgaaatgtcggttacgaatggataaattacagcttaaaggaatgtcttatagcatgtgcacagggaagttcaaggttgttaaagaaatagcagaaacacaacacggaacaatagttattcgagtacagtatgagggagacggaagcccatgcaaaatacctttcgaaataatggatctcgagaaacgatacgtgctcggacgtttaattacagtaaatcctattgtaacagaaaaagacagcccggttaacatagaagctgaaccacccttcggggatagttatatcatcataggagtagagcctgggcaattgaaattgaattggtttaaaaagggtagtagtataggtcagatgtttgaaaccactatgagaggggcgaaaagaatggctatactgggcgacacagcatgggacttcggaagtttaggaggggtattcacctccatcgggaaagcccttcaccaaatattcggagccatttacggtgcagccttttccggcgtgtcttggacaatgaagatccttataggcgtcataataacatggataggaatgaactcaagatcaacgtctctgagcgtatcgctagtgttagttggcatcgttactctatatttaggagttatggtgcaagccgacagtggatgtgttgtgtcatggaaaaacaaagagttaaaatgtggaagtggaatattcattacagataacgtccatacatggacagaacaatacaagtttcaacccgaaagtccatcgaaattagcttcagcaatacaaaaagcacaagaggaaggtatatgtggaattagatcagtcacaaggcttgagaacttaatgtggaaacaaataacgcctgaattgaatcatattcttgctgaaaacgaagtaaaactaactataatgaccggtgatataaaaggtatcatgcaagctgggaaacgaagtttaaggccccaaccaacagaattaaaatattcatggaaaacttggggtaaagctaagatgctttccactgagtcacacaatcagacattcttaatagacggtccggaaactgcagaatgtccaaacacaaatagagcatggaactccctggaagtagaggattacggcttcggagtattcactactaacatttggctcaaacttaaagaaaagcaagatgctttttgcgattcaaaacttatgagtgcagccattaaagataatagggccgtacacgcagacatgggttattggattgaatcagcattaaacgacacatggaaaattgagaaagcgtcgtttatagaagtaaagaactgtcactggccaaaatcacatacactctggtcgaacggtgtactagagagtgaaatgataattcccaaaaatcttgcaggccccgtgagtcagcataattaccgccccggatatcacacacaaattgcaggcccttggcaccttggtaaactggagatggactttgacttctgtgacgggacaactgttatagtaacagaggactgtggaaaccgggggccatcactgcggacaacaacggcatcaggaaaacttataacagaatggtgttgtagatcatgtacgctcccgcccctaaggtaccgaggtgaagacggttgctggtacggcatggagatcaggcctttgaaagaaaaggaagaaaacctggttaatagcctagtgaccgcgggtcatggacaagtcgataatttctccttgggcgtgctaggcatggcattgtttcttgaagagatgttgcgaacaagagtcggtaccaaacatgctatactgctggtagcagtgtcatttgttaccctaatcaccggaaatatgtcgtttaaggatttgggaagagtagtagtaatggttggagcgaccatggcagatgatataggtatgggtgtaacatatttagctttactggcagcattcaaagttagacctacctttgcggcgggtctcctgttaagaaaactaaccagtaaggagctaatgatgaccaccattggaattgttctattaagccaatctaccataccagaaacagttttggagttaaccgatgcactagctctaggcatgatggttctgaaaatagtacgaaacatggaaaaataccaacttgcggtaacaataatggcaatactttgtgttcctaatgccgtcatactgcaaaacgcctggaaagttagttgcacaatactggcagtagtaagcgtatcaccattactattaacatctagtcaacaaaagacagattggattccacttgccttaaccattaaaggtcttaatcccacggcgatattcttaacaacactgtcacgtacaaataagaaacgatcgtggccactgaacgaggccattatggcagtaggtatggtgtcgattcttgcttcgtcccttcttaagaacgacattcctatgaccggtccgctcgttgcagggggtttgttaaccgtgtgctatgttctgactgggcgtagtgccgacttagagcttgaaagagctacggatgtcaagtgggaagatcaggcagagataagtggctcaagtccaattttatctattactataagcgaagacggatcaatgagtatcaagaacgaagaagaagaacaaacactaactatactgattagaacagggttactggtcatatcaggattgttcccaatttcgataccaatcacggctgcagcatggtatttatgggaggtcaagaaacaacgcgccggtgtgctgtgggacgtaccgagtccaccaccaatgggaaaagcagaactggaagacggagcatatagaatcaaacaaaaaggtatattaggatattctcaaataggcgccggtgtttataaagaaggtacattccacacaatgtggcatgtaactagaggtgcagttttaatgcataaaggtaagaggatagaaccctcatgggcagacgtgaagaaagatctgatttcttacggtggtggctggaaactcgagggcgaatggaaagaaggtgaagaggtacaagtcttagctttggaaccaggaaagaatccacgagctgtccaaactaaaccgggattgttcaaaacaaacacgggaacaataggagccgtatcattagatttttcacctggaacatcaggtagtcctataatagataagaaagggaaggtagtaggtctatatggtaacggtgtcgtcaccagatcgggggcttacgtttcagctattgctcaaacagaaaaatcgatagaggataatccagagattgaagatgacatcttcagaaagcgccggcttacaattatggacctacaccccggagctggcaaaacaaaaaggtatcttccagcaatagttcgggaagcgataaaacgcggcttaaggactttaatattagcgccaactcgagtcgtagcggcggaaatggaagaggccctaagaggactgccaataaggtaccaaacccctgcaatacgagctgaacatactggtagggaaatagttgacctaatgtgccatgcaacctttaccatgcgattattgagccctgtaagagtaccaaactacaatttaatcataatggatgaagcgcactttactgacccagcgtcaatagccgcgcgtggatatatatcaacacgggttgaaatgggcgaagcggcgggaatattcatgacagcaaccccgcctggatcacgggaccctttcccccaaagcaatgcaccaattatagatgaggaacgagaaataccggagagaagttggaactcaggccacgaatgggtgaccgactttaagggaaagacagtatggttcgtgccttccatcaaggcaggaaatgacatagccgcatgcttaaggaaaaatggcaagaaagtcatccaattgtcaagaaagactttcgactcagaatacgtgaaaactcgtacgaatgactgggattttgttgtaactacggacatatcagaaatgggtgcaaatttcaaagcagaaagagttatcgatcccagacgatgtatgaaaccggtgattctaacggacggagaggaacgcgtaatactagcaggcccaatgcctgtcacacattcatcagcagcccaaagaagaggaaggatcggtcgtaatcctaaaaacgaaaatgatcaatatatctatatgggagaaccactagaaaacgatgaagactgtgcacactggaaagaagcgaaaatgcttcttgataacataaatacgcccgaaggcattataccatcaatgttcgaaccagaacgagaaaaagttgatgcaatagatggggagtatcgcttacgaggtgaagccagaaaaactttcgtcgatctgatgcgacggggcgacttgccagtatggctagcatacaaagtagcagccgagggcattaattacgcagacagacggtggtgttttgatggaatcaaaaataatcaaatcttggaagagaacgtagaagttgaaatttggacaaaagaaggagaacgtaaaaagctaaaaccaaggtggctggatgcccgtatttactctgatcctttagctctgaaagaatttaaagaatttgcagctggaagaaaatcccttacattaaatttaataactgagatgggtcgattaccgacttttatgacacagaaaacaagagatgctctcgacaacctggcagtactgcataccgcagaggcaggcgggagagcatacaatcacgccttaagtgaattacctgaaacattagaaacactcctactcctaacactattagctacagtaaccgggggcatatttctatttttaatgtccggcagaggaataggaaagatgacactgggaatgtgttgtatcatcacagcatccatattactctggtatgcgcagattcaaccgcactggattgccgcatcaataattttagaatttttcttaatagttttactcattccggaaccagaaaagcaaagaacaccacaggacaaccagttaacttatgtggtgattgctatactaaccgtggtagcagcaacgatggctaatgaaatgggctttctagagaaaaccaagaaagatcttgggttaggctcaatagcgacacaacaaccggaaagcaacatattagacattgatctaaggcctgcatctgcatggacattatatgcagtcgctacaacatttgtgacacccatgttgcgacattccattgaaaactcgagcgttaacgttagtttaacggcaatcgcaaaccaagcaaccgttctaatggggctaggaaaaggatggcccttatctaaaatggatataggcgtacccttattagcaataggatgttactcacaggtaaacccaataacactcacggccgctttacttttactcgtggcgcattacgcaattataggtccaggtctacaggcaaaggctactcgagaagcccaaaagagagccgctgcaggtataatgaaaaaccccacggtagacggtatcacagtgatagatctcgatcctataccatacgatcctaaatttgagaaacagctcggacaagtgatgttgctcatcctgtgtgttactcaagtccttatgatgagaacaacctgggcactctgcgaagccttaacactagccacaggtccgatttctacattgtgggagggaaatccaggacgattttggaatacgacaatcgctgtttctatggcaaacatttttcgaggatcgtatctagcaggagcaggactcttattttcgataatgaaaaatacgactaacacaagaagagggacaggaaatataggggaaactctgggagaaaagtggaagagtagactaaacgcacttggtaaaagtgaatttcaaatctataagaaatcagggatacaagaagtagaccgcacactcgctaaggaagggataaaacgtggggaaacggatcatcacgcagtttctagaggttcagcaaaattaagatggttcgtagaaagaaacatggtaacaccggagggaaaagttgtagacctaggctgtggtcgaggaggttggtcgtactattgcggaggcctgaaaaacgttagggaagtcaagggtttaaccaaaggagggcccggtcacgaagaacccatacctatgtctacgtacgggtggaatttagtcagactacaatctggcgtcgacgttttctttatacctccggaaaaatgcgatacactgctatgtgatattggggagagctcacctaatccaaccgtagaagcaggtcgtacactgcgtgtccttaatttagtggaaaattggttaaataataatactcaattttgtattaaagtactaaatccctacatgcctagtgttattgaaaagatggaggcactccaacgaaagtatggaggtgcattagtccgtaatccactatctagaaactcaactcacgagatgtattgggtaagtaatgcttctggaaacatagtctctagcgtaaatatgatatcccggatgttaatcaacaggttcacaatgagacacaagaaagcaacttatgaaccagacgtagacctcggatccgggacgaggaatatagggattgaaagtgaaatacctaacttagatattataggtaaaagaatcgagaaaatcaaagaagaacatgaaacttcctggcactatgaccaagatcatccatataaaacttgggcataccacggcagctacgaaacaaaacaaactggttcagcttccagtatggttaatggtgtagtgagattactcaccaaaccatgggacgttctaccaaccgtaacacaaatggcaatgactgacacgacaccttttggtcagcaaagggttttcaaggaaaaggtagatacaaggacacaagaacccaaagaaggaacgaagaaattgatgaaaatcaccgcagaatggctttggaaggagttaggcaagaagaaaacaccacgaatgtgtacacgagaggagtttactcgaaaggtacgatcgaacgcagctctcggggcaatattcacagacgagaataaatggaagtccgctcgagaggcagttgaagactcacgattttgggagctagtagataaggagcggaacttacacctagaaggaaaatgtgaaacatgcgtgtacaacatgatgggaaaacgggagaaaaagttaggcgagttcggcaaagcaaaaggaagtcgcgctatatggtatatgtggttaggggcacgattcctcgaatttgaagccctaggcttcctgaatgaagatcattggttctcacgagaaaattcacttagcggggtagaaggtgaaggtttgcataaacttggatacattttgcgcgacgtaagcaagaaagaagggggcgctatgtatgcggatgatactgccgggtgggacaccagaattacactagaggaccttaagaacgaagaaatggttacaaaccacatggaaggtgaacataagaaattagctgaggcgatatttaaactaacgtatcaaaataaagtcgtgagggttcaacgaccaacacctagaggaacagtaatggacataataagcagacgggatcaaagaggttctggtcaagtaggaacttatggccttaacaccttcacaaacatggaagcccaactaatccgtcaaatggaaggtgaaggagtcttcaaaaacatacaacacttaaccgttacagaggaggcggcagtgcagaattggctcgcacgagttggaagggagagattaagtagaatggcaatatctggcgatgattgtgtagtaaagccgttagacgatagatttgcaaacgcacttaccgcactaaatgacatgggcaaaatacgaaaggatatacaacagtgggaaccaagcaaaggctggaacgattggactcaagttcctttctgcagtcaccattttcacgagttgataatgaaagacggaagagttctagttgtaccgtgtagaaatcaagacgaactcataggcagggcacgcatcagccaaggtgcgggttggtcactacgagaaacagcgtgcctcggcaaaagctacgctcaaatgtggagtctcatgtatttccatagacgtgacttaagattagccgccaacgcgatatgttcagctgtcccgagtcattgggtcccaacatctagaactacatggtcgatacacgccaaacatgaatggatgacaactgaagacatgctgacagtatggaaccgcgtatggattcgcgaaaatccatggatggaagataaaacgccagtagagtcatgggaggaaataccctacctaggaaaacgggaagatcagtggtgcggatccttgataggattaacatccagagctacctgggcgaaaaatatacaggcagctataaaccaggttagatcactcataggtaacgaagaatacactgactacatgcccagtatgaaacgttttcgacgagaagaagaggaagccggcgtactttggtaa

SEQ ID NO: 22325 - RNA, 9876 nt, synthetic construct
  misc_feature 1..9876: note = derived and/or modified CDS sequence (opt6) from DENV-2__GU131932__SS-prME
  source 1..9876: mol_type = other RNA
tccgcagggatgattatcatgctaattcccactgtaatggcattccatttgacaacaagaaatggagaaccgcacatgattgtagggattcaagaaaaaggtaaatccctgcttttcaaaacagaagatggggtaaatatgtgtacattaatggcgatggatttgggagaactttgcgaggacacaattacttacaaatgtccattgcttcgccaaaatgaacctgaagatattgattgctggtgcaatagcacatctacttgggtgacatacggaacgtgtaccactactggagaacaccgacgagaaaaacgatccgtggcccttgttcctcatgttgggatgggactcgaaacacgtacagaaacatggatgagttcggaaggagcttggaaacatgcacaaagaatcgagacctggatcttaagacatccaggtttcactataatggcagccatacttgcatacacgatagggacgacacattttcaacgcgtcctaatatttatcttgctaacagccgtagcaccatccatgactatgagatgcataggaatttctaatcgagactttgtagaaggggtgtcaggaggtagttgggtagatattgtcttagaacacggaagctgtgtgaccactatggcgaaaaataaacctaccttggattttgaattaataaaaacggaagcgaaacaaccggctaccctaagaaaatattgcatcgaagcgaaactgacaaacacaacgactgaaagtagatgtccaacacaaggcgaaccctcactcaaagaagaacaagacaaacggtttgtatgtaaacacagtatggttgatagagggtggggaaatgggtgcggcctgtttggaaaagggggtattgttacctgcgcaatgttcacatgtaagaaaaatatggagggtaaaatagtacaaccggaaaacctagaatatactatcgtagtaacacctcatagcggtgaagaacatgctgtaggaaatgataccggaaaacatggcatggaaataaaagtaacaccacaatcttccataacggaagctgagcttacaggatatggcacagtaaccatggaatgttcgcctcgtactggattagactttaacgaaatggttctacttcaaatggagaataaggcatggcttgtacatagacagtggtttttggatctgccattaccatggctaccaggtgcagataaacaagaatcaaattggatacaaaaagagacgttagtaactttcaaaaatccgcatgctaagaagcaagatgtggttgtcttgggttctcaggagggggcaatgcatactgcactcactggggctactgaaatacaaatgtcaagcggaaatcttctattcaccggtcacttgaaatgcagactccggatggataaacttcaactcaaaggaatgagttattctatgtgtacgggaaaatttaaagtagtaaaagaaatagcggaaacacaacatggaacgatagtgattcgtgtacagtatgagggagatgggagtccatgcaagataccgttcgaaataatggatttggaaaaacggtatgtgcttgggagactgattacagtcaaccctattgttacagagaaagactcacctgtaaatatagaagctgaaccgccctttggtgatagttacataataatcggagtagaacctggacaactgaaacttaattggttcaagaaagggagttcaattggacaaatgttcgagacgacaatgagaggtgccaaacgaatggccatcttaggagatacagcctgggattttggaagcctgggtggtgtttttacttcgataggaaaggccctgcatcaggtttttggggcaatatacggagctgcattttcgggtgtctcctggacaatgaaaatcttaataggagtgataataacttggataggtatgaactccagaagtacctcgttatcagtttctctggttctagtgggaatagtgacactttatttaggtgtaatggttcaagctgatagtggctgtgtcgtttcatggaaaaataaagagctaaagtgtgggtctggcatatttataacagataacgttcacacatggactgaacaatacaaatttcagccagaatcgccttctaaattagcatcagcaattcagaaagctcaagaagaaggcatatgcggtatacggtccgtaacacggctcgaaaatctaatgtggaagcaaataacaccagaattaaaccatattttagcagaaaacgaggtgaaactaacgataatgacaggagatataaaagggattatgcaagcaggtaaaaggtctttaagaccgcagccgacagaattaaaatacagttggaaaacatggggcaaagcaaaaatgctttcaacagaatcttacaaccaaacatttttgatcgatggacctgaaactgcagaatgtccaaacacaaacagggcgtggaactcattggaagtagaagattacgggttcggagtctttaccaccaacatatggctcaaactaaaagaaaaacaggatgctttttgcgattcaaaacttatgtcggctgcaataaaagataacagggcggtacatgcagatatgggttattggattgaaagtgccttaaacgatacgtggaagattgagaaagcatcattcattgaagttaaaaattgccattggcccaaatcacataccttgtggtcaaatggagtgcttgagtctgaaatgattattcccaaaaatctcgcggggccagtgagtcagcacaattatagaccaggatatcacacacaaatagctggaccttggcatctaggaaagctagaaatggatttcgatttttgcgatggaacgacagtaatagtaaccgaagactgcggaaacagaggtccttccctcagaaccactacagccagcggcaaacttattacagaatggtgttgtcgctcctgtacgctcccacctttgagatatcggggagaagacggatgctggtatggtatggaaatacgacctttaaaagaaaaagaagaaaatttagtgaacagtctagtgacggccgggcatggtcaagtggacaatttctccctaggcgttttagggatggcgttgtttttagaagaaatgctacgtacaagagttggaacaaagcacgccatcttgttagtagcagtcagctttgtgacgctaattaccggtaacatgagttttaaagacttaggtcgagttgtagtaatggtgggcgcgacaatggctgatgacattggaatgggggtgacctaccttgcgttgctagcggcctttaaggtacgtcctacatttgcagcaggacttcttcttcgaaaacttacaagcaaagaattaatgatgactaccattggtattgtattactaagtcaaagtacaattcctgagaccgtcctcgaactcacagacgcattagctcttggaatgatggttttaaaaattgtaagaaatatggaaaagtatcaattagcagtcaccataatggctattttatgtgtcccaaacgcagtcatcctacaaaatgcttggaaagtttcctgtactatattagcggttgtctcagtaagcccactactattaaccagttcacaacagaaaacggattggatccctctcgcacttacaataaaaggtttgaacccaacagcaatttttctaacaacactatcacgtacgaataagaaacggagctggccattaaacgaggccatcatggctgtaggtatggtatcgatattagccagctcactgctcaaaaatgacattccaatgacaggtccactggttgcgggaggattactaaccgtatgctatgtcctaaccgggagaagtgccgatctagaacttgagcgagcaaccgatgttaaatgggaagaccaagccgagataagtggatcttctccaattttatctataacaatttctgaagacggctctatgtccatcaaaaacgaagaagaagaacaaacactaacaatattgattcgtactggtctactggtaataagtggattatttccgataagcataccaataacggcagcagcgtggtatctttgggaagtaaagaaacaacgggccggtgttttatgggatgtgccgagtccaccgcccatgggcaaagccgaacttgaagatggtgcttaccgtataaaacaaaaaggaatactcggctactctcaaattggtgccggcgtgtacaaagaaggaacgttccacacaatgtggcatgttacaagaggcgcggtactgatgcataaaggaaaacgaatagaaccttcatgggcagatgtgaagaaagatctaattagctacggaggcggttggaaattagaaggggagtggaaggaaggggaagaagtccaagtactcgctctggaacctggcaaaaatcctagggcagttcaaactaaaccaggtctgttcaaaacaaacacagggacaatcggggcagtttcattggacttctcacccggtacaagcggtagcccaataatcgacaagaaaggaaaagtagttggtttatacggtaatggggtagtaacacgttcgggggcctacgtctcagctattgctcaaacagaaaaatcaatcgaagataatccagaaatcgaagatgacatatttagaaaaagacgtttaacaataatggacttacatccaggagcaggtaaaactaaaagatacctcccggctatagtgcgggaggcgataaagaggggtttgcgaacattaatcctggcacccacacgagtagttgcagcagaaatggaggaagcgctcagaggtttgcctatacgttatcagacaccagcaatcagagcagaacacacaggtcgagaaattgtagacttaatgtgtcatgccacattcacaatgagattattgagcccggtcagagtaccaaattacaatttaatcatcatggatgaagcccattttacggatcctgcatcgattgccgctagagggtatatatccacgagggttgaaatgggtgaggctgccggaatattcatgaccgctactccacctggttcgagagatccgtttccccagtcaaatgctcctattatagacgaagaaagagaaataccagaaagaagctggaactctggtcacgaatgggtgaccgacttcaaaggaaaaacagtttggttcgtaccgagtattaaagctggaaatgatatagccgcttgtttacgtaaaaatggaaagaaagtaatacaactgtcacggaaaactttcgattctgagtatgtaaaaactaggacaaacgattgggactttgttgtgacgactgacattagtgaaatgggcgccaatttcaaagcagagcgagtcatcgaccctagacgctgtatgaaacccgtcatccttacagatggtgaagaaagagtaattctagcaggccctatgccagttacacattcgtcagcagcgcaaagaaggggacgtattggacgaaacccgaaaaacgagaacgatcaatacatttatatgggagaaccacttgagaatgacgaagattgtgcacattggaaggaagcaaagatgttgctagataatataaatacaccagaaggtattattccaagtatgtttgaaccagagagagaaaaagtcgatgccatcgatggcgaatatcgattaaggggagaggcgcgcaaaacatttgttgacttaatgaggcgtggagacctgccagtctggttagcctacaaagtagctgcggaaggaattaattatgctgatcgccgttggtgttttgatggaattaagaataatcaaatattagaagaaaacgtagaagtagaaatttggactaaagagggggagcgcaagaaacttaaacccaggtggttagatgcccgaatatatagtgatccattggcccttaaagagttcaaagaatttgctgcaggacgaaaatcattgacgttgaacttaataactgaaatggggagactaccaacatttatgacgcagaaaaccagggacgcgctcgataatttagcggttctacataccgcagaggcaggaggtagggcctataatcacgccttaagtgaactacccgagactttagagacacttctactattaactttattggcgacagttacgggaggaatatttttatttctcatgtcaggcagagggatagggaaaatgacgctgggaatgtgttgcatcataactgcgagcatattactctggtatgcacaaatacaaccgcattggattgcggctagcataatattagaatttttcttgatcgttctgttaatcccagaacccgaaaaacaaaggacgccccaagataaccaattgacttatgttgtaatcgcaattcttacagtagtagctgctaccatggcaaatgaaatgggattcctggaaaagacaaagaaagatctgggtctgggaagtatagctacacaacagccagaatccaatattttagacatagacttacgaccagctagcgcatggactttatacgcagttgccaccacatttgtaacaccaatgctacggcacagtatagaaaacagtagcgttaatgttagtttgactgcaatagctaaccaagcaactgtattaatgggactgggtaaagggtggcctttatccaagatggacataggagtaccgttgctagcaattggatgttacagtcaagttaacccgattactcttacggcagcgctactattgttggtcgcccactacgcgataataggacctggcttacaagccaaagctacgcgagaagcgcagaaaagggctgcggcaggtatcatgaaaaacccgacagtcgatgggataacagtgattgacctagacccgatcccttatgaccctaaattcgagaagcagctaggccaggtaatgctgttgatattgtgtgtaacacaagtactaatgatgaggaccacatgggctctatgtgaagctctaacattagctaccggtcccatctccacactgtgggaaggtaacccagggagattctggaataccactatagctgtatcgatggcaaatatttttcgaggttcctatcttgctggggcagggctgttattctcgattatgaagaatacaacaaatacgaggagaggaacgggtaatataggggaaactcttggagaaaaatggaaaaatagacttaatgcattaggtaaatcagagttccaaatctataagaaatccgggatacaagaagtcgatcgaacattagcaaaagaaggtattaaaagaggagaaaccgaccatcatgcagtcagccgcggaagtgccaagttgcgatggttcgtagaacgaaacatggtgacgccagaagggaaagtcgttgatctcggctgcggaaggggaggatggtcatactattgtggaggactcaaaaatgtacgagaagtaaaaggactaactaagggtggtcccgggcacgaagaacctatcccgatgagtacatatgggtggaaccttgtaagattacagtctggcgttgatgtcttctttatccctcctgaaaaatgtgatactctgctgtgtgacatcggcgaatctagtcccaatcctaccgtggaagcaggcagaacgttgcgagttctcaatctggtagaaaactggctaaataataatacacaattctgcattaaagttttgaatccatatatgcctagtgtaatagagaaaatggaagcattgcaacgaaagtatggtggagctctagtgagaaatcctctatcaagaaacagcacacacgaaatgtattgggtatcaaatgcgtctggtaatatagtaagcagtgtaaatatgattagtcggatgctaattaatcgatttaccatgagacacaagaaagcgacatacgagcctgatgttgatttaggatcagggacacgtaatattggaatagaatctgagattccaaacctagatattattggaaagagaattgagaaaataaaagaagaacacgaaacaagctggcactacgaccaagaccatccatataaaacgtgggcatatcatggatcatacgaaacaaaacagactggaagtgcatcttcaatggtcaatggtgttgttagattactgacgaaaccatgggatgtcctccctacagtaacccaaatggcaatgacagacaccacaccttttggacaacaaagggtcttcaaagaaaaagttgacacgagaacacaagagcctaaagaaggtaccaagaaactgatgaagataactgctgaatggttatggaaagagcttggcaagaagaaaactccccgcatgtgcacccgagaagaatttacaagaaaagtacgaagcaatgcagcactgggagccatatttaccgatgagaataaatggaaatcggcccgagaagcggtcgaagattcaaggttttgggagctagttgataaggaaagaaacttgcacttagaaggtaaatgtgaaacatgtgtctataacatgatgggaaaacgagagaagaaactaggagaatttggaaaggcaaaaggctcgagagctatatggtacatgtggcttggggcccgctttctagaatttgaagcattagggttcttaaatgaagatcattggttttcgcgagaaaacagtctaagcggggtcgaaggtgagggcttacataaattaggatacatattgagagatgtctctaagaaagaaggaggagctatgtacgcggatgataccgccggctgggatacaaggataactttagaagatcttaaaaatgaggaaatggtgacgaatcacatggaaggtgagcataagaaattagcagaggctatctttaaactcacgtatcagaacaaggtagttagagttcagagaccaacgcctcgaggaacggtgatggacatcataagtcgaagagaccaacgaggatcaggccaagtcggcacatatggattaaatacctttacaaatatggaagcacaattaatacggcagatggaaggcgagggggtttttaagaatattcaacatctgactgtaacggaagaagcagcggttcaaaattggttggcaagagtaggccgtgagagacttagtagaatggcaatctcaggcgacgattgcgtagtaaaacctttagacgataggtttgccaacgcattgactgcattgaatgacatgggaaaaattagaaaagatatacaacaatgggaaccatcaaaggggtggaacgactggacacaagtaccgttttgtagccaccattttcatgagctaatcatgaaagatggtagagttctagttgttccgtgtcggaatcaagacgagttaatcgggagggcaaggatttctcagggggctggttggagtttaagggaaaccgcctgtttaggaaagagctatgcacagatgtggtcgttaatgtattttcatcgaagggatttaagattggctgcaaatgcaatatgttcagccgtgccttcacactgggtcccaacaagcagaacgacatggtctatacacgccaaacatgaatggatgacaacagaagacatgcttactgtatggaatcgagtatggatccgtgaaaatccttggatggaggacaagaccccagttgaatcatgggaagaaattccatatttaggtaaaagagaggaccagtggtgcggcagcctaataggacttacgtcaagagctacatgggcgaagaatattcaggctgcaataaatcaagttagaagtttgataggtaatgaggaatacacagattacatgcctagtatgaagcgattccgtcgagaggaagaagaggcaggagtactatggtaa

SEQ ID NO: 22326 - RNA, 9876 nt, synthetic construct
  misc_feature 1..9876: note = derived and/or modified CDS sequence (opt6) from DENV-2__GQ199892__SS-prME
  source 1..9876: mol_type = other RNA
acagctggggtaatagttatgctgattcctaccgcaatggcatttcatctaacgaccagaaatggcgaacctcatatgatagttggaagacaagaaaaaggcaaatcgctactgtttaaaacagaagatggagttaatatgtgtacgcttatggcgatagatctaggtgaactatgtgaagatacaataacctataaatgcccgttactacgacagaatgaacctgaagatatagactgctggtgtaactcaacaagtacttgggtgacgtatggtacatgcacaactacaggagaacaccgcagagagaaaaggagcgtggccttagtacctcacgtgggaatggggttagaaaccagaacagaaacctggatgagttcggagggagcatggaaacacgtacaaagaattgaaacttggatactaagacatccaggatttacgattatggctgcgatacttgcatacaccatcggaactacccattttcagcgagcattgatatttattttacttacagcagtagcacctagtatgacaatgcgttgtataggtatcagtaacagggatttcgttgaaggagtatcaggaggctcatgggtagatattgtactcgaacatggatcgtgtgttaccacaatggctaaaaataagccaaccctcgattttgaactgataaaaacggaggcaaagcaacccgcaacacttagaaaatattgtatagaagcaaaactcacgaatacgactacagagtctcgttgtccaacccagggggaaccttctcttaatgaagaacaagacaaacgatttatttgtaaacatagtatggtagaccgcggatggggtaatggatgtggtctattcggaaagggcgggatagtaacatgtgctatgttcacttgcaagaaaaatatggaaggtaaaatagtacaaccagaaaatttggaatacacgatcgtgattactccacactctggagaagaacatgctgtaggaaatgatacaggcaaacacggaaaagaaataaaaataacaccccaatcatctacaacagaagcagaattaacagggtacggaacagttaccatggaatgcagccctaggacaggtcttgattttaacgaaatggtgctacttcaaatggaagacaaagcatggttggttcaccgtcaatggttcttggatctgcccttaccttggttgcctggagcagacactcaaggtagtaactggattcagaaagagactctagtaacattcaaaaatccgcatgccaagaagcaagatgtagttgtgctcggaagccaagaaggtgcaatgcatacagcactaacgggcgcaacagaaattcagatgtcatcaggaaatctacttttcactgggcatttaaagtgcaggttaagaatggacaagctacaactcaagggtatgagttatagtatgtgtacaggaaaatttaagattgttaaagagatagcggagacacaacacggaacgattgtaatacgtgtccaatatgaaggagatggagcaccatgtaagataccgtttgagataacagacttagagaaacgacatgttttaggacgattaattacggtaaatccaatcgtgacagaaaaagattcccctgttaacatagaagccgaaccaccgttcggagatagctatatcatcgtaggggtagagccaggacaactaaaacttaattggttcaagaaaggatcgagcattggtcaaatgtttgagactacaatgagaggcgcaaagcgaatggcaatccttggagacaccgcatgggatttcggatctctcggcggggtgttcaccagtataggcaaagcacttcaccaagttttcggagcgatctatggagctgcattttctggggtgagttggacaatgaaaattttaattggtgtgataataacttggattgggatgaatagtaggtcaactagcttgtcagtctcactggttcttgtgggggttgtaacgttgtaccttggcgccatggtacaagccgattcaggttgcattgttagttggaaaaataaagaattgaaatgcggatcgggaatattcattactgacaatgtccacacttggacggaacaatataaattccaaccagaatccccatctaaactagctagtgcgatacaaaaggcccacgaagaagggatatgtggaataaggtctgtaacacggttggaaaatcttatgtggaagcaaataactccagagctcaatcacatattatctgagaacgaagtaaaactaacgattatgacaggagatattaagggaatcatgcaggcaggaaaacgcagtttaagaccgcaacccacggaactaaagtactcgtggaaaacctggggcaaagctaaaatgctatctacagaatcgcacaaccaaacgtttcttatagatggaccagagactgcggaatgtcctaatactaatagagcatggaactcgctagaagttgaagactatggttttggcgtgttctcaacgaacatttggctaaaattacgagaaaaacaagacgtattttgtgattcgaagttgatgtcagccgctataaaagataatcgagctgtacatgctgacatgggctattggatagaatcggccctaaatgatacttggaagatggaaaaagcatcgtttattgaagtaaaatcatgtcattggccgaaatcgcatacgttatggagcaacggagtcttagaatcggaaatgatcatacccaaaaattttgcaggacctgtctcacaacataattacagaccgggttatcatacacagaccgctggtccctggcatttaggaaaattagaaatggacttcgatttttgcgaagggacaaccgttgtagtcactgaagactgtggtaatagaggcccatcactaaggactacaacagcatcgggtaagttaattaccgagtggtgttgtagatcttgcactcttccaccattacgatatcgtggcgaagacggatgttggtatggaatggaaataagaccacttaaagaaaaggaggaaaacctggtaaatagcttagtaaccgcgggacacgggcagattgataacttttcattaggaatattaggaatggctttgtttttagaagagatgttgagaacccgcgtaggaacaaagcatgcaatactgttggtagcattgtcattcgtcactttaataacagggaatatgtcatttcgtgacttaggtcgagtgatggttatggtcggcgcaactatgaccgacgatataggaatgggggtaacatatctagcattgttagcagctttcaaagtccgcccaacttttgcagcaggattactactacgaaaactaacctcaaaagaattaatgatggccactatcggaatagcgctactgtcccaaagcactctccccgaaactatattggagttgaccgatgccctagccttaggaatgatggcattaaaaattgtaagaaatatggaaaaataccaactcgcagttacaataatggcgataagttgcgtacctaatgcagtcattttacaaaatgcctggaaagttagttgcacgattcttgcagccgtaagcgtttcgccgttgttactgaccagctcgcaacagaaagctgactggattccgctggcgctcactataaaaggcttaaatcccacagctatatttttgaccacgttatcgcgtacgagcaagaaaagaagttggccccttaacgaagcaataatggctgttggaatggtatcgatcctagcttcatcactactcaaaaatgatattccgatgacaggtcccctagtggctggaggactactcactgtgtgttatgttctaacgggtcggagtgctgaccttgagctcgaaagggctgcagacgtaaaatgggaagaccaagccgaaatcagtggctcctccccaatacttagcataactataagtgaagacggctcgatgtcaattaagaatgaggaagaagaacaaaccctaacaattctcataagaacggggttattagttatatcaggagttttccccgtgtcaataccaataacggctgcagcatggtacctgtgggaggttaagaaacagagggccggggttctatgggatgtacctagtccacctcctgtaggcaaggcagaacttgaggatggggcgtacagaattaaacaaagaggtattctaggatatagtcagatcggagccggagtatacaaagaagggacattccacacaatgtggcatgttacaagaggtgctgtccttatgcatcgtggtaaacggatcgaaccgtcatgggctgatgtcaagaaagacctaatttcgtatggagggggttggaagctagaaggagaatggaaggagggggaagaggtacaagtgttagcattggaaccagggaaaaacccaagagctgtacaaacaaagccaggcatatttaaaacgaatacagggaccattggggctgtcagcttagattttagccccggcacaagtggttccccaatagtagatagaaaaggaaaggtagtaggcttgtacggaaacggtgttgtaacacgtagcggagcctatgtgagtgccatagcccaaactgagaaaagtatagaagataaccctgaaatagaagatgatatattcagaaagaaaagattaacaataatggatctccatcccggggctggtaaaacgaaaagatatctgccagcaatagtaagggaggcaataaaacggggcttgcgaacgcttatacttgcccccacaagggtcgttgctgctgaaatggaagaagccttacgaggactacctatacgatatcagacgccagcgattagagcagaacacacgggtagggagattgtagacttgatgtgccatgccactttcaccatgagactgctgtcaccggtaagagtacccaactataacctaataataatggatgaagcacatttcaccgaccctgcatcaattgcagcccgcgggtatatttcaacacgcgttgaaatgggagaagctgctggcatttttatgactgctacaccacctggttccagagatccatttccgcagtcgaatgcaccgattatggatgaagaacgagaaatacctgaaagaagctggaactctggccatgagtgggtaacagactttaaagggaaaacagtatggttcgtcccttcaattaaagccggaaatgatatagcagcttgcctgaggaaaaatggaaagaaagtaattcaactttcaagaaaaacatttgatagcgaatatgtaaaaacacgggcaaatgattgggactttgttgtgactactgacattagcgaaatgggagctaactttaaagcagagagagtgatcgatccaagacggtgtatgaaaccagtaatacttactgatggagaagaacgggtaattttagctggacctatgccagtaacgcatagttccgctgcacaacgccgtggtagaataggtagaaatcccaaaaatgaaaatgatcaatacatatacatgggggaaccacttgaaaacgatgaagattgtgcacattggaaagaggccaaaatgctcctagataatataaatacccccgaagggataatacctagcatgtttgaaccagaaagggaaaaagtggatgctattgatggagaatacagattaaggggcgaagcccgaaagacctttgtagatctcatgcggagaggcgatctgcctgtatggttagcttataaagtagcagccgaaggcataaactatgccgacaggaaatggtgttttgatggaatcaaaaataaccaaatattagaagagaatgtggaagttgaaatatggactaaggaaggtgaaaggaagaaattaaaaccacgctggcttgatgctcggatatatagtgatccactggccctgaaggaatttaaagaatttgcagccggaagaaaaagcctaaccctaaacttaatcacggaaatgggacgtcttccaacatttatgacgcaaaaggccagaaatgcgttggataacttagctgtacttcacacagcggaggtgggcggcagggcctacacccacgccttaagtgaattacctgaaacgttagagacacttttgttattgaccttacttgcaacagttacgggtggtatatttttgttcttaatgagtggtaaaggtataggaaagatgacactcggtatgtgttgtataatcacggctagcatactattatggtatgctcaaattcaaccacattggatcgcagcctcaataatacttgagttctttttaattgtcttactaattccggagcctgagaaacagagaacgccacaggacaatcagctcacctacgtggtcattgcaatattgacggtcgtagctgctacgatggccaacgaaatgggctttttggagaaaacgaagaaagatctaggctttggatcaataacaacacaagaatcagaatctaacatactagacattgatctaagaccagcaagtgcctggaccttatatgccgttgcaactaccttcgtaacacccatgcttagacattctatagaaaactcaagtgttaacgtttcactcactgcaatcgcaaatcaagcgacagtcttaatgggacttgggaaggggtggccactttcgaaaatggatataggagtgccgctactggctataggatgttactcgcaggttaatccgataactcttaccgcggcacttctattattagttgcacattatgcgattataggtccaggccttcaggctaaggcaaccagagaggcccaaaagagagcagctgctggtatcatgaaaaacccgaccgtagacggaataactgttatagatttagaaccaataccctacgatccaaaatttgaaaagcaattgggacaggtaatgcttctgatactatgcgttacgcaggtattaatgatgagaactacgtgggcattatgtgaagctctgactttagcaactggtccaatcagtacactatgggaggggaatcctggacgtttttggaacaccacaatagcagttagtatggcaaatatttttaggggctcttatctcgcgggtgctggactactatttagtatcatgaaaaatactactaacacccggcgtgggaccggaaatgttggagaaactcttggagaaaaatggaagtctcgactaaatgctttagggaaatctgaatttcagatatacaagaaaagcggtattcaagaagtagaccggacactcgcaaaagagggaattaagagaggcgaaactgatcatcacgcagtaagtagaggttccgcgaaattaaggtggtttgtagagcgcaatatggttactccggaaggtaaggtagtggacctcggttgtggacgtggaggatggtcctactattgcgggggtttaaagaacgtccgagaagtcaaaggcttgacaaaaggagggcctggccatgaagaacccatccctatgtctacatacggatggaacttggtccgcctgcaaagtggagttgatgtattcttcactccacccgagaaatgcgataccctcctatgcgatataggagaatcatcaccgaatcccactatcgaagcaggacgaacgttaagagtactaaatctagtagaaaattggttaaacaacaatactcagttttgcatcaaggtcctaaacccctacatgcccagtgtaattgagaagatggaaacattgcaacgcaaatacggaggagcactcgttagaaatcctttatcgcgaaattcaactcatgagatgtattgggtgtccaatgctactggtaatatcgtgagttcagttaacatgatatccagaatgttaattaataggttcaccatgaagcacaaaaaggccacttacgaaccagacgttgacttgggatctggaacacgaaatataggaatagaaagtgaaataccaaacctagacattatagggaaacggatagagaaaattaagcaagaacatgagacttcttggcactatgaccaagatcacccttataaaacttgggcctatcacggatcgtatgagaccaagcaaactggttctgcgagcagtatggtcaacggagttgtaagacttcttacgaagccttgggacgtagtcccaatggtgactcaaatggcaatgacagacacaacgccatttggacaacaaagagtttttaaagaaaaagtggacacacgtacacaggaaccaaaggaaggcaccaagaaactaatgaaaataacagcagaatggttgtggaaagaattaggtaaagagaaaactccgcgaatgtgtaccagggaagaatttactaggaaagttagatcaaacgctgcattaggggcaatctttactgatgagaataaatggaaatcagccagggaagcagtagaggatggaagattttgggaacttgtcgatagagaaaggaatttacacttagaaggaaaatgtgaaacatgcgtgtataacatgatgggcaaaagagaaaagaaactaggagaatttggaaaagccaaaggatcgagagcgatctggtacatgtggctgggggcaaggtttcttgaatttgaagcactaggctttctcaatgaagaccattggtttagtcgaggaaattcactatccggagtagaaggtgaaggattacataggctaggttatattcttcgagaagtgggcaagaaagaaggaggggcaatgtacgcagacgacactgccgggtgggacacaaggataactttagaagacctgaagaacgaagagatggttaccaatcatatgaagggagaacacaagaaacttgccgaagcaatatttaaattaacttaccaaaacaaagtcgttcgagtacaaaggcctaccccgagggggactgttatggatataatatcgaggaaagatcaaaggggtagtggacaagtagggacatatggcctcaacactttcactaatatggaagcgcaactgataaggcaaatggagggagaagggatatttaagagtattcaacacctaactgctacagaagagatcgccgtacaaaactggttagctcgagtagggagagaaagattatcacgaatggctattagtggggacgattgtgtagtaaaaccaatagatgaccgctttgcatccgcacttacggccttaaatgacatgggaaaagtaagaaaggatatacaacaatgggagccttcgagaggatggaacgactggacccaggttccattctgctctcaccattttcacgaattggtaatgaaagacgggagggtcttagtcgtaccctgtagaaatcaagatgaactaatagggcgagcaaggatatctcagggagcaggatggtctctaaaagaaacggcgtgtttaggtaaaagttatgcccaaatgtggacactaatgtactttcatcggagagatcttcgactagcagcaaacgctatttgtagcgctgttccgagtcattgggtcccaacttcacgaaccacatggtcaatacatgccaagcatgaatggatgactacagaagacatgttagcagtatggaaccgagtgtggattcaagagaatccgtggatggaagataagacgccggttgaaagctgggaagaagttccatatttaggaaaacgagaagatcagtggtgtgggtcactaatcggtcttacatctcgtgctacttgggccaaaaacatacaaacagccattaatcaagtacgaagtttaatcggaaatgagggttatacagactatatgccctcgatgaaaagatttagacgagaagaagaggaagcaggcgtgttatggtag

SEQ ID NO: 22327 - RNA, 9876 nt, synthetic construct
  misc_feature 1..9876: note = derived and/or modified CDS sequence (opt6) from DENV-2__JF730044__SS-prME
  source 1..9876: mol_type = other RNA
acagctggagtgattataatgttgattccaactgctatggcgttccatttaactaccaggaatggggaaccacacatgattgtaggtcggcaagaaaaaggaaaatctttactattcaaaaccgaagatggagttaatatgtgcactttaatggcgatagatcttggtgaattatgcgaagatactatcacatacaaatgtccactcctacgacaaaatgaaccggaggacatagattgttggtgcaacagcacatccacttgggtgacatacggtacttgtacaactacaggggaacataggcgagagaaaaggagtgtggctctcgtccctcacgttgggatgggacttgaaacacgaacagaaacttggatgtcgtcagaaggagcatggaaacatgtacaaaggatagaaacatggattttaaggcatcctgggttcactataatggcagctatactggcatacaccataggaacgacacacttccaacgggctttaatttttatacttctaactgctgtcgctccaagtatgacaatgcgatgtataggtataagtaatcgcgatttcgtagaaggtgtttctggcggatcctgggtagacatcgtactagagcatgggtcctgtgtcacaactatggccaaaaataaacctacattagactttgaattaattaaaacggaagctaaagaaccagcaacattacggaaatattgtatagaagctaaactaacaaacacaacaactgagtcacgatgtcccactcaaggagaacctagcttaaacgaggaacaagataaaaggttcgtttgtaaacacagtatggttgaccgaggatggggcaacggatgtggactattcggcaaaggaggaatagtcacgtgtgctatgtttacatgcaagaaaaatatggaaggaaaaatagtacagccagaaaaccttgagtataccatcgtcattacacctcattcgggcgaagaacatgctgtggggaatgatacgggaaaacatggcaaagaaataaagataacacctcagtcttcgtcgacagaagcggagttgaccggttatggtacagtaaccatggaatgctcacccaggacgggactcgactttaacgaaatggtactgttgcaaatggaagataaagcatggttagtacatcgtcaatggtttttggatttacctctcccatggttacctggggcggacacacagggatcaaattggatacaaaaagaaaccttagtcacttttaaaaatccacatgcaaagaaacaggatgtggttgtacttggctcacaggagggtgcaatgcataccgccctaaccggcgcaacagagatacaaatgtcttcgggtaatttactatttactggacatctgaaatgtcggttacgaatggacaagctgcaattaaagggaatgtcatattcaatgtgcacaggaaagtttaagattgttaaagaaatagctgaaactcagcacggtactattgtaattcgcgtacagtatgagggagacgggagcccttgcaaaatacccttcgagataatggacttagagaaaaggcatgttttagggcgccttataacagtaaacccaatagtcaccgagaaagacagtcccgtaaatattgaagcagaaccaccattcggggacagttatattataattggagtcgagcctggtcagttaaagctaaactggtttaagaaaggttcaagcattggacaaatgttcgaaactacaatgcgtggagcgaaaagaatggcaattttaggtgatacagcctgggattttggaagcctcggaggagtcttcacttctatgggaaaagcacttcatcaagtctttggggcgatatatggcgctgcattttcaggcgttagctggacaatgaaaattctaataggtgtaataataacgtggataggcatgaatagtcgaagtacaagtttgagcgttagtttggtcctagtcggagtaataactctatacctaggagccatggtacaagcagattcaggatgtgtagtctcatggaaaaataaagaactgaaatgtggctcaggaatatttataactgataacgttcacacgtggaccgagcaatacaaatttcagccagagtcaccatcaaagctagcctcggccattcaaaaggctcacgaagaaggtatttgtggtattaggtctgttacacggctggaaaatttgatgtggaaacagattacgcctgaactcaatcacattttatcagaaaatgaagtcaaactcacgattatgacaggagacataaaaggtataatgcaggctgggaaacgtagccttcgaccgcaaccaacagaattgaaatactcgtggaaaacctggggcaaagctaaaatgctaagcaccgagagccataatcagacgtttttaatagacggaccagagaccgccgaatgtcctaatactaacagggcttggaactctcttgaagttgaagactatggattcggagtttttaccacaaatatctggctcaaactaagagaaaagcaagacgtcttttgtgattcgaaactaatgtctgctgctatcaaagacaatcgcgcggtccacgccgacatggggtattggatagaatcagcacttaatgacacgtggaaaatggaaaaggcttcttttatagaagtaaaaagttgccattggccaaaatcgcatacattatggagcaatggagttttagaaagcgaaatgattatacctaaaagttttgcaggtcccgtatcccagcacaactatagaccaggatactacacacagactgcaggtccgtggcatttaggaaaactcgaaatggactttgatttctgtgaggggaccacagttgtagtcaccgaagactgtggaaataggggaccttcgctaaggacaactacagcgagcggtaagctaataaccgaatggtgttgcagaagttgtacactaccaccactacgttataggggagaagacggttgctggtacggcatggaaataagaccactgaaagaaaaagaagaaaatttggtcaactctctagtaactgcaggacatggtcagatagacaactttagtctaggagttttaggaatggctctatttcttgaagaaatgctaaggactcgagtgggaactaaacacgctatactacttgtagccgtctcctttgtcacgttgataaccggaaacatgtcttttagagatctaggtagggttatggtaatggtaggagcaactatgaccgatgacataggcatgggtgtaacgtacctagcactgctagccgctttcaaagtgagaccaactttcgcagccggccttttactaagaaagttgaccagcaaagaattaatgatggcaacaattggcatagcactactaagtcaaagtactattcccgagacgattcttgaactaacggacgcgctcgctttaggtatgatggtacttaaaatcgtaaggaacatggagaaatatcaactcgcagtaaccataatggctataagttgcgttccaaacgcagtaatactacaaaacgcctggaaagtaagttgcacaatattagcagccgtcagcgtatccccactgctactaaccagtagtcaacaaaaagcagactggattccattagccttaacaattaaaggtttgaatcctacggcgattttcttaactacattatctagaacctcaaagaaaagatcatggccactaaacgaagcaatcatggctgttggcatggtgtcaatactcgcatcctctttacttaaaaacgatatacccatgacagggcctttagtagcgggtgggctactaacagtttgttatgttctgactggtcgtagtgcagatcttgaattggaaagggcaacagatgtaaagtgggaggatcaggcagaaatttcaggtagctccccaatattatctataacaatatcagaagacggttctatgagtattaagaacgaggaggaagaacaaaccttgactattctgatcagaactggactgcttgtcatcagtggattgtttccagtctcgataccaattactgcagccgcctggtatctatgggaagttaagaaacaaagggctggagtactatgggatgtcccatcgccaccaccagtgggcaaagctgaacttgaagatggtgcatatagaataaagcaaaaaggcattttgggctactcacaaattggtgccggagtatataaagaaggtacttttcatactatgtggcacgtcactcgaggagcagtattaatgcatcggggcaagcgaatcgaaccttcctgggcagatgttaagaaagatttaatcagttacgggggaggatggaaactcgaaggagaatggaaagaaggtgaagaagtacaagtgctcgctctcgaacccggcaaaaatccgagagcagttcagactaaacccggattattcaaaaccaatacagggactataggagcagtatccctcgattttagcccaggtaccagtggaagtccaatcgtcgatcgtaaaggcaaggtcgtaggcttatacggaaacggtgtagttacccgatcaggggcatatgtatcggcaattgcccagacggaaaagagcatagaagataatcctgaaattgaagacgatatctttagaaagaaacgacttacgataatggatttacatcctggagcaggcaaaacaaaaaggtatctccctgccatcgtccgagaagccattaaacgcggacttcgcacacttatacttgccccaacacgagtagttgccgccgaaatggaagaagctctccgcggtttgcctatacgataccagacccccgcaatccgtgcagaacacacaggaagagaaatcgtagatctaatgtgtcatgcaacattcacaatgaggttgctatcaccagttagagtacctaactataatttgatcatcatggatgaagcccattttaccgatcctgcaagtatagcagctcgagggtatatctcaacaagggtcgaaatgggcgaggctgccggaattttcatgacagcaacacccccaggatcgagagacccattcccccaatctaatgctcctattatggacgaagaaagagaaattcccgaacgttcctggaatagcggtcatgagtgggtgacggacttcaaaggcaaaacagtatggttcgtgccgagcattaaagctggtaacgatatagccgcatgcctcaggaaaaacggtaaaaaggtaattcagttgtcaagaaaaacgttcgattcagagtacgttaagacaagaacaaacgattgggatttcgtagtcacaacggacatatctgagatgggagcaaacttcaaagccgaacgagtcatagatccgagaagatgtatgaagccggtaatcctaaccgacggagaagaacgagtaattttagctggcccgatgcccgtgacacattcttcagcagcacaacggcgcggtcggataggacgtaatcccaaaaacgaaaatgatcaatacatatatatgggagaacctcttgagaacgatgaggactgcgcacattggaaagaagctaaaatgctattggataatattaatacacccgaaggcataattccatcaatgtttgaaccggaaagggaaaaagtcgatgccatagatggtgaatatcgtctgcgtggcgaggctagaaagacatttgttgacctaatgaggagaggggacttacctgtatggttagcctatcgcgtggcggcagaaggaataaattatgcagaccgaagatggtgttttgacggagtcaaaaataatcaaatcttggaagagaacgttgaagtagaaatatggacaaaagaaggtgaacgtaagaaactaaaaccaagatggttggatgcacggatatattctgatcccctggcactcaaagaatttaaagaatttgctgcaggtaggaaatccttaaccctaaacctcataactgaaatgggtagacttccaacttttatgacgcagaaagcccgtgacgctttagataacctagctgtattacatacagctgaagctggtggtagagcctataaccatgcgttatctgagctaccagaaacattagaaactctcttgctgttaacattacttgccactgtgactggtggtatatttctcttcttgatgtccggcaaaggggtaggaaaaatgacactaggaatgtgttgcattataactgcctctatactgctctggtatgcacaaattcaaccgcactggatcgctgcttcaataatccttgaatttttcttaatcgttttactaatccccgaaccagaaaaacaacgcactcctcaggacaaccaattaacttatgtagttatcgcaatcttaaccgtagtcgctgcgacaatggcgaatgaaatgggttttctagagaaaaccaagaaagatctaggtctaggaagtatcgcgacccaagagcctgaatcaaatattctggacatcgatttaagaccagcaagtgcttggacactttatgctgtggcgacaacattcgttacacccatgctaagacattcaatagagaactcaagcgtgaacgtttcattaacagcgattgccaatcaggctaccgtacttatggggctcggtaagggctggccattatctaaaatggatatcggcgtaccattacttgctataggttgttatagtcaagtaaacccggttacattaaccgcagcgcttttattactggtagcgcactatgccataatcggacctggactacaagcgaaagccacacgggaagctcagaagagagcagctgctggaataatgaaaaaccccacggtagatgggattaccgtaattgacctggatccaatcccatacgatccaaaattcgaaaaacaactgggccaagtgatgctcctaatactttgcgtaactcaagtgttgatgatgaggaccacttgggcattatgtgaagcactaactttagcgacaggaccaatatctacattatgggagggaaacccgggacgattctggaatacgacaatagctgtgtcaatggcgaatattttccgtggaagttacttagcgggagccgggttattgttttccatcatgaaaaataccacaaatacaagaagaggaactggaaacataggagagaccctaggcgaaaaatggaaaagtagacttaatgccttaggaaaaagtgagttccagatatataaaaagtcaggaatccaagaagtggaccggacattggccaaagaaggtattaaacgaggggaaacggatcaccacgctgtctcaagaggttcagcaaaactaagatggtttgttgaacgcaacatggtaacaccagaaggcaaagtagttgatcttggctgtggacgaggtgggtggtcctactactgcggcgggcttaaaaatgtcaaagaagtaaagggtcttactaaaggtggcccaggtcacgaggaaccaataccaatgtctacttacggctggaatctagtacgcctacaatctggtgtcgacgtattctttactcctccagaaaaatgcgacacattactgtgcgatatcggtgaaagctccccaaatccgacgatcgaagccgggaggacactacgtgtattgagtttagttgaaaattggctaaataatgatacccaattttgcataaaagtactaaacccttatatgccctctgtaatcgagaaaatggaaaccttacagaggaagtatgggggagcgttagttcgaaatcccttatcgcgaaactcaacacatgagatgtattgggtaagtaacgcaaccggcaatatagtctcttcggtaaatatgatatcaaggatgctcataaacaggttcacaatgaaacataagaaagccacatacgaacctgatgtcgatttgggctcgggtacgcgaaatataggaatagaatcagaaattcctaatttggacatcatcggcaaacgaattgaaaagataaaacaagagcatgaaacaagctggcattatgaccaagatcacccatataaaacatgggcctatcatggtagttacgaaacaaaacaaacgggatccgcatcctccatggtcaacggagtggtcagattattaacaaaaccatgggacgtcgtaccgatggtaacacagatggcgatgaccgacactacacctttcggacaacaacgtgtctttaaagaaaaagtggatacacgtacacaggagcctaaagaaggcacaaagaaactcatgaagattacagccgaatggctctggaaagaactaggtaagaagaaaaccccgagaatgtgtacacgcgaggaatttacaaggaaagttcgatcaaatgcagcccttggagcgatcttcacagacgaaaacaaatggaagtcagcacgggaagcagtagaagatagcagattttgggaacttgtggataaagaacgtaatttgcacttagaaggtaaatgcgagacatgcgtatacaacatgatggggaaacgagagaaaaagctgggggaatttgggaaagctaaaggaagtagagcaatctggtacatgtggctgggcgccagatttttagaatttgaggctctaggatttcttaatgaagatcactggttttcgagagaaaattcgttaagtggagtagaaggtgagggtttacataaactagggtatatactgagagatgtcggcaagaaagagggtggcgcaatgtacgccgatgatacagctggttgggacactagaataacactggaagatttgaaaaacgaagaaatggttacaaaccatatggagggcgaacacaagaaactagccgaagctatattcaaactaacttatcaaaataaggtagtccgtgtacaaagaccaacaccccgtggaaccgtaatggacataatatctcgacgagatcaaagaggatcgggacaggtcggcacatacgggctgaacacatttacgaatatggaggcacaactaatccgacagatggaaggtgaaggtatatttaaaagcatccagcatctaacagccactgaggaaatagccgttcaaaactggctagcacgggttggaagagaacgtttatcaaggatggcgattagtggagacgattgcgtggtaaaacctttagatgataggttcgcaagcgctctaactgccttaaatgatatgggcaaagtacgcaaggacatccaacaatgggaaccgtctagagggtggaatgactggacacaagttcctttttgcagccaccatttccatgaattaataatgaaagatggaagggtattagtagtaccttgcaggaatcaggacgaattaatagggagagcgagaatatctcaaggcgcaggctggtcattgaaagaaacggcatgcctcggtaaaagctacgcacaaatgtggtcacttatgtacttccatagaagagacttacgacttgcagcgaatgctatatgtagcgccgtaccttcacactgggtacctacaagtcgaacaacatggtctatccatgccaaacatgaatggatgacaactgaagatatgctaactgtctggaatagggtctggatacaggaaaatccgtggatggaagacaaaaccccagtggaaagctgggaggaagttccctacttgggaaagcgagaagatcaatggtgtggatcactaatcggactcactagccgtgctacgtgggcaaagaatatacaaacggcaatcaatcaagtacggtcattaatcggtaatgaagaatacactgattatatgccatcaatgaaacgatttcgaagagaagaggaagaagcgggcgtactctggtaa

SEQ ID NO: 22328 - RNA, 9876 nt, synthetic construct
  misc_feature 1..9876: note = derived and/or modified CDS sequence (opt6) from DENV-2__FJ639697__SS-prME
  source 1..9876: mol_type = other RNA
acagcaggagtaataataatgttaattcccacagctatggcatttcatctgaccacacgcaatggagaacctcatatgatagtaggtcgacaagaaaaaggaaaaagcctattattcaaaactgaagatggagttaatatgtgtactttgatggcaatagacctgggagaactctgtgaagatacaataacatacaaatgtccgcttttaagacaaaacgaaccagaagatatcgattgttggtgtaattctacttcaacgtgggtgacatacgggacttgcactacaactggtgaacatcgaagagagaaaagaagcgtagctttagtgccccacgtgggtatgggactagaaacacgaactgaaacatggatgtcctcagaaggagcttggaaacatgtgcaacgtatcgaaacatggatactacgtcatccggggttcacgataatggcagcgattctggcttatacgataggtaccacacattttcaaagagcattaatattcatattattaaccgctgtagcacccagtatgactatgagatgtatcggaatcagtaatcgagacttcgtagaaggtgtcagtggtggttcatgggtagatatagttctagaacacggtagttgcgtaacaacgatggctaaaaataaaccaacgctcgattttgaattaattaaaacagaagcaaaagaaccagcaactctaaggaaatattgtatagaagcaaaactaaccaatacgaccacagaatcaagatgcccaacacaaggagaaccgtcattaaatgaagaacaagataaacgatttgtatgtaaacattcaatggtagacagaggatggggaaacggttgtggtctgttcggaaaaggaggaatagtaacgtgcgctatgtttacttgcaagaaaaacatggaaggtaagatagtgcaaccagaaaatctagaatatacaatcgtaattacaccacatagtggggaagaacatgcggtaggaaacgatacaggtaaacacggcaaagaaataaaaattacaccgcaaagcagttcaaccgaagcagaattaacaggatacggaacagttactatggaatgctcccctaggacaggattagatttcaatgaaatggttctactccaaatggaagataaagcctggttggtacaccgtcagtggtttttagatttaccattaccctggttacctggagcagatacccaaggaagcaattggatacagaaagaaaccttagtaactttcaagaatccacatgccaagaaacaggatgtagtagttttaggaagtcaggaaggagcaatgcacacggctctgacgggagcaacagaaatacaaatgtcgagcggaaatctgttgttcacaggtcatctaaaatgccgtctccgaatggataaattacaattaaaaggcatgagctacagtatgtgcacaggtaagtttaaaattgtcaaggaaatagcagaaactcaacatggtacgattgtcattagggttcaatacgaaggagacggcagtccgtgcaaaatcccttttgaaataatggacctggagaaaagacacgtccttggaaggttgatcactgtaaatcctatagtgactgaaaaagactctccggtgaatatagaggcagaacccccttttggggattcttacattataataggagtcgaaccaggtcaattgaagttaaattggttcaagaaaggatccagcataggccaaatgttcgagactacaatgagaggtgcaaaacgtatggcaatactaggggacacagcttgggatttcgggtctctgggcggggtttttacatctatgggaaaggccctacatcaagtatttggtgcaatatatggggcggcatttagcggagtttcatggacaatgaaaattctcataggggtgatcatcacatggatcggaatgaactctagaagtacttccctcagtgttagcttggtcttagtcggtgtaataacactatatttaggagcaatggtacaagctgattctgggtgtgtagtatcgtggaaaaataaggagttaaagtgtggttctggaattttcataaccgacaatgtacacacatggacggaacaatacaaatttcaaccagagagcccgagtaaacttgccagcgcaattcaaaaggcgcatgaggaaggtatctgtggaatacggagtgtgacgaggcttgaaaatttgatgtggaaacaaattacaccggagttaaatcatatattatcagaaaatgaggtaaaactcacaattatgactggagacataaaaggaattatgcaagccggaaaaagatcactgagaccccaacccactgaattaaaatattcctggaaaacatggggaaaagcaaagatgctcagtacagaatcccataaccagaccttcctgattgacggaccagaaaccgcggaatgcccgaataccaaccgagcgtggaactccctagaagttgaagactacgggtttggagtgtttacaacaaacatatggctcaagttgagggaaaagcaggatgtattttgcgattctaaactcatgtcggccgcaatcaaggataaccgagccgtccatgcagatatggggtattggatagagtccgcattaaatgacacgtggaagatggaaaaagctagtttcatcgaggtaaaaagttgtcattggccaaaatcacatactctatggtccaatggcgtgctcgaaagcgaaatgatcatacctaaatcattcgcagggcctgtatcgcaacataattacagacccggttactacacacagacggcaggcccatggcatctaggaaagttggagatggattttgatttctgtgagggcaccacagtggtagttactgaagattgcggcaacaggggtccatcccttcgaacaacaactgcatcaggaaaattgataacagaatggtgctgtagaagctgcacgcttccgccactgagatacagaggagaagatggatgctggtatggcatggaaataaggccattaaaggaaaaagaggaaaatttggtgaacagcctagttaccgccggacacggacagatagacaatttttctcttggagtcctaggaatggccctatttttagaagaaatgctaaggactagagtgggaactaaacatgctatattgctagtcgctgttagctttgtaacactcataaccggtaatatgagctttcgtgacttaggacgcgtaatggtaatggtaggagctacaatgacggatgacattgggatgggggtcacttacttggcgttattggccgcttttaaggtgagacccacatttgcagctggtttactgctaagaaaattaactagcaaagagctcatgatggctacaatcggaatagcgttgctatcgcaaagtaccataccagaaacaattttagagttaaccgacgcattagccctaggaatgatggtgctgaaaatagtacggaacatggagaagtaccaattggcagtaacgataatggccatcagttgtgttccaaacgcagtaatactacaaaatgcttggaaagtaagttgtactatactggcggcagtaagtgtctcacctcttcttttaacatcgtcgcaacagaaagcggactggattccactagcattaactataaaagggttaaatcctactgcaatcttcctgacaacactctcgagaactagcaaaaagagatcatggccgctcaatgaagccataatggctgttggaatggtatcaatattggcgagtagcctcctaaagaacgatatccctatgacaggcccacttgttgccggagggcttctcacagtgtgttatgttttgactgggcgttcagcagatctcgaactagaacgagcaacggatgtaaaatgggaagatcaagcggaaattagtggaagcagtcctatcttaagtattacgatatccgaagatgggtccatgtcaatcaaaaatgaagaagaagaacaaacactgacaatattgatacgtaccggtctattagttatttcgggtctctttccggtttcgattccgataacggctgctgcgtggtacctatgggaagtcaagaaacagcgagccggagttctttgggatgtcccgtcaccgcctccggtcggaaaagctgagttagaggatggcgcctatcggattaaacaaaaaggtattttgggttattcacaaattggagcgggtgtatataaagagggtacttttcacaccatgtggcatgtgacccgtggggcggtattgatgcatagggggaaacgtatagaaccttcgtgggccgatgtcaagaaagaccttatttcttatggagggggatggaagttggaaggggaatggaaggagggagaggaagtgcaagttctagctctcgaacctgggaaaaatccacgcgcagttcaaaccaaaccgggacttttcaaaacaaatacaggaacaatcggcgccgttagcctagatttttcacctggaacctcaggatcaccaattgtagatcgaaaaggaaaagtcgtaggtctatatggaaacggtgtcgtcaccaggtcaggagcatatgtatctgcaatcgcgcaaacagagaagtccatagaagacaacccagaaattgaggatgatatttttcgcaagaaaaggctaacaattatggatctgcaccccggggcaggtaaaacgaaaagatatttacccgcgatagttagggaagccattaagcggggactacgaacactcattctagctccaacaagagttgttgcagcagaaatggaagaggccttgcgagggttaccaatacgatatcagactccagcaatcagagcagagcacacggggcgagaaatcgtcgacctgatgtgtcacgcgacatttactatgcgattattgtctcctgtcagagtgccgaactataacctaataataatggacgaggcacattttacggaccccgccagcatagcagctcgagggtacatatcaaccagagtagaaatgggcgaagccgcgggcatcttcatgaccgctacaccaccaggctccagggatcccttcccgcagtctaatgcaccaataatggatgaagaaagagaaataccggagcgatcatggaacagtggtcacgaatgggtaactgattttaagggtaaaactgtatggttcgtaccatcaatcaaagcagggaacgacattgctgcatgtttgcgcaaaaatggcaagaaagttatacagttaagccgtaaaaccttcgactcagaatatgtaaaaacacgtactaatgattgggattttgtagtgacgactgatatcagtgagatgggagcaaactttaaagcagagagggtcatagatcctcgtcgctgcatgaagccagtcattctgacagacggagaagaacgtgtcatactagcaggccccatgccagtaactcatagttcagcagcacagcgtagagggcgaattggtaggaaccccaagaatgaaaatgatcagtatatctatatgggagaaccgttggaaaatgatgaagactgcgctcactggaaggaggcaaaaatgctactcgacaatataaacacacccgaaggaataattccatccatgtttgaaccggaacgtgaaaaagttgatgctatcgacggcgagtatagacttaggggtgaagcacgaaaaactttcgttgacctaatgaggaggggcgatttgcctgtatggttagcctaccgtgtcgcggcagaaggaataaattacgcggaccgacgttggtgctttgatggggtcaaaaacaatcaaattttagaggagaacgtggaggtggaaatatggactaaagaaggggagagaaagaaattaaaaccacgatggttagatgctagaatctacagcgacccattagctttaaaagaatttaaggaatttgctgctggccgtaaatccttaaccctaaatctgataacggaaatgggaagactacccacattcatgacacaaaaggcccgggacgctttagataatctagctgtattacacacagcagaggcaggagggagggcgtataaccatgcattgtcagagctaccagaaacgttagaaacacttcttctattaacactactcgccactgtcacgggagggatcttcctatttctcatgtctggaaaaggtgtaggtaagatgactttgggaatgtgctgtataatcacagcatcaatattactctggtatgctcaaatacagcctcattggatagcagcttctataatactagagttctttcttatagtactgctaataccagaaccggagaaacagaggacaccacaagataaccagctgacctatgttgtgattgcaattttaacggttgtagctgctaccatggctaatgaaatggggttcctggagaaaaccaagaaagacttaggattgggtagcatcgccactcaagaacctgaaagcaatattcttgacatagatctacgaccagcctctgcgtggacactatatgctgtagcaacaactttcgtgacacctatgctcagacattcaatagaaaattcatcagtaaacgtgtctctcacagccatagccaatcaagccacagtattaatgggacttgggaaaggatggcccttatcaaaaatggacattggggtcccattgctagccatcggatgctacagtcaagttaatccagttaccctaacagctgctctcctactattggttgcccattacgccatcataggtccaggactccaggcaaaggcgacgcgagaagctcaaaagagggctgcggcaggcataatgaagaaccccactgttgatgggattacagtaattgatctagacccaattccatacgacccaaaattcgaaaaacaattgggccaagtcatgttacttatcctatgtgtgacgcaggtcttgatgatgaggacgacatgggcactttgtgaagcattgacattagccaccggccctataagtactttatgggaaggaaatccaggacgtttttggaataccacaatagcagtatcaatggccaacatctttcgaggatcgtatttggcgggagcaggattattgttctcaataatgaagaatacaacaaacacaagaagaggcacgggcaacatcggcgagactttaggtgaaaaatggaaaagtagattgaatgccttagggaagtcggaatttcaaatatacaagaaatcaggcatacaagaggtagacagaacgttagctaaggaagggattaaaagaggtgagaccgatcatcacgcagtttctagaggttcagccaaattaagatggtttgtcgaaagaaatatggtcaccccggagggaaaagtggttgacttaggatgcggaagaggaggttggtcatattattgtgggggcctgaaaaacgttaaggaagtcaaggggttgacgaagggcgggccaggacatgaggaaccaattcctatgtcaacgtatgggtggaacttagtgaggctccaaagcggagtagatgtattctttaccccgccagaaaaatgtgacacactcctctgcgacataggggaatcatcaccaaaccccaccattgaagctgggagaacattacgtgtgctcagccttgtcgagaactggctaaacaatgatacccaattctgcataaaagtgcttaatccgtatatgccttcagtcatagagaaaatggaaacactgcaaagaaaatacggaggcgctctggtaaggaatcccttatccagaaatagtacacatgaaatgtattgggtatccaacgcaacgggaaatatagtaagttcagttaacatgatttctagaatgctgattaataggttcacaatgaaacacaagaaagcaacgtacgaactagacgtagatttagggtcaggaacaagaaacatcggcatagaaagtgaaattccaaatctggatataataggtaagcgaattgagaaaataaaacaagaacatgagacctcatggcattatgatcaggatcatccttacaaaacttgggcataccacggtagctatgagacaaagcaaactggaagtgctagttcgatggtaaacggggtcgtaagactgctcaccaagccttgggatgttgttcctatggtaactcagatggcaatgactgatactaccccatttggacagcaaagggtatttaaagagaaggtagacacacgtacgcaagaaccaaaagaaggaactaagaaactgatgaagataacagcagagtggttatggaaagagttaggtaagaagaaaacccccagaatgtgtacaagggaagaatttacaagaaaagtgcgaagcaatgctgcactcggagcgatatttacagatgagaataagtggaagagtgctcgcgaggccgttgaagattcacgattctgggaattagttgataaagaaagaaatttacacttagaaggaaaatgtgaaacatgcgtttataacatgatgggcaagagagagaagaaacttggagaatttggaaaagcgaaaggaagtagagccatatggtatatgtggcttggcgcaagatttctagagttcgaagcacttggctttctgaacgaagatcattggttcagccgtgagaatagcctatcgggtgtagaaggtgaaggattacataaacttggatatattcttcgcgatgtgggcaagaaagaagggggagcaatgtacgccgacgacaccgctggatgggacacacggataacactagaagacctcaaaaatgaggaaatggtcacaaaccatatggaaggagagcataaaaagttagcggaagctatctttaagttaacttatcaaaataaagtggttcgtgttcaaagaccaactcctagaggtactgtgatggatataataagtagaagagatcaaagaggctcgggacaagtaggaacgtacggattaaacacttttactaacatggaggcccaactaatccgacaaatggaaggcgagggaatatttaaaagcatccaacacctaactgtgacagaagaaattgccgtacaaaactggttagctagagtaggacgagagagattaagtagaatggcaataagcggagacgattgtgtagtgaaacccctggatgatcggtttgcgagtgcactgacggcattaaatgatatgggaaaggtgcgaaaggatattcaacaatgggagcccagcagaggatggaatgattggacacaagttcctttttgtagtcatcattttcatgagcttataatgaaagatgggcgcgtcctagtagttccgtgccgaaaccaagatgagttaatagggagagctagaatctcacaaggtgccgggtggtcccttaaggagacggcttgcctaggaaaatcgtatgcccaaatgtggagtctcatgtactttcaccgtcgagatctacgcttggccgcaaacgcaatatgttctgcagtcccttcacactgggtaccgacaagtcgtactacatggagcatacatgcaaaacatgagtggatgacaaccgaagatatgctaacagtctggaatcgagtttggatacaagaaaatccctggatggaagataaaacgccagtcgaatcctgggaggaagtgccttacttaggaaaacgtgaagatcaatggtgtggtagtttgataggcctaacctcaagaactacctgggccaaaaatattcagaccgcaattaatcaagtgcgctcattaataggaaacgaggagtacactgactatatgccatcaatgaaaagatttcgccgcgaagaggaagaagccggtgttttatggtaa

SEQ ID NO: 22329 - RNA, 9876 nt, synthetic construct
  misc_feature 1..9876: note = derived and/or modified CDS sequence (opt6) from DENV-2__FJ639698__SS-prME
  source 1..9876: mol_type = other RNA
acagcaggggttataatcatgctcatccccacggctatggcgttccatctgactacccgcaatggtgaaccccacatgattgtaggacggcaagaaaaaggaaaaagtctcctattcaaaactgaagatggtgtaaatatgtgcactttgatggcaatagacttaggagaactttgtgaagacaccataacctataaatgtcccttacttcgtcagaacgaacccgaagacatcgattgttggtgtaattctacaagtacgtgggttacctatggaacatgcactacaactggagaacacagaagagaaaaacgttccgtagccctagtaccacatgttggtatgggtcttgaaacacgcacagaaacttggatgtcatcggaaggggcatggaaacacgcacaaagaatagaaacttggatactgagacatcctggattcacaattatggcagcaatacttgcttacacaattggaactacgcattttcaaagagcattgatattcattctgctcacagcagtagcaccatcaatgacaatgcgatgcataggaatttccaaccgagattttgtagaaggcgtttcaggaggctcttgggtggacatagtattagaacatggctcttgcgtaacgactatggccaaaaataaaccaacattagactttgaactcataaaaacagaagctaaagaaccggcaactctacgaaaatactgcatagaagccaaactaacgaatactaccactgaaagcagatgccctactcaaggcgaaccgtcattaaatgaagaacaggataaaaggttcgtttgtaaacattcaatggttgatcgcggctggggaaatggctgtggtttatttggcaaaggaggcattgtaacgtgcgcgatgttcagctgcaagaaaaacatggaaggaaaaatcgtgcagcccgagaatctcgaatatacaatagttataacaccgcatagcggtgaagaacatgcagttgggaatgacactggaaaacatggaaaagaaatcaagatcacaccgcagtcatctataacagaagcagagctaacaggctacggaactgtaacaatggaatgttcacctaggacaggcctagattttaacgaaatggtattactccagatggaggataaagcatggttagtacataggcagtggttcctggacttaccacttccatggctaccaggtgctgacacccaaggaagtaattggatacaaaaagagacattggtcacgttcaagaatcctcatgccaagaagcaagatgttgtagttttgggttcacaagaaggagcaatgcacactgcacttacgggggcgacagaaatacaaatgtcttcgggaaacttgcttttcacaggccacctgaaatgtagactacggatggataaactgcaacttaaaggaatgtcatattcaatgtgcactggcaaattcaagatagtgaaagaaatcgcagaaactcagcatggcacaatagttatcagggtgcagtatgaaggagacgggagcccctgcaaaataccgtttgaaatcatggacttggagaaacgtcacgtattgggtaggttaatcacagttaatcccattataacagaaaaagacagtcccgtaaatatagaggctgagcctccctttggtgattcttatattatcataggagtcgaaccaggtcaacttaaactcaactggtttaagaaaggaagttctattggacaaatgttcgagacaacaatgcgtggtgcaaaaagaatggcaatacttggtgatacagcttgggattttggatcattgggaggagtgttcaccagtattggcaaggcgctacatcaagttttcggagcgatttatggagctgccttctccggagtttcttggacaatgaaaatcctgattggagtaataatcacatggattggaatgaactcccggagtacaagtttatcagttagtttggtgttagttggagttattacgctatatttgggggctatggtacaagcggattccggttgtgtagtcagctggaaaaataaggaactaaaatgcggttctggtatttttataacggacaatgtccatacttggactgaacagtataagtttcaacctgaatccccatctaaattagcgagcgcgattcagaaagctcacgaagagggtatctgtggtattcggagtgtaacacggctagaaaatctaatgtggaaacaaataacccctgagcttaatcatattcttagcgaaaatgaagtcaagttaactataatgactggcgacataaaaggaataatgcaggcaggaaaacgctccttacgaccacaacctacagaattaaaatactcttggaagacatggggcaaagcaaaaatgttatcaactgaatcacacaatcaaacatttttaatcgatggacccgaaaccgccgagtgtccaaatacaaatagagcttggaactctttagaagtagaagactacggatttggcgtatttacaacaaatatatggctgaaacttaaagagaaacaagacgttttctgcgatcctaagttgatgagcgcagctataaaagataatcgagcagttcacgcggatatgggttactggatagagtctgccctaaatgatacatggaaaatggaaaaggcatctttcattgaagttaagagctgccattggccgaaaagtcatacattatggagtaatggagtcctagaatcagaaatgataataccaaagggttttgcgggtccggttagtcaacataactatcgcccgggctactacacgcaaacagcagggccatggcatttgggaaaacttgagatggattttgatttttgtgaaggcactacggttgttgtcacggaagattgtggaaacagaggacctagtcttagaacaacgaccgcatccggtaagttaataacggagtggtgctgtagaagttgcactctaccaccgcttcgataccgaggtgaggatggatgttggtatggtatggaaataagacccctaaaggaaaaagaagaaaatctcgtaaattctctcgttaccgcaggccatggtcaaatagacaatttctcactgggagtactaggaatggccttattcctagaagaaatgttaagaactcgagtggggacaaagcacgcgatacttcttgtggcagtaagttttgtaactttaataaccgggaacatgagcttcagagatttaggcagagttatggttatggtcggagctacgatgacggatgatatcggaatgggagtaacttatcttgcacttttagccgcattcaaagtacgaccgacgttcagtgcaggactacttctcaggaagttaacatcaaaagaacttatgatggctactataggaatcgctctattgtcacaaagtacaatcccggagaccatattagaactaacagatgcactcgcactgggaatgatggtcttaaaaatcgtaagaaacatggagaaatatcaactagcagttactataatggccataagctgcgttcccaacgcagttatacttcagaacgcttggaaagtgagttgcacgatcttagcagccgtctccgtttcgccattattgttaacaagctcccagcaaaaggcagactggataccgctcgccttgacaattaaaggcttaaacccgacagccatatttttaacgactctttccagaacctctaagaaaaggtcatggccattgaatgaagctataatggcagtggggatggtgtctattctagcatcctctttattgaagaatgacataccaatgacgggtcccttggtcgccggtgggctcttaacagtatgttatgtactaaccgggcgatcggcagatttggaattagaaagagcaactgacgtaaaatgggaagaccaagccgaaatatcaggttcctcgcctattttatcgattacaattagcgaagatggaagcatgagtatcaaaaatgaagaggaagaacaaacgctcacaattttaatccgaacgggactgttggtcatatcaggattatttccggtatctatacccattacagctgccgcttggtatctttgggaggttaaaaagcagagggcaggagtattatgggatgttccgtcgccccctccagtcggaaaagccgagctagaggatggtgcatatcgaattaaacaaaaaggaatacttggttatagtcagataggtgccggcgtctacaaagagggaactttccatacgatgtggcacgtaacaagaggtgcagttcttatgcatagaggaaaacgaattgaacccagttgggccgatgttaagaaagatctgatctcttatggagggggatggaaactggaaggagaatggaaagagggagaagaagtccaagttcttgcattagaaccgggtaaaaatccgcgcgcagtacagactaaacccggcttattcaaaactaacacaggaacaattggtgcagtgagtctggacttttccccaggaacatctggatctccgatagttgatagaaaaggaaaagttgtgggattatacggaaatggagtagttactaggtctggcgcctatgtctcagcaatagcacaaacggaaaaatcaattgaagataatcctgaaatagaagacgacatatttagaaagaaaagactaactataatggacctacaccctggagcaggaaaaacaaaacgatatttgccggcaattgtgagagaggcaataaaaagaggactccggacgcttatcctcgcacctacgagagtggttgccgcagaaatggaagaggctttaagggggcttccaatacgatatcaaacccccgcaatcagagcagaacatacagggcgggaaatagtagatttaatgtgccacgcgacattcactatgcgcctcttatctccagtaagagtccccaactataatttgataatcatggatgaagcccattttactgatccggcaagtatagcagcaagagggtatatatctacacgagtagaaatgggggaagcagcgggtatattcatgacagctacaccacccggtagccgtgatccttttccacaatctaatgctccaattatggatgaagaaagagaaatcccagaaagaagttggaatagtggacatgagtgggtaactgatttcaaggggaagacagtgtggttcgtgccctcgataaaagctggaaatgatatagcagcctgtctgaggaaaaatggaaagaaagtgattcagttatccagaaaaacgttcgatagtgaatacgttaagactcgaactaatgattgggactttgtggtaacaaccgacatttcggaaatgggtgctaatttcaaagccgaaagggtaatagatcccagacggtgcatgaagcctgtaatcctcactgatggagaagaacgcgtgattctagcaggaccgatgcctgttacccattcgtccgcagcacaaagaagaggcagaattgggaggaacccaaagaacgaaaacgatcaatatatttacatgggagaaccgctggaaaatgacgaagattgtgcacactggaaagaagcaaaaatgttactggacaacattaatacacccgagggaattatacccagtatgtttgaaccagaacgcgaaaaagtcgatgcaatagatggagagtaccggttaagaggtgaggcaagaaaaaccttcgtagatctaatgcgcagaggagacttaccagtctggctagcatacagagttgccgcagaaggaattaactatgctgatagaagatggtgcttcgatggcgttaaaaacaaccaaattctcgaagagaatgtagaagtagaaatctggacaaaggaaggcgaacgaaagaaactaaaacccagatggttggatgcacgcatatacagcgatcctctagctctgaaagaatttaaagaatttgcagcaggccgaaaatctctcacactaaatttaatcactgaaatgggtcgtttgcccacatttatgacccaaaaagcgcgggatgcacttgataatcttgctgtacttcatacagccgaagttggtggtagagcttacaatcacgctttatccgaattacccgaaacgttggagacattattattgctcacattgttggcaacggtaaccggaggaatctttttatttttgatgtcgggaaaaggggttggaaagatgaccttgggtatgtgttgtattataactgcaagtatactgttatggtatgctcaaatacaaccgcactggatagcagcttctataatactagagttctttttaattgttctactcatcccggagccagaaaaacagagaacgccacaggacaaccagctaacctatgttgtaatcgcaatcttgacggttgttgctgccactatggcaaacgaaatggggttcctagagaaaactaagaaagatctcggattgggaagcatcgcaactcaagagcccgaaagcaacatattagatatagatctacgcccagcaagcgcctggacattgtacgcagtagcgacaacattcgtcaccccaatgctgcgacattcaatagaaaactccagcgtaaacgtatcactaacagcgattgctaatcaagcgacagtactcatgggcctaggaaaaggatggccgttatccaaaatggacatcggtgtccccttacttgctattggatgctattcccaagtaaaccctatcaccttgacagctgcactcttgttgctagtagcccattacgcaattataggaccaggacttcaagcaaaagccacgcgagaagctcagaaaagagcagcggctggcattatgaaaaatccaaccgtcgacggtataacagttatcgacttagatcctattccgtacgatccaaaatttgaaaaacagctagggcaagtaatgcttctgattctatgtgtaactcaagtgctaatgatgagaactacatgggcattgtgtgaggctctcacactcgccacgggtccaatatccaccttatgggaaggaaaccctggcagattctggaatactacaatagcagtttcaatggctaatatattcaggggaagttatcttgcaggcgcaggtctattgttctcaataatgaagaatacaacaaatactcgcagaggcacgggtaacattggtgagacacttggagagaaatggaaatctaggcttaacgctctgggtaagaatgagttccaaatttataagaaatcgggaatacaagaagtcgataggacactcgcaaaagaaggaataaaacgcggagaaacggaccaccatgccgtatcgcgtgggagcgcaaaactacgatggtttgttgagaggaacatggttacacccgaaggaaaagtcgtcgatttaggatgtggtagaggtggttggagttattattgcggaggtttgaaaaatgtacgagaagtaaaaggtttaacaaagggtggtcctggacatgaagaacctataccgatgagtacatacggttggaatctagtaaggctacaaagtggggtcgacgtattctttaccccacccgagaaatgcgatactctactatgtgatataggagaatctagccctaaccctactatagaagcaggcaggactttgcgcgttctcagcctcgtagaaaattggctaaacaatgacactcaattttgtataaaagttttaaacccgtatatgccttccgtaattgagaaaatggaaacactccaacgcaaatatggcggtgccctagtacgaaatcccctatccagaaattccacgcacgaaatgtactgggtgtccaacgcaacgggaaatattgtttcaagcgtaaatatgattagccgaatgctgattaatagatttacgatgaaacacaagaaagcgacatatgaaccggacgtggatttaggtagtggcacaagaaacattggaatcgagagcgaaatcccgaatcttgatataattggtaaaaggatagagaaaattaaacaggaacatgaaacaagttggcattatgaccaagaccatccctataaaacatgggcctatcatggaagctatgaaacgaagcaaaccggaagtgcttcctctatggtaaacggtgtagtccgattactcacgaaaccatgggatgttgtacccatggttacacagatggccatgacagatactaccccattcggacagcaaagagtcttcaaggagaaggttgatacaagaacacaggagccaaaggaaggaacgaagaaattaatgaagataactgcaaaatggttatggaaagaattgggcaagaagaaaactccaagaatatgtacgagagaagagttcaccaagaaagttaggagtaatgctgcattaggtgcaattttcactgatgaaaataaatggaagtcggcgcgagaggctgtagaagacagccgtttctgggaattagtagataaagaaaggaatttacatttagaagggaaatgtgaaacttgcgtatacaacatgatgggcaaaagagagaagaaattgggagagttcggaaaagcgaagggatccagggccatttggtatatgtggctcggtgccagattcctagaatttgaggccctcggatttctcaatgaagatcattggttttcgcgtgaaaacagcttatccggcgtagaaggagaagggcttcataaacttggttatatacttagggatgtatccaaaaaggaaggaggggcgatgtatgcagacgatacagcggggtgggacacaagaataacactagaagatctgaagaatgaagaaatggtaacaaaccatatggaaggggagcataaaaagttagcagaagcaatattcaaattaacgtaccaaaacaaagtggtgagggtgcaaagaccaacaccaagaggtacggtcatggatattatttcaaggagggatcaacgcggtagtggccaagtagggacatacgggctaaatacttttacaaatatggaggcacaattaatcagacaaatggagggagaaggaatattcaaatcgatacaacatttgacggtcaccgaagaggtcgcagtgcagaactggctagcaagggttggtagagagaggctatctcgtatggccatatcaggagatgattgtgtggtcaagcccctagatgacagattcgcttctgcgcttactgcgttgaacgatatgggcaaggtaagaaaagacatacaacaatgggagccatcgcggggatggaatgattggacgcaagtccctttctgttcgcatcactttcacgaacttataatgaaagatggacgtgtattggtagtcccctgtagaaaccaggacgagttgatcggacgagcaaggatatcacaaggagcaggatggagtctcaaagaaaccgcgtgcttaggaaaaagttatgcgcaaatgtggtctttgatgtattttcatagaagagaccttcgacttgccgctaacgcaatatgttcagcagttccgagtcattgggtgccaacaagcagaacaacctggtcgattcacgcaaaacatgaatggatgacaacagaagatatgcttactgtttggaacagagtatggatacaagaaaacccctggatggaagataagacaccagtggaaagctgggaggaagttccctatctggggaagcgagaagatcaatggtgtggcagtcttatagggctcacttctagggctacgtgggccaaaaacatacaaaccgcgataaaccaagttcgtagtttgattggcaatgaggaatatactgactatatgccttctatgaagcgttttagacgggaagaagaagaggcgggcgtattatggtaa

SEQ ID NO: 22330 - RNA, 9876 nt, synthetic construct
  misc_feature 1..9876: note = derived and/or modified CDS sequence (opt6) from DENV-2__FJ639699__SS-prME
  source 1..9876: mol_type = other RNA
actgcaggggtaataattatgcttatacctacagcgatggcattccatttgacaacgcgaaatggcgaaccacacatgatagttggacgacaagaaaaaggtaaaagtcttttgtttaaaacagaagacggagtgaatatgtgcacattaatggccatcgacctaggggaactgtgtgaagatactattacatataaatgtccattgctgaggcaaaacgagccggaggatatagactgctggtgcaactcaacttcaacatgggtaacttacggaacatgcaccacaacaggagagcatcgcagagagaagcgttcagtagctctagttccccatgtaggaatgggtttggaaacgcgcactgaaacatggatgagcagcgaaggcgcctggaaacatgcgcaaaggattgaaacgtggatacttagacatccaggttttacaattatggcggccatcttagcatacacaataggaacaacccacttccagagagcactaatattcattttgttaacagcagttgctcccagcatgacaatgcgatgtattggaatatctaaccgcgacttcgttgagggtgtatcgggaggctcatgggtagatattgtgttagaacatggaagttgcgttacaaccatggccaagaataaacctacgttagatttcgaacttattaagacggaagctaaggagccagcaacattgcgaaaatactgcattgaagcaaagttgacaaatacaacaactgaaagtcgatgtccaacgcagggagaaccctcactgaatgaggaacaagataaaaggttcgtatgtaaacattctatggtggatagaggatggggaaatggctgcggccttttcggtaaaggcgggatagtaacttgcgccatgttttcctgtaaaaagaatatggaagggaaaattgttcaacctgaaaatttagaatatactattgtgattaccccccacagtggtgaggaacacgctgtagggaacgacactggaaaacatggtaaggaaatcaaaataactccccaaagcagtataacagaggcggaattaacaggttatggtacggtcacgatggaatgctcaccccgtacaggattagattttaatgagatggtactattacaaatggaggacaaagcctggctagtacatagacaatggttcttagaccttcctctcccttggttaccaggagccgatacccaggggagtaattggatccagaaggaaacccttgtcacgtttaagaatccgcacgcgaagaaacaagatgtcgtagttttgggatcacaagaaggtgcgatgcacacggcgctaacaggtgcaacagaaatccaaatgtcaagcggaaatcttctatttacgggccatctcaagtgccgcctaagaatggataagttacaactcaaaggaatgagctattccatgtgtacaggaaaatttaagatcgtgaaagagatagccgagacccagcacgggacgatagtgataagagtacagtacgagggtgatggatcgccatgcaaaataccgtttgagatcatggatttagaaaagcgccacgtactaggccggttaataactgtcaatcccataatcaccgaaaaggattctcccgttaacattgaagccgagcctccattcggagattcttatataattatcggtgtggagccaggacaattaaagctaaactggttcaaaaaagggagcagcataggccaaatgtttgagacaacaatgagaggagcaaagcgtatggcaatactaggagataccgcttgggactttgggtcattgggaggtgtcttcaccagcatagggaaggcattacatcaggtttttggagcgatatatggagcagcattcagtggagtcagctggacaatgaagattctaataggagttataataacctggatagggatgaacagccgaagtacgagtctatccgtcagtttagtcctagtaggagttattacattatatttaggcgcaatggtacaagctgacagtgggtgcgtagtgtcttggaagaacaaagagttaaaatgcggatccggaatttttataacagacaatgttcacacgtggacggagcaatacaaattccaaccagaatcgccgagcaaactggcgagtgccatccaaaaagcccatgaagaaggaatatgtgggatcaggagtgttacacgtcttgaaaatctaatgtggaaacaaatcacaccagaacttaaccatatcttaagcgaaaatgaggttaagctgactattatgaccggtgatataaaagggattatgcaggcgggcaaaaggtcacttaggccacaacctacagaattgaagtactcatggaagacttggggaaaggcaaaaatgttgagcacagaaagccacaaccaaacgttcctcatagacggaccagaaaccgcagaatgtccaaatactaaccgagcatggaactcgctggaggtcgaagattatggattcggagtatttaccacaaatatatggctcaaattaaaagagaagcaagatgtcttttgtgattctaagcttatgagtgcggcaataaaagataaccgggcagtccacgcagatatgggatattggatagagtcagcactgaatgacacatggaagatggaaaaagcctcatttatagaagtcaaaagctgtcattggcccaaatctcatacactatggtcaaacggggttctcgaatcagaaatgatcatacccaagggttttgccggtccagtttcacaacataattatcgaccgggttattacactcaaacagctggaccttggcacttaggcaaactagaaatggatttcgacttctgcgaaggcactactgttgtagtcacagaggattgcggtaatcgtggacctagcctgagaaccacgactgcaagtgggaaactcattacagaatggtgttgtaggagttgcactttaccccctttaagatatcgtggtgaagacggatgctggtatgggatggaaattcgcccattaaaagaaaaagaggaaaatctagtgaattcgttagtaactgcaggacatggacagatagacaatttctcactgggcgttcttggaatggcattgttcttagaggaaatgttacgaacaagagttggaacaaaacacgcaatactattagtagcagtaagttttgtgactttaatcacaggaaacatgtcatttcgagatttaggacgtgtcatggtaatggtaggagctacaatgaccgatgatattggcatgggagtaacgtatcttgcgttgctcgcagcgtttaaagtgagaccaacttttgcagccggacttctattacgaaaactaaccagtaaagaacttatgatggccacaataggtatagcattgctttcacaatcaacaatacctgaaactatattagaactaacagacgcgcttgcactagggatgatgatcttaaaaattgtaagaaatatggaaaaataccagttagcggtcactattatggccatatcttgtgttccgaacgccgtaatactacaaaatgcctggaaggtaagttgcaccatattagcagctgtaagtgtgagcccattactacttacgagtagtcaacaaaaagctgactggatcccattagcacttaccattaaaggtttaaaccctacagcaatctttttaacgacacttagcagaacttctaagaaaagatcgtggccattaaatgaggctattatggcagtcggaatggtatcaatactagcgtcatcactcttgaaaaatgacattccaatgacaggaccactggttgcgggggggttactgacagtttgctatgtgttgaccggacgatcggctgatctagaactggaacgagcaacggatgtcaaatgggaagatcaagcagaaatatcaggcagctcacccatccttagcattacaattagtgaagatgggtcaatgtcaataaaaaacgaagaagaagaacaaactttaacaattttaataaggacaggtctacttgtaatctcaggtctatttcccgtttcgattcctatcaccgcagctgcttggtacttatgggaagttaaaaaacagcgggcaggagttctgtgggacgtaccaagcccccctccggttggaaaagcggaattagaagatggtgcataccgtataaaacaaaaaggtattcttgggtattcccaaataggtgctggagtttataaagaaggtacatttcatacaatgtggcatgttactagaggagcggtactaatgcatcgcggaaaacggatcgaacccagttgggcagatgtaaaaaaagatctaattagttacggaggaggatggaaactagagggagaatggaaagaaggcgaggaagtgcaagtattagccctagagccaggtaaaaacccgagggctgtgcagaccaaacctggtttgtttaaaaccaacacgggtacaattggagctgtatccttagacttttccccgggtacgtcaggatcaccgatcgtagataggaaaggtaaagttgtcggtctatacggcaatggtgtagtaacaagaagtggagcatacgtaagcgcgattgcacagacggaaaaatccatcgaagacaacccagagatagaggatgacatatttcgtaaaaaaagactcacgatcatggatctacaccctggcgccggtaaaacgaaaagatatttaccagcaatagtgagagaggcgattaaaagggggttacgcacattaatcttggcaccaacaagggttgtggctgcagagatggaggaagctctaaggggattaccaatacggtaccagacaccagccattagggccgaacacacaggaagagaaattgttgatctcatgtgccatgcaaccttcaccatgagactactcagtccggtgcgcgttcctaattacaatttaattattatggatgaagcgcatttcaccgatccagcatcaatcgctgcaagaggctatatatctacaagagtcgaaatgggcgaagccgcaggtatctttatgaccgccacacccccaggcagccgtgatccctttccgcagtcgaacgcccccatcatggatgaggaaagagaaatacccgaacgatcatggaacagtggacacgaatgggtaactgattttaaaggtaagacagtgtggttcgtaccatcaatcaaagctggaaatgatatagctgcttgcttacgaaaaaacgggaaaaaagttatccaattgtcgcgaaaaacattcgatagtgaatatgtcaaaaccagaacaaacgattgggattttgtcgtgacaactgacataagcgaaatgggcgctaactttaaagctgaaagagtaatcgacccaaggcggtgtatgaagcctgtgatactaactgatggtgaggaaagagtgatacttgctggaccaatgcctgtaactcactcgtccgctgcgcaaaggagaggtcgcattggaagaaatccgaaaaatgaaaatgatcaatatatttatatgggcgaacctctagagaacgatgaggactgtgcacattggaaagaagcaaaaatgctccttgataacataaacacccccgaaggaattattccaagtatgttcgaaccagaacgagaaaaggtggatgcgatagatggggaatatagactgagaggtgaagcgagaaaaacttttgtagacctcatgaggcgcggcgatctaccagtgtggctagcataccgagtcgccgctgaaggtataaattatgcagacagacgctggtgctttgatggagtaaaaaacaatcagatcctcgaagaaaatgtagaggttgaaatatggacaaaggaaggtgagagaaaaaaattaaagccacgttggctagacgctcgaatatactcagaccctctcgccttaaaagaattcaaagagttcgccgcaggtcgtaagtcattaacactaaatctaataactgaaatgggacgactcccgacctttatgacacaaaaagcgcgagatgctttagataatctagcagtactccatacagcagaggttggagggagagcatataatcacgcgctctcagagctaccagaaacgcttgaaacgttactactcttgacgctgttggcaacagtcacaggagggattttcctgtttctaatgagcggaaaaggtgtcggtaagatgactctaggaatgtgttgtataattaccgcgagtatactgctatggtatgctcaaattcaacctcactggattgcagctagcatcatcctggaatttttcttgatagtgttattaatccctgaaccagaaaaacaacgtacgccgcaagataatcagctcacatatgtagtcattgccatactaacggtcgtggctgccacaatggcaaatgaaatgggctttttagaaaaaacgaaaaaagatctgggactggggagcatcgcgactcaagaacccgaatcaaacattttagatatagacttaagaccagcaagtgcctggactttatacgcggttgccacgacattcgtaactccaatgcttcgccactccatagagaattcgagtgtaaatgtcagtttgacagctattgccaatcaagctactgtgttaatgggtttaggaaaaggctggcctttatcaaaaatggatataggagtaccactactagctattggatgttattcgcaggtaaatccgattacactaaccgcggccttattattgctagttgctcactatgcaattattgggccaggcctacaagctaaagcaacccgtgaagctcaaaaaagagcggccgctggaattatgaaaaatccaactgtagacggaattacagtgattgacttagatccaataccttacgatccaaagtttgaaaaacaactagggcaggtcatgcttttaatattatgcgtaacgcaagtgttaatgatgcggacaacttgggcactctgcgaagcattaacactagcaactggaccgatttcgactttatgggaaggaaatcccgggcgattctggaatacaacaatcgcagtttctatggcaaatattttcagagggtcatatcttgctggagcaggactattattttcaattatgaaaaatacgacaaacacaagaagaggaacagggaacattggagaaacacttggggagaagtggaaaagtcgtttgaacgcattagggaagaacgaatttcaaatatataaaaagagcggcatacaagaagttgatcggaccttggcaaaagaaggaatcaaaaggggagagaccgaccaccatgcagtaagtagaggcagcgcaaaactacgatggtttgtggaaaggaatatggtaacacctgaaggcaaagtagtagatcttggctgtggaagagggggatggtcttattactgtggtggactcaaaaacgtacgagaagtaaaaggactgacaaaaggtggaccgggccatgaagaacctattccaatgagtacatatggctggaacttagttcgacttcagagtggagtggacgtattcttcacccctccagaaaaatgcgacacgctgttatgtgatataggagaatcaagtcctaacccaaccattgaggcaggaagaacactccgcgtattatcactagtagaaaattggcttaataacgatactcagttctgcattaaagtattaaatccatatatgccatcagttattgaaaaaatggaaaccttacaaagaaagtatggtggagcgctagtaagaaatcccctatcgcgcaactcgacacacgaaatgtattgggtctctaatgccacagggaacatagtcagctccgtcaacatgatctccaggatgttgataaatagatttacaatgaaacataaaaaagcaacttacgaaccagatgtagatttgggatctggaaccaggaacataggtatcgaaagcgaaataccaaatctcgatatcatagggaaacgaattgaaaaaattaaacaggagcacgagactagttggcattacgaccaagaccatccctataaaacatgggcgtaccatggaagctacgaaactaaacaaactggatcagctagcagtatggtcaatggcgttgtacgtcttttaacgaaaccatgggacgtagtgccaatggtaacacaaatggccatgactgatactactccctttggacaacaacgggtttttaaggaaaaagtcgacacaagaacccaagagccaaaagaaggaacaaaaaaactgatgaagatcaccgcaaaatggctatggaaagaactgggaaagaagaaaacaccaaggatatgtacacgtgaagaattcacgaagaaggtacggagtaacgcagcccttggcgcgatatttacagacgaaaataaatggaagtctgcaagagaagccgttgaggatagtcgattttgggaattggtggacaaagaaagaaatctacacctagaagggaaatgcgagacttgtgtgtacaacatgatgggtaaacgagaaaaaaagctaggtgaattcgggaaagcgaaaggaagcagggcaatttggtatatgtggttaggggcaaggttcctcgaattcgaggctcttggttttcttaatgaagaccattggttttcccgggaaaattctctatcaggggtagaaggcgaaggactgcataaattagggtatatccttagggatgtaagtaaaaaagaggggggggcaatgtatgcagacgatactgctgggtgggatacgaggattacattagaagacttaaaaaacgaggaaatggttaccaaccacatggaaggtgagcataaaaaacttgccgaagcaatatttaagttaacataccaaaataaagtagtaagagtgcagcgtcctactccccgcggaacagtcatggacattattagtaggagggaccaacgtgggtctggtcaggtaggaacttacggcttgaatacattcaccaatatggaagcccaactgattaggcaaatggaaggggagggtattttcaagtctattcaatacctcactgtcacagaggaagtagcagtgcaaaattggctggccagggtaggaagagagcgtttaagccgaatggcaataagcggggatgattgtgtagtaaagcctctagacgatcgctttgcgagcgcattaacagctttgaatgacatgggcaaagttagaaaagatattcaacaatgggagccttctagaggatggaatgactggacgcaagtcccgttctgttcccatcacttccatgaactgattatgaaagatggtagagtcctcgttgtaccatgtagaaatcaagacgaactaatcggtagagcacgtatatcacaaggggcagggtggtcccttaaggaaacagcatgtcttggcaaatcttacgcacaaatgtggagtcttatgtactttcatcgccgggacttacggctcgcagcaaacgccatttgtagcgccgtaccatcgcattgggttccaacttcccgaacaacctggtcaatacacgctaaacatgaatggatgactacagaggatatgttaaccgtatggaatagggtttggattcaagagaacccatggatggaagataaaacccctgtggaatcatgggaagaagtcccatatttaggaaagcgtgaagaccaatggtgtgggagtttgattggcttgacttcccgagccacatgggctaaaaacatccaaacggcaatcaaccaagtacgctcattaattggtaatgaagaatacaccgattacatgccctcaatgaagcgtttcagaagggaagaagaagaggccggagtattgtggtaa

SEQ ID NO: 22331 - RNA, 9876 nt, synthetic construct
  misc_feature 1..9876: note = derived and/or modified CDS sequence (opt6) from DENV-2__FJ639700__SS-prME
  source 1..9876: mol_type = other RNA
acggcgggtgtaataataatgttgatccccactgcaatggcatttcacctaacgacgagaaatggagaaccccacatgattgtgggaagacaagaaaaagggaaaagcctgctgtttaaaactgaagacggagttaatatgtgtaccctaatggcaattgatctaggagaactatgtgaagatacaattacatataaatgtccattattgaggcaaaatgaacccgaagatatagattgttggtgcaactcgacaagtacctgggtgacctacggtacgtgcaccacgacgggagaacatagaagagaaaaacgtagtgtagcactcgtacctcatgtgggaatgggcctggaaactagaactgaaacatggatgtcaagtgaaggagcttggaaacatgcccaacgcatcgaaacgtggatcttaagacatcctggatttactataatggcagcaattttggcatacacaataggtacgacacattttcaaagagccctaatatttatattactaactgctgtcgcaccatcaatgaccatgagatgtataggaatttcaaatagggattttgtggaaggagtgagcgggggctcatgggtagacattgtcctggaacacggaagttgcgtaacgacaatggctaaaaacaaacccaccttagactttgaacttataaaaactgaagcaaaagagcctgcaactttaagaaaatattgtattgaggcaaaactcacaaatacaactactgagtcgagatgtcctacacaaggggagccatcactaaatgaagaacaagataaacgcttcgtatgcaaacatagtatggttgatcgcggatggggtaatggatgcggcttgtttggaaaagggggcatagtcacgtgcgcaatgttttcgtgtaagaaaaatatggaaggaaaaattgtacagccagaaaatcttgaatatacaatagtaattactcctcattcaggcgaagaacatgccgtcggcaacgacacgggcaaacacggaaaagagattaaaattacaccacaatcttccataacagaagcagaattaactggatatggtaccgtaacaatggagtgtagccctagaactggcttagacttcaacgaaatggtattactacaaatggaagataaagcatggctcgtacacaggcaatggtttctcgacctaccacttccatggcttccaggggcagacactcaaggatcgaactggatccagaaagaaaccctagtaacattcaaaaaccctcatgccaagaaacaagatgtagtagtcttgggatctcaagaaggtgcgatgcacactgcattaaccggagcaacagaaatacaaatgagctcaggcaatctactattcacgggacatttaaagtgtagactgcgaatggacaaattacaactaaagggaatgagttacagcatgtgtaccggcaaattcaaaatagtcaaagaaatagcagaaacccagcacggaactatcgtaattagggtacaatatgaaggtgacggaagcccttgtaaaataccatttgaaataatggatttagagaaaaggcacgtgttaggtagattaattacagtcaacccgataattactgaaaaggactcccccgtaaatatagaggccgaacctccatttggagattcatatataattatcggggtagaacccgggcaacttaaattaaattggttcaagaaaggcagctccataggacagatgtttgaaacaacaatgcgaggtgctaaacgcatggccatactaggggacactgcatgggactttggatcattaggaggggtctttacttcaatcggaaaggccttacatcaagtcttcggagccatttatggagctgcgttttcgggggtctcatggacaatgaaaatattaattggagttattattacttggataggtatgaactctagaagtacatcactgtctgtatcattagtcctcgtaggagttataacgttgtatctcggggccatggtacaggcagactcgggttgtgtggtatcttggaaaaataaagagttaaaatgtggctcgggcatatttattacagataatgtacatacttggacagagcaatataagtttcaacccgaaagcccatcaaagctagctagtgcaatccaaaaagcacatgaagagggaatatgtggaataaggtcggtcactaggctagagaacctaatgtggaaacaaatcacaccagaactcaatcacatactaagcgagaatgaggctaaactcacgatcatgactggagatattaaaggcataatgcaagccggcaaacgcagtcttagaccgcaaccaacagagctaaaatacagttggaaaacttggggaaaggccaaaatgcttagtacagaatcgcataatcaaacgtttctaatagacggaccagaaactgccgagtgtccaaatacaaatcgtgcatggaactcacttgaagttgaagactacggatttggagtatttacaaccaatatctggctcaagttaaaagaaaaacaagacgtattttgtgatagtaaactaatgtccgctgctattaaagataaccgtgcggtacatgcagacatgggctattggattgaatcagccctaaatgatacctggaagatggaaaaggcaagttttattgaagtgaaatcatgtcattggcctaaatcacacacactttggtctaatggtgtattagaatcagaaatgataattccaaaaggtttcgcaggaccggtgagccaacataactaccggccaggttaccacacacaaacggctggaccatggcaccttggaaaactggaaatggattttgacttttgtgaagggaccacggtcgttgtaacggaagattgtggtaaccgagggccaagtttgcgtaccacgactgcgtcagggaaactcataacggaatggtgctgtagatcctgtacactaccacctttaaggtatcgtggagaggacggatgttggtatggtatggagataagaccattaaaggaaaaagaagaaaacttagtaaattccctagtaactgctggacacggtcaaatagataatttttccctaggcgtactgggtatggcgttatttttggaagaaatgcttaggaccagagttggaacaaaacatgcaatcctcttagtggccgtcagttttgttacattaataaccggaaatatgtcattcagagatttaggaagggtgatggtgatggtcggggctaccatgacagacgacataggaatgggagtaacatatctagcacttctagcagctttcaaagtcaggcccacattcgcagcgggtctcttgctacgaaaattaacttccaaagagctaatgatggctacaataggcatagccctactttctcagtctacgatacccgaaaccatactagaactgaccgatgccctggcgctaggtatgatgatactaaaaatagtaagaaacatggaaaaataccagcttgctgttactataatggccatcagttgtgttccaaacgcagttattttgcaaaatgcatggaaggtgagttgtacgattcttgctgctgtatcggtcagtcctcttttgttaacgagttctcaacagaaggcagactggatcccattagcattaaccataaaagggctcaatccaaccgcaatcttcctgacaactctttcaagaacaagcaagaaacggagttggcccttgaatgaggcaataatggcagttgggatggtaagtattctagctagttctttactaaagaacgatatcccaatgacaggcccattagtagcaggaggacttttaacagtttgttatgtactaacaggaagaagcgccgacctcgaactagaacgcgcaacagatgttaaatgggaagatcaagcagagatctcaggaagttccccaattctctcaattacgatatccgaagacggtagtatgagcatcaaaaatgaagaagaagaacaaactttgacaatactcattcggacgggattgctagtaatatcgggtttgtttccggtttctataccaattaccgcggccgcgtggtatttatgggaagtcaagaaacaacgagcaggagtattatgggatgtcccgtcgccaccacccgtaggtaaagccgagttagaagatggagcatataggatcaaacaaaaaggtatactaggctattcgcaaataggtgcaggcgtatataaagaaggtacattccacacaatgtggcacgtaacaaggggagcagtattgatgcatagaggtaaaagaattgagccaagttgggcagatgtcaagaaagacttaatatcttacgggggtggctggaaactggagggggaatggaaagaaggggaagaagtacaagtccttgcgcttgaacctggtaaaaacccaagagccgtacagacgaaaccaggactctttaagaccaatacaggtacaattggcgcagtatcactcgatttttctcctggtacgtctggttcacctatcgtcgacagaaaaggaaaggtagtgggactgtatggaaatggcgtggtaacgagaagcggcgcttacgtatcagccatcgcgcaaacagagaaaagcatagaagacaatccagagatcgaagacgacatattcagaaagaaaagactaacgataatggatttgcatcccggagctggtaaaacgaaaagatatctgccagcaattgtacgtgaagctattaaaagaggcttacggacactaattttagcccccacacgcgtggtggctgcagagatggaagaagctctacgtggactccctattagatatcaaacacccgcaataagagcggaacatacaggtcgagagatagtcgacctgatgtgccatgctactttcactatgaggttactatcacctgttcgtgtaccaaactataacttaataataatggatgaagcacacttcacagacccagcgtcaatcgctgcaagaggatacatctctacccgcgttgaaatgggtgaggcagcgggtatattcatgacggccacacctcctggatcaagagatccattcccgcaatcaaacgcaccaataatggatgaagaacgggaaatacccgaacgcagctggaactctggacatgaatgggttacagactttaagggaaagacagtttggtttgtgccgtcgataaaagctggtaacgacattgcagcgtgtttgcgtaaaaacggcaagaaagtgatccagttatcaaggaagacattcgattcggaatatgtgaaaacacgcacgaatgactgggattttgtagtgactaccgacattagcgaaatgggagccaacttcaaggctgaacgcgtgatagatccccgacgatgtatgaaaccagtcattttgactgatggtgaggagagagtcatattggcaggcccgatgccggtaacccattcctcggcagctcaaaggagaggcaggataggtcgcaatcccaaaaatgaaaacgaccaatatatatatatgggagagcctttagaaaatgatgaagactgtgcacattggaaggaggcaaaaatgctgttagacaacattaacacaccagaaggaataataccctcaatgtttgaacctgaaagagaaaaagttgatgcaatagatggcgaatacagactaagaggagaagcaagaaaaacatttgttgaccttatgcggcgaggagacctacctgtatggttagcttacagagtagcggcagaaggaattaattacgcggacagacgatggtgctttgatggagtgaaaaacaaccagatattggaagagaatgtagaagtagagatttggactaaagagggcgaacgtaagaaactaaaaccaagatggctcgatgccaggatatattcagaccctttagcattgaaggaatttaaagagttcgcagcgggtcgaaagtcattaacactaaatctcatcactgaaatgggtcgtttaccgactttcatgactcagaaggcccgtgacgctctcgataatttagcagtactacataccgctgaagttggagggagagcttataatcacgctctatcagaattgcctgagactcttgagacgctacttctactaacattgctagcaacagtaactggcggcatatttttatttttaatgtcagggaaaggtgtcggaaaaatgactctcggaatgtgctgtataattacggctagtatactattgtggtatgcacaaatacagccacattggatagcagcatccattattttagaatttttcctaattgtcttgttaattcctgaaccagaaaagcaacgcactccacaagataaccaactcacgtacgtggttattgctatattaacagttgttgcagcaaccatggcaaacgaaatgggtttcttagagaaaactaagaaagatctcggattgggatcgatagctactcaagaaccagaatcgaatatcctcgacatagaccttcggccggcttcggcgtggacactatacgcggttgcgacaacctttgtaacgcctatgcttagacacagcattgaaaattcttctgtaaacgtttccctcacggcaattgcaaaccaagccaccgttctcatgggcctaggaaaaggttggcccctatcgaaaatggacattggggtaccgctcttggcaataggatgctatagtcaagtgaaccctataacattaactgctgcactgctattattagtagcacactacgcgatcatcggccccggacttcaggctaaagcgacaagagaagcgcagaaaagggcagcagcaggaattatgaaaaacccaacagtagacggaataacagtcatcgatttagatccaatcccatacgacccgaaatttgaaaaacaactaggccaggtcatgttgttaatattatgcgttactcaagttctcatgatgcgtacgacatgggcgttatgcgaggcgcttacactagcgactggtccgatatctacattgtgggaaggtaatccaggaaggttttggaacacaacaatcgcagtaagcatggcaaatatttttagggggtcttatttagcgggcgcgggtctcttattctccataatgaaaaatactacaaatactaggagaggcacgggtaacattggtgagactctaggcgaaaaatggaaaagtagacttaatgctctcggtaaaaatgaatttcaaatatataaaaagtcaggcattcaggaagtagacagaactttggccaaagaaggaataaagaggggcgaaacggatcaccacgctgtaagtcggggatctgcaaagctgcggtggttcgtagaacgcaatatggtaactcccgaaggcaaagtagtagacctaggatgtggtagaggaggttggtcgtactactgtggtggattgaaaaatgtcagagaagtgaaaggattgacaaaaggaggtcctggacatgaagaacccataccgatgtcgacttatggttggaatctagttcgacttcagagtggagttgacgtgtttttcaccccgccagaaaagtgtgacacactcttatgtgatatcggtgaaagctccccaaatccgacaatcgaggccggacgaacattacgtgttctaagcctagtcgagaattggcttaacaatgatacacagttctgcattaaagtgttgaacccctacatgccttcggttatcgagaaaatggaaactcttcaaagaaaatacggaggtgcgctagtaagaaatccattgtctaggaatagtacacatgaaatgtattgggtttcaaatgcgacgggaaatattgtttcgtccgttaatatgatctctcgaatgttaattaacaggtttactatgaaacataagaaagcgacgtatgaacctgatgttgatctgggctcaggaacgaggaatatagggattgaatcggaaattcctaatttagatatcattggcaagcgtatagaaaagataaaacaggagcatgagacttcatggcattacgaccaagaccacccctacaagacatgggcatatcacggaagctatgagactaaacaaacaggtagtgctagcagcatggtaaacggcgttgtcagactattgaccaagccatgggacgtggtgccgatggtaactcaaatggctatgacagacactacaccgttcggccaacagagagtattcaaggaaaaagtagatacaagaacgcaagaaccaaaagaaggaactaaaaagttaatgaaaataacggcaaaatggctttggaaagaactaggcaagaagaaaacgccgcgaatatgcacgagagaagagttcactaagaaagtgcgatccaacgcagcactgggtgcaatatttacagacgaaaataaatggaaatcagcgagagaagccgtagaagatagtcgattttgggagttagtcgacaaggagagaaatctacacttagaagggaagtgtgaaacgtgcgtgtataacatgatgggaaaaagggagaagaaattaggtgagttcggtaaagcaaaaggctctcgagcaatatggtacatgtggttaggagcgagattcttagagttcgaagcacttggtttcctaaatgaagaccattggtttagtagagaaaactctctgtcaggggtagaaggtgaaggtttacacaaactagggtatattctacgggatgtttcaaagaaagaagggggagccatgtatgcggacgacacggcgggttgggatacgcgaataaccctggaagacctcaaaaatgaagaaatggtaacgaatcatatggagggcgaacataagaaattggcagaagcaatatttaagctaacctaccaaaacaaagttgtgcgagtacaacgccctacacctagaggcacggttatggatataatctcccgtaaagatcaaagaggatcaggacaagtaggaacatatgggctcaatactttcactaatatggaggcacaactaattagacaaatggaaggtgaaggtattttcaaatctatccaatacctaacagtgacggaagaggttgcagtgcagaactggctcgccagggtaggacgcgaaagacttagtaggatggccataagcggagatgattgtgtagtaaaaccactagatgataggtttgcttccgcgctaacggccctaaatgacatgggtaaagttcgaaaggatattcaacaatgggaaccatcaagaggttggaatgattggactcaagtacctttttgttcgcatcattttcatgaactaataatgaaagatggacgagtgcttgttgtaccatgtcgcaatcaagacgagctcataggcagggcgagaattagtcaaggagcaggctggagcttaaaagaaaccgcctgcctaggcaaatcgtatgcccaaatgtggtcactaatgtactttcataggagagatctacggctcgctgcaaacgcgatatgctcagcggtacctagtcactgggtaccaacaagtcgaactacctggtcgatccacgctaaacatgaatggatgacaaccgaagatatgcttactgtatggaacagagtttggattcaagaaaacccatggatggaagataaaacacccgtagaatcatgggaagaggtcccgtaccttggaaagagagaagatcaatggtgtggatctttaattggtctaacatcaagagcaacatgggccaaaaacattcaaactgcaataaaccaagttaggagcttaatcggaaacgaagagtacaccgactacatgccttcaatgaaaaggtttcgccgagaggaagaagaagcaggagtgttatggtag

SEQ ID NO: 22332 - RNA, 9876 nt, synthetic construct
  misc_feature 1..9876: note = derived and/or modified CDS sequence (opt6) from DENV-2__GQ868620__SS-prME
  source 1..9876: mol_type = other RNA
agcgcagggatgataattatgttaataccaacagtgatggcttttcatttaacgacaagaaacggtgaaccccatatgatagtaggtatacaagaaaaaggaaaatctctattattcaaaactgaagatggggttaatatgtgtactctaatggcgatggatctgggagaactttgcgaagatacaataacatataaatgcccattattgcggcaaaacgaaccagaagacattgattgttggtgcaattcgaccagtacttgggtgacctatggcacgtgtacaacaacaggcgaacataggcgagagaaaagatcagttgcgcttgtaccacatgtaggaatgggtctagaaacacgaacagaaacctggatgtcaagtgaaggggcttggaaacacgctcaaaggatcgaaacttggatcctcagacatccaggattcactattatggctgcgattttagcttacaccatagggaccactcacttccaaagagcgttgatctttatactattaacggctgtagctcccagtatgacaatgagatgtataggcatttcaaatagagattttgttgaaggagtatcgggtggaagctgggtggatatagtattagaacatggttcctgcgtaactacaatggctaaaaataaaccaactttagattttgaactgataaaaaccgaagcaaaacaaccagctacacttagaaaatactgtattgaagcaaaattgacaaacactacgacagaaagtagatgccccacacaaggagaaccttctttaaaagaagaacaagacaaaaggtttgtatgcaaacactctatggtggatagaggttggggaaacgggtgtggcttgttcggtaaaggagggatagtaacctgtgcaatgtttacatgcaagaaaaatatggagggcaaaatcgttcaacccgaaaatctagaatatacaatagtagtcactccacattcaggcgaagaacacgcagtaggaaacgataccgggaaacacggaaaagaaataaaagtaacgcctcaaagttccataacagaggcagagttgacaggatacgggactgtaacaatggaatgctccccaaggacgggcttggactttaacgaaatggtattattgcagatggaaaacaaagcatggctagtgcacagacagtggttcctagatctaccactaccatggctcccaggagcagataaacaaggctccaattggatacagaaagaaaccttagttacattcaagaatccccacgccaagaaacaagatgtcgtagtattaggaagccaggaaggagctatgcacacagcattaaccggcgccacggaaatacaaatgtcatctggcaatctcctctttactggccatctaaagtgtaggctaagaatggacaaattgcagctaaagggaatgtcatatagtatgtgtacagggaaattcaaagtggtcaaggaaattgccgagactcaacacggaaccattgttatacgagtgcaatacgaaggggatggaagcccatgcaaaataccatttgaaattatggatctagaaaaacggtatgtccttggcagactaattactgtgaacccgatagtaacagaaaaagattcaccagtcaacattgaagcggagcccccatttggtgatagttatataattataggggttgaaccgggccaattaaaacttaactggttcaagaaaggttcgtcaattggacagatgttcgagaccactatgagaggcgcgaaaagaatggctattcttggagatactgcatgggattttggatccctaggtggggtttttacgtcaatagggaaggcactacatcaagttttcggggcgatttatggagctgcattttccggagtctcatggacaatgaaaatattaatcggggtaattataacatggatcgggatgaactctcgttcaacttccctctctgtttctttagtcttagtaggaatagtcacactctatctaggagtgatggtacaagccgatagtggctgcgtggtctcttggaagaataaggaactcaaatgtggctctggaatatttataactgataatgtccatacatggaccgaacaatacaagtttcaaccggaaagcccatcaaaactagcgtctgcaattcaaaaggcacaggaagaagggatatgtgggattcgtagcgttacccgactggagaacctgatgtggaaacaaattaccccagagttgaaccatatactggctgaaaacgaagttaagctaaccataatgactggcgatataaaaggcatcatgcaagcaggaaagagatccctacgtccacaaccaacagaattaaagtactcttggaaaacctggggtaaagccaaaatgctatcgacagaaagtcacaatcaaacctttttaatagatggtcccgagactgccgaatgtcccaatacaaatagggcgtggaactcactggaagtggaagattatggcttcggggtgttcactacaaatatatggttgaaacttaaagaaaaacaagatgcattctgtgattcaaaattaatgtcagcagcaataaaagataacagggcagtccatgcggatatgggctattggatagaatcagcattaaatgacacctggaagatagaaaaagcatcgttcatcgaggtcaaaaattgccattggccgaaatcacatacattgtggagtaatggagtactagaatcagaaatgatcattcccaaaaatctggcgggtcccgtctcccaacataattaccgacctggatatcatacgcagattgcaggaccgtggcacttaggcaaattagaaatggattttgacttctgtgatggaacaacagttattgttacagaggattgcggtaatagaggtccatcactaaggaccaccacagcgagcgggaagctaatcacagaatggtgctgtcgatcttgcacactaccaccacttcgatatcgcggagaagacggatgctggtatggcatggagatccggccactaaaagaaaaggaagaaaacttagtgaacagtttagtaaccgctggccatggacaagttgataatttttcgttaggagtgcttggtatggcactctttctcgaagagatgttgcgtactcgagtaggtactaaacacgcaatcctattagtggccgtatctttcgtaactttaataacagggaacatgtctttcaaagacctgggaagagtcgtcgtaatggtgggtgctacaatgaccgatgacatagggatgggagtaacatatctagctttattagcagcttttaaagtacggcctacattcgctgcagggctcttattacgcaaacttaccagtaaggaactaatgatgactacaataggtatagtgctgctatctcaaagcacgataccagaaacaatccttgagttaaccgacgcactagctttgggcatgatggtcctgaaaatagtaagaaatatggagaaatatcaattggcagttacaattatggcgattctctgcgttccgaacgcggtaatcttgcaaaatgcttggaaagtaagttgtacaatactggcagttgtgtcagtatctcccttactattaaccagtagtcaacagaaaacagattggatcccactagctttgacgattaaaggattaaacccaactgctatatttctcacaacactgtctagaaccaataaaaagagatcatggccattaaacgaagcgatcatggccgttggaatggtatcaatcctcgcgagttctctattaaagaatgatataccaatgacaggtccactcgttgcagggggcttactaaccgtctgttacgtactaacaggacgatcagccgacctagaattagagagagctaccgatgtaaaatgggaagaccaagcagaaatttccggatctagtccaatattatctataacaattagtgaagacggttcaatgagtatcaaaaatgaagaagaagaacaaactcttacaatactgattcgaacaggtctattagtcataagtggcctgttccccgtatctatcccgattacagcagctgcctggtacctatgggaggtcaagaaacagcgcgcaggggtactgtgggatgttcctagccctccacctatgggaaaagccgaactagaagacggagcatatagaataaaacaaaaaggtattctcggctactcacaaataggagctggagtatacaaggagggcacatttcacacgatgtggcacgtaactaggggagcggttcttatgcacaaagggaaaagaattgaacctagctgggcagatgtgaaaaaggatctcataagctatggagggggttggaaacttgaaggtgaatggaaagaaggggaagaagtgcaagtattagcattagaaccagggaaaaatcctagagttgttcaaacaaagccggggttatttaaaacaaatactggtacaataggggctgtttctctcgatttttcaccagggacctcaggttcaccgattatcgacaagaaaggcaaagtagtaggactctatggtaacggcgtcgtcacgagatcgggagcgtatgtatcagccatagcacaaacagaaaaatcaatagaggacaatcctgaaatagaagacgatatttttaggaaacggcggctgaccatcatggatctccacccaggtgccggaaagacgaagcgttatttgcccgcaattgttcgggaggcaataaaaagagggttgagaactttgatacttgcaccaactagagtagtagcagcagaaatggaagaagcgctacgagggctacccatacggtatcagacaccagctataagagcggagcatactggtagagagatagttgatcttatgtgtcatgctacattcacaatgagactattaagcccagtaagagttccaaattacaacttaattataatggacgaagcccactttacagacccggcatccatcgcggccagaggatatataagtacgcgtgtcgaaatgggagaagctgcaggtatatttatgacggcaacgccaccgggaagtagagacccttttcctcaatcaaatgcaccaataatcgacgaagaaagagaaattcctgaacgtagttggaatagtggacatgaatgggtgactgactttaaaggaaaaacggtttggttcgtgccaagtataaaggcaggcaatgacatcgcagcctgcttaaggaaaaatggaaagaaagtaatacaactatccagaaagaccttcgacagcgagtatgttaaaacgcggacgaatgattgggactttgtagtaacaacagacatcagcgagatgggagctaactttaaagctgaacgcgtcatagacccaaggagatgcatgaaacctgttatattaacggatggggaggagcgggtaatcctggcaggccctatgcctgtaacacatagctcagccgcccaacgcaggggacgcattggccgaaaccctaaaaacgaaaatgatcaatatatatacatgggggaaccactcgagaatgacgaagactgcgcacactggaaggaagcgaaaatgttactagacaatattaatacacctgaaggtataataccgtcaatgttcgaacctgaaagagaaaaagtcgatgctattgatggagaatataggcttcgaggagaagccaggaagacttttgtagacttaatgagacgaggagatctaccagtctggctcgcttataaagtcgcagctgagggcatcaattatgctgatcgacggtggtgtttcgatggcatcaaaaataaccaaatacttgaagagaatgttgaagtggaaatatggactaaggaaggagagagaaagaagttaaagcccagatggctagacgcacggatatactcggacccgctggccctaaaagagttcaaagaatttgctgccggccgcaaaagtctaacgctaaacttaataaccgaaatgggaagacttccgacttttatgacgcaaaagactcgggacgcattggacaacctcgcagtcctacatacagcagaagctggtggcagagcgtataatcacgctttatccgaacttccagaaacgttagaaacacttctattgcttacattactagcgactgtaacgggaggcatttttctattcttaatgagcgggagagggataggtaagatgacgttgggtatgtgctgtataattacggcttccatactcttatggtacgcacaaattcaaccacactggattgcagcatctattatactagagttctttctaatagtcttactaataccagaaccagaaaagcagagaacaccacaggacaaccaactaacgtatgtagtcattgcgatattaacagttgttgcggcaacgatggccaacgaaatgggttttctggaaaagaccaagaaagaccttgggctgggtagtatcgcaacgcagcagcctgaatcaaatatcttagacatagacttgcgcccagccagcgcctggacactttacgcagtagcaactacatttgtgaccccaatgctccgtcattcaattgaaaatagtagtgtcaacgtatccctcaccgcaatagccaaccaggctaccgtcttgatgggactaggaaaaggatggccgctatcgaaaatggatatcggggtcccactattagctataggctgctactcacaggttaatcctataactttaactgcagccctactactgcttatagcccattatgcaataattggtccgggtctccaagctaaggcaacaagagaagcacagaaaagagctgctgctggaatcatgaaaaatccaacagtcgatggaatcactgttatcgatctggatccgatcccctacgatccgaagttcgaaaagcaacttggccaagttatgttactgattttgtgcgtaacacaagtacttatgatgagaacgacttgggcattgtgtgaagccttaacactggccactggtcctatttctactctctgggaaggtaaccctggtcggttttggaacactactatcgctgttagtatggccaacatatttagagggtcgtacctcgctggagctggattacttttctcaataatgaaaaacgcaaacaatacccgcaggggaactggtaacattggcgaaacccttggcgaaaaatggaagtcgcgactcaacgcattaggaaaaagcgagtttcaaatctataagaaatcaggcatacaagaagtagacaggacattggcgaaagagggcataaaaaggggagaaacggaccatcacgctgtttccaggggttctgcgaaactaagatggttcgtcgagcgaaatatggtaactccagaaggcaaagtcgttgacctaggatgtgggcgtggtggttggagctattactgcggaggcttgaaaaatgtgcgagaggttaagggactaacaaaagggggacccgggcatgaagaacccatacccatgtctacttatggctggaatctagtgcgcctacaatcaggtgtggatgtattctttattcctcccgaaaagtgtgataccttgctctgcgacataggtgaatcaagtccaaatcctacagttgaagcaggacgcactttaagagttctgaacttagtagaaaattggctaaacaatgatactcaattctgcataaaggtcttaaatccatatatgccttcggtgatcgaaaagatggaggcacttcaacgaaagtatggtggagcgttggtccggaacccactatcaaggaactcgacacacgaaatgtactgggtatcaaatgcatccggaaacatagtgagcagcgtgaatatgataagtcgtatgctaatcaatcgttttacaatgagacacaaaaaggccacgtatgagccagatgtagatctaggatcaggaacacgcaacattggaattgaatcagaaatcccgaacctagacatcataggaaagagaatagagaaaataaagcaagagcatgaaacaagctggtactatgaccaagatcacccttataaaacctgggcctatcacggaagttacgaaacgaagcaaacaggaagcgcttcgtcaatggtaaatggcgttgtaagattgctcaccaaaccatgggacgttcttccaacagtcactcaaatggcgatgacggataccacaccttttggtcaacagcgggtcttcaaagagaaagttgatactagaacacaagaaccaaaagaaggaactaagaaactcatgaaaataacggcagaatggctatggaaagagctgggtaagaagaaaactccaaggatgtgcacaagggaagaatttataagaaaagtaagatcaaatgcagcgttaggagccatattcacggatgaaaataaatggaaatcagcacgagaagcagtagaagacagtcgattctgggagttagttgacaaagagcgtaatttacatttagaaggtaaatgcgaaacttgcgtatacaatatgatgggtaaacgagagaagaaactaggtgaatttgggaaagcaaaaggcagccgagccatatggtacatgtggctaggcgcgagattcttggaatttgaagcgctagggttcctgaacgaagaccactggttcagtagggagaactcgttaagcggagtagaaggggaagggctccacaagctaggctacatattaagagatgttagtaagaaagagggaggcgccatgtacgcagatgatacagcgggctgggatacaagaattacattagaagacttaaagaatgaggaaatggtaacaaatcatatggagggagaacataagaagttagctgaagctatctttaagctcacatatcaaaacaaagtcgttagggtccaacgaccaaccccgagaggaacagtaatggatataataagcagaagagaccagagaggtagtggacaggtaggaacctatgggttaaacacattcacgaatatggaggcacaactgatacggcaaatggaaggtgaaggcgtatttgaaaacatccagcacctaacggtgactgaagaagtcgctgtacagaattggttagcgagagtaggaagggaaaggttaagtagaatggcaatcagcggtgacgattgtgtagtaaagcccttagacgacagattcgctaacgcacttacagcattaaacgacatgggtaagattcgaaaagacatccaacaatgggaaccgtccaagggatggaatgattggactcaagtcccattttgtagccatcattttcacgaactcatcatgaaggacggaagagtcctagtggtaccttgccgaaaccaagatgagctgattggccgagcaagaatcagtcaaggtgccggttggtcattgagagaaacagcatgtcttggaaaatcatatgcccaaatgtggtcgctaatgtatttccatagaagagacctaagactcgccgctaacgcaatatgctcggcagtacctagtcattgggttcccacgtctagaacaacatggtctatccacgccaagcacgaatggatgactacagaggacatgctaacagtctggaatagagtttggattagagaaaatccatggatggaagataaaacacccgtagagtcttgggaagaaattccatacttaggcaaacgtgaagatcaatggtgcggttcattaattgggctcacgagccgagcgacttgggcgaaaaatatacaagctgcgattaatcaagtaaggtcgctcattggaaatgaagagtatacagattacatgccgtctatgaaaagatttagaagagaagaagaggaagctggagtactctggtga

SEQ ID NO: 22333 - RNA, 9876 nt, synthetic construct
  misc_feature 1..9876: note = derived and/or modified CDS sequence (opt6) from DENV-2__FJ639702__SS-prME
  source 1..9876: mol_type = other RNA
actgcaggggtaataataatgttaattccaactgcaatggctttccaccttaccacccgaaacggagaacctcatatgatagtaggtagacaagaaaaagggaaatccctccttttcaaaactgaagacggtgttaatatgtgcacattaatggcaatagatttgggcgaattatgcgaagatacaattacctataaatgtcctttattaaggcaaaatgaaccagaggatatagattgttggtgtaattcgacatcaacgtgggtcacatatgggacttgcacgaccacaggtgaacacaggcgcgagaaaagaagcgttgccttagttccccatgtagggatgggactagaaacaagaaccgaaacatggatgtccagtgagggagcatggaaacatgtgcaacgtattgagacatggatccttcggcacccaggtttcacaattatggcagctattctagcatacacgataggaacaacgcacttccaaagggcattaatattcattctacttactgctgtagctccttctatgaccatgagatgcataggtatatccaaccgagacttcgtagaaggcgtctcgggaggatcatgggttgacattgttctggaacacggttcatgtgtaacaactatggccaaaaataaaccaacactggatttcgaattgataaaaacagaagcaaaagagccagctactttaagaaaatactgcatagaagctaaactgacaaatacaacgaccgaatctcgatgtccgactcaaggagaaccctccttgaacgaagaacaagataaaaggtttgtttgtaaacactcaatggttgacagaggttggggaaatggatgtggtttattcggaaaagggggtatagttacatgcgcaatgtttacatgtaagaaaaatatggaaggtaaaatcgtacaacctgaaaacttagagtacacaatagtaattactccacactcgggagaagaacatgcggtaggaaacgatacaggtaaacatggcaaagaaataaaaataacgcctcagtctagttcaaccgaagcagaactaactggctatggaactgtaactatggaatgctcccctagaacaggactagattttaatgaaatggtgctactacaaatggaggataaagcatggttagtgcacaggcaatggtttcttgatttaccacttccgtggctacccggtgcagatacacaaggatcaaattggatacaaaaagagacgttagtaaccttcaaaaaccctcacgcgaagaaacaagatgttgtcgtactaggctctcaggagggcgccatgcataccgcgttaacgggcgccactgagatacaaatgtcaagtggaaatttgctttttactggacatttaaaatgtaggttaagaatggataaactgcaacttaaggggatgtcatattcaatgtgcactggtaaatttaaaatagttaaggaaatcgctgaaacacaacacggtactattgtaataagagtccaatacgaaggcgatggatcaccctgtaaaattccattcgaaataatggaccttgagaaaaggcatgttttgggtagattaattactgttaacccaatagtcacagaaaaagattcaccagtgaatattgaggccgaacctccctttggtgattcctatataattataggagtagaacccggacaacttaaattaaactggtttaagaaagggagcagcatagggcaaatgtttgaaacaacaatgcgaggcgcaaaacgaatggcaatattgggcgacacagcgtgggattttggcagtctcggcggagtattcacatctatgggaaaagcactccatcaggtattcggtgcaatatatggtgcggctttttccggggtttcttggaccatgaaaatactgataggtgtaattattacatggataggcatgaactccagatcaacatcacttagtgttagcttggttttagtaggtgtgataacattatatttaggtgcgatggtacaggcggactctggttgtgtcgttagttggaaaaataaagaactaaagtgtggatcaggtatctttataacagataatgtccatacatggacagaacaatacaaatttcagccagaaagcccgtcaaagttggcgtctgcaatacaaaaagcccatgaagagggcatctgtgggattcggagcgtaacaagacttgagaacttaatgtggaaacagataacacctgagctaaatcatattctgagtgagaacgaagtgaaattgacgataatgaccggcgatatcaaaggcattatgcaagccggaaaaaggtcattgaggccacagccaacagaactcaaatacagttggaaaacttggggtaaggccaagatgctgtccacagaatcacacaatcaaacctttctcatagatggaccagaaacagcggaatgtcctaataccaaccgtgcttggaacagccttgaagttgaggattacggctttggtgtattcaccacaaacatatggttaaagctacgtgaaaaacaagacgttttctgcgactcaaaactaatgtctgctgcgataaaagacaaccgagccgtacatgcagacatgggatattggatagaatccgcactaaacgacacatggaaaatggagaaagcaagttttatagaagtaaagtcatgtcattggccaaaaagtcatactttatggtctaacggagttcttgagtcggaaatgatcatacccaaaagtttcgcaggcccggtatctcaacataattatagacctggctactatactcaaactgcaggtccatggcatctagggaaactcgaaatggatttcgatttctgtgaaggaacaactgtagtggttacggaggactgtggaaatcggggcccttcgcttcgtacgactacagcgagcggaaaattaatcacagaatggtgctgtagaagctgcacgctgcccccattacggtatagaggagaggatggttgttggtatggtatggagataagaccgttaaaagaaaaggaagaaaatttagtcaactcacttgttacagccggccacggacagattgacaattttagcttgggggttttgggaatggcgttattcctcgaagaaatgcttagaactagagtgggaactaaacacgcgatactcttagtagctgtgagtctggtaactcttattacaggcaatatgtcattccgtgaccttggacgcgtcatggttatggtgggcgccaccatgacagatgacataggcatgggagtaacctatctagcattacttgctgcattcaaagtgagaccaacatttgcagcagggcttttgttaaggaaattgacatcgaaagagcttatgatggcaacgataggaatagcccttttatcgcagagtacaattcccgaaactatactggaattaacagacgcattagccttaggtatgatggtacttaagatagtaagaaatatggagaaataccagcttgcggtaaccataatggccatcagttgtgttcctaatgcagtaatactacaaaatgcgtggaaagtctcatgcacaatactagcagccgtatccgttagtcctctgttgcttacgagttcacaacaaaaagccgattggattccactagcgttaactatcaagggactaaacccaaccgctatctttctgactacacttagtcgaacctctaagaaacgtagttggccccttaacgaagcaattatggcagtcggtatggttagtatcctggctagcagtcttcttaaaaacgacataccaatgacaggaccgctagtagcagggggtcttttaacagtttgctatgtactaacaggcagatccgcagatctcgagctggaacgggcgacggatgtgaaatgggaagaccaagcagagatatcgggaagctctcccatcctgtctatcaccataagtgaggatggatcgatgagtatcaaaaatgaggaagaagaacagacactgacgatattaatcagaacaggcttgctagtaatatcaggtttatttccggtttcaatccctattaccgcagcagcatggtatttgtgggaagttaagaaacaaagggccggtgtattgtgggatgttccgtcaccacctcctgtcggaaaagcggaattagaggatggtgcttatagaataaagcagaagggaatactcggttattcgcaaattggggccggagtgtataaggaagggacatttcatactatgtggcacgttactagaggggcagtattgatgcatagaggtaaacgaatagaaccaagttgggctgatgtcaagaaagacctcatttcatatgggggcggctggaaactagaaggtgaatggaaagaaggagaagaagtccaagtattagcgttggaacccggtaaaaacccaagagcagtccaaactaaacccggtctctttaagacgaacacaggcacgatcggtgcagtctcattagatttttctccaggcacttctggatcgccgattgttgaccgtaaaggaaaggtggttggtttatacggaaatggcgtagtaacacgatcaggagcgtacgtaagcgcgatcgcacaaactgaaaaatctattgaagataatccagagattgaggacgacatttttcggaagaaaagactaacaattatggatttacatccaggagctggcaaaacgaagagatacctaccagcgatagtcagagaggcgataaaacgagggctccgcacactaatactagctcccactagagtagtagcagcagagatggaagaagcgctgaggggactgcccatacgatatcaaactcctgctatccgagcagaacacacaggaagagaaatcgtagacttgatgtgtcatgctacattcactatgcgcttattgagtccagtacgcgtgcctaattataatcttatcataatggatgaagcacacttcacggatccagcttcaattgctgctcgaggatatatatcaacacgagtagaaatgggagaagccgcaggcatcttcatgacggcgacgccgcccgggagtaaggatccatttccgcaaagtaatgcaccaataatggatgaagagagagaaataccagagagatcctggaactcgggtcatgagtgggtcacagacttcaaaggaaagacagtctggtttgtgccgtcgataaaagcaggtaatgatattgccgcttgtttacgtaaaaatgggaagaaagtgatacagttaagtagaaaaacatttgattcagaatatgtcaaaacgcgaactaatgactgggactttgtcgttactacggatatatcagaaatgggagcaaattttaaagcagaacgcgtgattgatcccagacgttgcatgaaaccagttatcctaacagacggcgaagaaagagtcatattggcaggtccaatgccagtcacacattccagcgcagcccaacggagaggtagaataggaagaaatcccaaaaacgaaaacgaccagtacatatatatgggtgaaccattagaaaacgacgaggattgcgcgcattggaaagaggccaaaatgctattagataatattaatacgcccgagggtataatacctagtatgttcgaacctgaacgggaaaaagttgacgcaatcgatggagaatatagactacgcggagaagcacgtaagacgtttgtagaccttatgcggagaggggatttacctgtgtggttggcatacagagtcgcagcagaagggataaactacgcggataggagatggtgtttcgacggggtgaaaaataatcaaattcttgaagagaacgtagaagtagagatatggacaaaggagggggagaggaagaaattaaaaccccgctggctagatgcaagaatatatagtgacccattagcattgaaagagttcaaggaatttgccgctggtcgaaaatctctaaccttaaatttaataacggagatgggaaggttaccaacattcatgacacaaaaagctagggatgcattagataatctagccgttctacacaccgccgaagcaggaggtcgggcatataatcatgcattgagcgaactcccagaaacccttgaaaccttattattgctcaccttattagcaacagttacaggcggagtgtttctattcttaatgagtggaaagggagtcggaaaaatgacattgggaatgtgttgtataatcactgcgagcatattactatggtatgctcagattcagccgcactggattgcggcaagtattatcttagaatttttccttatagttctcttaattccggagccagaaaaacaaaggacccctcaagacaaccaattgacatatgttgtgatcgccatcctaactgtggtagcagccacgatggctaatgaaatgggattcctagagaaaacaaagaaagatctagggttaggatccatagctacacaggaaccagaaagtaatatactggacatagatttacgcccagcatcagcttggaccctatatgcagtcgctactaccttcgtaacccctatgttacgacactcaatagaaaacagtagtgttaacgtaagcctcacggcgattgctaatcaggcaacagtcttgatgggactaggaaaaggctggcctttgtcaaaaatggacataggcgtaccattattagcaataggatgctactcacaagtcaatcctgtcactctgaccgctgccctactattgcttgtagcccattacgccatcataggaccaggtttgcaggcaaaagcaaccagagaggcccagaaaagggctgcggccggaataatgaagaatccaaccgtcgacggcataaccgtaatagacctagaccccatcccatatgaccccaagttcgaaaaacaattaggccaagtaatgctcctaatactatgcgtaactcaggttttaatgatgcgtacgacctgggcactgtgcgaagccctgacactagctaccggtccaataagcaccctttgggaaggtaatccaggacgattctggaacactacgattgctgtttccatggcaaatatttttaggggctcgtacctagccggagcagggttactcttcagcattatgaaaaacactacgaacacacgaagaggaacgggaaatatcggagaaactttaggggaaaaatggaaatctaggttaaacgcactaggaaaatcagaatttcaaatatataagaaatcaggaatacaagaagtagatagaacgttggctaaagagggaattaagcgtggggaaacagatcatcacgcagtaagtcgtggtagtgcaaaactaaggtggtttgtagaaagaaatatggtcacacccgagggaaaagtagtagatctaggatgtggtcgtggaggctggtcatattactgtggaggtcttaaaaacgttaaagaagtaaaaggcctaacaaagggcggaccaggccatgaagaaccaatcccaatgtccacttacggatggaacctagttaggttacaaagtggagtggatgtgttctttacaccgcctgaaaaatgcgatacgctattatgtgacataggagagagttcaccgaatccgacaatcgaagcgggcagaaccttaagagtcctgagtttagtcgaaaattggttaaacaatgacactcaattttgcataaaagttttaaacccctacatgcccagtgtaatagagaaaatggaaaccttacaaaggaagtacggaggcgcattagtgaggaacccacttagtaggaactcaacgcacgaaatgtactgggtcagcaacgcaacaggtaatattgtctcaagcgtaaacatgatatctaggatgttaatcaataggtttactatgaaacataaaaaggccacatacgaaccggacgttgacctgggttctgggacaagaaatattggcattgaaagtgaaatacccaacttagatataataggtaaaagaatcgagaaaataaaacaggaacatgaaacaagttggcactacgaccaagaccatccatataaaacctgggcataccatggctcttatgaaaccaaacaaactggctcggcaagctcaatggtaaatggggtcgttcgattgcttacaaaaccgtgggatgttgtacctatggtaacacaaatggcaatgactgacaccacaccctttggtcaacaaagggtttttaaggagaaagtcgacacccgtacacaggaacctaaggaaggaacgaagaaactcatgaaaataacagccgaatggctctggaaagagctagggaagaagaaaacacctaggatgtgtactcgcgaagaatttacaaggaaggtacggtcaaacgcggcactaggtgcaatattcacggatgaaaataaatggaaatctgcccgagaagcagtggaggattcgcgattttgggaattagtagacaaggaaagaaatctacacctagaaggaaagtgcgaaacttgcgtatacaacatgatgggtaaaagagaaaagaaacttggggaatttggtaaagcaaaaggatctagagcaatatggtatatgtggttgggtgcaagatttttagagtttgaagctctaggatttttgaatgaagaccattggttttcccgtgaaaactcgttaagcggcgtagaaggagagggattacacaaactagggtatatactgagagacgttggtaagaaagaaggaggagcaatgtatgccgatgatactgctggatgggacacgcgtattactttagaagacttgaaaaacgaagagatggtcacgaaccatatggagggagaacataagaaattagcagaagctatatttaaattaacataccaaaataaagtcgtccgcgtacaaagaccaacaccaaggggaacggtgatggacattatttcaaggagggaccagagagggagtggacaagtaggaacttatggattaaatacctttacgaatatggaagcccaattaatacgacaaatggaaggagaaggtatctttaagagcattcaacatttaactgcgacagaagaaatcgccgtgcaaaactggttagctagagtgggaagagagcgactgtcacgaatggcaatcagtggcgacgattgcgtagttaaacctcttgacgaccgattcgcttcagctctaactgcactaaatgacatggggaaggtccggaaagacatccagcaatgggagccgtctagaggatggaatgattggacacaggtaccattttgttcacatcactttcacgagctcataatgaaagatggacgggttcttgtagtcccatgccgcaaccaagacgaattgatcggccgagcacgaatatcacaaggagccgggtggtcactaaaggaaactgcatgcctcggtaaatcttatgctcagatgtggtcactaatgtattttcatagaagggatctacgcctggctgcgaacgcaatttgttctgcagttccaagccattgggtaccaactagcaggacaacatggtcgatacatgcaaaacatgaatggatgactactgaggatatgttgaccgtatggaaccgagtatggatacaggaaaatccctggatggaagataaaactccagtagagtcgtgggaagaagtgccttatctagggaagcgagaagaccagtggtgtggctctcttataggtttaacatcaagagcaacttgggctaaaaacattcagacagcaattaatcaagtcaggtccctaatcggcaatgaagaatacaccgattacatgccgagcatgaaacgatttcgcagagaagaagaagaagcgggagtactatggtaa

SEQ ID NO: 22334 - RNA, 9876 nt, synthetic construct
  misc_feature 1..9876: note = derived and/or modified CDS sequence (opt6) from DENV-2__GQ868621__SS-prME
  source 1..9876: mol_type = other RNA
agcgcaggcatgattattatgttaatcccaacagtcatggcctttcaccttaccacccgaaacggtgagccacatatgatagtaggaatacaagaaaaaggaaaatctctgctttttaaaacagaagatggtgtaaatatgtgcacgctcatggcgatggacctcggagaattatgcgaagatactatcacctacaagtgcccactgttgcgccaaaatgaacccgaagacatcgattgttggtgtaattctaccagtacctgggtgacttatggtacatgtacaacaacaggagagcatcggagagagaaaaggtccgtggcactggtgccacatgtaggaatgggtttggaaaccagaacggaaacatggatgagctcagaaggggcatggaaacatgcacaaagaatagaaacatggatcttaagacatcccggctttactataatggcagcaattttggcctacacaatcggaactactcactttcaaagagtgttaatttttattctcctgacagccgtggctccaagcatgactatgagatgtataggtatatctaaccgggatttcgtcgaaggcgtttcaggtggttcctgggtagacattgttttagaacatggttcttgcgtaacaacaatggcgaaaaataaacctactctagattttgaattgattaaaactgaagccaaacagccagccacactacgcaagtattgcatcgaggccaaactcacaaacacaacaaccgaatccagatgtcctactcaaggtgaaccctcactcaaagaagaacaagataaaagatttgtctgcaaacattcaatggtagaccgaggttggggtaatggttgtggattattcggtaaaggtggcattgtaacttgcgcgatgtttacttgcaagaaaaacatggagggaaaaatagttcagccagagaacttagaatatacaatagtagtgacacctcatagcggtgaagaacatgctgtgggtaatgataccgggaagcacggaaaagaaatcaaagtcacaccacaaagcagtattactgaagctgaattaaccggttatgggaccgtcaccatggaatgttcacctcgtactggcctagattttaatgaaatggtactattacaaatggaaaataaggcctggctagtacataggcagtggtttttagatttacctctaccgtggctcccaggtgccgataaacaagagtctaattggattcaaaaagaaactctagtaacatttaaaaatccacatgcaaaaaaacaagacgtagtagtgcttgggagccaagagggtgcaatgcatacagcattgacgggcgcgacggaaattcagatgtcctctggaaacttactttttacagggcacttgaaatgccgcctacgcatggacaaactacaattaaagggaatgagttatagtatgtgcaccggcaaatttaaagtagtgaaggaaatagcagaaacacagcatggtacaatagttatcagagtacaatacgagggagatgggagtccatgtaagataccgttcgagatcatggaccttgaaaagagatacattttaggaagattgataaccgttaatccaatcgttacagagaaggatagtccagtcaacatagaagctgaaccgccatttggggacagttacataataataggagtagaacccggacaacttaaattgaattggttcaagaaaggtagtagtatcggtcaaatgtttgaaacaaccatgagaggggctaaaagaatggcaatattgggtgacacagcatgggatttcggatctctcggaggagtatttacctcgataggtaaagcgttacatcaggttttcggtgcaatttatggcgcggcattcagtggagtttcgtggaccatgaaaattttaataggagtaatcataacctggattggcatgaattcacgttccactagtctttctgtctcactcgtgttagtaggtatagttacactgtaccttggagtgatggtacaggctgactcgggatgtgtagtctcttggaaaaataaagaactaaaatgtggttcagggatatttataactgataatgttcacacatggactgaacaatataaatttcaaccagaatcaccatcaaagcttgcatctgctatacagaaggcacaagaggagggtatatgtgggatacgatctgtgacgcgattggaaaatttgatgtggaagcaaataactccagaattgaaccacatcttagcagaaaatgaggtaaaattaactataatgacaggagatattaaaggaataatgcaggccggtaaaagatctttgcgaccacaacctaccgagctaaaatatagctggaaaacatgggggaaagcgaaaatgctctcaactgaaagttataaccaaacatttcttatcgatggaccggaaacagcagaatgtccaaacaccaatagagcgtggaattctcttgaagtagaggactacggtttcggagtattcactaccaacatttggttgaaattgaaagaaaaacaagacgccttctgcgattctaaactaatgagcgctgcaataaaagataaccgtgcagtacatgcggatatgggttattggatcgagagtgccttaaacgacacatggaaaattgagaaggcatcatttattgaagtaaagaattgccattggccaaaaagtcacactctttggagcaatggtgttttggaatctgagatgatcatacccaaaaatctagctggccccgtatcacaacataactatcgcccggggtatcacacacagatcgccgggccttggcaccttgggaagctcgaaatggactttgacttctgtgatggaacaactgttatagtcacagaagattgtggaaaccgcggacccagcttaaggacaacaacagccagcggtaaactcataaccgagtggtgttgcaggtcttgtaccttgccaccattgcgatacagaggagaagatggatgttggtacggaatggaaataaggccccttaaggaaaaggaagaaaacttagttaattctttagtaaccgcaggtcatggtcaggttgataacttttctctaggagtattaggaatggcattgtttttagaagagatgctgagaacacgggtcggcaccaaacatgcaatattattagtagcggtaagtttcatgactttgatcacaggaaacatgagtttcaaagatttaggtagagtagtggtaatggtaggagcaaccatggcagacgatataggaatgggcgtaacttatctagccttactagcagcttttaaagtaagaccaacatttgcagcagggctattactgcgtaaattaacgtcaaaagaactaatgatgacaacaatcggaatagtactattgagtcagagtactatacccgaaacagtattagaattaacagatgccttggcactaggaatgatggtcctcaaaatcgttcgcaatatggaaaaatatcaactcgctgtcacaatcatggccattctgtgcgtgcccaacgctgtaatcttacagaatgcatggaaagtatcatgtaccatactagcagtagtaagcgtgagtcctttattgttgactagcagtcaacagaaaactgactggatcccactcgcactgacaatcaaaggtctaaatccaaccgcgatttttctcactacactctcgcggacgaataaaaagagaagctggccccttaacgaagcaataatggctgtaggaatggtgtcaatattggcctctagtcttctaaaaaacgatatccctatgaccggtcctttagtcgcaggtggtttattaaccgtttgttatgtcctgacgggtcgatcggccgacttagaactggaacgggcaacggatgtcaaatgggaagaccaagcagagataagtggatcaagcccaattctatcaataacaattagtgaagatggatcaatgagtataaaaaatgaagaggaggaacacacactgaccatacttattcgcactggtcttctcgttatcagcggtctattcccaatctcaatacccatcactgcggccgcatggtatttgtgggaagttaaaaagcaaagagcaggggtattatgggatgtgccatccccaccgcctatgggaaaggccgaacttgaagatggagcatatagaatcaagcaaaaaggaatactaggctatagtcaaataggagcgggtgtatataaagagggaacttttcataccatgtggcatgttacacggggggcagtactgatgcataagggtaaaaggattgagccatcatgggcagatgtaaaaaaagacttaatatcatatggaggcggttggaaactagaaggagaatggaaggagggagaagaggtacaggttctggctttggaacccggaaaaaacccaagggccgtgcaaacaaaaccaggactatttaaaacgaatacaggaacgataggagcagttagtttggattttagtccgggcacaagtggatctcctattatagataaaaaaggcaaagttgtaggactttatggcaacggagtggtgacgagaagtggcgcatatgtgtctgcgattgcccagaccgaaaaatccatcgaagataatcccgaaatcgaagacgacatatttaggaaaagaaggctcacaattatggatttgcatccgggagccggtaaaacgaaacgttacttaccagctatcgtgcgtgaggctataaaaagaggtctacgaaccctaattttagcacctactagggtagtagcagccgaaatggaagaagcgttgcgaggactccctattaggtaccaaactcctgcaataagggctgaacatacaggaagggaaatagtggacctgatgtgtcacgctacattcaccatgagacttctcagcccagtacgggttccaaactacaatctgattataatggatgaggcccacttcaccgaccctgcctctatagcagctagaggttatataagcacaagagttgaaatgggtgaagccgcagggatatttatgaccgcaacaccacctggaagcagagatccgttcccgcaatctaatgcacccataatagatgaagaaagagaaatccctgaacggtcttggaacagcgggcatgaatgggtcactgattttaaggggaagacagtatggtttgttccctcaataaaagctggaaacgatatagcagcttgccttcgcaaaaatggcaaaaaagtgatacaattgtcaaggaagacttttgattcagaatatgtgaagaccagaactaacgactgggattttgttgttacaacggatataagcgaaatgggcgcaaattttaaggctgaaagagttattgacccaagacgatgcatgaaaccagttatccttactgatggtgaagaacgcgtgatactcgctggccccatgcctgtcactcacagctcagctgctcaaagacgtgggagaataggacgcaacccgaaaaacgaaaacgaccaatacatctacatgggtgaaccactcgagaatgacgaagactgtgcacactggaaagaagcaaaaatgcttttggacaatataaacacaccagagggaatcataccttcaatgttcgaaccagaaagggaaaaggtcgatgcaatagacggagaatacagactacgaggcgaagcgagaaagaccttcgttgatcttatgcgacgcggagacttaccggtttggctagcctacaaagtagcagccgaaggtatcaattacgctgacagacgatggtgctttgatggcattaagaacaaccaaatattggaagagaacgtggaagttgagatatggaccaaagaaggagaacggaagaaactcaaacctcgatggctagacgcgagaatttactcagacccacttgcacttaaagaattcaaagaatttgctgctgggaggaagtccctcactttaaacctaatcacagaaatgggtagactgcctacattcatgacccagaaaacgagagatgcactagacaaccttgcggtcctacatacagcagaggctgggggacgtgcttacaatcacgccttatctgaacttccagaaactttagaaactctattattattaacgctactagcaactgtgactgggggcatcttcctgtttttaatgtcagggagggggatcggaaaaatgactctagggatgtgctgtataattacagctagtatattactatggtatgcccaaatccaaccccactggatagcagcttctattatcttagaattctttctgattgtgttacttatcccagagccggagaagcaaaggacaccacaagataatcaacttacttatgtagtaatagctatattaaccgtcgtagcggcaaccatggcaaatgaaatgggatttttggaaaaaacgaagaaagatctcggattaggttcaatagcaacacaacaaccagagtccaatatcttagatatagatctgcgtcctgcctcagcatggacactttatgctgtagcgacaacttttgttaccccaatgttaaggcactcaatcgaaaactccagcgtgaatgtaagtttaacagcgattgctaatcaagcaacggtgttaatgggactcggtaaaggttggccactatcaaaaatggatataggagtaccccttttagccataggctgttattctcaagtcaacccgatcaccttaactgcggcactactgctattagttgcacattatgccattataggccctggactccaagccaaagcaacacgagaggctcagaagagagccgcagcggggataatgaaaaacccaaccgtcgacggcataacagtaatagatctagacccaataccgtacgatccgaagtttgaaaaacaattgggtcaagtaatgttactgatactctgtgtaacacaagtacttatgatgaggacaacatgggcgctatgtgaagcgttgacattagcgacaggaccaatctcgacgttatgggaaggaaacccgggacgtttttggaatactactatagccgtaagcatggctaacatattcagaggtagctacctggcgggcgcaggtttgttattctccatcatgaagaacacaactaacacacgtagagggacagggaacattggagagacattaggggagaaatggaaaagccggcttaacgcactgggtaagagtgagttccaaatatataaaaaatcagggatacaggaagtagaccgaactttagctaaagaagggattaaacgcggggaaacagaccaccacgcggtttcccgtggatcagcaaaacttcgatggtttgtcgagagaaatatggtcactccagaaggaaaagtggttgaccttggatgtggaaggggtggttggtcttattactgtggaggactaaaaaatgtacgtgaggtgaagggacttactaaaggaggaccaggtcatgaagaacccattcctatgtccacatatggttggaatcttgtaagactccaaagtggagttgatgttttcttcataccaccggaaaaatgcgatacactactctgcgatataggggaaagttccccaaatccaaccgttgaagcaggtaggactttaagagtacttaatttagtggagaattggcttaataacaatacgcaattttgcatcaaagtcttaaatccatatatgccatctgtaatagaaaaaatggaagcactacaacgcaaatatgggggggcgttagtaagaaatccactatcaagaaattctacacacgagatgtattgggttagcaatgcatcaggtaatattgtaagttcagtcaatatgatatcaagaatgttaataaatcgattcacaatgagacataaaaaagctacctacgagccagatgttgatttgggaagcggaacaaggaacataggaatcgagtccgaagttcctaatcttgatataataggaaaaaggattgagaaaataaaacaggaacatgaaacaagttggcattatgaccaagatcatccatacaaaacgtgggcctatcatggaagttatgaaactaaacagacaggctcagcatctagcatggtgaatggagtagttcggttacttaccaagccttgggatgtcctaccaacagtcacccagatggctatgacagataccacaccatttggacagcaaagagtatttaaagaaaaagtagatacaagaacacaggaacccaaggaaggaaccaaaaaattaatgaaaataactgcagagtggctgtggaaagaattaggtaagaaaaaaacccctagaatgtgtactcgagaagaatttaccagaaaagtgcgaagtaacgcggcactcggagctatattcaccgatgaaaataaatggaagtcagcgagagaagcagtagaagatagtaggttctgggaactagtagacaaagaaagaaaccttcacctggaaggtaaatgtgagacatgcgtctataacatgatggggaaaagagaaaagaaattaggtgaatttggaaaggcaaaaggatcacgtgcaatctggtatatgtggctaggagcaagattcttagaattcgaagctttaggcttcctaaatgaagaccactggttttctcgcgagaattccttgtcaggcgtagagggagagggtttacacaaattgggttatattctgagagatgtgagcaagaaagaaggcggagccatgtatgccgatgataccgcaggctgggatacaagaattacattagaagacctaaaaaatgaagagatggttacgaatcacatggaaggagaacacaaaaaattggcagaggccatattcaaattgacctatcagaataaagtagtgagagttcagcggccaactccacgtggaacagttatggatataatatcaagaagggaccagcggggtagtgggcaagtgggaacgtatggtctcaatacatttacaaacatggaagctcaacttatccgtcaaatggaaggagagggagtttttaaaaacatccaacacttgactgtcaccgaggaggtggctgttcaaaattggcttgcccgcgtagggcgtgaacgtttatcgagaatggctataagtggcgacgattgcgtggtcaaaccactagacgataggttcgcaaatgcacttacagcgttgaatgatatggggaaaatcagaaaagacattcaacaatgggagccatccaagggttggaatgattggactcaagtccctttttgtagtcatcacttccatgaattgataatgaaagatgggcgcgtgctagttgtgccttgtcgaaatcaggacgagctaatagggagagcacgaatttcgcaaggtgctggttggtcattgcgtgaaacggcctgtttgggaaaaagttatgcacagatgtggagcttaatgtatttccaccgcagagacttgaggcttgcagcgaatgcaatttgctcagctgtaccttcgcactgggttcccaccagtaggacgacatggtcgatacacgcaaaacatgaatggatgacgaccgaggatatgttgactgtgtggaatcgggtatggatacgagaaaatccatggatggaagataaaacaccggtagaatcttgggaagaaataccatatcttggcaaaagagaagaccaatggtgcggtagccttatagggttaacaagccgtgcgacatgggccaaaaatatacaggctgctataaatcaagtaagatctttgataggaaacgaagaatacactgactatatgccatcgatgaaacgtttccgaagggaggaagaagaggcaggagtactatggtaa

SEQ ID NO: 22335 - RNA, 9876 nt, synthetic construct
  misc_feature 1..9876: note = derived and/or modified CDS sequence (opt6) from DENV-2__FJ639704__SS-prME
  source 1..9876: mol_type = other RNA
agtgctggaatgataataatgttaattcctaccgttgtagcatttcatttgactacccgtaatggagaaccacatatgattgttggtatacaagaaaaaggcaaatcgttactctttaaaactgaagacggagtaaacatgtgtacacttatggcaatggatctcggagaactttgcgaagatacaataacatacaaatgccctttattgcgacaaaacgaaccagaagacatagattgttggtgtaattcgacgtcaacctgggtaacatatggtacttgcacgactacaggcgaacatcgacgagagaaaagaagtgtagccctagtccctcatgtagggatgggtctagaaacaaggaccgaaacatggatgtcttcagaaggagcatggaaacatgcacaacgaatagaaacatggatactacgacacccaggttttactataatggcagcaatattggcatatactattgggactacgcactttcaacgtgctttgatattcatactactaacagcagtagccccatcaatgaccatgagatgtattgggatcagtaaccgtgacttcgtggaaggcgtctctggtgggtcatgggtagacatagtattagaacacggatcgtgtgtaacaaccatggcgaaaaataaaccaaccctcgatttcgaactaataaaaacagaggccaaacaaccggccacactcagaaaatattgcattgaagctaaactaactaacaccactaccgaatcgcgatgcccgactcaaggcgaaccgtcattgaaagaggaacaggataaaaggttcgtatgcaaacactcaatggttgaccggggatggggaaatggctgcggacttttcggtaaagggggcatagttacttgcgcaatgttcacgtgcaagaaaaacatggagggtaaaatagtacagccggaaaacttagaatacactattgtagtgacacctcatagcggagaggagcacgcagttggaaatgacacaggaaaacatggaaaagaaataaaagtaactccacaatctagtatcacagaagccgaacttaccgggtacggtaccgtaacgatggaatgcagcccaagaactgggctcgactttaatgagatggtcttactacaaatggaaaataaggcttggcttgtacatcgacaatggttcttagatctacctttaccttggttaccgggtgctgacaaacaagaaagcaattggattcaaaaagaaactctagtaacatttaagaacccgcacgccaagaaacaggacgttgtggtcttagggtcccaggaaggagctatgcacaccgcccttacaggagcaaccgaaatccagatgagtagcggaaatctattgtttactggccacctaaagtgtaggctccgtatggacaaactccagttaaagggaatgtcctacagcatgtgtactggcaaatttaaagttgtaaaggaaattgccgaaacacaacacggtactatagtgataagggtacaatatgagggagatgggtccccttgcaagatccctttcgaaatcatggatttagagaaaagatatgttctaggtagattaatcactgtcaacccaatagtcacagaaaaagatagtcccgttaatatcgaggcggagccgccttttggtgatagctatatcataatcggcgtcgagcccgggcaactcaaacttaattggtttaagaaagggagcagtatcgggcaaatgtttgagacaactatgcgtggggcgaaacgaatggctattcttggagatacagcatgggattttggctccctaggtggagtatttacaagtataggtaaagcacttcaccaagttttcggcgcaatatatggtgcagcattctctggtgtaagctggacgatgaagatactgataggggtaataattacatggataggtatgaatagcagatcaacatctttgagtgtaagcctagtgcttgtagggatagttaccctatatttaggcgtaatggttcaagcagattcaggatgcgttgtttcatggaagaacaaagaactgaaatgcggttctggcatttttattacagacaatgtacacacctggacagagcaatataaatttcaaccagagtcaccatccaaattagcaagtgcaatacaaaaagcccaggaagaaggaatatgtgggatacgatcagtcacgagactagaaaatctcatgtggaaacaaataacgcctgaattaaatcatatattagccgagaatgaagtaaaactgaccataatgacgggagatataaaagggataatgcaagcaggtaaacgaagtctcagaccgcaacctacagagttaaagtactcatggaaaacctggggcaaaaccaaaatgttaagtacagaatcgtacaaccaaactttcttaattgacggtcccgaaaccacggagtgtccaaatactaatagggcatggaactctctggaagtcgaggattatggatttggtgtatttactactaatatttggctcaaattgaaggaaaaacaagatgcattctgtgattcaaaactaatgtctgcagccataaaggacaatcgggcggtacacgctgatatgggatactggattgaatctgcactcaacgatacttggaaaatagagaaagcaagttttatagaagtgaaaaactgccactggccaaaatctcatacgctttggtcaaatggagtgctcgagtcggaaatgattatacccaaaaatcttgctggacctgtgtcacaacacaactatagaccggggtatcatactcagatcgccggtccatggcatttgggaaaactagagatggatttcgacttttgcgatggaacaactgtaatcgtgactgaggactgtggcaatcgaggaccatcgttaagaacaaccaccgcgtcaggcaaactaatcacagaatggtgttgcagatcgtgcacattaccgccattaaggtaccgtggtgaagatggttgttggtatggcatggaaatacggccgcttaaagaaaaagaggaaaacttagtaaattccttggttaccgctggtcacgggcaggtcgataatttttcccttggtgttcttggaatggcattgttcctcgaagagatgttacgcaccagagtaggtacgaaacacgcgatattattggttgctgtatcatttgtgacgctaataacaggaaacatgtcatttaaagatcttggaagagtagtcgtgatggttggagccaccatggcagatgatattgggatgggcgtgacttatctagctctattagcagcatttaaggtaagaccaacctttgctgcgggattgctgctaagaaaacttacttcaaaagaactcatgatgactacaatagggatcgtcttgctctcccaatcaaccatacctgagacaatattagaactgacagacgctttagcgctcggaatgatggtccttaagatagtacgaaatatggaaaagtatcaactcgctgtcaccatcatggcaattttatgcgtacccaatgcagtaatattacaaaatgcatggaaagtttcatgcacgattttagcagtggtatcggtgagtccactccttttgacttcatcacaacaaaaggcggactggattccccttgcattaaccataaaagggttaaatcccactgcaatatttttaacaaccctatctagaaccaataagaaacgtagttggccactgaatgaggctattatggcagtaggaatggtatcaatattagcctcgtctctattgaagaatgacatacccatgacaggaccactcgtggctgggggactcttaacagtctgctatgttttaacaggacgatcagccgacttagaactggaaagagcaacagatgtcaagtgggaagaacaagcggagatttctggatcctcaccgatattgtccatcacaatctctgaagatggtagtatgagcatcaaaaatgaggaagaagaacagacactaacaatattaatacgtacaggtctattagttatatcaggactctttccaataagtatccctataaccgcagcagcttggtacctctgggaagtcaagaaacaaagagcgggagtattatgggatgttccaagtccaccacccatgggtaaagccgaacttgaagatggtgcatatcgtattaaacagaagggaattttagggtacagtcaaattggcgcaggcgtctacaaggagggaacttttcacacaatgtggcatgtaactcggggagcagtacttatgcacaaaggtaaaaggatcgagccttcatgggcagacgtgaagaaagatctaattagctatggcggtggatggaagttagaaggagaatggaaagaaggtgaagaagtccaagtcttggcactcgaacccggcaaaaatccacgagctgttcaaacaaagcccggactattcaaaaccaacacgggcacaattggtgcagtatccctagatttctctccaggcacgtcaggttcgcccattattgataagaaaggaaaagttgtaggattgtacggaaacggagtagtaaccaggtcaggagcatatgtctcagcaattgcgcaaacggaaaagagtatagaagacaacccagaaattgaagacgatatctttcgcaaacgaaggctcacaatcatggaccttcacccaggggcaggaaaaactaaaaggtacctgccggcgatcgtgagagaggcaataaaacgtggtctaagaacactaatattggcaccaacaagagtagtcgcggcagagatggaagaggctttgcgcggactacccattagatatcaaacaccagccattcgcgcagaacataccggtagggagatagtagacctaatgtgtcacgccacatttacaatgcgtctactaagtccggtccgtgtgccgaattataatttgattatcatggacgaagcacacttcacagacccggcatcaattgcggcacgtggatatatttcgactagggtggaaatgggagaggcagcaggaatttttatgaccgcaacacctcctggaagtagagacccgttcccacaatctaatgctcccataattgacgaagaacgtgaaatccctgagcgtagttggaatagcggacatgaatgggtaacggacttcaaaggaaagactgtatggtttgtaccaagtataaaagcaggaaatgatattgcggcctgcttaaggaaaaatgggaagaaagttatacaactctccagaaaaacttttgactccgagtatgtaaaaacgagaaccaatgattgggattttgttgttactacagatatttcagaaatgggcgcaaactttaaagcagaaagagtgatcgaccccagaagatgtatgaagccagtcatattaactgacggtgaggaacgtgtaatcttagcaggaccgatgccagtaactcattcttcagccgctcaaagaagaggccgaattggtcgaaacccaaagaatgaaaatgatcagtacatatacatgggtgaaccgttagaaaacgatgaagactgtgcgcattggaaagaagcaaagatgttgttggacaacataaacactccagaaggaattataccatcaatgttcgagcccgaaagagagaaggttgatgcaattgatggtgaataccgactccgaggagaagctcgcaaaacattcgtagatcttatgagaagaggcgatttaccagtttggcttgcatataaagtcgcagcagagggaatcaactatgcagatcgtagatggtgttttgacggaatcaaaaataatcaaattttagaagaaaatgtagaagttgagatttggacgaaagaaggagaacgtaagaaattaaaaccccgatggttagatgctagaatttatagcgacccattggcgctgaaagaatttaaagagttcgctgccggacgaaaatcgctcacactgaacttaataacagagatgggcaggcttccaactttcatgacgcaaaagactagagacgctcttgataacttagccgtgctacacactgctgaagcagggggccgcgcctacaaccacgctttatctgagttacctgaaaccctagaaacactactactcttaacacttttagcaactgtaacaggaggtattttcttgtttctcatgagtggtaggggaattggaaaaatgacgctaggcatgtgctgcattattacagcttcgatcctactgtggtacgcacagattcaacctcattggatcgctgctagcataattttagaatttttccttatagttctcttaattcccgaaccagaaaagcaaagaacaccacaggacaaccagttgacatatgtcgtaatagcaatacttacggtagtggcggcaacaatggccaatgaaatgggcttccttgagaaaactaagaaagaccttggtcttggttccattgcaacacaacaaccagagagtaatatcctggacattgatcttcgaccagcaagtgcatggacgctgtatgcagtagcaacgacctttataactccaatgctgagacattcgatagaaaattcctcagtgaacataagcctaacagcaatagcgaatcaggcgacagtgcttatggggcttggaaaaggatggccattatcaaagatggatattggtgtccctctacttgcgataggttgctattcccaagtaaatcccattactttaactgccgctttacttctattagtagcacattacgctataattggtccgggactgcaagcaaaggctacaagagaggcacagaaaagggcagcagcaggtattatgaaaaacccaactgtcgatggaatcactgtaatagatttggacccgattccatacgatcctaagtttgagaagcaactgggtcaagtgatgctgctaatactttgtgtgacacaagttctaatgatgcggacaacgtgggctttgtgcgaggcactaacgctagcaacagggcccatcagtactttatgggagggaaacccaggtcgattttggaacacaaccatagcagtctcgatggcaaatatatttagaggatcctatctagctggagcaggccttctcttttctataatgaaaaacaccaccaatactaggaggggtacggggaatatcggcgaaactttgggcgagaagtggaaatcacgtctaaatgccttaggtaagagtgaatttcaaatatacaagaagtcaggtatccaagaagtggatcgaacacttgcaaaagaaggaattaaaaggggagaaacagatcaccatgcggtctccagaggatctgcgaaactgaggtggttcgtcgagcgcaacatggttacaccagaaggaaaagtagtagacctagggtgtggacgtggagggtggtcatattattgtggaggtcttaagaacgtgaaagaagtgaaaggactgactaaaggagggcctggacatgaagaaccaatccccatgtcaacgtatgggtggaatctagtacgattacagtctggagtcgatgtgttctttataccacccgaaaagtgcgacacattactttgtgatataggcgagagcagtccaaatcctactgtagaagcagggaggactctcagggtcttaaacttagtcgagaattggctgaacaataatacacagttttgtataaaggtcttgaatccgtatatgccttcagtgattgagaagatggaagcattacagagaaagtacggaggagctcttgttagaaatcctctaagtcgcaattcgactcacgaaatgtattgggtatcaaatgcgtcagggaatatagtaagcagtgtcaacatgattagccgtatgctcataaataggtttactatgagacacaaaaaggcaacatatgaacctgatgtggatttagggagcggtacaaggaacattgggatagaaagtgaagtacctaaccttgatataatcgggaaaagaattgaaaagattaaacaagaacacgaaacaagttggcattacgatcaagatcacccatataaaacatgggcatatcatggttcatatgaaacaaaacaaactggatccgcgagtagtatggttaatggagtagtacgactcctaaccaaaccatgggatgtactaccaacagtaacacaaatggctatgactgacacaaccccatttgggcaacaaagagttttcaaagagaaggtagatactcgaacacaagaacccaaggaaggaaccaagaaattaatgaaaatcacagccgaatggttatggaaggaactaggtaagaagaaaactccacgtatgtgcacccgtgaagagtttacacgaaaagttcgaagcaatgctgcacttggtgcaatattcacggatgagaataaatggaaatcagcaagggaggccgtagaggactcaagattttgggaacttgtggacaaagagcgaaatttacatttggagggcaaatgtgagacttgtgtttataacatgatgggcaaaagagagaagaaactaggagagttcggaaaagccaaagggtcccgagcaatatggtacatgtggttaggggccaggttcttagagttcgaggcgcttggatttttgaacgaggaccattggttctcgagagaaaattcactaagtggcgtagaaggcgagggtttgcataaactaggatacattttacgggacgtaagcaagaaagagggtggagccatgtatgctgatgacacagcagggtgggacacacggatcacgttagaagatctgaagaacgaagagatggttacaaaccacatggaaggagagcacaagaaactagcggaggctattttcaaattaacctaccaaaacaaagtagtgagagtgcagcgacctacccctagaggcacagtgatggacatcattagccgcagagaccagagagggagtggccaagttggaacatatggactaaacacatttacaaacatggaagcccagctaatacggcaaatggaaggtgaaggagtttttaaaaatattcaacatttaacagtgactgaggaagttgccgtacaaaattggcttgcccgtgtcggtagagaaaggttatcgagaatggcaataagtggcgatgattgcgtagttaaaccattagatgatagatttgcaaatgcattgacagcactaaatgatatggggaaaatacgaaaagacatacaacaatgggagcccagcaaaggttggaatgattggacacaagtaccattctgttctcatcatttccatgaactgatcatgaaagacggaagagtattagtcgtcccttgccgcaaccaagacgagctgatcggtagagctaggatatctcaaggagccggatggtctctgagagagacggcatgtctaggaaaaagttatgcccaaatgtggagtttaatgtacttccacaggcgggatcttagattagcagcaaacgccatatgttcggcagtaccttctcattgggttcctacgagtagaaccacgtggtcaatacatgcgaaacacgaatggatgacaacagaagatatgctaacagtttggaaccgtgtttggataagagaaaatccatggatggaagataagacgccagtagaatcatgggaagaaatcccatatctagggaaacgagaagaccaatggtgtggatcgttaataggattaacttcacgcgcaacatgggctaaaaatatacaggcagcgataaaccaagtaagaagcctaatcggaaacgaggaatatacggattatatgccatccatgaagaggtttagaagggaagaggaggaggccggcgttctttggtaa

SEQ ID NO: 22336 - RNA, 9876 nt, synthetic construct
  misc_feature 1..9876: note = derived and/or modified CDS sequence (opt6) from DENV-2__GQ868622__SS-prME
  source 1..9876: mol_type = other RNA
agtgcgggaatgattataatgcttatacctacagtaatggctttccatttaacaacacgaaatggggaaccacacatgatagttggcatacaagaaaaagggaaatcactcctatttaaaacggaagatggggtaaatatgtgcacccttatggcgatggaccttggcgaactttgtgaagacacaataacttacaaatgtccacttttacgtcaaaatgaaccagaagacattgattgttggtgcaattcaacaagtacatgggtcacgtacgggacctgtacaactactggtgaacacagaagagaaaaacgttccgtggctctagttccacatgtcggaatgggtcttgaaactagaacagaaacgtggatgtcttcagaaggggcttggaaacacgcccaacgtatagaaacctggatcctgaggcaccctggtttcaccataatggccgctattctagcttacacaattggcacaacccactttcaaagagcacttatctttatactattaacagcagttgctccatcaatgacaatgagatgtatagggatatctaatcgagattttgttgaaggcgtatctggaggcagttgggtagacatcgtccttgaacatgggtcttgtgtcacaaccatggccaaaaataaaccaactttagatttcgaattgataaaaactgaagcccgccaacctgcaactttaagaaaatactgtattgaagcaaaactgaccaatacgaccacagaaagtaggtgccctacccaaggcgagccatcattaaaagaagaacaagataaacgtttcgtttgcaaacacagtatggtcgatcgaggctgggggaatgggtgcggcttatttgggaaaggcggaatagttacatgtgccatgtttacgtgtaagaaaaatatggaaggaaaaatcgttcaaccagaaaatctcgaatatactatcgtcgttacacctcatagcggtgaagaacacgcggttggcaacgataccgggaaacacggtaaagagattaaagtaacgccgcagagttcaattacagaagcggaactaacaggctatggaacagttactatggagtgcagtcctcgaacgggcctagatttcaacgaaatggttttgcttcaaatggaaaacaaagcatggctagtacaccgtcaatggtttctcgatctaccattaccatggcttccaggcgcagataaacaagggagtaactggatccaaaaagaaacgttagtaactttcaaaaatccgcatgccaagaaacaagacgtggtagtattgggatctcaagagggagctatgcatacagcgctcacgggagccaccgaaatccaaatgtcttctggcaatttattatttaccggccacttgaaatgtagattaagaatggacaaattacaactcaaaggtatgtcatattctatgtgcaccggtaaatttaaagtagtaaaagaaatagcagaaactcaacatggaacaatagtcattcgcgttcaatatgaaggggacggaagcccatgcaaaataccgttcgagattatggatctcgagaaaaggtatgtactaggcaggcttataaccgtaaaccccatagttactgaaaaagattctcctgtgaatattgaagcggaaccaccatttggagacagttacatcataataggcgttgaacctggtcaattgaaactcaactggttcaagaaaggaagttccattggccaaatgtttgagactacaatgcgcggtgccaaaaggatggcgatcttaggagatactgcgtgggatttcggaagtttaggcggcgtttttacgagcataggaaaagcattacaccaagtctttggagcaatctatggagcagcttttagtggagtttcatggacaatgaaaatattaatcggggtcataataacatggataggcatgaactcgcgaagtacatctttaagtgtgtcattagtattagtaggtattgtgacgctatatctgggggtgatggtccaagccgattctggctgcgttgtaagttggaaaaacaaagagcttaaatgtggctccgggatatttataactgacaatgtacatacgtggaccgagcaatataaattccagcctgaatcacctagtaaattagccagcgctatacaaaaagctcaagaagagggaatctgtggaatccgttcagtcactaggttagaaaatctgatgtggaaacaaatcacgccagaattgaaccatatattagcagagaacgaagttaaattgaccattatgacaggcgatatcaaaggaataatgcaggcaggcaaaagatcacttcggccacaaccgacagaacttaagtattcatggaaaacatggggtaaagctaaaatgttatcaaccgaaagccataatcaaacattcctaattgacggtccagaaaccgctgaatgcccaaacactaatagagcatggaactcactggaagtggaagattatggatttggtgttttcaccaccaatatctggctaaaactaaaagagaaacaagatgcgttttgcgattccaaactgatgagtgccgctatcaaagacaaccgggccgtacatgcagatatggggtactggattgagagcgccttaaacgatacatggaaaatagaaaaagccagtttcattgaagtcaaaaattgccattggcctaaaagccacactttatggtcaaacggagtcttggaaagcgaaatgattatacccaagaatcttgctggtcctgtgtcacagcataattacagacccggttaccatacccaaatagcagggccttggcaccttggaaaattagaaatggattttgacttttgcgatggaacaacagtgatagtaacagaagattgcggtaaccgcggaccgtcattaagaaccacaacggctagcggtaagctaataacagaatggtgctgcagatcgtgcactttaccaccgttacgctatcggggagaagatggatgttggtatggaatggaaataagacctttaaaagaaaaggaagagaatctcgtgaacagcttagtaacagcaggacacggacaagtcgacaattttagtttaggtgttcttggaatggctctctttctggaagaaatgctaaggacacgtgtaggaaccaaacacgccattctattagtggcggtgtccttcgtcactctaatcacaggaaatatgagttttaaagacctagggcgtgttgtagtaatggtaggagcaacaatgaccgatgatataggaatgggagtgacatatctggcactattggctgcttttaaagttaggccaacatttgcagccggattattactcaggaagctaacatcaaaagaattaatgatgacaacgataggaattgtactcttatcacaaagcaccatcccggagacaatactggagttaactgacgcgctggcgctaggaatgatggttttaaaaatagtacgagatatggaaaaatatcaactcgcagttaccatcatggcgattctttgtgtgccaaatgcggtaatactacaaaacgcatggaaagtttcgtgcacgatattagccgtcgtatctgtttcacctttactattgacctcatctcaacagaaaacagactggatccccctagctctgactattaaagggttaaatcccacagcaattttcctaacaacattaagccgaacaaataagaaaaggtcttggccactcaatgaagccataatggcagtgggaatggtgtctatacttgctagttcattattaaagaatgatattccaatgacgggaccactcgtggccgggggtttattaacagtatgttatgttttaacaggacgatcagccgacctcgaacttgagcgggctactgacgtaaaatgggaagaccaagccgaaatctcggggtcgtccccaatcttaagcataacaatatcagaagacggttcaatgtccatcaaaaatgaagaagaagaacaaactctcactattttgataagaactggtctcttagtcatatcgggactatttccagtatcgataccgataacagcagctgcttggtacctatgggaagttaagaaacaaagagcaggcgtactgtgggatgtgccatctccgccacccatgggaaaagctgaacttgaagatggagcatatagaataaaacaaaaaggtattttaggttacagtcagatcggcgcgggagtttataaggaaggaacttttcatacaatgtggcatgtcacgcggggagcagtcctaatgcataaaggtaaacgtatcgaaccctcctgggctgatgttaagaaagacctaatctcctacggcggtggctggaaattagaaggggagtggaaagaaggagaggaagtccaggtcttggcattagagcccgggaagaacccaagggccgtgcaaactaaacccggactatttaagacaaataccggcactattggagctgtttctctggattttagccccggcacctccggatctccaattatcgataaaaagggaaaagtagtaggactctatggtaatggagtcgtcactcgctcaggagcatacgtaagtgcaatagctcagacagaaaagtctattgaggacaatcctgaaatcgaagatgatatctttcgaaaaagacgattaactataatggatctgcatcctggagcgggaaaaacaaaacgctacctccccgctatagtgagagaagccataaaaaggggactcagaacgttaatactggctcctacaagagttgttgctgcggaaatggaagaagccttgagaggacttccaatcaggtatcagacgcctgcaattcgtgcagaacacaccggtcgggagatagtcgacttaatgtgtcatgctactttcactatgagactcttatcaccagtccgggtgccaaattataatttaataattatggacgaagctcatttcaccgatccggcttcaatagcagcaagaggctatataagtacgcgagtcgaaatgggtgaagcagcgggaatctttatgactgccactccccctggaagtcgcgatccatttccacaatcaaatgcacccataatagacgaagaaagagaaatcccagaaaggagctggaactcaggacatgaatgggtaacagattttaaaggtaaaacagtatggttcgtacccagcataaaagccggcaatgatatagcagcgtgcttgcgcaagaatggcaaaaaggttatacagctatctcgaaagacttttgactcagaatatgtaaagacaagaactaatgactgggatttcgttgtaaccacagatatttccgagatgggtgctaattttaaagccgaacgagtgattgatccccgtcgatgcatgaagccagtaattttaactgatggggaagaacgggtaatactggcgggacccatgccagttacacactcttctgctgcacaaaggagaggaagaatcggcagaaatcccaaaaatgagaatgatcaatatatatatatgggagaacctctagaaaacgacgaagattgcgcacattggaaagaagccaaaatgttgctagataatattaacactccagaaggaattataccgagtatgtttgaacccgagcgcgaaaaagtcgatgctatagacggagaatatcgtcttcgaggagaagcacgaaaaaccttcgttgacctaatgcgaagaggggatctacctgtatggttagcctataaggtagcagcagaaggcattaattatgccgacagaagatggtgcttcgatgggatcaaaaataaccaaattttagaggaaaacgttgaggtagaaatttggacaaaagaaggtgaaagaaagaaacttaagcccaggtggctagatgcgagaatctactcagacccgctcgcattaaaggagttcaaagagttcgccgcagggaggaaatccctcactctcaatttaattacggaaatgggtaggttaccaactttcatgacccaaaagacaagggatgcacttgacaacttggccgtactgcatacagcagaagcaggcggtcgagcttacaaccacgcattaagtgaacttcctgaaacgttagaaacactattgctgctaacattattagcaactgtaacaggagggattttcctatttctaatgtccggtcgaggcataggaaagatgacacttggtatgtgttgtatcattactgccagtatattgttatggtatgcacaaatccagcctcattggatcgcagcctctattattttggagttctttttaatagttctactaattcccgaaccagagaaacaaagaacgccacaagacaatcaacttacatacgtagtaatagcaatccttacagttgtggcggcgactatggcaaacgaaatgggattcctcgagaaaacgaagaaagatcttggtctaggaagtatagccacccaacaaccagaatctaacatcttggacatagatctcaggcccgcttcagcttggacattgtatgctgtagcaacaacattcgtcacaccaatgttacgtcattcaatcgaaaatagctccgtaaatgtttcattaacagctatagctaaccaggcaacagtattgatgggcttggggaagggatggccactttcgaaaatggacattggtgtacctctactcgcaataggctgctattctcaagtaaatcctataacactcacggcggccctactattgcttgtagcccattacgcgattataggaccaggtcttcaagcaaaagcgacacgagaagcccagaaaagagcagcagcaggcattatgaaaaatccaacagttgatgggataacggtaatcgatttagatcctattccctacgacccgaagttcgaaaaacaattaggccaggtgatgctattaatcctctgcgtaacacaggtcttaatgatgcgtacaacatgggccctctgcgaagcactgactcttgcaaccggaccaatatctacactgtgggagggaaacccaggaaggttttggaatacgactatagctgtgagtatggcgaatatatttagaggttcatacttggctggcgcaggattgttattttcaatcatgaagaacacgacaaatacaaggcgtggtaccggtaatatcggtgaaactctaggagaaaaatggaaaagtagattaaatgctttaggaaagtcagaatttcaaacatacaagaaaagtggtattcaggaagtagacagaacactggctaaagagggaataaagagaggagaaacagatcaccatgctgttagcagaggatcagcaaaacttagatggtttgtcgaaagaaatatggtaactccagaaggcaaggttgtcgatctggggtgcggaagaggagggtggagctactactgcggtggtctgaaaaatgtaagagaggtcaaaggactgacgaaaggaggccctggacatgaggaacctattcctatgagtacttatggatggaatttggtgagactacaaagcggtgtagatgtattcttcataccccctgaaaaatgtgacacgctcctttgtgatataggtgaatctagtcctaatccaacagtagaggcaggtcgcacgttaagggttttaaatctagtcgagaactggcttaacaacaatacacaattttgtattaaggtactgaatccttatatgccttcggtaattgagaaaatggaagccctgcaacggaaatatggaggagccttagtccgaaatccattaagtcgaaatagcacacatgagatgtattgggttagcaacgcaagtggaaatatagtgtcaagcgtcaatatgatatcacgaatgctaataaacagatttactatgcgtcataaaaaggccacatacgaacccgatgtagatttaggtagtggcacgcgaaacataggcatagaaagtgaaatacctaatctcgatattattggtaaaagaattgagaaaataaagcaggaacatgaaacaagctggcattatgaccaggatcatccgtataagacctgggcatatcatggttcatatgaaacaaaacaaacaggttctgcaagttcgatggttaatggagtagtgcggttgcttactaagccgtgggatgtacttccaacagtaacacaaatggctatgaccgacaccacaccattcgggcagcaaagagtctttaaagagaaggttgacacacgtacccaggaaccaaaagaagggaccaagaaactaatgaaaattacagcagaatggttatggaaggagttaggcaagaagaaaacacctcgcatgtgtactagggaggaatttacaagaaaagtacgttcaaacgcagcactcggcgctatctttacggatgaaaacaaatggaaatcagctagggaagcagtggaggataggcgtttctgggagctagttgacaaagaacgaaacctgcacttagaaggtaaatgcgaaacatgcgtatacaacatgatgggaaaaagagagaagaaactaggtgaatttggcaaagctaaaggatccagagcgatatggtacatgtggttgggagcacgttttctagagttcgaagctctaggattcctcaatgaggatcattggttttctcgagaaaatagtttaagtggtgtagagggagaaggattgcacaaactggggtacatcctccgcgatgtttctaagaaagaaggaggggcaatgtatgctgatgacaccgccggttgggatacacgtataacgttagaagacttaaagaatgaagaaatggtgacgaatcacatggaaggggaacataagaaactcgctgaggcaattttcaagttgacatatcaaaataaagtcgtaagagtacaacgacctactcctagaggcacagttatggatataataagtaggcgggatcaaagaggatcgggccaagtcggtacatacggcttaaacacgtttacaaacatggaggcacaactaataagacaaatggaaggagaaggtgttttcaaaaatatacagcatttaacggcaactgaagaagtagcagttcaaaactggctagccagagtagggcgagagcgactctctagaatggcaatatcaggtgacgattgtgttgtaaagccactggacgacagattcgcaaatgcactgaccgctttaaatgatatgggaaaaatacggaaagacatccaacaatgggagccatccaaaggttggaacgactggacacaagtaccattctgttctcatcacttccacgaacttataatgaaagacgggagagtgctggtagtaccttgtaggaatcaagacgaattgatcgggcgagcccgcataagccaaggtgctgggtggtcattgcgagaaactgcgtgtctagggaaatcctacgctcaaatgtggagtttgatgtattttcaccgacgtgacttacgcctagcagcgaacgcaatatgtagtgcagtaccgtcacattgggtacctacatcaaggacaacgtggtcgatacatgcaaaacatgaatggatgacaactgaagatatgctcacggtttggaatcgagtatggatacgggaaaatccatggatggaagacaaaactccagttgaaagttgggaggaaatcccctatctgggaaaaagagaagatcaatggtgtggttcgctaataggccttacatctcgagcgacttgggccaaaaatattcaagctgcgatcaaccaggttcgtagccttatcggcaacgaagaatatactgactatatgccatcaatgaaacggttcaggagggaagaggaggaagcaggcgtactgtggtga

SEQ ID NO: 22337 - RNA, 9876 nt, synthetic construct
  misc_feature 1..9876: note = derived and/or modified CDS sequence (opt6) from DENV-2__FJ639705__SS-prME
  source 1..9876: mol_type = other RNA
tctgcaggaatgataattatgttgatacctacagtcatggctttccacctaactaccagaaacggagaaccacatatgatagtcggaatacaagaaaaaggcaaaagtcttctcttcaaaaccgaagatggagtaaacatgtgtacactaatggctatggatcttggagaattgtgcgaagatacaataacatacaaatgccccttactaagacagaatgaaccagaagacatagattgctggtgcaattccacaagcacatgggtaacatacggtacatgtacgactacgggagaacaccgaagagaaaaacgttctgtagcattagttcctcatgtaggtatgggtctagaaacgagaacagaaacatggatgtcttccgaaggtgcatggaaacatgcacaaagaattgaaacttggattctaaggcatccagggttcacgattatggccgctatccttgcatatactataggaacgacccatttccaacgagcattgatatttatattactaacagcagtagccccttctatgactatgcgatgcattggcataagtaacagagattttgttgaaggagtatcaggagggagctgggttgacatagtcttagaacatggttcatgcgttacgacaatggccaaaaacaaaccaacattagatttcgaactaataaaaacagaagcaagacaacctgcaacactgaggaaatattgtattgaagcaaaattgaccaacactacaactgaaagtaggtgccccacacaaggcgaaccttccttaaaagaagaacaagacaaacgtttcgtttgtaaacactccatggtcgacagaggttggggtaacggatgcggtcttttcggtaaaggtggcatcgtgacatgtgccatgtttacatgtaagaaaaacatggaaggaaaaatagtacagccagaaaatctagaatacacgatagtagttactcctcactctggagaagaacatgcagtaggcaacgataccggaaaacacggaaaagagattaaagtgacaccccaatcatccataacggaagcggagctaacaggatatggaacagtaaccatggaatgcagtcctcgcacaggtttagacttcaatgaaatggtcctacttcaaatggagaacaaggcttggttagtccaccggcaatggtttttagatttacctctaccttggctacctggcgcggataaacaaggcagcaattggatacaaaaagaaaccttagtaacattcaaaaacccgcatgcgaagaaacaagacgtagttgtactaggatcgcaagaaggagccatgcatacagctctaactggggccaccgaaatacaaatgtcgtctggcaatttgctatttaccggtcacctgaaatgcagactacgtatggataaattgcaactaaaaggaatgtcttatagcatgtgtactggtaaattcaaagtagtcaaagaaatcgcggagacacaacatggaactattgttatacgagttcaatatgaaggagacggctccccgtgcaaaattccattcgaaatcatggacctagagaaaagatatgttttaggtcgactcataacggttaatcctatagtaactgagaaagactcgccagtaaatattgaggccgagccgccgtttggtgatagctatatcattatcggagtggaaccgggtcagctaaaacttaactggtttaaaaagggttcgagcatagggcaaatgtttgaaactacgatgagaggtgcaaagagaatggccattttaggtgacacagcatgggacttcggctcgctaggtggagtttttacaagcataggtaaagcattacatcaagtatttggggcgatttacggagccgccttttcaggtgtttcgtggaccatgaaaatcttaataggcgtaataataacatggattggaatgaactctcgaagtacttcactatcagtatccttagttttagtaggcatagtcactctctatctgggagtaatggtccaagcagacagcgggtgtgtagtgtcttggaaaaacaaagaactgaaatgtggcagcggaattttcataaccgataatgtgcatacttggaccgaacaatacaagtttcaaccagaatcaccaagtaagttggcatcggccatccaaaaggcccaagaagaaggaatatgcggtataagaagtgtgacaagattagagaacttaatgtggaaacagataacacctgaactaaaccatatcttagccgagaatgaagtcaaacttacaattatgacgggagatattaaaggcataatgcaagctggaaaacggagtttgcgaccgcaaccaactgaacttaaatattcctggaaaacatggggtaaggcaaaaatgctgtcaacggaatctcataatcaaacattcctaatcgatggaccggaaacagctgaatgtccaaatacaaatagagcttggaactcgttagaggtagaagattacggattcggggtttttaccaccaatatatggctgaaactcaaagagaaacaggatgctttttgtgatagcaaactcatgtcggcggcaatcaaagataatagggcagttcatgctgatatgggatattggatagaatcagctttaaacgatacatggaaaatagaaaaagcctcttttatagaggttaagaattgtcattggccaaaatcacacactctatggtcgaacggagtactcgaaagtgaaatgattatcccaaagaacttagctggtccggtttcacaacacaactatcgacctggatatcacacccagatagctggcccgtggcatctaggaaaacttgagatggactttgacttctgtgacggtactactgtcatagtcacagaggactgcgggaacagaggtcccagcttgagaacgacgacggcctctggtaaattaataacggaatggtgctgccggtcatgtacacttccacccttaagataccgtggagaagatgggtgctggtacggcatggaaataaggccgctaaaagaaaaagaggaaaaccttgtaaattcactggtgacagccggtcacgggcaagtggataacttctcactaggggtgttaggaatggcgttattcttggaagaaatgctaagaactcgcgtcggtacaaagcacgctatcctactggtagcggtatcttttgtcactctcattacaggaaacatgtcctttaaagacctgggaagagttgtcgttatggtcggggccactatgactgacgatatagggatgggagtaacgtatttagcactgctcgcagctttcaaagtacggccgacatttgcggcaggcctactattaagaaaactaactagcaaagaactgatgatgaccacgatagggatagtccttctctcgcagagtactattcccgaaacaattttagaactcacagatgctttggctctagggatgatggttctcaaaatcgtccgcgatatggagaagtaccaactagccgtaaccataatggcgatactatgtgtaccgaatgcggttattcttcaaaatgcttggaaagtatcgtgcacaatactagccgtagtaagtgtaagtccattactattaacatcctcacagcagaaaaccgattggataccactagccctaacgatcaaagggctaaatcccactgctatatttttgaccaccttgagcaggacgaacaaaaagagatcgtggcctttgaacgaggcaataatggcagtcgggatggtatcgatcctagcgagtagtcttctgaaaaatgacatccccatgacgggacccctagtagccgggggtctactaacagtctgttatgttctaacaggtcgttcggcagacttagaattagaaagggcaactgacgtgaaatgggaagatcaagcagagatctcaggaagctcgccaatactttcaataacgatatcggaagacgggtctatgtctataaagaatgaagaagaagaacagacacttacaatactgataaggaccggattattagtcatatcaggccttttcccagtgagtataccaattaccgcggctgcatggtatttatgggaagttaagaagcaaagggcgggcgtgttatgggatgttccgtcacctccaccaatgggaaaagcagagcttgaagacggtgcctataggataaaacaaaaaggaatactaggctattctcaaataggcgcgggcgtttataaagaaggtacctttcatactatgtggcacgtaacgaggggtgcggttttaatgcacaaaggcaaacgtattgaaccgagctgggcagatgttaagaaagatctaatcagttacggaggaggatggaaattggaaggagaatggaaagaaggtgaagaggtccaagtgcttgcgctcgaaccagggaagaatcccagagcagtgcaaaccaaaccaggcctctttaaaacaaacacaggtactataggtgcggtgagcttggatttttctcccggtacaagcggatcgcccataatagacaagaaaggaaaagttgtcggtctctatggaaatggtgtggtgacaagaagcggggcgtacgtatcagcaatagcgcaaactgaaaaatccatagaagataacccggaaatagaagacgatatatttcgaaaaagaagactgactatcatggaccttcacccaggcgcgggaaagacaaagagatacctacccgcaatagtgcgagaagccattaaaagaggactaagaacccttatactcgctccaacgagagtcgttgcagcagaaatggaagaagctctaagaggattacccatacgatatcagactcctgctattagagcagaacacaccggacgtgaaattgttgacttaatgtgtcatgcaacatttacaatgcgactgctaagcccggtccgagtgcccaattacaatttgatcatcatggatgaggcacacttcactgacccagccagcatagcagcaagagggtatataagtactcgagtagaaatgggtgaagcggccggtatattcatgacagcaacacctccgggatcacgggacccatttccacagtcaaatgcacccatcatagacgaagaaagggagattccagagaggtcatggaatagtggccatgagtgggtaacagatttcaaaggtaagaccgtgtggttcgttccaagtatcaaggcaggaaatgatattgcagcatgtttacgtaaaaacggcaagaaagtaatacaattgagccgaaaaacgttcgatagtgaatatgtaaagacaagaaccaatgattgggactttgtagtaacaactgacataagtgagatgggggccaattttaaggcagagagagttattgatccccgacgctgtatgaagcctgtcatactaacagatggcgaagaaagagtcatacttgcagggcccatgccagtaacccatagtagtgccgcgcaaagaagaggccgtataggtcgcaatccaaagaacgaaaacgaccaatacatatatatgggcgaaccattggaaaatgacgaagactgtgcacactggaaagaagcaaaaatgttgctcgacaacatcaatacgccagaaggaataataccttccatgttcgaacccgaaagagagaaagttgacgcaattgatggggaatatagactcagaggggaggccagaaaaacgttcgttgatctcatgaggagaggagacttaccagtttggctcgcttataaagttgcagctgagggtatcaactatgcagataggcgatggtgtttcgatggcatcaaaaacaatcaaatattagaagagaacgtggaggtcgaaatctggacgaaagaaggtgagaggaagaaactaaaaccgagatggttagacgctaggatttactcagatccgttggcgctcaaagagttcaaagagttcgcagctggtcgaaaaagtctgactcttaatttaataactgaaatgggaaggctgcccaccttcatgacacaaaagacaagagatgccttagataatctagcggtgctccatacagcggaagccggcggtagagcttacaaccatgccttgagcgaattgcccgaaacactcgaaacactgcttttattgacattattagcaacagtaactggtggaatatttctatttctaatgagtggacgaggtatcggtaagatgacattaggtatgtgttgcatcattactgcctccattctattatggtacgcccaaatacaaccacactggatagcagctagcattatactagagttcttcctgatcgtactactgataccagaaccagaaaaacagagaactcctcaagataatcagttaacgtacgtagtcatcgcaatcctaacagttgttgcagcaacaatggcaaacgaaatgggcttcctggaaaagaccaagaaagacttaggtttaggtagtatagcgacacaacaacccgaaagtaacattttggacatcgacctcaggccggcatcggcgtggacattatatgctgtagcaacgactttcgtgacacccatgctcagacattcaatagagaacagttctgtaaatgtaagcctaactgcgatagctaatcaggcaacagtgctaatgggactaggaaaaggttggccgttatcaaaaatggatataggtgtacctttgttagcaattggttgttactcacaagtaaaccctattacactaacagctgcattactaagtcttgttgcacactatgcgataataggaccaggtcttcaagcaaaagcgacacgagaggcccaaaaacgagccgcggcgggaatcatgaaaaacccaacagtagatggcattactgtgatagacttagacccgatcccatatgatccaaaatttgaaaagcaattaggtcaagtaatgttgctgatattatgtgttacacaagtactaatgatgaggacgacctgggccctttgtgaagcattgacgctagccacaggtccaatttctacattgtgggaaggaaatccgggaaggttttggaatactacaatagctgtgtcaatggccaatatatttcggggaagttatctcgcgggagctggactattgttttctattatgaagaacacaacaaacactcgacgaggaacaggtaacataggagaaacactgggtgaaaaatggaaatcgaggctaaatgcgctagggaaatcggagttccagacttacaagaaatcaggcattcaagaggtagacagaaccttggcaaaagaaggtataaagagaggagagacagaccatcatgcagtaagcagaggatctgcaaaattacgttggtttgtagaaagaaatatggttactccggagggtaaggtagtagatctgggttgcggaaggggtggatggagctattactgtggaggtcttaagaacgttcgggaagtgaagggacttaccaaaggaggccccggtcatgaagaaccgataccaatgtctacatatgggtggaatcttgtaagattacagtctggagtagatgtattctttattcctccagaaaagtgcgacactttattatgtgatattggggaaagctctccaaaccctacagttgaagccggtcgaacactacgtgtcttaaacctagtagaaaactggcttaataataatactcaattttgtattaaagtactcaatccatacatgccatcagtaattgaaaagatggaagcgctacaacgaaaatatggaggagctctagtacgtaatcctttaagcaggaactcaacacatgagatgtactgggtcagtaacgcatcaggaaatatagtgagtagcgtcaacatgataagccgaatgttaatcaataggtttacaatgcggcacaaaaaggcgacctatgaacctgatgttgacttgggctcaggaactcgcaatattggaatagaatcagaaatacccaatttagatattatagggaaacgtattgagaaaataaaacaagaacacgaaacaagttggcactacgatcaggatcatccatataaaacatgggcttatcatggttcatatgaaacaaaacagacaggctctgcctcgagcatggtaaatggagtggtcaggcttctaaccaaaccatgggacgttcttccaactgttacacaaatggcgatgactgatactactccattcggtcaacaacgcgtcttcaaagaaaaagttgatactagaacacaagaaccaaaagaagggacaaagaaactcatgaaaataacagctgaatggctttggaaagagcttggtaaaaagaaaactcctcgcatgtgtacacgtgaggaatttactagaaaagtgcgatcaaatgccgctttaggagcaatattcaccgatgagaataaatggaaaagtgcccgcgaggcagtagaagactcacgtttctgggagttagttgataaagagaggaacctacatcttgaaggtaaatgtgagacttgtgtatataacatgatgggaaaaagagagaagaaactcggtgagtttggaaaagcgaaaggcagccgagcaatatggtatatgtggctaggcgcaaggttcctagaatttgaggcactgggcttcttaaacgaggaccattggttttcacgagaaaactcattgtcaggtgtagagggtgaaggactgcacaaattaggatatatactaagggatgtaagcaagaaagaagggggagcaatgtatgctgatgacaccgcgggctgggacactcggattacattggaggatctaaagaatgaagagatggtcactaatcatatggaaggagaacataagaaattagcagaggctatcttcaaactcacgtatcaaaataaagtggtacgggtacaacgcccaacacccagaggtactgtaatggacattatctcaaggagagatcaacgaggatctggccaagttggtacctacggattaaataccttcacaaacatggaggcacaattaatacgccaaatggagggagaaggtgtctttaaaaatatacaacatttaacagcgactgaagaagtagctgttcaaaattggttggcaagagtaggaagagaacggctaagtagaatggccatatctggcgatgattgcgttgtaaaacctcttgatgatcgatttgcaaacgctctcaccgctctgaatgacatggggaaaataagaaaagatatacaacaatgggaaccaagcaaagggtggaacgattggacccaagtgccattttgctctcaccactttcatgagctgataatgaaagatgggagagtcctggtagtgccatgccgtaaccaagatgaactgataggcagggctagaattagccaaggagcaggttggtctttgcgagaaacagcgtgcctaggaaaatcctacgcccaaatgtggagtttgatgtattttcacagaagagacctcagattagcagcaaacgcaatttgcagtgccgtaccttcacactgggtacccacaagtaggacgacatggagtatacacgccaagcatgaatggatgacaactgaggacatgttaacagtgtggaacagagtgtggattcgggaaaatccatggatggaggataaaacaccagttgaatcatgggaagagatcccgtatttaggaaagagagaggatcagtggtgtggatcattaatcggcttaacaagtagagcaacatgggccaaaaatatccaggcagcaataaaccaagttcgttcattaataggcaacgaagagtatacagattacatgccttcaatgaaacgatttagacgagaagaggaagaagccggcgtactttggtaa

SEQ ID NO: 22338 - RNA, 9876 nt, synthetic construct
  misc_feature 1..9876: note = derived and/or modified CDS sequence (opt6) from DENV-2__FJ639706__SS-prME
  source 1..9876: mol_type = other RNA
agtgcaggtatgataattatgcttattccaacagtaatggcatttcacctaactacgcgaaatggagaaccacatatgattgtaggaatacaagaaaaaggtaaatctttactatttaaaacggaagacggggttaatatgtgcacgctaatggcaatggatctcggagaattatgtgaagacactataacgtacaaatgtccattacttcgacaaaacgaaccggaagacatagattgttggtgcaattcgacaagtacgtgggtaacatacgggacatgcacaacaacaggcgaacatcgaagagaaaaacgatcagtggctctagtcccccacgtaggaatgggattagagactaggacggagacttggatgtccagtgagggagcatggaaacacgcacaacgcatcgagacctggatattaaggcatccaggatttaccataatggctgcaattctagcgtatacaataggcactactcatttccaaagagcactaatattcattttattgacggcagttgctccatctatgactatgcgttgtattggaatatctaatcgggatttcgtcgagggggtatcaggtggcagttgggtcgatatcgtcctggaacacggttcctgcgttaccacaatggccaaaaacaaacctacgttagattttgagttaattaaaaccgaagcaaaacaaccagcgactttacgaaaatattgcattgaagctaaactaacaaataccacgactgaatccagatgcccaacacagggcgaaccctcactaaaggaagaacaagataaacgcttcgtatgcaaacattcaatggtcgacagaggatggggcaatggatgcggacttttcggcaaaggtgggattgtaacctgtgccatgtttacctgtaaaaagaatatggaaggtaaaattgttcaaccagaaaatctcgaatatacaatagtagtaactcctcattctggcgaagaacacgcggtagggaatgacacaggaaaacatggcaaggaaataaaagtcactccgcaatcgtccataacagaagctgaattaacaggatacgggacagtaactatggaatgttccccacgaacgggtttagacttcaatgaaatggtgcttttgcagatggaaaacaaagcgtggctagttcatagacaatggttcctagatttaccactaccatggttgcctggagcagataagcaaggtagtaattggatacaaaaagaaactctagtgacatttaaaaatccacacgcaaagaagcaagatgttgtagtattggggtcccaggaaggtgctatgcatacagcattaacgggagcaaccgaaatacaaatgtcaagcggcaatttactattcaccggtcatttaaaatgtagacttcgtatggataaactacaattaaaaggtatgtcgtattcaatgtgtactggaaaattcaaggtagtgaaggaaatagcggaaactcaacacggaacgatcgtaataagagttcaatacgagggcgatggttcaccatgtaaaattccatttgaaattatggatctagagaaacgttatgtactagggagacttataacagtcaaccctatagttacagaaaaggacagccctgtaaacatagaagcagaaccaccgttcggggatagttacataataatcggggttgaaccaggccaattaaaactgaactggttcaagaaaggaagtagtattggtcaaatgtttgaaacaacgatgcgaggtgccaaacgaatggcaatcttaggtgatacagcctgggattttggttctctaggcggagtatttacttcgatcgggaaggccttacaccaagtattcggggcaatatatggggctgcatttagcggtgtatcgtggactatgaaaatactgattggtgttatcataacatggatagggatgaactcgagaagtacatccctatcagtatcactggtacttgtaggaatcgttacgctatacttaggagtaatggtacaggctgatagtggatgtgtagtcagctggaaaaataaggaattaaaatgtggttccggcatctttatcacagataatgtacatacctggacagagcaatataaattccagcctgagtccccgtccaaacttgcttccgcaattcaaaaagcacaagaggaaggaatttgtggcatcaggagcgtaaccaggctagaaaacctcatgtggaaacaaataacaccagaactaaaccatatactagcggaaaacgaagtaaagttaacaataatgacgggagatataaaaggaatcatgcaggcaggaaagcgatccctcagaccgcaacctaccgaattgaaatactcatggaagacttggggaaaagctaaaatgctatcgacggaatcgcataatcaaactttcttaattgacggtcccgaaacagcggagtgtcctaacacaaatcgcgcttggaatagccttgaagtcgaggactacggctttggtgtgttcaccaccaatatctggctaaaattaaaagagaagcaggatgcattctgtgatagtaagctcatgtccgcagccatcaaagacaatcgagcagtccatgccgacatgggatattggattgaatctgcgttgaacgacacttggaagatagaaaaagcatcattcattgaagtcaaaaactgtcattggccaaaatcacacaccttatggagcaacggcgtactcgagtcagaaatgataattcctaaaaacttagcagggccagtaagccaacataattatcgcccaggttatcacacgcaaatcgcaggaccatggcatttaggcaaacttgaaatggattttgacttctgtgatgggacaaccgtaatcgttacagaagactgcgggaatagaggaccttcacttcggactacgacagcttcaggcaagttgatcacagaatggtgttgtcgaagttgcacgctaccaccactgaggtatagaggtgaggatggatgttggtacggtatggaaatacgtccattaaaagaaaaagaggagaatctggtaaattcattagtcaccgcaggacatggacaagtggataatttcagtttgggtgtcttaggtatggcactttttctcgaagagatgcttagaactagagttggaacaaaacacgctattctgcttgtggcagtcagttttgtgaccttaataactggaaatatgtcctttaaggatctaggtagggttgtagtaatggtgggcgctacgatgacagacgatatagggatgggtgttacatacttggctttattagccgcttttaaagtgagaccaacattcgcagcgggcttattgttacgaaaactaaccagcaaagagcttatgatgaccacgattgggatagcactcctcagccaatcaactataccagagacaatattagaattgactgatgcgctcgcattaggcatgatggttctaaaaatagtccgcgacatggaaaagtaccagttagccgttacaataatggctatcctatgtgtaccaaacgcagtaatcttacaaaacgcatggaaagttagttgtacgatcctagctgtagtttcggtttctccacttcttttaacatcaagccaacaaaagacagattggataccactcgcactaactataaaaggattaaatcccaccgccatatttttgacgacgctaagtcgtacaaataagaaaagatcttggcctctaaatgaagctataatggcagtaggaatggtaagtatattagcgtcatctctattaaagaatgatatcccaatgaccggtccgttagtcgctggagggctacttacggtctgctacgtcttgacaggtagaagtgccgatttggaattagaaagggcgaccgatgttaaatgggaagaccaagctgagatttcaggaagttctccaatactaagtataactatttctgaagacggcagtatgtccatcaagaatgaagaggaggaacagaccctcacaatactcattagaaccggtctacttgtaatttcaggcttattcccagtatctatcccaataacggccgctgcttggtatctctgggaagtgaagaaacaacgagcgggggtattgtgggacgtaccaagtcctccccctatgggaaaagcagagttggaggacggtgcgtatcgcataaaacaaaaaggcatcctaggatatagtcagatcggagcaggagtatataaggaaggaacgtttcacacaatgtggcacgttacaagaggggctgtgctaatgcacaaagggaaaagaatagagccaagttgggcggatgtcaagaaagaccttatatcatacggagggggttggaaacttgaaggagaatggaaggagggagaggaggtgcaggtattagcactagaaccaggcaaaaatccaagagcagtacaaacaaagccagggttatttaagactaacaccggtaccattggcgctgtttccttagacttctctcctggtacatctgggtcacccataattgataagaaaggaaaagtcgtggggctatatggaaacggagtagtaaccagatccggtgcatatgtctccgccatcgcccaaacggaaaaatcgatagaagataatccggaaatcgaggatgatatattccgcaaacgaaggttaacaatcatggatctacatccaggagcaggcaagactaagcgttatctaccagccatagtaagagaagcgataaaacgtggattgaggacgttaatcttagctccaacaagagttgtagctgcagaaatggaagaggctttacgaggactacccataagataccagacaccagccattagggctgaacatacaggaagggaaattgtcgatttaatgtgtcatgctacgtttaccatgagattattaagtccagtaagggttcctaactataatctgatcattatggatgaagcgcacttcacagacccagcgtctatagccgcaagaggttacataagtactcgagtagagatgggagaggccgcgggaattttcatgacggccactcccccgggatcccgagacccctttccacagagtaacgcaccgatcattgacgaagaacgcgagattccagaaagatcatggaactctggccacgagtgggtaacagattttaagggtaagacagtctggttcgtcccctcaatcaaagccggaaatgacattgctgcatgtttgcgcaagaacgggaagaaagtcatacaattatcacggaaaacttttgattcggaatacgtgaaaacacgaaccaacgattgggactttgtagtaacaacagacattagtgaaatgggtgctaactttaaggccgaaagagttatcgatcctagaagatgtatgaaacctgttatattaacagacggtgaggaacgagttatacttgccggtccgatgccggtaacacacagctcggcagcacaacgacggggtagaatcggaagaaacccgaaaaatgaaaatgaccaatacatctatatgggagagcccttagaaaatgatgaagactgcgcgcactggaaggaggcgaagatgcttttggacaacattaacacgccagaaggtattatcccatcaatgttcgaaccagagcgcgagaaagtggacgccatagatggagagtaccggttaaggggagaagcacgtaaaacattcgtggatttaatgagaaggggagatctaccagtatggctagcctacaaagtggcagcggaaggaataaattatgcagataggagatggtgctttgacggaattaaaaataatcaaattcttgaagaaaatgtggaagttgaaatttggacaaaagaaggggaaagaaagaaactgaagccaagatggctcgacgcgagaatttattccgatcctttagccctgaaagagtttaaggagtttgctgccgggaggaaatcattgactttgaatttgataacggagatgggacggttgcccacatttatgacacagaaaacgagagatgcactagacaatctggctgtattacatacagcagaagctggaggtcgagcttacaatcatgctctttcagagttaccagaaacactagagacacttctattattaaccttactagctactgtaacaggaggcatttttctattccttatgtcaggcagggggataggaaaaatgacactaggaatgtgctgcattataacggctagtatcttattatggtatgcacaaatccagccccattggatagccgccagcataattctagagttctttcttattgtcttgctaatacctgaacccgaaaaacagagaacaccgcaggataaccagctaacgtacgtagtaatagcaattcttactgtagtggcagcaacgatggcaaacgagatgggatttcttgaaaagacaaagaaagatttagggctgggctccatagcaacgcaacagccagaatcaaacatactagatatcgaccttagaccggcaagcgcatggactttgtatgcggtagcaacgactttcgttactccaatgcttagacacagcattgagaacagctcggtcaacgtgagccttacagccatagcaaaccaagcaacagttctcatgggactaggtaaaggctggcctctatcaaaaatggacatcggtgtacccctactagccataggatgctattcacaagtgaatccgataacattgacagcagcattactactcctagtagctcattatgcgatcattgggccaggtctacaagctaaagcaaccagagaagctcaaaagcgtgcagctgcaggaattatgaagaaccctaccgtggacggtataacggtgatcgatctagatccaattccatatgatccaaagttcgaaaaacagctagggcaagttatgttgctaatcctttgcgtaacgcaagtactaatgatgaggacaacgtgggccttatgcgaggctttaacattagcgacgggtccaataagcaccctctgggaaggtaatccaggcagattctggaacacaaccatagctgtttcaatggccaatatctttagaggcagttatttggcaggagccggccttttattctctataatgaagaatactacaaatactagaagggggacaggcaatataggagagacgctaggggaaaagtggaaatcaaggttgaatgcgctcgggaaatcggaatttcagacatataagaagtctgggattcaagaagtagatagaacattggctaaggaaggtataaaacgaggcgaaacagaccaccacgcagtctccaggggttcggccaaacttagatggttcgttgagcgcaacatggttacgccagaaggcaaagtggtagatttagggtgtgggaggggtggttggtcttactactgtggagggttaaagaatgttagagaagtgaagggattgaccaaaggaggtccgggacacgaggagccaattcctatgtcaacatatggctggaatttggttagactacaatcaggagttgacgtcttctttattccaccggaaaagtgcgacacattactttgcgacataggggaatcatctccaaatccgacagtagaagcaggtagaacactccgtgtacttaacctggtagaaaactggttgaataacaatactcagttctgtattaaagttttaaacccctatatgcccagtgtgatagagaaaatggaagcacttcagcgtaaatatggaggagcactcgttagaaatccattatctagaaattccacacatgaaatgtactgggtcagcaatgcatcagggaatatcgtctcatcagtaaacatgatctctcggatgttaattaatagatttaccatgcgacataaaaaggcaacatacgagcccgatgtagatctcgggtccgggacgcgtaacataggaattgagtccgaaattccaaaccttgacattatcggcaaaagaatagagaaaattaaacaagaacatgaaacatcttggcattatgatcaagatcatccctataaaacatgggcatatcacggcagctatgaaactaaacagacaggatcagctagctccatggtaaatggcgtggttcgattactaacgaaaccttgggatgtgttacctacggtaacacaaatggcaatgacagatacgactccattcggacagcaaagagtatttaaagaaaaagtggatactcgaacccaagaaccgaaagaggggaccaagaaattaatgaagataacagcagagtggctatggaaagagctagggaagaagaaaacacctcgtatgtgtacgcgagaagagtttacacgtaaagtgcgtagtaatgccgcactaggagccatttttacagatgaaaataaatggaaatctgcacgggaggcggtagaagattcaagattttgggaattagttgataaagaaagaaatttgcacctcgaaggcaaatgtgagacatgcgtctataacatgatgggtaaacgggaaaagaaactaggagagttcgggaaagcaaaaggatctagagcaatctggtatatgtggcttggggcccgtttcttagaatttgaagcattaggttttctaaatgaagatcattggttctcaagggaaaatagtttgtccggagtggaaggagaaggattgcataaactaggatacatactacgagatgtatcaaagaaggaaggtggagccatgtacgcagacgatacggcaggatgggatacgcgaataacactagaagacctcaaaaatgaagaaatggtcactaatcatatggaaggtgaacacaaaaagctggccgaagcaatcttcaaacttacatatcaaaacaaagtagttagagttcaacgacccacaccaagaggaaccgttatggatataatatcaaggaaagatcaacgaggttcaggacaagtagggacgtatggcttgaatacgttcactaacatggaagctcaattgattcgacaaatggaaggagagggagtgtttaaaaatatccaacacctaaccgcaactgaagaagttgcagttcaaaactggttagcgcgtgtaggcagggagagactctccagaatggcgataagcggagacgattgcgttgtaaaacctttagacgatcgatttgctaacgctctcacagcattgaatgacatgggaaaaataagaaaggatattcaacaatgggaaccttcgaaaggatggaacgactggacgcaagtaccattttgttcgcatcatttccacgaacttatcatgaaggatggacgtgtattagtagtgccctgtagaaaccaggatgaattaatagggcgagcacgaatatcgcaaggtgctggatggtctttgcgggaaacagcatgcctaggaaagagttatgcccagatgtggagcctgatgtacttccatagaagggaccttagacttgctgctaatgcaatttgtagtgcagttcccagtcattgggtacctacgtccagaacgacatggtctatccatgcgaaacacgaatggatgacgacagaggacatgttgacagtttggaatagggtatggatacgggaaaatccttggatggaagataaaacaccagttgaaagctgggaagaaattccatacctagggaagcgagaggatcaatggtgtggatccttaattggtctgacttcacgggcgacatgggccaaaaatattcaagcagctattaatcaagtaagatccttaatcggtaatgaggaatacacagattatatgccaagtatgaaacgattcagaagggaagaggaagaagccggtgtattatggtag

SEQ ID NO: 22339 - RNA, 9876 nt, synthetic construct
  misc_feature 1..9876: note = derived and/or modified CDS sequence (opt6) from DENV-2__FJ639707__SS-prME
  source 1..9876: mol_type = other RNA
tccgcaggtatgattataatgctgattcctactgtaatggcttttcatctaacaacgaggaatggtgaacctcacatgattgtaggaatacaagaaaaaggtaaatccctactattcaaaactgaagacggtgttaatatgtgtactttaatggctatggacctaggcgaattgtgtgaagatactataacttataaatgcccactactgcggcaaaatgaaccagaagacatagactgctggtgtaactcaacctcaacatgggtgacgtatggtacttgtacgacaacaggtgaacatagaagggagaaaagatcggtagccttagtaccacatgttggcatggggctcgaaacacgaacagaaacatggatgagttcagaaggagcatggaaacacgcccaacggatagaaacatggatcttaagacacccagggttcactatcatggcggcaatccttgcgtatactataggaacgacgcactttcaacgggtgctcatttttatattattaacagctgtagcaccttctatgacaatgaggtgcatcggaataagtaaccgagactttgtagaaggcgtgtcaggcggctcttgggttgatattgtattagaacacgggtcctgcgtaacaaccatggccaaaaataaaccaacccttgattttgaacttatcaaaacagaagcaaaacaaccagcaacactacgcaaatactgcatagaagcaaaactaaccaataccactaccgaatcaagatgtcccacgcaaggtgaaccttccttaaaagaagaacaagacaagagattcgtatgtaagcactcgatggtagatcgcggttggggcaatggttgcgggttatttggcaaaggtggaattgtgacgtgcgctatgtttacctgtaagaaaaacatggaagggaagatagtacaaccagaaaatcttgaatatactattgtagtaacaccacactctggagaagaacatgcagttggcaatgacactggaaaacatggaaaagaaataaaagtaacgccacagtcatctattacagaagcagagttgacagggtacgggacagtaaccatggaatgttccccgagaacgggactggatttcaacgaaatggttttacttcaaatggaaaacaaagcatggctcgttcatagacaatggtttttagacctaccactgccatggttaccaggtgcagataaacaggagagcaattggatacagaaagaaaccctagtgacttttaaaaacccacacgctaagaaacaagatgtcgtcgttctaggctcacaagaaggtgccatgcatacagcgctcactggcgccaccgaaatccaaatgtcatctggaaatttgcttttcacgggtcatctgaaatgtaggttaagaatggacaaactacagctaaaaggtatgtcatattcaatgtgcaccggaaaatttaaagtggtcaaggaaatagctgaaactcaacatggtacaatagtgattagggtacaatatgagggagacggatcaccttgcaagataccatttgagataatggatttagagaaaagatacatcctaggcaggcttataacggtaaatcctattgtaacggagaaagattcaccagtaaacatagaagcagaaccaccgttcggagactcatatataattataggcgttgaacccggacaattaaaattaaattggttcaagaaaggaagttctattggtcaaatgtttgaaacaactatgagaggcgctaaaagaatggcaatactgggtgataccgcctgggattttggatcattaggtggagtcttcacatccatcggtaaagcacttcatcaggtattcggagcgatctacggtgctgcgttctcaggcgttagctggactatgaaaatcttaataggagttattatcacatggattggtatgaatagtcggagcacaagtttaagcgtgtcgttagttctggtcggtatcgttacactctatcttggagtaatggtacaagcagactcagggtgtgttgtctcgtggaaaaataaggaacttaaatgcggaagtggtatattcataaccgataacgtacatacatggactgaacagtataaatttcaaccagaaagcccgtccaaactagctagcgcaatccaaaaggctcaagaagaaggaatctgtggtatccgaagtgttactagactggaaaacctaatgtggaaacaaatcacccctgaattaaatcatattcttgctgaaaatgaggtaaaattaactattatgactggagatataaaaggcataatgcaagccggtaaaaggagtctgagaccgcaacccacagaactgaaatatagttggaaaacttggggcaaggctaaaatgctatcaaccgaatcatataaccagacttttctaatagatgggccggaaacaactgaatgtcccaacacgaatagggcatggaactctcttgaagtcgaagattatggctttggtgtattcactacaaatatatggcttaagctcaaagaaaaacaagacgctttttgcgattcaaagttgatgtccgccgccataaaagacaatagggccgtccatgctgacatgggctattggattgagtccgccttgaatgatacgtggaaaatagagaaagcgtcatttatcgaggtcaaaaactgtcactggcccaagtcgcatactctttggtccaatggagtactagaaagcgaaatgattataccgaaaaacctcgcgggtccggtcagtcaacataactacagacccggttaccatacccaaatagcaggaccatggcacttaggaaagttggagatggattttgacttttgtgatgggaccacagtcattgtaacggaagactgtggaaatcgaggaccgtctttacggactactacagcaagtgggaaattaataacagagtggtgctgtagaagttgtactctaccccctttaagataccgcggagaagacgggtgttggtatggaatggagatacggcctttgaaagaaaaagaagagaacctggtaaactccttagtaacggctgggcacggtcaagtagacaacttctcgctaggcgttttaggtatggcattattcttagaagaaatgttgcgaacaagagttggcacgaaacatgctattttgcttgtagcggtatctttcatgacattaataacaggcaatatgtcatttaaagaccttggaagagtagtagtcatggtaggtgctactatggcagacgacatcggaatgggtgtaacatacttagcactcttagctgcctttaaagtaagacctactttcgctgctggactattactacgaaaacttacctccaaagaactcatgatgacgacaattggcatagtgctactatcacaaagtacgatacctgagactgtattagaactaaccgatgcgctagcattaggtatgatggtactaaagatagttcgaaacatggaaaaatatcaactggcggtaacgattatggcaatcctctgcgtacctaacgcagtaatattacagaacgcatggaaggtatcctgcacaattctagcagtggttagtgtaagccctctgcttctaacttcatcacaacagaaaacagattggataccattagccttaacaataaaagggcttaaccccactgcaatattcctcaccacattaagtcggactaacaagaagagatcttggccgcttaatgaagctataatggcagttggaatggttagtatactggccagctcattactgaaaaacgacataccaatgacgggaccactagccgctggagggctgttaactgtatgttatgtcctaacagggcggtcagcagatctggaattagagagagccacagatgtaaaatgggaagaccaagcggagataagtggatcgtcacccatactcagcataacaatatcagaagacgggtcaatgagtatcaaaaacgaagaagaagaacaaactttaacaattctaataagaaccggtctgcttgtaatatcgggcttattccctatatccatcccaatcactgctgcagcttggtatttatgggaggtaaagaaacaacgagccggggttctctgggatgtcccttctccgcccccaatgggaaaagctgaactcgaagatggggcataccggataaaacagaaaggaatattgggttattcacaaattggggctggtgtatataaagaaggaacatttcacacgatgtggcatgtaacgagaggagcagtgttgatgcataaagggaaacgaattgaaccctcatgggcagacgtcaagaaagatctcatctcatatggaggaggatggaaactcgaaggagagtggaaagaaggagaggaggtacaagtattagctctagaacccggtaaaaaccctagagcagttcaaactaaaccaggtttattcaaaacaaatactggaacgatcggagccgtgtcacttgatttttcgcccggcactagcggaagtcccataatagacaaaaagggaaaagtcgtgggcctgtatggtaacggagtagtaactagaagcggggcttatgtttcagccattgcgcagaccgagaagagtatagaggataacccggagattgaagatgatatatttagaaagaggagactcacgatcatggatttgcacccaggcgctggtaaaacaaaacgctatctgcctgcaattgtaagagaggctattaaaagaggattgaggacactaattttagcaccgacgcgagtggtcgcagcagagatggaggaggcattacgaggactcccaatccgataccaaacgccggccatacgcgcagaacatacaggtagggaaattgtggatctaatgtgtcatgctacatttacgatgagacttctgtcacctgttcgagtgccgaattataatttgataattatggacgaagcccactttaccgatcctgctagtatagctgccagaggttatatctctacaagggttgagatgggagaagctgcgggtatattcatgaccgctactccaccaggttcaagagacccattcccacagtcaaacgcgcctataatagatgaagaaagagagataccagagaggagctggaacagcggtcatgagtgggtaacagattttaaagggaaaacagtatggttcgtaccatccatcaaggccggtaacgatatagctgcatgtcttcgtaaaaacggcaagaaagtaatccagcttagtagaaaaactttcgattctgaatatgctaaaacccgaacaaatgattgggatttcgttgtgactactgacatatctgaaatgggagccaattttaaagcagaaagagtcatagatcctaggcgatgtatgaaaccggtaatcctaacagatggagaggaaagggttattctcgctggacctatgccagtcacacatagtagcgcagcgcaaaggcggggacgtataggccgtaaccccaagaatgaaaatgatcaatatatctacatgggagaaccactagagaatgacgaagactgcgcacattggaaggaagctaaaatgttgctagataacataaatacgccagaaggaataatcccatccatgtttgaacccgaacgggaaaaggtcgatgccatcgatggcgaatatagactccggggagaagcacgaaagacatttgtagatctcatgaggaggggcgatttaccagtatggttggcatataaagtggctgcggagggaatcaactacgcagacaggagatggtgtttcgatgggatcaaaaacaatcaaattctagaggaaaatgtagaagtagaaatttggacaaaggagggagaaaggaagaaactgaagccgaggtggcttgatagtagaatttacagcgaccctctagccctgaaagagttcaaagagttcgccgcggggcggaagagtttaactttaaacttaattacagagatgggtcgtctccccaccttcatgacccaaaagacaagagatgcgctagataatctggcagtacttcatacagctgaagccggtgggagagcatataatcatgcactctcagaactccccgaaacattagagactcttcttctactgacgttgctagcgactgtgacaggaggtatatttctatttctaatgagtggaagaggaattggaaaaatgacactaggaatgtgttgtatcattacagcgtctatacttttatggtatgcacaaatacagccacactggattgcagcatcgataattcttgaatttttcttaatagttttactaataccagagcctgaaaaacaaaggacacctcaggataatcaactaacttacgttgttattgcaattctaactgtggtagcagccactatggcaaacgaaatgggatttttggaaaagacgaagaaagatctagggcttggctctattgccacacaacagcctgaatccaatatactagacatagatctccgaccagcgagtgcctggacactatatgccgttgcaacaaccttcgtgaccccaatgttacggcatagtatcgaaaatagctcagtgaacgtcagtctaaccgccattgctaatcaagctaccgtacttgtcggacttggaaaaggttggccattatcaaaaatggatataggtgttccgttactagcgatcggttgttactctcaagtaaatccaataacactgacagcagctcttttgttattagtggcacactatgccataattggtccaggattacaagctaaagcgacacgggaagcgcaaaaacgagcagcagcaggaataatgaaaaatccaacggttgatggtatcacagtaatagatttagacccaatcccatatgacccaaaatttgaaaaacaattgggacaggtaatgctactaatactttgcgttacacaagtcttaatgatgcgaacaacttgggcattgtgcgaggctttaacccttgccaccggtcctattagtactttgtgggaaggtaacccaggaagattctggaacactacgattgccgtttcaatggcaaatatatttagggggtcctatctagcaggagcgggcttattattcagtataatgaaaaacactactaatacaagacgcgggaccggaaatataggagaaactctgggagagaaatggaaatctcgtttaaatgctctaggaaaatccgagttccaaatttacaagaaatccggcattcaagaagttgacaggacactggcgaaagaaggaatcaaaagaggagagactgaccatcatgctgtcagtagggggagtgctaaattaaggtggttcgtagagcggaatatggttacaccggaaggcaaggtcgtggatttaggatgcggtcgcgggggttggtcgtattactgtggagggctcaaaaacgtaagagaagtcaaaggacttacaaaaggaggacctggccacgaagaacccataccaatgagcacttacggttggaatttagtacgattacaatccggagttgatgtgttctttattcccccggaaaaatgtgatactcttttatgtgatataggcgaaagctcaccaaacccgacagtagaagctggccgtactctccgagtcttaaatttggtcgagaactggcttaataataatacccaattttgtattaaggtattgaatccctacatgcctagtgtgattgagaaaatggaagcactacaacgaaaatatgggggtgccttagtacgtaatccactgagcagaaatagtacacacgaaatgtattgggtatctaacgcaagtggtaacatagtcagctcagtaaacatgatctcaagaatgttaattaataggtttacaatgcggcataagaaggccacttacgaaccagatgtcgatttaggctctggtacacgtaacatcggaattgagagtgaagtacctaatctcgacataatcggaaaaagaatagagaaaattaaacaagagcatgaaacaagttggcactacgatcaagaccatccatacaaaacttgggcgtatcatgggagctacgaaacaaaacaaaccggatccgcatcctctatggtaaatggagtagttaggttactaaccaaaccttgggacgttcttcctaccgtaacccaaatggcaatgaccgataccacaccattcggacaacaaagagtttttaaagaaaaggtagatactcgcacacaggagccgaaagagggaacgaaaaagttaatgaaaattaccgcggaatggctatggaaagaattagggaaaaagaaaaccccaagaatgtgcacgagagaggagttcacacgcaaagttagatcaaatgctgctctaggggctatcttcacagatgagaacaaatggaaaagtgccagagaagctgtagaagacagtcgtttctgggaactcgttgacaaagaaagaaatctccatttagaagggaagtgcgagacatgtgtctataacatgatgggtaaacgtgagaagaaactaggtgagtttggaaaagctaagggttccagagcaatttggtatatgtggctcggggctagattcttagagttcgaagcactgggattcctaaacgaagaccattggtttagtagagaaaactcattaagcggtgttgaaggagagggactgcataagctgggttatatcctcagggacgtaagcaagaaagaaggtggagctatgtatgcagatgatacagccgggtgggatacacgtattacactggaagatctcaaaaacgaggagatggtcactaatcatatggaaggtgaacacaagaaattagctgaagctattttcaagctaacataccagaataaagtagtgagggtacagcgcccaacgcctcgaggaacagtcatggatattatttcaagaagagaccaaagaggatctggtcaagtcgggacttacggtctaaacacgttcactaacatggaagcacagctgatacgacagatggaaggggaaggggtttttaagaatattcaacatttaaccgtaacggaagaggtcgctgtacagaattggttagctcgtgttggtagggagaggttgtctcggatggccatcagcggtgacgattgtgtcgttaaacctctagatgaccgattcgcaaacgcattaactgcattgaacgatatgggtaaaatcagaaaagacatacaacagtgggagccgagcaaaggttggaatgattggacccaagtgcctttttgttcacaccactttcacgaactaatcatgaaagacggcagggtacttgtggtaccatgtaggaaccaagatgaattaataggtagagcaagaatctcacaaggggcaggatggtctcttcgagaaacggcctgtctcggtaaatcatatgcgcagatgtggtccttgatgtactttcatagaagagacctgaggctagcggcgaatgccatttgctcggcagtaccttcacattgggtcccaacttcccgaaccacttggtcaatacatgcgaaacatgagtggatgaccacagaagacatgttaactgtttggaatcgcgtatggataagagaaaacccatggatggaggataaaactccggttgaaagctgggaagaaatcccctacttgggaaaaagagaggaccagtggtgcggctctttgataggactcacgtcgcgagcaacgtgggcgaaaaacattcaagctgctataaatcaggttagatcattaataggtaatgaggagtacacagattatatgccatcaatgaagcgattcagacgtgaagaggaggaagctggggtcctgtggtaa

SEQ ID NO: 22340 - RNA, 9876 nt, synthetic construct
  misc_feature 1..9876: note = derived and/or modified CDS sequence (opt6) from DENV-2__FJ639708__SS-prME
  source 1..9876: mol_type = other RNA
tctgcgggaatgataataatgcttattccgacggtaatggcattccatctaactacgagaaatggtgaaccacatatgattgtagggatccaagaaaaaggtaaaagtttattatttaaaaccgaagacggagtaaatatgtgcacgctcatggcaatggacttaggtgaactatgtgaagacaccattacatataaatgtccattactaagacaaaatgaacccgaagatatcgattgttggtgtaattcaacgagtacatgggttacatatggtacatgtacgaccacaggagaacatagacgtgaaaaacgttcagtagccttagtccctcatgttggaatgggtctggagactagaacagaaacctggatgtcctccgagggagcatggaaacatgcgcaacgaattgaaacatggatactaagacacccaggatttactattatggcagccatcttagcgtacacaatcggaacaacacatttccaacgagtccttatatttatattactaacagcagttgcaccatctatgactatgagatgtatcggtatatcaaatagagatttcgtagaaggggtgagcgggggatcttgggtagatattgtccttgagcacggatcatgtgtcactaccatggctaaaaacaaacctacattggatttcgagttaatcaaaaccgaagccaaacaaccagccactctgagaaaatattgcatagaagccaaactaacaaatacaactacagaaagccgatgtcccacgcaaggagaaccgagtttaaaagaagaacaagacaaaagattcgtatgtaaacattccatggttgatagaggatggggaaacggatgcggtctctttggaaaagggggtatagtaacgtgtgcgatgttcacatgtaagaaaaatatggaaggtaaaatagtacaaccagaaaacctagagtatactatagtagtaacaccacactcgggagaagaacacgcagtcggaaatgacaccggaaaacacggaaaagaaattaaagtcacgccccaatcgtctataacagaagccgaattaacaggttatggtactgtgacaatggaatgttccccaaggactggtctagacttcaacgaaatggtattactacaaatggaaaataaagcatggctggttcataggcaatggtttttagatttgccacttccgtggcttcccggagctgacaaacaagaaagtaactggatccaaaaagagaccctagtaacatttaaaaacccacacgctaagaaacaagatgttgttgtattaggttctcaagagggggcgatgcacacagcgctaacgggagccactgagatccaaatgtcatccggaaatcttctctttacagggcatctaaaatgtcgattgcgcatggacaaattgcaacttaagggcatgtcctatagcatgtgtacaggcaaatttaaagttgtaaaggaaatagctgagacgcaacatgggacaatagtaatacgggtgcaatacgaaggtgacggaagtccatgtaaaattccattcgagataatggatctcgagaaaagatatatactgggaagattgataacagtcaacccaatagtaacagagaaagattcaccagtcaacatagaagctgaaccgccgtttggtgattcatatattataattggggtagagccaggtcaacttaaattgaattggtttaagaaaggttcaagtataggacaaatgtttgagacgaccatgagaggcgctaaacgcatggcgattttaggagatacggcgtgggattttggttcactcggaggtgtatttacatccataggtaaggctttacaccaagtatttggtgctatatatggagcagcttttagtggcgtctcatggacgatgaagattttgattggggtaataattacgtggatagggatgaatagtagatcgactagcttgagtgttagtttggtcctagttgggatagttaccttatacctgggagtaatggttcaagctgattcagggtgtgtcgtctcatggaaaaacaaagaattaaaatgtggatcaggaatttttattacagacaacgtccacacatggacggaacagtataaattccagccggagagtccgagcaaattagcaagcgccatacagaaagctcaagaagaaggaatatgtggaataagatcagtaactagattagaaaatttaatgtggaaacaaataactccagagctaaaccatatcctagcggaaaatgaagtcaagttaactatcatgactggagacatcaaaggaataatgcaggccggaaagagatcacttcggccacaacccacagaactcaagtattcctggaaaacctggggaaaagcgaaaatgttgagtacagaatcttacaaccaaacatttttaatagatgggccggaaaccgcggaatgcccaaacactaacagagcatggaactccttagaagtcgaagattatggattcggagtatttacaactaacatttggttgaaactaaaagaaaaacaagacgcattttgtgactcaaaactaatgagcgcggccattaaggataaccgggctgttcatgctgatatgggttattggatagaaagcgcattgaatgatacgtggaaaatagaaaaagcatctttcattgaagttaagaattgccattggccaaaatctcatacactttggagtaatggtgtacttgaatcagagatgatcatccccaagaatctagctggcccggtgtctcaacataattataggcctggatatcacactcaaatagcaggaccgtggcatttgggtaaacttgagatggattttgatttctgcgacggaacgactgttatagtaactgaggattgcggtaataggggaccttcgttgaggacgacaactgcttccggtaaacttattaccgaatggtgttgcaggagctgcaccctaccaccgttacgctaccgtggcgaagatggatgttggtacggcatggaaataagaccgctaaaagagaaggaagaaaatttagtaaacagtcttgtcactgcaggtcatgggcaagtagacaacttttcactaggggttttaggtatggctttatttctagaggaaatgctcagaactcgggtaggaaccaagcatgctatactactggttgcagtatcctttatgacgctaataacgggcaacatgtcattcaaagatttaggacgtgtggtagtaatggtaggtgccaccatggccgatgatatcggcatgggagtaacttacttagcacttctggctgccttcaaagtaagacctacatttgctgccgggttattacttaggaagctaacatcaaaagagttaatgatgacaacaatcgggatcgtattgctttcacaatcaacaataccagaaactgtattagagctaacagatgcactcgcattaggaatgatggttttaaagatagtaaggaacatggaaaagtatcagctcgccgttacaatcatggctattttgtgtgtcccaaacgcagtcattcttcaaaacgcttggaaagtatcatgtactattttagcagttgtttccgtcagcccactcctactaacatccagccaacagaaaaccgactggataccgctagctttgacgataaaaggattgaatccaactgcaatattccttaccacattaagtagaacgaataagaaaagatcttggccattaaacgaagcaatcatggcagtaggaatggtgtctatattagcaagctccttacttaaaaatgacataccaatgacaggccccctagtagccggaggtttactcacagtctgctatgtattaacgggtcgatcagcagatttagagcttgaacgagcaactgatgttaaatgggaggaccaagctgagatctcaggatctagtccgattctttcaataactatttcggaagacggctccatgtcaattaaaaatgaagaagaagaacagacacttaccatactaatcaggaccggattattagtaatttcagggcttttcccaatatctattccaataaccgcggcggcctggtatctatgggaagtcaaaaagcaacgtgctggagtactatgggacgtcccatcgccgccgcctatgggcaaagcagaattagaggatggagcatacagaattaaacaaaaaggaatactaggatattctcaaattggagcaggagtatacaaagaggggacctttcatacaatgtggcatgttacacgtggagcggtcctgatgcacaaaggaaagcgcatagaaccaagttgggcggacgttaaaaaggacttaatatcatacggtggaggatggaaactagaaggagaatggaaagaaggcgaagaagtccaggtacttgcattagagcccggcaaaaatcctagagccgtgcaaactaaacctggactatttaagactaacacaggaacaatcggggccgtgagtttagattttagcccagggacgtctggatcaccgatcatagataagaaaggtaaagttgtcggactatatggaaatggcgtcgtaactcggtctggggcttatgtgtcagcaatcgctcaaacagaaaaatcaatagaagacaatcctgaaattgaagatgatatatttcgaaagcgcagattaacaattatggatctgcacccaggcgctggaaaaacgaaaaggtacctaccagcaatcgtacgagaagcaataaagcgaggccttagaacgttaatactagcacccactagggtggtagcggctgagatggaggaagcgttacgtggccttcctataagatatcagactccagctatacgagctgaacacacaggtcgagagattgtagatctaatgtgtcacgcgacattcactatgagattattatcaccagtcagagtacccaattacaacttaataataatggatgaggctcattttactgaccctgcgtcaattgctgcccgaggatatatatcaacaagagtggaaatgggagaagccgctggaattttcatgacagctacccctccagggagtagagatccattccctcaatcaaacgcacccataatagacgaagaaagagaaataccagagagatcatggaactcaggtcatgaatgggttacagactttaagggaaaaaccgtatggtttgtgccatcgatcaaagctggaaatgatattgcggcatgtctaaggaaaaatggaaagaaagtaatacagctttcaagaaagacgttcgatagcgaatacgtcaaaactagaaccaatgactgggattttgttgtgacaacagacattagtgagatgggagcgaatttcaaagccgagagagtaatagatcctaggcgctgtatgaaacctgtaattttaaccgatggcgaagagagggtcattttagcaggacccatgcctgttactcattcctccgcagcacaaagaagaggcagaataggaaggaacccgaaaaacgaaaatgaccaatatatatatatgggggaaccactagaaaacgatgaagactgtgctcactggaaagaagcaaaaatgttattagataatattaatactcccgaggggataataccctctatgtttgaacctgaacgcgaaaaagttgacgcgatcgatggagagtatcgcttaagaggtgaggcccgaaaaacatttgtagatctcatgagacgaggcgatttgccagtctggcttgcatacaaagtcgcagctgaggggattaattatgcagacaggcggtggtgtttcgatggtatcaaaaataatcagattttagaagaaaacgtcgaagttgagatctggaccaaagaaggagaaagaaagaaactgaagccaagatggctagacgccaggatatatagtgatccattggcgctcaaagagttcaaagagttcgctgcagggagaaagagcttaacacttaacttgataacagaaatgggtagattgcccacgttcatgacacagaaaacaagagacgcgctagataacttagcagtattgcacactgctgaagccggtgggcgagcgtataatcacgcactaagcgaattacctgaaaccttagaaacgcttctactattaacgttacttgcaactgtaacgggcggcattttcctattcctcatgagtggacgaggtataggaaaaatgacgctaggtatgtgttgtatcataaccgcttcaatattgttatggtacgcacaaattcaaccccattggatagcggcttcaatcatactcgaatttttcttaatcgtactcttaatacctgaacctgaaaagcaaaggaccccacaagacaatcagctgacgtacgttgtgatcgccatactaacagtcgtcgccgccaccatggcgaatgaaatggggttccttgagaaaacgaagaaagatctaggattaggatctatcgctacccaacaaccagaatcgaacatactcgacatagacctccgtccagcttcagcatggacactatacgcggtggccacaacttttgtaacaccaatgcttcgacattcaattgaaaacagcagtgttaacgtaagcctaacggcaattgcgaaccaagctactgttttaatgggccttgggaagggatggccactttcaaaaatggacataggcgtaccattactggctatagggtgctactcacaggtaaaccctatcacattgacagcggcgttattacttttagtggctcactatgccataattggacctggcctacaagccaaagcaacccgagaggcacagaaaagggcagcagcaggaataatgaaaaatccaacagttgatggaattactgtgatagacctggatcccataccgtacgatcctaagtttgaaaaacaactaggacaagttatgctccttattttatgtgtgacccaagtacttatgatgcggacgacttgggcactctgtgaagcattgacattagctactggtccaattagcacactgtgggaaggcaacccaggacgtttctggaatacaacgatagccgtctctatggccaatatattccgtggtagctatctagctggtgcaggcttattattttcaataatgaaaaacactacaaacactcgcagaggaacaggtaacataggtgaaacgctcggcgaaaaatggaaatctagactaaatgccttgggtaaatccgaatttcaaatatataagaaaagtgggattcaagaagtcgacagaactctagcgaaagagggaataaaacggggcgaaacagatcaccatgcagtatcaagaggttctgcgaaactccgatggttcgtagagagaaacatggtaacaccggaaggaaaggtggtagatctaggctgtggcagaggtggctggagctactactgcggcggactcaagaatgtccgcgaagttaaaggattaacaaagggtggcccagggcatgaggaacccatcccaatgagtacttatggctggaatttagttagactacaaagtggagtagacgtgttcttcataccccctgaaaaatgtgacacattgttgtgtgatatcggagagtcatcgcctaacccgacggtggaagccggacgcacccttcgtgtcttaaacttagtggaaaactggttaaataacaatactcaattttgcataaaggtcttaaacccatacatgccatcagtaatcgagaaaatggaggcattacaacggaaatatggaggagctctagtgagaaaccctttatcacgtaattccacccacgagatgtactgggtatcaaacgctagtggaaatatcgtaagttcagttaacatgatcagtaggatgttgatcaatagatttactatgaggcacaagaaagcaacatacgaacccgatgtagatttgggatcggggacgcgaaatataggaatagagtcagaagttccaaatctggatataataggaaaaagaatagagaagattaaacaggaacacgagacctcatggcattacgaccaagatcatccctataaaacttgggcttatcacggttcctatgagacaaaacaaacaggttccgcaagttccatggtgaatggagtagtaaggctgttaactaaaccctgggatgttttacccacggtgactcaaatggctatgacggacacaactccattcggtcaacaaagagtttttaaagaaaaagtggatacaagaactcaagaacccaaggaaggaaccaagaaacttatgaaaattacagctgagtggttgtggaaggagttgggcaagaaaaagacaccgcgcatgtgtactagagaagagttcacccgcaaagtacgttcgaatgctgctctaggggccatatttaccgatgaaaacaaatggaaatccgcccgtgaagcagttgaggatagtagattctgggaattagtcgacaaagaacgaaacttacatctagaagggaaatgtgaaacttgcgtttataatatgatgggcaaacgtgagaagaaattaggagaatttggaaaagctaagggcagtagggcgatctggtacatgtggctaggagcaagatttcttgaatttgaagctctaggatttcttaatgaggatcactggtttagtcgagaaaattcgctatcgggagtagaaggtgaaggcttgcacaagctgggttatatactaagagacgtctccaagaaagaaggcggggctatgtacgccgacgacaccgcaggatgggatacacggattactcttgaagatctcaaaaatgaagaaatggtcacgaatcacatggaaggggagcacaagaaattggcggaggcaatttttaagctaacctatcaaaataaagtggtcagggtccaaagacccaccccacgtggaacggtgatggatataatttctagaagagaccagagaggatcgggacaagtgggaacatatgggttaaatactttcactaatatggaagcccagctcattagacaaatggagggtgaaggtgttttcaaaaatatacagcatctaacagtgactgaagaagtggcggtacagaattggctagcacgcgtcggccgggaacgactaagcagaatggcaatatcgggagatgattgtgtagtcaaacccttagatgatcgcttcgctaatgcgttaactgcattaaatgatatgggcaagatacggaaagatattcagcaatgggaaccgagtaaaggttggaatgactggacacaagttcctttttgcagtcaccatttccatgagctaataatgaaggatgggagagtgctagtagttccatgtaggaatcaagatgaactgattgggagggcaagaatatcccaaggagcgggctggagtctaagggaaacggcgtgcctaggaaaatcctatgcccaaatgtggtcgttgatgtattttcatagaagagatctacggcttgctgcgaatgcgatatgtagtgctgtaccatcccactgggtacccacatcacgtacaacatggagtatacacgctaagcatgaatggatgacaactgaagatatgttgacggtatggaacagggtctggataagagaaaacccttggatggaagataaaacgccggtggaatcatgggaggaaatcccttatcttggaaaaagagaggaccaatggtgtggttctctcataggtttaacatctcgtgccacctgggccaaaaatatacaggcggccatcaatcaagtgaggtcactaataggcaatgaagaatacacagactacatgccaagtatgaaaaggtttagaagggaagaggaagaagctggagtcttatggtga

SEQ ID NO: 22341 - RNA, 9876 nt, synthetic construct
  misc_feature 1..9876: note = derived and/or modified CDS sequence (opt6) from DENV-2__FJ639709__SS-prME
  source 1..9876: mol_type = other RNA
tctgcaggcatgataataatgctaataccaacggttatggcatttcatctaacgacacggaatggggaacctcatatgatcgttggtatccaagaaaaaggaaaatctcttttattcaaaaccgaagacggagtaaacatgtgtaccttaatggctatggatctaggtgaactttgcgaagatacgattacatacaaatgtcctcttctcaggcagaatgaacccgaagacatagactgttggtgcaactcaacttcaacctgggtaacatatggaacatgtacaacaacaggagaacacagacgagaaaaacgctcagttgccttagtgccacacgtagggatgggactcgaaacaaggacagaaacttggatgagttctgaaggcgcatggaaacatgcacaaaggatcgaaacctggatacttaggcatccaggatttaccataatggcggctattttagcatataccataggtactactcattttcaaagagcactcattttcatactactaacagcggttgcacctagcatgacaatgagatgcataggcataagtaatagagacttcgtagaaggtgtgtcaggaggtagttgggtagacattgtgctcgaacacggaagttgcgtgacgactatggctaaaaacaaaccgacattggatttcgaactaattaaaacagaagcaaaacaacccgcaaccttacgaaaatactgcatagaagcaaaattaacaaatacgacgactgagtcaagatgtcctacacagggtgaaccttctttgaaagaagaacaagataaaaggtttgtttgcaaacattctatggtagatagaggttggggaaatggctgcggactatttggcaaaggcggcatagtgacttgcgcaatgttcacatgtaagaaaaatatggaaggaaaaatagttcaaccggaaaacttggaatatactattgttgtcactccgcacagcggcgaggagcacgcagtaggcaatgacacaggcaaacatggcaaagagattaaagttacgccacaatcaagcataacagaggcagaactcacgggttatgggacagtgactatggaatgtagccccaggacgggactcgactttaacgagatggtcttattacagatggaaaataaagcatggctggtacacagacaatggtttctagacttaccactgccatggctaccgggagccgataagcaggggtcgaactggatacaaaaagaaactctcgtaacttttaaaaatcctcatgccaagaaacaggacgtggtcgtactaggatcccaagagggcgctatgcacacagctttaaccggtgcgaccgaaatacaaatgtctagcggtaatttactattcacaggacacctcaagtgccgacttcgcatggataagctccaattaaagggaatgagctattctatgtgcacggggaaattcaaggttgtcaaagagatcgctgagacacaacatggaactattgtaattcgagtacaatatgaaggagacgggagtccctgtaaaataccctttgagataatggatttggaaaagaggtacgttttaggaagattaataaccgtcaatccaatagtaacggaaaaagacagtccggtgaacatagaagccgaaccgccattcggagactcatacattattattggggtcgaacccgggcaactcaagctgaattggtttaaaaaggggtcatccattggacagatgtttgagactacaatgagaggggcgaaacgaatggctattttaggggatacagcatgggactttggttcgttgggtggtgtttttacaagtataggaaaagcacttcatcaagtattcggagcgatatatggtgctgcgttttcaggagtaagttggaccatgaaaatccttatcggagtgataattacatggatcgggatgaactcccgttcaacgtctcttagcgtatcattggtcctagtgggaatagtgacgctatatttaggagttatggtacaagcagatagcggatgtgttgtaagctggaaaaacaaggagcttaaatgtggatcaggtatatttataaccgacaatgtacacacgtggacggaacaatataaatttcaaccagaaagcccgtcaaaacttgcatcagccatacaaaaagctcaagaagaaggtatatgtgggatacggtctgtgaccagactcgagaacttaatgtggaagcaaatcacaccggaattaaatcatatacttgcagaaaatgaggtaaaattaacaataatgactggggatattaaaggcataatgcaagccgggaaaagatctttacgaccgcaacccacagaactcaaatatagttggaaaacatggggtaaagcaaagatgttatcaactgagtctcataatcagacttttctcatagatggacctgaaactgccgaatgtcccaatactaaccgagcatggaatagcttagaagtagaagattatggattcggggtattcactaccaacatttggttaaagctaaaagagaaacaagacgccttttgtgatagtaagctaatgtctgctgcgataaaagacaatagagcggtacacgcggatatgggctattggatcgaatcagcacttaatgatacatggaaaatcgagaaagctagttttatagaagttaagaattgccattggccaaaatctcacactctatggtctaacggagtattggaatcggaaatgatcataccaaagaatctcgctggacctgttagtcagcacaattacaggcctggatatcacacacaaatcgcagggccctggcacctgggaaaattggagatggatttcgacttttgcgacgggactacagtcatcgtgaccgaagattgcggcaacagaggccccagcttacggacaacaaccgcctctggaaaactaatcacagaatggtgctgtaggtcctgcactctccctcctttaaggtacagaggtgaggacggctgttggtacggaatggaaatacgtcctctaaaagaaaaggaagaaaacctggttaactccttagtaactgcggggcacggccaagtagataattttagtctcggcgtattaggaatggcactattcctggaagaaatgttacgaacacgtgtgggcactaaacatgctatactattagtagcggtaagtttcgttaccctaataactggtaacatgagctttaaagacctaggacgcgtggtagtaatggtaggcgcaacaatgaccgacgatattggaatgggagttacatatctagcattattggcagcttttaaagtaagacctacgtttgcagcgggacttttactacgaaaattaacatcgaaagaattaatgatgaccacgataggcatcgtattgctgtcacaaaccaccatccctgaaactatactggaattaactgacgctctggctctgggtatgatggtccttaagatagtacgcgatatggaaaaataccagctagcagtcaccatcatggcaatactttgcgtcccgaatgctgtgatattacaaaacgcctggaaagtcagttgcacgatccttgcagtcgttagtgtctcacctctccttctgacctcatcacaacaaaagactgattggatcccactagctctaacaatcaaaggattaaacccaactgccatatttttaactactttaagtcgaactaataagaaacgatcttggccgttaaacgaagccatcatggccgttggaatggttagcattttggctagtagcttgcttaaaaacgacatacccatgacaggacctttagtcgccggtgggctcctgacagtctgttacgtgttaacaggccgaagcgcagatctagaacttgagcgagctacggacgtaaaatgggaagatcaagctgaaattagtggatcttccccaatactgtcaataactatatcggaagatggttcgatgtctattaaaaacgaagaagaagaacaaactctaacgattttaatcagaactggtttgttagttatttctggcttatttccagtttcaatacctataacggcagctgcatggtatttatgggaggtaaagaaacagagggcgggagtactatgggatgtaccatctccgcctccgatgggcaaggctgaattggaagatggtgcgtatcgtatcaaacaaaaagggattctagggtactctcaaattggtgctggcgtgtataaagaagggacgttccatacaatgtggcatgtcacacgaggtgccgtattgatgcataaaggtaagcgaatagagcccagctgggcagacgttaagaaagatctaatatcatacggagggggctggaaacttgagggagaatggaaggaaggcgaggaagtacaagttctcgcattagagccgggtaaaaatccgcgagcagtccagacaaagccaggactattcaaaacgaacacgggtactatcggagcagttagcttagatttttcacccggtacatcagggagtcccattatcgacaagaaaggaaaagtggtaggcctttacggaaacggagtagtaaccaggagtggagcatacgtaagtgcaattgctcagacggaaaagagcattgaagacaatccggaaattgaagacgacatatttcgaaagcgtcgtttaactatcatggatttacatcctggcgccgggaaaacaaagagatatttaccggcaatcgttagggaggcaattaaaagaggccttcgtacacttattttagcccctacaagagttgtagcggctgaaatggaagaagcgctccgaggattaccaattcgctatcaaaccccggctatccgtgctgaacacacaggaagagaaatagtagatttaatgtgtcacgcaacgttcacgatgcgattacttagcccggtcagagtcccgaactataatctaattataatggatgaggctcattttaccgatccagcaagcatcgccgcgagaggatatatttccacaagagtcgaaatgggagaagcagcaggaatttttatgactgctacccctccaggcagccgagacccttttccgcaaagtaatgctccaataattgatgaggaaagggaaatacccgaacgctcctggaacagtggtcatgaatgggtcacagattttaaaggcaaaacagtttggtttgtaccatctattaaggcaggcaacgatattgccgcgtgtttgagaaagaatggaaagaaagttatacaactaagtcggaaaactttcgattccgaatacgttaaaacgaggactaatgattgggatttcgtcgtaacaacggacatttctgagatgggggccaattttaaagcggaaagagtaatagatcctagacgatgtatgaaaccagtaattttaacagatggtgaagagagggtcattctagctggaccgatgccggtcacgcattcgtctgcagctcaaagaagggggcgaattggcagaaaccctaaaaatgagaatgatcaatacatttacatgggagaaccccttgagaacgatgaagactgtgcacattggaaagaagcaaaaatgctattagataacattaatacaccggagggaattataccatcgatgtttgaaccggaaagagaaaaagttgacgcaattgacggcgaatatcggttacgaggtgaagcacggaaaacattcgtggatttaatgcgtaggggagatctaccagtgtggttggcatacaaagttgcagcggaaggtattaactatgctgaccgtagatggtgtttcgatggtattaaaaataatcagatattagaagaaaatgtagaagtcgagatttggaccaaggaaggcgaacgtaagaagttaaaacctcgatggttagacgcccgaatatacagcgatcctcttgctctaaaggaatttaaagagttcgctgcaggaaggaaaagtttaacactaaacttgataacggaaatggggcgattacccacgttcatgacgcagaaaacgagagatgctctcgacaatttagcagtactccacacagctgaggcaggaggacgagcatacaaccatgcattaagtgaactacctgagacactagaaacacttttattgctaaccttgcttgccaccgtcactggagggattttcttattcttgatgtcaggaagagggatcggaaaaatgacgttaggaatgtgctgcataataacagcatcaatactattatggaacgctcaaatccaaccacattggattgccgccagtataatactagaatttttcctaattgtcctacttattcctgagccggaaaaacaaagaaccccacaagacaaccaacttacgtacgtggtaatagccattctgacggtagtagctgcaactatggcaaatgagatgggttttctagagaaaacaaagaaagatcttggattaggtagtattgctacgcaacagcctgaaagtaacatactagatattgacttaagaccagcttcagcttggaccttgtatgcagtagcaacaacatttgttacgcccatgctaagacattctatagaaaattctagtgttaacgtctcattaaccgctatagcaaaccaagcaactgtactaatgggcctaggcaaaggctggcctttatctaagatggatatcggggtcccactcttagcgattggttgttattcacaggttaacccaattactttaactgcggcacttctattacttgtagcccattacgcaataatcggaccgggactacaggccaaagctacgagagaagctcagaaaagggctgcagcggggataatgaaaaatcccactgtagatggaataaccgtgattgatcttgaccctatcccatatgatccgaagtttgaaaaacagctgggacaggtaatgctgcttatattatgtgttactcaagtactgatgatgagaaccacatgggctctttgtgaagcactgactctggcaaccggtcctatttctaccttatgggagggcaatcctggtcgattctggaatactacaattgcagtttcaatggccaacatttttagaggaagttacctggccggtgcgggtttactcttcagtataatgaagaacacaacaaacacaagaaggggcaccggaaatataggggagacactaggtgagaaatggaaatctaggttgaacgcactaggaaaatctgagttccaaacctacaagaaaagtggtattcaggaagttgatcgtactctagcaaaagaaggaattaaaagaggagagacagatcatcatgcagtatccagaggaagcgctaaattacggtggtttgtcgaacgaaatatggtcactccagagggtaaggtagtggacctcgggtgtggaagaggcggctggagctattattgtggaggactaaagaatgtgagagaagtcaaaggattgacaaaaggagggcctggccatgaggaacctataccaatgtcaacctacggttggaatcttgttagattacaatcaggagtagacgtatttttcatacctccagagaaatgtgatacattattatgtgacataggcgaatcatcaccaaatccaaccgttgaagccggcagaacattacgagttcttaatctggtggaaaactggttaaataacaatactcaattttgcatcaaggtattaaatccgtacatgccatccgttattgaaaagatggaggcactgcaaaggaaatatggtggggcacttgtacgtaatccattatcaagaaactcgactcatgaaatgtactgggtctcaaatgcttcagggaatatagtatcctccgttaatatgatttcaagaatgcttataaacaggttcacaatgagacataagaaagcaacatatgaaccagacgtggatctaggatcaggaacaaggaacataggaatagagtcagaaattcccaacttagatattataggaaagagaatcgagaaaataaaacaggaacatgaaacatcttggcattatgaccaggaccatccatataaaacttgggcctatcacggcagttacgaaactaaacaaacagggagtgcctctagcatggtaaatggagtcgtacgattactaacgaaaccatgggacgtacttcctacagtaacacaaatggcaatgaccgacactactccttttggacaacagagggttttcaaagaaaaagtagacacacgaactcaagagcctaaggaagggacaaagaaactgatgaagataactgctgaatggctctggaaagaacttggtaagaagaaaacacctcgcatgtgtacacgtgaggaatttacaagaaaagttagaagcaacgcagctctaggtgcgatttttacagatgagaacaagtggaaatcagcaagagaagcagtagaagacagtagattctgggaattagtcgacaaagaaaggaacctccatctcgaaggaaaatgcgaaacatgcgtttacaatatgatgggcaaacgggagaagaaactaggcgagtttggcaaagccaaaggttctcgagcaatctggtacatgtggcttggtgcacgctttcttgagttcgaagccttaggattccttaacgaagatcattggttttcacgggagaatagtctctcaggtgtcgaaggagagggattacataagttgggttacatacttcgagacgtaagtaaaaaggaaggaggagctatgtatgcagatgacacggcaggctgggacactaggataactttagaagacctcaagaacgaagaaatggtaactaatcatatggagggcgagcacaagaaactagcagaggcaatattcaaacttacttatcagaacaaggtcgttcgagtacaacgaccaaccccaaggggtacggtaatggatataatttcaagaagagaccaaagaggatcaggtcaggtaggaacttatggcttaaacacatttactaatatggaggcacaactaattcgacagatggaaggagaaggagtttttaaaaacatacaacatctaacagcaacagaagaagtagcagtacaaaattggctagcaagggtaggacgggaaagattatcgcgtatggccatatcaggagacgattgcgtcgtgaaaccccttgatgatcgctttgccaatgcattaacagcgctaaacgatatgggaaagatacgaaaagacattcaacaatgggaaccatctaagggttggaatgattggacacaagttcctttctgttctcatcatttccacgaactaataatgaaagatggtcgtgtattagtagtgccctgcagaaatcaagacgaattaattggtcgggcgcgaatcagtcagggagctggatggtcgttacgtgagaccgcctgcttaggcaaatcgtacgctcaaatgtggtccctcatgtacttccatcgtcgggacctcaggcttgccgcgaacgctatatgctccgctgtcccatctcattgggttccgaccagtaggaccacttggtcgatacacgcgaagcacgaatggatgacgactgaagatatgttaactgtatggaatagagtctggattagggaaaatccatggatggaagataaaactcctgtagagtcctgggaagaaattccatatttagggaaacgagaagaccagtggtgcggctccctaattgggttaactagccgagctacatgggccaaaaatattcaagcagcaattaatcaggtaagaagtctaataggcaatgaagaatataccgattacatgccatccatgaaaagatttaggcgagaagaagaagaggctggagtgttatggtag

SEQ ID NO: 22342 - RNA, 9876 nt, synthetic construct
  misc_feature 1..9876: note = derived and/or modified CDS sequence (opt6) from DENV-2__FJ639710__SS-prME
  source 1..9876: mol_type = other RNA
agcgctggcatgatcattatgctaattccaactgtaatggcatttcacttgactacaaggaatggcgaaccgcacatgatcgttggtattcaagaaaaaggtaaatcgctgttatttaaaacagaagatggtgtaaatatgtgtacactgatggctatggacttaggtgaattatgcgaagataccattacttacaaatgcccactactaaggcaaaacgaaccagaagatatagattgctggtgcaacagcacaagtacttgggtaacctacggcacttgcacaactacaggggaacatagaagagagaaaaggagtgtggcacttgtgccacatgtagggatgggtttggaaacacgcactgaaacatggatgagttcggaaggagcatggaaacatgcacaacgtatcgaaacctggatattaagacacccgggatttactataatggctgcaatcttagcatataccatcgggacgacacactttcaacgagcgttgatttttatattactaacagcggtcgcaccatcaatgactatgcggtgcattggaatatccaatcgtgactttgtagaaggagttagcggcggaagttgggtcgacatagtactagaacacggatcgtgcgtaacgaccatggctaaaaacaaaccgaccttagacttcgaactaataaaaactgaagcaaaacagccagcaacattaagaaaatactgtatcgaagcaaaactaactaacacgactacggaatcacgttgtccaactcagggagaaccgagcctaaaagaagaacaagataaaaggttcgtatgtaaacactccatggttgatagaggttggggcaacggctgtggacttttcgggaaaggcgctatagtaacctgtgctatgtttacctgcaagaagaacatggaaggtaagatagtccaaccggagaatcttgaatacaccatagtggtaacacctcactctggagaagaacacgcggtcggaaatgacacaggtaaacacggtaaagaaattaaagtgactccacaaagttcgattacggaagctgaactaacaggctacggaacggttacgatggaatgctcacctagaactggattggattttaatgagatggtactactgcaaatggagaataaagcatggctagttcacaggcaatggttcctggatttaccgttaccatggttaccaggcgctgataaacaggaatcaaattggattcagaaagaaactttagtcacatttaaaaatccccacgccaagaaacaagacgtagtagtactaggatcgcaggaaggtgcaatgcatacagcattaacaggcgcaacagaaattcagatgtcaagcggaaacctgctatttacaggtcatttaaaatgtcgattaagaatggataaactccaacttaaaggtatgtcatatagtatgtgcacaggaaaattcaaagtggtgaaagaaatcgcggagacgcaacatggtacgatagtcatacgtgttcaatatgaaggagatgggagtccatgtaaaatacctttcgaaatcatggatttggagaaacgatatgtactcggtaggttgataactgtaaatccaattgtaacagagaaagattcaccagtaaacatagaggcggaaccaccttttggagatagctacataattatcggagttgaaccggggcaactaaaactgaattggtttaagaaaggatctagcataggccaaatgttcgaaactacaatgagaggagcaaaaagaatggccattttaggggacacagcctgggatttcgggtctcttggtggagtctttacttctataggtaaagccctacatcaagtatttggagcaatttatggcgcagcgttctcaggagtcagctggacaatgaaaattcttatcggcgttatcataacgtggattggaatgaatagcagatcaacaagtcttagtgtatccttaattctggtgggaatcgtaacactatatttaggcgtaatggtacaggcagacagtggatgtgtagtatcatggaaaaataaagagttaaaatgtggatctggaatatttataaccgacaatgttcacacttggacagagcaatataaattccaaccagagagcccatcaaaactggcaagtgctattcaaaaagcacaggaggagggtatttgtgggatacgatcggtaacacgcttagaaaatttgatgtggaaacaaattacacccgaattgaaccatatcttagcagaaaatgaagtaaaattgacgattatgacaggagatataaaaggtattatgcaagcggggagacgatcgctaaggccacaacccaccgaattaaaatattcatggaaaacgtgggggaaagctaagatgctttcaacggaaagttataatcaaaccttcctcattgatgggcctgaaacaacagaatgtcctaatactaatagagcctggaactcactagaagtggaagattatgggttcggcgtatttacaacaaacatatggctgaagctaaaggaaaaacaagatgctttctgtgactcaaaattaatgtccgcggccatcaaagataatagagctgttcacgccgatatgggatactggatagagtcagcacttaacgatacttggaaaatcgaaaaagcatcatttattgaagtcaagaattgccattggcctaaatcgcacacgctttggtctaacggagttttagaaagcgaaatgattattcctaagaatttggctggtccagtttcccaacacaactaccgaccgggataccatacacaaattgctgggccttggcacttaggcaaattagaaatggactttgatttttgtgacggaacgacagtcattgtcacagaagattgcggtaatcgtggtccttcattgaggactactacagcatcaggtaagttaataaccgaatggtgttgccgcagctgcactctgccaccactaaggtatcgaggtgaagacgggtgctggtacgggatggaaattagacctctaaaagaaaaagaagaaaatcttgtcaactccctagtaaccgctggacacgggcaagttgataatttttcattgggtgtcctaggcatggccttatttctcgaagaaatgttacgaacacgcgttggaaccaagcacgcaatattactggtagccgtaagtttcgtaacacttattacgggaaacatgagtttcaaagacctggggcgggttgtggtaatggtaggagcaactatggcagacgacataggtatgggagttacatatttagccctattagccgcatttaaagtgagacccactttcgcagcgggtttgctattgaggaaactcacctccaaagaactaatgatgacaaccattggaattgtactccttagccaatccacgattccagagacaatactagagctgacggacgcattagctctcggaatgatggtactaaaaatagttagaaatatggaaaaatatcaactagctgttacaattatggcaatactgtgcgttcctaatgctgttatactacaaaacgcatggaaagttagctgcactatattagcagtagtaagcgtctcgccattgttattaacaagttctcaacagaaaaccgattggattccattagcacttactatcaaagggctcaatcccaccgctatcttcctaactacattaagtaggactaacaagaaacgaagctggcctttgaatgaggcgatcatggcagtaggtatggtaagtatccttgcgagtagccttttgaaaaacgacataccgatgaccggacctctcgtcgcgggaggactacttacggtgtgttatgttttgaccggaagaagtgctgatcttgagctagagagggcaacagatgtaaaatgggaggaacaagccgagatatctggcagtagcccaattcttagtataacgataagtgaagatgggtcaatgtcaatcaaaaatgaagaggaggaacaaaccctgaccatactgatcagaacagggttgcttgttatctctggtttgttccccatcagtataccaataacggctgcagcatggtacttgtgggaagtcaagaaacaaagggctggggtactgtgggatgtaccgtcacctccaccaatgggtaaggcagaacttgaagatggggcatacaggattaagcagaagggcatattaggatattctcaaattggggctggagtgtataaggaaggaacatttcacactatgtggcacgtcacacgtggtgcagttttgatgcacaaaggaaaacggattgagccatcatgggcagatgtcaagaaagatttgatttcctatgggggcggatggaaactagagggagagtggaaagagggagaagaagttcaagttctagccttagaaccgggtaaaaatccgagggcagtccagacaaagcccggccttttcaaaacgaatactggaacaataggcgctgtgtcattggattttagcccaggcacatcgggaagtcctataatagacaagaaaggtaaagttgtagggttatatggtaatggagtcgtgacgcgcagcggcgcatatgtcagcgcaatcgcacaaacagaaaagagcatcgaggataatccagaaatagaagacgatatctttcgtaaacgacgactcactatcatggatttacatccaggagcaggaaaaacaaaaaggtatttgccagcaatagtgcgtgaagctattaaaagaggacttcgcactctaatactggcgccgacgagagtcgtagcagcagaaatggaggaagccctccgcggcttacccattagatatcaaactccggccataagagcggagcacaccggtcgtgagatagtagatttaatgtgccatgccaccttcacgatgaggcttctttcacctgtgagagttcctaattataatttaatcataatggacgaagctcattttaccgaccctgcctcaatagcggctcgaggatatatctcaacacgagttgaaatgggggaagcggccggtatattcatgaccgctaccccaccaggatccagggatccgttcccacagagtaatgcaccaatcatagatgaagaaagagaaattccagaacgttcatggaatagcggacacgagtggataacggattttaaaggaaaaacagtatggtttgtaccttctataaaagctggaaatgacatagccgcgtgtctccgtaaaaatgggaagaaagtgatacaactgtcaagaaaaacatttgactcagaatatgtaaaaacaagaactaacgattgggattttgtagtcactaccgatataagtgaaatgggtgccaatttcaaagccgaacgcgtaatagacccacgacgatgcatgaagccagtgattctgacagatggagaagaaagagtcatcttagcaggaccaatgccagtaacgcactcgtcagcagctcaacgcagaggacgtataggacgcaatcccaaaaatgaaaatgaccaatatatatatatgggagaacctttagagaatgacgaagattgtgcacattggaaagaagcgaaaatgcttctagacaacatcaacacacctgaaggcatcataccttcaatgttcgagccggaaagagaaaaagtggatgcaatagatggggaatatcgtttgaggggcgaagccagaaaaacattcgtggacttaatgagacgcggcgatctacctgtctggcttgcttataaagttgctgccgaagggataaattacgcagatcggcgttggtgctttgatggaattaaaaataaccaaattttggaggaaaacgtcgaagtagagatatggacaaaggaaggtgaaagaaagaaacttaaacctcgatggcttgatgcgcgcatttacagcgacccattagcacttaaagaatttaaagaatttgcagcaggacgcaaatctttaacgctgaatctaataacggaaatgggtagactccccacatttatgacgcagaaaactcgtgatgccctagacaatttggctgttttgcatactgctgaagccggtggaagggcttataatcacgcattgtcagaactaccagagacacttgaaacgctgctattattaacgcttctcgccactgtaactggtggaatcttcctattcttaatgtccggacgaggtattggaaagatgacgctcgggatgtgttgtataattacggcgagtattttactatggtatgcacaaatacaaccccattggatagcagcgagcatcatattagagttctttttaattgttttgttaataccggaaccagaaaagcaaagaacgccacaagacaatcaactgacatatgtagttatagcaattttaacagtggtagcagcaaccatggctaatgaaatgggatttctcgagaagaccaaaaaggacttgggattagggtctattgccacacaacaacccgaatctaatattctagacatagatttgagaccagcatcagcatggaccttatatgcagttgcaacgacttttatcacccccatgttgagacattctatagaaaattcttcagtgaatacttccttaaccgcaatagcgaatcaagcaacagtcttaatgggtctaggtaaagggtggccattgagtaagatggatatcggggtacccctcctagcaataggttgctattcacaagttaacccaataacacttacagctgcattattgcttttggtagctcactacgcaatcattggcccaggcctacaggctaaagcaactcgcgaagcacagaaaagagccgcagctggaataatgaaaaatcctacggtagatgggataaccgtcatagatttagatcctattccgtatgaccccaaatttgaaaaacaactgggtcaagtgatgttattaatcctatgcgtgactcaagtgttaatgatgaggactacttgggcactttgtgaagcattgacacttgcaacaggtccaatatctactctatgggaaggaaatccgggtcgtttctggaatacaacaatagcggtctcaatggctaatattttccgagggtcatatctagctggagctggcctcctttttagtataatgaaaaacaccacgaacaccagaagaggtaccggaaacataggtgaaactttgggagaaaaatggaagtcgcgcctaaacgctcttggcaaatctgagtttcaaatctataagaaaagcggcatccaagaagtggatcgaacattagccaaagagggaataaaacggggcgaaaccgatcatcatgcagtctctcgaggttccgctaaattgagatggtttgtagagaggaatatggtaacgccagaggggaaagtagtggacctaggttgtgggagaggtggatggtcgtattattgcggagggctcaaaaatgtaaaagaagtcaagggcttgacaaagggaggtcctggtcacgaagaacccattcctatgagtacttacggatggaatttagtacggttacaaagtggtgtcgacgtatttttcatacctccagagaaatgtgatactcttctatgcgacattggagaatccagcccaaaccccacagtagaagctggaaggaccctacgggttttaaatcttgttgaaaattggctgaataataacacccaattctgtataaaagtgttgaatccctatatgccgtctgtaatcgagaaaatggaagccctacagagaaagtacggaggagccctagtgagaaatccactctctaggaatagtacgcatgagatgtactgggtcagtaatgcatcaggtaacatagtttcatccgttaatatgatatcaaggatgctcataaatagatttacgatgcgacataagaaagcaacttacgaacccgatgttgatctcggttctgggactagaaatattggtattgaaagcgaagtacctaatctagatataataggtaaaaggatagagaaaataaaacaagaacatgagacatcctggcattacgaccaagatcatccttataaaacttgggcataccatgggtcatatgaaacaaaacagacaggatctgcaagctccatggttaatggtgttgtaaggctcctaacaaaaccgtgggatgtccttccaacagttactcagatggcgatgacagacacaacaccctttggccaacagagagtatttaaggagaaagtagatacaagaacgcaagaaccgaaagaaggcactaaaaagctaatgaaaataactgcggaatggttatggaaagaattagggaagaagaaaactcctaggatgtgtaccagagaagaatttacgcgtaaggtaagaagtaacgcagcgttaggcgctatttttacagatgaaaataaatggaagagtgcaagagaagcggtagaagactccagattttgggaattggtggacaaagaacggaacctacatttagaaggaaaatgtgagacttgcgtatataatatgatgggaaaaagagagaagaaactaggagagtttggtaaagccaaaggatcaagagctatatggtatatgtggttaggtgccaggttcctggaatttgaagcacttggctttctgaatgaagatcattggttctcacgagaaaattctttaagtggagttgaaggagagggacttcataaactagggtatattttgcgagacgtgagcaagaaagagggtggagctatgtatgccgatgatactgccggatgggacacgaggattaccctagaagatctgaaaaatgaggagatggtcactaatcacatggaaggtgaacacaagaaattagcagaagcaatatttaaattaacctatcaaaataaggtagtccgagtacaaagacctactcctagaggaactgtaatggacataatatcacgccgtgatcaaagaggaagcggacaagttggaacatatggattaaatacgtttactaacatggaggctcaattgatcagacagatggaaggagaaggagttttcaagaacatacaacatcttacagtgactgaagaagtagctgtacaaaattggctagcacgcgtagggcgtgaacgtctatctagaatggcaatatcaggagatgactgcgtcgtcaagccattggatgatagatttgctaacgctttaaccgccctaaatgacatgggtaagattaggaaagatatacaacagtgggaaccatctaaaggatggaacgactggacacaagtgccattctgttcacatcatttccatgaactaataatgaaagacggacgtgtcctagtggtaccctgtaggaatcaagacgagctgataggacgggccaggatttcccaaggcgcaggttggtctctaagagaaacggcgtgtttgggaaaaagctatgcacaaatgtggagcttaatatatttccaccgacgtgacctacgattagcggctaatgcgatttgctctgctgtaccatcgcattgggtaccaacgtcaagaacgacatggagcatccacgcaaaacacgaatggatgaccacggaagatatgctgacggtatggaatcgagtctggatacgagaaaatccttggatggaagataaaacaccagtagaatcttgggaagaaattccctacctaggtaaaagagaggatcaatggtgtggtagcttaattggcttaacctctcgagcaacctgggctaaaaatatccaagcagctataaaccaagtccgttcattaattggcaacgaagaatataccgactatatgccatctatgaagcggttcaggcgcgaagaggaagaagccggtgtcctatggtaa

SEQ ID NO: 22343 - RNA, 9876 nt, synthetic construct
  misc_feature 1..9876: note = derived and/or modified CDS sequence (opt6) from DENV-2__GQ868623__SS-prME
  source 1..9876: mol_type = other RNA
agtgcaggtatgattattatgttaataccaactgtaatggctttccacttaaccaccagaaatggggaacctcacatgatagtcggaatacaagaaaaaggaaaaagcctactatttaaaacagaagatggtgtgaatatgtgcacgttaatggctatggatctaggtgaactctgtgaagatacaataacatacaaatgccctctattaagacagaatgaacctgaagatatagactgctggtgtaatagcacatcaacatgggttacgtacggaacttgtacaaccaccggggaacacaggagagagaaacgatcagtagcgctagtcccccatgtaggaatgggtcttgaaacacgtacggaaacttggatgtcttcggaaggagcatggaaacatgctcaacgaatcgaaacgtggatattgaggcatccaggatttacaataatggctgccatattagcatatacaattggaacaacacatttccaaagagcactgatcttcatcttattaacagctgtagctcctagcatgacgatgagatgcattggaatatccaaccgagatttcgtagaaggagttagtggaggttcatgggttgacatcgtattggaacatggtagttgcgtaacaacaatggctaaaaataaaccgaccctagactttgaacttatcaaaacagaagctaaacaaccggccacgctacggaaatactgtatagaagccaaattaacgaatacaaccacagaaagtaggtgtccaacccaaggtgaaccaagcctcaaagaagaacaagataaacgattcgtctgtaaacactcaatggttgacaggggttggggaaatggatgcggtctgtttggtaaaggaggcattgtaacgtgtgccatgttcacctgtaagaaaaatatggagggaaaaatcgttcaacctgagaatcttgaatatactatcgtcgtaacaccccattcaggcgaagaacatgccgtaggaaacgatactggtaaacatggaaaagaaataaaagtaacgccgcagagttctatcacagaggcggaactaacaggatatggaacagtgaccatggagtgtagcccccgcactggtttagatttcaatgaaatggtattattacagatggaaaataaagcatggcttgttcatcgccagtggtttttagatctacccctaccatggttaccaggggctgacaaacaaggatctaattggattcagaaagaaacccttgttacattcaaaaatcctcacgccaagaaacaagacgtagtggtcttaggttcacaagaaggtgcaatgcacacagcacttacgggagcgacagaaattcaaatgtctagcggtaaccttttatttactggacatctaaaatgtcggctaagaatggacaaattacaattgaaaggaatgtcatacagtatgtgcaccggtaaatttaaagtcgtaaaagaaatcgctgaaactcaacatggaacaatagtcatcagagtgcaatatgaaggagacggatccccttgtaaaattccatttgaaattatggacttagagaaaagatatgttttaggccgtctcataacagttaatccgatagttacagagaaagatagtcccgttaacatcgaagcagaaccaccattcggagacagctacattataataggggttgagccgggacagctaaaactaaactggtttaagaaaggtagctctatcggacagatgtttgagacaacgatgagaggggctaaaagaatggccatcttaggagacactgcctgggactttggatctttaggaggggtctttacatccattggcaaagcactccaccaagttttcggagctatatacggagcggcattttcaggagtttcctggaccatgaaaattctgataggggtaataatcacatggataggtatgaactcaagatccacgtcgctttcagtatcattggtcctggtgggaatcgtaacattatatctcggagtaatggtgcaggctgatagtggctgtgttgtaagttggaagaacaaagagcttaaatgcggttcgggcatcttcattaccgataatgtacacacctggacagagcaatataaatttcaaccggagagtccatccaaactagcaagcgcaatccaaaaggcacaagaagaaggtatttgcggtataagatccgtaaccagacttgaaaaccttatgtggaaacagataaccccagagttgaatcatatactcgcagaaaacgaagttaaacttaccataatgacaggtgatatcaaaggtataatgcaggcaggaaaaagaagtcttcgaccacaaccaacggaactaaaatactcctggaaaacttggggaaaggctaaaatgttaagtaccgaaagccataatcagacgtttctaattgatggcccagaaactgcagaatgtccgaacacgaaccgagcctggaactcccttgaagttgaggattacggtttcggagttttcacaacaaatatatggctcaaactgaaggaaaagcaagatgcgttttgtgatagcaaactgatgtcggctgcaataaaagataaccgtgctgtccacgcagacatgggttactggattgagtcagcactaaacgatacatggaaaattgaaaaggcgagctttatagaagtcaaaaactgtcactggccaaagtcccatacactctggagcaatggagttttggaaagcgaaatgatcattcccaaaaacttggcaggaccggtatcacaacataactatcgaccaggataccatacgcaaatcgcggggccttggcatttagggaaactagaaatggatttcgatttttgcgatggaaccacagtaatagtaactgaagattgcgggaaccgcgggccatcactgaggactacaaccgcatcaggaaaattgataaccgagtggtgttgccgatcatgtaccctaccacctttacgataccgaggagaggacggatgctggtatggaatggaaatacgtcctcttaaggaaaaagaggaaaatctggtaaatagtctagtaactgccggacatggacaagttgacaacttctctctaggagtactaggactagcactattcttagaagaaatgctaagaacgcgtgttggcacgaaacacgctatcctcttagttgccgttagctttgtaacattgataacgggaaatatgagtgtaaaagacctaggacgagtggtagttatggttggtgcgactatgacagatgatatcggcatgggagttacttatctcgcattattggcagcctttaaagtccggccaactttcgcagcgggtctacttctgaggaaactgacctcaaaagagctaatgatgacaactataggaatagtcttactgtcgcaaagtacaataccagaaactatactagaacttacagatgcgctagccctaggtatgatggtacttaaaatcgtacgggacatggaaaaatatcagttagcagtaaccataatggcaatactatgtgtcccaaatgctgtcatattgcaaaatgcttggaaagtctcatgcacaattcttgccgtcgtaagcgtgagcccactactgctgacatcttcacaacagaaaacggactggattccgctcgcgttaactataaaaggcctaaacccaaccgcaatatttttaactaccttaagtagaacaaacaagaaacgaagttggccattaaatgaagcaataatggctgtaggaatggtaagcatacttgcttcatcacttttaaagaacgatatacctatgaccggtcctttggtcgctggaggtctactgaccgtctgctatgtattaacgggacgatccgccgacctagagttagaaagagcaactgatgtaaaatgggaagaccaagcagaaatatctggatcatcgccaatactttcaataacgatctcagaggacggatcaatgtcgatcaaaaatgaggaggaggagcaaaccttaacaattctaatacgaacaggactcttagtaatctctggattatttccagttagtattcccataactgccgctgcgtggtacttatgggaagttaagaaacagagagcgggagttttatgggatgttcccagcccgccaccgatgggaaaagctgaactggaagacggtgcctaccgcataaaacaaaaaggcattctaggctatagtcaaataggggctggtgtttacaaagaaggcacctttcatacgatgtggcatgttacaagaggggcagtcttaatgcataaaggcaaaagaatagaaccgagctgggcagatgtgaagaaagacttaatatcttacggtggtggttggaaacttgaaggggagtggaaggagggagaagaggtacaagtcttagcattggaacctggtaaaaacccaagagccgtccaaaccaagcctggcctattcaaaacgaacacagggactattggtgccgtatcgttggacttcagtccaggcacttcgggttccccgataatagacaaaaagggtaaagtagtcgggttatatgggaatggagtggtaacgcgatccggagcatatgtatcggctatcgcacaaacagaaaaatctattgaagataaccctgaaatagaagacgatattttcaggaaaagaaggttaacgatcatggacttacatcctggcgccgggaaaacaaaaaggtatctaccagccatcgtcagagaagccatcaagcgaggtctccggacgttaatattagctccaactcgggtagtagcagctgaaatggaagaagcattaagaggattaccaattcgttatcaaacccctgcaattagggccgagcatacaggacgtgaaattgtcgaccttatgtgtcacgcgactttcacgatgagattattaagtccagttagagttccaaattataacttaataatcatggacgaagcacactttacagatcctgcttcaattgctgcaagaggatacataagcacaagggtagaaatgggcgaagcagcgggaatatttatgactgccacaccaccaggaagtagagaccccttcccacaatcaaacgcaccaataattgatgaggaaagagaaattccggaacggtcatggaactcaggccatgaatgggttactgattttaaagggaaaactgtgtggttcgttccttccattaaagccggaaacgatatagctgcatgtctcaggaaaaatggaaagaaagtaatacagttatcaagaaagacttttgatagcgagtatgtcaaaacaaggacgaacgattgggacttcgttgttacaactgatatctcagaaatgggagccaatttcaaggcagaaagggtaatagatccaagacgttgcatgaaaccagtaatccttacagacggcgaagaaagagtgatacttgctggaccaatgccagttacacattcttctgcagcacagagacgaggacgcatcggtagaaatcccaaaaatgaaaatgaccaatacatttatatgggggagcctttagaaaacgacgaggactgtgctcattggaaagaagcgaagatgctactggataacattaatacgcctgaaggaatcataccatcaatgtttgagcccgaaagagaaaaagtagacgctatagacggagagtataggttgagaggtgaagcgaggaagaccttcgttgacttaatgcgtaggggtgacttaccagtttggttggcatataaagttgcagcagaaggtaccaattatgccgacagacggtggtgtttcgatggaattaaaaataaccaaatacttgaagagaacgttgaagttgagatttggaccaaagagggagaaaggaagaaactaaaaccccgatggctggacgccaggatctatagtgaccctctggcattaaaagaatttaaagaatttgcagcagggcgaaaatcattaacactcaatctaattaccgaaatgggacggctccccacgttcatgacacagaaaacaagagatgcgctcgataaccttgctgtactacacacagccgaagcaggaggacgagcatataaccatgccctatctgagctaccagaaacactggaaactctactgcttttgacactcttagccactgtaacaggaggcatatttctattcttaatgagtggacgtggcataggcaaaatgacactaggaatgtgctgcataataacagcttccattcttctttggtatgctcaaatacagcctcactggattgcagcctcaattatattagagttctttcttattgttctgttaatcccagagcccgaaaaacaacgtacacctcaagacaatcagttaacgtatgtagtaattgcaattctaactgtagtagcagcaacaatggctaacgaaatgggattcctagaaaagactaagaaagatctcgggctaggatcaattgcaacacaacaaccagaaagcaacatccttgatatagatctcagaccagcctcggcgtggacgctctacgcagtcgcgacgacttttgttacaccgatgctgagacacagtatcgaaaactcatccgtaaacgtttctctgaccgcaatagccaaccaggccacggtcttgatgggccttggtaaaggttggcccctatcaaaaatggatattggtgtaccattactggcaatcgggtgttattcgcaagtaaaccctatcactttaacagctgcacttctgctacttgtggctcattacgccataattggtccaggcttacaagcaaaagcgaccagagaggctcagaaaagagctgcagcgggtataatgaaaaaccctacggtagacgggataactgttatagacttggaccccataccctacgatcccaaattcgaaaaacaactaggacaagtgatgttattaattctatgtgtaacacaagtgctaatgatgcgaacaacttgggctctttgcgaggcattaacgttagctactggaccaatatccacactatgggaaggaaatccggggcgattctggaacacaacaatcgccgtttctatggctaacatttttcggggcagttacttggcaggagccgggctacttttctcaataatgaaaaacactacgaatacaaggaggggaacggggaatattggcgaaacactcggcgaaaagtggaagtcaagactgaacgccttaggcaaatctgagttccaaacctataagaaatccggaatacaagaagtggaccgtaccctagccaaagaagggataaaaagaggggaaaccgaccatcatgcggtttcaaggggtagtgccaaattgaggtggttcgtagaaaggaatatggtgactcctgagggaaaagttgtagatctaggctgtggtcgtggaggctggtcctattattgtggtggacttaaaaacgtacgagaagtcaaaggtctaactaaaggaggaccaggacatgaggaacccattccaatgtcaacgtatggatggaacttagtaagactgcaatctggagtcgacgtgttctttatacctccagaaaaatgcgacacccttctatgcgacattggagaaagcagtccaaatccaacagtcgaggctggcagaacattacgggtgttaaatctggtagaaaactggcttaataataacactcaattctgtataaaagttttaaacccttatatgccatcggtaatcgagaaaatggaagcattgcaaaggaaacacggcggtgcattagttaggaatccattgtcgaggaactctacccacgaaatgtattgggtgagcaatgcgtcagggaacattgtgtcgtcggtaaacatgatttctagaatgctaattaaccgattcactatgagacataagaaagctacatatgaacccgacgtagatctcggatctggaacaagaaatatcgggatagagtctgaaatacccaacttggatataatcggcaaaagaatagagaaaataaaacaagagcatgaaacttcatggcactatgatcaagatcatccatataagacatgggcctatcacggttcgtatgaaacaaagcaaaccggatcagcctcatcaatggtaaatggggtcgtccggttacttacaaaaccctgggatgtccttccgacggtcactcaaatggcaatgacggacacgaccccttttggtcaacaaagagtttttaaagagaaggtagacactcgaacgcaagaacccaaagagggaaccaagaaactgatgaagattacagcagagtggctctggaaagagcttggcaagaagaaaactccaagaatgtgtacgcgtgaagaatttactaggaaagttagatctaatgctgctcttggagcaatatttacagatgaaaacaagtggaaatccgcccgggaagcagttgaagactcacgcttctgggaattagtggatcgagaaagaaacctacatctagaaggaaaatgcgagacctgcgtgtacaatatgatgggaaagcgcgaaaagaaactgggagagttcgggaaggcaaaagggagccgtgccatatggtacatgtggctcggggcgaggtttttggaatttgaagcactagggtttcttaatgaagatcactggtttagtagagaaaatagcttaagcggggtagaaggtgaaggactccacaagttaggttatatattaagagacgtatctaagaaagaaggtggagctatgtatgcagacgatacagcaggttgggacacaagaattacactcgaagacttaaagaatgaagagatggttactaatcatatggaaggtgaacataagaaacttgccgaagcaatatttaaactaacttaccaaaataaagttgttcgcgtacaaaggccaactcctagaggcaccgtaatggacataataagtcggagagaccaaagaggatctggacaagtgggaacatacggtctaaatacattcacaaatatggaagctcaactaataagacaaatggaaggtgaaggagtatttaagaatatacaacatcttacagctaccgaagaagtagcggtacagaactggctcgctagagtaggtagggaacgactatcgaggatggcaataagtggggatgattgtgttgtaaaaccgttagatgacaggtttgccaacgccttaaccgcattaaatgacatgggtaagataagaaaagacattcaacaatgggaaccctctaagggatggaatgactggacccaagtaccgttttgcagccatcatttccatgaactaataatgaaggatggaagggtcctagtagtgccatgtagaaatcaagatgaattgatcggtagagcaagaattagccaaggtgctggatggtcacttagagaaacggcgtgcctaggcaaatcatacgcgcaaatgtggagcttaatgtattttcacagacgggacttaaggttagcagcgaacgccatatgctcagcagtaccaagtcattgggtaccaacgtcacgaacaacgtggagtatacatgctaaacatgagtggatgactactgaagacatgttaacagtctggaatcgagtttggataagagaaaatccatggatggaagataaaacaccggttgaatcgtgggaagagataccttacctcggcaagagagaggaccaatggtgtggcagcttgataggactaacttcaagagctacctgggccaaaaatattcaagctgcaataaatcaggtacgtagtcttataggaaatgaagaatatactgactatatgccaagcatgaaacgatttcgacgagaggaagaggaagccggtgttctatggtga

SEQ ID NO: 22344 - RNA, 9876 nt, synthetic construct
  misc_feature 1..9876: note = derived and/or modified CDS sequence (opt6) from DENV-2__GQ868624__SS-prME
  source 1..9876: mol_type = other RNA
tcagcggggatgataataatgttaattcctaccgtcatggcatttcatttaactacgcgaaatggtgaaccacacatgattgtaggaatacaagaaaaaggaaaaagcctactattcaaaacggaagacggagttaatatgtgcacattgatggctatggatctcggagagttgtgcgaagatacaatcacgtacaaatgcccattactacgccaaaacgaaccagaagatattgattgttggtgtaactcaacgagcacatgggtcacgtacggaacgtgtactactacgggggaacacagacgagagaaaagatccgtcgcacttgtaccgcacgtaggaatggggttagaaaccagaacagagacttggatgagtagcgaaggcgcatggaaacatgcacaaaggattgagacatggatacttagacatcccggtttcactataatggcagcaatattggcgtatacaataggcacaacacactttcaacgtgtactgatcttcattctacttacggcagtggcaccatcaatgacgatgcgatgcatcggtatcagcaaccgagactttgttgaaggggtatctgggggtagctgggttgacatagttttagagcatgggtcgtgcgtcacaacaatggccaaaaataaaccgactctcgacttcgaactgataaaaacagaagcgaaacaacctgcaacattgaggaaatactgtatcgaagcgaaactaacaaacacaacgacagaatccagatgcccgacgcaaggagaacccagcttaaaagaggaacaggacaaacgttttgtatgcaaacattcaatggttgatagaggttggggtaatggttgtggactattcggtaaaggaggaatcgtaacatgcgctatgtttacatgtaagaaaaacatggagggaaaaatagtacaacctgagaatttagaatatacaatagtcgtaacaccacactcgggcgaagaacacgctgtagggaacgacactggcaaacatgggatggagatcaaagtaacacctcaatcgagtatcacagaggcggagttgacagggtatgggacggtaacaatggagtgcagtccaagaaccggtttagattttaatgaaatggtgttactccaaatggaaaataaagcatggttagtgcacagacaatggttcttggatctcccactaccttggcttcctggtgctgataaacaagagtcaaactggatacaaaaagaaacgttggtcacgtttaaaaacccccacgcgaagaaacaagacgtagtggtcttaggaagccaagaaggagcaatgcatacagcattaacaggtgctacagaaatccagatgagttcgggaaatctcctatttacggggcatctaaaatgcaggcttagaatggacaaattacaattgaaaggaatgagttatagtatgtgtacagggaaattcaaagtggtgaaagagatcgcggaaacgcaacacggaactatagtaatccgagtacagtatgaaggagatggttctccttgcaaaatccctttcgaaataatggaccttgagaaaagatacgttctaggacgattgattacggtaaacccaattgtaactgagaaagacagcccagtaaatatagaagccgaaccgccattcggtgactcttatataatcataggagtggaacctggacaattgaaattgaactggttcaaaaagggaagcagcataggccaaatgttcgagacaacgatgagaggagcaaaaaggatggctatattaggagatactgcatgggattttggatctcttggaggcgtctttacgagcatcggcaaggcactacatcaagtatttggagcaatttacggagcggctttctcaggagtatcatggacaatgaaaattctaataggagttataataacatggataggcatgaactctagatcgacaagtctcagtgttagtctcgtacttgtaggtatagttaccctatacttgggtgtgatggtccaagccgactctggctgcgtggtatcgtggaaaaataaagaactaaaatgcgggagtggcatctttataacagataatgttcacacctggacagaacagtacaaattccaaccagaatcaccatcaaaacttgctagtgcaatacaaaaagcgcaagaagaaggcatctgtggaataagatctgtgactcggctagaaaatttgatgtggaagcagataacaccagaattgaatcatattcttgcagagaacgaggtaaaacttacaataatgacaggtgacattaaaggaataatgcaggcaggaaaacgttctctccgtccacaaccaacggaattgaagtattcatggaaaacttggggtaaagctaaaatgctatccacggagtcttacaaccaaactttcctaatagatggaccagaaactgctgagtgccccaatactaaccgcgcatggaactcgctcgaagtagaggattatgggtttggtgtttttacaacaaacatatggctaaaattgaaagaaaaacaagacgcattctgcgattcaaaattgatgagtgcagcaattaaagataatagggcagtacatgccgatatgggatactggatagaatcagccttaaatgacacctggaaaattgagaaggcctcattcatagaagtcaagaattgccattggccgaaaagccataccctctggtccaatggagtgctcgaatcagaaatgataatacctaaaaatctcgcaggtcccgtctcacaacataattatcggcctggataccatacacagatagctggaccttggcacttaggtaagctcgaaatggacttcgatttctgtgacggtacaaccgtgattgttacggaagattgtggaaaccgaggtccaagccttcgaactacaaccgcaagcggaaaacttataacagaatggtgttgtcgaagttgcaccttaccaccattaaggtatcgaggagaagatggttgttggtatggaatggaaatacggccacttaaggaaaaggaagagaacctagtaaatagtctagtcacagcaggccacggtcaagtagataatttcagtctgggtgtcctggggatggctttatttttagaggaaatgttaagaaccagggtcggcacgaagcatgcgatcctcttggtggctgtatcatttgttacacttattacaggaaatatgtcttttaaggatttaggcagagtagtcgtgatggtgggagctaccatggccgatgacattgggatgggtgtcacgtatttagcactccttgcagcttttaaagtccgaccaacgttcgctgctggattgctccttcgtaaattaacatccaaggaattaatgatgactactatcggaatagtattattgtctcagtcaacaataccagaaacggtcctagaactaacagatgctttagcattgggaatgatggttctaaaaatagtcagaaatatggaaaaatatcaacttgccgtaacaattatggcaatcttgtgcgtgcccaacgccgtgatcctgcagaatgcttggaaagttagctgtacaatacttgctgtagtatctgtgagccctttattgcttacaagttcccagcagaaaacagattggataccactagcactaacaataaaaggactcaatcctacagcgatatttctaactacgctttcaaggacgaacaagaaaagatcatggccgcttaatgaggctattatggccgtaggaatggtgtccatacttgcatcgagtttgcttaaaaatgatattccaatgaccggaccgctagttgctggaggactactaacggtttgctatgtgttaactggaagaagcgctgacctcgaattggaacgagcaactgatgtcaaatgggaggatcaggcagaaataagcggtagtagtccaatattaagcatcaccatctcagaagacggcagcatgtcaatcaaaaatgaagaagaggaacaaactttaaccatattgatacggactggactactggttataagcggattattcccaatcagtatacctataacggcagccgcatggtatctgtgggaagtcaagaaacaaagggccggtgtgttgtgggatgttccatcaccaccacccatggggaaagcagaattggaggacggggcgtatagaataaaacagaaaggtatcttaggctactcacaaataggtgcgggagtgtacaaggaaggaactttccacacaatgtggcatgtaacacgaggcgcagttttaatgcacaagggcaagaggatagaaccttcatgggcggatgtcaaaaaggatcttattagttatggagggggttggaaattagaaggtgagtggaaagaaggagaagaagtgcaagtcttagcattggaaccgggtaagaatccccgtgcagtccaaacgaagccaggattatttaaaacgaatacaggtacaataggagcagttagtctagatttcagtccaggtacgagtggttccccgatcatagacaagaaaggcaaagtcgtaggactgtatggaaatggagtagtcacgaggagtggtgcatacgtatcggccatagctcaaacagagaaaagcattgaagataatccagagatagaagacgacatattccgaaaaagaagattaacaattatggacctgcacccaggagcaggtaaaacaaagagatatttacctgcaatagttagggaggccataaaacgaggtttaagaacactcattttagcacctaccagagttgtcgctgccgaaatggaagaggcattaagggggctgcccattagatatcaaacgcctgcaattagggcggaacacacagggagagaaatcgtagatcttatgtgtcatgcaacatttacgatgcgactactgtcacccgtcagagtaccaaattataacctcataataatggatgaagcacactttacagaccccgcatcaatagcggcaaggggatatatttcaactcgagtagaaatgggggaagcagccggtatatttatgacggcgacaccccctggctcaagggatccattccctcagagtaacgcaccaattatcgatgaggagcgcgaaataccagagcgttcttggaactcaggacatgagtgggttacagactttaagggaaaaacagtctggtttgtaccttctattaaagctggaaacgatattgcagcatgtttgaggaaaaatgggaagaaagtaatacaattaagtcgtaaaaccttcgatagtgaatatgtaaaaacgagaacgaatgactgggatttcgtagtgacaaccgatatttcggaaatgggtgctaatttcaaagcagaacgcgtaattgatcccagaagatgcatgaaaccggtaatattaactgacggagaagaacgcgtgatactggcaggaccgatgccagtgactcattccagtgcggctcagcgacgtggacgtattggtcgaaatcctaagaacgaaaatgatcaatacatatacatgggtgaaccattagaaaacgatgaagattgcgcccattggaaggaggcaaaaatgctactcgataacattaacacccccgaaggaattattccaagtatgttcgaaccggagcgagaaaaagtggatgccattgatggagagtatcgtttacgaggagaagcgaggaaaaccttcgtagatctaatgaggcgaggagacttaccggtatggttagcctataaagttgcagcggaaggaataaattatgctgacagacgctggtgtttcgacggtattaaaaacaaccaaattttagaagaaaacgtcgaagtggaaatatggactaaagaaggagagaggaagaaactcaaaccacgttggttagacgcaagaatatattccgacccattagctctgaaagaatttaaagagtttgctgcaggtcgtaaatcactaaccctaaatttaatcacagagatgggcagattaccgacttttatgacccagaaaacgagggatgcactagataatctggctgttttgcacacagcggaagctggtgggagagcatacaaccacgcgctctcagaattgccagaaactctggaaactctattgctcctcacactactggcaacagttacgggaggaatttttctctttctaatgagtggtcgtggaatcggtaagatgactttaggcatgtgttgcatcataacggcatcaatactgttatggtatgcacaaatacaacctcattggatagcagccagtattatacttgagttctttttgattgtcctactaatacctgaacctgagaaacaaaggacgccccaagataaccagctaacttatgttgtaattgcaatcctcactgtcgtagcagctacaatggcgaatgagatgggcttcctagaaaagaccaaaaaggacttagggctaggttctatcgctacacaacaacctgaatcgaacatactggatatagatttaaggccagcaagtgcctggaccctatatgctgttgcaaccacattcgtaacacccatgttaagacactctatcgagaactcttctgtaaatgtgagtctaaccgcgattgccaaccaagctaccgtactaatgggtctaggaaaaggttggccgctatctaaaatggacataggcgtaccattacttgccataggttgctattctcaagttaatcctattacacttacagctgctctcctcctattggtagcacattatgcgatcataggaccgggcctacaagcaaaagcgacgagagaggctcagaaaagagcagcagctggaataatgaaaaatcctacggtcgatggaataacagtcattgatctagaccccataccatatgatccaaaattcgagaagcagctaggtcaggtaatgttgctgattctatgtgtaacacaagttctcatgatgcgtaccacatgggctctatgtgaagcgctaacgctagcaacaggacctatatctacattgtgggagggaaaccctggaagattctggaatactaccatagcagtaagcatggctaacatatttcgtggaagctatctcgcgggagctggtcttttgtttagtatcatgaaaaatacgaccaatacgaggagaggcactggtaatatcggagaaacgctaggcgaaaaatggaagtctcgacttaatgcgttaggaaaatcagaatttcaaatatataaaaagtctggtattcaggaagttgatcgcacgctagcaaaggaagggattaagaggggagagacagatcaccatgccgtaagtaggggttcagcaaagttacgatggttcgtagagagaaatatggtcaccccagaaggaaaagtagttgacttagggtgtggaagaggtggctggagttattactgtggagggctgaaaaacgtcagagaagttaagggtctaaccaaaggagggcccggccacgaggaacctatacccatgagtacgtacggatggaatcttgtccgtctgcaatctggcgttgacgtgttctttatacctccagaaaaatgtgacacgttactatgtgatataggtgaatcttcaccgaatccaaccgtagaagcaggaagaacactgagagtgcttaatctagtagagaactggttaaataacaacacccagttttgtattaaagtccttaatccatatatgccatcggtgatcgagaaaatggaagccttgcaacgaaaatatggcggtgcacttgtacgtaatcctttatcacgaaacagtacgcacgaaatgtattgggtgagtaatgctagcggtaacatagtgtcatcagtaaatatgataagtaggatgctcataaataggtttaccatgagacataagaaagcgacatacgaaccggacgtcgacttggggagtggtacgcgaaatataggaatagaaagcgaaattccgaatctagacataattggtaaacgaatagagaaaattaaagaggaacatgaaacaagttggcactatgatcaagatcatccttataaaacttgggcctaccatggaagttatgaaacaaagcaaacgggttctgccagttcaatggttaacggagtcgttagactactaacaaaaccatgggacgtattaccaaccgtaacgcaaatggctatgacagacacaacgccttttggtcagcagcgcgtttttaaagaaaaagtagacactcgaacacaagagccaaaagagggcacgaagaaactcatgaaaattacagcagaatggctttggaaagaacttggcaagaagaaaacaccccggatgtgcacccgtgaagaatttacgagaaaggtgcgctctaacgcagcacttggggcaatttttactgatgagaataaatggaagtccgcaagggaggcagtagaagactctaggttttgggaacttgtggataaagaaagaaacctgcatctcgaaggcaaatgtgaaacctgcgtatataacatgatgggaaaacgtgagaagaaattaggtgaatttggtaaagctaaaggctcgagagcaatttggtatatgtggttgggcgctcgttttcttgagtttgaagcactgggatttctaaatgaagatcactggttcagtagagaaaattccctgtcgggtgttgaaggagagggtttacataaacttggatatatcttacgagatgtgtctaagaaagaaggtggggcaatgtacgccgacgatacggctggatgggatacccggatcacattagaggacctgaaaaacgaagaaatggtgacgaatcatatggaaggcgaacacaagaaactagccgaagcgatttttaaactaacatatcaaaacaaggtggtaagagtacagagaccgacccctcggggcactgtaatggatataattagtcggcgagaccaacgtggttctggccaggtgggaacgtatgggcttaacacttttacgaacatggaggcccagttaatacgtcaaatggaaggtgaaggagtattcaagaatatccaacatttgacagtgacggaggaagctgctgtacaaaattggcttgctagagtgggaagagaaagactctctagaatggcaatctcaggagatgattgtgtagttaaacccttagatgataggttcgctaacgcccttacagctttgaatgatatgggaaaaatacgtaaagatatacagcagtgggagccgtctaaaggctggaatgattggactcaagtacctttttgttcacatcactttcacgagttaataatgaaggacggtcgtgttttggttgtaccatgtagaaatcaagacgaactcatcggcagagcacggataagccaaggggcaggatggagcctcagagagaccgcttgcctaggaaaatcgtatgcgcagatgtggtcattaatgtattttcatagaagagatctgagacttgccgcaaacgcaatttgtagtgccgtccctagtcattgggtgcctacgtctaggacgacgtggtccatacatgcaaaacacgaatggatgacaactgaagatatgctcacagtatggaacagggtgtggattagggaaaacccgtggatggaagataaaacaccagtggagtcttgggaagagataccatatttaggcaaaagggaagaccaatggtgcgggagtctaattggtctaacaagtagagctacctgggccaagaatattcaagcagctataaaccaagtaagatccttgattggaaacgaagagtataccgactatatgccgtctatgaaacggtttcgacgtgaggaagaggaagctggggttttatggtaa

SEQ ID NO: 22345 - RNA, 9876 nt, synthetic construct
  misc_feature 1..9876: note = derived and/or modified CDS sequence (opt6) from DENV-2__FJ639717__SS-prME
  source 1..9876: mol_type = other RNA
tcggcaggaatgataattatgctgattcccaccgtaatggctttccacttgactactcggaatggggaaccgcacatgatagttggcatacaagaaaaaggtaaatcgctattatttaaaacagaagacggcgtaaatatgtgcacattgatggcaatggatttaggagaattatgcgaagatactataacctacaaatgtcccttgttaaggcaaaatgaaccggaagatatcgactgctggtgcaactcgacaagtacatgggtcacctatggtacatgtacaacaacaggggaacatcgaagagaaaaacgcagcgtagcactcgttccacatgtaggcatgggtttagaaacaagaacagaaacttggatgtcaagtgaaggcgcttggaaacacgcgcaaagaatagaaacctggatcttacgtcaccctggcttcacaataatggcagcaatattggcctatacgattggaaccacgcattttcaacgcgcattaatatttattttacttaccgccgttgctccatcaatgacaatgaggtgtataggcatatcaaatagagactttgtggaaggtgttagtggtggaagttgggtagacatagtgctagaacatgggagctgtgttacaactatggctaaaaacaaaccgacattagattttgaattgataaaaacagaggctaaacaacctgccactcttagaaaatattgtattgaggcaaaattaacaaatactaccacagaatctagatgccctacacaaggcgaaccttcattaaaagaagaacaggataaaagatttgtttgcaaacactcaatggtagacaggggctggggaaatggctgtggactgttcggaaaaggaggcatagtaacgtgtgcgatgttcacatgtaagaaaaatatggaaggaaaaatcgtacagccggaaaatctagagtatacaattgtagttacaccacactcgggtgaagaacatgcagtcggcaatgataccgggaaacatggcaaagagataaaagtaaccccacaaagttcgataacagaggcagaactaacggggtacggtactgtaacaatggaatgttcgcctaggaccggcttagacttcaatgaaatggttctactgcaaatggaatcgaaagcgtggttagtgcatcgccaatggtttctagacctgccattgccatggctgccaggcgcagataaacaaggatcaaattggatacaaaaagaaactttagttacttttaaaaacccacacgctaagaaacaagatgttgtggttttaggttcgcaagaaggagcaatgcatacagcattaaccggagcaacagaaatccaaatgtcatccgggaacctcctttttactggtcaccttaaatgcagactgcgaatggacaaactacaactgaaaggaatgagttacagtatgtgcaccggtaagtttaaggtggtcaaagaaatcgctgaaacacagcatggaacaatcgtaattagagttcagtacgagggggatggatctccttgtaaaattccctttgaaattatggatctagagaaaagatatgtattgggtagattgatcactgtcaatccgatagttactgagaaagatagtccggtgaacatagaggccgaaccgccattcggtgattcatatataataataggtgttgaaccaggtcaattaaaattaaattggtttaaaaagggctcatctattggacagatgtttgaaactacaatgagaggagctaaacgcatggctattctaggagatacagcgtgggattttggatctttaggaggtgtatttacaagcataggaaaagcgctacaccaagtcttcggtgccatatatggagccgctttctcgggggtaagctggactatgaagattttaataggcgtaattattacatggatcgggatgaacagtcgaagtacatcattaagtgttagtctagtcctcgtcgggatagtcactttatacttaggagttatggtgcaagcagacagtggctgtgtggtgagttggaaaaataaagagttaaaatgtggaagcggtatttttatcacagacaatgttcatacatggacagaacaatacaagtttcaacctgaatcgccgtctaaattggcatctgctatacaaaaagctcaggaagaagggatctgtgggataagatccgtaactcgattagaaaatctaatgtggaaacaaataacaccagagctcaatcatatactagcagaaaacgaagtcaaactgacaattatgacaggggacataaaaggaattatgcaagcaggaaaaagatcattgcgaccgcaaccaaccgaattgaaatattcatggaaaacctggggcaaggctaaaatgctctctacagagtcgcataaccagacatttttaatcgacggtcctgaaactgctgaatgcccaaataccaatagagcgtggaactctctcgaggttgaagattatggttttggggtctttacgaccaatatatggttaaaattaaaagagaagcaagatgcattctgcgacagcaagctaatgtcggcagccataaaggataatcgagcggtacatgctgatatgggatactggatagaatcagctttgaatgatacatggaaaattgaaaaggcatcgttcatagaggtgaaaaactgtcactggccaaagtcgcacacactttggagtaatggtgttcttgaatccgaaatgataatacccaaaaatttggcgggtcccgttagccagcacaattatagaccgggatatcacacgcaaaccgccgggccatggcaccttggtaaactagaaatggactttgatttttgtgatggtacaaccgttatagtcacagaagattgtggaaacaggggacccagcttgagaacaacaacagcatcaggaaaactgataactgagtggtgttgccgaagctgtacattaccacccttgaggtacaggggagaggacggatgttggtatggcatggagattcgacccttaaaggaaaaggaggaaaaccttgtcaattctcttgttactgcagggcacgggcaagttgataatttttcattaggagtattgggtatggccctatttctcgaagagatgctgcgaacgagggtaggtacaaaacatgcaattttactggtggcggtgtcttttgtgacattgataactggaaacatgtcgtttaaagatctcggacgtgtggtagtaatggttggtacgacaatgacagatgatataggaatgggtgttacatatttagcgctactagcagcgtttaaagtccgacctactttcgctgccggcttgttattaagaaagttaaccagcaaagagttaatgatgactaccatcggaattgtcttgctctcgcagtcaacaataccggaaacaattctcgagttaaccgatgcattggcgctaggtatgatggtccttaaaatagtcagagatatggaaaaatatcaactagcagtgacaattatggcaatattgtgtgtacctaacgcagtaatcttgcagaacgcatggaaggtaagttgcactattctggcggtagtatctgtttcgccactgttacttacatcatcccaacagaaaactgattggataccacttgctcttactataaaaggcctcaatccgacggcaatattcttaactacgctcagtaggacgaataagaaacgcagttggccactgaatgaggcgataatggcagtaggtatggtcagtatattagcgagctctcttttgaaaaacgatattccaatgactggtccattagtggcgggtggtctactcacagtatgttatgtattaactggccggtctgcagatctggaactagaaagagccacagacgtaaagtgggaagaccaggcggagatttctggttcaagtccgattttgagtatcacaatatcggaagatggctcgatgtcgatcaagaacgaagaagaagaacagaccttgactatcttaataagaactggtctactcgttatatcaggattattccccgtcagtatacctattacggcggccgcctggtacctatgggaagtgaagaaacaaagagctggagtactttgggatgtcccttcccctcctccaatgggaaaagcagagttagaagatggagcgtatagaatcaaacaaaaaggtatattaggctactctcaaataggggctggagtttataaagaaggaactttccatacaatgtggcatgtaaccagaggggcggtgctaatgcataaaggaaaacgaattgaaccaagttgggcggacgtaaagaaggaccttatttcttatgggggagggtggaaactagaaggtgagtggaaagaaggggaagaggtccaagtattagccttggaaccagggaaaaacccacgagcagtccaaactaagccaggcctctttaaaacaaacacaggaacaataggtgcggtctcattggatttttcacctggtacaagtggctctccaataatagacaagaaaggaaaagtggtaggactttatggcaatggggtggtaactcgctccggagcctatgtttctgctatagcacagacggaaaagtcgatcgaggacaaccctgagatagaagatgacattttcagaaaacgaagacttacaataatggatctgcacccaggcgcggggaaaacaaagcgctatcttccagcgatagtaagagaagctataaaaagaggtctaaggacgcttatcctggctcccacaagagtagtagcggctgaaatggaggaggctttaagaggtctcccgattcggtatcagacaccagcgatccgagctgaacatacagggagagaaatagtagatttaatgtgccatgcaacatttacaatgcgattacttagtcctgtaagggttcccaactacaacttgatcataatggacgaagctcactttacagacccggcctcgatagcagctcgtggttatatctcaaccagagtagaaatgggagaagcagccggcatattcatgaccgcgacccctcctggtagtagagacccgtttccgcaatcgaatgcacctataattgacgaagaacgtgaaatcccggagagatcctggaatacaggtcatgagtgggtaactgactttaaagggaaaacagtatggtttgtaccgtctatcaaagcaggtaacgatattgctgcttgtttgcgcaaaaacggtaagaaagttatacagctctcgaggaaaaccttcgactccgaatatgttaaaacaagaacaaacgattgggattttgtagtcaccacagatataagtgaaatgggagccaatttcaaagcagaaagggtgatagacccaagaaggtgcatgaaaccagtcattctaacagacggagaagaacgggttatactagcgggaccaatgccggtaacgcattcaagcgcggcacaacggcgtggtcgaataggaagaaatccgaaaaacgaaaacgaccagtacatttatatgggagaaccccttgaaaatgacgaagactgtgctcattggaaggaagctaaaatgctgctagataacattaacactccagagggtattattccaagtatgtttgaacccgaacgggaaaaagtagatgccatcgatggtgaataccggttacgaggcgaagccagaaaaacattcgtcgacctcatgagaagaggagaccttccggtttggctagcctacaaagtggctgcagaaggaataaattatgctgataggcgatggtgttttgatgggattaagaataatcaaattctagaagagaatgtagaagtagaaatatggaccaaagaaggcgaaaggaagaaactcaaaccacgttggctagatgcacgaatatatagcgaccctctcgctttaaaggaatttaaagagttcgcagcaggtcgtaaaagcctcaccttaaatctaatcaccgaaatgggcagactacccaccttcatgactcagaaaactcgagatgcactagataacctagcagtactccacacagcggaagccggaggtcgggcatataatcatgcattaagcgaactgccagaaaccctagaaacgttattactgttaacattgttagcgactgtaacaggtggtatatttttgtttctcatgagcggacgaggtattggtaaaatgacactaggaatgtgttgcataataaccgcctcggttcttctctggtatgcacaaattcaaccccattggattgccgctagtattattctcgagttctttttaatagtacttttaattccggaacccgagaaacaacggacaccacaggacaatcagttaacctatgtagtcattgcaattctgactgtagtagcagcaactatggcaaatgaaatgggatttctcgaaaagacgaagaaagatttaggtctcggatccatagcaacacagcagccagaatccaacatcctagatatagatctacgaccggcatcagcctggacattatacgccgtcgcgacaacctttgtaacaccaatgctgcgacacagcatagaaaattcaagcgtaaatgtttcattaacggctattgctaatcaagcgacagtattaatgggtctaggaaaaggatggccattatcaaaaatggatatcggagttccattattagctataggctgttatagtcaagtaaatccaattaccctgacagccgccctacttttactcgtagctcattatgctataatcggaccaggacttcaagcaaaggcaacaagggaagcccagaaaagagcggcagcgggaatcatgaagaatcctacagttgatggaattacagtaatcgaccttgatcccatcccttatgacccgaaatttgaaaaacaattgggacaagttatgcttctaattctgtgcgtcacacaggtgctaatgatgagaaccacctgggcattgtgcgaagcgttaacacttgccacaggtccaatctctacattgtgggaaggaaaccctggccgtttttggaatacaactattgcggtatcaatggctaatattttccgtggcagctacttagctggagcagggctactattttcaattatgaaaaacacgactaatacaagacgaggaacaggcaatataggggaaacgctaggtgaaaaatggaaatcacgactcaatgcacttggcaaatctgaatttcaaacctataagaaaagtggcatacaagaagtcgacaggactttggcaaaagaaggcatcaaaaggggtgaaactgaccatcatgctgtttcgcgagggtcggcgaaactgaggtggttcgtagaacgaaatatggtgacacctgaaggtaaagtagtcgatttaggatgtgggcgcgggggctggtcctactattgcggaggactcaaaaacgttcgggaagttaaaggactcactaaagggggacccggacatgaggaacccatacctatgtcaacctatgggtggaatttggtacggttacaatcgggcgtagatgtatttttcataccgcccgaaaaatgtgatactttattatgtgacataggggaaagtagtcctaatcccacagttgaagcaggaagaacactgcgagtcttaaatcttgtggagaactggctaaataataacactcagttttgcattaaagttttaaatccttatatgccatccgtgatcgagaaaatggaagccctacaacgtaaatatggtggcgctcttgtacgaaatccacttagccgcaactcgactcacgagatgtattgggtaagcaatgcctcaggtaacatagtttcatcagtcaacatgatatcacggatgttgattaatcgctttactatgaggcacaaaaaggcgacatacgaaccagacgttgacctgggcagcggtactagaaatataggaatagaaagcgagataccaaacttagatatcattggtaaaagaatagagaagattaaacaggagcacgagacatcctggcactacgaccaggatcacccttacaagacatgggcctatcatggttcatatgaaaccaaacaaacagggtcagcttcaagtatggtgaatggtgtagtaaggttgttaacaaaaccctgggatgtcctacctacagtaactcagatggcaatgaccgatactacccctttcggccaacaaagagtattcaaagaaaaagtagacacaagaacacaggaaccaaaagaaggtacgaagaaactaatgaagataacagcagaatggttatggaaagaattggggaaaaagaaaacccccagaatgtgcaccagagaagagttcacacgaaaagtaaggtcgaatgcagcactcggagcgatatttactgatgagaataagtggaaaagcgcgagagaagccgtcgaagatagcagattctgggagttggttgacaaggagaggaatctacacttagaagggaaatgtgaaacctgtgtttataacatgatgggtaaaagagagaagaaactaggcgagttcggcaaagccaaaggatccagagctatatggtatatgtggctaggagcacgcttcctagagtttgaagctctcggatttcttaatgaggatcactggttttctagagaaaattccttaagcggagtagaaggtgagggactacataaactaggatatatattaagggacgtgagtaagaaagaagggggtgcaatgtatgcagatgacactgcgggatgggacacccgaattacactagaagacttgaaaaatgaggaaatggtgacgaatcacatggaaggagagcataagaaactagcagaagctatatttaaactcacttatcagaataaagtggtccgagtgcagcgtcctacacctagagggactgtaatggatataatctcacgcagggatcaaagaggaagtgggcaagtgggaacatatggcctaaatacatttactaacatggaggctcagttaatccgacaaatggaaggggaaggagttttcaaaaacattcaacatttaactgcaactgaggaagtagctgttcaaaattggctcgcacgggtgggtagggaaagactgtcgagaatggccatctcaggtgacgattgcgtggttaaaccattagatgaccgtttcgctaacgcactcacggcgctgaacgacatgggaaaaataagaaaggacatacaacagtgggaacctagcaagggatggaatgactggacccaggtaccattctgtagtcatcatttccatgaacttataatgaaagatggtagggtcttagttgtgccgtgccgaaatcaagatgaacttatagggagagcaaggataagtcaaggagctggatggtcgcttcgagaaacggcgtgtcttggtaaatcatacgcacaaatgtggtctctaatgtactttcatcggagagatctaagattagcagcaaatgcaatatgttctgcagtgccaagccactgggtccccacttcaagaacaacgtggtctattcatgctaagcatgaatggatgactaccgaagacatgttgacagtgtggaatagggtgtggatcagggagaatccgtggatggaagacaaaacacctgtggaatcatgggaagaaattccgtacttaggaaaaagggaagatcagtggtgcgggtcactaataggcttgacgagtagagcaacttgggccaaaaacatacaagccgcaatcaatcaggtgaggtcccttatcggtaacgaagaatacacagactatatgccttcaatgaaaaggtttagaagagaagaggaagaagccggtgtattgtggtag

SEQ ID NO: 22346 - RNA, 9876 nt, synthetic construct
  misc_feature 1..9876: note = derived and/or modified CDS sequence (opt6) from DENV-2__FJ639718__SS-prME
  source 1..9876: mol_type = other RNA
agcgctggtatgattattatgctaattccgactgtaatggcgtttcacctcaccacgagaaacggtgaaccacatatgatcgtgggaatacaagaaaaaggtaaaagtctcttattcaaaacggaagatggagtgaatatgtgtactctcatggctatggatctaggtgaattatgtgaagatactataacttataaatgtccacttttaagacaaaatgaacctgaagacatagattgctggtgtaacagtacttcaacatgggttacatatggaacctgtacaacgaccggagaacatcgaagggagaaaagatcagtagcactggtacctcatgtaggaatgggactcgaaacaagaacagaaacttggatgtcaagtgaaggagcttggaaacatgctcaacgaattgaaacatggattttacgacatccaggatttacaataatggctgcaatattggcatatacgatagggactactcattttcaaagagtactaatttttattctactaacagctgttgcaccaagcatgacgatgagatgcatcggaatctctaaccgtgactttgttgaaggagtgtctggaggaagctgggtagacatagttttagaacatggaagttgtgtaacgacaatggccaaaaataaaccgactctagacttcgagttgatcaaaacagaagcgaaacaacccgcgacattgagaaaatactgtatagaagctaaactaacaaacacaacaactgaatcccggtgtcctactcaaggagagccatcattaaaagaggaacaagacaaacgatttgtatgtaaacacagcatggtggaccggggttggggtaacggttgcgggttattcggaaaaggagggatagtaacgtgtgcaatgtttacatgtaaaaagaatatggaaggaaaaatagtccagccggagaatttagaatatacaatagtagtaactccacactctggagaagaacacgcggtcggcaatgatactggaaaacacggcatggaaatcaaagtaacacctcaaagctcaattacagaggcagagctgacagggtatgggaccgtaacgatggaatgttcaccaagaactgggctcgacttcaatgaaatggtactactgcaaatggaaaataaagcatggttagtccaccgacaatggttcttagatttgccactaccttggttaccgggagcagataaacaagaatcaaattggattcagaaagaaacccttgtcacgttcaaaaatcctcatgccaagaaacaagacgtggttgtattaggcagccaagaaggtgctatgcacaccgcactcacaggtgcaacagaaattcaaatgtcgagtgggaatttattatttacaggacacctaaaatgtcggcttagaatggataaattgcaattgaaaggaatgagttattctatgtgtactggaaaatttaaagttgtaaaagaaatcgccgagacgcaacacggaacaatagtgataagggtacaatacgagggagatggatcaccttgtaaaattccctttgaaataatggatctggagaaaaggtacgttttagggcgccttatcacagtaaatcctatagtaactgagaaagattccccagttaacatagaggccgagcccccattcggagactcctacatcatcataggtgttgaacccggccaactaaaactaaattggttcaagaaaggcagcagtattggacaaatgtttgaaaccactatgcgtggcgcaaaaagaatggcaattctaggtgatacggcttgggacttcggttctctaggcggcgtgttcacttcgattgggaaagcccttcaccaagtgttcggagctatatacggagctgcctttagtggcgtatcatggacaatgaaaatactaattggtgttataataacatggattggtatgaactcacgatcgacaagcctaagtgtatcccttgtacttgtcggaatagtaacactttatttaggagttatggttcaggcggactcaggctgcgtcgttagttggaagaataaggaattgaaatgcggatctggtatattcattaccgataatgtacatacatggacggaacaatacaaattccagcctgaaagtccaagtaagctggcttcagcaatacaaaaagcccaagaggagggcatatgcggcattagaagcgtaactaggctagaaaatttaatgtggaaacaaatcactccagaactcaaccatatattggcggaaaacgaagtgaaattgaccattatgacgggagacattaagggtattatgcaagcagggaaacggtccttgcgcccacaaccaactgaattgaaatattcctggaagacatgggggaaggctaaaatgctaagtacagaaagttataaccagacgttcctaatcgacggtccagaaactgcggaatgtcccaatactaatagagcatggaactccttggaagtggaagattatggatttggggtctttacaacgaacatttggctaaaactcaaagaaaagcaggacgccttctgcgatagcaagctaatgtccgccgcaatcaaggataatcgtgcagtacacgctgatatgggctattggattgaatcagccttaaatgatacatggaaaatagaaaaggcttcatttatcgaagtcaaaaattgtcactggccaaaatctcatactttgtggtccaatggggttttggaaagtgaaatgattatccccaaaaacctggcgggaccagtctctcagcacaactacagaccgggttaccacactcaaatcgcaggaccatggcacctgggcaaactagagatggacttcgatttttgcgacggaaccacggtaatagtaacggaagattgtggcaaccgaggaccgtcacttcgaacaactactgcatccgggaaacttataacggagtggtgttgtagatcatgtacattaccacccctgagatatagaggtgaagatggatgttggtacggaatggaaattcgtccgctcaaagaaaaagaagaaaatctcgttaatagtttagtaacagccggacatggacaggtagataatttcagtttaggagtgttaggaatggccttattcttggaagagatgctaagaactcgtgtcggaacaaagcacgctatattattagtagctgtcagctttgttactcttataacagggaacatgtcgttcaaagatttaggacgagtagtggtcatggtaggggcgacaatggctgacgacattggtatgggtgtcacctatttagcccttctcgctgcctttaaagtgcgtcccacattcgcggcaggtttattactccgaaaattgacatcgaaagaactgatgatgacaaccatcgggatagtattattatctcaatctactataccggaaacggtacttgaactcacagacgcccttgcactaggcatgatggtactcaagatagtcagaaatatggagaaatatcagcttgccgtaacaatcatggctatattgtgtgtgccaaatgccgtaatattacaaaatgcatggaaggtatcttgcacaattctagccgttgtatcagtcagccccctactattaacgtcctcccagcaaaagactgactggattccccttgcgctcacaattaagggcctaaatccaaccgctatatttctaactaccctttctcgaacaaacaagaaaagatcatggccattaaatgaggcaataatggcagtgggaatggtaagcatattagccagctcgctcctcaaaaatgatattccaatgactggacctttagtcgccgggggactattgacagtgtgctatgtgctgacaggcagatcagccgatctcgaattggaaaaagcaacagatgtaaaatgggaagatcaagctgaaatatcaggatcgtctccgatcctaagcattaccattagcgaagatggatctatgtcgatcaaaaatgaagaagaagaacaaactctaactatactaataagaaccggtctattagttataagtgggttattcccaatatcaataccaataacggctgccgcctggtacttatgggaagtcaagaaacagcgagccggagttctatgggacgttccaagccctccaccaatgggaaaagcggagctagaagatggtgcctaccgaatcaagcagaaaggaatattgggatatagccaaataggtgcaggagtgtataaggaggggacatttcatactatgtggcatgtcacaagaggggcagtactgatgcataaaggtaagcgcatagaaccctcatgggccgatgtgaaaaaggatttaataagctatggaggtgggtggaaacttgaaggagaatggaaagagggagaggaggttcaggtcctggcactagagccgggcaaaaatccaagggccgtccagacgaaacctggactgtttaaaactaatacaggaactatcggtgcggtaagtctggacttcagtcccggcaccagcggttctccgataatagataagaaaggaaaagtagtcggactatacgggaatggtgtagtgactagatccggagcatatgtcagtgcgatagcgcaaaccgaaaaatcaatcgaagacaaccccgaaatagaagatgatattttccgcaagcgtcgcctcacaatcatggatctccaccctggcgcaggaaaaacaaaaaggtatctaccagcgatagtaagggaggcaataaaacgcggtctcagaacgcttatattggccccaacgagagtagttgcagctgaaatggaagaagcattaagaggattacccatccgatatcaaactcccgctattcgagctgaacataccggccgggaaattgtagatttaatgtgtcatgctacatttacaatgcgtctgctatccccggttagagtaccaaactacaatctcattatcatggatgaagcccactttactgatccggctagcatagccgcaagaggatacataagtacgagagttgagatgggtgaagcagctggcatattcatgactgcgacaccaccaggttcgagagatccgtttcctcagtctaacgctcctataatagatgaagaacgtgaaataccagaaagatcatggaactcaggacatgaatgggtgacagattttaaaggaaaaactgtttggttcgttccgtcaataaaggctgggaatgacatagcagcatgtttgaggaaaaatgggaagaaagtaatacaactatcaaggaagacttttgattcagaatacgtaaagacaaggactaatgattgggattttgtagtaactacagatatctccgaaatgggagcaaatttcaaggctgaacgagtaatagatccaagaaggtgcatgaagccagttatattaacagatggagaggaacgcgtcatattagcaggaccaatgccagtcacccattcgtcagcggctcagcgaagaggacgtattggtcgaaatccaaagaatgaaaatgaccaatatatttatatgggagaaccactagaaaatgatgaggattgtgcacactggaaggaagcaaaaatgctgctggataatattaacacgcccgaaggcataataccaagcatgtttgaacccgaaagggaaaaagtggatgccatagatggcgaatatcgactaagaggggaagcacgaaaaacatttgtcgatctaatgcgaagaggagatctaccagtatggctggcttacaaggttgctgctgaaggcataaattacgcagataggaggtggtgtttcgacggaattaaaaataatcaaatactagaagaaaacgtggaagttgagatctggactaaagaaggagaaaggaagaaacttaaaccacgttggctggatgctcgaatatattcggacccacttgccctcaaagaatttaaggagttcgccgcaggacgtaagagcttgacattaaatttgattactgaaatggggaggcttcccacattcatgacgcagaaaacgagggatgccttagataatttagctgtcctacatactgcggaggccggcggaagggcatataatcatgcattaagcgagctcccagaaacgctagaaacgttattactactgactttgttagcgacagtgaccggaggcatatttttatttctaatgtctggaagagggataggaaaaatgacactcggcatgtgctgcataatcacggcgtcaatactgctctggtacgcacagatacaaccgcactggatagcggcatctattatactcgagttctttttaattgttcttctcatacccgaaccggaaaagcaacgaactccacaagacaaccaactgacttacgtggtgatagctattttaaccgtcgtagcagctactatggcaaacgaaatgggttttctagagaaaactaagaaagatctcgggttaggatcgatagccacacagcaacctgaaagtaatatactagatattgatttgcgacctgcatcagcttggacattatatgcagtagcaactacttttgttactcctatgctaagacactccatagaaaactcaagcgtcaacgtatcattaacggcgattgcaaaccaagctactgtattaatgggcttgggaaagggatggccactatcaaaaatggacatcggagtcccattgctagcaattggatgttattcgcaagttaatccaataactctcactgctgcactacttctcttagttgctcactatgcgataattggacctggtctacaagcaaaagcgacacgtgaagcacagaaaagggcggctgcgggaataatgaagaatccaacagtggatggaataaccgtgattgatttagatcccatcccatacgatcctaaattcgaaaagcaattagggcaggtaatgctgttgatactatgcgtgactcaagtattgatgatgaggacaacttgggccctttgtgaggcacttacgcttgctacaggtccgatatccacgttgtgggagggtaaccccggaagattctggaatacaacgattgctgttagtatggcaaatatctttcgagggtcctatctagccggtgcgggcctactattttcgataatgaaaaatactacaaacactaggaggggtacagggaatattggggaaaccttaggcgaaaagtggaagtctcgacttaatgcactgggtaagtcagaatttcaaatttataagaaatccggcatccaagaagtagatcgaacccttgcaaaagaaggaatcaaaagaggcgagactgaccatcatgccgtctccagaggttccgccaaactaagatggttcgttgaacgcaatatggtcacaccagaaggtaaagtcgttgatttaggatgtgggaggggaggttggtcgtattactgtggtgggctcaaaaatgtgcgagaagtgaaaggactaaccaagggaggacccggccatgaagaaccaataccaatgtcaacctatggttggaatttagtaagactacaatctggggtagacgtattctttatacctccggagaaatgtgatacgctcctatgtgacattggcgaatcgtctcctaacccaactgtagaagctggcagaactttaagagtgctgaacctggtagagaactggctcaacaataacacacaattctgcataaaggtgctaaacccatatatgcctagtgtgatagagaaaatggaggcactgcaaagaaaatacggtggcgcattagtacggaacccactttctagaaattctactcatgaaatgtattgggtaagtaacgcgtcaggtaacatagtcagctcggttaatatgatctcaagaatgctaataaatcgattcacaatgcgacataagaaagccacatatgaacctgacgtagacctaggatctggaacgaggaacattggtattgaaagtgaaatacccaatttagatataataggtaaaagaatagagaaaataaaagaagaacacgagacttcatggcattacgatcaggaccatccttacaaaacatgggcttaccatggttcatacgagacaaaacaaacaggatcagcatcaagcatggtaaacggagtagtaaggttactgaccaagccgtgggacgtattacccacagtaactcagatggcaatgactgacacaacacctttcggacaacaaagagtattcaaagagaaagtagatacgagaacacaagaaccaaaagaaggcactaagaaattaatgaaaataaccgcggaatggctctggaaagaattaggcaaaaagaaaactccgcgaatgtgcacacgagaggaatttacacgcaaggttaggagtaatgcagcattaggcgcgatcttcactgatgaaaataaatggaaatccgctagggaggccgtggaagataacaggttctgggagttagtagacaaagaaagaaatttacatctagaaggtaaatgcgaaacatgcgtttataacatgatggggaaaagggaaaagaagttaggcgaatttggaaaagcaaaaggttcaagagcaatctggtacatgtggcttggagcacgattcctcgaatttgaagcattaggttttcttaacgaagatcactggttcagcagagagaacagtctgtcaggagtagagggtgagggacttcataagttaggttatatactaagagatgtaagcaagaaagaaggtggggcgatgtatgccgacgacacagcaggctgggatacaagaatcacactagaagatctcaaaaatgaagagatggtaacaaatcacatggaaggggaacataagaaactagccgaggctattttcaaacttacatatcaaaataaagtcgttcgtgtacagcgcccaacgccgcgaggcactgtaatggacataatatcaagaagggatcaacggggtagcggacaagttggtacctatggattaaatacctttaccaacatggaggcgcaactaatcaggcagatggaaggggaaggtgtcttcaaaaacattcaacatttgacagtgacggaagaagcggcagtccaaaactggctagcaagagttggacgagaaaggttgtcacggatggcaatttccggtgacgattgcgttgtaaaaccccttgacgaccgctttgcgaatgcactgacagcattaaatgacatggggaaaatcagaaaagacattcaacaatgggaaccgtcaaaagggtggaacgactggacgcaggtaccgttctgctctcatcatttccacgagctagtaatgaaagacggacgcgtattggtcgttccttgtcgaaatcaagacgaattgataggccgcgcaagaatcagtcaaggtgcggggtggagcctaagggaaaccgcctgtttaggcaaaagttacgctcaaatgtggagcctgatgtattttcatagacgtgacctaaggttagcggcgaacgcgatttgttcagcggtaccaagtcattgggttcctacaagtaggactacctggtcaatacacgcaaaacatgagtggatgacaacagaagacatgttgacagtgtggaaccgtgtttggataagggaaaatccatggatggaagacaaaacccctgtagaatcctgggaagaaatcccctatctaggcaaaagagaagaccaatggtgtggatctttaatagggttaactagcagggccacgtgggctaaaaatattcaagctgccattaatcaagtcaggtcactgataggcaacgaagagtatacagactatatgccatcaatgaagagattccgtagggaagaagaagaagcgggcgtactatggtga

SEQ ID NO: 22347 - RNA, 9876 nt, synthetic construct
  misc_feature 1..9876: note = derived and/or modified CDS sequence (opt6) from DENV-2__GQ868625__SS-prME
  source 1..9876: mol_type = other RNA
tcggcagggatgattattatgcttataccgactgttatggctttccacctgacaacacgaaacggtgaaccacatatgatcgtgggtatacaagaaaaaggtaagtcactcttatttaagacagaagacggtgtgaatatgtgcacactgatggctatggaccttggcgaactgtgcgaggatactattacatacaaatgccctttattaagacaaaacgagccagaggacattgactgttggtgtaattcaacttcgacatgggttacttacggtacatgcaccactactggagagcatagacgtgaaaaaagatctgtcgctttagtgcctcacgtagggatgggactagaaacaaggactgaaacatggatgtcttctgaaggggcatggaaacacgctcaaagaattgaaacgtggatacttaggcaccctggtttcactattatggctgccatactggcctacacgatcggaacaacacacttccaaagagtcttaatattcatacttttaacagcagttgcaccaagtatgacaatgcgctgtataggaatctcgaatcgagactttgttgaaggtgtttcagggggatcatgggtggatattgtattagaacacggaagttgcgtaacaactatggcaaagaataaaccaacgctagattttgagctaataaaaacagaagctaagcaaccagcgacgttgaggaagtactgcattgaagccaaactaacaaatactacaactgagtcacgctgtccaacacaaggtgaaccttcattaaaagaagagcaagataaaagattcgtctgcaaacattcaatggttgaccgaggatggggaaatggatgtggactttttggaaaaggaggaatcgtcacttgtgccatgtttacttgcaaaaaaaatatggaaggcaaaatagtccaaccagaaaatctagaatacactatagtagtaacgccacattcaggtgaagaacacgcagtaggaaacgacactgggaagcatggaatggaaattaaggtaacacctcagtcgtcaataacagaggctgagctcacaggttatggtactgttaccatggagtgttcaccaagaacaggactagactttaacgaaatggtcttgttgcaaatggaaaataaagcatggctcgtgcaccgtcaatggtttttagatttacctttaccatggctacccggagcagataaacaagaatctaattggatacagaaggaaacgctcgttacttttaagaatcctcatgcaaaaaaacaagatgtagtcgtcttaggatcacaagaaggtgctatgcatactgcattaactggtgcaacagaaatacaaatgtcttcaggaaatctgcttttcacgggacatctaaagtgtcgattacgcatggataaattgcagttaaaaggcatgtcatacagcatgtgcacaggaaaatttaaagtagtaaaagaaatagcggagactcaacacggtaccatagtcatacgtgtccaatatgaaggcgacggcagcccttgcaaaataccctttgaaattatggatttagaaaaacgatatgtcctcggccgtctcataacagtcaatccgattgtcaccgagaaagattcaccagtaaatatcgaagccgaaccccctttcggagactcttatatcatcataggagttgaaccaggtcaattaaagcttaattggttcaaaaaaggttcatcgattggtagaatgtttgaaacaaccatgagaggcgccaaaaggatggccattctgggagacaccgcttgggacttcgggtcgctaggaggtgtttttacgtcaattggcaaagcgttacatcaagtttttggagcgatatacggggcagcattttctggagtatcatggactatgaaaatactcatcggtgtcataatcacctggataggaatgaactcacgatcgacgtcactctcagttagtttagtactcgtagggatcgtaacgctataccttggagtgatggtccaagccgattcaggatgtgtcgtgtcttggaaaaataaagaattaaagtgcggttctggtatatttataaccgacaatgttcacacatggacggaacaatataaatttcaaccggaaagccctagtaaacttgcctctgcaatacagaaagcacaggaagagggaatatgtggaataagatcagtaacccggctcgaaaacttgatgtggaaacaaataacgccggaattaaaccatatcctagctgaaaatgaagtcaagctcaccatcatgaccggggacattaagggtataatgcaggctggtaaacggtcattgagaccccaacctacagaattaaaatactcttggaaaacctggggaaaagcaaaaatgctatctactgaatcatataaccaaacatttttaattgacggacctgaaacagctgaatgtcctaacactaatcgggcttggaactcattggaagtcgaagactatggatttggcgtatttactacaaatatttggcttaagttaaaggagaaacaagacgcgttctgcgattcaaagttaatgagcgcagccataaaagacaatcgcgcagtccatgccgatatgggttattggatagagagtgcacttaatgatacatggaaaatagaaaaggcatcatttattgaagtcaaaaattgccattggccaaaatcccataccctatggagtaatggtgtgctggaaagcgaaatgataatacccaaaaacctagccggtccagtctcccaacacaattaccgaccaggataccatacacaaatagcggggccatggcatctaggaaaactcgagatggatttcgatttttgtgacggcacgactgttattgtaacggaggattgtggcaacagaggcccctcattaaggacaacaacagcttcagggaaactcataaccgagtggtgctgtagaagctgtacactcccgccactaagatataggggcgaagacggctgttggtacggaatggagatcagacccctaaaagaaaaagaagaaaatttggtaaattccctagtgacagctggacatggccaagttgataatttctcgctaggagtgctcggtatggcgttgtttttggaagaaatgctaagaacaagggtaggcacaaaacacgcaatcttactagttgccgtaagctttgtaactctcataacagggaacatgtcttttaaggatctagggcgagttgtggttatggttggcgcaacaatggctgacgatataggaatgggagtaacctacttagcacttctggcagcgtttaaagtaagacctacattcgctgccggccttcttctacggaaattaacatcaaaagaattaatgatgacaactatagggatagttcttctaagtcaatctactattccagaaacagtcctggaactgactgacgctcttgctttgggaatgatggttctcaaaatagttagaaacatggaaaaatatcaacttgcggttaccatcatggcaatcctatgtgtacctaatgctgtcatcttgcaaaacgcttggaaagtaagttgcacaatattagcagtcgtttcggtgagcccattgttattaacgagctcacaacagaaaacagactggataccactggctctaacaataaagggtctcaacccaactgctatattcttaactaccttatcacgcaccaacaagaaacgctcctggccgttgaacgaagcaataatggctgtaggaatggtaagtatactagcaagttctttgttaaaaaacgatatacccatgacaggccctttggtagcaggtggactgttaacagtatgttatgtgttgactgggagatcggcagatttagaactagaacgagcaacagatgtaaagtgggaagatcaagcggaaatatccgggagttcgccaatactctcaatcactatatcagaagatggctcgatgagcataaagaacgaagaggaagagcaaaccctaactatactcatacgtaccggtctattagtgatcagcgggctattcccaattagtataccaataacagcagccgcgtggtatctttgggaagtcaaaaagcaacgagccggtgtcctatgggatgttccgtcacccccacccatgggtaaggcggaattggaagacggagcttatagaattaaacaaaagggaatacttggatatagccaaataggcgctggagtgtataaggagggtacctttcatacaatgtggcacgtgactagaggtgccgtgttgatgcataaaggaaagcgtatcgagcccagctgggcagacgttaaaaaggatttaataagttatgggggtggctggaaactcgaaggggaatggaaagaaggagaggaggttcaagtactagcattagaaccaggtaagaacccgagagcggttcaaacaaaaccgggactattcaagactaataccggaacaataggcgctgtatcattagattttagtccaggaacatccggttcgcccattatagataaaaaaggtaaggttgttggattgtacggcaatggcgtagtcacaagaagtggagcctacgtgagtgcgatagcacagacggaaaaatcaattgaagacaaccctgaaattgaagatgatatattcagaaagcgcagactcaccataatggatttacatccaggtgctggtaagactaaacgataccttcctgctattgttagagaagcaataaagagaggactaagaactttaattttagcccccactcgtgtagtggctgcagaaatggaggaagcacttagggggctaccaatccgatatcaaaccccagcaattcgtgctgagcacacaggccgggaaatagtagatctaatgtgccatgctacttttactatgaggttgcttagtcccgtcagagtacctaactataacctaataatcatggatgaagcacattttacagaccctgcaagcattgctgcacgaggttatatctctactcgggtggagatgggagaagccgcgggaatatttatgacagccaccccacccggcagtcgagaccctttccctcaatcgaacgcaccaataatagatgaagaaagggaaattccggaacgatcttggaactccgggcacgaatgggtgacagatttcaaaggaaagacagtatggttcgtgccatcgatcaaagcaggaaatgatatagctgcatgtttgcgaaaaaatggaaagaaagttatacagttgtcaagaaaaacatttgattcagaatatgtcaaaacacgaacaaacgattgggatttcgtagtgaccacagatataagcgaaatgggagcaaatttcaaggcagaaagagttatcgatccaagaaggtgtatgaaacccgttatattaacagacggagaggagcgagtaattttggccggacctatgccagtaactcattcctcagcagcccaaagaaggggacggattggtagaaatccgaaaaatgaaaatgatcagtacatctatatgggagaacccctagaaaatgatgaagactgtgcacattggaaggaagccaaaatgttgctagataatattaatacaccggaaggtatcataccaagcatgtttgaaccggagcgtgaaaaagtggatgcaatagatggagagtacagactcagaggagaagctcgtaaaacatttgtagacctcatgcgtagaggtgaccttcccgtttggttggcatataaagtagcagctgaaggaataaattacgcagatcggagatggtgcttcgatggcataaaaaataaccaaatcctagaggagaatgttgaggtagaaatctggacaaaggaaggcgaaaggaagaaattaaaacctcgatggcttgacgcgcgaatctactcagatccactcgcgctaaaagaattcaaagaattcgcggcaggtcggaaatcactgacattaaatttaattacggagatgggccggttacccacttttatgactcaaaaaaccagagacgccttggataatcttgctgtgctgcacactgcagaagctgggggtagagcgtataatcatgctctatcagaattgcctgaaacgttagaaactttgttactcctgacacttttggctacggtcacgggaggaattttccttttcttaatgtccgggagaggcataggcaaaatgactctaggcatgtgttgcataataaccgcatcaatattattatggtacgcacaaattcaaccacactggatagctgcttcgatcatccttgaattcttcctgatagtactcctgataccagagcctgagaaacaaagaacacctcaagacaaccaattaacatacgttgtaatcgcaatcctaacggtcgtagctgcaacaatggccaatgagatgggattcctagaaaaaacgaaaaaagatttaggcctaggttccattgcaacacaacaaccggaaagtaatatattagacatagacttaaggccagcgtcagcttggaccttatacgcagtcgctaccacctttgtaactcctatgttgagacatagtattgagaacagtagtgttaacgtaagtctaacggcaatagcaaaccaggcgacagtattgatggggcttggtaagggctggcctttaagcaagatggatataggtgttccattactagcaatcggctgctatagccaagtaaacccaataactttaacagcagctttgctattgcttgttgcacactatgctataataggtccgggattacaggccaaagccacaagggaagcccaaaagcgagcagctgcaggaataatgaaaaatccaaccgttgatggaataacagtaatagatcttgaccctattccatacgatccgaaatttgaaaaacagctcggtcaagtaatgcttttaatattgtgcgtaactcaagtccttatgatgcgtaccacttgggcactctgtgaggcgttaacacttgccactggacccatttctacactatgggaaggaaatcccggacgcttttggaacacgacgatagcggtgtccatggcgaacattttccgcggtagctatcttgcaggtgcgggtctattattcagtataatgaaaaatactactaatactcgtaggggaaccggcaacatcggagaaacgcttggtgagaaatggaaatcaagattaaatgcactgggcaagagcgagtttcaaatatacaaaaaaagtggaatccaagaagttgatcggactttagcaaaagaaggtataaaaagaggagaaactgatcaccatgcagttagtcgaggaagcgcaaaacttagatggtttgtggaacgcaatatggtcacaccagaaggcaaagttgtcgacttagggtgcggacgcggaggatggtcatattattgtggaggactaaaaaatgtaagagaagtcaaaggactaacaaaaggagggccgggacacgaggaacctataccaatgagcacctacgggtggaacttagttcgtctccaatctggagttgatgtcttctttatacccccagaaaaatgcgacactttattatgcgacataggcgagagtagtcctaatcctactgtagaagcaggtagaaccttaagggtactaaacctggttgaaaattggttaaataacaacactcaattctgtataaaagtactgaatccttatatgccaagtgtgatagagaaaatggaagcattacaaagaaaatatggcggtgcactagtacgcaatcctttgtccagaaactctacacacgaaatgtattgggtttcgaatgcatcgggtaatattgtaagttcagtaaacatgatatccaggatgttgattaatagatttacgatgcgacacaagaaggcaacttatgaacctgacgttgacctaggatccggaacaaggaatataggtatagaatcagagattccaaacttggatataattggaaaaaggattgagaaaattaaggaagagcacgagacttcatggcattacgatcaagatcacccgtataaaacatgggcgtatcacgggtcttacgagacaaaacaaactggctcagcaagcagtatggtaaacggtgtggttcgtttattgacaaaaccttgggatgtgctgcccacggtaacccagatggcgatgacggatacaactccattcggacaacaacgtgttttcaaagaaaaagtagatacacgtacccaggaaccaaaagaaggtaccaagaaactaatgaaaattaccgcggagtggctatggaaggaattgggaaaaaaaaagaccccccgcatgtgtacgcgagaagaatttaccagaaaagtgcgcagtaatgccgcgttaggagccatattcactgatgaaaataagtggaaatctgcaagagaagctgtcgaagatagtcgattctgggagttggtagataaggaacgtaacttacatctggaaggaaaatgcgagacctgcgtctacaatatgatgggaaaaagagaaaaaaagttgggcgaattcggaaaggccaagggtagcagagcaatatggtatatgtggctcggagcgagatttttggagttcgaagcactaggttttttgaatgaagaccattggttttctagagaaaattcattaagcggagtggaaggagaaggcttacataaattaggctacatacttcgagacgttagtaaaaaagaaggcggggctatgtacgccgatgatactgcagggtgggacacgagaatcaccttagaagacctgaagaacgaagaaatggtaacaaatcacatggaaggcgaacacaaaaaacttgcagaggctatatttaaacttacgtaccaaaataaggtcgtaagagtgcaacgcccaacccctcgtggaacagtcatggatatcatctcaagacgtgatcaaagagggtctgggcaagtaggcacatatggtctaaatacttttaccaacatggaagcacaactaatacgccaaatggaaggagagggcgtattcaaaaacattcagcatcttacagtcactgaagaagcagccgtgcaaaattggctagcacgcgtaggcagggaaagattatcaagaatggctatttcaggagatgattgtgtggtcaaacctttggatgatcgattcgctaacgcattgaccgccctcaacgatatgggtaagatcaggaaagatattcagcaatgggaacctagcaagggttggaatgactggacccaagtccctttctgttcacatcattttcatgaattagtaatgaaagatggtagggtattagttgtgccctgtcgaaaccaagacgagctaataggccgtgctagaatcagtcaaggtgcggggtggtcactaagagaaacggcctgcctggggaaaagttatgcccagatgtggtccttaatgtattttcataggcgcgatcttagattagctgctaatgccatctgctccgcagtgccctcccactgggttccaacaagccgcacaacttggagtatacacgctaaacatgaatggatgacgactgaagacatgctgactgtgtggaaccgtgtttggatacgagaaaacccttggatggaagataaaactccagttgagagttgggaagaaataccctatttaggcaaaagagaagaccagtggtgtggaagcctgataggtctcacgtctcgagcaacctgggcaaaaaacatccaagcagccattaaccaagttcggagcttaatcggaaatgaggaatataccgattacatgccctccatgaaacgcttccgaagagaagaagaggaagctggtgtcttatggtaa

SEQ ID NO: 22348 - RNA, 9876 nt, synthetic construct
  misc_feature 1..9876: note = derived and/or modified CDS sequence (opt6) from DENV-2__KF955401__SS-prME
  source 1..9876: mol_type = other RNA
agcgctggtatgataattatgctcataccgacagtaatggccttccatttaacaactaggaatggtgagccacatatgattgtcggcatacaagaaaaaggaaaatctttattatttaaaacagaagatggagtaaacatgtgcactcttatggccatggatctcggtgaactttgcgaagataccataacttacaaatgcccattgctcagacaaaatgagccagaagatatcgattgttggtgcaactcgacatccacgtgggtaacgtatggaacctgtaccactacaggagaacatagacgagaaaaaagatcagtcgcattagttccccacgttggaatgggactagaaacgagaacagaaacatggatgtcaagcgagggagcttggaaacacgcccaacgcatagaaacttggatattgagacatccaggattcacaatcatggctgccatactagcatataccatcggaacaactcactttcagagagtactaattttcattttattaacagcagtagcaccgtctatgacaatgagatgcataggaatttccaatcgagattttgtggaaggtgtgtctggtggatcatgggttgatattgtcttagaacatggtagctgtgtcaccactatggctaaaaataagcctacactagattttgaactaataaaaacagaggccaaacagccagcaactttgagaaaatactgtatagaggctaagctaactaacactactacagaaagtaggtgtcctacacaaggagagccctctctcaaggaagaacaagataaacggttcgtttgcaaacactccatggtagatcgcggctggggcaatggatgcggattattcggaaaaggtgggatagtcacatgcgccatgttcacctgcaaaaaaaacatggaagggaagattgtccagcctgaaaacttggaatatacaatagtagtcacaccacattcaggagaagaacatgccgtcggcaacgatactggaaagcatggaatggaaattaaagtcactccacagtcaagtataactgaagccgaactgactggttatggaacagttacaatggaatgttcaccccgaactggactagattttaacgagatggtacttctacaaatggagaataaggcgtggcttgtgcataggcaatggtttctcgatctgcctcttccgtggcttcctggtgcagacaaacaagaaagtaattggattcaaaaggagaccctcgtgaccttcaaaaacccacatgcaaaaaaacaagatgttgtcgtactaggaagtcaggaaggtgctatgcacacagccttaactggggcaactgagattcaaatgtcctcggggaacttgttgtttactggacatctgaaatgtcgactaagaatggacaaactacaattaaaaggcatgtcatatagtatgtgtacaggtaaattcaaagttgtgaaagaaattgctgaaacccaacacggtacaatcgttatacgagtacaatacgaaggtgatggcagtccctgtaagatcccttttgaaattatggaccttgaaaaaagatacgttttgggacgtctgataaccgtaaaccctatcgttactgaaaaggattcaccagttaatatagaagctgagcctccatttggtgattcatatatcataataggtgtggaacccggtcagctcaaactgaattggttcaagaaaggatcatctattggccaaatgtttgagaccactatgaggggcgcaaaaagaatggcgatcctaggtgacaccgcatgggattttggatcattggggggcgtatttacgtcaattggaaaagcgcttcatcaagtgttcggagcgatctacggagtggcatttagtggagtatcctggacgatgaagatattaataggtgtaattataacgtggatcggtatgaattcacgctctacttcattatctgtatctctagtcctggttggcatagttactctttatttaggtgttatggtacaagcggattccggatgcgtcgtaagctggaagaacaaggagttaaagtgtggatctgggatcttcattacggacaatgtccatacctggacggagcagtataaattccaacccgaaagtcctagcaaactagcatcagccatacaaaaagctcaagaggaaggaatttgcggtataagaagtgtcacaaggcttgaaaatttaatgtggaagcaaatcacgcccgagcttaaccatattttagccgagaacgaagttaagcttacaatcatgacaggtgatatcaaaggaattatgcaagcaggaaagagatcacttagaccacaaccaacagaactgaagtattcttggaaaacgtggggaaaggctaaaatgttgtttacagaaagttataatcagacttttttaatagatggccctgaaacagccgaatgccccaataccaatcgtgcatggaacagtttagaagtagaagactatggattcggcgtctttactactaacatatggttgaaattaaaagaaaagcaggatgctttttgcgattcaaaattaatgtctgctgccatcaaagacaatcgtgcagttcatgcagacatggggtattggattgaatctgcgctaaatgatacgtggaagatagagaaggcttccttcatagaagtaaaaaattgccattggccaaagtcccacacactttggagtaacggagtactcgaatcggaaatgataataccgaagaatcttgccggaccagtgtcacaacataattatagaccgggctatcatacccaaattgctggcccatggcatctgggaaagctcgaaatggattttgacttttgcgacgggactacggttatcgttacagaggactgcgggaatagaggaccgagtctaaggaccacaacagcgtcaggaaaacttataactgaatggtgttgcagatcgtgtacactacccccattaaggtaccgaggagaagatggttgttggtatggaatggaaattcgtcctctaaaagaaaaagaggaaaatctagtaaattcattggtaacggctggacatggccaagtagataatttctcgctgggggtacttggcatggcactattcttggaagagatgttgcgaaccagagtaggaaccaagcatgcgattctccttgtagcagtcagcttcgtaacactaatcacaggtaacatgagcttcaaggatctcggaagagtggtagttatggttggagcaacaatggcagacgacataggtatgggagttacataccttgctctattagcagctttcaaagtaagacccacatttgctgccgggctactactacgtaaattaacctcaaaagaactgatgatgacgaccattggcatcgtgttattaagtcagtcaacaataccggaaacagtactagagctcacagatgcattggccctaggaatgatggtgctgaagatagtaaggaatatggagaaatatcaattggctgttacaatcatggctatactctgtgtaccaaatgccgtgattctacaaaatgcttggaaggtctcttgcacaatccttgcagttgtgtcggtatcccccttactacttacgagcagtcaacaaaaaacagactggatcccactggctttaacgatcaaaggactaaacccaacggctatttttctaaccacgctgtcgcgaaccaataagaaacgatcctggcctttaaatgaagcgatcatggcagtaggaatggtatctatcctcgcatcatcattattgaaaaatgacattcccatgacaggcccgctagtagcaggcggattactcactgtatgctatgttcttaccggacgttctgctgatttagaactcgagcgtgcgactgacgtgaagtgggaagatcaagccgaaatatcagggtcaagccctattctatcaattaccatttcagaggacggctcgatgtcaattaaaaatgaagaagaagaacaaacactaactattttaatccgtactggattgctagtgattagtggcttatttcctataagcatcccaataactgccgcagcatggtatttatgggaagttaaaaaacagagagcaggcgttctgtgggacgtaccaagtcccccaccaatgggtaaagctgagctagaagatggggcgtatagaattaaacaaaaaggcatacttggttacagtcaaattggagcgggagtctacaaggaaggtactttccatactatgtggcacgtcactaggggagcagtactgatgcacaagggaaaaagaattgaaccatcatgggcggatgttaaaaaggatttaatatcctatggagggggatggaagttggagggtgagtggaaagaaggtgaagaagttcaagtattagcattggaaccaggcaaaaatcctcgcgcggtgcaaacaaaaccagggctatttaaaactaacaccggtactatcggagctgtttcattagatttttccccgggaacttctggttcaccaataatagataaaaaaggaaaagttgttggactctacggcaatggcgtggtgacacgaagtggagcttacgtatcagctattgcacaaacggaaaaaagcattgaagataatcctgagatcgaggacgatatatttagaaagaggagactgacaattatggatctacacccgggtgctggaaaaaccaagagatatttacccgccattgtacgagaggctataaaaagaggtttacgaacattaatactagcaccaacgagagtcgtcgcagcagaaatggaagaagcgttaagaggtcttccaatacgatatcaaacaccagctattcgtgccgaacatacagggcgggaaatagtggatctgatgtgtcacgcaacattcacaatgagactactttccccggtacgtgtacctaattataatctgataatcatggatgaggcacactttactgatccagcaagcatcgcggccagaggttacatttcaacaagagtagaaatgggtgaagctgcaggtattttcatgacagccacaccccctggaagtagagatccttttccacaaagtaatgctccaattatcgatgaggagagagaaataccggaaagaagctggaactccggacatgagtgggttactgattttaaaggaaaaacggtatggtttgttccctcaattaaagcagggaatgatatagcagcatgtttgaggaaaaatggaaaaaaggtaatacaattatcacgaaaaacgttcgatagtgagtacgtaaagactcgtacaaacgattgggactttgtagttacaaccgacataagcgaaatgggagccaattttaaagcagaaagggtcatagacccaagaaggtgcatgaaaccagtaatcctcaccgacggcgaagaaagagttatattagctggtccaatgcccgttacacatagttcagcggctcagaggaggggtcgaattggccgtaaccctaaaaatgagaacgaccaatatatatacatgggtgaacccctggaaaacgacgaagactgtgcacattggaaagaagcaaaaatgctattggataacataaatacaccggaaggaatcattccatccatgttcgagcccgaacgtgaaaaagtagacgctattgacggagagtatagactccgaggagaagcacgtaaaacgtttgttgacttaatgagacgaggcgatcttccagtatggctagcatataaagttgctgccgaaggaattaactatgcagaccggcgatggtgtttcgatggaatcaagaataaccagattctcgaagaaaatgtcgaggttgagatatggaccaaggaaggagagcgaaaaaaactaaagcccaggtggctagatgcccgtatctatagtgacccacttgcattaaaagaatttaaagaatttgcggcaggacgcaaaagtttaacgttaaatcttattacagagatgggtagattacccactttcatgacacaaaagacacgtgacgcactagataacttagctgtacttcacacggctgaagcaggtggacgagcatacaatcacgccttaagtgagctgccagaaactttagaaacgctattactattaacattattagcgactgtaacaggaggtatattcctcttcttgatgagcggtagaggaattggaaagatgacactcgggatgtgttgtataataacggcttccattctgttatggtatgcacagatacaaccgcattggattgcggcctctataattttagaattttttctaatcgtactactaattcctgaacccgaaaaacaaagaacaccgcaggataatcaactaacctacgtggtaatagctatattaaccgtagtagcagcaactatggcaaatgaaatggggtttctagaaaaaacgaaaaaagacttaggcttgggcagtatagcgacccaacaaccagaatcgaatattcttgatattgatctgcggccagcttctgcatggacactctacgcagtggctacaacttttgttaccccaatgcttcgacattccatagaaaattcctcagtaaacgtatcgttaactgctatagccaaccaagcgaccgtattgatggggctcgggaaagggtggccattaagcaaaatggacataggagtaccactattagccatcgggtgttacagccaagtcaatcctattacactaactgccgctttactattacttgtcgcacattacgcaattataggaccgggcttacaagccaaagcgacaagagaagcgcaaaaacgagccgccgctggtataatgaaaaacccgactgttgacggcataactgtaatcgacttagatcccatcccatatgacccgaaatttgaaaaacaactaggtcaagtcatgttgctaatcctatgtgtgacacaggtgctaatgatgcgtacaacttgggcactctgcgaggcccttacccttgcaacaggtccaataagcaccctatgggaaggcaaccccggtaggttctggaacacaacaatcgcggttagtatggcgaatatattcagaggttcgtatctggcaggtgctggcctcttgttcagtatcatgaaaaatacaacaaatacgcgacgaggaactggaaatattggagaaactctaggagaaaagtggaaatcacggctgaacgccctaggcaaatcggagttccaaatttataaaaaaagtggtatccaagaagtggatcgtacgctagctaaagaagggataaaacggggcgaaactgaccaccacgcggtctcgaggggatcggccaaactacgatggtttgttgagcgaaacatggtaacgccggaaggtaaagtagtcgacctgggatgcggccgtggggggtggagctattactgcggaggattaaaaaatgtgagggaggtgaagggattaacgaaaggaggtccaggacacgaagaaccgattcctatgtccacatatggttggaacttagtgagactgcagagcggagtcgatgtattcttcataccccctgaaaaatgtgatactttattatgcgatataggtgaaagcagcccaaacccaactgtggaggcaggtcgaaccctacgtgtacttaacctagttgaaaattggttaaataacaatacgcaattttgcataaaagttttaaatccgtacatgccatcagttatcgaaaaaatggaagctttacaaaggaaatacggcggtgcattggtgagaaatccattatctcgaaattccacacatgaaatgtattgggtgagtaatgccagtggtaacatcgtatctagtgtaaatatgataagtagaatgttaataaatcgattcacaatgagacacaaaaaagcaacgtacgagccagatgtagatttggggagcggcacacgaaatataggaatagaatccgaaacaccgaatctagacataataggtaagcgaatagaaaaaataaaggaagaacacgaaacctcatggcactatgaccaggatcacccgtacaaaacgtgggcttatcatggttcttatgagacaaagcagaccgggtcggccagtagtatggtaaatggagtcgttcgacttcttacaaaaccatgggatgtgctgccgaccgtgactcagatggcaatgacggacacaacccccttcggccaacagagagtattcaaggaaaaagttgacactcgaacgcaagaaccaaaagaggggacaaaaaaattaatgaaaataacggcagaatggctttggaaggaactgggtaagaagaaaacccctagaatgtgcacccgcgaagagtttacccgtaaagtacggtcaaatgctgcccttggggccatctttactgatgaaaacaaatggaaatccgctcgcgaggcagttgaagatagccgattttgggaactggtagataaagaacgcaatctacaccttgaaggaaaatgtgaaacttgtgtatataacatgatgggaaagagagagaagaagttgggggagtttggaaaagcaaaaggaagtagagcgatctggtacatgtggctcggagctaggtttctagaattcgaagccttaggattcttaaacgaagatcactggtttagtagagagaattcactcagtggggtagaaggagaaggactacacaaactggggtatatattaagagacgtttctaaaaaggagggaggagcaatgtacgctgacgacactgcagggtgggacactcgaatcacgctagaggacctcaaaaacgaagaaatggtaacaaatcacatggaaggcgaacataaaaaactggcagaagcaatatttaaactaacgtaccaaaataaagtagtgagagtacagcgacccacacctcgagggacagttatggacatcatttcaaggagagaccagcgaggctctggacaagtgggaacctatgggcttaacacgttcacaaatatggaagcacaacttattagacaaatggaaggagagggcgttttcaagaatatccaacatctaaccgtgacggaggaagcagcagtgcaaaactggctagcaagagtcggtagagaacgtctaagcaggatggctattagcggagacgattgtgtcgtaaaaccgctggatgatagatttgctaacgccttaacggctttaaatgacatgggtaagattagaaaagatatacagcaatgggaacccagtaagggatggaatgactggacacaggtaccattttgctctcaccatttccacgagctaatcatgaaggatggacgagtgctcgtagtaccatgccgtaatcaagacgaattaattggaagggccagaatatctcaaggcgctggatggtcactgagagaaacagcatgcttaggtaagtcctatgcacaaatgtggagcctaatgtatttccatagaagagatctccggttggctgccaatgcaatttgcagtgccgtaccatcacattgggtaccaacatcaagaactacttggtcaatacatgctaaacacgaatggatgaccactgaggacatgttgacagtttggaatagagtttggatacgagagaatccatggatggaggacaaaacgccggtcgaaagttgggaagaaatcccgtatttaggtaaaagagaagatcaatggtgcggaagcttaatcggactgacatcaagagctacgtgggccaagaacattcaagctgcaataaatcaggtacgttctctgataggaaacgaggagtatacagattacatgccctcaatgaagcgatttaggagagaggaagaagaagctggcgttttatggtaa

SEQ ID NO: 22349 - RNA, 9876 nt, synthetic construct
  misc_feature 1..9876: note = derived and/or modified CDS sequence (opt6) from DENV-2__JF730047__SS-prME
  source 1..9876: mol_type = other RNA
agcgcaggaatgattataatgttaatacctacagtgatggcttttcatttgacaacacggaatggtgaaccccatatgattgttggtattcaagaaaaaggaaagagcttactcttcaaaactgaagatggagttaatatgtgtacattaatggcaatggacctaggagaactttgtgaagatactatcacttacaaatgcccgctcttgaggcaaaatgaacctgaagatatcgactgctggtgcaattctacatccacgtgggttacgtacggaacatgtactactacaggcgaacataggcgggagaaacgctcagtcgcgttagtaccacatgttggcatgggattagaaacacggactgaaacttggatgtcgtctgagggcgcctggaaacatgcacaacgaatagaaacatggatattgcgtcatcctggattcactattatggcggctatcttggcatacacaattgggaccacacactttcaaagagcgttgatctttatactattaactgcggtagcaccaagcatgacaatgagatgtataggtatttcgaacagggactttgtagagggcgtaagtggaggaagttgggttgatattgtactagaacacggatcttgcgttacgacaatggccaaaaacaaacctacattagactttgagcttatcaaaacagaggcgaaacagcctgcgactttaagaaaatattgtatagaagcaaaattaacaaatactacaacagaaagccgctgtccaactcaaggcgaaccgtctttgaaagaagaacaagataaacgttttgtttgtaaacactcaatggtcgatcgggggtggggaaatggatgcggcttattcgggaaaggaggaattgtcacgtgtgctatgttcacctgtaagaaaaatatggaaggcaaaatagtgcaaccggagaatctcgagtacacaattgtcgttacaccacactctggcgaagaacatgctgttggaaatgacacgggaaaacatggaaaagaaatcaaagtgacaccacaatcgagcataaccgaagccgaactaactggttatggaactgttacaatggagtgcagtccaaggacaggtctagattttaatgaaatggtcctcttacaaatggaatctaaagcctggctcgtccatcgacagtggttcttagacctaccacttccatggctacctggtgcagataaacaaggatctaattggatccagaaagagacgttagtcacatttaaaaatccacatgccaagaaacaggatgtggtagtgttaggaagccaagagggggcaatgcacacagcgttaacaggcgcaacggaaatacagatgagttcggggaatctactatttacaggtcaccttaaatgcagactccgtatggataaactccaactaaaaggaatgtcatactcaatgtgtacaggaaaattcaaagttgtaaaagaaattgccgaaacacaacatgggacaatagtgataagggttcagtacgaaggagacggtagcccctgcaaaataccattcgaaattatggacttagagaaaaggtacgtactaggacgattgataacggtcaacccgatcgttactgagaaagatagcccagtaaatatagaagccgaaccaccgtttggtgacagttatataattattggagtagagcccggtcaactaaaattaaattggttcaagaaagggagtagcataggacaaatgtttgaaacgacaatgagaggagcaaaacgaatggctatcttgggcgacacagcctgggattttgggtcattaggcggagtttttacatcaattgggaaagcacttcatcaagtattcggcgctatttacggagctgctttcagcggcgtttcgtggactatgaaaatcctaataggggtaataataacttggataggtatgaacagccgcagcacatctttatcggtaagtttagttctagtgggaatcgtgaccctatatctcggcgtaatggtccaagcagatagtggatgtgtagtctcatggaaaaataaagaattaaaatgcggctccggaatatttataacggacaatgtacacacctggacggaacagtacaaatttcaaccagagagtcctagcaaattagcaagcgctatacaaaaagcccaagaagaagggatttgtggaataagaagtgtaacaagattggagaacctgatgtggaaacaaattacaccagaactaaatcacatattagccgaaaatgaagtaaaattaaccattatgactggcgatattaaaggcattatgcaagcaggaaaacgcagtttacgcccacaacctacggagctcaaatactcatggaaaacatggggaaaagcgaaaatgcttagtaccgaatcacataatcagacttttctcatagatggaccggaaacagctgaatgcccaaacactaacagagcatggaatagtttagaagtagaggactacggatttggagtatttactacaaatatatggctaaaactaaaagagaaacaagatgctttttgcgactccaaactgatgtctgcggcaataaaagataatagggctgttcatgcagacatgggatactggatcgaaagtgcgttaaacgatacatggaaaatagaaaaggccagttttatagaagtaaagaactgtcactggcctaaaagccatactctatggtcaaacggagttctcgaaagtgagatgataatacctaaaaatttggctggcccagtgagtcaacataactatcgacctgggtatcacactcagaccgccgggccatggcacctcggtaaattagaaatggattttgacttttgcgacggcaccactgttatagtgacggaggattgtggaaaccggggtccgagcctccgcacgacaacggcgtcaggaaagctcataacagaatggtgttgtagatcatgcactctgccacccctaaggtatagaggggaggatggatgttggtacggcatggagatacggcctctgaaggaaaaagaagaaaatcttgtcaattcacttgtaacagcaggccacggacaagtggataattttagtctgggagttttaggtatggccctttttcttgaagaaatgttacgaacacgggtaggcactaaacatgctatattacttgtcgccgtgtcattcgttacacttataacaggcaacatgtcctttaaggacctgggacgtgtagtagttatggtggggactacaatgactgatgacataggaatgggtgtaacctacctagccctattagccgcatttaaagtgcgtcccacattcgctgctggtctattgttaaggaaattgacaagtaaagagttgatgatgacaactatagggattgtactattatcacagagtacaattcccgagactattttagaactcactgacgcccttgctctagggatgatggtcttaaaaatagtaagggacatggaaaaatatcaactagcagtcacgatcatggcaatactatgtgtaccaaacgcggtcatcctgcaaaacgcgtggaaagtgagctgcacaatactagctgtcgtatctgtttccccactactactaacgagcagccagcagaaaacagactggattccattagcactcactattaaaggtctcaatccaactgcgatcttcttaaccaccctgtctaggacaaataagaaacgaagctggccactcaatgaggcaataatggcagttggaatggtttccatcctagcgtcatcattactgaaaaatgacatacctatgaccggacccttggtagctggtggtctattaactgtatgttacgtattaacgggtagatccgccgacttggaactagagcgagccaccgacgtaaaatgggaagaccaagctgagatatcaggatcatcaccaattttatcaatcacaatatccgaggatggatcaatgtcaatcaaaaatgaagaggaagaacaaacactaacaattttgatacgaaccggtttactcgtaatcagcggattatttccagtttctattcccattacagcggccgcctggtatctctgggaagtaaagaaacagcgagcgggagtactgtgggacgtaccatcaccacccccgatgggcaaagccgaattagaggatggggcttacagaatcaagcaaaaagggattttaggatactcgcaaataggggcaggagtatacaaggaaggaacctttcacactatgtggcatgtcaccagaggggcagtgctaatgcataaaggaaaaagaatcgaaccttcgtgggccgacgttaagaaagacttaatttcatatgggggagggtggaaattagaaggagaatggaaagagggtgaagaagtacaagtcctggcccttgaacctggtaaaaacccaagagcagtgcagacaaaaccaggcttatttaaaaccaatacaggaaccatcggagctgttagcctagatttcagtcccgggacaagtggaagccctattattgataagaaaggaaaagtcgttggattatacggtaatggtgttgtaaccaggagtggcgcttatgtcagtgcaatagcgcaaacggagaaaagtattgaggacaacccagagatagaggacgacatatttaggaaacgtcgcttgaccattatggacttgcaccccggtgcaggaaagacaaaaaggtacttgccagcgatcgtccgtgaagcaatcaagagaggattacgaaccttaatactggcaccaactcgcgtagtggctgcggagatggaggaggccttgcgtggtctcccaatacgttaccaaactcccgctatccgcgccgaacatactgggagggaaatagtagacctcatgtgccatgccacttttacaatgaggttactaagtccggtaagagttcctaactacaatcttattattatggatgaagcccacttcaccgacccagcttcaattgctgcaagaggatacatctcaacccgcgtagaaatgggtgaggcagcaggcatatttatgacagcgacaccacccggctcaagagatccgtttccacaatccaatgcacctattatagatgaagaacgagaaatacctgaacgatcctggaataccgggcatgagtgggttactgattttaaaggaaagaccgtgtggtttgttccgagtatcaaagcaggcaatgatattgctgcatgtttaaggaaaaacggcaagaaagtaatacaactaagtagaaagacctttgatagtgaatacgtaaaaacaagaacaaatgattgggatttcgttgtaaccacagatataagtgaaatgggtgctaattttaaagcagagcgagtaatagaccccagacgttgcatgaaacctgtaatattaacagatggtgaagaacgagtaatactggcgggacccatgccggttacacacagttcggcggcacagagacggggtcgaatagggaggaatcctaaaaatgaaaatgaccagtacatctacatgggagagccactagaaaacgatgaggactgtgctcattggaaggaagcaaaaatgttacttgataatataaatacaccggaaggaataatacctagtatgtttgaacccgagagagaaaaagtagatgctattgacggagaatataggcttcgaggtgaggcgcgtaagactttcgtagatttgatgcgaagaggggacttacctgtatggttagcatacaaagtcgcagcggaaggtataaattatgcagaccgcagatggtgctttgatggtatcaaaaataatcaaatattagaggaaaatgttgaagtagaaatatggactaaagaaggagaacggaagaaacttaaacccagatggttagatgcaagaatatactcagatcccctagcattaaaagaatttaaagaatttgccgctggtcggaaaagcctgaccttaaatttgattactgaaatgggccgcctcccaacattcatgactcagaaaacgcgggacgcactagataatttagctgtgttacatactgccgaagcaggaggcagagcgtataatcacgcactcagtgagctacccgaaacgctggaaacacttctactacttacattactagctacggtaaccggcggaatattcctatttcttatgagcggacgaggaataggtaagatgacactgggcatgtgttgtattatcacagcgagtatactcctatggtacgctcaaattcaacctcactggattgccgcttcgataatcttggagttcttccttatcgtactcctcataccagagcccgaaaaacaacgaacgccacaagataatcaactaacgtatgtagtaattgcaatacttactgtagtggctgcgacgatggctaacgaaatgggattcctggagaaaaccaagaaagacctagggttaggatcaatcgcaacgcaacaacctgaatccaatattttagatatagatttacgtcctgcttctgcttggaccttgtatgccgtcgcgactacgttcgtaacaccaatgttgcgccatagtattgaaaatagttcagtaaacgtttcactcacagcgatagcaaaccaagccactgtgttaatgggactaggaaagggatggcccctctcaaaaatggacattggagtaccgctcttagcaattggatgttactcccaagtaaacccgatcaccctcactgcagcactgctgctcttggtcgcacattatgctataataggaccaggactccaagcaaaggccacgcgggaagctcagaaacgtgctgcggctggaataatgaagaacccgaccgtcgacggaatcaccgtaatcgatttagatccaataccatacgatcctaaatttgaaaagcaattaggtcaagtcatgctcctgatcctatgtgttacacaagtattaatgatgcgaactacttgggcactttgtgaagcattaacactagctacgggccctatatctacattatgggaaggaaaccctggacgattctggaacacaacaattgcggtttcaatggcaaacattttcagaggaagttatttagcaggagctggactactattttccattatgaaaaacactacaaacaccagacggggtacaggaaacatcggagagaccttgggagagaaatggaagagtagattaaacgcattaggaaagtctgagttccaaacttataagaaatcggggatccaagaagtcgatagaacattagcaaaagagggaattaagagaggtgaaacagaccaccatgctgtaagccgcggctcagcaaaattacgatggttcgtagaacgcaatatggtaaccccagagggaaaggttgtggatctcggttgtggccgtgggggatggtcctattactgcgggggactcaaaaatgtccgtgaagtaaaaggtctaacgaaaggaggacctgggcatgaagaaccaattcccatgagcacttatggatggaatctagtacgattgcagtcaggggttgacgtattctttataccgcctgaaaaatgtgatacactgttgtgtgacatcggggaaagcagtccaaatcctacggtagaagccggaagaacattgagggtactgaatctggtggaaaattggttaaataataatacacagttttgtataaaagtactcaacccatatatgccgagcgttatagagaaaatggaagcattacaaagaaaatatggtggagcactggttagaaatcctctgagtagaaattccacacatgaaatgtattgggtatcaaatgctagcgggaacattgtatcaagcgtgaatatgatatcaagaatgctaattaataggttcacgatgagacacaagaaagcgacgtatgagccagacgtagaccttggatcaggaacccgcaacataggtatagagagcgagataccaaacctagacattatcggtaaaaggatagagaaaataaagcaggaacacgaaacctcgtggcattatgaccaggatcatccatacaaaacatgggcttaccacggaagttacgaaacgaaacaaaccgggtctgcaagctcaatggtaaacggagtcgtaaggctacttactaagccatgggatgttttaccaacagtaacacaaatggctatgacagacacaacacccttcggacagcaacgtgtgtttaaagaaaaagtagatactagaacacaagaaccaaaagaaggtactaagaagctcatgaaaataaccgcagaatggctgtggaaagaattaggcaagaagaaaacacctagaatgtgcactcgagaagaatttattagaaaggtaagatcaaacgctgccctaggggcaatttttacagatgaaaataaatggaaatcagctcgtgaagcggtagaagactcgcggttctgggaattggtggacaaagaaaggaatctacatttagaaggcaaatgcgagacttgtgtgtataatatgatgggtaaaagagagaagaaactcggagaatttggcaaagccaaaggatcgagagcgatatggtacatgtggttaggtgctcgattcctcgaatttgaggctttaggattcttaaatgaagatcattggttctcacgcgaaaactcactatctggtgtcgaaggtgaaggactgcataaacttggctatattctccgagatgttagtaagaaagaaggaggagcgatgtatgccgatgatactgccggatgggacacacgcatcacactcgaagatctgaaaaatgaagagatggtaacaaatcacatggaaggagaacacaagaaactagccgaagccatctttaagctaacttatcaaaacaaggttgtcagagtacagaggccaaccccacgcggaactgtaatggatataatcagcaggagagatcaacgtggctctggccaagtcggaacatacggtctaaatacatttaccaatatggaggcacagttgataagacagatggagggagaaggtgtctttaagaacatacaacatttgaccgccacagaagaggtagcggtcaaaaactggttggccagagtcggaagagaaagattaagtaggatggcaattagcggtgacgactgtgttgtgaagcctctagatgaccgctttgctaatgccttaactgccttaaatgatatgggaaaaatcagaaaagatatacagcaatgggagccatcaaagggttggaatgactggacacaagttccattctgttctcaccattttcacgaattaattatgaaggatggaagagtgttagtagtaccatgccgaaatcaagacgaattaatcgggagggcaaggatttcgcaaggcgcaggctggtctctaagagaaacagcgtgcttggggaaatcttatgcacaaatgtggtctctaatgtactttcatcgtagagacctgcgattggctgcaaacgctatatgttcagccgtcccatcacactgggttcccacaagtcgtacaacctggagtatacacgccaagcatgaatggatgacgacagaggacatgctcacagtatggaatagagtatggatacgagagaacccatggatggaagataaaaccccagtcgagtcttgggaagaaattccctatctaggcaaacgagaggatcaatggtgcggctcgttgattggcttaaccagcagagctacatgggccaaaaatatccaagctgctattaaccaagttcgatcactcataggtaatgaagaatatacggattacatgccaagtatgaaacggttccgccgagaagaagaagaagcaggggtcttatggtaa

SEQ ID NO: 22350 - RNA, 9876 nt, synthetic construct
  misc_feature 1..9876: note = derived and/or modified CDS sequence (opt6) from DENV-2__JF730048__SS-prME
  source 1..9876: mol_type = other RNA
tcagcgggtatgattataatgctaattcctacggtgatggcattccacctaacaacccggaatggtgaacctcacatgatagttggtatacaagaaaaaggaaaatcattacttttcaaaaccgaagatggagtgaatatgtgtacactaatggcaatggatttaggagaattatgcgaagatacaataacttacaaatgccccttactacgacaaaatgaaccagaagatatcgattgctggtgcaattcaacaagtacctgggttacgtatgggacatgtactaccactggagaacacagacgtgagaaaagaagtgtggctttagtccctcatgtgggcatggggttggaaacccggactgaaacttggatgtcgtccgaaggcgcatggaaacatgctcagcgtattgaaacttggattcttcgacacccgggtttcactatcatggctgcaattctagcatataccataggaacgacccactttcagagagcattgatatttattctactaacagctgtggcaccttcaatgactatgagatgtataggaatttcaaatcgagactttgtggaaggtgtgtctggaggctcatgggtagacatagtattagaacatgggtcttgtgtcactacaatggccaaaaataaaccaacattagacttcgagttaattaaaactgaggcaaaacaaccagcaaccttaagaaaatactgtattgaggctaaactaactaacaccacaactgagtctagatgtccaacacaaggagaaccaagtctgaaagaagaacaggacaaaagattcgtatgtaaacactcgatggtggaccgaggatggggcaatgggtgcggcctatttggtaaaggaggcatagtcacatgtgcaatgtttacatgtaagaagaatatggaagggaaaatagttcagccagaaaacctagagtatactatcgtcgtcacaccccatagcggagaagaacacgccgtaggaaacgatacgggcaaacatggaaaagagatcaaagttactcctcaatcgagcataacagaagccgaattaactggatatgggaccgtcaccatggaatgttccccaagaacggggctggactttaatgaaatggtacttcttcaaatggaatccaaagcctggctagttcatcgccaatggttcttagatcttccattaccatggttacccggagccgataaacaaggatccaattggatacaaaaagaaacacttgtaacttttaaaaacccccatgctaagaaacaggatgtggtagtcttaggaagccaagagggggcaatgcacacggccttgactggagcgacagaaatccaaatgagcagcggtaacttattgtttaccggtcatttaaaatgccggctccgaatggataaattacaactgaaaggcatgagctatagtatgtgtactggtaaattcaaagttgtgaaagaaatagccgagactcagcatggaactatagtaatccgggtccaatatgaaggtgatggatcaccctgcaaaatcccttttgaaataatggatctcgagaaacgttatgtcctaggacgtctgattactgtgaatcctatagttactgagaaagatagccctgttaatattgaagccgaaccacccttcggagactcatacatcattatcggggtagaacccgggcaactaaaactaaattggttcaagaaagggtcaagtataggacagatgtttgaaacaaccatgcgtggagcgaaaaggatggcaatcttaggcgatacagcttgggattttgggtcactagggggagtattcacatcgattggaaaagcattacaccaagtatttggggccatctatggtgcggcattttccggggtaagttggactatgaaaatcctaataggcgtcataattacttggataggaatgaactccagaagtacaagtctaagtgtctcattagtactggtaggaatagtcacattatacttaggtgtgatggtccaggccgacagtggctgtgtagtatcatggaagaacaaagaacttaaatgcggtagcggaatattcataaccgacaatgtgcatacttggactgagcaatataagttccaaccggaatccccctcaaaattggctagtgcaatccaaaaagctcaagaagaagggatttgtggaattagatcagtaacaagactagaaaatttgatgtggaaacaaataacaccagaactaaaccatattttagcagaaaatgaagttaaactaacaattatgacaggtgacataaaaggcataatgcaggctggaaaaagaagcctccgaccgcaacctacagaattaaaatattcgtggaaaacatggggaaaagctaagatgctttcaaccgagtcacacaatcaaacatttctaatagacgggcctgaaaccgcggaatgccccaatactaacagagcctggaatagcttagaagtcgaagattacgggtttggcgtctttaccacaaacatttggcttaagttaaaagagaaacaagacgcattctgtgactcgaaattgatgtcagccgcgataaaggacaacagggcggtccacgcagacatgggatactggatcgaatcggcccttaacgatacatggaaaatagaaaaagcgagctttatcgaagttaaaaattgccactggcccaaaagccacacactatggagcaacggggtcctcgaaagcgaaatgataatccctaagaacttggcagggcctgtctcgcaacataactatagacctggataccatacgcaaacagcgggcccttggcatttaggcaagctagaaatggacttcgatttttgcgatggaacaacagtcatagtaacagaagactgtggtaatcgcggcccatctttacgtacaacgacagcaagtggtaaattgataactgaatggtgttgtagaagttgtacacttcctccattgcgataccgtggagaagacgggtgctggtacggcatggaaatacgacccttgaaggaaaaggaagaaaatctagtaaattcattagttactgccgggcacggtcaagtagacaacttttcgctgggcgtattaggaatggcattattcctcgaagaaatgcttagaactcgcgttggtacaaaacatgcaattctcttggtagcagtttcattcgttacccttattactggcaacatgtctttcaaggatttaggacgtgtggtcgttatggtaggaaccactatgaccgatgatattggtatgggagtcacttacttagcattattagctgcattcaaagttagaccaacctttgcagcgggtttattgcttcgtaaacttacatccaaggaacttatgatgactaccattgggattgtcttattgtcgcaatcaacaatcccagaaacaatattggaattaacggacgctttagcactcggaatgatggtgttaaaaatcgtaagagacatggagaagtatcaactagcggttactataatggctatattatgcgttcccaatgcagtgattttacagaacgcatggaaagtaagttgtaccatcttagcagtggttagcgtcagtcctttgttacttacctctagtcaacagaaaactgattggataccgctagctttgactatcaagggacttaatccaacggcaatattcctaacaaccctaagcagaacaaataagaaaagatcatggccacttaacgaagctattatggcggtaggaatggtttcaatcctggcatccagcctactcaaaaacgacataccaatgactgggcccctcgttgcaggaggactcctaacagtttgttacgtactcacaggaaggtcagctgatttagaacttgagagagctacagatgtgaagtgggaagaccaagcagaaatatctggatcgtctccgattctgtcgataactataagtgaagatggttccatgtcgatcaaaaatgaagaagaagaacaaaccttaaccatcctaatacgtacaggcctccttgtaataagtggacttttccctgtgtcgattcccataacagctgccgcgtggtacctatgggaagtcaagaaacaacgtgcaggagtcttatgggatgttccgagcccaccgcccatgggaaaagctgaactggaggacggcgcttataggataaaacagaagggtattttaggctactcacaaatcggtgctggtgtatacaaagagggaaccttccatactatgtggcatgtcacaaggggagcagtcctaatgcataaagggaagcgaatagaaccttcatgggctgatgttaagaaagacttgatatcatatgggggcggctggaaactagaaggagagtggaaggaaggcgaggaagtgcaagtacttgcgttggagccgggcaaaaatcctagagcagtacagacaaaaccaggacttttcaagactaacactggaactataggggcggtttcattagacttctctccaggtacatcaggatcaccaataatcgacaagaaagggaaagtcgttggactatacggtaatggagtggtaactcgatccggtgcatatgtatccgcaatagctcaaacagaaaaatccattgaggataacccagagatcgaagatgatatattccgaaagaggagactaacaataatggaccttcatccaggggccggaaaaaccaaaagatacttacccgcaattgtcagggaagcaataaaacgtggtctacgaactctgatactagcgcctactagagttgtcgcggcagaaatggaagaggctttaagaggacttcccataaggtaccaaacgcctgcaatccgtgcggaacatacaggaagagaaattgtagatctaatgtgccatgcaacatttactatgcgcctattgagtcctgtacgagttccgaattataatctaataatcatggatgaagcacattttacagatccggcatcaatagctgccagggggtatattagtacacgagtagaaatgggtgaagctgcaggcattttcatgactgctacaccccctggatccagagattccttcccgcaatctaatgctccaatcatagatgaagaacgagaaataccagaacggagttggaatacggggcatgaatgggtaacggactttaaaggaaagaccgtttggttcgtaccaagcatcaaggccggtaacgatatcgctgcatgtttaaggaaaaatggcaagaaagttatacagttaagcagaaagacattcgactcagagtatgtcaaaacgagaaccaatgattgggatttcgtagtaacgacagacataagtgaaatgggtgctaattttaaagcagaacgggtaatagacccaaggagatgcatgaaacccgtaatattaacagacggtgaagaaagggtaatcctagctggcccgatgccagtaacacatagctccgccgcacagaggagaggacgcataggccgcaatcccaaaaacgaaaacgatcaatatatatacatgggcgagccactggaaaatgatgaagattgtgctcattggaaagaagcaaaaatgctactagacaatatcaacacccccgagggcatcataccgtcaatgtttgaacccgaaagagaaaaagtggacgcaatagatggagagtaccgcttaagaggcgaggcgcgaaaaacatttgttgatttaatgagacgaggagatttgcccgtttggttggcttataaagttgctgctgaaggaattaattatgctgatcggaggtggtgttttgatggaattaaaaataatcaaatattagaagaaaatgtggaagttgaaatatggactaaagaaggagaaaggaaaaagttaaagccaaggtggttggatgcaaggatatactccgacccattagccctcaaagaatttaaggagttcgccgcggggcgaaaaagtctgaccctaaatctaatcacagaaatgggcagattacccacgtttatgacacagaaaactagagatgctttagataaccttgcagtcttacatacagcagaagcgggtgggagggcgtataaccacgctctgtcagaattaccagaaactctagaaacattattattacttacactcttggccactgtgacagggggaatatttttatttttaatgtctggacgaggcataggcaagatgacgttaggaatgtgttgcataataaccgcctcaattctgctatggtatgctcaaatacaacctcattggattgcagcgtcaataattctagagttctttctaatagttctgttaatacctgaacctgaaaaacaaaggactccacaagacaaccaactaacatatgtagtcatagctatcttgacagtcgtagctgccacaatggctaatgagatgggatttctagaaaagactaagaaagacctgggtctaggatcgattgctacacaacaacctgaaagcaacattctggatatcgatttgagaccagcttcagcttggactttatacgcagtcgcgacaacattcgttacaccgatgctaagacattcaatagaaaacagctcggtcaacgtctctcttacagccatagccaatcaagcaactgtactgatgggcttagggaaaggatggccactttccaaaatggacattggagtgccactgttagcaatagggtgttatagtcaagtaaatccgataaccttaacagcagcattactattgttagtcgcccattacgctattataggtcccggattgcaagcaaaggctactagggaagctcaaaaacgagctgccgcaggtataatgaagaacccgactgtcgacggaataactgtaattgatttagatcccattccctacgaccccaagttcgaaaaacaacttggtcaagttatgctgttaatattatgcgtaactcaagttcttatgatgcgaactacatgggctctatgtgaagcgttaactctggcaacaggccccatatcgacgctttgggagggaaatccaggaagattttggaatacgacaattgcagtctcaatggcaaacatttttcgaggtagttacctcgccggtgcgggacttctctttagtattatgaagaatacgactaatacacgtaggggcactggcaacataggagaaacgctaggtgaaaaatggaaatcaagattaaacgcattggggaaatcggagttccaaacttataagaaaagtggaatacaagaagtcgatcgaacgttagcaaaagaaggcatcaaacgtggcgaaacagatcaccatgctgtatctagaggttcagccaaactgcgttggttcgtggaaaggaatatggtcacaccagaagggaaagtagtcgatctaggatgtggaagaggagggtggagttattattgcggaggtctcaaaaatgtgagagaggtcaaaggtttgacgaaaggtggaccaggacacgaggagcccatccccatgtcaacatatgggtggaacctagtcagattacaatctggagtagatgtcttctttataccaccagaaaaatgcgacaccctcttgtgtgacataggagaaagctcaccaaatccgacagtagaggctggacgtacgttgagggtacttaacttagtagaaaattggttgaacaacaacacgcaattttgtataaaagtactgaacccctacatgccttcagttattgaaaagatggaagcgcttcaacgaaagtatggtggagcattagtgagaaaccctctgtctaggaactctactcacgaaatgtattgggtatcaaatgcgagcggcaatatagtatcaagtgtaaatatgatttccagaatgcttataaatcgtttcacaatgcgtcataaaaaggcgacatatgagccggacgtagaccttggatctggaacgagaaatataggtatcgaaagtgagataccaaacttggacattatcggtaaacgaatcgagaagataaaacaggaacacgaaacgtcgtggcattatgatcaagatcatccatataaaacctgggcttaccacggcagttatgagacaaaacaaacggggagcgccagcagtatggttaatggggttgtgagattacttacgaaaccgtgggacgtattacccaccgtcacacaaatggcgatgacagacacgacaccgtttgggcaacaaagagtttttaaagaaaaagtcgatacccgaacgcaagaacccaaggaaggcaccaagaaactaatgaaaattacggccgaatggctatggaaggaattaggtaaaaagaaaactccgagaatgtgcacacgagaagagttcacgagaaaagtcaggagtaatgctgcattaggagcaatattcacagacgaaaataagtggaaaagtgcacgtgaagcagttgaagatagtcggttttgggagctggtagacaaggaaagaaatctacatctagaaggtaaatgtgaaacttgcgtgtataacatgatgggtaaacgagagaagaaattaggagagttcggaaaagcaaagggaagccgggctatatggtatatgtggttgggggccagatttttggaatttgaagcattagggtttttaaacgaagatcattggtttagtcgtgaaaattcactgagtggggtagaaggagaagggctccacaaattaggatacattctacgagatgttagtaagaaagaaggaggtgcgatgtacgcagatgatacagccggctgggatactcgtatcactctcgaagacttaaagaatgaggaaatggttacaaatcatatggaaggtgagcataagaagctagccgaggcaatcttcaaactgacttatcaaaacaaggttgtcagggtacagaggcctacacctcgtggtacggttatggacataattagtcggagggaccaaagggggagtggacaagttggtacatacggacttaacacatttacgaacatggaagcgcaactaataaggcaaatggaaggtgaaggggtatttaaaaatatacaacatctcactgcaactgaagaggttgcagtgaagaattggcttgccagggtaggccgtgaaaggttatcaagaatggcaattagcggcgacgattgtgtggtaaagccattagacgatcgatttgctaacgcattaacagcgctcaatgacatgggcaaaataagaaaagatatacaacagtgggaaccctcaaagggttggaatgattggacacaagtcccattttgtagccatcatttccatgaacttataatgaaagatggtagggtgttagtagttccgtgccgtaatcaagacgaattaataggaagggcacgaatatcacaaggagcagggtggtcattacgtgaaactgcatgcttaggaaaaagctatgctcaaatgtggtcattaatgtattttcatcgtagggacttacgtttagcagctaacgcgatatgttctgcggtaccgagtcattgggtaccgacaagtagaaccacttggagtatacacgcaaaacatgaatggatgacgacagaagacatgctaaccgtatggaatagggtatggatcagggagaacccatggatggaagacaagacacccgtcgaatcatgggaagaaataccttacttaggcaaacgtgaagatcaatggtgcggttcattaataggattaactagcagagcgacctgggctaagaatatacaagctgctataaatcaagtaagatcgctaatcggaaatgaagaatacacagattacatgccatcaatgaaaagattccggagggaagaagaagaagcaggggtactctggtaa

SEQ ID NO: 22351 - RNA, 9876 nt, synthetic construct
  misc_feature 1..9876: note = derived and/or modified CDS sequence (opt6) from DENV-2__KF955402__SS-prME
  source 1..9876: mol_type = other RNA
agtgctggaatgataatcatgcttattccaaccgttatggcattccatcttactacgaggaacggtgagccccacatgattgtaggcatccaagaaaaaggtaaatcactactattcaaaaccgaagatggggtaaatatgtgcacattgatggctatggatcttggcgaattgtgtgaagataccattacatataaatgtccattactccgacagaatgaacctgaagacattgattgctggtgcaacagcacatcaacttgggtaacatatggaacttgtactactacaggtgaacaccggagagagaaaagaagtgtggcattggtgccacacgtaggaatgggccttgaaactcgaacggaaacttggatgtcctcggaaggtgcgtggaagcatgcacaaaggatcgagacatggattctcaggcatccaggcttcacaataatggccgcaatattagcctatacaataggaacaactcatttccagagagtcttaattttcatcttgcttacagcagtagcaccttcaatgacaatgcgatgtatcggtatttccaaccgtgtttttgttgaaggtgttagcggtggatcatgggttgatatcgtactggaacacggatcctgcgtaacaaccatggcgaaaaacaaaccaacattggatttcgaattgataaaaactgaagcgaaacaaccagcaacactaaggaaatattgtatcgaagcaaaactaactaacactactacagagtctagatgtccgacccaaggcgaaccctcacttaaagaagaacaagataaaaggttcgtatgtaaacactcgatggtagatcgaggatggggaaatggttgtggactatttggaaaggggggcatagtcacctgtgctatgtttacatgtaaaaaaaatatggaaggtaaaatagtccaaccggaaaatcttgaatatacaattgtggtcaccccacattctggagaggaacatgcagtaggcaatgatacaggaaaacacggaatggaaataaaggttaccccacagagtagtattactgaagccgaattaactggttatggcacagttacgatggaatgttcaccaaggactggtttagatttcaatgaaatggtattgctccagatggaaaataaagcttggttggtacataggcaatggtttcttgaccttccattgccatggttaccgggagccgacaaacaagaatctaactggattcaaaaagagaccttggtaactttcaaaaatccacatgccaagaaacaggacgtggtcgtcttaggaagccaagagggtgctatgcatacggcattgacaggagctacggaaatacaaatgtcaagtggaaatctactgtttactggacatcttaaatgtaggttgaggatggacaaactccaactcaaaggtatgtcttattctatgtgcacaggtaaattcaaagttgttaaggaaatagcggaaacacagcacggaactatcgtaataagagtacaatacgaaggtgacggtagtccgtgtaaaattcccttcgaaattatggacttagagaaacggtatgtcttgggacgtttgataaccgtcaatcccattgtaacagagaaagattcacctgtaaatatagaagcggagccaccttttggtgattcatatataatcatcggcgttgaaccaggacaactgaaacttaactggttcaaaaaaggaagttcaataggtcaaatgtttgaaactaccatgagaggtgcaaaacgtatggctattctaggggatacagcctgggattttgggtcgttaggaggagtatttacaagtataggaaaggcactgcatcaagtgtttggcgcaatttatggcgtagcatttagtggagttagctggaccatgaaaattttaatcggcgtgataataacatggatcgggatgaattctcgttctacatcactatcggtaagccttgtacttgttggaatcgtgacactttacttgggagttatggtacaggcagatagtgggtgtgttgtaagttggaaaaacaaagaactcaagtgtggaagtgggatatttataactgataatgtccacacctggactgagcaatataaattccaaccagaatctccgagcaagttagcgagcgcaattcaaaaagcccaagaagaaggtatctgcggaattagaagcgttacaaggctggaaaacctgatgtggaaacagataacaccggagttaaaccatatcttggcggaaaacgaagtaaaactaactattatgaccggagatattaagggaataatgcaggcaggaaaaagatctttgaggccacagcccactgaattaaaatactcgtggaagacatggggaaaagcgaaaatgctgtctacagaaagctataaccaaacatttcttatcgatggtccagaaactgcagagtgtccaaacacaaaccgggcatggaatagcctggaagtcgaagattacggatttggggtgttcacgacaaatatatggttaaagttaaaggaaaaacaggacgcattctgcgactcgaagcttatgtcagcggccataaaggataatagagctgtacatgctgatatgggatactggatagaaagtgcgttaaacgatacgtggaaaatcgaaaaggcatcattcatagaagttaaaaactgtcattggccgaagtcccatacattgtggagtaatggtgtacttgagtcggaaatgataattcccaaaaatctagcaggacctgtttcacagcacaattacagaccgggatatcatacccaaatagcaggaccttggcatctaggtaaacttgaaatggattttgatttttgtgatggcactaccgttatagtaacggaagactgtggaaatagaggaccgtctcttagaactaccactgcttcgggtaaattaatcacagaatggtgctgcagatcctgtacgttgccacctctacgttacagaggcgaagatggctgttggtatggaatggaaattcggccgctaaaggaaaaggaagaaaatctagtcaactctttggtgacagctggacacggacaggtagacaatttttcgctcggtgtgttaggaatggcgttatttctggaagagatgctaagaacaagagtcggtactaaacatgccattttactagtagcagtaagttttgttactttaataactggaaatatgtcctttaaggacttagggcgagtagtggttatggtaggagctactatggctgatgacataggcatgggagtcacatatcttgcattattggcagcattcaaggtgagaccaacatttgcggccggccttttattaagaaaactaacaagtaaggaactaatgatgacgacgattggtatcgtgttactaagtcagtcgaccattcccgaaacagttctggaattaactgacgcactagcattaggaatgatggtacttaaaattgttagaaatatggagaaatatcagctagcggtgacgataatggctatcctatgtgtacccaacgcggtgatattgcaaaatgcttggaaagttagttgcacaatactagctgttgtctccgtatcgcccttattattaacatcctctcagcaaaaaactgattggataccattagccctaactataaaaggactgaacccaactgctattttcctaaccacactatcccgtacgaacaagaaaagatcatggcctctaaacgaagctataatggctgtcggcatggtgtctatacttgcatcttctctacttaaaaacgacataccaatgacggggcccttagtcgccgggggacttttaactgtttgttacgtattaaccggaaggtcagcggatttagaactagaaagagcaacagatgtgaagtgggaggatcaagctgaaatttcagggtcgagtcctattctgagtattacaataagtgaagatggatccatgtctataaaaaacgaagaagaagaacagacgcttacaatattaataagaacaggactactagtcatatctggacttttccccatatcaattccaataacggcagccgcatggtatttatgggaagttaagaaacaacgagcaggagtactatgggatgtcccttctcccccccccatgggaaaggctgagcttgaagacggcgcatataggattaaacaaaaaggcattctagggtacagccaaatcggcgcgggagtatataaagaaggaacctttcataccatgtggcacgtgactagaggtgcggttttaatgcataaaggaaaacgaatagaaccaagttgggcagacgtgaaaaaagatttaatatcatatggaggtggatggaagttagaaggagaatggaaagagggtgaggaagtacaggtcctcgcgctggaaccgggaaagaatccaagagctgtacagacaaagccggggttatttaaaactaatactggcactatcggcgcggtaagtctcgacttcagtccgggtacatctggaagcccgataattgataaaaaaggaaaagttgtcggactatatgggaacggcgtagtaacgagatcgggggcttatgtatcagctatagcacaaacggagaaaagcatagaagataacccagaaatagaagatgacatatttagaaaacggcgcctaactataatggatttacaccccggggctggcaaaactaagagatacttaccagcaatcgtaagggaagcaataaaaaggggacttagaacattaattcttgcgccgacaagagtggttgctgcagagatggaagaggcattacggggattaccaattaggtaccaaacaccggcgatcagagcagaacacacgggaagagagattgtagatctgatgtgtcacgcaacattcacaatgcgcttattgagtccagtgcgtgtaccaaactacaatctgattataatggatgaagcgcacttcactgatccggcatcaattgctgcccgcggatatatatccacgagggttgagatgggcgaagcagccggtatttttatgactgctacacccccagggtccagggatccgttcccacaatcaaacgctccgattattgatgaggaaagagagattccggaacgaagttggaattccggacatgagtgggtcacagactttaaaggcaaaacagtatggtttgtaccatcaataaaagcaggcaatgacattgccgcatgtttaagaaagaacgggaagaaggttattcaattatcgcgaaagacttttgattccgaatacgtcaagacaagaactaatgactgggactttgtcgtaacaacagacataagcgaaatgggagcaaactttaaagctgaaagggtgatagatccaaggagatgtatgaaaccagtgatattgacagacggggaagaacgggttatcctagcaggcccaatgccagtaacgcattcctctgcggcgcaaagaagaggcagaataggtagaaacccaaaaaacgagaatgaccaatacatatatatgggcgaaccattagagaatgacgaagactgcgcacattggaaagaagctaaaatgcttttagataatattaatacaccagaggggattattcctagcatgtttgaaccagagcgcgaaaaggtagatgccattgatggtgagtataggttgagaggagaggcaaggaaaacgttcgtagacctgatgagaagaggagatttacctgtctggctcgcgtataaggttgcggcagaagggatcaattacgccgatagacgttggtgcttcgacggtataaaaaataatcaaatactggaagagaatgttgaagtagaaatatggaccaaagaaggtgaaaggaagaaactaaaacccagatggttggacgcaagaatatattcggacccactagcactcaaagagtttaaggaatttgctgcggggagaaaaagcttaacattgaatctcataaccgaaatggggaggcttccaacatttatgacacaaaagaccagggacgcgttagacaatctggcagtattacacacagcagaggcaggtgggagagcttataaccatgctctaagtgaactgccagagacgctggagacccttctactattaacacttcttgcaactgtgacaggaggcatctttctattcctaatgtcaggcagagggataggaaaaatgacgttagggatgtgctgtataataactgcttcgatactattatggtacgctcaaatacaaccccattggatcgctgcatcaataattctagaattttttttaatagtccttttaattcccgaacccgaaaagcaacgaacacctcaagataatcaattaacatatgtggtaattgctatcttgacagtagtagccgcaactatggcgaacgaaatgggttttttagaaaaaactaaaaaagacctagggctaggatcaatagctacacaacagccggaatccaacatcttagatatagatttacgcccagcatccgcatggactctctatgcagtcgctacaacatttgtaactccgatgctaaggcattcaatagaaaattccagtgtaaacgttagcttaacggcaatagcaaaccaggctaccgtcttaatgggcttaggaaaaggatggccgttaagcaaaatggacataggggttcctctactagccatagggtgctatagtcaagtaaacccaataacactcaccgctgccttattattgttggtagcccactatgctataataggacctggacttcaagcaaaagcaactagagaagcacagaaaagagccgccgctggcattatgaaaaacccaacagtagacggcataacagtgattgacctggatcccataccatatgacccaaaattcgaaaaacaactagggcaagtgatgctcttgatactttgtgtaacacaagttctcatgatgaggactacatgggcgctttgcgaagctctgactttagcaaccggaccaataagtacactttgggaaggtaatccgggacgattctggaatacaacgattgcggtttctatggcaaatatttttcgaggttcatatttagctggagccggattactgttttcaatcatgaaaaatacaaccaataccaggaggggtacaggtaatataggagaaactttgggtgaaaagtggaaatcacgtttaaacgccctcggaaaatcagaatttcaaatatataaaaaaagtggaatacaagaggtagaccgcacattagccaaggaaggtattaaaagaggagaaactgatcatcacgccgtatcaagaggcagtgctaaactgagatggtttgtggagcgtaacatggtaacaccagaagggaaagtggtagacctaggatgcggtcgaggtggatggtcatactactgtgggggcttgaagaacgtcagggaagtaaaaggattaacaaaaggcggaccggggcacgaagaaccaataccgatgagtacctatggttggaatctagttcggctacagtcaggagttgacgtattttttataccgccagagaaatgcgatacacttttatgtgatataggtgaaagcagcccaaatcctactgtcgaagcaggcagaacgctacgtgtgcttaacctagtcgaaaactggcttaacaataatactcagttctgcataaaagtactcaacccttatatgccatcagtaatagaaaagatggaggctcttcaacgaaaatatgggggtgctctagtacggaatccactaagtcgaaattcaacacatgaaatgtactgggtcagtaacgcaagtggaaatattgtctcaagtgtcaatatgataagccggatgttgataaaccggtttacaatgagacataagaaagctacctatgaacccgatgtagatcttggatctgggacccgaaacataggtatcgaaagcgagacaccaaatcttgacataataggtaagcgaattgaaaaaataaaagaagagcacgaaacatcatggcactacgaccaggaccatccatataagacgtgggcctaccatgggtcatacgagactaaacaaacaggatctgcatcaagtatggtcaatggcgtagttcgactacttacaaaaccatgggatgtactccccacggtcacacaaatggcaatgacggacactactccattcggtcagcaaagagtatttaaggaaaaagtagataccagaactcaagaacccaaagagggaacaaaaaaactaatgaaaataaccgctgaatggttatggaaagaacttgggaagaaaaaaacgcctcggatgtgtacaagagaagagttcaccaggaaggttagaagtaatgcggctctaggtgccatattcactgacgagaacaaatggaaatcagcaagagaagcagtcgaagacagcagattctgggaattggttgataaagaacgcaatttacatctcgaaggaaaatgtgaaacatgcgtgtataatatgatgggaaaacgagaaaagaaactaggggaattcggtaaggctaaagggagtcgcgctatttggtacatgtggctcggggctagatttctagaattcgaagctcttggatttctaaatgaggatcattggttttcacgagaaaatagtttgtctggagtagaaggtgagggtttacacaaattgggatatatactacgcgatgtgtcaaaaaaagaaggaggggcaatgtatgcagacgatacagctggatgggatacacggatcacgttagaagatttaaaaaacgaagaaatggtaactaaccacatggaaggagagcataaaaaattagcagaagcaatatttaaattaacatatcaaaataaagtcgtaagggtacaacgaccgacaccacgaggtactgttatggatataataagtcgaagggaccagcggggcagcggtcaggtaggaacatatggcttaaacacattcacaaatatggaggcgcaactaattagacaaatggaaggtgaaggggtattcaagaacattcaacacttgacagtcaccgaagaggcggcagtacagaattggcttgcacgcgtaggaagagaacgtctgagtcgtatggcaattagtggtgatgactgcgtagttaagccactagatgaccgctttgctaatgccttaactgcactaaatgacatgggtaagatcagaaaggacattcagcagtgggagccttccaagggatggaatgactggactcaggtaccattctgttcccatcacttccacgaattgataatgaaagacggaagggtgctagtggtgccatgcagaaatcaagatgaattaattggaagagcacgtattagtcagggcgctggttggtctctaagggaaacagcgtgcctgggtaagagttatgcccaaatgtggtcgttaatgtactttcatcgccgagatttacgcttggctgcgaacgcgatatgcagtgcagttccttcgcattgggtccctactagtagaacgacgtggagcatacacgcgaaacacgagtggatgactactgaggatatgctaacggtgtggaaccgtgtttggataagggaaaatccgtggatggaagataaaacacctgttgaatcttgggaagaaataccctatcttggtaaacgggaagatcagtggtgtggtagtctcattggcctcacttcaagagccacctgggcgaagaatatacaagccgcgatcaaccaagtcagaagtctaataggaaatgaagaatacacagactatatgccatcaatgaagcggtttaggagagaggaggaagaagcaggtgtactctggtga

SEQ ID NO: 22352 - RNA, 9876 nt, synthetic construct
  misc_feature 1..9876: note = derived and/or modified CDS sequence (opt6) from DENV-2__FJ898460__SS-prME
  source 1..9876: mol_type = other RNA
actgcgggtgtaattgtaatgctaatccctactgcaatagcatttcatctgacgactagaaatggtgaacctcatatgattgtggggagacaggaaaaaggaaaatcattgctttttaaaacggaagacggggtaaatatgtgtactctgatggcaattgatttgggagaattatgtgaagatactataacgtataaatgtccactgttacgacaaaatgaacctgaagatatagattgttggtgcaatagtacttctacctgggttacctacgggacttgtactaccaccggagaacatcgacgtgaaaaacggtctgtcgctttagttcctcacgtcggaatgggactagaaaccagaacagagacctggatgtccagtgaaggagcttggaaacacgtacaaagaatcgaaacttggattctccggcaccctggatttacaataatggctgcaatattagcttatacaattggtacgactcattttcaaagagctcttatatttattttgttgaccgctgtagcaccctcaatgacaatgaggtgcataggaattagtaatagggatttcgtagagggagtaagcggtggatcctgggtggacatagtcctggaacacggaagctgcgttacgaccatggccaaaaataaaccgaccttggattttgaattaatcaaaacagaagccaaacagcccgcaactctaaggaaatactgcatagaagcaaaactgacaaacacaacaacagaatctcgatgcccaacacaaggggaaccgtcgttaaacgaagaacaagataaaaggttcatatgtaaacattcaatggtcgataggggatggggaaacggatgtggattatttggaaaaggaggaatagtcacatgtgcgatgttcacctgtaagaaaaacatggaggggaaagtagtgcagccagaaaatttagagtatacaatagtaataacaccccattcgggtgaagaacacgcagtaggaaacgatactggtaaacatgggaaagagatcaaaatcactccccaatcaagtataaccgaagccgaattaacaggctacggtactgtgacgatggagtgcagcccgcgtactggcctagattttaatgaaatggtattactacaaatggaggataaagcatggcttgtccacaggcaatggttcttggatttgcctctaccatggttaccaggggccgatacacagggatctaattggatacaaaaagagactctcgtaacatttaaaaatcctcatgccaagaaacaagacgtggtggttttaggaagccaagagggggcgatgcatacagctctaactggagctaccgaaattcaaatgtcaagcggtaacctattatttacaggtcacttaaaatgtagattaagaatggataaattacagttaaaaggtatgagctactctatgtgtacaggaaaatttaaaatcgttaaggaaatagccgagacacagcacggcacaatagtcatacgggtccagtatgaaggagatgggagtccctgtaaaattccgttcgaaataacagacttagaaaaacgccatgtgctgggtaggttaataaccgtcaatcccatagtaacagagaaagattcaccggttaacatagaggccgaaccaccatttggagacagctacataataatcggagttgaaccaggacagttaaaacttaactggttcaagaaagggtcatcaatcggtcaaatgtttgaaacaaccatgcgaggagcaaagagaatggcaattttaggagatacggcatgggacttcggttctctaggaggcgttttcacaagtataggtaaagcattgcatcaagtatttggggcgatatatggagccgcatttaatggagtctcctggactatgaaaatcttaataggcgtcattataacttggattggtatgaatagccgtagtacaagtttatcagtgagtcttgtcttagtaggagttgtcacactctacctcggagctatggtacaggctgactcaggatgcgtagtcagctggaaaaacaaagaattgaagtgcgggagtggcattttcattactgataatgttcatacatggactgaacaatataaattccaacctgaatcgccatcaaaactcgcgtcggccattcaaaaggcacatgaagagggcatttgcggaattagatcagtgacaagactagaaaatctcatgtggaaacaaatcacgccggagttaaatcacatattaagtgaaaatgaagtaaagctcaccataatgactggtgatataaagggaataatgcaagcgggcaaacgtagtctgagaccacagccaactgaactcaaatattcttggaaaacttggggaaaggctaagatgctgagcacagaatctcataatcagacttttctaattgatggaccagaaaccgctgaatgcccgaacactaatagagcttggaacagtctagaggtagaagactatggatttggcgtgttttctacaaatatatggttaaaattgcgagagaaacaggacgtattttgcgactccaaactaatgagtgctgcaatcaaagataatagagcagtccatgcggacatgggatattggatagaatcagctttaaacgatacatggaaaatggagaaagcatcgttcatagaggtgaaaagttgccactggccgaagagtcacactctttggtcaaatggagtattggaatcggaaatgattataccgaagtccttcgccggacctgtaagtcaacataactatagaccaggatatcatacccagacagccggaccatggcatttagggaagttggaaatggatttcgacttttgcgagggaactactgtagtcgtaacggaggactgcggaaacaggggtccatcactaagaacaactaccgctagtggtaaactaattactgaatggtgttgtcgttcatgcacactacctcccctaaggtatcgaggagaagacggctgctggtatggaatggaaatcagaccactgaaagaaaaggaggagaatctagtaaatagcttagtgacagcagggcatggccagatagacaacttttcgttaggggtattgggtatggcactattcttagaagaaatgttaagaactagagtcggtacaaaacatgcgatactacttgttgcggtgtcttttgtaacactaattacaggtaacatgagttttagagatcttggtagagtgatggtaatggtaggtgctacaatgacagatgatataggaatgggtgtaacatatctggccttattggctgcttttaaagtgcgtcccacatttgcggcaggtttattactaagaaaacttacatcaaaagaattaatgatggcgaccatagggatagcccttctctcacaaagcactatgcctgaaactatattagaattaacggatgcattagcgctggggatgatggtccttaagatagtaaggaacatggaaaaataccaattggcagtaaccattatggcaataagttgcgtcccgaatgcagtaatattgcagaatgcatggaaagttagttgcacaatcttggcagcagtttcagtaagtcccttgctgttgacatcatcccaacaaaaggcagattggatacctctagcactgacgataaaaggacttaacccaactgcaatattcttgacaacattgagtcgtacaagcaaaaagaggagctggccactaaacgaagcaataatggctgtaggtatggtgagtattctagcttcaagtttactcaagaatgatattcctatgactggtcctcttgtagctggaggcctgttaacggtatgttacgtattaaccggaagatcggctgacctagaactagaaagggcagctgatgtaaaatgggaggaccaagctgaaatcagcggaagctcccctatattgtcgataacaataagcgaggatggaagcatgagtatcaaaaacgaagaggaagaacagacactaacaatcttaatccgaactggcctattggtcataagcggggtatttcctgtatctattcctattacagccgccgcatggtacctatgggaggtcaagaaacagcgagcaggggtcctgtgggatgtaccgtccccgcctccagttggaaaagcagaattagaggacggtgcctatagaataaaacaaagaggaatcctgggttacagccaaattggggcaggagtatataaagaaggtacattccataccatgtggcacgtaacaagaggcgcggttttgatgcatcgtggtaagagaatagaacctagttgggcggatgttaagaaagatttgatcagttacggtggcggatggaagttggaaggagaatggaaagaaggggaagaagtccaagtactcgcattagagcctggaaagaatccaagggcagtccaaacaaaaccaggaatatttaaaacaaacacaggtacaataggtgccgtatcacttgattttagccccggtacaagtggatctccgattgttgatcgcaaggggaaagtagtgggattgtacggaaatggagtagtaaccagaagtggagcatacgtttccgcaatagcacagactgaaaaatctattgaagataaccctgaaatagaggatgacatattcaggaagaaaagattaacgataatggacttacaccccggtgcgggtaaaacgaaacgctacttaccagcgatcgtaagagaagcaataaaaagaggtttaagaaccctcatactcgcacccacccgggttgttgcggcggaaatggaagaggctttgcggggactacccataaggtatcaaaccccagcgatacgagcggagcatactggtagagaaatcgtagaccttatgtgccacgcaacgtttacaatgcgacttctttcaccagtaagagtcccaaattataatctaatcattatggacgaagcacattttacagacccagcaagcatagcagcgcgaggttatatatcgacccgagtagaaatgggtgaagccgcgggaatattcatgactgctactcctcccggttctagagatccattccctcagtcaaacgcccctattatggacgaggagagagagataccagaacgttcctggaactccggacatgaatgggttacagattttaaaggtaaaactgtgtggttcgtaccatcaatcaaggcaggaaatgatatagcagcgtgtcttaggaagaacggcaagaaggtgatacagctaagccgaaaaacttttgatagcgaatatgtgaaaacaagagcgaatgattgggattttgtcgtaacaacggatattagtgagatgggagcgaactttaaagccgaacgtgtaatcgatccacgaagatgcatgaagccagtaatactcactgatggagaagaaagagttatacttgcaggccctatgcctgttacccattcttcagcagcccaacgtcggggtagaattgggcgaaacccgaagaacgaaaacgatcagtatatctatatgggcgaaccactagaaaatgatgaagattgtgcacattggaaagaggcgaaaatgctcctagacaatattaatacacctgaaggaattatcccatcaatgtttgagcccgaacgggaaaaagtagacgctatcgatggggagtatagactacggggagaagcaagaaaaacttttgttgacctcatgcgacgtggtgatttgccggtttggttagcatataaagtcgcagccgaaggcataaattatgcagatagaaagtggtgttttgatgggattaagaataatcagatactagaggaaaatgttgaagtagaaatatggactaaggaaggggaaaggaagaaattaaaacctaggtggttagatgcgagaatatattccgacccacttgctctcaaagagttcaaagagtttgcagctggacggaagtccttgacattaaaccttattactgaaatgggtagattacccacgttcatgacccaaaaggcaagaaacgccctagataatttagcagttctacacaccgcagaagcagggggcagagcatacaaccatgcactgtcagaactaccggaaactctagaaacgttgttattactcacattattagcgactgtcaccggtggaatattcctctttctaatgtctggtaaaggaattggaaaaatgactctaggaatgtgttgcataataactgcttcaattttattatggtacgcacaaattcaacctcattggattgccgcaagcattatactagagtttttcctcatagttctattaattccagaaccggaaaaacagcgaacaccccaagacaatcagctcacatatgttgttatagcaatactaacagtagtagcggctacgatggccaatgagatgggatttttagaaaagactaagaaggacctagggttaggctctatcactacacaagaatcagaatcaaacatactagatatagatttaaggcctgcctctgcctggacactttatgcagttgcaactacttttgtcacaccaatgttgcgccattctatagagaactcatcggtcaatgtaagtctgacggcaattgcaaatcaagccactgtattaatgggcctagggaaaggatggccactatccaaaatggatatcggagttccactacttgctataggatgttacagccaagtgaatccaattacactgactgcagctttgttacttcttgtggcacattacgctataatcggtccagggctacaagccaaagcaaccagggaagctcagaaaagagctgccgcgggcattatgaagaatccgacagtcgatgggataactgtaattgatttagagccgataccctacgatcccaagttcgaaaagcaactagggcaagtaatgctgttaatactctgcgttacccaagtactaatgatgcgaacgacctgggccctttgtgaagcgctaaccttagccacaggaccaatatctacactatgggaaggcaatccaggtagattttggaacacaacgatagcagtctcaatggccaacatattcagaggaagctatctcgctggcgcaggactcttattctctatcatgaaaaataccactaacacgagaagaggaacaggaaacataggggaaacgttaggagaaaaatggaagtcaagacttaatgcattgggaaagagtgagtttcaaatatataagaaaagcggcattcaagaagttgataggacactagctaaagaaggaatcaaaagaggagagacggatcatcatgcggtatctagaggatccgcaaaactaagatggttcgtagagagaaatatggtaacaccagaaggtaaagtagtagacttaggatgtggaagaggcggttggtcgtactactgcggaggactcaaaaacgtgagggaagtgaagggcctaaccaagggaggacccggtcatgaagaacccgttccaatgagtacgtacggatggaacctagtgcggctccaatcgggcgtagatgtctttttcaccccgcctgaaaaatgtgatacattattgtgcgatatcggcgaatcgtctccgaaccctacaatcgaggcaggtagaactctcagagtccttaatctggtcgagaattggttaaataataacactcaattctgtataaaagtacttaacccgtatatgcccagtgtaatagagaaaatggagactctacaacgcaaatatggaggtgcccttgttcgtaaccccctatctagaaattcaacacatgaaatgtactgggtctcaaatgcaactggaaatattgttagttcggttaacatgatctctagaatgctgattaatagatttacaatgaaacacaagaaagcaacatatgagcccgacgtggatctaggatccggaactaggaacataggaatagaatctgaaactccaaatctagatataatcggaaaaaggattgagaaaatcaaacaggaacacgagacatcgtggcactatgaccaagaccatccctataaaacatgggcctaccatggcagctatgaaactaaacaaacgggtagtgcatcatcgatggtgaacggagtagttagactgctgactaaaccatgggacgtggtaccaatggtaactcaaatggctatgaccgacacaactccgttcggccaacaacgagtgtttaaagaaaaagtcgacacacgaacgcaagaaccaaaagaaggcactaagaaactgatgaaaataaccgccgaatggttgtggaaagaattaggcaagaagaaaactcctaggatgtgtacaagagaagagttcacgaagaaagtaaggtccaatgcagctctaggtgctattttcaccgacgagaacaaatggaaaagtgcaagggaagccgtggaagacggaagattttgggaattagtcgaccgagaacgcaatttacatcttgagggaaagtgcgaaacgtgtgtatataatatgatgggaaaaagagagaagaaacttggggagttcggaaaagctaaaggctcacgggcaatatggtatatgtggttaggagcgcgtttcctagaatttgaagcattaggattcttaaatgaagatcactggtttagccgaggaaacagtctctcaggagtggagggagagggcctacatcgcttaggctacatactaagagaagttggcaagaaagaaggtggggcgatgtatgcagatgacacagcgggttgggacacaagaattactctagaagacttgaaaaatgaggaaatggtaactaatcacatgaaaggtgagcacaagaagctagcagaagcaatattcaaactaacatatcagaataaggttgtacgagtacagagaccaacaccaagaggcaccgtgatggacattatttcaagaagagatcaaaggggatcaggtcaagtaggaacatatggattaaatactttcacaaatatggaagcccaactcatcagacaaatggaaggagaaggaatttttaaaagtattcaacatctaacagcaacagaagaaattgcagtacaaaattggcttgcaagagtagggagggaaagattaagtcgaatggcgatcagtggtgacgattgtgtggtaaagccaatagacgacaggttcgcatcagctcttaccgctttaaacgacatgggaaaagtacgcaaggacattcaacagtgggaaccatctcgagggtggaacgattggacacaagtccccttttgcagtcaccactttcatgagttagttatgaaagacggaagagtgcttgtcgtaccttgtaggaatcaggacgagttaattggacgcgcaagaatatcacaaggagcgggatggagtttgaaggagacggcatgtcttgggaaatcctacgcacaaatgtggaccctgatgtactttcatagacgtgatctacgcctagcagctaatgcgatttgttccgcagtaccaagtcattgggtaccaacctcaagaacaacgtggtcaatacacgctaaacatgagtggatgaccacagaagacatgttagccgtgtggaacagggtctggatccaggagaatccttggatggaagataaaaccccggtcgaaagttgggaagaagtgccatatctgggcaagagagaagaccagtggtgcggctcgttaattgggcttacttccagagcaacgtgggcaaagaacattcaaactgcgatcaatcaggttagaagcctgataggtaatgaagaatatacagattatatgccatcgatgaaaaggtttagacgagaagaagaagaggctggagttctgtggtga

SEQ ID NO: 22353 - RNA, 9876 nt, synthetic construct
  misc_feature 1..9876: note = derived and/or modified CDS sequence (opt6) from DENV-2__FJ882602__SS-prME
  source 1..9876: mol_type = other RNA
acagcagggatgattattatgttaataccaactgcaatggcttttcatttgaccactagaaatggagaacctcacatgatagttagtcggcaggaaaaaggtaaatcactgcttttcaaaaccgaagacggagtcaatatgtgtacattgatggcaatggatttaggtgaactttgtgaagatacaataacatataattgtccgcttttacgacaaaatgaaccagaagatatagactgttggtgtaactccacctctacatgggttacctacggaacatgcacagctaccggcgaacaccgccgcgaaaaacgatctgttgcgttagtaccacatgtgggtatgggtttagaaacgcgtacagaaacatggatgagttcagaaggcgcgtggaaacatgcccaacgcatagaaacttggattttaaggcatccaggttttacaattatggccgcaatactagcgtacacaattggaacaacatattttcaaagagtactgatatttatcttgctgacggcggttgcaccctccatgactatgagatgcatagggattagtaatcgcgatttcgtagaaggagtctccggtgggagttgggtggacattgttctagaacacggttcctgtgttacaactatggccaaaaacaaaccaacactagacttcgaactaataaaaacggaagcaaaacagccagcaacattacgaaaatattgcatagaagctaaattgacgaacactacgactgcttcaagatgtccaacacagggtgaaccctcactaaacgaggagcaagataaaagattcgtttgcaaacacagtatggtagacagaggatgggggaatggctgcgggctattcggcaaaggaggcatcgtgacatgtgcaatgttcacgtgtaagaaaaatatggaaggtaaaatcgtacaaccagaaaatctggaatacactatcgtaattacgccccattcaggagaggagaatgcagtaggtaatgacacgggtaaacatggaaaagagattaaagtgaccccacaaagcagtattacggaggccgagcttacaggatatggtacggtaactatggaatgtagcccgcggacaggtttagacttcaacgaaatggtgttgctgcaaatggaaaacaaggcttggttagttcacagacaatggtttctagatcttccgttgccttggcttccaggcgcagatacacaaggtagtaattggatacaaaaagagacattggtaacgtttaaaaatccacacgcaaagaaacaagacgtagtagtactaggatcccaagagggggctatgcatactgcattaacaggtgctacagaaatccagatgtcaagcggtaacctactttttaccggccacctgaaatgtcgcctaagaatggataaacttcaacttaaaggaatgagttattcgatgtgcacgggaaaatttaaagttgttaaagagatcgccgaaacccaacatggaactatagtgataagggttcaatatgagggagatggcagtccatgtaaaatcccattcgaaattatggatctagagaaacgacatgtgttaggaagactaataacagttaatcccattgttactgagaaggacagccctgttaatatcgaagctgaaccaccatttggagactcatatattatcattggagtcgaaccaggacaattaaaactatcatggttcaagaaaggaagtagtataggccaaatgtttgagacaaccatgaggggtgccaaacgaatggccattctgggtgatactgcttgggacttcggttcattaggtggcgtctttacatcaattggtaaggcactgcaccaagtcttcggagctatctacggggcagcattctcaggagtttcctggacaatgaagatactaatcggagtggttattacatggatagggatgaactcaagatcaacaagtttgtcagtagctttagtgctagtaggagtcgtcacgctatatctcggagttatggtacaagcagacagcggatgtgtagtctcatggaagaataaagaattaaagtgcgggagtggaatattcataaccgataatgttcatacatggacagaacaatataaatttcagccagagagccccagtaagctagcctcagctatccagaaggcacacgaagaaggtatttgcggcatacgcagcgttaccagattagaaaatttaatgtggaaacaaattacacctgaattgaatcatattttaagcgaaaatgaagttaagctaacaattatgaccggagatataaagggtattatgcaagctggtaagagatcgctaaggccccaaccaaccgaattaaaatatagttggaaaacttggggcaaagcaaaaatgctatcaacagagccccataatcagacatttctcattgatggccctgagacagcagaatgccctaatacaaatcgagcctggaacagcttggaagttgaagattacggttttggcgtatttacaacaaacatatggttaaaactgaaagaacgacaggacgtattttgcgactctaaactaatgtccgcagcgataaaggataatagagctgtacatgccgacatggggtactggattgagagcgcattaaatgatacatggaagatagaaaaggcctcattcatagaagttaaaagctgccattggcccaagagccatacgttatggagcaatggcgtattggagagtgagatgataataccgaaaaacttcgctggaccagtatctcaacataactatcgaccgggatatcacactcaaaccgcaggaccgtggcaccttggaaagttagaaatggattttgacttctgcgaaggtactacagttgtagttactgaagactgtggcaatcgtggtccgagtcttcgaactacgacagcgagcggcaaactgattacagaatggtgttgtcggagttgcaccttgccaccccttagataccgtggtgatgatggatgctggtatggcatggaaataagaccccttaaggaaaaagaagagaacctagttaacagtttggttacagctggatacggtcaaatcgataacttctctttaggggtcctggggatggccctatttttagaggaaatgttaagaacgcgagtggggaccaaacatgcagtcctgttagttgcggtaagtttcatgactcttattacaggaaacatgtcatttagagatttaggtcgggttgtggttatggtgggagctgctatgacagatgatataggaatgggagtaacgtacttagcattgcttgcagctttcaaggtccgacccacattcgctgccggattgctattgcgtaaacttactagcaaagagctaatgatgactacgataggaatagtccttctctctcagtcaaccataccagagacaatactagaattaaccgatgctctagcactaggaatgatgattctcaagatagtccgcaatatggaaaaatatcagttagcagtcactatcatggcaatcctatgcgtgccgaacgccgtaatattacaaaacgcctggaaggtaagctgcacaattcttgctgtggtttctgtaagcccattgcttcttacaagtagtcaacagaaggcagattggataccattagcgttaaccatcaaaggtctcaatccaacggctattttcttaactacactaagtagaaccaataagaaacgatcctggcctctaaacgaagcaattatggcagtaggaatggtgtcaatcttagcgtcatctttgcttaaaaatgacataccaatgactgggccattagtcgcgggaggattactaactgtatgctacgttttaactggacgttccgcagaccttgaattagaaagggcagcagatgttaggtgggaagatcaggcagaaatctcggggtccagccctatactatctataacaataagtgaagatgggtccatgtctattaaaaacgaagaggaagaacaaacactgacgatcctaatcagaacaggtctcttagttatctcagggttgtttccagtatcaataccaattacggccgcagcttggtatctatgggaggtaaagaaacaaagagccggcgtcctttgggacgtcccatcgcccccacctgttggaaaagctgagctagaggacggagcataccggataaagcagaaaggcattctaggatattcacagataggagcaggagtctacaaagagggtacattccacacaatgtggcacgtaacaagaggagcggtgttgatgcataagggaaagagaatagagccgtcatgggcggacgtacgtaaagatttaatatcctatggtggcggttggaaacttgaaggtgaatggaaagagggtgaagaggtacaagtattagccttagagcctggtaaaaatcctagagctgtacaaacaaagccaggcttatttaaaacaaacaccggcaccataggtgctgtatccttagatttttcaccaggtacctcgggaagtcctatagtagataaaaagggaaaagttgtgggtctatatggaaatggagtggtaacaagaagtggaacctatgtttctgccatagcccagactgagaaatctattgaagacaaccccgaaattgaagatgatattttccgcaaaagaagactcacaatcatggatctacatcccggtgctggaaaaactaaaagatatttaccagccatagtaagggaagcaattaagagaggtttaagaacgctaattcttgcgccgacaagagtagtagcagctgaaatggaggaagcattaaggggcttgccaatacgatatcaaacgcctgctattcgggctgagcatactggtcgcgaaatcgtagacctgatgtgtcacgcgacatttaccatgcgtttactaagtccagtccgtgtgccaaattataatttaatcataatggatgaagcacattttacagatccggcaagtatcgctgcaaggggttacatcagtacaagagtagaaatgggcgaagcggcaggaatatttatgacagccacaccccctggatcgagagatccatttcctcaaagtaatgcgcctataatggatgaggaacgtgagattccagaaaggtcatggaatagcggccacgaatgggtaacagactttaagggcaaaacagtatggtttgtgccttcaatcaaagcaggcaatgatatagcggcctgtctacgtaaaaatggtaagaaagtgatccaactgagcaggaaaacatttgattccgaatatattaaaactagaacaaatgactgggattttgtagtcactactgatatatcagaaatgggcgctaattttaaagcggaaagagtcattgatccacgacgatgcatgaaaccggttatattgactgacggagaagaacgagtaatactggcaggacctatgcctgtaacacacagtagcgcagctcaacgtagaggaagaataggtagaaaccctaaaaacgagaatgaccaatacatatacatgggagaaccactagaaaacgatgaagattgtgcgcattggaaagaagctaagatgctgctagataatataaatacaccagaagggataataccatcgatgttcgaacctgagagagagaaggttgacgcaattgacggtgaatacaggctcagaggagaagcccgaaagacttttgtagacttgatgaggcgaggggacctaccagtctggttagcttatagggtagccgcagagggaattaattatgcagaccgacgctggtgttttgacggtattaaaaataatcaaatattagaggagaatgtagaagtcgaaatttggacgaaagaaggagagaggaagaaattaaaacccaggtggctagatgcaaggatatattcagatcccttagccttaaaagaatttaaagaatttgctgcaggaagaaagagcttaaccttaaatcttattacagaaatgggaagactcccaacttttatgacacagaaagctcggaacgctctggataacctagcagtattacacacagccgaagctggcggcagagcttataatcacgcgttaagtgaactacctgaaactttagagacgttactactgctaacactacttgcgacagtaacgggaggaatatttttattcttaatgtccggtaaaggaattggaaaaatgaccctcggaatgtgttgcattataaccgcgtcgatactactatggtatgcgcaaatacagccacattggatagccgcgagtattatattggagttctttctaattgtattgttgatcccggaacctgaaaaacaaaggactcctcaggacaaccaactaacttatgtggtcattgctattctcacggtagttgccgcgacaatggcaaacgaaatgggattcttggagaaaaccaagaaagaccttggcttaggaagtattgctacgcaacagccagagtcaaatatattggatatagacttgaggccggcaagtgcttggacactatacgctgtcgcaacgacattcattactccaatgcttagacattctatagagaatagctcagtcaacgtttccttaacagccatagcaaatcaggccacagtcttaatgggacttggaaaaggttggccgttgtctaagatggacataggagtaccactactcgctataggatgttacagccaagtcaatcccatcactttgacagccgccctactactattggtggcacattacgcgattatcggtccggggttgcaggcgaaggctactcgcgaggcgcagaaaagagccgcggccggtattatgaaaaacccaaccgtagatggaataactgtaatcgatttggaccccatcccatatgaccctaaatttgaaaagcaactaggccaagttatgctgttagtactatgtgtcacacaagtgttgatgatgaggacaacgtgggccttatgcgaagctctaactttagcaactggccccatatcaacgttgtgggaaggcaatccgggtagattctggaatactaccatcgctgtgagcatggccaatatatttcgcggttcatatttggcgggtgcagggcttctattttctataatgaaaaataccactaacacaagaaggggaaccggaaatactggagagacattaggtgaaaagtggaagaatcgactaaatgccctcggaaaatcagaatttcaaatttataagaaatcaggaatacaagaagtagatagaacattagctaaggaaggtattaaacgaggagaaaccgatcatcacgcagtatctagaggctctgctaaacttaggtggttcgtcgaaagaaatctagtcacacctgaaggcaaggtcgtagatctgggctgtggccgaggcggatggagttattattgtggtggactaaagaacgtacgagaggtcaaaggattaaccaaaggtgggccaggtcacgaagaacctattccaatgagtacatacggctggaatctggtacgacttcagtccggggtcgatgtattctttactcctcccgaaaaatgtgacacactgttatgtgatattggcgagagttcaccgaatcctactgtagaagcgggaagaactcttcgagtgttaaatctagtcgagaattggttaaacaataacacccaattttgcattaaagtgttaaacccgtacatgcctagcgttatagaaaagatggaagccttgcaacggaaatatggtggtgccctggttcgaaatccactatcaaggaactcaacacatgagatgtactgggtgtcgaatgctagtggaaacattgtatcaagtgtcaacatgatatcaagaatgttgataaaccgttttacaatgcgacataagaaagccacgtatgaaccagacgtcgacttaggaagtgggacaagaaatataggaatcgaatcagaaactccaaacctagatataataggaaaaaggattgagaaaataaaacaggagcacgagacttcgtggcactacgatcaggaccatccttacaaaacatgggcataccatggaagctatgaaacgaaacaaaccgggtcagcgagttcaatggttaacggcgtagtcaggttacttacaaaaccctgggacgttatacccatggtcacacaaatggcgatgacagatacgactcctttcgggcagcagagagtgtttaaagagaaagtcgatactcgcacacaagaacctaaggaagggacaaagaaactcatgaaaatcacagcagaatggctgtggaaagaactaggtaagaagaaaacaccgagaatgtgcacccgtgaagagttcaccaggaaagtaaggtctaatgccgcattaggtgccatttttaccgacgaaaacaagtggaaaagcgcgagagaagcggtagaagactcccgattttgggaattggtggataaagaacgaaatctacatctcgaaggcaaatgtgaaacatgcgtgtacaacatgatgggaaaacgagagaagaaattaggagagttcggaaaagcgaaggggtccagagctatatggtatatgtggttaggggcgagattcttagaatttgaagcattaggattcttaaatgaggatcattggttttctcgggaaaactcattatcgggggtagaaggagaaggtctacacaaactgggatatatattaagggatgtttccaagaaagagggtggcgcgatgtatgcagacgacactgcagggtgggacacgaggataactttagaggatctcaaaaatgaagaaatggttactaaccacatggaaggggaacacaagaaactagctgaggccattttcaaattaacataccagaataaggtggtccgggtacagcgcccaactcctagaggaacggtcatggatataatatcccgacgggaccaaagaggtagtgggcaagtgggtacatatggactaaatacttttacgaatatgggggctcagttaatacgtcaaatggaaggagaagaagtatttaaaggcattcaacatctaactgctacagaagaaattgcagttcaaaattggttagccagagtaggaagagagcgactatcaagaatggcgatatcaggagacgattgcgttgtaaaaccgctagatgaccgttttgcctctgccttgactgccctaaatgatatgggcaaggtgagaaaagatatacaacagtgggaaccttcgcgtggttggaatgattggactcaagttcccttttgctcgcaccatttccacgaacttataatgaaagatggaagggtactggttgtcccctgtcgaaaccaagatgaattaataggtcgtgctcgtatttcacaaggtgcaggttggagtctccgagaaactgcctgtcttgggaaatcatacgcacaaatgtggtcacttatgtatttccatcgaagagatctgaggcttgcggcgaacgcaatatgttcagcggtgccaagtcattgggttcctaccagtagaaccacatggtctattcatgcaagacatgagtggatgacgaccgaagacatgttaactgtctggaatagagtatggattcaagaaaatccttggatggaagataaaacaccagttgaatcatgggaagaaataccctatctagggaaacgagaagatcagtggtgcggatccttaataggcctaacatctcgggcaacttgggcgaaaaatatacagactgcgataaatcaagtgagaagcctaatagggaatgaagaatacaccgattatatgccctcaatgaaacgattccgaagagaagaagaagaagcgggagttctatggtaa

SEQ ID NO: 22354 - RNA, 9876 nt, synthetic construct
  misc_feature 1..9876: note = derived and/or modified CDS sequence (opt6) from DENV-2__GQ252676__SS-prME
  source 1..9876: mol_type = other RNA
acagcaggcgtaataatcatgttaatacccactgcaatggcgtttcacctgacaacccgcaatggtgaacctcatatgattgtgagtaagcaagaaaaaggcaaaagtttactcttcaaaaccgaagaaggagtaaacatgtgcacgcttatggcaatggacttaggagagttgtgcgaagacacaataacatataactgtcccttactaagacaaaatgaaccggaagacatcgattgttggtgtaactcaacatctacatgggtgacgtatgggacttgtaccgccactggagaacacaggagagagaaaaggagcgtagcattggtaccacacgtaggaatgggcctcgaaacacggacagaaacatggatgtcctcggaaggagcgtggaaacacgcacaaagaatagaaacatggatattgagacatccaggttttacaatcatggctgcaatactagcttataccatcggtacaacgtatttccaaagggtactgatatttatacttcttacagcagttgccccatcgatgacgatgagatgtatcggaatttcaaacagagactttgtagaaggcgtttcagggggatcatgggtagacatagtcttagaacatggctcatgtgttaccactatggccaaaaataaacctacactggacttcgaattgataaaaacagaagctaagcaaccagccacgcttagaaaatattgcatcgaagccaaactaactaatacaactacagctagtcgctgcccaacacaaggagaaccttcgttgaatgaagagcaagataagcgattcgtatgtaaacattctatggtagatagagggtggggtaacggttgtggcttgtttggaaaaggaggcatagtaacttgtgcaatgtttacctgcaaaaagaatatggaaggaaaaatagttcaaccagaaaatttggaatatactatcgttgtaactccgcactcaggcgaagaaaacgcagtcggcaacgatacagggaaacatggcaaagagataaaagtaacaccacaaagttctatcacggaagccgaactaacaggatacggaactgtgacaatggagtgttcaccaagaacgggtttggattttaacgaaatggtgctactgcaaatggaaaacaaggcatggctggtccatagacaatggtttttagatctgccactaccttggctaccgggtgctgacattcagggttcgaactggatacagaaggaaactctagttacttttaaaaatccacatgctaagaaacaagatgtggttgtactcggaagtcaagaaggggctatgcatactgctctaacaggtgcaaccgaaatacaaatgagtagtggaaatctgctgtttactggacaccttaaatgccgattaaggatggataaactgcaactaaaaggcatgtcatattcaatgtgcactggtaaatttaaagtagttaaagagattgcagagactcaacatggaactatagtagttagagtccaatatgagggcgatggttccccttgtaagattccatttgagataatggatttggaaaagaggcatgtgctaggacgtttaataactgtcaaccctattgttacagaaaaagattcacctgttaatattgaagctgaaccacccttcggagattcttacataataataggagttgagccaggtcaattgaagctatcatggtttaagaaagggagtagtataggacaaatgtttgaaaccactatgagaggggccaaaaggatggcgattctgggtgacacggcttgggattttggctcgttgggaggagtctttacgtcaattggaaaagcacttcaccaagtttttggagcaatatacggagctgcattctctggcgttagttggacaatgaagatactaatcggcgttgtaatcacttggattggaatgaactcccgaagcacttccctgagtgtatcactagtactagttggtgtggtaactctgtatctgggtgttatggtacaagccgattctggctgcgtcgtgagctggaaaaataaagagttgaagtgtggctcaggaatcttcatcactgacaatgtccatacatggaccgagcaatataaattccaacccgaatctccatcaaaattagcaagcgctatacagaaagctcacgaagaggggatttgcggaattagaagtgtgacgcggcttgagaatcttatgtggaaacaaataacgcctgagttgaaccatatcttaagtgaaaacgaagtaaaactctccatcatgactggcgatataaaaggcataatgcaagctggaaaaagatcgcttcgtccgcagcctacagagctaaagtatagttggaaaacatggggtaaggcaaaaatgttatcaaccgaaccacataaccaaactttcctgatagatggacccgagactgctgaatgtccaaacactaatagagcttggaacagcttggaagttgaagattatggatttggagtattcacgaccaacatatggcttaaattaaaagaaaggcaggacgtgttctgtgattctaagttaatgtctgcagcaatcaaagacaacagggctgtacacgctgacatgggctattggatcgaatccgcattaaacgatacatggaagatagaaaaagccagttttatagaagtaaaatcttgtcattggcctaaatcacacacattatggtcgaatggagtgttagagtcagaaatgataataccaaaaaactttgccggtcctgtctcacaacataactacagaccgggatatcacacacaaactgcaggtccatggcatttaggtaaattggaaatggatttcgacttttgcgaaggtactacggttgtggtaactgaagactgcggtaacaggggtccaagtttgcgaactactactgcgtccggtaaactcattacagaatggtgctgtagatcatgcacgcttccaccacttcgatatcgcggagaggatggttgttggtacggtatggaaatacgacctcttaaagaaaaagaagaaaatttggtcaatagtttagtgacagcgggccatggtcaaatagataacttcagtctgggtgttctaggtatggctctgtttttggaggaaatgctcagaacaagggtcggtactaaacacgcagtacttttagtagcagtatcattcatgactttaattaccggtaacatgtcttttagagatctaggacgggtgatggttatggtgggcgcggcaatgacagatgatataggtatgggagttacatatcttgccttactggcggcatttaaggtaagacccacgttcgctgctggtttattgctcagaaagctaacatcaaaagaactaatgatgacgactatcggaatcgtattactgagtcaatcaaccatccctgaaacaatattagaactcacagacgctcttgccctagggatgatgattttaaaaattgtccgcaacatggaaaagtatcaactcgccgtcactattatggcaatactatgtgtacctaatgcagtgatattacaaaatgcatggaaggtaagttgcactatattagctgcagtcagcgtttcacccttactcctaactagttcccaacaaaaggcggattggattcctttggctttgacgataaaaggcttgaacccaacagccatttttctaactacactaagtagaactaacaaaaaacggtcgtggccactaaacgaggcaattatggcagtcggaatggtatccatactagcttcctccctattaaaaaatgatatacctatgactggtccgttagtagcgggaggactactaacagtgtgctatgtactcacaggcaggtccgcagatctagaacttgaacgagccgcagacgttaggtgggaagatcaagccgagatttcaggaagctcgccaatactaagtataacaattagcgaagacggaagtatgtccattaaaaacgaagaggaagagcaaacactcactattctaatccggactggattactggttatcagtggtctatttccagtaagcatcccaattacggcagcagcatggtatctatgggaggtcaaaaaacagagagcaggtgttttatgggatgttccgtcaccaccgccagtaggaaaagctgaattggaggatggcgcttaccgcataaaacaaaaaggcattttaggctatagccaaattggagcaggtgtttacaaagaggggacgtttcacacaatgtggcacgtgacacgaggagcagtactaatgcataaaggaaagagaattgaaccctcatgggcggatgtcagaaaagatttaataagttacgggggagggtggaagttggagggtgagtggaaggaaggagaagaagtacaagtattagcattagagcctggaaagaacccgcgggcagtacagacaaaaccaggacttttcaaaacaaacactggaacaataggggcagtgagtcttgatttctctcctgggaccagtgggtccccgattgttgacaaaaaaggtaaagtcgtaggactatatggaaatggtgtcgtcactagatccgggacgtatgtatcagcgatcgcgcaaaccgaaaaatctattgaagataatcccgaaatagaagatgacattttcaggaaaaaacgcctaacaataatggatctgcatccaggggccggtaaaactaaaagatatctaccagcaattgtaagagaagcaatcaaaaggggtttgcgtaccttaatactcgcacccacacgcgtagtcgcggctgaaatggaagaagccctaagaggtcttcccataagataccaaacacccgcaattagggccgagcataccggcagggaaatcgttgacttaatgtgccatgctacgtttaccatgcgactactaagtccagtacgagtaccaaattacaacctgataatcatggatgaagctcactttaccgatccagcatctatagctgcgcgaggctacatcagcacaagagtagagatgggtgaagccgcgggtatatttatgacagcaacaccacctggaagtagagatccatttccgcaatcaaatgccccaataatggacgaagagcgggaaatacctgaacgttcttggaacagtggtcatgaatgggtaacagatttcaagggtaagaccgtctggttcgtcccaagtattaaggctggcaatgacatcgctgcttgtttgagaaaaaacggaaagaaagtaatacaactaagccgtaagaccttcgacagtgaatatataaaaacacgcaccaatgattgggactttgttgttacgacggatatttcagaaatgggtgctaattttaaagcagaaagagtaattgacccgcgacgttgtatgaaaccagttatattgaccgatggagaagaacgagtcatactcgcgggcccaatgcccgtaacccactcaagcgcggctcaacgacgcgggagaattggcaggaatccaaaaaacgaaaatgatcagtatatttatatgggagaacccttagaaaatgacgaagactgtgcacattggaaagaagcgaaaatgctgctggataatattaacacaccggaaggcataatccctagcatgtttgaaccagaaagggaaaaagttgatgcaatcgatggagaataccgcttaaggggagaagccaggaaaacattcgttgacttaatgaggagaggtgatctaccagtatggctagcctatagggtagctgcagagggaattaactatgcagaccggcgctggtgttttgatggaataaaaaacaaccaaattttagaagaaaacgtagaagtagaaatatggacgaaagagggcgagagaaagaaactaaaaccgagatggttggacgcaagaatatatagtgatccactcgcactaaaagagtttaaggaatttgctgcaggaagaaaatcacttactttaaaccttattacagaaatgggcagactacccacatttatgacacaaaaagcacgaaacgcactagataacctggccgttcttcacacagcagaagctggaggaagagcgtataaccatgccctcagtgagctaccggaaacattggaaacacttctactattaactttgctagcgacagtaacaggtggcatatttttatttttgatgtccggaaagggaataggcaaaatgacactcggaatgtgttgtattataaccgcctctatactactatggtatgctcagatacagccacattggatcgcagcgtccataatactggagttttttcttatagtattattaataccggaaccagaaaaacaaagaacaccacaagacaaccagctaacttacgtggtgatcgctattctaaccgtagtagctgcaacaatggcgaatgaaatgggctttctggaaaagacaaaaaaagatttcggcttgggatcaatagctacacagcaaccagaatccaatatacttgacattgaccttcgtcccgcttcagcttggacactttatgctgtcgcaaccacatttataactccaatgctcagacattctattgagaatagctcagtgaacgtctcgttaaccgcaatagcaaatcaagcaacagtcttgatgggtctcggtaaagggtggccgctaagtaaaatggacataggagtcccgctattagccattggatgttatagccaagtaaatcccattaccttaaccgctgcactcctactattagtcgcacattacgctataattggaccaggacttcaagcaaaagcaacgcgcgaagctcaaaaacgagcagctgcaggaataatgaaaaatcctacggtagacgggattacagtaattgatctcgacccaataccatatgatcctaaattcgaaaaacagttaggtcaagtcatgcttttagtactatgcgtgactcaagtattaatgatgcgtactacgtgggcactgtgtgaagcattgaccttagctactggtccgatctctaccctatgggagggaaatcccgggagattttggaatacaactattgcagtctccatggcaaacatttttagaggttcctatctagcaggagcaggattactcttttcaattatgaaaaacaccacaaacacaaggcgcgggactggtaatactggggaaactctaggggaaaaatggaaaaatcgacttaattctttgggcaaatctgagttccaaatttacaaacgatcgggaattcaggaagtagaccgtacactcgccaaggaagggattaaaagaggagaaacggatcatcacgccgtaagtagaggatctgcaaaactgcgatggtttgtggaacgtaacttagttactccagaagggaaggtagtcgacctaggatgcggaagagggggatggagttattactgtggaggtttgaaaaatgtaagagaagtgaaaggtctaaccaaagggggcccaggacatgaagagccaattcccatgtcaacttatggatggaatctcgtaagattacagtcgggcgtcgacgtattctttacacctccggaaaagtgcgatactttactatgcgatattggagaatccagtccgaacccaacagtagaagcaggcagaactttgcgagtattaaatttagtagagaattggcttaataataacacacaattctgcattaaggtattaaacccttatatgccaagcgtaatagagaaaatggaaacgcttcaaagaaaatacggtggtgcgctagttagaaacccactgagccggaactccacccatgaaatgtactgggtaagcaacgcatctggtaacatagtatcctcggttaatatgatctcccgtatgttaataaatagatttaccatgcgacataaaaaggcaacctatgagcccgatgtggatcttggttcaggcacaagaaacataggaatagagtctgagacccccaacctcgacataataggtaaaagaatagagaaaataaaacaagaacacgaaacttcttggcattacgatcaagaccatccgtataaaacatgggcatatcacgggagctacgagaccaagcagaccgggagtgcgtcatccatggtcaatggcgtggtacgactcttaacaaagccatgggatgtcatacctatggtcacgcagatggcgatgactgatacaacaccttttgggcaacaaagagtttttaaagaaaaggtcgatacacgtacacaagagcctaaagagggaactaagaagttaatgaagattacagcagaatggctctggaaagaattaggaaagaaaaaaactcctaggatgtgtactcgtgaagaatttgcacgtaaggtacgttccaacgcagccttgggtgccatcttcacagatgaaaataaatggaagagtgcacgagaggccgtcgaagactcaagattttgggaactagtcgataaagaacgaaatctacatttagaaggaaagtgcgagacatgtgtctataatatgatgggaaaaagagaaaaaaaaatcggagaatttgggaaagcaaaaggatctcgcgccatttggtatatgtggttaggagcgagatttttagagtttgaggctctagggttcttaaatgaagaccactggttttcaagagagaacagtctgtccggggtagaaggcgagggccttcataaactcggttacattctccgagaagtaagtaaaaaagagggaggcgcaatgtacgctgatgacacagccgggtgggacacgcgaattacgttagaggacctaaaaaacgaagagatggtgacgaaccatatggagggcgagcataaaaagttagccgaggcgatctttaaactaacatatcaaaacaaagtagtacgagtacaacgacccactccaagaggtactgtcatggacataatcagcagacgtgaccaaaggggaagcggtcaagtcggcacatatggattgaatactttcacaaatatgggtgctcaattgataagacagatggagggagagggagtctttaaaggtatacaacacctaacagcgacggaagaagttgccgtccaggattggctagcacgcgtaggtcgagaacgactgagtcgaatggcaatatccggagatgattgtgttgttaaaccattagatgataggtttgcctcagctctcacggcactcaacgatatgggtaaagttagaaaagacattcagcaatgggaaccaagcagaggctggaatgactggacccaggtccctttttgctcgcatcacttccatgagcttataatgaaagacggaagagtgctagtcgtaccctgcagaaatcaggacgaattaattggtcgagcgaggatatctcaaggggcgggttggagtctcagggaaacagcatgcctgggtaaatcctacgctcaaatgtggtccctaatgtacttccatagacgcgatttacgtctagcagcaaatgctatatgctctgcggtcccaagccactgggtgcctacgtcacgaacgacctggtcaattcacgcaagacacgagtggatgacaaccgaagacatgctaacggtgtggaaccgcgtttggattcaagagaacccatggatggaagataagacccctgtagaatcctgggaagaaataccatacttagggaaacgagaagatcagtggtgcggtagtttaattggactaacaagtcgggcaacgtgggcgaaaaatattcagacagcaataaatcaagtaagatcactaattggcagcgaggaatacacagactatatgccgagtatgaaacgttttcgaagggaagaagaagaggcgggtgtactgtggtaa

SEQ ID NO: 22355 - RNA, 9876 nt, synthetic construct
  misc_feature 1..9876: note = derived and/or modified CDS sequence (opt6) from DENV-2__GQ252677__SS-prME
  source 1..9876: mol_type = other RNA
acggcgggggtaataataatgttaataccaactgctatggcatttcacctaactacacgaaatggagaaccacacatgatagtaagtaaacaggaaaaaggtaaatcattactatttaaaacagaagaaggagtaaacatgtgtactttaatggcaatggatcttggtgaattatgcgaagacacaataacatataattgcccgctgctacgtcaaaacgaaccggaagatatagactgttggtgtaattccacaagtacttgggttacatacggaacttgtacagcaaccggcgagcataggcgcgagaaaaggagtgtagcgctagtacctcacgttgggatgggactagaaactcgtactgaaacttggatgtccagcgaaggagcttggaaacacgcccagcgaatagaaacttggatattacgtcatccaggatttacgataatggcagctatcttagcctatacaataggtactacctacttccaaagagttttaatatttatccttctaaccgctgtagcaccatctatgacaatgcgctgcataggtatctcaaatagagactttgtggaaggggtgtcgggagggagttgggtagatattgtattagaacacggatcgtgtgtaacaacgatggcgaaaaataaaccaacattggacttcgaactaataaaaaccgaagcaaaacagcctgccacattaagaaaatactgcatagaagcaaaattaaccaatacaacgacagcaagtagatgccctactcagggtgaaccatctcttaacgaagaacaggataaaagatttgtgtgtaaacactcaatggtagatagaggttgggggaacgggtgcggtttgtttggaaaaggagggattgttacgtgcgcgatgtttacttgtaagaaaaacatggaaggaaaaatagttcagcctgaaaacttagaatatacgattgttgtgactccacatagcggggaagaaaatgcagtcggaaatgacacaggtaaacatgggaaagaaataaaagtcactccccaatcatcaataactgaagcagagctaacgggatacggcacggtaaccatggaatgttcaccacgtactgggttagattttaacgaaatggtattattacagatggaaaataaagcctggctcgtacaccgccagtggtttttagacctccccctaccttggctaccaggcgcagatattcaaggcagcaactggatacaaaaagaaactctggtaacgtttaaaaatccacatgctaagaaacaagatgtagtcgtcttaggaagtcaagaaggtgctatgcatactgctcttactggagcgactgaaatccaaatgagctctggaaatctattatttaccggtcatctgaaatgcagattaagaatggataaattacagcttaaaggcatgtcttatagtatgtgtactggtaaatttaaagtagtgaaagaaattgcagagactcagcatggaaccattgttgttcgggtacaatatgagggagatggttctccgtgcaaaataccatttgagatcatggacctggagaaacgacatgtcttaggacgacttatcactgtaaatccaattgtcactgaaaaagactcgcctgttaacatagaggcagaaccaccattcggagattcatatattataattggggtagaacctggacaactaaaattaagttggtttaagaaaggtagttcaatagggcaaatgtttgaaactactatgcggggcgcaaaacgaatggctattttaggcgatactgcatgggacttcggatcattaggcggtgtatttacatcaatcggcaaagcattacatcaagtttttggagcgatttatggagccgctttttcaggtgtttcctggactatgaaaatattgatcggagttgttattacctggataggtatgaatagcagatctacatcactatctgttagcttagtgcttgttggcgtagttactctctacctcggagtgatggttcaagctgacagtggatgcgtagtttcatggaaaaataaagaattaaaatgtggaagtgggatttttattacagacaacgttcacacgtggaccgagcagtacaaatttcagccagagtcaccaagcaaattagcgagtgccattcaaaaagcccatgaagagggaatatgcggtatacgttcagtaacaaggttagaaaatttgatgtggaaacaaataacgcctgagttaaaccacatattaagcgaaaatgaagtcaaattaagtataatgacaggggatataaaaggaattatgcaggcagggaaaagatccttacggccacaacctacagaattaaagtacagctggaagacatggggaaaagcaaaaatgcttagtactgaaccacacaatcagacttttcttatagatggtcctgagacggcagaatgtcccaatacaaaccgtgcgtggaactcactagaagttgaagactatggttttggggtttttactactaatatatggttaaaattgaaagaaaggcaagacgtattctgtgactcaaaattgatgagcgcagcgatcaaggataatagagcagtccatgcagatatgggatattggattgaaagcgcactgaacgatacttggaaaatcgagaaggcatcatttattgaagtaaagagctgccattggcccaaatctcacacactttggagtaatggagtattagagtctgaaatgatcattccaaagaacttcgcgggacctgtctcacagcacaactatcgaccgggatatcatactcaaaccgcaggtccatggcatttaggaaaattagagatggacttcgacttctgtgaaggaacgactgtcgtcgttactgaagactgcggcaacaggggcccatcattacgaactacaaccgcctcaggtaaattaatcactgaatggtgctgccggagctgtaccttgcccccactaaggtatcgtggagaagacggttgttggtacgggatggaaatacgaccgctcaaagaaaaagaagaaaacttagttaactcattggtgacagcaggacacggccaaatcgataacttctcactcggagttttggggatggcacttttcttagaagaaatgttacgcacaagagtgggtacaaagcacgctgtcctattagtggctgtctcatttatgaccttaataacagggaacatgagtttccgagacctaggacgagtaatggttatggtcggagcagcaatgacagacgacattgggatgggggtaacctatttagctctcttggcagcgtttaaagttagacccacattcgcagccggactactactacgcaagctaacaagcaaagagttaatgatgaccacaatcggcatcgtactactctcacaaagtactattcctgagacgattcttgagctaactgatgcattggccttgggaatgatgattttaaaaatagtacgtaatatggaaaaataccaactggcagtaacaatcatggcaatactctgcgttccaaatgcggttatattgcagaacgcatggaaagtaagctgtactatcttagcagcagtatcggtctcgcccttactactgacatcgagtcagcaaaaggcagattggatcccactcgcactaacgataaaaggcctcaaccctacagctatctttctgaccaccctctcccggaccaacaagaaacgatcatggcctctgaacgaggccataatggcagtgggaatggtttccatcttggcaagtagccttctcaaaaacgacataccaatgacaggccctctagttgccggcggattgctgactgtatgctatgtattaacaggcaggagtgccgatctcgaacttgaaagggcggctgacgttcgatgggaagatcaagccgaaatttccggttcatcgccaatattatctataacaattagcgaagatggttcaatgtccatcaaaaacgaggaggaagaacaaacattaacaatcttaattcgtacaggtctattagttatatcaggcttatttcctgtgtctataccaatcacagcggcggcttggtatctatgggaggtcaagaaacaaagagccggcgtcttgtgggacgtaccatcgcctcctccggtcggaaaggctgaactagaggatggagcgtaccgcataaaacaaaaaggaatacttggctactcacaaataggcgcaggagtgtataaggagggtacatttcacacgatgtggcacgtcacaagaggcgcggttctaatgcataaaggcaaacgaatcgagccaagctgggcagatgttagaaaagatttaatatcttatgggggaggatggaaattggaaggggaatggaaggaaggagaagaagtacaagtcttagcattagaaccgggcaaaaacccccgagctgtacagaccaaaccaggtctattcaaaacaaatacaggtacaataggcgcggttagtctggacttcagccctggtacaagtgggtcccccatagtggataagaaaggaaaggtagtaggattatatggtaacggagttgtaacaaggtcaggaacttatgtttctgcaattgcgcaaacagaaaaatctattgaagataaccctgagattgaagacgatatatttagaaagaaacgattaacaataatggatttgcatccgggggctggaaaaacaaaaaggtacttgccagccattgtgcgtgaagcaataaaacgtggactgagaactcttattttggcacccacacgtgttgtagctgcagaaatggaagaggctttgcgaggattaccaataagatatcaaactcctgccatacgcgcagagcataccggaagagaaatagtagacttgatgtgtcatgcaacttttacaatgagattattatcacccgtacgagttccaaattataatttaatcataatggacgaggctcatttcactgacccggcaagtatagctgcaagaggatatatttccactagagtcgaaatgggagaagccgccggaatatttatgacagcgacgccgcctggctcgagagacccttttccccaaagcaatgctccgattatggatgaggagcgagaaataccagaaagatcctggaacagtggtcatgaatgggttactgacttcaaagggaaaacggtatggtttgtaccctcaattaaagcgggaaacgacattgcagcatgtctcaggaaaaatggcaagaaagttatacaattatcaagaaaaacgttcgactcggaatatataaaaactcgaactaatgattgggactttgtagtcacaactgatataagtgaaatgggcgctaattttaaagcagaaagagtaatagacccccgtagatgtatgaagcctgtaatattgacagatggagaggagcgggtcatcctagcaggaccgatgccagttactcattcatcagcagctcagcgccgtggtagaataggaaggaaccccaaaaacgaaaatgatcaatatatatatatgggggaaccattagaaaacgatgaagactgtgctcattggaaagaagcaaagatgttacttgacaatattaacacaccagaaggaataatcccatccatgttcgaaccagaaagagaaaaagtggatgctatagatggtgagtatcgtctaagaggagaggctcgtaaaacattcgtagatctaatgagacgaggagatctacctgtatggcttgcatatagggtagcagctgaaggaatcaactatgcggatcgacgttggtgctttgacggaatcaaaaataatcaaatcctagaagagaacgtcgaggttgaaatttggaccaaagaaggtgaaaggaagaaactcaaacctaggtggctcgacgcaagaatttattcggaccctctcgcattgaaagaatttaaagaatttgccgccggaagaaaaagtctgacattaaaccttattacagaaatgggtagattacctactttcatgacacaaaaagcgcgtaacgcattagataacctggccgtcctgcacaccgccgaggctggtggccgggcttacaaccatgcattaagtgagttaccggaaaccctggaaacgttactactcttaactctactggccaccgtaacaggtggtatatttctattcctaatgtcgggcaagggaataggtaagatgactctaggaatgtgttgtataatcacggcatcaattctgttgtggtacgcacagattcaacctcattggattgcggcttcaataatattagagttctttcttatagtactgttaataccagaacctgaaaaacagaggacaccgcaagataaccaattaacatatgttgttatagccatattgacagttgtggcagcgacgatggccaatgaaatgggatttttggagaaaaccaagaaagattttggtttaggatccatagcaacgcagcaaccagaaagtaacatcttagacatagacctgcggcctgcaagtgcctggaccctatatgcggtagctactactttcattacaccaatgttacgacattcgattgaaaatagtagtgtgaatgtatcgctaactgctatcgcaaatcaagcgacggtacttatggggcttggaaaaggttggccactatccaaaatggacataggtgtacctctgttagcaatcggatgctacagtcaagtaaaccccataactctaactgccgcgttactcctcttagtagcacactatgctataattggaccgggattacaagctaaggcaacgagagaagcacagaaaagagctgcagctggcattatgaagaatcctacagtagacggtatcacggttatcgacctagatcctatcccttacgatcctaagttcgaaaaacaattaggacaggtgatgttattagtattatgcgtaacgcaggtattaatgatgagaactacatgggccctatgtgaagcattaacgctagcgaccggtccgatttcaacattatgggaaggtaacccagggcgtttctggaatacaacaattgcagtttctatggcaaacatattcagagggtcttatcttgccggagcaggtttgctattcagcataatgaaaaataccacgaatacccgcaggggcacgggtaatacaggggaaacattgggagaaaaatggaagaatagattaaacagtttaggaaaaagtgagttccaaatatataagcgatcaggaatccaggaagttgacaggacattggcaaaagaaggaatcaaaagaggggaaactgatcatcatgcagtttctagagggtccgcaaaattaagatggtttgtagaaaggaatttagtaacacccgaaggaaaagtagtggacttaggctgcggaaggggcggttggtcttattactgtggcggcctcaaaaacgtaagagaagttaagggcctaaccaaaggaggacctggacatgaagaacctataccaatgagtacctatggatggaatctagtgaggctgcagagtggtgttgacgtctttttcaccccaccagaaaagtgcgacacattattatgtgatatcggtgaaagttcccctaatccaacagttgaagctgggcgaacattacgtgtcttaaacctggtcgaaaattggctaaacaacaatactcaattctgtataaaagtcttgaatccctacatgccatccgtaattgagaaaatggaaactttacaaaggaagtacgggggagccctggtgagaaatcctctttcacgcaatagtacccacgaaatgtactgggtcagtaatgctagtgggaatatcgtaagcagtgtaaacatgatatcaagaatgctcataaacagattcacaatgagacataaaaaggcaacttacgaaccagacgtcgacctcgggagcggcacaaggaacataggtattgagtctgaaactccaaacttggacataatcggtaaaaggatagagaaaattaaacaagaacacgaaacatcttggcattatgatcaggaccacccgtataagacttgggcataccacggttcttacgaaacaaaacagacaggctcagcgtctagcatggtgaatggagtggtcaggttactgactaagccatgggacgtaattccaatggtcacacagatggccatgacagatacgactccctttggtcaacaacgagtattcaaagaaaaagtggatactcggacacaagagccgaaggaaggaaccaagaaactaatgaaaatcacagcagagtggctatggaaagagctaagaaagaagaaaacaccaagaatgtgcacaagagaggagttcgcgcgaaaagtccgctccaatgcagcattgggcgcaattttcacagatgaaaacaagtggaaatccgcccgagaagcagttgaagacagccggttctgggaattagtagataaagagagaaacttgcatctggaaggaaaatgcgaaacgtgcgtctataatatgatggggaaacgagagaagaaaataggagagtttggcaaagcaaaaggtagtagagctatatggtatatgtggttaggagctagatttttggagttcgaagcattaggatttttaaacgaagatcactggtttagccgtgaaaattcactctctggagttgaaggtgagggattacataaacttggctacatacttcgagaagtatctaaaaaggaaggaggggcaatgtacgctgatgacacagctggctgggatacccgaataacccttgaagatttgaaaaatgaagagatggtaaccaaccacatggaaggcgaacataagaaactagcggaggccatatttaaattaacatatcaaaacaaagtagtaagagtgcaaagaccaacaccaaggggaacagttatggatatcatttcacggcgagatcaaaggggttcaggccaagtcggtacatatggtttaaacacgttcacgaatatgggagcccaattgattcgccagatggaaggagaaggcgtattcaaaggaatacaacacctcacagcaactgaagaggtcgccgtgcaggactggttagcccgcgtaggaagggaacgactatctagaatggctatatcaggcgacgattgtgtagtgaaacccctagacgacagatttgcaagcgcactaacggcattaaatgatatgggcaaagttagaaaagacatccaacaatgggaacccagtaggggatggaatgattggacacaggtcccgttctgcagccaccattttcatgaattgataatgaaagatggacgagttcttgtagtaccatgtaggaatcaagatgaactaataggacgagcgagaattagtcaaggcgcaggttggtcactacgcgaaacagcctgtctcggaaaaagctatgctcaaatgtggtccctaatgtattttcatagaagggacctaagactggccgcaaatgcaatttgtagtgcagtgccaagtcattgggtcccaacatcacgaacaacatggtcaatccatgcccgtcacgagtggatgacaaccgaagacatgctaacggtctggaatcgagtgtggatacaagaaaatccatggatggaggataagactccagttgaaagctgggaagaaataccatacttggggaaaagagaagaccagtggtgtggatccttaatcggattgacatcacgcgctacctgggcgaaaaatatccagactgccataaaccaagtaagatcattaataggatccgaagagtatactgactatatgcctagtatgaaacgctttagaagggaagaagaagaagccggtgtactttggtga

SEQ ID NO: 22356 - RNA, 9876 nt, synthetic construct
  misc_feature 1..9876: note = derived and/or modified CDS sequence (opt6) from DENV-2__FJ898438__SS-prME
  source 1..9876: mol_type = other RNA
actgtgggagttatagtaatgttaatacctactgcaatggcatttcatttaactactagaaacggggaaccacatatgatcgtagggagacaagaaaaagggaaaagcctattgtttaaaactgaagacggggtcaatatgtgtacactaatggcaattgatctaggtgaactatgtgaagatacaataacatataaatgcccattattacgtcaaaacgaaccagaagacatagactgttggtgcaatagtacaagtacatgggttacttacgggacatgtagcacaactggtgaacatcgcagagagaaaaggtcagtagcgttagtgccacacgtgggaatgggattggaaacacgaaccgaaacttggatgagttcagaaggagcatggaaacatgtacaacggattgaaacatggattttacggcaccctggctttactatcatggcagcgatacttgcttacacaattggtacaacacattttcaaagagccttaatatttatcctgttaacagcagttgcgccctcaatgacaatgagatgtataggtatatctaatcgggactttgtggaaggggtcagcgggggttcgtgggttgacatcgttctagaacatggaagctgtgtaacaacgatggccaaaaataaacctacgctagattttgaattaataaaaacagaagctaaacagcctgccaccttacgtaaatactgcatagaagcaaaattaacgaacactacaacagagtcacggtgtccaacccagggtgaaccttcgttaaatgaagaacaagataaacgctttatttgtaaacacagcatggtggataggggatggggtaatggatgtggtctattcggaaaaggaggaatcgtcacttgtgctatgtttacatgcaagaaaaatatggaaggaaaagtagtgcagcccgaaaacttcgaatatacaatagtaataacaccacacagtggagaagaacacgcggtaggtaatgatacagggaaacacggaaaagaaataaaaataactccacaatcctcaataactgaagccgaacttacaggctacggcacggtgaccatggaatgttcaccaagaacaggacttgacttcaatgagatggtcttattacaaatggaggataaagcatggctggttcatagacagtggttcctagatcttcctttaccttggttaccaggcgcagacacccaggggagtaattggattcaaaaagaaactttggtgacctttaaaaacccacatgccaagaaacaagatgtggttgtattaggatcacaagaaggcgctatgcacaccgcgttaaccggtgcgaccgaaatacagatgagcagcggaaatttattatttaccggtcacctaaaatgtagattgagaatggataaactccagcttaaaggaatgagttatagcatgtgcaccggtaaatttaaaattgtgaaagaaatcgcggaaacacagcacggaacaatcgttataagagtacaatatgaaggtgacggcagtccatgtaaaatcccattcgagattactgacttagaaaaacgtcatgtgttagggagattaatcacagttaatccaattgttaccgaaaaagatagcccggttaacatcgaagcagagcccccatttggagactcctatattatcattggagttgaaccaggacagctaaaactaaactggtttaagaaaggatcaagcataggacaaatgtttgaaacaacgatgcgaggagcgaaacggatggccatcctcggggatacagcatgggactttggatcgttaggaggggtttttacctctatcggtaaagcgctacatcaagtattcggcgcaatatatggagccgcgttctccggggtcagttggacgatgaaaattctaattggagttattattacatggattggaatgaacagcaggagcacgagcttgtcagtaagtttagttctcgtgggcgtagtaaccctatatctaggagcgatggtccaagcagacagtggatgtgtagttagctggaaaaacaaagaattaaaatgtggatcaggcatcttcattacagacaatgtacatacatggacagaacaatacaaattccaaccggagtcaccgagcaaacttgcatcagccatacaaaaagcgcacgaagaaggcatttgtggaatacgatcggtaactcggttagagaatctgatgtggaaacagataaccccagagctaaatcatatattgtcagaaaatgaagtaaaacttactatcatgacaggagatatcaaagggatcatgcaagctggaaaaagatccttacgaccacagcctacggaactgaaatacagttggaaaacctggggtaaagcaaagatgctttcgacagaaagtcacaaccaaacatttctgattgatgggccggaaactgcagagtgcccaaactctaacagggcttggaacagtttagaagtcgaagattatggattcggtgtatttacaacgaacatttggctgaaactgagggagaaacaggatgtattttgtgactctaaactcatgagtgcggcgattaaggataatcgcgcagttcacgccgacatggggtactggatagagtcagcgctcaatgacacatggaaaatggagaaagcatcttttatcgaggtaaaatcatgtcattggccaaaaagtcatactctatggagtaacggagtacttgaatctgagatgataatacccaaaaattttgctggtcccgtaagtcaacataactatcgaccaggataccatacacaaactgcaggaccttggcatcttggaaaactagagatggatttcgatttctgcgaaggtaccaccgtagtcgtgaccgaagattgcggaaatagagggccgagtctgagaaccacaacagcctcagggaaactaataactgaatggtgttgccgtagctgcacgttacctcctctaagataccgaggggaggatggatgttggtacgggatggaaatacgccccttaaaagagaaagaagaaaacctagtaaattcattagtgacggccggacatggccagattgataatttttctctgggagttctaggtatggccctctttttggaagagatgctaagaacaaggataggaacaaaacatgccatcctattagtggcagcgtcatttgtgaccctgatcacaggaaatatgtcgttcagagatcttggccgagttatggtgatggtgggtgcaacaatgactgatgatataggtatgggagttacatacttagctctacttgcggcatttaaagtgcggcctacattcgcagcgggattgctactgaggaaactgacgtcgaaggagcttatgatggccacaataggtatagcactactctctcaaagcacgataccagagactatactagaattaactgacgcactagctctgggtatgatggtgctaaagatagttcgaaacatggagaaatatcagcttgccgttacaataatggctatatcgtgtgtacctaatgctgttatccttcaaaacgcttggaaagtatcatgtaccatcctggcagcagtatcagtatcgcccttattactaacttcaagtcagcaaaaagcagactggatacctctagcgttgactataaaaggtttgaatccaacggctatcttcttgacaactctaagcagaacttctaagaaacgatcgtggccactaaacgaagcagtgatggccgttggcatggtaagtatattggcttctagcttacttaaaaatgatataccgatgacaggaccattagtagccggaggcctcctcactgtctgctacgtgctaacaggaagatctgcagatctcgagctcgaaagagcggctgatgtgaaatgggaagatcaagcagaaatatcgggttcaagtccaatcttatcgataactataagcgaagatgggtccatgagtattaagaatgaagaagaggaacaaacacttacgatactaatccgaacaggcctattggtaattagtggagtttttccggtaagtatcccaataacagcagcggcttggtacctttgggaagttaagaaacaaagagctggtgttctatgggatgtaccttccccacccccggtagggaaagcggaactcgaagatggcgcatatagaataaaacagcgtggtatacttggttacagtcaaataggagccggggtttataaagaaggtacgtttcatacgatgtggcatgtaacccgaggagctgtattgatgcatagagggaaaagaatcgagccgtcctgggctgacgtcaagaaagacttaatatcctatggagggggatggaaactagaaggagaatggaaagagggagaagaagtccaagtattagcactagagccgggtaaaaatccaagggctgtccaaactaaaccaggaatattcaagacaaatacgggtacgattggcgcagttagtctagattttagccctggaacgagtggatcacccatcgttgatagaaaagggaaagtagtaggactatatggtaatggagtagttacacggtcgggagcgtatgtgtcagccatagcacaaactgagaagtctatcgaagataatcccgagatcgaagacgacatcttcagaaagaaacgactaacaattatggatttacacccgggagcaggtaaaactaaaaggtaccttccagctatagtaagggaagctataaagagagggctgaggacgcttattttggcacctaccagggtagttgcagccgagatggaagaggctttaagaggtcttccaattagatatcaaacccctgctattaaaacagaacacactggcagagaaatcgttgatttaatgtgtcacgccacatttacaatgcgtctactctctccagtaagagttcctaactataacttaatcataatggacgaagcccattttacagatcctgctagtatagccgcacgaggatatatatcaacaagagtagaaatgggggaagctgcggggatttttatgacagcgacaccgccaggttctagggatccattcccacaatcgaatgctcctataatggatgaggaacgagaaataccggaaaggagttggaactcaggacatgaatgggtgacagactttaagggcaaaactgtttggttcgttccttcgattaaagccggaaatgatattgcagcatgcttgaggaaaaatggcaagaaagtaatacaactatcaagaaaaacgtttgacagcgaatacgtcaaaactcgggccaatgattgggattttgttgtaactaccgatatttcggaaatgggggctaacttcaaagcggaaagggtgatcgaccccagacgatgcatgaaacctgtgatattaacagacggtgaagaaagagtcatcctcgcaggaccaatgccagtcacccacagctcggccgcgcaaaggcgaggcagaataggccgaaaccccaaaaatgaaaatgaccaatacatatatatgggcgagccattagagaatgatgaggactgcgctcactggaaagaagcaaaaatgctgttagataacataaacacaccggaaggtattatcccatcaatgtttgaaccagaacgagagaaagttgacgctattgacggagaatatagattgcgcggagaggcacgtaaaactttcgttgacttaatgagaagaggagatttacctgtatggctcgcgtacaaagttgccgcagaaggcatcaactacgctgatagaaaatggtgcttcgatgggattaaaaataaccaaatactagaagagaacatggaagtagaaatatggacaaaagaaggagaaagaaagaaactaaaaccaaggtggttagatgctcgtatatactcggatccgctagccctaaaggaatttaaagaatttgcagcaggtagaaaatcgttaactctaaatctaataactgagatgggcagacttcccacgttcatgacgcagaaagcccgaaatgcacttgataatttggccgtactccatacggcggaagcagggggacgtgcttataaccatgcgttaagcgaattacctgagacactagaaaccctcctgttattaacactccttgcaacagtcacgggagggatattcttatttttaatgtccggaaaaggaatcggcaaaatgacattaggcatgtgttgtatcataacagcaagcatattactttggtacgcccaaatccagccccattggatcgctgcatcaataattcttgagttctttctgatagttttgctaataccagaaccggaaaaacaaagaactccacaggacaaccaattaacgtacgtcgttattgcaatactaaccgtcgtagcggccacaatggccaacgaaatgggatttctagagaaaacaaagaaagacttaggtcttggatcaatcactacacaagaaagcgaaagtaacatactggacattgatttacgacccgcatcagcatggactttgtacgctgtagcaactacattcgtgacgccaatgctgcgtcattccatagaaaattcaagcgtaaacgtctctctcacagccatagctaatcaggccacagtactcatgggccttgggaagggatggccactatcaaagatggatattggagtacctctcttggcgattgggtgttactcccaagtgaatccaataacccttacagcagctttactacttctagtcgcgcattatgccataatagggcccggactccaggccaaagctacaagggaagcgcagaaaagagccgcagcaggcataatgaaaaaccctactgtcgatggaattacggtaattgacttagaaccaatcccatacgatccaaaattcgagaaacaattgggccaagtcatgttactaatattgtgtgtaacacaagtattaatgatgagaacaacatgggctttatgcgaggcccttacattagcaacaggaccaataagtacattatgggaaggcaatccaggacgtttttggaatacgacaattgcagtaagcatggcaaatatcttcagaggaagctatctggcaggggcaggcctgttattcagcataatgaaaaatactaccaatacacgacgaggaactggcaatattggtgagacattaggagaaaaatggaaatctagactcaatgcgctgggcaaatccgaatttcaaatatacaaaaagtcagggattcaagaggttgatagaaccctagccaaagaaggaataaagcgtggagaaactgatcatcatgcagtaagtagaggaagcgctaaattgaggtggtttgttgaacggaacatggttactcctgaggggaaggtggtggatctaggttgtgggagaggagggtggtcgtattattgtgggggcctcaaaaatgttagggaggttaagggacttactaaaggaggaccgggacacgaggagccaatacccatgtcaacgtacggctggaacttagtacgattgcaatcaggagttgatgtattctttactcctccagaaaagtgtgacacgctattgtgtgatataggagaaagctcaccgaatcctaccattgaggcaggtcgaacattgcgtgtcctcaatttggttgaaaattggctaaataataatactcaattctgtattaaagtattgaacccatacatgcctagcgtaatagagaaaatggagacactacaacgaaagtatggaggggcgttagtcaggaacccgctatcacgtaattcaacccatgagatgtactgggtatctaacgcgacggggaatatagtttcaagtgtaaatatgatttcacgcatgttgataaatagatttaccatgaaacacaagaaagccacttacgaaccagatgtagatctaggaagtggcacaagaaacatcggcattgaaagcgagatccctaatttggacattataggaaagagaatagagaaaatcaaacaagaacatgagacgagctggcactatgatcaggaccatccatataaaacgtgggcttaccatggaagttatgaaacaaaacagacagggagcgcttccagtatggtaaacggcgtcgtcagattgcttaccaagccttgggacgtagtaccaatggttacacaaatggcgatgacggacacaacgccctttggtcagcaaagagtttttaaagaaaaggttgacactcgcacgcaagaaccaaaagaagggaccaagaaattaatgaaaatcacagctgaatggctatggaaagaattaggtaaaaagaaaactccaagaatgtgcacaagggaagagttcacaagaaaggtaagatcaaacgctgccctcggtgccatctttacagatgaaaataagtggaagtcagcgagggaagcggtcgaagatgggagattttgggaattggtagaccgagaaaggaatttacacttagaaggcaaatgcgaaacatgtgtgtacaatatgatgggcaaacgagagaagaaactcggtgagtttggtaaggctaagggatcaagggcaatatggtatatgtggcttggtgcccggttcttggaatttgaagccctaggatttttaaacgaagatcattggttctcccgagggaatagtttatcaggagttgagggggaaggactacatcgcttaggatatatattacgggacgtgggcaagaaagaagggggagccatgtacgcggacgatacagcaggatgggatacgagaataacattagaagacctaaagaacgaggagatggttactaaccacatgaagggtgaacacaaaaagctagctgaagcaatatttaaacttacgtatcaaaataaagttgtcagagtacaaagaccaacaccgcgaggcacagtgatggatatcataagtcggcgagatcaacgagggagtgggcaagtaggtacatatggcttgaacacgtttacgaacatggaagcccaactcatacgtcaaatggaaggagaaggtatttttaaatcgatccagcacttaacagcgacagaggaaatagcagttcaaaattggctagcgagagtaggtcgggagcgattatcgaggatggcaatctcaggagacgattgtgtagtcaaacccatagacgatagattcgcgagtgccctaactgctctgaatgatatgggtaaagtaagaaaggacattcaacagtgggaaccatcaagaggctggaacgattggacccaggtccccttctgcagtcaccactttcatgagttggttatgaaagatggtagagtactcgtggtaccatgtagaaaccaagatgagctaataggccgtgcacgcataagtcaaggagcaggctggagtttaaaggaaacggcctgtcttggaaaatcatatgcgcaaatgtggactttaatgtattttcacagacgtgacttgaggctcgcagcgaacgctatttgttccgcagtaccatcacattgggtccccacttcgaggacgacgtggtcaatccacgccaagcatgagtggatgacgacggaagacatgttagcagtatggaaccgagtttggatacaagaaaacccttggatggaagacaaaaccccagtagaaagttgggaagaagtaccctatcttggaaagagggaagatcaatggtgcggatcgctaattggtctcacatcaagagcaacctgggctaaaaacatacaaactgccataaatcaagtaagaagtttaataggaaatgaggaatatacagattacatgcccagcatgaagagatttcggagggaagaggaggaagctggagttctatggtga

SEQ ID NO: 22357 - RNA, 9876 nt, synthetic construct
  misc_feature 1..9876: note = derived and/or modified CDS sequence (opt6) from DENV-2__GQ199893__SS-prME
  source 1..9876: mol_type = other RNA
acggcaggggtcatagtaatgctcatcccaacagcaatggcgttccatttaacgacaaggaacggtgaacctcacatgatcgtaggacggcaagaaaaagggaagtctcttctttttaaaaccgaggatggggtaaatatgtgcacactaatggcgattgatctcggagagctatgcgaagatacgattacatataaatgtccactcttacgtcagaacgaacctgaagatatagactgctggtgtaacagtactagcacgtgggtcacctatggaacatgtacgacaactggggaacatcgaagagagaaaagatctgtagccttggtaccacatgttggtatggggctagaaacgagaacggagacttggatgagttcagaaggagcttggaaacacgttcagcgtatcgaaacctggatcttaagacacccgggttttactataatggcagcgatacttgcgtataccatcggaaccactcatttccaaaaagcgttaatatttattttactaacagcagtggctccgtctatgacaatgcgatgtataggaattagtaaccgagattttgtagagggcgttagcggtgggtcatgggttgatatcgtactcgaacatggatcttgtgtaacaacgatggccaaaaacaaaccaactctagatttcgaacttattaaaacagaggccaaacagccagctacattacgaaagtactgtatcgaggcaaaattaactaacacaactacagagtcacgttgcccaacacaaggagaaccttcgttaaatgaagaacaggacaagagatttatctgcaaacatagtatggtagatagaggatggggtaatggatgtggtttgttcggtaaaggtgggattgtgacgtgcgcaatgttcacctgtaagaagaacatggaaggaaaggttgtccaaccagaaaaccttgagtatacaatagtaataacgccacattctggggaagagcatgccgttggcaacgacactggtaaacacgggaaggagataaagataacaccacagtcttctatcacagaagctgaactcaccggatatgggactgtaacaatggaatgtagtccaagaacagggctcgactttaacgaaatggttttgctacaaatggaagataaagcttggttagtacatcggcagtggttccttgatttaccattaccatggctcccaggagcagatactcagggatctaattggatacaaaaagaaactttagttacattcaagaacccacacgccaaaaaacaagatgtcgttgtcttaggaagtcaggaaggcgccatgcatacagcattgacaggagcaaccgagattcaaatgtcaagtggtaatcttttatttaccgggcatctaaaatgtcgactgcgaatggacaaattgcaactgaaagggatgagttactcgatgtgtacaggaaaatttaagatagttaaggaaattgcggaaacacaacatggaacaatagtgataagagtgcaatatgaaggagacggaagcccgtgcaaaataccatttgaaattacggatcttgaaaaaaggcacgtattaggcaggttaattacggtgaatccgatagtaactgaaaaggacagcccggttaatatcgaggcagaaccaccgttcggagactcatatattatcataggggttgaaccaggtcaacttaagttaaattggtttaagaaaggatcgagtataggccaaatgttcgaaactacaatgagaggtgcaaagcgaatggccatactaggggacactgcttgggatttcggcagcttaggcggagtttttacgtcaattggtaaagccctccatcaggtgtttggagcaatttacggagcagccttttctggtgtgtcatggaccatgaaaatactcataggagtcattatcacttggattggtatgaatagtcgttcgacatcgttaagcgtatccctagtgctagttggggttgtaacattatacctaggtgcgatggtccaagcagactcaggttgcgttgtgtcttggaaaaataaagaattaaaatgtgggtcaggaatattcataacagacaatgtgcacacatggaccgaacagtataagttccaaccagaaagtccttctaaattagctagcgccatacaaaaggcacatgaagaaggcatttgtggtataagatcagtaacgagacttgaaaacctaatgtggaaacagattacacccgaattgaatcacatactatcggaaaatgaggtgaagttaaccatcatgacaggagatataaaaggaataatgcaagcggggaaacggagtcttagaccacaacccacggagttaaagtactcgtggaaaacatggggaaaagcaaaaatgttatcgacagaaagtcataatcaaacttttctcatagacggtcctgagactgctgaatgtcccaataccaatagggcttggaatagccttgaagttgaagattatggatttggtgtgtttacgacaaacatatggctgaaacttagggagaaacaagacgtattttgtgacagcaaattaatgtctgcagccattaaagacaatagagccgtacacgctgatatgggatattggatagagagtgcactaaatgatacttggaagatggaaaaagcctcgtttatagaagtaaaatcctgtcactggccgaagtctcacactctctggtcgaatggagttctggagagtgaaatgataatacctaaaaattttgcagggcctgtcagtcaacataattatcgccctggatatcatacccagacagcagggccttggcacttgggtaaattagaaatggactttgacctatgcgagggtaccacagttgtcgttacagaagattgtggaaacagaggccccagtctgaggactaccactgcatctggaaaacttatcacagaatggtgttgtcggagttgtacgctaccaccactacgttataggggtgaggatggttgttggtatggaatggaaattcgacctctaaaagagaaagaggaaaacctagtaaactctctagtaactgctgggcacggacagatagataactttagcttaggtgtacttggcatggcattatttcttgaagaaatgttgcgtacgagaattggtactaaacacgcaatcttattagttgctgtgagctttgtcactctgataaccggcaacatgtcatttagagacctaggtagagttatggtcatggtaggcgcgactatgacggatgatatcgggatgggagtcacttatctcgcacttttggcagctttcaaagtgcgtccaacgttcgcagcaggtttacttctacgtaagcttacttcaaaagaattaatgatggcgacaataggtattgctttgctgtctcagtccaccataccagaaacaatactcgaattaactgatgcacttgcgcttggaatgatggtattgaaaatagttagaaatatggaaaaatatcaactggcagtcaccattatggcgatatcatgtgtacctaatgcagtcatattacagaatgcatggaaagtcagctgtacaattcttgcagcagtttccgtatcaccattattattaacatcaagtcaacaaaaggctgactggataccactggcacttacaattaagggcttaaacccaacagctatcttcttaactactttatcacgcacaagtaagaagagaagttggcctttaaacgaggcaataatggcggtaggcatggttagcatactagcctcgtctctcttaaaaaatgacataccgatgacaggacctttagtagcagggggtttattgaccgtatgttacgttcttacaggaagaagcgcagatctagaactggaaagagcggctgacgttaaatgggaagatcaagcagagatttcgggctcatcgccaatccttagtatcacaatctctgaagacggtagtatgagtataaagaacgaggaagaagaacaaacattgaccatactaatacggactggtctattagtcatttctggggtatttcctgtaagtattccaataaccgctgctgcgtggtacttatgggaggtgaagaagcaaagggcgggagtcttatgggacgtgccatcaccaccaccggtagaaaaagccgaattagaagacggtgcctacagaataaaacagcgggggattttagggtacagccaaataggcgcaggcgtctacaaagaaggcacctttcacactatgtggcatgtcactaggggtgcagttttaatgcatagaggaaagcgaatagaaccaagttgggccgacgttaaaaaagatctcatttcttacggcggagggtggaaacttgaaggcgagtggaaagagggcgaagaggtacaagtcctagctttggagccgggtaagaatcctagagcagttcaaacgaaaccaggcatttttaaaacaaacactggaactataggagcggtctcgttggacttcagcccaggaactagtggaagtccaattgtagaccgcaaaggaaaagtcgtgggactttacggaaacggcgttgtgactcgatcgggtgcgtacgtgtccgccatagcgcagacagaaaaaagtattgaagacaaccccgagatagaagatgacatttttcgaaaaaaaaggcttactataatggatttacaccccggggcaggcaagacaaagcgctacttaccagcaatagtacgggaagcaataaaacgaggactaagaaccctaatactagcaccaacacgagttgttgctgctgaaatggaagaagcactaaggggacttccaatacgatatcaaacgcctgctataaaaactgaacatacaggacgcgaaatagtagacttaatgtgtcatgccactttcacaatgcgactactaagcccagtaagggtccctaattataacctaataattatggacgaagctcattttacagatcctgctagcatagcagcgcgtgggtatatatctacacgagttgagatgggcgaagcggcaggtatatttatgacagctacgccgccaggttcgcgagatccattccctcaatccaacgcaccaattatggacgaggaaagagaaatacctgagcgtagctggaattccggacatgagtgggtaactgatttcaaaggtaaaacggtatggttcgtaccaagtattaaagcggggaatgatattgccgcctgtttgagaaagaatggtaagaaagttatacagttgtccagaaaaacgttcgatagcgagtatgtaaaaacaagagcaaacgattgggactttgtagtgaccactgacatctctgagatgggggcgaactttaaagccgaaagagtaattgaccccagacgctgcatgaaacccgtaattttgacagacggtgaggagagagttatattggcaggacccatgcctgttacacatagctccgctgcacaacgtcggggacggataggacgaaacccaaagaatgaaaatgatcagtacatttatatgggggagccgctagaaaacgacgaagactgcgctcattggaaagaggctaaaatgctattagacaatattaataccccagaaggaataatacctagtatgtttgagcctgaaagggaaaaagtggatgcgatcgacggggaatatagacttagaggtgaagcaagaaaaacatttgttgatcttatgaggagaggagacctgcccgtatggttggcttacaaggtcgctgctgagggtataaattacgctgaccggaaatggtgtttcgatgggataaaaaataatcaaattctcgaagagaacattgaagtagagatttggacaaaagaaggagaacgaaagaaactaaagccaagatggttagatgctcggatatatagcgatcctttagctttaaaagaattcaaagaatttgctgcaggtcgtaaaagcttaacactaaatcttatcacagaaatggggagattacccacctttatgactcagaaagcacgtaacgcgttagataatctagcggtgttacacactgcagaagctggaggaagggcttacaatcacgccctatctgaactgccagagacactagagaccttgctacttttaaccctactggctactgtaacaggagggattttcctgttcctaatgtcaggtaaaggaatcggaaagatgactttaggaatgtgctgtataataactgcatcaattctactatggtatgcgcaaattcaaccacactggattgctgccagcatcattttggagttctttttaattgtgttattgataccagagccagagaagcaacgtactccccaggataaccaactgacatatgtcgttatagcgatactgacagtggtcgcagcaactatggctaatgagatgggttttttggaaaaaacaaagaaggatttaggtttgggaagtataactactcaagagagtgaatcgaacatactagacatagatctacgtccagctagcgcatggacgctgtatgcagtagctacaacttttgttacaccaatgttaagacacagtattgaaaactcatcggtgaacgtttcactaacagccatcgctaatcaagctacagtattaatgggcctaggcaaaggatggccacttagtaagatggatataggagtacctcttctagcaatcggatgttatagccaagtaaacccaataacattgacagctgcgttgttactactagtggcacattatgcgattataggacctgggctccaggctaaagctacacgagaagcacagaaaagggcagccgcaggtattatgaagaatccgacggttgatgggattacagttatagaccttgagcctataccctacgatccaaaatttgaaaaacaactgggacaagttatgcttctaatattatgtgtgacacaagtattgatgatgaggactacgtgggcactttgtgaagcattaacgttggctactgggccgataagcacgctatgggagggaaaccccggtagattctggaacacaaccatagccgttagcatggcgaatatatttcggggatcgtaccttgctggtgcaggattactatttagcattatgaagaacacaaccaatacgagaagaggaaccgggaatatcggtgaaactcttggggaaaaatggaaaagtagactaaacgccctcgggaagtcagaattccaggtttacaagaagtcaggcatacaagaagtcgatagaacacttgcgaaggagggtattaaaaggggagagacagatcatcatgctgttagtagaggttcagcaaaattacgttggtttgtcgaaaggaacatggtaacgccagaggggaaagttgtggatttaggctgtggaagaggagggtggtcttactactgtggggggctaaaaaatgtaagagaagtaaaaggcctaacgaaagggggaccaggtcatgaggaaccaatacctatgtccacctacggttggaacctggtgaggttgcaaagtggagtagatgtatttttcacaccacctgaaaaatgtgatactctactatgtgatattggcgagtcttcacccaatccaacaatagaagccggccgtacgttaagggttttgaaccttgtggaaaattggttaaataataacacacaattttgtataaaagtcctaaacccatatatgccatcggtaattgagaaaatggaagcgttgcaaaggaaatatggaggggcgttagtacggaatccattatccagaaatagtacacacgaaatgtattgggtatcaaatgctactggaaatatagtgtcttccgtaaatatgatatcaagaatgttaataaacaggtttacgatgaaacacaaaaaagcgacctatgaacctgatgtagatttaggttcagggacaagaaatattggaattgaatcggagattcccaacctagatataataggtaagagaatagaaaaaataaagcaagaacatgaaacatcttggcattatgatcaagatcatccttataaaacctgggcatatcatggatcatacgaaacaaaacagaccggttctgcttcctcaatggtgaatggagtagttagactgcttactaaaccatgggacgtcgtaccaatggtaacacaaatggctatgacagatactacacctttcggtcagcagcgagtattcaaggaaaaggtggacacgagaactcaagagcccaaagaaggtactaagaaattaatgaaaatcactgcggagtggctatggaaggaattgggaaaaaaaaaaacacctcgaatgtgcacccgagaagaattcacaagaaaggtcaggagtaatgccgctttaggtgcaatatttacagatgaaaataagtggaaatcagcccgggaagctgtcgaggatgggcgattttgggaactcgtcgatagggaacggaacttacacctcgaaggaaaatgcgaaacatgcgtttataatatgatgggtaaacgtgagaaaaaattgggggagtttggtaaagctaaggggtcgagagcgatttggtatatgtggctaggggcgcgtttcctagaattcgaagcactcggtttcttgaatgaagatcattggttttcaaggggaaacagtctaagtggagtagaaggcgaagggctacatcgacttggatatatattaagagacgtaggcaaaaaagaaggtggagcaatgtatgccgatgatacagcaggatgggatacaagaataactcttgaagatttaaagaatgaagaaatggtcacgaatcacatgaaaggagaacacaaaaagctcgcagaggcaatttttaaactaacctaccaaaacaaagtagttcgagtacagcggccaaccccaagagggacagttatggatataattagcaggcgtgatcaaaggggttcagggcaagtaggtacgtacggtttaaatactttcactaatatggaagcgcaattgatacgacagatggaaggggaagggatatttaaaagtattcaacatcttacagcaacggaggaaatagcagtccaaaactggctagcaagagtaggccgagaaagactctccagaatggctataagtggtgacgattgcgtagtaaaacccatagatgataggtttgcaagtgccctaacggcgttaaatgacatgggtaaggtacgaaaagatatccaacaatgggagccgagtcggggttggaatgattggactcaagtgcctttttgttctcatcattttcacgaactagtgatgaaagatggcagagtgttggtagttccatgtcgtaatcaggatgaattaattggcagagctcgaatttcgcaaggtgctgggtggagccttaaagaaacggcttgtttgggcaagtcatatgctcaaatgtggaccttgatgtactttcaccgacgggacctaagactcgctgcaaacgccatctgttcagctgtgcccccacattgggtaccaacgagtcgtaccacatggtcaatacatgccaagcatgaatggatgacaacggaggatatgttggcagtctggaatagagtatggatacaagaaaatccatggatggaagacaagacaccagttgaaagttgggaagaggtaccatatctaggcaaaagagaggatcaatggtgtggctcattaatcggtctaacttctagagcgacatgggctaaaaacattcaaacagcgataaatcaggtaagatctctaatagggaatgaagagtatacagattacatgccatcaatgaagcgatttcgaagggaggaagaggaagctggagtgttatggtga

SEQ ID NO: 22358 - RNA, 9876 nt, synthetic construct
  misc_feature 1..9876: note = derived and/or modified CDS sequence (opt6) from DENV-2__GQ199894__SS-prME
  source 1..9876: mol_type = other RNA
acggcaggggtcatagttatgttgattcccactgcgatggcatttcatcttacaacacgaaatggtgaaccgcatatgatagttggaaggcaagaaaaagggaaaagtcttttatttaaaacagaagatggggtcaacatgtgtaccttgatggcaattgacctaggagaactatgcgaagacacgattacgtataaatgtccattactaagacaaaacgaacctgaagatatagattgttggtgcaatagcacatcaacctgggtcacctacggtacgtgcactactactggagaacacagaagagagaaacgaagtgtcgcgctagtgccacacgtaggtatggggctggaaacgagaacagaaacttggatgtctagtgaaggtgcttggaaacatgtacaaagaatagaaacctggatattgcgtcatccaggatttactataatggcagcgatactagcgtatacaatagggacaactcacttccagaaagcactaatctttatattactaacagcagttgcaccatcaatgaccatgagatgtataggaatctccaacagagattttgtagaaggggtttcaggaggatcctgggttgacattgtgctagaacacggatcatgcgtgacaactatggcgaaaaacaaaccaacattggattttgaattgattaaaacagaagctaaacaacctgctactctacgaaaatattgtatcgaagcgaaattaactaataccactacagaaagcagatgcccgactcaaggagagccttctttaaatgaagaacaggataaacgttttatttgtaaacactcaatggttgacagaggatggggaaatggttgcgggcttttcggcaaaggcggaatagttacgtgtgcgatgttcacatgtaagaaaaatatggaaggaaaagttgttcaaccagaaaatcttgaatacaccatagttataacgccacatagtggagaagaacacgcagtgggaaacgatacaggaaaacatggaaaagaaatcaaaataactccgcaatcaagtatcacagaagccgagcttacaggatatggaacagttacaatggaatgtagtccacgaacaggactggattttaatgaaatggtattattacagatggaagataaagcatggttggttcataggcagtggtttttagatctaccattaccttggctcccgggagctgatacccaaggtagcaattggattcaaaaagagacattagttactttcaaaaacccgcacgcgaagaaacaggacgttgttgtactgggaagtcaagagggtgcaatgcacaccgcattaacaggagccactgaaattcaaatgtctagtggtaatctcttattcacaggtcatttaaaatgcagactgagaatggacaaactacaactaaaagggatgagttactcaatgtgcactggaaaatttaaaatagtcaaagaaattgcagaaacacagcacggtacaattgttataagagtgcaatacgaaggagacggctctccgtgcaaaataccgtttgagatcactgaccttgaaaaacgacacgttttggggcgtctgattacagtcaacccgatagtaactgaaaaagattcccctgttaatatagaggcagagcctccctttggcgacagctacatcattataggcgtggaacccggtcaactaaaacttaactggttcaagaaaggttccagtattggacagatgtttgagacaactatgcgcggggcaaaacgtatggcaatattaggggacacagcgtgggacttcggaagtctaggtggagtcttcacatccatcggcaaagcactacatcaagtatttggagcgatttacggggcggcattttccggggtcagttggactatgaaaatcttaatcggagtaattataacatggataggcatgaacagccggtcaaccagtctgtcagtatcgttggttctcgtaggcgttgtaacactatatttgggagctatggtccaggccgattctgggtgtgtagtctcatggaaaaataaagaattaaaatgcggttcaggtatatttatcacagacaatgtacacacctggacggaacaatacaaattccagccagagtctcctagtaaactagctagcgctattcaaaaagcgcacgaagaaggcatatgcggtataaggagcgttactcgcctagaaaacctaatgtggaaacaaattacacctgaattaaatcatatactatctgagaatgaagtaaagttaaccattatgacgggcgatataaaaggaatcatgcaggctggtaaaagaagcctgcgaccccaacccacggagcttaagtacagttggaagacctgggggaaagccaaaatgctatctaccgagtcgcacaaccaaacttttctaatagatggacccgagaccgcagaatgtccaaatactaatcgtgcttggaatagtctagaggttgaggactatggtttcggcgtattcactaccaatatttggctaaaactgcgagaaaagcaagatgtcttttgtgattcgaagttaatgagtgcagcaatcaaggacaatcgcgccgtgcacgcagacatgggttactggatagaatcagcgttaaacgatacttggaaaatggaaaaggcgagcttcattgaagttaaaagttgtcattggccgaaatctcataccttatggagcaacggagttcttgagtccgaaatgataataccaaaacatttcgcaggaccagtaagtcaacataattacagaccaggttaccacacacaaacggccggaccttggcacctaggcaaattagaaatggattttgacctgtgcgaaggtacgacagtagttgtaacggaggattgcggaaacagaggaccatccctacgtactacgactgccagtggaaaattaatcaccgagtggtgctgtaggagttgtacattgcctcccctaagatacagaggagaagacggatgttggtatggaatggaaattaggccacttaaagagaaagaggaaaacttagtcaattcacttgtaaccgccggtcacgggcaaattgacaatttcagtttgggggtgttgggaatggctttgttcctagaagagatgctgagaactagaataggcaccaagcatgccatattgctggtagcggcaagttttgtaacgttaatcacaggaaatatgagctttcgagatctaggacgagttatggttatggtaggcgcaactatgaccgatgacataggaatgggagttacatatttggcacttttagccgcttttaaagtcagaccaacctttgcagctgggttgctgctcagaaaactgacaagcaaagagttaatgatggccaccattgggattgctttattaagccaaagcacgatcccagagacaattttagaattgaccgatgccctggcactcggaatgatggtcttgaaaatagttagaaatatggaaaaatatcaactggcagtgacgattatggctatatcatgtgtgccaaacgcagtaatacttcagaatgcttggaaagttagttgcactattctagcggctgtatcagttagccccttactactaacatcctcacagcagaaggcagattggattccccttgcattaactattaagggactaaaccccacagctatatttttgacgacactaagtcgtaccagtaagaaaagaagttggccattaaatgaagctataatggccgtaggaatggtgtctatactggcatcgtcgcttctcaaaaatgacatcccgatgactggaccattagtcgctggagggttattaacagtatgctatgttttaacaggaagatcagccgatctagaacttgagcgtgctgcggatgtaaaatgggaggatcaagcagaaatttcaggttcatctccaatattaagtataactatatccgaagacggatccatgtccataaagaatgaagaagaagaacaaacattgactatactaattagaacaggtctcctggtaatctcaggtgtattcccggtatcaataccaattactgcagcagcatggtacctatgggaagtgaagaaacagagagccggtgttttgtgggatgtcccctccccaccccctgtggaaaaagcggagctagaagacggcgcctaccgtattaaacaaagaggaatacttggctactctcaaataggcgccggtgtctacaaagaaggtacctttcatactatgtggcatgtgacacgtggcgctgtgctcatgcatagaggaaaaagaatagaacccagttgggctgacgtaaagaaagaccttatatcttacggaggtggttggaaattagaaggagaatggaaagaaggcgaagaagttcaagtactagcattagaaccaggcaaaaaccctagagccgtccaaacgaaaccaggtatatttaagacaaatacaggtactataggcgcagtatctttagacttttctccaggaacaagcggcagcccaatcgtagataggaaaggaaaagtcgttggattatatggtaatggggtggtaacaagatcgggtgcatatgtctcagctatcgcgcaaaccgagaaaagtatagaagacaatcccgaaatcgaagacgatatattcaggaagaaacgactgacgatcatggatctgcatccgggggcaggaaaaactaaacgatatttaccggcgattgtcagggaagcaattaaaaggggcttgcgaacattaatactagctccgacccgcgtagtcgcagcggagatggaggaagcactacgaggtttacctattcgataccaaacccccgctataaaaacagaacataccggtagagagatagtggatttaatgtgtcacgctacttttacaatgagactgttatcacccgtccgagtaccaaattataacctgattataatggatgaagcgcactttacagaccctgcgtcaatcgcagcacgagggtatattagcacaagggtggaaatgggagaagccgcggggatttttatgacagcaactccaccaggatcaagagacccattccctcaatctaatgcaccaattatggacgaggaacgtgaaataccagaaagaagctggaactctggtcacgagtgggtgactgactttaaaggtaagacagtatggtttgttccaagcattaaagcgggaaatgacatagcggcctgccttcgcaaaaatggcaagaaagtaatacaactctcgagaaaaacatttgacagtgaatatgttaagactagagctaatgattgggactttgtagtgacaacggatataagtgaaatgggcgcaaactttaaagcagaaagggtaatagacccacgtagatgtatgaaacccgtaatactaactgacggtgaagaacgagtgatactagcaggtccaatgcctgtgactcatagttcagcagctcagaggcgcggcagaatcggaaggaatcctaaaaatgaaaatgatcagtacatctatatgggcgaaccactggaaaacgatgaagactgtgctcactggaaagaagcaaagatgttacttgataatatcaatactccggaaggcattataccttccatgtttgaaccagaaagagagaaagtagatgcaatagatggggagtaccgattaagaggtgaggctagaaaaacgttcgtagacttgatgcgtcgtggagaccttcccgtgtggttagcgtataaagtagcagccgaaggaatcaattatgcggaccgtaaatggtgtttcgatggaatcaaaaataaccaaatactagaggaaaatatagaagttgaaatatggacaaaagaaggagaaagaaagaaactcaaaccacggtggttagacgcgagaatatactcagacccactagcattaaaggagttcaaagaatttgctgcgggtcgaaagagcctaaccctcaatttgatcactgaaatgggtagactgccgacttttatgacacaaaaagcgagaaatgctctcgataatttagcagtattacatactgcagaggctggtggacgcgcttataatcatgcactgagtgaactcccagaaacactcgaaaccttactactactaactctattagctacagtaacaggcgggatatttctatttctcatgtcaggtaaaggaatcgggaaaatgacgttaggaatgtgttgcataataacagcttcaatattgttatggtacgcccaaatccagccccattggattgccgcctcaataatactggaatttttcctaatagtgttactgattccggaacctgaaaaacaaagaactccgcaagataatcagctaacttatgttgtcatcgccattttgacagtagtagcagccacaatggcaaacgaaatgggttttctcgagaaaaccaagaaagatctgggcttaggtagcataactacacaagaatctgaaagtaacatcctagacatagacttacgtccggcgtcagcctggacattgtacgcagttgccacaacatttgttacaccgatgctaagacattccatagaaaatagttcggtaaacgtgagcttaactgcgattgcaaaccaagcgaccgtattgatgggactagggaaaggctggcccctgtctaaaatggatattggagtcccattattagcgataggatgctattctcaggtaaatcccataactttaacagcggccttattacttttggttgcacattacgcaataattggtccaggcctacaagccaaagcaacaagagaagcacagaaaagggctgcagcaggaataatgaaaaatcctacagtagatgggatcactgtcatcgacttagaaccaattccgtacgatccaaagtttgagaaacagttaggacaagtaatgttgctaatattgtgtgttacgcaggtattaatgatgcggacaacttgggccctctgcgaagcattaactctggcaaccggcccaataagtacattatgggaaggcaatcctggtagattttggaatactacaatagcggtatctatggctaacatattccgaggcagttacttagcgggagctggactcttattttcaataatgaaaaatacaacaaacactagacgaggcactggaaacattggagaaacgttgggagaaaaatggaaatcacgtctcaacgccttaggtaaaagtgaatttcaagtctacaagaaatctggtattcaagaagttgataggactctagctaaagagggaataaaaagaggagaaaccgatcaccacgctgtctcccgtggaagtgcaaaattacgctggtttgtagagcgcaatatggttacccctgagggtaaagtagtagacttaggttgcggaagaggtggatggagttattattgcggaggcctcaaaaacgtaagagaagtaaaagggctgacaaaagggggccccggccacgaggaacccattccgatgagtacttatggctggaacctagtacgcctacaatcgggcgtagatgtattcttcacaccacccgagaagtgcgacacactgctatgtgacattggcgagtcgagcccaaatccaacaatcgaagcaggaaggacactccgagttttaaacttggtcgagaattggctcaacaataacacccaattttgcataaaagtgttgaacccatatatgccaagtgtaatcgagaaaatggaagctctacaaagaaaatacggtggggccttagtaaggaatccgctctctcgaaacagcactcatgaaatgtattgggtaagcaatgcaacgggaaatattgtttcaagtgtgaatatgatatctaggatgctaatcaatcgattcacaatgaaacataagaaagctacatatgaaccagatgtagatcttgggtcaggcacccgaaacatcgggattgaatcggaaatccctaatttagacataataggaaaaaggatcgagaaaataaaacaggaacatgagacaagctggcactacgatcaggatcatccgtataaaacatgggcttaccatgggtcatatgaaactaaacaaactggatctgcgtcaagcatggttaatggtgttgtaagactcttgacaaaaccatgggatgtagtgcccatggtaactcagatggcaatgacagatacaaccccgtttggtcagcaacgagtttttaaagaaaaagtagatactagaacacaagaaccgaaagaaggcacaaagaaactgatgaaaattaccgcagaatggttatggaaagaattaggcaagaagaaaactccgaggatgtgcacaagggaggagttcaccaggaaagttagatcaaatgcagctttaggtgctatctttactgatgaaaataaatggaaaagtgctagagaagcagtagaagatggtcgtttctgggagttagtggacagagaacgcaatctccatctagaaggcaaatgtgaaacttgcgtgtacaatatgatgggaaaaagagagaagaaattaggcgagtttggaaaagcgaaaggaagccgtgccatatggtacatgtggttaggtgcgagattcttagaatttgaagccttagggttcttaaacgaagaccattggttctcaaggggaaatagtctctcaggtgtcgaaggcgaaggtttgcaccgattaggttatatcttacgagacgtaggaaagaaggaaggcggagccatgtacgcggatgatacagcaggttgggacacacgcataaccttggaggatctcaaaaatgaagaaatggtcacaaaccacatgaaaggagagcacaaaaagctagcagaagcaatattcaaattaacctaccagaataaagtagtgagagtacagcggccaaccccacgaggcacagttatggatatcatctctagacgtgatcaacgaggatcaggacaagttggaacctacggtctcaatacttttaccaatatggaagcacaactaattagacaaatggaaggggaaggaatttttaaatccattcaacacttgacagcaacagaggagatcgcagtccagaattggctcgcgagagtaggtagagagagactctctcgcatggcaataagtggagatgactgtgtagtaaaaccaattgacgatagattcgcttcagcgcttactgcactaaatgatatgggaaaggtaagaaaagatatacagcaatgggaaccgtcgagaggatggaatgactggactcaagtaccattctgctcgcatcacttccatgaactcgtgatgaaggatggacgggtccttgtagtgccatgcagaaatcaagacgagttaataggacgagctagaataagtcaaggagcggggtggtcactcaaagagactgcctgcctaggaaaatcctacgcgcaaatgtggacgttaatgtacttccatcggagggacttaaggctagcggctaatgccatatgcagtgcggtgccgccacattgggtaccaacgagtagaactacttggtcaatacacgctaaacatgagtggatgacaactgaggacatgctggcagtatggaatagagtatggattcaagaaaatccatggatggaagataaaacaccagttgagtcttgggaagaagtaccatatctaggaaaaagagaagaccaatggtgcggaagtcttattggcttgacaagtcgcgcgacatgggctaagaacatacaaaccgcgatcaatcaggttagatcactaattggtaacgaagaatatacagactacatgccatcaatgaaacgctttcgacgagaggaagaagaagccggtgtactttggtaa

SEQ ID NO: 22359 - RNA, 9876 nt, synthetic construct
  misc_feature 1..9876: note = derived and/or modified CDS sequence (opt6) from DENV-2__FJ898439__SS-prME
  source 1..9876: mol_type = other RNA
acggctggagtgattgtaatgttaataccaacggcaatggcattccatcttaccactcggaacggcgaaccacatatgatcgtaggtcgccaagaaaaagggaaatcgctattgttcaaaactgaagatggcgtaaatatgtgtacattaatggcaattgatctaggtgaattgtgtgaggatacgataacctacaaatgtccactactgcgacaaaatgaaccagaggatattgattgttggtgcaactcaacctccacttgggtaacctacggtacgtgctcgaccacaggagaacatagaagagagaaacggtcagttgcattagtacctcatgtcggcatgggactggagacaagaaccgaaacgtggatgagttccgaaggagcttggaaacatgtccagcgaatagaaacatggatcctaaggcatccaggattcacaattatggcagcgatactggcttataccatcggaactacacactttcaacgtgctctgatctttattctattaactgcagttgcaccatcgatgacaatgagatgtattggaataagcaatcgagactttgtcgaaggcgtttcaggtggatcttgggtagatattgttttggaacatgggtcatgcgttacaaccatggcaaaaaacaagcccacattagactttgagttaatcaaaacagaagcgaaacagccagccacactaagaaaatactgtatagaagcaaaattaactaacaccacaacagaaagtagatgtccgacacagggagagccgagccttaatgaagagcaagataaaagattcatatgtaaacactccatggtagatagaggatggggaaatggctgcggcctttttgggaagggtgggattgttacctgtgcaatgtttacctgcaaaaagaacatggaaggaaaagttgttcagccagaaaatctagaatacacaatagtcattacaccccatagtggtgaagagcatgctgtcggaaacgatactggcaaacacggaaaagaaataaaaattacaccacaaagttcaataacggaggcagagttaaccggctacggaacggtgaccatggaatgctccccgcggactggactagatttcaatgaaatggtgcttctacagatggaggataaggcgtggcttgtacatagacaatggttccttgacttgcccctaccttggcttcccggagcagacactcaagggagcaactggattcagaaggagacactggtaacattcaagaatccacatgccaagaagcaagatgtcgtagtgctggggagtcaagaaggtgcaatgcatactgcattgaccggagcaacagaaatacaaatgtcttccggaaacttattgttcactggtcatctgaaatgcagacttagaatggataaattgcaactaaaaggtatgtcatattccatgtgtacaggaaaatttaagatagttaaagaaattgcagagacacaacacggaactatagtcatacgcgtacagtatgaaggcgacggttcaccttgtaaaattccttttgaaataactgatcttgaaaaaagacatgtattaggaagactgataacagttaatccaatcgtaactgggaaggattctccggtgaacattgaagcggaaccacctttcggcgattcttatataattataggagtggaacccggccagctaaaacttaattggtttaaaaaaggaagttccattggtcaaatgtttgaaacgacgatgagaggagcgaaaagaatggctatactcggtgataccgcatgggattttggtagtctagggggcgtcttcacttcaataggaaaagctcttcaccaagttttcggggcaatctacggagcagccttctcaggcgtcagttggactatgaaaatactaattggagtaataataacttggattggtatgaattcccgctctaccagcttatctgtaagtctagttttggtaggggtagttacactctatttgggggcaatggttcaagctgattcaggatgcgtagtctcatggaaaaacaaagaacttaagtgtggatccggaatatttataactgataacgtacatacgtggactgaacaatacaaattccagcctgagtcgccttctaaattagcgagtgcaatacaaaaagcgcatgaagaaggaatttgtggcatccgaagtgtcacacgcctagaaaacctgatgtggaagcaaatcacacccgaactgaaccacattctgagcgaaaacgaagtaaaattaacgattatgactggcgatattaaaggtatcatgcaagccggtaaacgaagcctgaggcctcaacctaccgagctgaaatactcatggaagacatggggaaaggcaaaaatgttaagtacagaatctcataaccaaacgtttctcatagacggaccagagacagccgaatgcccaaacacgaatagggcctggaattccctagaagtcgaagattacggatttggcgtattcacaaccaatatatggctaaaactgcgcgaaaaacaagatgtattctgcgattccaagttaatgagcgctgccataaaagacaatcgtgcggtccacgcggatatgggttactggatagaatcagcacttaacgatacctggaagatggaaaaggctagttttatagaagtaaagagctgtcattggccaaaatcacatacgttatggagcaatggggtgctagaatctgagatgattattccgaaaaattttgcaggcccagtaagtcagcacaactatagaccagggtaccacactcaaaccgctggtccgtggcacttagggaaacttgaaatggatttcgatctctgcgagggaaccacagttgtcgtaacggaggactgtggcaatcgaggaccatcactacgtacgacaacggcgagcggcaagcttataacggaatggtgctgtcgttcatgtacattaccgccacttagataccgaggagaagatggttgctggtacggaatggaaatacgtccacttaaagaaaaagaggaaaatttggtaaattctctggtaaccgccggacatggccaagttgataacttttccctaggcgtactgggaatggctctctttctagaggaaatgcttcgaacaaggattggaaccaaacatgccattctgctagtagcagcatcatttgtgacactaataaccggtaatatgtcatttcgagatctgggacgggtgatggtaatggtcggagcgactatgaccgatgatataggtatgggggtgacatatctggcgcttttggctgcctttaaagttcgccccacatttgctgctggattgctgttaagaaaacttacaagtaaggaacttatgatggctactataggcatagccctgttatcgcaatcaacaataccagaaacaatattagaattaacggatgcattagccttgggtatgatggtactaaaaattgtccgtaacatggaaaagtaccaactagcagtaactatcatggctatctcatgtgtccccaacgcagtaatactacagaatgcgtggaaagtttcatgcacaatcttagccgctgtatcagtttctccattgttactaacaagttcccaacaaaaagcggattggattcccttggcattaactataaaaggattaaatcctacggctatcttcctcacaactcttagtcgcacttccaaaaaaaggagctggccccttaatgaagcggtaatggcagtgggaatggtatctatacttgcgagctctcttctaaaaaatgatattccgatgaccggacctttagttgctggcggactattaacggtatgttacgtcttgactggccgatcggcagatttagagctagaacgtgctgcagatgtgaaatgggaagaccaagctgaaataagcgggtcctcgccgatcctttccataaccatatcggaagatggctcaatgtcaattaaaaacgaagaagaagaacaaacattaacgattttaataaggaccggcttactagtaatctcaggagtgttcccagtaagtataccgattacagcagccgcatggtatttatgggaggttaaaaaacagagagcaggtgtcttatgggacgtaccatcgccgccgccggtagagaaagcagagctagaagacggtgcttataggataaaacaacgtggcatactaggttatagtcagataggagcaggggtatataaagaaggaacatttcataccatgtggcacgtaactcgtggcgctgtgcttatgcataggggtaaaagaattgaaccttcttgggcagacgtaaaaaaagatttaatcagttatggtggagggtggaaactagaaggagaatggaaagaaggagaagaggtacaggtactcgcattggagccaggaaagaatccgcgggcggttcaaactaagccaggtatcttcaaaacgaacacaggaacaataggcgcagtctcgctcgactttagtcctggtaccagtggaagccctatagtagaccggaaaggaaaggtagttggattatacggcaatggagtagtcacgcgctccggggcatacgtgtcagcaattgctcaaacagaaaaatcaattgaggataacccagagatagaagacgatatcttcagaaaaaaaagacttacaataatggatctccaccccggagcaggcaaaacaaaaagatatttaccagcaatagttagagaagcgatcaaacgaggactccgtacattaatactagctccaacacgagtagtagctgctgaaatggaggaggctttacgaggacttccaatacgttatcaaacaccggcaataaaaacagagcacactggccgagaaatcgtggacttgatgtgtcatgcaacatttaccatgagactcctttctcctgtacgtgtacctaattataatttaataataatggatgaagcccatttcacagaccccgctagcatcgcagccagaggatatattagcactcgagtcgaaatgggggaagcagcaggcatatttatgacagcaactcctccaggaagtagggacccatttccacagagtaatgcgcctataatggatgaagaacgagagatacctgaaagatcctggaactctggacacgagtgggtgacggacttcaagggaaagaccgtctggtttgtgccatcgataaaggccgggaacgatattgctgcctgtctcagaaaaaacggcaagaaagttatacagttgtcaagaaaaacgttcgactcagagtatgtaaagacccgagcaaatgattgggattttgtggtaaccacagacatttcagaaatgggcgcaaacttcaaagccgaaagggtcatagaccctaggaggtgtatgaaacctgtaattttaactgatggcgaagagcgagttattcttgcaggaccaatgccggttactcattcctcagctgctcagagacgaggaagaatcggacgcaaccccaaaaatgaaaatgatcagtatatatatatgggtgaaccgttagagaatgatgaagattgtgctcattggaaagaagctaaaatgttactagataatattaatactcccgaaggaatcatcccaagtatgttcgaaccagaacgagaaaaagtagatgcgatagatggggaatacagattaagaggagaagcaagaaaaacatttgtcgatttaatgagacgaggggatttaccggtctggctagcttacaaagtcgccgccgaagggataaactacgcagataggaaatggtgcttcgatggtataaaaaataatcagattttggaagagaatatggaagtagagatttggacaaaagagggagaacgtaaaaagttaaagccgcggtggctggatgcacgaatatactcagatcctttagctttaaaggaatttaaagaatttgccgctggaaggaagtcattaacgctcaacctaattacggaaatgggtcgactacccacttttatgacccaaaaggctcgtaacgctttagacaacctcgcagtactgcatacggcagaaacaggcggcaaagcatataatcacgccctaagcgagttaccggagactttagagacattattgttactaacacttctagcgaccgtcacaggaggtatatttctatttttaatgtctgggaaaggtatagggaaaatgacgcttggtatgtgctgtataataacagcctcaattctgctatggtacgcacaaattcaaccgcattggatagcagcatcaataattctagaattttttttaatagtactattaattcctgaacctgaaaaacaaagaaccccacaagataaccaactaacttacgtggtcatagcgattttgacagtagtagcagctacaatggccaatgaaatgggatttctcgaaaaaactaaaaaggatttaggattcggaagtattaccacacaagagtctgaaagcaatattttagacatagacctcaggccagcaagtgcctggacactatatgcagtcgcaactactttcgtcactcccatgcttcgacacagcattgaaaattcttcggtcaatgtctcactgaccgccatcgcgaatcaggctacagtgctaatgggcttaggcaaaggatggcccctatctaaaatggatataggcgtacctctgttagccataggttgctattcacaggtcaatccaataaccctaactgcagcgctccttctcttggttgctcattatgccattgtgggtcccggcctgcaggccaaagcaactcgagaagcacaaaaaagagctgcggcaggtattatgaaaaatccaacggtagacggtattacagtcatagacttagagcctataccatatgacccaaaattcgaaaagcagctgggccaggtaatgctcttaattttatgcgtgactcaagttctaatgatgagaacaacctgggccctatgtgaggcattaaccttagcaacagggccaatcagtacgctatgggaggggaaccccggtagattctggaataccaccattgcagtatccatggcaaacattttccgtgggtcgtatttagcaggcgcaggccttttattttccataatgaaaaacacaacaaatactagaagagggacaggtaatataggagagacactgggagagaaatggaaatctcgtctaaatgcattgggtaagtctgagtttcaaatttacaagaagtctgggatccaagaagtagacagaacactcgcaaaggagggaataaaaagaggggaaacagatcaccatgctgttagcagaggctctgcaaaactacgatggtttgttgaacgtaatatggtgacaccggaagggaaagttgtagatttaggttgcggcaggggcggctggtcttattactgcggagggttaaagaatgtccgagaagttaaagggttaacaaaaggaggacctggacacgaagaaccaatcccaatgagcacctacggatggaatttagtaaggttacaatcaggagtcgatgtgttctttacacccccggaaaaatgtgacacccttctgtgtgacattggagaaagcagtcctaatccaaccatagaagcaggtcgtacattaagagttcttaatttagtagaaaactggttaaataacaatacacaattctgcataaaagtactcaatccatatatgccgtcagtcatcgaaaaaatggaaacgttacagcgtaagtacggaggtgcattagtacggaaccctttaagcagaaattcaacacacgaaatgtactgggtgtccaacgcgacaggaaatatagtttcatcggtaaacatgatatctaggatgttaataaataggttcacaatgaagcataaaaaggccacttacgaaccggatgtggaccttggaagcggaactagaaatataggaatagaaagcgaaatcccgaatcttgacatcattggcaaaagaattgagaaaataaaacaggaacatgagacttcatggcattatgatcaagatcatccatataaaacgtgggcatatcatggctcttacgaaacaaaacagaccggcagcgcaagttcaatggtaaacggagtcgtgaggctgttgacgaaaccttgggacgtagtacccatggtcacgcaaatggcaatgacagacacaacaccattcggtcaacaaagagtgtttaaggaaaaagtagacacgcgaacccaagaacctaaggaaggtacaaaaaaattaatgaaaatcaccgccgaatggttatggaaggaactgggaaaacgtaagactcctcgtatgtgtacacgtgaagaatttacaagaaaggttagatctaatgctgcgctcggagcaatatttactgacgaaaataaatggaagagtgcacgcgaagccgtagaggatggacgattttgggaactcgtagatagagaacgaaacttacacttggaaggaaaatgtgagacatgtgtatataatatgatgggaaaaagagaaaagaaactcggagaatttggtaaagccaaagggtcacgagctatctggtatatgtggctaggcgctagattcttggaatttgaagccttaggatttcttaatgaagatcattggtttagtagagggaatagcttaagcggtgtcgaaggagaaggtctccatagacttgggtacatactaagagacgtaggcaagaaggagggcggcgctatgtatgcagatgatacagccggttgggataccagaattacgttagaagatttaaaaaatgaggaaatggtaactaaccacatgaagggagagcataaaaaactagccgaagcaatatttaaacttacataccaaaataaagtcgtacgagtacagcgaccaacacctcgcgggacagttatggacattataagcagaagggatcaacgcggatcaggacaagttggtacgtatgggttgaatacttttacgaatatggaagcgcaactaattcgccaaatggagggcgaaggaattttcaaatctatacaacatctcacggccacagaagaagtcgcagttcaaaattggcttgccagggtgggtcgtgaacgattatcaagaatggctatatccggtgatgattgcgttgtaaaacctatagatgaccgattcgccagtgcgttaactgcgttgaatgatatgggtaaagtccgaaaggatattcaacaatgggagccttcgcgggggtggaacgattggactcaagtacctttctgtagccaccatttccacgagttagtaatgaaagacggacgtgttttggtagtcccatgtcgtaaccaagatgaattaatcggacgggcccgaatttcacaaggtgcaggatggtcgttaaaagagactgcttgtttaggaaaatcctacgctcaaatgtggacactgatgtactttcacaggagagacctacgactggcggctaatgcaatatgctcagcagtaccctcccattgggtcccgactagtagaacgacatggtcaattcacgcaaagcacgagtggatgactacagaggatatgttagccgtatggaatagagtgtggattcaagaaaatccttggatggaagacaaaacccccgtcgaaagctgggaagaagtcccatacctaggaaaacgggaggatcaatggtgtggttctctaattggtttaacctcccgcgcaacttgggcaaaaaatattcaaaccgcaataaatcaggttcggtcattgataggtaatgaagaatataccgactacatgccaagtatgaagagatttcgtcgggaggaagaagaagctggagtactgtggtaa

SEQ ID NO: 22360 - RNA, 9876 nt, synthetic construct
  misc_feature 1..9876: note = derived and/or modified CDS sequence (opt6) from DENV-2__GQ868588__SS-prME
  source 1..9876: mol_type = other RNA
actgctggaatgataataatgctgattccaactgtaatggcatttcacttaaccactagaaacggagaacctcatatgatagtttcaagacaagaaaaaggaaaatccttattattcaaaactaaagatggaactaacatgtgtacgcttatggcactagaccttggagaactatgcgaagacacaatcacctacaaatgcccttttctaaaacaaaatgaaccagaagatattgattgttggtgcaacagtacaagcacatgggtcacatatggaacgtgtacaacaactggagaacatagaagagagaaaaggtcagtagctctagtcccacatgtaggcatgggtttagaaacgagaaccgaaacatggatgagttctgaaggagcatggaaacatgcacaacgtatagaaacgtggattttgcgacatccgggatttactatcatggcagctatattggcgtatacgataggaacaacccatttccaaagagtattaatttttattctattaaccgcaattgctccaagtatggcaatgaggtgtataggtataagcaaccgagactttgtagaaggtgtatcaggaggatcgtgggttgatatagttttagaacatggatcctgcgtgactacaatggccaaaaataaacctacgttagattttgaactaataaaaacagaagctaaacagcctgcaactcttagaaaatattgcatagaagcaaaactaacaaacactacaacagattcacgctgtcctacccagggcgaaccaacgttaaatgaagaacaagacaaaagatttgtctgtaaacattcaatggttgacaggggatggggtaatggttgtgggttgtttggaaaaggagggatagtaacttgtgcaatgtttacatgtaagaaaaatatggaaggtaaaattgttcaaccggaaaatttggaatatacagtggttattaccccgcactctggtgaagaacatgctgtgggaaatgatacagggaaacatggtaaagaagtgaaaatcacaccccaatccagtataactgaagcggaactaactggatacggtacggttacgatggaatgtagtcctagaacaggtctagattttaatgaaatggtgctactgcaaatggaagataaggcttggttagtacatcgacaatggtttttagatttaccgttgccttggctgcctggagcagatacacaaggaagtaattggatacaaaaagaaactctagtcacttttaagaatcctcatgccaagaaacaagatgtggttgttttaggaagtcaagaaggagcaatgcatacagctctcacaggagcaacggaaatacaaatgagttcaggcaatctattgtttacagggcatttaaaatgtaggttgcggatggataaacttcaattaaagggaatgtcatatagtatgtgtaccggcaaatttaaaatcgttaaagaaatcgcagagacccagcacggaaccatagtaattagggtacagtacgaaggcgacggtagtccatgtaaaatcccctttgaaataatggacctcgagaaaagacacgtgctcgggaggctaatcactgtaaacccgattgtcacggagaaagatagtccagtcaacattgaagcggaaccaccttttggcgattcatacataataataggagtagagccagggcaactcaaactagactggtttcgaaaaggatcctctatcggccaaatgtttgaaacaaccatgcgcggtgcaaagagaatggctatcttgggggacaccgcatgggacttcggatcactaggtggtgtatttacatcaattggaaaggctttacaccaagtctttggagctatatacggtgcggccttttctggcgttagttggactatgaaaatcctaataggggtgattatcacctggataggaatgaactcaagaagcacgtctctttcagtcagcctagtattagttggtatagtaactttatacttaggtgtgatggtacaagcagattcaggatgtgtagtttcctggaaaaataaggaattaaagtgcggatccggcatttttgtaaccgacaatgttcatacgtggacagaacaatataagttccagcctgaatcgcccagcaaattagctagcgcgattcaaaaagctcatgaagaaggcatctgtgggattaggtcagttacaagactagagaacttaatgtggaaacaaataactagcgaacttaatcacatcttaagtgaaaacgaagtgaagctcactatcatgactggtgacataaaaggaataatgcaggtaggaaaaagatcactgcgaccacaacctaccgaattaaggtatagttggaaaacctggggcaaggcaaagatgctgagtacagagctccacaatcagacattcctaatcgacggtcctgaaactgcggagtgtccaaacactaacagggcatggaatagcttagaggtagaagattacggattcggtgtatttaccactaacatctggctacgattaagagaaaaacaagacgtgttttgcgatagcaagttgatgagtgcagcaataaaggataaccgggccgtacacgccgatatgggatattggattgagagtgccttaaacgacacgtggaaaattgaaaaagcatcctttatcgaagttaaatcttgccattggccgaaaagtcatactttatggtctaatggtgtcctggaaagtgaaatggtaattcccaaaaatttcgcaggtcccgtaagtcagcacaataatcgccctggatatcacactcagaccgcaggtccgtggcatctagggaaactcgaaatggactttgatttctgcgagggtactacagtcgttgtcacggaagaatgcggaaaccgggggccgagtctccgaaccacgacggcctcggggaaactaataaccgagtggtgttgtcgaagctgcacattgccacccctaagatataggggtgaagatggatgttggtatgggatggaaataagaccgcttaaggaaaaagaagaaaaccttgttagctctctagtgacagccggacacggacagatcgataattttagtcttgggatacttggcatggcattatttctagaagaaatgctgagaactagagtaggcacaaaacacgcgatcctgctagtagctgtcagctttgttacattaattactggaaatatgtcgtttagagatctagggagagttatggtcatggtgggtgctaccatgaccgacgatatagggatgggtgtaacttatcttgccctcctcgctgcctttaaagtcagaccgacattcgctgcaggattattattgcggaaacttacttcaaaagaattaatgatgactaccataggtatagtactattgagtcagtcatcaataccagagacgatattggaacttacagacgccctagccttaggaatgatggtactcaaaatggtaaggaacatggaaaaatatcaattagcggtcacaatcatggccattttatgcgtgcccaatgcagtcatcttacagaatgcctggaaagtgagttgtactatattggcagtagtttctgtttcaccactccttctaacgtcttcccaacaaaaggcagattggattccactagctctaaccattaaagggctaaatccgactgctatttttctaactactttatcgcgaacaagtaagaaaaggtcgtggccattaaatgaagcgataatggctgtggggatggtctcaatactagcatcatcgctgttgaaaaatgacatcccaatgacagggcctttagtagcgggtggactacttaccgtatgctatgtgctaacaggacggtcagcggatctagaattggaaagagcaaccgatgtaaaatgggacgaccaagcagagataagcggatcctcaccgatcctttcaataacaatttcagaagacggtagtatgagcattaaaaatgaagaagaagaacaaacgttaacaatactaataagaactgggctgttggtgatatctggattattccctgtatcgatcccgataacggcggccgcatggtacttatgggaggtcaagaaacagcgcgcgggggtattatgggacattccaagtccgccaccagtaggaaaagctgaactagaagatggcgcgtaccgaatcaaacagaaagggatacttggctactcgcaaataggtgctggggtgtacaaagaaggaacttttcacacgatgtggcatgttacaagaggagccgtcttaatgcacaaaggtaaaagaatagaacctagttgggctgatgtaaagaaagatctcatatcttatgggggaggctggaaattggaaggtgaatggaaagagggggaagaagtacaagttctagcattagaacctggcaaaaatccacgagcggttcagaccaaacccggactatttcggactaatacagggaccataggagcagtctccttagacttctccccggggacaagtggatcacccatagtcgataagaaaggaaaagtcgttggcttatatggcaatggggtggttacgcgctcaggcgcgtatgtgtcagccattgcccaaaccgaaaaatccattgaagacaacccagagatagaagacgacattttcaggaaacgaaggctcactataatggatctacatccaggcgcaggaaaaacaaagaaataccttcccgcaattgttagggaggccattaaaagaggtttacgaactttaatcttagctccaactcgggtagttgccgctgaaatggaagaagccttacgaggcttgccaataaggtaccaaactcccgctatacgcgcggaacacactggaagagaaatagtcgatttgatgtgtcatgcaacatttactatgcgattactctcacctatacgagtcccaaactacaatttgatcatcatggacgaagcacattttacagatccggccagcatcgcagcgcgtggatatatcagtactcgagtagaaatgggagaagcagctggtatctttatgactgcaacacctccagggtctcgggatccattccctcaatctaatgcacctatcatggatgaagaaagagaaataccagaacgaagttggaactcaggacatgaatgggtaacggattttaagggaaaaactgtgtggtttgtaccatctataaagacaggaaacgacattgcagcatgtcttaggaaaaatggtaaaagagtgatacaattgtctaggaaaacattcgacagcgaatatgtaaaaacaagaacaaatgactgggactttgtcgtgacaacagatatttcggaaatgggcgcaaactttaaagcagagcgagtgattgatccacgtcgctgtatgaaaccagtaattctaaccgatggggaagaaagggtaatactcgccggtccaatgccagtaacacatagctccgcggcacaaagaaggggcagaatcggacgaaacccgagaaatgaaaatgatcaatatatatatatgggagaaccattggaaaacgacgaagattgtgcacactggaaagaagctaagatgctattggataatataaacactccagaaggaataataccaagtatgtttgaaccagaacgagaaaaagtcgacgcaatagatggagagtataggctaagaggagaggcaaggaaaactttcgttgatctaatgcggagaggagacctaccggtctggcttgcgtataaagtagcatcagaaggcataaattacgctgatagaaggtggtgtttcgacggaaccaggaacaatcaaatactggaagaaaatgtagaagtggaaatctggacaaaagaaggtgaacgaaagaaactaaagcctagatggttagatgctcgtatatacagtgatcccctagccctgaaagaatttaaagagttcgcggctggaaggaagagtctaactctcaatttaataaccgaaatgggccgactccctacgtttatgactcagaaagccagggatgcgctggacaatctggcagtacttcataccgcagaagcgggtggtaaagcgtataaccatgcattatccgaacttcctgaaacattagagactctattgctgttaactttgttagccacagtaactgggggaatatttttattcttaatgtctggacgtgggataggcaaaatgacgctcggaatgtgctgcattatcacggcaagtatattattatggtacgctcagattcaacctcactggatagctgcttccataatattggagtttttcctcatagtattgctaatccctgaaccagaaaaacaaagaactccacaggataaccaattaacgtacgttataatagcaattctcactgtcgtcgcagcaaccatggcaaacgaaatgggattcctagagaaaaccaagaaagacctcggtctgggacatatagcaacccaacaacctgaaagcaacattctagacatagatttacggccggcttcggcatggactctatacgctgtggcaactacttttattacaccgatgctaagacacagcattgaaaacagttccgtgaatgtgagtctaacggccatagcaaaccaggcaacagtccttatgggactaggaaaaggctggcccttatctaagatggatatcggggtcccgctcttggcgatcggctgttactcgcaagtcaatccaattacattgactgctgcattattacttctcgtggctcactatgcaataataggtccaggcctccaagcaaaagcgacaagggaagcacaaaaacgagcagcggccggtattatgaaaaacccaacagtagacgggataactgtcattgacttggatcccattccctatgatccgaaatttgagaaacagttaggtcaagtaatgctgcttgttttgtgcgtgacacaggtattaatgatgaggaccacatgggcgctatgcgaggcacttactttggcaaccggcccagtttcgaccttatgggagggaaacccaggacggttttggaacactacaatcgccgtctccatggcaaacatatttagaggatcatatctcgctggggcaggcttactttttagcattatgaaaaatactacatcaacacgccgaggcactggtaacataggtgaaactcttggagaaaaatggaaaagtagactgaatgccttgggaaaaagcgaatttcagatatataagaaatcagggatacaagaagtggatcggacccttgcaaaagaaggcatcaagagaggagagacagatcaccacgcagtatcaaggggcagcgcaaaactccggtggttcgtagaaaggaatctagtaacaccagaggggaaagtagttgatttgggatgtggacgaggagggtggtcatactactgcggaggactcaaaaatgtaagagaagtaaaaggtttaactaagggtggccctggtcacgaggaacccataccaatgagtacgtacggttggaatttagtacgactacaatccggagtcgacgtattctttgtaccgccagaaaagtgcgacacactactttgtgatattggagaatccagtcctaaccctacagtagaagcagggagaactttacgagtcttaaatcttgtcgagaactggcttaacaataacacgcaattctgcgtcaaggtattaaatccttacatgccctcagtaattgaaaggatggaaacattacaaagaaagtatggtggtgctctcgtaaggaatcccctctctaggaactccacccacgaaatgtactgggtatcgaatgcaagcggaaacatagtaagcagtgtaaatatgattagtaggatgctgataaatagattcacaatgagacacaaaaaggctacatatgaaccagatgtggatttaggatctggaacccgaaatattggaatagagtctgaaactccgaatttagatattattggaaaacgcatcgagaaaataaaacaggagcatgaagcaagctggcactatgatcaagatcacccttacaaaacgtgggcttatcacggatcatatgagaccaaacaaacaggttcagcgagtagcatggttaatggggtggtcaggttattaacgaagccatgggatgttgtcccaatggtaacacaaatggcaatgaccgacacgacaccgttcgggcaacagagggtattcaaagagaaagtcgacactcgtactcaagaacccaaagaaggaactaagaaattgatgaaaataacagcagagtggctatggaaggaattgggcaagaagaaaactcctcgtatgtgcacgagagaggagttcaccaagaaagtaagaagtaacgctgctttaggggcaatatttactgatgaaaataaatggaaatcagcccgtgaagctgttgaagataataggttctgggagctagtcgataaagaacggaatctacacctggagggaaaatgcgaaacatgtatatacaacatgatgggaaaacgggaaaagaaattaggtgagttcggcaaagcaaagggctctagagcaatatggtacatgtggttgggtgctagatttctagagttcgaagcattaggtttcttaaatgaggatcattggttctctcgagagaatagtttatccggcgttgaaggggagggtcttcacaagttgggttatatattgagagaagtgtcaaagaaagagggaggagctatgtacgccgatgatacagcaggttgggataccaggattaccatagaagatctcaaaaatgaagaaatgattacgaatcacatggcaggagagcataagaaattggcggaagcgatatttaaacttacataccaaaacaaagttgtaagagtccaaagacctactccgagaggaacggtaatggatattattagtcgtcgtgatcaaagaggaagcgggcaagttggaacttacggcctcaacacttttactaacatggaggcacaactcatacgacaaatggaaggagaaggcatatttaaatcaattcaacatttaaccgcgagcgaagaaatagcagtacaggattggcttgtccgagtaggccgggaaagattatcccggatggcgatttcaggagatgattgcgttgtaaaaccactagacgaccgcttcgctagggcactaactgcactaaacgatatgggtaaagtaaggaaagatatccaacaatgggaaccttctagaggatggaatgactggacacaagtacccttctgttcacaccactttcatgagctcattatgaaagatggtcgtatattagtggtcccgtgccgaaaccaggatgaactaataggtagggcgagaatctcgcaaggagccggctggtcactccgtgaaacagcctgtcttggaaaatcctatgctcaaatgtggagtcttatgtacttccataggagagaccttagactagcagcaaacgcaatttgtagtgccgtaccatcgcattgggtaccaacaagtaggaccacttggtcaattcatgcgagccatgagtggatgaccacggaggacatgctgaccgtatggaatagggtctggatacttgaaaacccatggatggaagataaaacgcccgttgaatcttgggaagaaatcccttatttagggaaaagagaggaccaatggtgtggctctctgataggtctaacatcgagagctacttgggccaaaaacatacaaacagccataaatcaagtacgaagtctaataggcaacgaagaatacacagattacatgcctagtatgaaacgatttagacgagaagaagaagaagccggtgtactgtggtaa

SEQ ID NO: 22361 - RNA, 9876 nt, synthetic construct
  misc_feature 1..9876: note = derived and/or modified CDS sequence (opt6) from DENV-2__GQ868590__SS-prME
  source 1..9876: mol_type = other RNA
acagctgggatgattataatgttaattcctacagttatggctttccatttgactacccggaatggagaaccacatatgatagtaagtcggcaagaaaaaggtaaatctcttctatttaaaaccaaagatggaacaaacatgtgtacgttaatggcaatggatttaggcgaattgtgcgaggatacaataacttacaaatgcccctttttaaaacaaaacgaacccgaagatatcgactgttggtgtaatagtacaagtacctgggtaacgtacggtacatgcactacaacgggagagcaccggagagaaaaacgttccgtcgcattagtaccacatgtaggaatggggctagaaacacgaacggagacgtggatgtctagtgaaggggcatggaaacacgctcaacgtattgaaacgtggatactgagacacccagggtttactataatggcagcaatcttagcatataccattggaactacacattttcaacgagtcctaatattcatactattgactgccattgcgccaagtatgacaatgcgatgcatagggatatcgaatagagactttgttgaaggtgtgagtggaggctcgtgggtggatatcgtattggaacacggtagttgtgtaacaactatggccaaaaataaaccaacacttgattttgagttgataaaaactgaagcaaaacaacccgctacactcagaaaatactgcatagaggccaaattgaccaatacaacaacagactctagatgtccaacacaaggggaaccaacattgaatgaagaacaagataaaaggttcgtatgcaaacattcaatggtagataggggctggggcaacggatgcggtctattcggaaaaggtggaattgttacatgcgccatgtttacatgcaagaaaaatatggagggtaaaatcgtccaaccagaaaatctagagtataccgtcgttattacacctcattcaggtgaagaacatgcagtaggcaatgatacagggaaacatggcaaagaagttaaaataacgccccaatcctcaatcacagaagctgaactgacaggatacggtaccgtaacaatggaatgttcccctcgcactggactggatttcaacgaaatggtgttattgcaaatggaagataaagcatggcttgttcaccgacaatggttcttagatctaccactaccttggctcccaggagccgacacacaaggatctaactggatccagaaagaaactttagttacgtttaagaacccgcatgctaagaaacaagatgttgttgttctcgggtctcaagaaggtgctatgcatacggctctaactggtgcaaccgagatacaaatgagtagtggcaatctattattcacaggacacctcaagtgcagacttcggatggataaattacaattaaaaggcatgagctattctatgtgcacggggaaatttaaaatagtgaaggaaatcgcagagacacaacatggaacaattgtaattcgagtccaatacgaaggggatggaagcccttgtaaaataccatttgaaataatggatttagagaaaagacacgtattagggagactgataacggtcaacccgatagttacagaaaaagactcgccagtgaatatagaggccgaaccgccattcggcgattcgtatataattattggtgttgaaccgggacagttgaaactcgattggtttaagaaaggatcttccatcggacaaatgttcgaaactacaatgagaggcgctaaacgtatggccattttaggtgacaccgcctgggactttggatcacttggtggaatgttcacgagtataggtaaagcccttcaccaggtattcggtgcaatatatggagctgcgttctcgggcgtcagctggaccatgaaaatattaattggagtcataataacctggataggaatgaactcgagaagtacgtcgctcagtgtgtcgctcgtactcgtaggaatcgttacgctgtacttgggcgtaatggtacaagcagattctggttgtgtagtaagctggaaaaataaagagctgaaatgcggcagtggtatcttcgttaccgataacgtccatacatggacggagcaatataaatttcaacctgaatccccgtccaaattagctagtgcaattcaaaaagcacatgaagaaggaatatgcggtataagaagtgtgaccagattagaaaacctgatgtggaaacaaataacccccgagctcaatcacatactctccgagaacgaagttaagctaacaataatgacaggggacactaaaggaataatgcaagtggggaaaagatcattaagaccacagccaaccgaactacgatactcttggaagacatggggaaaagcaaaaatgttaccaacagaattacacaatcaaacattccttatcgacggaccagagactgcagagtgtccaaatactaaccgagcgtggaactcactagaggtagaggactatggctttggtgtattcacaacaaacatatggttgagattacgggagaaacaagacgtattttgtgactctaaacttatgagtgctgcgataaaggacaatagagcagtacatgctgatatgggttattggatagaatccgcactaaacgacacatggaaaatcgagaaagcctcatttattgaagtgaaaagctgtcattggcctaaatctcataccttatggagtaatggtgttctggagagcgaaatggtaataccaaagaacctagcgggtcctgtgagtcaacataacaatagacctggataccacactcaaactgccggcccatggcatctcggtaaacttgaaatggattttaatttttgtgaaggtacaacggtagtggtgactgaagagtgcggtaatcgaggtccctcgttacgtaccacaacagccagtgggaagttaataaccgaatggtgctgccgaagttgcacacttccaccactacgatatagaggtgaagatggatgttggtatggtatggagatcaggccgcttaaagagaaagaagagaacttagtaagcagtctagtgacagcaggacatggacagattgataacttcagtctcggaattttagggatggctctctttctagaagaaatgctgcgtactagagtaggaacaaaacacgccatactattggtcgctgtatcatttgtcacactaattacaggaaacatgtctttcagagatctgggtagagtcatggtaatggtcggggcaaccatgacggatgacattggaatgggagtcacttacttagcgttactcgccgcatataaagtgcgtccaacattcgctgcaggcctactcctgagaaaactgactagcaaagaattaatgatgacgacgataggtatcgttttgttaagccaatcatccataccggaaactattttggaattaacagatgcattggcactcggaatgatggtactaaaaatggtacgcaatatggaaaaataccaactggccgtaacgataatggccatattatgcgtaccaaatgctgtaatccttcaaaatgcctggaaagtgtcttgcactatattggcagttgtctccgtatcacccctactactgacatcgtctcagcagaaggccgattggataccactggctctcacaataaagggtttgaacccaaccgcaatatttttaacaacactaagcagaacatcaaagaaacgctcatggccacttaatgaagccattatggcggtaggaatggtgtcaatccttgcttctagccttttaaagaacgatatcccaatgacgggtccattagtagcagggggccttctaacagtatgttatgtactaacggggaggtcagcagatcttgaattggaaaaagctacagatgttaaatgggacgaccaagctgaaataagtgggtcaagcccaatactttcgataacaatttctgaagatggatcaatgagtattaaaaacgaagaggaagaacaaaccttaacaatcttaatacgaactggactattagtaatatcaggcttatttccggtcagtatccctataacggcagctgcatggtacctatgggaggtcaagaaacaacgagcgggcgtactctgggatgttccatctccacctccagtaggcaaagcagaattggaagatggcgcatatagaataaagcaaaaaggtatactcggctattctcaaataggtgctggagtttataaggagggtacgtttcatactatgtggcatgtaactagaggagcagttcttatgcataagggtaaaagaattgaaccttcgtgggccgacgtaaagaaagaccttataagttatggtggaggatggaagttagagggggaatggaaagaaggagaggaagtacaagtacttgccctagagcccgggaaaaaccctagagccgtccaaaccaagcctggtctttttcgcacaaataccggaaccataggtgcggtaagcctagatttttcgcctgggacctctggctcaccgattgtcgacaagaagggtaaggtggtaggattatatggaaacggagtagtcacaagatcaggagcatatgtcagcgcaatagcgcaaactgaaaaatcaattgaagataatccagaaatagaagatgacattttcagaaagcgacgcttaacaataatggatttgcatccaggggctggtaaaaccaagaaatacctacccgcaatagttagggaagcaataaaaaggggacttagaacattaattttagcgcccacaagagtggtcgctgccgagatggaggaggctctacgaggacttcctattcgctaccaaacgcctgccattagggctgaacataccggcagagaaattgtagatctcatgtgtcacgcaacattcactatgagattattatctccaataagggtccctaattataatctaataataatggatgaagcccactttaccgacccagccagtatagcagccaggggatacataagcacacgagtcgaaatgggtgaagctgcaggcatcttcatgacggctacaccacccggcagtagagacccgtttccgcaatcaaacgctccgataatggatgaggaacgggagatcccagaacgctcatggaactccggacacgaatgggtcacggatttcaaaggaaaaacggtctggtttgtaccaagcataaaaaccgggaatgacatagcggcctgtttacggaagaatgggaaaagagtgatacaactcagccgaaaaacttttgacagtgaatacgtcaagactcggacaaatgactgggattttgttgtaactacagacatttctgaaatgggtgctaattttaaagcagaaagggtcattgacccacgccgatgtatgaaacccgtcatcttaacggacggggaggaacgagttattctagcaggtccgatgcctgtaacgcattcgagtgcagcgcagagaagggggcgtatcggaaggaatcctagaaatgaaaatgatcagtatatatacatgggcgaaccgctggaaaacgatgaagattgcgcgcattggaaggaagccaaaatgttattggataatattaatacacccgaagggatcataccttctatgtttggtcccgaaagagaaaaagtagatgccatagatggggaatatagacttagaggagaagctaggaaaacatttgttgaattaatgaggcggggagaccttccagtatggctagcctataaagtagcctccgaaggtattaactacgcagatcgccgctggtgctttgacggtacacgtaataatcaaatattagaagaaaatgtggaagtagaaatttggactaaagaaggagaaaggaagaaattaaaaccccgatggcttgacgcacgaatatattcagatcccttagctcttaaagagttcaaagaatttgcagcgggaaggaaatcattgacacttaatttaataaccgaaatgggtagactcccaactttcatgacccaaaaggctagagatgcgctcgacaaccttgccgttttacatacagcagaagcgggaggtaaagcatataatcatgcactgtcagagttaccagagactttagaaacattgttgctactaacgctactcgctacagtaacagggggtatttttctctttctaatgagcggtagaggaatagggaaaatgacactagggatgtgttgcattatcacagcttcgattctactatggtacgcccaaatccaacctcactggatagccgcaagtatcatccttgagttctttttaatagttttgcttattcccgaacctgagaaacaaagaacacctcaagacaaccaactgacatatgttataatagcgatcttaacagtagtagctgcaacaatggcgaacgagatgggatttttagagaaaacaaagaaagacctggggcttggccatatcgccacccagcagcctgagtcaaacatcctcgacatagatttacgaccagcttccgcatggaccctgtacgcagtagctactactttcattacacctatgctacggcattcaatcgagaactcatcagtaaatgtgtcacttaccgcaatagctaaccaagctactgtgctcatgggcttaggtaaaggatggcctttaagtaaaatggacattggagtacctttgcttgcaatcggctgttattcacaagtaaatccaataacattaacagcagcgcttttactattagttgctcattatgcaataataggaccaggcttacaagccaaagcaactcgagaagcacagaaaagagccgccgctggcattatgaaaaatcctactgttgatggaataaccgtaatagatttagatccaatcccatatgacccaaaatttgagaagcagctcggacaagttatgctgttagtactatgtgtaactcaggttcttatgatgagaactacttgggcactttgcgaagcattaaccctggctactggcccagttagcaccctgtgggaagggaacccaggaagattctggaacactactatcgcagtctctatggcaaatatatttagaggttcttatctagcgggtgcaggactgctattttctataatgaagaatacgacctctaccagaagaggaacgggtaacattggcgaaacacttggagagaaatggaagagtagattaaacgctctcggtaaatctgaatttcagatctataagaaaagcggaatccaagaagtagatagaaccttagcaaaagaagggattaaacggggagaaaccgatcaccatgcagtatcaagaggttcagcaaagttgaggtggtttgtagaaagaaatctggtaactccagaaggaaaggttgtcgatttaggttgcggacgaggtggatggagttactactgtggaggattgaaaaacgttcgagaggtcaagggactaacaaaaggaggtccaggtcatgaagaaccaataccaatgtctacttacggatggaatctcgtaagactccaatcaggggtagatgttttctttataccaccagagaaatgtgatactttgctatgtgatattggagaatcaagccctaaccccacggtagaagcaggacgtacactgagggtcctaaatctggtagagagttggctcaataataacacgcaattttgtgtaaaagtactaaatccatacatgccatccgtaatagagaggatggaaacattacaacgaaagtatggtggagctcttgttagaaaccccctaagtagaaacagtacacacgagatgtattgggtttctaatgcaagtggtaatgtggtttcaagtgttaatatgatttcaaggatgttaattaacagatttacaatgagacataagaaagcaacttacgaacccgatgtcgacctaggttctggtactagaaacataggaattgaaagcgagacaccaaacctggacataatcggaaagagaatcgaaaagatcaaacaggagcatgaggcatcttggcattatgatcaagaccacccctacaaaacctgggcatatcatggctcatacgagacaaaacaaacgggatctgcgagctcaatggttaacggagtggtacgtctcctaactaaaccttgggatgtagtaccaatggtgactcaaatggctatgacagataccacaccttttggtcaacaaagagtatttaaagagaaagtcgatacacgcacacaagaacccaaagaaggcacaaagaaactaatgaaaatcacggctgagtggctctggaaagagctaggtaaaaagaaaacgcccagaatgtgtacaagggaagaatttactaagaaagttcggagtaacgctgcgctgggagcgatcttcacagatgaaaacaaatggaaaagcgcacgcgaagcagtagaagataaccgtttttgggaacttgtagataaggaacgtaatttgcatctcgaaggtaaatgcgaaacatgtgtatacaatatgatgggtaagcgtgaaaagaagttgggcgaatttggtaaagctaaggggtctagggctatatggtacatgtggctgggagctagatttctcgagttcgaagccttaggctttttgaacgaggatcattggttttccagagaaaacagtttatccggagttgaaggtgaaggtctgcacaaacttggatatatactgcgagaagtaagcaagaaagagggaggtgcaatgtatgcagatgacacggctggatgggatacgagaattacaatagaagacctgaagaacgaagaaatgattactaatcatatggccggtgagcataagaaactagcagaggcgatatttaaactgacatatcagaataaagtcgtaagagtacaaagaccaacccccattggaaccgttatggatattatatctagaagagaccaaagaggaagtggtcaagtcgggacatacgggttaaacactttcacgaatatggaggcacaactaattagacagatggaaggtgagggtattttcaaatccatacagcacttaactgcatcggaggaaattgcagtacaagattggttagtacgcgtagggagggaaaggctgtctagaatggcaatatcaggtgatgattgtgtagttaaacccttagatgacagattcgcccgagcgttaactgcattgaacgacatggggaaagttcgcaaggatattcagcaatgggagccatcaagaggctggaacgattggacgcaagtgccattttgtagtcaccacttccacgaattgataatgaaggatggaagaacgctagtagtgccctgtagaaaccaagatgagctgattggacgagcacgaatatcgcaaggggctggttggagccttcgagaaacagcctgtctcggaaaatcttacgctcaaatgtggtctctaatgtacttccatagacgtgatcttagacttgcagcaaatgcgatatgtagcgcggtcccgagtcactgggtaccgacatcaaggacaacatggtctatacatgctagtcatgagtggatgacgactgaagatatgttgacagtttggaatagagtatggatcttggaaaacccctggatggaagataaaactcccgttgaatcttgggaagagataccgtatttaggtaagagagaagatcagtggtgcggatctttaataggcctaacctcgcgggcaacatgggcgaaaaatatacaaactgctataaatcaagtccgttcattaatcggaaatgaagaatacactgattacatgccttctatgaagcgatttagaagagaggaagaggaagcgggggtattatggtga

SEQ ID NO: 22362 - RNA, 9876 nt, synthetic construct
  misc_feature 1..9876: note = derived and/or modified CDS sequence (opt6) from DENV-2__GQ868497__SS-prME
  source 1..9876: mol_type = other RNA
acagcaagcgtaatagtgatgttaataccaactgtaatggcattccacctcacaaccagaaacggagaaccgcatatgatagtaggaagacaagaaaaaggaaaaagtcttcttttcaaaacagaagatggagtgaacatgtgtactctaatggcaatagacttaggagaactatgtgaagacacaataacttataaatgtccgctactaaggcagaatgaacctgaagatattgattgctggtgcaatagcacttccacttgggtaacctatgggacatgctcgacaactggagaacacagaagggaaaaacgaagcgttgctctagtaccacacgttggtatgggcctcgaaacacgtaccgagacatggatgtccagcgaaggagcatggaaacatgtgcaaaggattgaaacttggatactaagacaccctggatttactataatggcagcaattcttgcatatacaattggtacaactcattttcaacgcgccctcattttcatattactgacagctgtagcgccaagcatgacgatgcggtgtattggtatatctaatcgggattttgtagaaggggtaagcggcggcagctgggtagacatagtgttagaacatggtagttgtgttaccacgatggccaaaaataaaccaacgttggattttgagttaattaaaaccgaggctaaacagccagcaacgttaagaaaatattgtattgaagccaaactaacgaacactacaacggaatcaagatgtcctacccaaggggaacctagtttgaatgaagaacaagataaaagattcatctgtaaacattcaatggttgaccgtgggtggggcaacgggtgcggcctattcggtaaagggggaatagttacctgtgctatgtttacatgtaagaaaaatatggaagggaaagtaatgcaaccggaaaacctggaatatacaatagtaattacaccacactctggagaagaacacgccgttggtaacgatacaggaaaacatggaaaagagataaaaatcacgccacagtcatctattacagaagcggagcttactggatacggtactgtaactatggaatgttctccccggacaggtttagacttcaatgaaatggttctgctccaaatggaagataaagcatggctggtacatagacagtggtttttagatttaccattaccatggctcccaggtgcagatacacagggcagtaactggatacagaaagagacattggtaacctttaaaaatccacatgcgaagaaacaagatgtagtggtcctcgggtcgcaggaaggcgctatgcatacagcgttaaccggagctacagaaatacagatgtcatctggtaatctcctgttcactggacaccttaaatgtcggttgcgtatggacaaactccaacttaaaggcatgtcgtactcgatgtgcactggtaaatttaaaattgtaaaagaaatagcggaaacccagcatgggaccatcgtgattagagtccaatatgaaggggacgggtcgccatgcaaaataccatttgaaattactgatttagaaaaacggcacgtgttaggaagattaataacggtaaacccaatagtaacagaaaaagattcaccagtaaatatagaggcggaacctccgttcggggacagctatataattataggagttgaaccaggacagctaaaactcaactggtttaagaaaggtagctcaatcggtcaaatgtttgagaccactatgagaggtgcaaagaggatggctattctgggagatactgcatgggatttcggatcattaggcggagtattcacaagtattggtaaagcgctacatcaagtattcggtgcaatttatggtgccgcattttcgggagtatcatggacaatgaaaattttgattggagttataataacatggattggaatgaactcaagatccacgtcgcttagtgttagtttggttttagtaggcgtcgtgacgctttacttaggagcaatggttcaagctgacagcggatgtgttgtttcttggaaaaataaagaactcaagtgtgggagtggaatttttataacagataatgtacacacatggacagagcaatataaattccagccagaaagtccctcaaaattagcatcagccatacaaaaggctcatgaagaaggtatatgtggtatacgatcggttaccagactagaaaacttaatgtggaaacaaattacccctgaactgaatcatattctgtcagagaacgaagtgaagctaactataatgacaggagatataaaaggtataatgcaggccggcaaacggagtctaagaccacaacccacagaacttaaatatagttggaaaacttggggaaaagcaaagatgctgtccacggaatcacacaatcagacattcttaatcgacggaccggaaacagcagaatgtccaaataccaatcgcgcatggaactcattagaagtggaagattatggattcggcgtgtttacaacaaatatctggttgaaattaagagaaaagcaggacgtcttttgtgatagtaaattaatgagcgcagctattaaagataacagagccgtacatgctgacatggggtattggatagagtccgcactgaacgatacgtggaaaatggagaaagcaagttttatcgaggtcaaaagctgtcactggccgaagtcccacactctgtggagcaatggtgttttagaatctgaaatgataattcccaaaaatttcgccggcccggtttcacagcataattataggcccggataccacacgcaaacagccgggccgtggcatttgggtaagctcgagatggactttgacttctgcgaaggcacaacagtagtagtgacagaggattgcggtaacagaggcccatcgttacgtactactacggccagtggcaaactaataacagagtggtgctgccgaagttgcactctaccccctcttagatatagaggtgaagacggttgttggtacggaatggaaattcgacccctgaaggaaaaggaagaaaacctagttaatagcctcgtcacggctggacacggtcagatcgacaacttctctctaggtgtgcttggtatggcactgtttctagaggagatgcttcgaactagaatcggaacaaagcacgccatattattagttgcggctagcttcgtaacgctaataacaggaaacatgtcatttcgtgatctaggaagagtgatggttatggtgggagccacaatgacagacgacataggcatgggcgtcacgtacctggccctactggctgcctttaaagttagaccaacattcgccgcgggtctattattacgaaaactgacaagtaaggaattgatgatggcaaccatcggaatagctctactatcccaatcaacaatcccagagacaatcttagaattgacggacgcgctagcacttggtatgatggttttaaagattgttcgcaatatggaaaaataccagttggccgtaacaatcatggcgataagctgtgtacctaacgcagttatacttcaaaatgcttggaaagttagttgtacaatcctcgctgcagtatcagtaagccccttattgcttacgtcctcgcaacaaaaagcagattggataccactagccttaaccataaagggcctaaacccaacagccatatttttgacaactttatctcgcacctctaagaaacgaagctggccactaaatgaagccgtaatggccgttggaatggtgtctatattagcaagttctcttctaaagaatgacattcccatgacgggaccattagtagctggcggattactaacggtatgttacgttctaacaggacgatcggcagatctagaactagagcgtgcagcagacgtgaaatgggaagatcaagctgaaatttctggatcgtcaccaatcctaagtataaccataagtgaagacggctcaatgtcagtcaaaaatgaggaagaagaacaaacactaacgatattaataaggacaggactattggtcatatcaggtgtatttcctgtaagtatccctattactgcagccgcatggtacttgtgggaagtcaagaaacagagagctggagtactgtgggatgtacctagtccgccaccggttgagaaagcagaattagaagatggagcctacagaataaaacaacggggtatattaggttattcgcaaataggcgcgggtgtatataaagaaggaacatttcatactatgtggcatgtaacgagaggagccgtattaatgcacaggggcaaaagaatcgagccatcatgggccgatgttaagaaagatctaattagttatgggggtggatggaaactagaaggagaatggaaagagggagaagaagtacaggtcctcgcactcgaacctgggaaaaacccccgcgcggtacaaacaaagccaggaatcttcaaaaccaatacaggtactattggggcggtaagccttgatttcagcccaggcactagcggcagtcctattgtagacagaaaaggaaaagtagtagggctatatggcaatggtgtagtaactaggtcaggggcttatgtgtctgcaatcgcacaaacagaaaaatcgatagaggataatcctgaaatagaagatgacatattcaggaagaaaaggctcaccatcatggacttacatcctggcgcaggaaaaaccaaaagatacctacctgcaatagtaagagaagcgattaaacgaggattaaggacactaatcctagcacccacaagggtcgtagcggcagagatggaggaagcactaaggggattacccattcggtaccagactcctgctatcaagactgaacatacaggacgtgaaatagtggacttgatgtgtcacgcgacgttcactatgcgcttactctctccagttcgtgtaccgaactataatcttatcataatggacgaagcacactttaccgatccggcaagtatagcggcacgagggtatatttctacaagagtggagatgggagaagcagcaggtatatttatgacggcgactccaccaggaagccgagacccatttccgcagtcaaatgcacctataatggatgaagagagggaaattccagaaagaagctggaactccgggcatgaatgggtaactgatttcaaaggaaaaacagtatggttcgtaccctcaatcaaagccgggaatgatattgcagcatgcttgaggaaaaatggaaagaaagttatacagcttagtagaaaaacttttgattcagaatatgtcaaaacacgggcaaatgattgggactttgttgtcacaactgatatcagcgaaatgggcgcaaactttaaggctgagcgcgtaattgatccccgtagatgtatgaagcctgtaatattaacggacggagaagaaagagttatcttagcaggacccatgccagtgacccattcatcggcagcacaacggcgaggtagaataggtcgtaatcctaaaaatgaaaacgaccaatacatatacatgggggaacctcttgagaatgacgaggattgcgcccattggaaggaggctaaaatgttgttagacaatataaatacaccagaagggataataccatcaatgttcgaaccagagagagaaaaagtagatgcaatcgacggagaatacaggctgagaggtgaagccagaaaaacctttgtagacctaatgagacggggagatcttccggtatggctagcttataaagttgcagcggaaggtattaattacgccgatagaaaatggtgttttgacggtatcaaaaataaccaaatcctagaagaaaatatggaggtggagatatggactaaagagggagagaggaagaaactaaaacctcgatggttagacgcgcgaatctatagtgacccacttgcactaaaagaatttaaagagtttgcagctggacggaaatctctcacattgaaccttataacagaaatgggacgattaccaacgttcatgacacaaaaagctcggaacgcattagataatttggcagtcttacatactgccgaggcgggaggacgagcatacaatcatgccctttcagagttacctgagactttagaaacattgctcttgttgacactgttggcaacggttacaggaggaatctttttatttctaatgtcaggcaaagggattggtaagatgaccttaggaatgtgttgtatcataaccgcgtcaattcttttatggtatgcacaaattcaaccgcactggattgctgcgtcaataattcttgagttctttttgatagtcttactgattccagagccagaaaagcaacgaacgccgcaagataaccaattgacctatgtggtcatagcaattctaactgtagttgcagcaacgatggcaaacgagatggggttcttggagaaaaccaaaaaggacttaggactaggatctattaccacacaagaatcagaaagtaatattctagatatagacctgagaccagcaagcgcctggacattatacgcagtcgctacgacatttgtgacaccaatgctacgccactcaatagaaaattcctctgtaaacgtatctctaacagcaatagcaaatcaagcaacagtacttatgggcctaggtaaaggatggccactgtctaaaatggacattggagtacctctgttggcaattggctgttattcacaagttaacccgatcacactaacggctgctttgctattattggtggcgcattacgcaataataggtccaggattgcaagcaaaagctaccagggaggcacagaaaagagcagcagcaggcataatgaagaacccaactgttgatgggataaccgtaattgatcttgaacctatcccttacgacccaaaatttgaaaagcaattagggcaagttatgttgctcatattatgcgtgacacaagttttaatgatgcgaacgacgtgggctttgtgcgaggctttgacgttagctactgggccaatcagtactttatgggaaggtaatcccggacgattctggaataccaccatagcagtcagcatggccaatatattcagggggtcataccttgccggagcaggtttgttgtttagcataatgaaaaacactacgaatacaagaagaggtactggcaacataggcgaaacccttggcgaaaagtggaaaagccgattaaatgcgctaggcaaaagtgaatttcaaatttataagaaatctggcattcaagaagttgatagaaccctagcaaaagaaggcattaagagaggagaaacggatcatcatgctgtatcaagaggttctgcgaaattacgatggtttgttgagagaaacatggttacacctgagggtaaagtcgttgatctaggatgcgggcgaggaggttggtcgtattattgtggaggcttaaaagatgtccgcgaggtaaaaggcttaaccaagggcggtccaggtcatgaggagccaatccctatgtctacgtatggatggaacctggtgaggttgcaaagcgggatagatgtgttctttacacctcccgagaaatgtgacacactattatgcgatataggggaaagctcaccgaatccaacaatcgaagcaggaagaactcttcgagtactcaatttagtcgaaaactggctgaataacaatactcaattttgtatcaaagttctcaacccatatatgccatcagtgatagagaaaatggaaactttacaaaggaaatacggaggagcgctagtacggaacccattatcaaggaacagtacccatgagatgtattgggtgagcaacgccacaggaaatatagtgtcgagcgttaacatgatatcgagaatgttaataaatcgctttacgatgaagcataagaaagcaacatatgaaccggatgtcgacctcggttcaggtactcggaatatcggaatcgagtccgaaattccaaacctggacataataggaaagagaatagagaaaatcaaacgagaacacgaaacatcatggcattatgatcaggatcatccgtacaagacttgggcatatcacggttcatacgaaaccaaacaaacaggatcagcgagttcaatggtgaatggtgtagttcgattattaacaaaaccgtgggatgtagtacccatggtaacacaaatggctatgacggatacaacaccatttggacaacagagagttttcaaagaaaaagtggataccaggactcaagaacccaaagaaggcaccaaaaagctaatgaaaataacagcggaatggctatggaaagagttgggtaagaagaaaacaccacggatgtgtaccagagaagaatttacccggaaagtcagatcaaacgctgccctaggggcaatattcactgatgaaaacaaatggaaatcagcccgagaagcagtagaagacggcagattctgggagcttgtagacagggaaagaaacctgcatttggaaggtaaatgtgaaacgtgcgtgtataacatgatgggtaagcgtgagaagaaacttggcgaatttggtaaagcaaaaggaagccgtgctatttggtatatgtggttgggggcacgctttctagagttcgaagctctcgggttcttaaacgaagatcactggtttagccgtggaaactccctgtccggtgtagaaggagaaggattgcaccgattagggtatatactgcgagatgtaggcaagaaagaaggtggtgccatgtacgcagacgacacagccggatgggacacacgtataacattggaggatctcaaaaatgaagaaatggtgactaatcatatgaaaggagaacacaagaaattagccgaggcgatattcaaactaacatatcaaaacaaggttgtcagagtacaaagaccaactccccgtggcacagttatggatattatttctcgaagagatcagagaggttctggtcaagttggcacttacggattaaatactttcacaaatatggaggcgcaactgataaggcaaatggagggcgaaggtatttttaaaagtatacaacatttaacggcaaccgaagaaatcgcggttcaaaactggctggctcgagttggacgtgaaagactctctagaatggcaatatccggtgatgattgtgtcgtcaaacctatagacgaccgttttgcctcagcattaacagctttgaatgatatgggtaaggttcgtaaagatatacaacaatgggaacccagtagaggctggaatgattggactcaagttcctttttgcagtcaccattttcatgaacttgtcatgaaagacggaagggtcctagttgttccgtgtcgcaatcaggacgaattaataggtagggccagaatatctcaaggtgcggggtggtcactaaaagagacagcttgccttggaaagtcctacgcacaaatgtggactcttatgtatttccacagaagagatttaagacttgcagctaacgcgatttgttcagctgtgccatctcattgggttcctacatcccgaacaacgtggagcattcacgctaaacatgaatggatgacgacagaggatatgttggctgtatggaatagagtttggatccaagaaaatccttggatggaggacaaaacacctgtagaatcatgggaagaagtaccatatttaggaaaaagagaagaccagtggtgcggtagtcttataggtcttactagccgagcaacttgggcgaaaaatatccagacggctataaaccaagtaaggtctctaataggcaatgaggaatacaccgattatatgccgtcgatgaaacgatttcgtaaagaggaggaagaagccggagttctatggtaa

SEQ ID NO: 22363 - RNA, 9876 nt, synthetic construct
  misc_feature 1..9876: note = derived and/or modified CDS sequence (opt6) from DENV-2__GU131959__SS-prME
  source 1..9876: mol_type = other RNA
acagctggtgtaatagtaatgttaatcccgacagtaatggcatttcatctaactaccagaaatggtgaacctcacatgatagtaggacgtcaggaaaaaggcaaatcgctactctttaaaaccgaagacggagtaaacatgtgtacgctcatggcaattgatctcggtgaactgtgtgaagatacaataacatataaatgccccctactgaggcagaatgaaccggaagacattgattgttggtgtaactctactagcacatgggttacctatggcacgtgtagtactacaggagagcatagacgtgagaaaagaagtgtggcgctagttccacacgtaggaatgggacttgaaacacgaactgaaacttggatgagtagtgaaggcgcctggaaacacgtacaacgtattgagacgtggatattaagacatccgggattcacaatcatggcagccatactcgcttatacaattggtacaacacactttcaaagagctctcatctttattctattaaccgcagtagctccatccatgactatgcgatgtattggaatttcaaatagagactttgttgaaggggtcagtggtggctcttgggttgatattgtcttggaacatggatcttgcgtaactactatggcgaaaaataaacctacactagattttgaactaattaaaaccgaagcaaaacaaccagcaacactcagaaaatactgcatagaggcgaaattgaccaacactacaactgaatctcgatgtcctactcagggagaaccatcactaaacgaagaacaagacaaacgattcatatgtaaacatagcatggtagaccgaggatggggtaatggatgcgggctatttggtaaagggggcattgtaacatgtgcaatgtttacttgtaagaaaaatatggaaggaaaagtagtgcagcctgaaaacttggagtacacaatagttattacacctcactcaggcgaagaacacgctgtaggcaatgacacgggtaaacacgggaaagaaataaaaattacaccccaatcctcaataaccgaagcggaactaactggatatggtacagttactatggaatgcagtccaagaacagggttagattttaatgaaatggttcttttacaaatggaggataaggcttggctcgtgcatagacaatggtttctagatcttcccctcccatggctacccggagctgacacccaaggttcgaactggattcaaaaagagactctagtgactttcaaaaacccacatgctaagaaacaagacgtagtagtattaggatcgcaagaaggagcaatgcatacagcactaacaggagcgacagaaatccaaatgtcaagtggaaatctcttattcactggccatttaaaatgtcgattaaggatggacaaattgcagcttaaaggtatgtcatatagcatgtgcaccggtaaatttaaaatagtaaaagaaatagcggaaacacaacatggaacaattgtaataagggtccagtacgaaggagatggatcaccatgcaagataccatttgaaataacagatttggaaaaacgccacgtactcgggcgcctaataacggtaaaccctatagtaacagaaaaagactctcccgtcaacatagaagcggaacctccatttggagattcatatataatcattggcgttgaaccaggacaattgaaactaaattggtttaagaaagggagttccatcggacaaatgttcgaaaccacgatgagaggggctaaaagaatggcaattttgggtgataccgcatgggatttcggttcgctcgggggagtatttacgtcaataggaaaagcattacaccaagtcttcggggctatatatggcgctgccttcagtggtgtgagctggacaatgaaaatcttgatcggtgtcatcatcacttggataggaatgaatactagaagtacgagcctctcagtatcgctcgttttggtaggggttgttaccctatatttaggggccatggtacaagcagatagcggttgcgttgtatcctggaaaaacaaagagctaaaatgtggtagtggaatatttataacagacaatgtacatacatggacagaacaatataaatttcaaccagagagtcccagcaaattagccagcgccatccagaaggcccacgaggagggaatctgtggaatccgatctgtcacgagattagagaacttaatgtggaagcaaatcacacccgagttaaatcacattttatcagaaaacgaagtcaaattaacgataatgaccggtgacataaaaggcattatgcaagctggaaagcggagtcttaggccgcagcccacagaactaaaatacagttggaagacatggggaaaagccaaaatgctttctaccgagtcgcacaatcaaacgttcttaatcgatggaccggaaaccgcagagtgccctaataccaacagggcatggaactctttagaggtagaagactacggatttggtgtatttactacgaatatatggctaaagctgcgcgaaaaacaagacgtattttgtgactcgaaactaatgagtgccgcaatcaaagataatagagctgttcacgccgacatgggttactggatagaatctgctctgaacgaaacatggaagatggagaaggcctcatttatagaggtaaaaagctgttattggccaaaaagccatacgctatggtccaacggagtgctagaaagcgagatgataataccgaaaaacttcgctggcccagtatctcaacataattatagacctggataccatacacaaacggcagggccatggcacctaggtaaattagaaatggatttcgatttatgcgaaggtaccacagtagtagtaaccgaagattgcggaaatagaggtcctagtttaaggaccacaacagccagtgggaaactaattaccgaatggtgttgccgtagctgtacattaccgccacttcgttacagaggtgaagatggatgctggtatggaatggaaattagaccgttaaaggagaaagaggaaaatctcgtaaattccttggtaacggcaggacacggacagattgataattttagcttaggagtcctagggatggcactattccttgaggaaatgctgaggacgagaatcggaacaaaacacgctattttgctcgtcgcagcatcattcgtaaccttaataaccggaaacatgtcctttcgagatttaggaagagtaatggtcatggttggagctacaatgacagacgacattggtatgggtgtaacatatttagctctactagcagcgttcaaggttagacccacatttgcagcaggattgttgttaaggaaattaacaagcaaagaactaatgatggcaactataggtatagctctactatcccaatcaactatacctgaaacaatactagaactaacagacgccctagcgttgggtatgatggttcttaaaatcgttcggaatatggaaaagtaccagctcgcagttacaatcatggctatatcatgtgtgcctaacgcggtgatattacaaaacgcctggaaagtaagttgcacaattttagcagctgtatcggtatctcctttattacttaccagttcacaacaaaaggctgattggattcctttggccctaactataaagggcctgaaccccacagcgatatttctaaccacattaagcagaacctccaagaaaaggtcttggccacttaacgaggcagtaatggcagtgggaatggtttcaatacttgcaagtagtctactaaagaatgacatacccatgactgggccattagttgcgggagggttgttgaccgtttgttacgtcttaacaggtcgcagtgctgacctcgaacttgaaagagcagctgatgtcaaatgggaagaccaggcagaaatcagcgggtcaagccccatactatctattacaatttcagaagacggatcaatgagtattaaaaatgaagaggaagaacagactttaactatactgatcagaacaggacttctggtaatatcaggagttttcccagtaagtatacccattaccgcagcagcttggtatctatgggaagtgaagaaacaaagagccggagtactatgggatgtcccaagcccaccgccggtcgaaaaagcggaacttgaagatggcgcttatagaatcaaacagcgcggaatactaggatactcacaaataggggcgggtgtgtacaaagaaggaactttccatactatgtggcatgtaacgcgaggtgcagtactaatgcatagaggaaagcgaatagaaccaagctgggcggacgtaaagaaagatctcatatcgtatggaggaggctggaaactagaaggagagtggaaagaaggggaagaagtacaggtgttagctctagagcctggcaaaaaccccagagcagttcaaaccaagccgggcatattcaaaactaacaccggaacaatcggagccgtatcgcttgacttctccccgggaacttctggatctcccattgtcgatcgtaagggcaaagtagtaggactgtatggcaacggtgtagtcacaaggagcggagcatatgtgtccgcgattgcccagacggagaaatcaatcgaagataacccggaaatagaagatgatatttttagaaagaagcgcctgactattatggaccttcacccaggcgcgggaaagacaaagagatacttgccggctatcgttcgcgaagcaataaaaagagggttaaggacactcatactagccccaacgagagtagttgctgccgaaatggaagaggcactcagaggcctaccaatccgttatcagacgcctgcaataaaaacagagcacacaggacgcgaaatcgttgatctaatgtgtcacgcaacgttcacgatgaggttactatcaccagtaagggtgcctaactataacctaattattatggatgaagcacattttacagatcctgcttcaatcgcggcacgtggatatatttcaacgcgagtcgaaatgggtgaagcagcaggaattttcatgacggcaaccccaccaggaagcagggacccattcccgcaatctaacgctccaataatggatgaggagagggagatacctgaaaggtcttggaactctggacacgagtgggttacggactttaaagggaagacagtatggttcgtaccttccataaaagccggaaacgacattgctgcttgcttgcgcaaaaacggaaagaaggtcattcaattatcaaggaaaacatttgattcggaatacgtcaaaactagagcaaatgactgggattttgtagtaactaccgatatttcggaaatgggcgcaaattttaaagcagaacgagtcatagatccacgacgttgtatgaaacctgtaatactaacagacggggaagagagagtcattttagccgggccaatgcccgtcacacatagtagcgctgcgcaaagacgaggtaggataggtaggaatcccaagaacgaaaatgatcaatacatatacatgggcgagccgcttgagaacgatgaagactgcgcacactggaaagaagcaaaaatgttactcgacaatattaatacaccagaaggcatcatcccgtccatgttcgagcctgaaagagaaaaggttgatgctatagatggggaatatagattaagaggcgaagcaaggaaaacattcgttgacttaatgcgaagaggagatttacctgtatggctagcatacaaggtggcagccgagggaataaactacgcagacagaaaatggtgctttgatggcatcaagaacaatcaaatactagaagaaaacatggaagtagagatttggacaaaggaaggcgaacggaagaaattaaaaccaaggtggctggacgctagaatttatagcgacccactagctttaaaagaatttaaagaatttgccgctgggaggaaatccctaactttaaacttgataacagaaatgggccgcctacctacatttatgactcaaaaagccaggaacgcgttagataacttagcagtgctacatacggcagaagccggtggacgcgcatataatcatgcgctcagtgaactaccggagacactcgagacacttttactgttgaccttattagcaactgtcactggtggtatatttctgtttttgatgtccggtaaaggaattggaaaaatgaccctcggaatgtgctgcattataacagcttctatattactctggtacgcacagatacagcctcactggattgccgccagcataattttagaatttttcttaattgtcctactcattccagaaccggaaaaacaacgaactccacaggacaatcaattaacctatgtagtcatagctatattaacagttgttgcagcaacaatggccaacgaaatgggatttttagagaaaaccaagaaagacttaggcctgggatcaataacgacacaagaaagtgaaagtaatatactagacatcgatctaagaccagcgagtgcttggacactctacgccgtagctacaacattcgtcactccgatgctgaggcacagcatagaaaatagtagtgttaatgtgtcactgacagcaatagcgaaccaagccacagtgctcatgggactagggaaaggatggcccctttcaaaaatggatattggagtaccattacttgcaattggttgttatagtcaggtaaatccaattacattaacggctgcactactactattagtagcacattacgcaataataggacctggtttgcaagcaaaagcgacaagggaggcccagaaacgagctgctgcaggtataatgaaaaatcctactgttgatggaattaccgtaatcgatctggagccaattccatacgaccctaaatttgagaaacaattggggcaagtcatgcttttgatcttatgcgtcacacaagtactcatgatgaggaccacgtgggctctatgcgaagcattaaccctcgcaactgggccgatttctacactttgggagggaaatcccggtaggttctggaatactacaatagcagtatcaatggctaacatatttaggggatcgtacttggccggagcgggtttattattctcgatcatgaagaatacgactaacactaggcgaggtacaggcaatataggggaaacactgggtgagaaatggaaaagtagattaaatgctctcggaaaaagcgagttccaaatctataagaaaagtgggatacaagaagtagatagaacattagcgaaagaagggattaaacgaggggaaactgatcatcacgcggtttctagaggttccgcaaaattacgatggttcgtagaaaggaacatggtaactccagagggaaaagttgtggacttaggttgcggtagaggcggctggtcctattactgtggaggtttaaaagacgttagagaagtcaaggggttaacgaaagggggaccaggccatgaggagccaattcctatgagtacatatgggtggaacctggtacgtttacaatcaggaatagatgttttcttcactcccccagagaagtgtgatacattactatgtgatataggagaaagttccccaaaccctactatcgaagcaggaagaaccttacgagtgcttaacttagtagaaaattggctgaacaataatacccagttttgtattaaggttttaaatccgtatatgccgtccgtaatagaaaagatggaaacccttcaaagaaaatatggaggtgcactggtaaggaacccactgagcagaaattctacacacgaaatgtactgggtttcaaatgcgactggaaatatagtgagttctgtcaatatgatatccagaatgctgataaatcgctttacgatgaaacataaaaaggctacttacgagccagatgtagatcttgggtcgggaacacggaacataggtattgagtctgagattcccaatttggacatcatagggaagcgtatcgaaaagattaaacaggaacatgaaacaagctggcactacgatcaagatcacccgtataaaacttgggcatatcatggttcctatgaaacgaagcaaacagggtcagcgtctagcatggttaacggagtagtgagactattgactaaaccatgggatgtcgtacccatggtaactcaaatggcaatgactgataccacgccatttggacaacaacgagtattcaaagaaaaggtagatacaaggacacaagaaccaaaagagggtactaagaaacttatgaagattactgccgaatggctatggaaagagcttggaaagaaaaagactccaaggatgtgcacgcgcgaagagtttaccagaaaagtccggagtaatgctgccctaggagcaatctttacggacgagaataagtggaaaagtgctagggaagctgtagaagacgggaggttctgggaattagttgatcgcgagcgtaacttacatttggagggaaaatgtgaaacatgcgtatataatatgatgggtaaacgcgaaaagaagctaggtgaatttggaaaagcaaaggggtcaagggcaatatggtatatgtggttaggggcacgctttttagagttcgaagccttaggttttctaaatgaggatcactggtttagtcggggaaattcactaagcggagtggaaggcgaaggtttgcatagacttggttacatactacgagatgtaggtaagaaagagggcggagcgatgtacgccgatgacacagcaggatgggatactaggataactctagaggatcttaaaaatgaggaaatggtaacaaatcatatgaaaggtgaacacaagaaactcgcagaagcaatattcaaactaacttatcaaaacaaagttgtacgtgttcaaaggcccacacctagaggtacggtaatggatataatatcacgaagagatcaaagaggttcaggtcaagtggggacttatgggctaaatacattcacaaatatggaagcacaactaatacgacaaatggaaggagaaggtatatttaaaagcatacagcacttaaccgcaacagaagaaatagctgttcagaattggctggcaagagtaggtagggaacgattaagtcgaatggctatatcaggagatgactgcgtggtaaaaccaatagatgatcggttcgcgagcgccctaacagcactaaatgacatggggaaggtaaggaaagatatccaacagtgggaacctagtcgaggttggaacgactggacacaagtcccattttgtagccaccattttcacgagttagtaatgaaagacggtagggtccttgtagtgccatgccgaaatcaagacgagcttataggaagggcgcgaatctcacaaggagcaggatggtcgttaaaagaaactgcttgtctgggcaaatcatacgcacaaatgtggacgttgatgtactttcataggagagatttacgtctcgccgcgaatgccatatgttcagcggttccatcacactgggtacccacctcaagaacaacctggtcaattcatgctaaacatgaatggatgactacagaggatatgcttgcggtttggaatagggtctggatacaggaaaatccgtggatggaagacaagacgccagtggaatcatgggaagaggtcccgtacttaggaaaaagagaagatcaatggtgtgggagccttataggtctaacgtcaagggctacgtgggctaaaaatattcaaactgcaataaatcaggtacgtagtctcattggaaatgaggagtataccgattatatgccctcaatgaaaagatttagaaaggaagaagaagaagcaggggttctgtggtag

SEQ ID NO: 22364 - RNA, 9876 nt, synthetic construct
  misc_feature 1..9876: note = derived and/or modified CDS sequence (opt6) from DENV-2__GQ868515__SS-prME
  source 1..9876: mol_type = other RNA
actgctggtgtaattgtaatgctaataccaacagtaatggctttccatttaactaccagaaacggagaaccacatatgatagtgggacgtcaagaaaaaggaaaaagtttattatttaaaaccgaagacggtgtaaatatgtgtacacttatggcaattgatttaggagaactttgtgaagatacaattacatacaaatgtccattgttacgccaaaacgaaccggaagacattgattgctggtgcaactctacttcaacatggatcacgtatggaacctgttcaactactggagaacatcgtagagagaaaagaagtgtcgctttggtaccacacgtaggtatgggactagaaacaagaacagaaacatggatgagtagtgaaggggcttggaaacatgtccaacggatagaaacgtggattcttcggcatcctggatttacaataatggcagcaattttggcgtatactataggaacgacacatttccaaagggcattaatattcattttacttactgctgtcgcaccaagtatgaccatgcggtgcatcggtataagcaatagagattttgtagaaggggtatcaggtggatcctgggtagacatcgtgctggaacacggcagttgcgtaaccacaatggcgaaaaacaaaccaacgctagattttgagttgataaaaactgaagctaaacaaccagctaccttacgaaaatactgtatagaagcgaaactaacgaatactactaccgaaagccgatgtcccacacaaggagagccatcactaaatgaagaacaagataaaagatttatttgcaaacattcgatggtagatcgtggttggggaaacggctgtggattatttggtaaaggaggcatagtaacatgtgcaatgtttacttgcaagaaaaatatggaagggaaagtagtccaacccgaaaacctagaatacacaattgtcattaccccacattccggcgaggagcacgcagtcggaaacgatacgggtaaacatggtaaagaaataaaaatcacgccacagagtagtataactgaagcagaactaactggatatggaacagtgactatggaatgttcgccacgaactggattagatttcaacgaaatggtattattgcagatggaagataaagcatggttggtgcatagacaatggtttttagaccttccgttaccttggttaccaggcgcagacacacaaggatcaaactggatacaaaaagagactctagtaactttcaaaaatccacatgcaaagaaacaggatgtagtcgtattgggaagtcaagagggcgcgatgcacactgcattaaccggggcaacagaaatacaaatgagctcgggcaatttactattcaccggtcatttaaaatgccgattgcgaatggataaattacagttaaaaggtatgagttattctatgtgcacgggtaaattcaaaatcgttaaagagatcgcggagactcaacatggaacaatagtaataagagtcaggtatgaaggggacggctccccatgtaaaatcccttttgaaataacggacagtgagaaaagacacgtcctaggtaggctaataactgtaaaccccatagttacagagaaagattcccccgtgaatatagaagctgaacccccttttggagacagttatataataataggtgttgaacctggacaattgaaattgaattggttcaagaaaggctcaagtataggacaaatgttcgaaactaccatgcgcggtgcgaaaagaatggcaattctgggagatacggcttgggatttcggtagcctaggaggtgtgtttacttcaattggtaaagcattacatcaggttttcggcgcaatatacggcgcagctttttcgggtgtttcttggactatgaaaatattgattggagttataataacatggataggtatgaactctcgaagtacatctctatcagtatcgctagttctagtaggggtagtcatcttgtatctcggagcaatggtccaagctgacagtggatgcgtcgtctcctggaaaaataaagagttaaaatgcggatccggaatatttataacagacaatgtccatacctggacagaacagtataaattccagcctgaatctcccagtaaactagcaagcgcaatacagaaagcgcatgaagaaggaatatgtggaatacgaagcgtaaccagactagagaatctgatgtggaaacaaataacaccagagctaaatcatatcttgtctgagaacgaagtaaaattaacaattatgacaggtgatattaaaggaattatgcaagcgggtaaaagatcactacgtccacaaccaactgaacttaaatattcgtggaaaacttggggtaaagccaaaatgctatccactgaatcccacaatcagacgtttctgatagatggaccagaaactgccgagtgcccaaatactaatcgagcttggaacagtctagaagtagaggactacggattcggagtctttacaactaatatatggctgaaattacgggagaaacaagacgtgttctgtgactcaaaattaatgagcgcagctattaaggataatagagcagtccatgccgacatgggatattggatagagagtgcactaaatgacacctggaagatggagaaggcttcgtttatagaagttaaaagttgtcattggccgaaatcgcatacgctatggtccaacggagtgctagaatctgaaatgataattccaaagaatttcgccggtccagtctcgcaacacaactataggcctggttaccatacacaaactgctggaccttggcatctaggcaaattggaaatggacttcgatctctgcgaaggaacgaccgttgtagtaactgaagattgcgggaaccgaggtccaagcctaagaacaacgacagctagcggtaaactaataacggagtggtgttgtaggtcgtgcactctaccaccgcttcgatatagaggggaagatggatgttggtatggcatggaaataagacctttaaaagaaaaagaggaaaatttagtcaatagcctagtaacagcaggtcatggtcaaattgataattttagtttaggagttcttgggatggccctcttcttggaggaaatgttacgaacacgaattggaactaaacatgcaattctattagtagcagccagctttgtaaccctcatcactggaaacatgagttttcgagatctcggacgcgtaatggtgatggtaggtgcgacaatgacagatgacattgggatgggtgtgacgtatttagctctattagctgcattcaaagtacgaccaacatttgccgcaggattgctacttagaaaattaacaagtaaggaactaatgatggctacaataggcatcgctttactttcacaatcgactatcccagaatctatcttagaattaacagatgccttagcactcggcatgatggtcttaaaaatagtaagaaatatggaaaagtaccaactggcagtgaccataatggcaataagctgtgttcctaacgcggtaatacttcaaaacgcgtggaaagtaagttgtactattttagcggcggtctcggttagtcctctattattaacgtcatcacaacaaaaggcagactggatccccttagcacttactattaagggcctaaacccaacggcaatatttttgaccactctatcaagaaccagtaagaagaggagctggccacttaatgaagccgtgatggctgtaggaatggtttcaatactggcatcgagtttacttaaaaatgatataccgatgacaggacctctagtagcaggaggtctactcactgtgtgctacgtacttactggtcgaagcgctgatctagaattagagagggcagccgatgttaaatgggaggaccaagctgaaatttccgggagctcccccatactgtctattacaatctctgaagatggttctatgagcatcaaaaacgaagaagaggagcaaacattaactatcctaataaggacagggctcctggtgataagtggagtattccccgtgagcattccaataacggcggcggcatggtatctatgggaagtcaagaaacaacgggcaggcgttctatgggacgtacccagtccgccccctgtagaaaaggcagaactagaagatggagcatatcggattaaacagcgtgggatcctcggatactcgcaaatcggagccggggtatataaagaaggtacattccatacgatgtggcatgtgacacgaggagcagtcctaatgcacagaggaaagcgcattgaacccagctgggcagatgtaaagaaagatcttatatcatatggaggcggatggaaactcgaaggagaatggaaagaaggagaagaggttcaagtgttagctttagagcctggcaaaaatccaagagccgttcaaactaaaccgggaatttttaaaaccaatacgggcacaataggtgcggtttcacttgattttagcccaggtacttccggatcaccgattgttgacaggaaggggaaagtcgtagggttatatggtaacggagtagtaacaagaagtggcgcgtacgtttctgccatcgcgcaaactgagaagtctatagaagataatccagagatagaagacgatatattcaggaagaaaaggctaaccataatggatttgcacccgggagccggcaaaacaaaaagatatttacccgcgatcgtgagagaagctataaagagaggattaaggacgctaattctagcacctacgagagtggttgcagctgaaatggaagaagcacttagaggcttaccaatccgttatcaaacaccagcaattaagactgagcatactgggcgagaaatagtcgacttaatgtgtcacgccactttcacaatgcgactcctctctccagttcgcgtaccaaattacaatttgataataatggacgaggcccactttacagaccccgcatcaatagcggctcgtggctatatatcaacaagagtggaaatgggagaagccgccggtatatttatgaccgccacaccacccggtagtcgcgatccatttccgcagtcgaacgctccaattatggacgaagaacgagaaatccccgagagaagttggaacagtggacatgagtgggtaaccgattttaaaggaaagactgtatggtttgtcccatcgataaaagcaggtaatgacatcgcggcttgcttacgcaaaaatggcaagaaagtcatccaacttagtaggaagacttttgatagcgaatacgtgaagaccagagcaaatgattgggacttcgtagtaacaacagatataagtgagatgggagcaaacttcaaagcagagagagtgattgaccctagacgttgcatgaaacctgttattcttacagacggtgaagaaagagtaatactagctggaccgatgccggtaactcacagctcggcagcgcaacgcaggggaagaataggtagaaaccctaagaacgaaaatgaccagtacatatatatgggagaaccattagaaaatgatgaagactgtgcccattggaaagaagccaaaatgttgttggataacataaacacaccggaaggaataattccctcgatgttcgaaccagaacgcgaaaaggtggatgctatcgatggagaatatagactccgtggggaagcaaggaaaacattcgtcgacttgatgcgtagaggagacctaccggtgtggcttgcttacaaagtggcagcagaagggataaactatgccgacagaaaatggtgcttcgatggcatcaaaaataaccagattctagaagaaaatatggaagttgaaatttggacaaaggagggtgaaaggaagaaattaaaacccagatggctagatgcaagaatttatagcgatccactggccttaaaagaatttaaagaatttgctgcaggaagaaaatccctaacactgaatttaataacagaaatgggaaggctacccacatttatgacacaaaaggctagaaacgcgttggacaacctagctgtattacacactgctgaagccggtggacgagcctacaaccatgcgctgtcggagttgccagaaacacttgagactttacttctattaacgttactagcaacggtaacgggaggaatatttctatttttgatgagcggaaaaggcataggcaaaatgacactgggaatgtgttgtatcataactgcctctatactgctttggtacgcacagatacaaccacactggatagcagcaagtataattttagaatttttcttgattgtgctactaataccagagcccgaaaaacaacgaacaccccaagataaccagttaacatacgtagtaattgctatcttaactgttgtcgcagcaaccatggctaatgagatgggatttctggagaaaactaagaaggatcttggtctcggcagtattactacacaggaaagtgaatccaacatattagacatagacttgagaccagcgtcagcgtggacgttgtacgccgtagcgacaacctttgtgactcctatgctacgacatagcattgaaaacagctctgttaacgtttcattaacagcaatcgcaaatcaggcaacagtactaatggggctaggaaagggatggccactaagcaaaatggacataggtgtacctttattagcaatcggatgttacagccaagtaaatccaattactttaactgcagcattattacttctggtcgcacactatgcgataataggacctggattacaagcgaaagcgacaagggaggctcagaaaagagctgctgccggaataatgaaaaatccaactgtagatggaattactgtaatagacctcgagcctataccatatgatccaaagtttgaaaaacagttaggacaagtcatgcttttaattttatgcgtcactcaagtcttaatgatgagaactacatgggctttgtgtgaagcgctaacactcgccaccggaccaatcagtacgttatgggaaggcaatcctggaagattttggaacacaacgatagcggtatctatggcaaacattttcagaggttcatatcttgcaggagcaggattattgttctcgattatgaagaatacgacgaacactagaaggggcaccggcaatataggtgagacattaggcgaaaaatggaaaagtagacttaacgctttaggcaaaagcgaatttcaaatctataagaaaagtggaatacaagaagtcgacagaaccttggctaaagaagggattaagagaggcgaaacagaccaccacgccgtcagtagaggtagtgcgaaattaagatggtttgtagaaaggaatatggtaacgcctgaaggaaaagtggttgatctaggatgtggaagaggcggatggagttattattgcggcggattaaaagacgtccgagaggtaaaagggcttaccaagggaggaccaggccacgaggagccaatcccgatgtccacatacggatggaacttagtacggctgcaaagcggaatagacgtattctttacaccacctgagaagtgcgacacattgctctgtgacataggtgaatcgtctcctaatccaactatagaggctggtagaacgctaagagtactaaatttagtggaaaattggctaaataataatacgcaattctgtattaaagtattaaacccttatatgccgtcagtaattgaaaagatggagactctccagcgtaaatatgggggagctttagtacgaaaccctctatcccgcaattctacacatgaaatgtactgggtaagtaacgcaactgggaatattgtctcgagcgtcaatatgatctcaaggatgttgattaatagatttactatgaagcacaagaaagccacttacgaacctgatgtagacttagggtcaggtacaagaaatataggaatagaatcagaaatccctaatctggatatcattggaaaaaggatagagaaaataaagcaagagcatgaaacctcatggcattacgatcaagaccatccgtataaaacgtgggcatatcacggatcatacgaaaccaaacaaacagggagtgcaagttctatggtaaatggagtggttcgactattaacgaagccatgggacgtcgtacctatggtgacacaaatggctatgactgataccaccccatttggacaacaacgtgtatttaaagaaaaggtagatacaagaacacaagaaccaaaagaagggacaaagaaattgatgaagataacagctgagtggctgtggaaagaattaggcaagaagaaaaccccacgaatgtgcacccgcgaagagttcacaagaaaagttcggagcaatgccgccctgggtgcaatatttactgacgaaaataaatggaaaagcgctcgagaagcagtagaagatggacgattttgggaactggttgacagggaaagaaatttgcatttagaaggaaaatgcgagacatgcgtatataatatgatggggaaacgtgaaaagaagctaggcgaatttggaaaagcgaagggatcaagggctatttggtatatgtggctaggtgctaggtttcttgagttcgaagcattaggtttcctaaatgaagatcattggttcagtaggggcaatagtttatctggagttgagggggaagggcttcaccggctggggtatatcttgagagatgtaggcaagaaagagggtggagcaatgtatgcagatgatactgccgggtgggacacaagaataactctagaagatctcaaaaacgaggaaatggttacgaaccatatgaagggggaacacaagaaactagctgaagcaatcttcaaactaacttaccaaaacaaagtagttagagtacagagaccaacaccacgtggaacagtaatggacattatttcgaggagggatcaacgcggatctggtcaagtaggaacctatggattaaacacgtttacaaatatggaagcacaacttataagacagatggaaggagaagggatttttaaaaacattcaacatttgactgcaacagaagaaatagctgtgcaaaattggctggcgagagtcggacgcgaaagactttctcgtatggcgataagtggagatgactgtgtagtaaagccgatagatgatcgattcgcgtcagcgctgaccgcattaaacgatatgggaaaagtgaggaaagatattcaacagtgggagccaagccgtgggtggaatgattggactcaagtacctttctgctcacatcactttcatgaacttgtgatgaaagatggtagagtattagtggtcccatgcagaaaccaagatgaactaatcgggcgtgctagaatttcccaaggggctggatggtctttaaaagagaccgcatgtctcggaaaatcgtatgcacaaatgtggacgttaatgtactttcacagaagagacttaagattagcagcgaacgcgatatgtagtgcagtcccctcacattgggtacctacaagtagaacaacttggagcattcatgcgaaacacgaatggatgaccacagaggatatgttggcggtttggaatcgggtctggatccaagaaaatccttggatggaggataaaacgccggtagagagttgggaagaagtcccatacctcggtaaacgtgaagaccaatggtgtgggtcactaatagggcttacttcgcgtgcaacatgggccaagaatatacaaactgcaatcaatcaagtgcggagtctaatcggtaatgaggaatatactgattacatgccatctatgaaaagatttagaaaggaagaagaagaggctggtgtcctatggtag

SEQ ID NO: 22365 - RNA, 9876 nt, synthetic construct
  misc_feature 1..9876: note = derived and/or modified CDS sequence (opt6) from DENV-2__GQ868516__SS-prME
  source 1..9876: mol_type = other RNA
actgctggagtaatagtaatgttaattccgacagttatggcatttcacttaaccactcgaaacggggaaccgcacatgattgtcggtagacaagaaaaaggcaaatctctacttttcaaaaccgaagatggcgttaacatgtgtacattaatggctatagatttaggtgaactttgtgaagatacaataacgtacaaatgtccactattaagacaaaatgaaccagaagacatcgattgttggtgtaactctacatcgacatggataacatacggcacatgttccactacaggcgagcaccggcgtgaaaaacggtccgttgctttagtgccgcatgtcggtatgggattggaaactagaaccgaaacctggatgtcctcagaaggcgcgtggaaacacgtacaaaggattgaaacctggattttgagacacccggggtttactattatggcagccatcctagcttacactataggaacaacgcattttcaacgagccttaatatttatcttgctaactgcggtagcacctagcatgacaatgcgatgtatcggaatatctaatcgcgatttcgttgaaggagtcagtggcggttcttgggtggatatagttctggaacatgggagttgtgtaaccacaatggccaaaaataaaccaacattagattttgaactgataaaaaccgaagcaaaacaaccggcaacactccgtaaatattgcatagaagcaaaactcacaaatactacaacggaaagtaggtgtccaacacaaggcgaaccatctctaaacgaagaacaagataaaagatttatatgtaaacattccatggtcgaccgcgggtggggtaacggatgtggtttattcgggaaaggagggatagtaacatgtgcaatgttcacatgtaagaaaaatatggagggtaaagtcgtgcaaccggaaaatctggaatatacaatagtcatcacaccgcattcgggagaggagcacgctgttggaaacgatacaggaaaacacgggaaagaaataaaaataactcctcagtcttctataacagaagctgaattaacagggtatggaactgttacaatggaatgttctcctcgtactggattagactttaatgaaatggtattattacaaatggaagacaaagcatggctagtgcaccgtcaatggtttctcgatctgcctttaccgtggcttccaggagcggatacacaggggtcaaattggatccaaaaggaaactttagtaacctttaaaaaccctcacgcgaagaaacaagacgttgtagtattaggtagccaagaaggagcaatgcacacagccctgacaggggccacagagattcaaatgagcagtggaaatctgctttttacgggacatttaaaatgtcgattaagaatggataagttacaactaaaaggaatgtcctatagtatgtgtacagggaaatttaaaattgtaaaagaaattgctgaaactcaacatggtacaatagtaatacgcgtgcaatatgaaggtgatggatcgccttgtaagataccattcgaaataactgatctagaaaagcgtcatgttttgggcagattgataacagtcaatcctatagttacagaaaaggactcacctgtaaacatcgaggccgaaccgccctttggggacagttacataataataggagtagagcccggccagttaaaacttaattggtttaagaaagggtcatcaataggccaaatgtttgagacaactatgcggggcgcaaagcgaatggcaatactaggagacacagcttgggacttcggatctttaggtggtgtatttacctcgataggaaaagcactacatcaagtattcggagcaatatacggggccgcattttcaggagtatcttggacaatgaaaattttaataggcgtcattataacatggattggaatgaacagcagatcgacaagtctgagcgtctctttagtgctagttggggtagttatattatacttgggggctatggtacaggctgatagcggatgtgtagttagttggaagaataaggaattaaaatgtggatcaggaatattcataaccgataatgtacacacatggacagaacaatacaagttccaaccggaatcacccagtaagttagcaagtgcgatccagaaagcacatgaggaaggcatatgtggaatcagaagtgtgacacgtctggaaaacttaatgtggaaacaaattaccccagaattaaatcatattctaagtgagaacgaagttaaactaacaataatgacaggcgacataaaaggcataatgcaagccggaaaacgtagcctaagaccacagccgacagaactaaaatattcgtggaaaacatggggtaaggcgaaaatgctaagtaccgaatcccataaccaaacatttctgattgatggtccagaaacagcagaatgtccaaacaccaaccgagcatggaatagtcttgaagtagaagactatggattcggagttttcactaccaacatctggttaaaattaagagaaaaacaagatgtattttgtgacagcaagttaatgtcagcagctatcaaagacaacagggcagttcatgcagacatgggatattggatagagtcagcactaaatgacacatggaaaatggagaaagcctcattcatagaagttaagtcatgtcattggccgaagagtcacacactatggtcaaatggtgtcctcgaaagtgaaatgattatacccaaaaatttcgctggaccggtctcacaacacaattacagacctggatatcatactcaaacagcgggaccatggcatcttgggaaattagaaatggattttgacctatgcgaaggtaccactgtcgtagtaacagaagactgcggtaatcgcggtccatcattaagaactacaacagcatcaggtaaacttattacagaatggtgttgtcgctcatgcacgttacctcccctaagatacagaggagaagacggatgttggtacggaatggagatacgacccttaaaagagaaagaggaaaatttagtcaattctttagtcacagcgggtcacggacaaatagacaatttctccttgggggtgttaggaatggcattattcctggaagaaatgctacggactcgaattggtacaaagcatgctattctgttggtagcagcatcatttgtaacattaataacgggtaatatgtcctttcgagacttaggtcgcgtaatggtaatggtcggagctacgatgactgacgatataggtatgggtgtcacatatctagcattattagcagctttcaaagtaagaccaaccttcgccgctggattactattgcgcaaattaacttcaaaggaactaatgatggccactataggcatagccttattaagtcagagtaccataccagagtctatccttgaactaacggatgcgttagcattaggaatgatggtattaaaaatagtaagaaatatggaaaaataccaactagcagtaactataatggccatatcctgtgttccaaacgctgttatattgcagaatgcgtggaaagtttcatgtacaatattagcggcagtgtctgtatcccctttgctactaacaagctcacaacaaaaagcagattggattccgttagcattgacgattaaaggattgaatccaactgcaatctttctcacaaccctatctaggacgagcaaaaagaggtcctggccactaaacgaagcagttatggcagttggaatggtgagtatactagcaagcagtctacttaaaaatgatattccaatgacaggccctctagtagccggaggtttacttaccgtatgttatgtcctaacggggagaagtgcagatttggaattagaaagggcagctgacgtaaaatgggaagatcaagcggagatttcgggttcttcccctattttaagtattacaatatcagaagatggttctatgtctatcaaaaatgaggaggaagaacaaacgttaactattcttatacgtactggccttttagtaataagtggtgtatttccggtcagtattccgattacagccgcagcttggtatttatgggaagtgaagaaacaacgagccggtgtactatgggacgtaccatcacctcctccagtagaaaaagctgaacttgaggatggtgcgtatagaataaaacaaagaggtattttgggttattcacaaataggtgctggagtatataaagaagggacttttcatacaatgtggcacgtaaccagaggtgctgtattaatgcacaggggcaaacgcatagagccatcatgggcagatgtaaagaaagatttaatatcgtatggaggcggctggaaattggaaggtgaatggaaagaaggtgaagaggtccaggtcttggcattagaaccaggcaagaatcctagagcggtacagacaaaaccaggaatttttaagaccaacactggcacaataggagcagtctcccttgatttctctcctggaacaagcggatcgccaatagtagatcgcaaaggtaaagtggtggggttatatgggaacggagtagtaacaagaagcggagcatacgtgtcagctattgcccaaacagagaaaagcatcgaagacaatccagagatagaggacgatattttccggaagaaacgcctaacgattatggatttacatccaggagccgggaaaactaaaagatacctacctgcaattgttagagaagcaattaaaagaggtctgagaaccctaattctggcaccgacccgcgtggtagccgcagaaatggaagaggcacttagagggttaccaatacgctatcaaactcccgctattaaaaccgaacatacagggagagaaatcgtcgatctcatgtgtcatgcgactttcacgatgagactccttagtccagtccgtgttccaaactataatttaattataatggatgaagcacattttaccgacccagcgagcatagctgctcgaggctatatcagcaccagagtagaaatgggagaagcagctggcatttttatgacagcgactccaccaggcagtagagatccattcccgcaaagtaatgctccaataatggatgaagaaagggaaattccggaacgctcatggaactccggccatgagtgggtaaccgactttaaaggcaaaaccgtttggtttgtcccttcaataaaagcagggaacgacatagcagcttgtttgaggaagaacggaaagaaagtaatacaactatcaagaaaaacatttgattctgagtatgtgaaaacgcgagcaaacgattgggattttgtggttacgaccgatatatcagaaatgggagctaactttaaggcagaaagggtcatagaccctcgtcgatgtatgaaaccagtaattttaaccgacggagaagaaagagtgatactagcgggtccgatgcctgtaacacacagcagcgcggcacaaagacgaggtagaatagggaggaatccgaaaaatgagaacgatcagtacatttatatgggagaaccattagaaaatgatgaagattgcgcccattggaaagaggccaagatgctgcttgataatataaatactcctgaaggcatcattccttcaatgtttgaacctgaacgagagaaggttgacgctattgatggggaataccggctacggggtgaagcgcgtaaaacatttgttgatttaatgagacgtggggatctacccgtctggttggcgtataaagtagctgccgagggcatcaactacgcagatcgtaaatggtgctttgatggtattaaaaataatcaaatactagaggaaaatatggaagtcgagatatggacaaaagaaggagaaaggaagaaattaaagccccgatggttagatgcgaggatctatagcgaccccctagccttaaaagagtttaaggaatttgcagcaggaagaaagtccctaacattgaatttgattactgaaatgggccggcttccaaccttcatgactcagaaagctcgcaacgcattagataacttagcagtcttgcacactgcggaggccggcgggagagcttacaatcatgctctcagcgaactacctgaaacgctcgaaacgctcttattattaacactgttggccacggtgacaggcggaattttcttattcctgatgtccggaaaagggattggtaaaatgacacttggcatgtgctgcataattacagcttccatactattatggtatgcacaaatacaaccacactggattgcagcaagtatcatactcgaatttttcttaatcgttttgttaataccagaaccagaaaaacaacgaacacctcaagataatcaattaacctatgtcgtaatcgccatacttacagtagtagctgcgacaatggccaacgaaatgggcttccttgagaaaactaagaaagatctcggtctcggatcaatcacaacgcaagaatcagaatctaacatcttagatatcgacctacggcctgctagtgcatggactctatatgcggtcgcgacaacatttgtgaccccaatgttaagacatagtattgaaaattcgagcgtgaatgtctcgcttacggcaattgcaaatcaagcgactgtactgatggggctggggaaagggtggccactatcaaaaatggatataggcgtacctttactagccataggatgttactcacaggtcaatccaattaccttaactgccgcgttgcttttattagtggctcattacgctataattggtccaggattacaagcgaaggcgacccgtgaagctcagaaaagggctgcagcaggaatcatgaaaaaccctactgtcgacggcataacggtgatagacctcgaaccaataccctatgatccaaaattcgagaaacaattgggtcaggttatgttattaatcctgtgcgttacgcaagtattgatgatgagaacaacatgggccctctgcgaggcgttaactttagccacaggaccaatttctactttatgggaaggtaaccccggaaggttttggaataccaccatagcagtttccatggcaaacatattcagaggtagctatctagcgggagccggtttattgtttagtataatgaaaaacaccacgaatacccgacgtggtactggaaatataggagagaccctaggtgaaaagtggaaaagcagattaaatgccctcggaaagtcagaatttcaaatctataaaaagtctggaatacaagaagtcgataggacattagcaaaagaaggaattaaaaggggagagacagatcatcatgcagtcagcagaggaagcgctaaactgagatggttcgtagaacgtaatatggttacaccagaaggaaaagtggtagaccttggatgtggcaggggtggatggtcttactattgcggcggactaaaagacgtaagggaagtcaaaggactgacaaaaggaggccctggacatgaagaaccaattccaatgtcaacatatggttggaacctggttcgattgcaatcagggattgatgtattctttactccacctgaaaaatgtgacaccctattatgtgatataggtgaaagtagtccgaaccctacaattgaggcaggtcggacactgagagtacttaatttagtggaaaactggctaaataacaacacgcaattctgtatcaaagtacttaacccatatatgcccagcgtaatcgagaaaatggagactcttcagagaaaatacggaggggcgcttgtgcgtaatccgttatcaagaaattcaacacatgaaatgtattgggtctcaaatgctaccggtaacattgtcagtagtgtaaacatgatatcgagaatgttgattaatcggtttaccatgaagcacaaaaaggccacgtatgaaccggatgtagatctaggaagtgggacacgaaatatagggatcgaaagcgagattccaaatttggatattatcggcaaaagaatcgagaagatcaaacaagaacacgaaaccagctggcactatgaccaagaccatccatacaaaacgtgggcgtatcatggtagctatgaaacgaaacaaacaggctctgcaagcagcatggtaaacggagtagttagactgttaactaaaccctgggatgtggtacccatggtaactcaaatggctatgactgacactacaccatttggccagcagagggtattcaaggaaaaggtagatacaagaacacaagaaccaaaagaaggaacgaagaaattaatgaaaataacagcagagtggctctggaaagagcttggtaagaagaaaacacccaggatgtgcactagagaagaatttactcgaaaggtccggtcaaacgctgcactaggcgcgatatttaccgatgagaacaagtggaaatccgcacgagaagcagtagaagatggccgattttgggagctcgtagaccgagaaagaaatttgcatttagagggaaaatgtgaaacatgcgtatataatatgatgggaaaacgtgagaagaaactgggcgagttcgggaaagcaaaaggatctagagctatatggtatatgtggctaggcgcaagatttttagaatttgaagcgttaggttttctaaatgaagatcattggttcagtcgtggaaactcgctgtccggtgtggagggtgaggggctccatcgattaggatatattctaagagatgttggcaagaaagaaggcggggctatgtacgcagacgatactgccggttgggatacaaggatcacacttgaagatttaaagaatgaggaaatggtgacgaatcacatgaaaggcgaacataaaaagctagcagaggccatttttaaattgacttaccaaaataaagtagtgcgtgtgcagcgaccgacacctcgaggtacagttatggacataatatcaagacgtgatcaacgtggatcagggcaagtaggaacttatggacttaatacctttacaaacatggaagcacagctaatccgccaaatggaaggcgagggtatattcaaaaacatacaacatctcactgctacagaagagatagctgtgcaaaattggttagcgcgagtaggacgggaaagactgagtagaatggcgatctccggcgacgactgtgtagtaaaacccatagatgatagatttgcctcagcattgacagccttaaacgacatgggtaaagtaagaaaggatatacaacagtgggaacctagtaggggttggaacgattggacgcaagtacccttttgttctcaccattttcatgaacttgtcatgaaagatggtagagtattagtggttccgtgtcgtaaccaggatgaacttattggtagagctaggatatcgcagggtgcgggatggagcctaaaagaaacagcgtgtctgggaaaaagctatgcacaaatgtggactctaatgtactttcatagacgtgatcttcgacttgccgcaaacgcaatatgctcagcagtaccaagtcactgggttcccaccagtaggactacttggtctatccacgccaagcacgaatggatgacaacggaagacatgctagcagtttggaaccgggtctggatacaagaaaatccttggatggaagacaaaactccagtggaatcatgggaagaagtgccctatttaggcaaacgtgaagatcaatggtgcggatcactaataggtcttacatcccgtgcaacatgggccaaaaacatacagacagccataaatcaagtccgttctttaattgggaatgaagagtacacagactacatgcctagtatgaaaagatttaggaaagaagaggaagaagcaggcgtactatggtaa

SEQ ID NO: 22366 - RNA, 9876 nt, synthetic construct
  misc_feature 1..9876: note = derived and/or modified CDS sequence (opt6) from DENV-2__GU131975__SS-prME
  source 1..9876: mol_type = other RNA
acagcaggggtgatagtaatgttgattccgactgtaatggctttccatctcaccactcgaaacggggaaccacatatgattgttggacgccaagaaaaagggaaatctttgttattcaaaacagaagatggtgtaaacatgtgcacacttatggcaattgacttaggtgaactgtgtgaagatacgataacttataaatgcccactgcttcggcagaatgaaccagaagacatagattgttggtgcaattcgaccagtacttggataacatacgggacatgctctacaacgggagaacacagaagggagaaaagatcagtagccttagtaccacatgtgggtatgggtctagaaacaagaacggaaacatggatgtcctctgaaggtgcatggaaacacgtacaaagaatagaaacttggatactaaggcatccaggatttacaattatggctgcaatcttggcatacacgatagggaccacacattttcagagggcattgatttttattttactcactgcagtggcgcccagtatgactatgagatgcataggaatttccaaccgagacttcgtagaaggtgttagtggaggttcatgggtagatattgtactggaacacgggagttgtgtcaccacaatggccaaaaataaacctacactcgactttgaattgataaaaactgaagctaaacaaccagcaacactcagaaaatattgtatagaagcaaaattgactaatactacaaccgaatccagatgtcctacccaaggagaaccaagccttaatgaagaacaagataaaaggttcatttgtaaacactcaatggttgatagaggatggggaaatggatgtggactttttggtaaaggaggaatcgttacttgcgcgatgttcacttgtaagaaaaatatggaggggaaagttgttcaacctgagaacctagaatacacaattgtgattacgcctcatagcggagaagaacacgccgtaggtaatgatacaggcaaacatggaaaagaaatcaagatcacacctcagtcttcaattacggaggctgaactaacggggtacggaactgtaaccatggaatgttcacctcgcacgggtttagactttaatgaaatggtattactacaaatggaagacaaagcgtggcttgttcatcgacaatggtttctcgatttaccattgccctggctaccaggagccgacactcaaggcagtaattggatacaaaaagaaacgttagtcacgtttaagaatcctcacgcgaagaaacaggatgtggtggtactaggatcacaggaaggagcaatgcacacagcgttaactggagcaacggagattcagatgtcttcgggaaaccttcttttcaccggacatctgaaatgcagactcagaatggataaactgcagcttaagggtatgtcgtactcaatgtgtactggtaaattcaagatcgtaaaagaaatagctgagactcaacatggaactattgtgatccgcgtacaatatgaaggcgatggatccccgtgcaaaataccctttgaaattacggaccttgagaaaagacatgtcctcggaagattaatcactgtcaatccaattgtaactgagaaagattctccagtcaacatagaagcggaaccaccattcggtgacagttatataataatcggcgtagaaccaggtcagcttaaattaaattggtttaagaaaggatcatctatcggccaaatgttcgaaacgacaatgcgaggagctaagagaatggcaatactgggagacacagcttgggacttcgggtccctaggaggggtttttaccagtataggtaaggcactccatcaagtatttggagcgatttatggagcggcattttcaggagtttcttggacaatgaaaatccttataggagtaataatcacctggattggtatgaactcaagatcgactagcttgtccgtatcattagttttggtgggggtagttatactatatctaggagccatggttcaagcagatagtggttgcgtagtatcatggaaaaataaggaacttaaatgcggatctggcatctttattacggataacgttcatacctggacagaacaatacaaatttcaacctgaaagcccatccaagctggcatcagctattcaaaaagcccatgaagaggggatttgtggtatcagatcggtaacaagattggaaaacttaatgtggaaacaaattacaccagagcttaaccacattttgtcggagaatgaagtaaaattaactataatgacaggagatataaaaggaataatgcaagctgggaaaagatcacttcgaccacaacccaccgaactaaaatactcgtggaaaacatgggggaaagccaagatgctttcaactgagtcacacaatcagacttttctaattgatggtccggaaacagctgaatgtcctaacacaaatagagcgtggaactcgttagaagttgaagattacggatttggtgtatttacaacaaatatttggctgaaattgcgcgagaagcaagatgtcttttgtgacagcaaattgatgtcagcagctatcaaagataatagagctgtacatgctgatatgggatattggatagagagcgcattaaacgacacctggaagatggaaaaggcttcgtttatagaagtaaaatcatgtcactggcctaaatcacacaccctttggagtaacggagtactagaatcggagatgatcatacccaaaaactttgcaggccccgtgagtcaacataattatcgaccagggtaccatacacagacagctggaccttggcatctaggaaagctcgagatggacttcgacttgtgcgagggcacgaccgttgtcgtcaccgaagattgtgggaatagaggaccttctttaagaacgacaacggccagtggaaaacttataacagaatggtgttgtagatcttgtacacttccacctcttagatacaggggagaggatgggtgttggtatggaatggaaatccgcccattaaaagaaaaagaagaaaacttagttaactctctagtaacggcaggacatggacagatagataattttagtctcggcgtactaggcatggctttatttcttgaagaaatgttacggacaaggataggtacaaagcatgcaattttgctagtggcagcgtctttcgttacactcattaccgggaatatgagtttcagagatttaggcagagtgatggtcatggttggcgcaactatgaccgacgatataggaatgggagttacctacttagcattgctggccgcatttaaagttcgaccaacatttgcagcagggctattactaagaaaactaacttccaaggaattaatgatggcaactataggaatagcgctactgagccaaagtactattccggaatctatcctagaactaacagatgcactagccctcgggatgatggttttgaaaatcgtcagaaacatggaaaaataccaactggcagttacaataatggcaataagttgcgtaccaaatgcggtgatcctacaaaatgcctggaaagttagctgcacaattttagctgcggtttctgtaagcccactattattaacgagcagtcaacaaaaggctgattggatcccattagcgttgacgattaaaggactgaatcctactgctatttttcttacaacgttatcaagaacgagcaagaaacgttcctggcccctaaatgaggcagtaatggcagtcggtatggtaagtattttagcaagcagcctgctaaagaacgatataccaatgacaggtccgttagtggctggtggactcctaacagtttgttacgttctaacaggtcgaagtgctgacttagaactagaacgagccgcagacgttaaatgggaggatcaagcagaaatatccgggtcttctccaattttatctatcactataagcgaggacggcagcatgtcaatcaaaaatgaggaagaggaacagacattaacaatattgattcggaccggactacttgttatctctggggtttttccggtttcgataccaatcacagcggccgcgtggtacctttgggaagtcaagaaacagagggccggtgtcctatgggatgtaccctcgcccccaccagtggaaaaagcagagctggaagacggcgcatatcggattaaacaacgaggtatactaggatatagccagatcggggcgggggtctacaaagagggtacgtttcatactatgtggcatgttaccaggggagccgtattaatgcatcggggcaaaagaattgaaccatcttgggcagacgtgaagaaagacctgatatcatacggaggtggatggaaacttgaaggcgagtggaaagaaggggaagaggtacaagttcttgccttagaaccagggaaaaatccacgcgcggtacaaactaaaccaggaatattcaaaaccaacacaggcacaatcggggctgtaagccttgacttttcgcccggaacgtctggaagtcctatagtagatcggaaaggtaaagttgtaggtttatatggaaatggtgttgttaccagatctggagcctacgtatcggcaatcgcacaaacggaaaaatctatcgaagacaatccggagatcgaggacgatatattcagaaagaaaagactcacgataatggacctacaccccggagccggtaaaacaaaacgttatttacccgctatagtacgcgaagcaataaagaggggattacgaactcttatactggcacctacaagagttgtcgctgcagaaatggaagaagcgctgagaggattaccaatccgttatcaaactcctgctattaaaacggaacatactggacgcgaaatagtcgatctaatgtgccatgcaacctttacaatgcggttattaagccccgttagagtgccgaactataacctaatcatcatggatgaagcacatttcaccgatccagcatcgattgctgcacgtggatatataagtacacgtgtcgaaatgggagaagcagcaggaattttcatgacggctacacctccgggatccagggatccctttcctcaatccaatgcacctataatggatgaagaacgggaaatcccagaacgatcttggaactccggccacgagtgggtcactgatttcaaaggtaaaacagtctggttcgtcccgtctattaaagcaggaaatgatattgcagcttgtctaaggaaaaatggcaagaaagttatacaattatcaaggaaaactttcgacagtgagtatgtaaaaactagagctaatgattgggattttgtagtaactactgatatatcagaaatgggagctaattttaaagcggaaagagtcattgaccctcgacgatgtatgaaacccgtcatactcacggatggtgaggaaagagtgatattagcaggtccaatgccggtgactcacagctctgctgctcaacgcagaggtagaatagggaggaatcctaaaaatgaaaatgaccaatacatctacatgggtgaacctctagaaaatgatgaagattgcgcgcattggaaagaagccaaaatgctcttggataacataaatacaccagaaggaataataccgtcaatgtttgagccagaaagggaaaaagtggatgcaatcgatggtgaatatcgacttagaggcgaagcgcggaaaaccttcgttgacctaatgcgtcgtggtgacctcccagtttggttggcgtataaggtagccgctgagggcataaattacgcagataggaaatggtgctttgacggaatcaaaaacaatcagattctagaggagaacatggaggtggaaatatggactaaagaaggtgagaggaagaaactaaagcctcgttggttagacgcgcgtatatactcggatccattagccttaaaagaatttaaggagtttgcggctggtcgcaagagcttaacattaaacctaattacagaaatgggaagactgccaacatttatgacacaaaaagcacgaaatgccttagacaacttagcagtactacatactgcagaagctggcggtcgagcatataaccacgctctcagtgagctaccagaaacgttggagactcttttgttactaacgctattagctacagttacgggcggcatatttttgttccttatgagtggcaaagggatcggaaaaatgacattaggaatgtgttgcataattactgcgtccatactgctctggtacgcccaaatacaaccacactggatagcagcatctattatactcgagttctttttaatagtactgttaattccagaaccggaaaaacaaaggacaccacaagacaaccaactaacatacgtggttatagccatacttacagttgttgcagcgaccatggcaaacgagatggggtttttagagaaaacaaagaaagaccttgggctagggtctatcacaactcaagaatctgaaagtaatatactagatatcgacttgcgtccagcaagtgcatggaccctatacgctgtggccactacgtttgtcacaccgatgttaagacatagtattgaaaattcttcagtaaacgtttcgttaacagcgatagcaaaccaagcaacagttctaatgggactaggtaaaggatggcctctatctaagatggacataggtgtcccattattagccatcggctgttactctcaagttaaccccattacattaaccgccgcattgttattacttgtcgcacattacgcgatcattggtcctggtcttcaagcaaaagcaacaagagaagcgcaaaagagagctgcggccggcatcatgaaaaacccaaccgtagacggtattactgtaatagacctagagcctatcccctatgacccgaaatttgaaaaacaactcggtcaagtcatgcttcttattttatgtgtgacacaagtactgatgatgcgtaccacatgggcgctgtgtgaagcattgacactcgcaacaggcccaataagcactctgtgggaaggtaatccggggcgattctggaataccacgattgccgtttctatggcaaacatatttagaggcagttatttagccggggccggtctacttttctccataatgaaaaacactacaaatactaggagaggaacaggaaatataggagaaacattaggcgaaaaatggaaatcgagacttaacgcattgggtaaatccgagtttcaaatatataagaaatctggaatacaagaagtagaccgaacactggctaaagaagggataaagaggggagagaccgaccatcatgcagtctctaggggatctgcaaagttaagatggttcgttgagagaaatatggtgacgcctgaaggtaaggtggtagacctaggttgtggaagaggcggatggtcttattattgtggcgggcttaaagatgttcgtgaagtgaaaggactaacgaaaggtggtccagggcatgaggaacctattccaatgagtacatatggatggaatttagtacgactacaatcgggcattgatgtgtttttcactccgccggaaaaatgcgatactctcttgtgtgatataggagaatcaagcccaaatcctacaattgaagctggacgcacactaagggttttaaatctcgtagaaaactggttaaataataatactcaattttgtattaaggtacttaacccatacatgccaagcgtgatcgaaaagatggaaacgctacaacgaaagtatggaggagcattagttcgaaatcctcttagccgcaactccacacatgaaatgtattgggtaagcaatgcaacaggtaatattgtgtcatcagtaaacatgataagcagaatgttaattaaccgtttcaccatgaagcacaaaaaggcgacctatgaacctgacgtagatttaggaagtggtacccgtaacataggtatagaatcagaaataccgaatctagacataattggcaaacgcattgaaaagataaagcaagaacacgaaacaagttggcattatgaccaagatcatccttacaaaacctgggcatatcatgggtcatatgaaacgaagcagacgggatccgcttcatccatggtcaacggggtcgttcgactacttaccaaaccatgggatgtagtccccatggtcacacaaatggcaatgacagatactaccccatttggtcagcagagagtttttaaggagaaggttgacacaagaactcaggaaccaaaggaagggactaaaaagctaatgaaaataacagcggagtggctctggaaagagctaggcaagaagaaaacgccacggatgtgtaccagagaagaatttacccgaaaggtcagaagtaacgcagcactcggagccatttttactgatgaaaacaaatggaaaagtgcaagagaggcagtggaagatggtagattttgggaattggtagatagggaaagatcccttcacctagaaggtaaatgtgaaacttgtgtgtacaatatgatggggaaaagagaaaagaaactgggagaatttggcaaagcaaaaggatctagggcaatatggtatatgtggttaggggccagattcttggagttcgaagcattaggattcttaaacgaagatcactggttttccagggggaatagcctatccggagttgagggggaaggactccacagattaggttacatattaagggatgtaggcaagaaagaaggaggcgctatgtacgcggacgatacagccggttgggatacaagaatcactttggaggatttaaagaacgaagaaatggtcactaaccacatgaaaggtgaacacaagaaactagcagaagcaatatttaaactcacttatcagaataaagttgtgagagtgcaacggccaaccccaaggggaactgtcatggatattatttccagaagggatcaacgaggtagtggacaagttggaacttatggactaaatacattcaccaatatggaggcacaattaatcagacaaatggagggagaaggtatattcaagaacatacagcatctaactgcaacagaggaaatcgcggtgcaaaactggctagcaagagtaggcagggagaggctttcgcgaatggccatctccggtgatgactgcgtagttaaacctattgacgacaggtttgcgagcgcccttacagccctaaatgatatgggaaaagtaaggaaagacatacaacagtgggagccaagcagaggatggaacgattggactcaagtgccattttgttcgcatcactttcacgaactcgtgatgaaagacggccgagtacttgtggtcccatgtagaaatcaagatgagttaatcggtagggctcgaatatctcaaggtgcaggatggtcactaaaagagaccgcctgcttgggcaagtcatatgcccaaatgtggaccttgatgtattttcatcgacgagatttaagactggcagcgaacgctatatgttcagctgtaccttcacactgggtaccgacaagcagaaccacatggtcaatacatgcaaaacacgagtggatgacgactgaggacatgctggccgtgtggaatcgtgtctggattcaggagaatccgtggatggaagacaaaacaccggtcgaatcatgggaagaagtaccctacttgggaaagcgagaggatcagtggtgcggttcacttattggacttacgagtagagctacttgggccaaaaacatacaaaccgctattaatcaagtaaggagtttgattgggaacgaagagtatactgattatatgcccagcatgaaacgattcagaaaagaagaagaagaagctggagtattgtggtag

SEQ ID NO: 22367 - RNA, 9876 nt, synthetic construct
  misc_feature 1..9876: note = derived and/or modified CDS sequence (opt6) from DENV-2__JN819422__SS-prME
  source 1..9876: mol_type = other RNA
acggctggagtcatagtcatgcttatacctactgcaatggcattccaccttactacacgtaatggggaaccacatatgatagttgggagacaggaaaaaggaaaatcattactatttaaaacagaagacggggtcaacatgtgcactttaatggcgattgacttaggagaactttgtgaagacaccataacctataaatgtccccttttaagacaaaatgaacctgaagatatagactgttggtgtaattctacatctacgtgggtaacttatggaacatgcacaacaactggagaacatcggagagaaaaacgcagcgtggcattagtcccccacgtagggatgggactagaaactaggacggaaacatggatgtcaagtgaaggagcttggaaacacgttcaacgtattgaaacatggattttacgccaccccgggtttaccatcatggcggcaatactagcatataccataggtacaacacatttccaaaaagcactaatattcatattgttaacagcagttgcaccatccatgacgatgagatgcataggcatatcaaatcgcgatttcgtagaaggagtaagcggtggatcatgggttgatatagtattagaacacggaagttgtgttacaacaatggccaaaaacaaaccaacattagacttcgaactgattaaaaccgaagccaaacagccagcaactctacgaaaatactgtattgaagccaaactcactaacacaactaccgaatcacggtgcccgactcaaggagaaccgtcattgaatgaagaacaagataaaagatttatttgtaaacactctatggtagatagagggtggggtaacggttgcggactttttggtaaaggaggtatagtgacatgtgcaatgtttacatgcaagaaaaatatggaaggaaaagttgtgcagccggaaaatctcgaatatacaatagtaataacacctcatagtggtgaagaacatgccgtcggcaatgacacagggaaacacggaaaagagataaaaataacaccgcaaagtagcataacagaagcagagctcactggatatggaacagtaactatggaatgttcgcctagaaccggattagacttcaacgaaatggtgttactacaaatggaagataaagcgtggttagtacataggcagtggttccttgatctcccgttaccctggctaccgggggcagatactcaaggtagtaattggatccagaaagaaacattagtcacattcaaaaatccacatgcaaagaaacaagatgtcgtagtattgggatctcaggagggcgccatgcataccgctctaacaggggcaactgagatccaaatgagttcaggaaatttgttatttactggtcacttaaaatgcagattaaggatggataaactacaactaaaaggcatgagttactcaatgtgcacaggaaaattcaaaatagtaaaagagatagcagaaacacagcatggtactatagtcattcgtgttcaatacgaaggtgatgggtcaccctgcaaaattccatttgagatcacagacctcgagaaaagacacgtattaggacgcctgattactgttaatccgattgttaccgagaaagattcgccagtaaatattgaggccgagcccccgttcggggactcttacattattataggggtagaacctggtcaattgaagttaaactggttcaagaaaggttcatcgattgggcaaatgttcgaaacaacgatgagaggtgcaaaaaggatggcgatactaggcgacacagcgtgggacttcgggagcctgggaggcgtcttcactagcatagggaaagcattgcaccaagtcttcggcgcaatctacggcgcagccttcagcggagtatcctggacaatgaagattttaattggagtgattataacatggattgggatgaactcccgatcgacatcattatctgttagtttggtcttagttggtgtagttaccctatatttaggtgcaatggtacaagcggactccggctgtgtagtgagttggaaaaataaagagttaaaatgcggctccggtatatttataacagataatgtacacacttggacagaacaatataaatttcagccagagtcgcccagtaagttagcttcagctattcagaaagctcatgaagaaggtatctgcgggataagaagcgttacgaggttagaaaatttgatgtggaaacagataactcctgaactaaaccatatactcagtgaaaacgaagtaaagttaactataatgacaggagatataaaagggataatgcaggcaggaaaaagatctctcagaccacaacccaccgaattaaagtattcatggaagacatgggggaaagctaagatgttaagcacagaatcacacaaccaaacattcttaattgatggcccagaaaccgcggaatgtccgaatactaatagggcctggaactcccttgaagttgaagattacggcttcggtgtatttactacgaatatatggttaaaactaagagaaaaacaagatgtgttttgtgattcaaaactaatgagtgcagcaataaaagacaacagagcggtacacgctgacatgggctattggatagaaagcgcactcaatgacacatggaaaatggaaaaagccagttttatcgaagtcaaatcctgtcactggccaaaatcacacacattatggagtaacggtgtactggaatctgaaatgatcatacccaaaaatttcgcaggaccagttagccaacataactatagacccggatatcatacacaaactgcaggaccatggcaccttggtaaattagaaatggattttgacttatgcgaaggtacgacagtagtcgttactgaagattgtggaaatcgaggtccctcgcttcgtacgacaaccgcatcaggcaaactcattacggaatggtgttgtcgatcttgtacgttgccacccttacgctaccgaggcgaagacggctgctggtacggtatggaaattcgaccattaaaagagaaagaagaaaacttagtgaatagtttagtgactgcaggacacggacaaatcgacaatttctcattgggagtgctaggaatggctctatttttagaagaaatgctgaggacaagaataggaacaaagcacgctattctcctggtagctgtgagtttcgtcactctaataactggaaacatgtcctttagagacctcggaagagtcatggtaatggtaggggctacgatgactgacgacatcggaatgggcgtaacatatcttgccctattagcggcatttaaggtccgaccaacgtttgctgcgggactcttattacgcaaacttacatcaaaagaactaatgatggcaaccattggaatagcactattatcccaaagtacaattccagaaaccatactagaattaaccgatgcgttagctttaggaatgatggtgttaaaaattgtaaggaatatggaaaaataccaacttgcagtgacaataatggctattagttgtgtaccgaacgcagtaatactgcaaaatgcctggaaagtcagttgcaccatcctcgcagcagtctcagtgtcacccttgctgctcacaagtagtcagcaaaaggccgattggatcccgcttgcactgaccatcaagggactcaatcccactgctatttttcttacaacactttcgcgaaccagcaagaaacgtagttggccgctaaatgaagctattatggcggttggaatggtttctatacttgcgtcgagtctactaaagaatgatattccaatgactggtcccctggttgctggtggcttgttaactgtttgttatgttttaaccggcagatccgcagacctagaactcgagcgagcagctgacgtcaaatgggaagatcaagcagagatcagtgggtcttcacccatcctgtccattacaatttcggaggatggaagtatgtctatcaaaaatgaagaggaagaacagactcttaccatactaatacggactggcttattagtgatatccggggtatttccagtcagcatcccaataactgcagcggcatggtacttgtgggaagtgaagaaacagagagccggagtcttatgggacgtacccagtccacccccagtggaaaaagcagaacttgaagacggagcatatcgtatcaaacagagaggcatcttgggttatagccaaattggagctggggtttataaagaaggaacgtttcatacaatgtggcatgtcacaaggggagcagtactaatgcaccgaggtaagagaatcgaaccatcttgggcagatgttaaaaaggacttaatttcgtacggtggtgggtggaagttagagggagagtggaaggaaggggaagaggtacaagtactagcattagaaccaggcaaaaatccacgagctgtccagacaaaacctggaatctttaagacaaatacaggaacgatcggggctgtgtctctcgacttctcgccaggaacaagtggttcccctatagtcgacagaaaggggaaagtcgttggtctatacggtaatggagtcgtaactcgaagtggagcatacgtatcggcaatagcgcagacggaaaaatcaatagaagacaatccggaaattgaggacgacatatttaggaagaaacgactgactataatggatcttcaccctggcgcaggtaaaacaaaaaggtacctgccagcaatcgtcagagaggcaataaaaagaggacttaggacactgatccttgctccaacaagggttgttgcggcagagatggaagaagctctgcgaggtctaccaatacgatatcaaacgccagccattaaaacccaacatacaggtagagaaattgttgatctaatgtgccacgcaacgttcacaatgagattattatccccagtgcgagtccctaactataacttgattatcatggacgaagcacactttaccgacccagcatcaattgctgcgcgggggtacatttcaacgagggtagaaatgggagaagctgcaggaatctttatgactgccacccctccagggtctcgcgacccgtttcctcagtctaatgctccaattatggatgaggaacgagagatccccgaacgctcatggaactctggccatgagtgggttacggattttaaaggaaaaaccgtatggttcgtgcccagtataaaagcaggaaacgacattgcggcctgtttgaggaaaaacgggaagaaagtgatacagctgagtagaaaaacatttgactcggaatatgtcaaaacaagagcaaacgattgggactttgtggtgaccactgacattagcgaaatgggagcaaactttaaagcagagcgcgtcatcgatcccaggcggtgtatgaaacctgtaatcttaactgatggagaagaacgtgtaatacttgcgggaccaatgccagttacacatagcagtgccgctcaacggcgtggccgtataggaagaaaccccaaaaatgaaaatgaccaatatatatatatgggagaaccattagaaaacgacgaagactgcgcccattggaaagaagctaaaatgttattagataacattaacactccggagggaataattccctcaatgtttgaaccggaaagagaaaaggtggatgcaattgacggagaatatagactgagaggggaagccagaaaaacctttgtagatttaatgagacgtggcgatctgcctgtatggctggcatacaaagtagcagcagagggaatcaattacgctgatagaaaatggtgtttcgacggaattaaaaataatcagatacttgaagaaaatatagaagttgagatttggaccaaagaaggtgaaagaaagaaacttaaacccaggtggttagacgcccgtatatattccgatccactagcgttaaaagagttcaaagagttcgcagctggtcgtaaaagcctgacgctaaatctcataacagaaatggggagacttccaacctttatgacacaaaaagctagaaacgcattagacaatctggccgtattacatactgcggaagcaggcgggagagcttacaatcacgcactatctgagctacctgaaacacttgaaacattgttgctactcactttactagccaccgtaacagggggaatatttctatttttgatgtcagggaaaggagtaggaaaaatgacattgggtatgtgttgtattataactgcgagtatactattatggtatgcccaaatacagccgcattggatagcagcatctatcattctggagttctttttaatcgtcctattaatacccgagccagaaaaacaacgaactccacaagataatcaactaacatacgtagtaattgcaatactcaccgttgtagcggcgacaatggctaatgaaatgggatttctagagaaaactaagaaagatttgggacttggatccatcacaacccaagaatctgagtcaaatatactcgatatagatctaagaccagcttctgcgtggacattgtatgcagtagcaacaacatttgtaacgccaatgcttagacattcaatagaaaactcatcggtaaatgtctcgttaaccgcaattgcaaatcaagcaacggttttgatggggttgggtaaaggttggccactttctaaaatggatattggagtcccgttattagctatcggctgttattcacaggtcaaccccataacgctcacagcagcattgcttctgttagtcgcacattatgccataataggaccgggactacaagccaaagcgacaagggaagcccaaaaacgggctgcagctggcataatgaagaatcccaccgtagacggaataacggtgatcgacttggaacctattccttatgaccctaaatttgaaaagcaactaggacaggtaatgttgctaattctctgtgtaacccaagttctaatgatgaggacaacatgggcattatgtgaggctttaacgttagcaacaggtccaatctcgaccttatgggaagggaaccccggacgtttttggaatacaacaatagcggtgtccatggcgaatatctttcgcggatcctatttagcaggagctggattactcttttctattatgaaaaatacaactaatacacgtagaggtacgggtaacataggagagacgttgggggaaaaatggaaatctagactaaacgcattagggaaaagcgagttccaagtgtataagaaatccggaatacaagaagttgaccggacattagcaaaagaaggcataaaaagaggagaaacagaccatcatgccgtatctagaggatccgcaaaacttcggtggtttgtcgaacgaaacatggtaacgccagagggaaaggtagtagatcttggctgcgggcgaggcggttggagttattactgcggcgggctaaagaacgtaagggaagttaaaggtttaacaaaagggggacctggtcatgaagaaccgatacccatgagtacgtatgggtggaacctagtgcgcctacaatcaggtgtggatgtatttttcactccaccggaaaaatgtgatactctactttgtgacattggtgaatcaagcccaaacccgacaatcgaggccggaagaacactaagagtgctaaaccttgttgaaaactggttaaataacaatactcaattctgcattaaggtattgaacccttacatgcctagtgttattgagaaaatggaagcattacaaagaaagtacggtggtgcattagttagaaatcccctgagtcgaaattctacacatgaaatgtactgggtctcaaacgcgactggaaatattgtcagttctgtcaatatgatcagtcgaatgctgattaaccgcttcacaatgaaacataagaaagctacatatgaacccgatgttgatttgggcagtggaacacgtaacataggcatcgagtcagagatacccaatctcgacattattggaaaaagaatcgaaaagattaaacaggagcatgagacatcctggcattatgatcaagatcacccatataagacttgggcctaccacggttcgtacgagacgaaacaaacaggatcagcatctagcatggtcaatggagttgttagattattaacaaaaccttgggacgttgtaccaatggtgactcaaatggccatgacagacaccacacctttcggtcaacagagggtattcaaagaaaaagttgacacaaggacacaagagccaaaagaaggtactaaaaagctgatgaaaataactgctgagtggctatggaaagaactaggtaaaaagaaaacaccacggatgtgcactcgagaagaatttaccagaaaagttagatccaacgcagccttaggagccatattcacagacgaaaacaagtggaaatcagcgagagaagcagtggaagatggcagattctgggaattagtagatagagaaagaaacctccacctagagggaaagtgcgaaacgtgtgtatacaatatgatgggaaagcgagagaagaaattgggagaatttggaaaagctaaaggaagtagagcaatatggtacatgtggttaggagcaaggttcctcgaatttgaggctttaggatttttaaacgaagatcattggtttagccgggggaactctctctcaggtgtagaaggtgaaggtctgcatcggttaggatacatccttagggacgttggcaagaaagagggcggtgcaatgtacgcagacgatacagcaggatgggatacacgaattacattagaagatctcaaaaacgaagaaatggtaacaaaccatatgaagggtgaacataagaaattagctgaagctatctttaaactaacatatcagaacaaggttgtcagagttcaacggccaacgccacgcggtacagtaatggatataatctcaagacgcgatcaaagagggtcaggacaagtaggcacttatgggcttaatacctttacgaacatggaggcacagttaatacgtcaaatggaaggtgaaggaattttcaaaagcattcaacatttaaccgctacggaagagattgcggtacaaaactggctagcgagagtaggccgtgaaagactatcccgaatggctataagcggggatgactgcgtggtaaaacctatagatgaccgatttgccagcgccttgacggccctgaatgatatgggcaaagtacgaaaagacatccagcaatgggaaccatcacgtggatggaatgattggacccaagtgcctttctgcagccatcacttccacgagctagtaatgaaagacggacgagttctagtggttccatgtagaaatcaggatgaactaattggccgcgctcgaatttcccaaggcgcaggttggagtttaaaagaaactgcctgcttgggtaaatcgtacgcccaaatgtggaccctaatgtactttcaccggagagacttgcgattggctgcgaatgcaatatgttccgctgtaccaccacattgggttccaacatcacgtacaacgtggtcgatacatgcaaaacatgaatggatgactacagaagacatgttagctgtctggaaccgagtatggatacaagagaacccttggatggaagataaaactcctgttgagagttgggaggaggtgccctatctgggtaagcgggaggatcaatggtgtggcagtctgattggactgacatcaagagcaacatgggccaaaaatattcaaaccgctataaaccaagtcaggagcctgattgggaatgaggaatatacagattatatgcccagtatgaagcggttccgcagagaggaggaagaagccggtgtattgtggtga

SEQ ID NO: 22368 - RNA, 9876 nt, synthetic construct
  misc_feature 1..9876: note = derived and/or modified CDS sequence (opt6) from DENV-2__GU131955__SS-prME
  source 1..9876: mol_type = other RNA
acagcgggggtaatagtaatgttaataccaactgtgatggcttttcatttgacaacacggaatggagaaccacacatgatagttggtaggcaggaaaaaggaaaatctctactgtttaaaactgaagatggtgtaaatatgtgcacccttatggccatagacttaggcgaactttgcgaagataccataacatacaaatgcccactgctaaggcaaaacgaaccggaagacatagattgttggtgtaattcaacaagtacttgggtgacatacgggacatgcagtactactggagaacacagacgtgaaaaacgtagcgttgcattagttccacatgttgggatggggcttgaaacgagaacagaaacatggatgagcagcgaaggcgcttggaaacacgttcaacgaatagagacatggattctacgacatcctggatttacaatcatggcagcaatactagcatataccattggcaccactcattttcaaagagctttgatatttattctcttaacagcggtggcaccaagcatgaccatgcgatgtattggaatatccaatagggattttgtcgaaggagtatctggtgggagctgggtagacatagtacttgaacatggaagctgtgtaactactatggcgaaaaataaaccaacacttgactttgagcttatcaaaaccgaagcaaaacaaccagctactcttagaaaatattgcatcgaagcgaaattaactaacacaacaaccgagtctagatgtccaactcagggagagcctagtctcaatgaagaacaagataaacgcttcatatgtaaacatagcatggttgatcgaggctggggaaacgggtgtggactattcggaaaaggcggtattgtgacctgcgcgatgtttacgtgtaagaaaaacatggaaggtaaagtagtgcaaccggaaaacctagaatacaccatcgtgataaccccgcattctggagaagaacacgctgttggtaatgatacaggaaaacatggtaaagaaatcaaaataacacctcaaagttcaataacagaagcagaactgacaggttacggaaccgttaccatggaatgcagccctcgtacaggacttgacttcaacgagatggtcctgttgcaaatggaagataaagcgtggctcgtgcatagacagtggtttctggatctaccattgccatggttaccaggagcagacacacaaggttctaattggatacaaaaagaaacacttgttacctttaaaaatccacatgcaaagaaacaagatgttgttgtgttgggctcacaggaaggagcaatgcacacagcattaacaggagcaacagagatacaaatgagctccggaaatctgttatttaccggtcacttaaaatgcagactcaggatggataaactccagctgaaaggtatgagttattctatgtgcaccggaaaatttaaaatagtaaaagaaatagctgaaactcagcatggtacaatagttatccgggttcaatacgaaggagatggttcgccctgtaaaattccttttgaaattactgaccttgaaaagcgacacgtattgggacgactaattacagtaaatcctattgtaaccgaaaaagactctccagttaatattgaggcagaacccccttttggtgattcatacatcataattggggtagaaccaggacaattaaaactgaattggtttaaaaagggatcgagcattggacaaatgtttgagaccacaatgagaggagcaaaaaggatggctatcttaggggacacagcatgggactttggaagtctagggggtgtatttacatccattggaaaggctttacatcaagtctttggtgcaatatatggagcggcattttcaggagtttcatggaccatgaaaatattaataggcgttataataacatggatcggtatgaactcacgatcgaccagtttatctgtgagcctagtattagtaggagtagtcaccttgtatttaggagcaatggttcaggcagacagcggttgtgtagtaagctggaaaaataaggaactaaagtgtggatctggaatctttattactgataatgtgcatacatggacagaacagtacaagttccaaccagagagtccttccaaacttgcatctgctattcaaaaagcccatgaagagggaatatgtggaatcagaagtgtgactagactcgaaaatttaatgtggaaacaaattacacctgagctaaaccatatattatcagaaaatgaagtcaagctgacgataatgacaggcgatataaagggtataatgcaggccggaaagcgttcgttaagaccacagccaactgaactgaaatacagttggaaaacatggggtaaagcaaaaatgctcagcacagagagccacaatcaaacatttctaattgatggccctgagacagcggaatgtcctaacactaatagggcctggaatagtctagaagtagaagattatgggttcggtgtttttacaactaatatatggcttaaattaagggaaaaacaagacgtgttctgcgattctaagttaatgagtgcagcgataaaagacaatagagcagtgcacgcggatatgggatattggattgaatcagcactaaacgacacctggaaaatggaaaaagcaagttttattgaggtaaagtcatgccattggcctaagtcgcacactctttggtcgaacggagtattagaatcggaaatgataattcccaaaaattttgccggaccggtttcccagcataactatcgtccaggctaccatacacaaacagccggaccatggcacttaggaaaattagagatggattttgacctttgtgagggtacgactgttgtggtaacagaggattgtggaaacagagggcctagcttaaggactacaacggcttcaggaaaactgataaccgagtggtgttgtaggagctgtactttgccacccttaagataccgaggtgaggatgggtgttggtatggaatggagataagaccactaaaagaaaaagaagagaacttggttaatagtttggtgaccgcgggacatggacagatagataacttctccctaggagttttaggcatggcgcttttcctcgaggagatgcttagaacaagaataggaacaaaacacgctattcttctagtagcagcctcttttgtaacccttatcacagggaacatgagtttccgtgatctgggccgagtaatggttatggttggtgctaccatgactgatgatatagggatgggcgtaacttatctcgcgttacttgcagcctttaaagttcgtcctacatttgctgcaggccttctactccgtaaactcacatccaaagagctaatgatggcaacaataggtatagcgttgctaagtcaatctacgatacccgagaccatattggaattaacagacgctctagctcttggcatgatggtgctcaagattgttaggaatatggaaaaataccagttagctgtaacaattatggcaatctcctgcgttcctaatgctgttatattacagaatgcgtggaaggtctcttgcactattttagcggctgttagcgtatcaccccttttactaacaagttcccaacagaaagctgattggatacctctggcacttacaataaaaggtttgaacccgacagcaatattcttgacaacactttcaaggacatccaaaaagagaagttggccattgaacgaggccgttatggcggtcggaatggtaagtattttggcgagctcgctgctcaaaaatgatataccaatgactggtcctttggtagctggaggactcctcacagtatgttacgtattaaccggccgctcagccgacttagaactagaaagggctgcggatgtaaaatgggaggatcaagcggagatctcaggatcaagtcctatactatccataacaatatcggaggatggatcaatgtcaatcaaaaatgaagaagaggaacaaacattaactatacttataagaactggactattagtaatcagcggcgtatttcccgtatcgatacccataacagcagcagcttggtacctatgggaggtcaagaaacaaagagcgggagtactatgggatgttccatcaccgcctccagttgaaaaagcggaattagaagatggtgcttatagaattaaacaaagaggtatactaggatatagccaaattggagcgggcgtatataaagagggtacatttcatacgatgtggcacgtcacaaggggagcagtcctaatgcataggggaaaaaggatcgagcctagttgggccgatgtgaagaaagacttgataagctatggtggtggctggaaactcgaaggcgaatggaaagaaggagaagaagtacaagtactagctctcgaaccaggtaaaaatccacgggcagtacaaaccaaaccgggaatattcaaaaccaatactggaaccattggcgcagtatcactggatttttcaccgggtacatcgggatctcccatagtcgatcggaaaggaaaagtcgttgggttatatggtaatggtgtggtgacaagatctggggcgtacgtcagcgcaatagcgcaaacagaaaagagtatcgaagataatccagaaattgaagatgatatattcaggaagaaaagactaacaataatggatttgcacccaggagcagggaagaccaagagatatctacctgcgatagtgcgagaggcgattaaacgaggtttaagaacattaatattagcaccaacccgagttgtagctgcagaaatggaagaagcgttaagaggattacctattcggtaccaaacgccagccataaaaaccgaacacacaggaagagaaatagtggatcttatgtgtcatgccactttcacaatgagattgctctcacctgtcagagttccaaattataacttaataattatggatgaagctcactttacagatccagcatctattgccgctcgtgggtacataagcacacgtgttgaaatgggtgaagcagcaggaatattcatgactgccacacctccaggttcccgagacccgtttcctcaatccaacgctccgataatggatgaagaacgagaaatacctgaaagaagttggaactcagggcacgagtgggtcacagactttaaaggaaaaactgtttggttcgtcccatccataaaggccggaaatgatatagctgcttgcttaaggaaaaacggtaagaaagtaattcaactttcccgcaaaactttcgatagcgaatatgtgaaaacaagagcaaacgattgggactttgttgttaccaccgatataagtgaaatgggggcaaactttaaagctgaaagggtgattgatccgcgtaggtgtatgaaaccagtaattcttactgatggtgaggagcgtgtaatccttgctggcccaatgcccgtcacccacagtagcgctgcacaaagacggggacgaatcggacggaatccgaaaaatgaaaacgatcaatacatatatatgggagaaccattggagaacgatgaagattgcgctcactggaaagaagctaaaatgctactagataatattaacactcccgagggaataataccttcaatgttcgaaccagaacgagaaaaagtcgacgcaattgacggagagtatagattacgaggggaggcaagaaagacttttgtagatttgatgagaagaggggatttaccagtatggctggcatacaaagtggcggccgaaggcataaattacgccgatagaaaatggtgttttgacggtattaaaaataaccaaattctagaagagaatatggaagtggagatatggacaaaagaaggagaacgcaagaaactaaagcccagatggctagacgcgcgcatatattcggatcctctagctttaaaagaatttaaagaatttgctgccggtaggaagagtctaacattaaatttaataacggaaatgggcaggctaccaacatttatgacacagaaagctagaaatgcactagacaaccttgcagtactacatactgctgaagcaggaggacgtgcatataatcacgctttatccgaattgcccgagacattggaaacccttttattattaactttacttgcaacggtgacgggaggaatatttctctttttaatgagtggcaaaggaattggaaagatgacactaggtatgtgttgtatcatcacagctagcattttgttatggtacgcccaaatacaaccgcactggatagctgcaagtattatattagagttctttctaatcgtactcctaataccagaaccggaaaagcaaaggacaccacaagataatcaattaacatatgtagtaatcgcgatactcacagtcgtcgcagccacaatggcaaatgaaatgggatttttagaaaagaccaaaaaggacctaggtttgggatctataacaacgcaagaatcagaaagcaacatattggatatagacctaaggccggccagtgcttggacactctacgcagtcgcaactacctttgtgactcccatgctcaggcacagtattgagaactcatctgtaaatgtaagtttgactgcaattgctaatcaagctacggttttaatgggactgggcaagggatggcccctttccaaaatggatataggcgtcccactgctcgctataggttgttattcacaagtaaacccaatcactttgactgctgctttattattattagtcgctcattacgcaataatcggacccggccttcaggcaaaagcaacacgtgaagcccagaaacgtgctgcagcaggaattatgaaaaaccccacggttgatggcataaccgtgatcgatctcgagccgattccatatgatcctaaattcgaaaaacaactaggtcaagtaatgctactaatactttgcgtcactcaagtgctaatgatgcgcactacatgggcactttgtgaagccttaacactagcgactgggcctattagcaccctctgggaggggaacccaggaagattctggaacacgacgattgcagtaagtatggcaaatatattcagaggatcttacctagctggtgcgggcctgctattcagcattatgaaaaataccacaaacacgcgtagaggcacaggaaatataggcgagacccttggcgaaaaatggaaaagcagattaaacgcattgggaaaatccgagtttcaaatatacaaaaagagcggtatacaagaggtcgataggacgctagcgaaagagggaataaagagaggagagacggaccaccatgcagtctccaggggatcagcaaagttaagatggtttgtagaaaggaatatggtcactccagaaggcaaggtagttgatctcggttgtggccgaggcggttggagttattactgcggtggactcaaggatgtaagagaggtgaaaggcttaactaaaggaggtccagggcacgaggaaccgataccgatgtctacgtatgggtggaatttggtcagacttcaatcggggatagatgtattcttcactcctccagaaaaatgcgacacactcttatgtgacataggagaatcgtcaccaaatccaactattgaagcgggccgaactctcagagtactcaacctagtcgaaaactggctgaataataatacacaattttgtatcaaggtacttaacccttacatgcctagtgtcatagaaaagatggagacattgcaacgtaagtatggtggagcactggtgaggaaccccttatcacgtaactcaacccacgaaatgtattgggtctctaatgcgactggcaatatagtatcttcagtaaatatgatctccaggatgttaataaatagattcacaatgaaacacaagaaagcgacatacgagcctgatgtagacctaggaagtggtaccagaaatatagggatagaaagcgaaatcccaaacttggatataattggcaagagaattgaaaagattaaacaagaacatgaaacgtcttggcactatgatcaagatcatccatacaaaacatgggcctaccatggcagttacgagactaaacagactggatctgcaagctcgatggtcaatggtgttgtacgattactaacaaaaccatgggacgttgtacctatggtaactcaaatggcgatgaccgacacgactccattcggacagcaacgggtattcaaagaaaaggttgatacccgaacacaagaaccgaaggaggggactaaaaagttgatgaaaatcacagcggagtggttatggaaagagctcggcaagaagaaaacacctcgaatgtgtacccgcgaagaatttacaagaaaagtgaggtccaatgcagcattgggtgctattttcacagacgaaaataaatggaagagtgcaagggaagccgttgaagacggaagattctgggagctagtggatcgagaacgaaatttacacttagaaggtaaatgtgagacttgcgtttataatatgatgggcaagagagagaagaaacttggagaatttggaaaagcaaagggaagcagagccatatggtatatgtggctgggagcgaggttcttagagttcgaggctttaggttttctgaacgaggatcactggttctcaaggggaaattctttaagtggagtagaaggtgaaggactgcacaggcttggatatatactccgagatgttgggaagaaagagggtggcgcaatgtacgcggacgatacagctggatgggacaccagaattacccttgaagatttaaagaacgaggaaatggtcacaaatcatatgaaaggagaacataagaaactagctgaggctatatttaaactaacgtaccaaaacaaagtagtacgagtacaacggcctactccaagaggaacagtgatggacatcatttctagacgcgatcagagaggatctggacaagtcggcacttacggcttaaatacgttcacgaatatggaagctcaattgataagacaaatggaaggggaaggaatttttaaaagcatccagcatttaacagccacagaagaaatagcagtacagaactggcttgctcgggttggtcgagaacgcctcagtaggatggcaatatccggagatgactgtgtagtaaaacccatagatgaccggtttgcgagtgcattaacggcactaaacgatatgggaaaggtacgaaaagacatacaacaatgggaacccagccggggttggaatgactggacacaagtgcctttttgttctcatcattttcacgagttagtaatgaaagatggacgagtcttagtagtaccttgtcgaaatcaggatgaacttataggtcgagctcgtattagtcaaggggcaggttggagtctaaaagaaacagcttgtctagggaagtcatatgcccaaatgtggacattgatgtacttccaccgaagagacttacgattagcagccaacgcgatttgcagcgcagtaccgtctcactgggttcccactagccgaacaacatggtcgattcacgcgaagcacgaatggatgactacagaagacatgttagcggtgtggaatagagtctggatccaagaaaacccttggatggaggataaaacaccagtagagtcatgggaggaagttccttacttgggaaaaagagaagatcaatggtgcggttcgctaattggtcttacctcaagagctacttgggcaaagaatatacaaacagctataaaccaagttaggtctttgataggtaatgaggaatatacagattatatgcctagtatgaaaaggtttaggaaagaggaggaagaggctggggtactatggtaa

SEQ ID NO: 22369 - RNA, 9876 nt, synthetic construct
  misc_feature 1..9876: note = derived and/or modified CDS sequence (opt6) from DENV-2__KJ189311__SS-prME
  source 1..9876: mol_type = other RNA
accgctggggtaatagttatgttaattccaaccgttatggcattccacttgacaacacgcaacggagaaccacacatgattgtcggacgacaagaaaaaggaaaatcgctgttatttaaaacagaagatggtgttaatatgtgcaccctgatggcaattgacttaggagaattgtgtgaagacacaattacgtacaaatgcccactgttaagacaaaatgaaccagaagacatagattgctggtgcaactctacgtccacgtggattacatacggaacctgttcaacaacaggagaacatagaagagagaaacgaagtgttgctttagtgccgcatgtgggaatgggactagaaactcggacagaaacctggatgtcatcggaaggagcttggaaacatgttcaaaggatcgaaacatggatactaagacaccctgggtttacaataatggccgctatactagcatatacgattggaacaacacattttcaacgagcacttattttcattcttttaacggctgtcgccccaagtatgaccatgcggtgcattgggatatccaacagggattttgtagaaggtgtaagtggaggaagctgggtagatatagtactagaacatggttcctgtgttacaaccatggccaaaaataaacccacattggacttcgaactaataaaaacagaagcaaaacaaccagcaactttacgcaaatattgcatcgaagcgaaacttacaaacacaactactgaatcgcgctgtcccacccaaggagaacccagcttaaacgaagaacaagataaacggttcatctgtaaacattcaatggtagatagaggatggggcaacgggtgtggactttttggcaaaggaggaatagtaacctgcgcaatgtttacatgtaagaaaaatatggaaggtaaagttgttcaaccagagaatttagaatatacgatcgtaataactccacacagtggcgaagaacacgcagttggtaatgatacaggcaaacacggaaaagaaatcaaaatcacaccacaaagctcaataaccgaagcagaacttacaggttatggaacagtaacgatggagtgtagcccacgtacgggtttagattttaatgaaatggtattgttacagatggaagataaagcatggttggtacacagacagtggttccttgacttacccctcccctggctacctggtgcagatacacaaggctcgaattggatccaaaaagagactcttgtcacatttaaaaatcctcatgcgaagaaacaggacgtcgtggtacttgggagtcaagaaggagcaatgcacacagcactcacaggcgctactgagatacaaatgagttcagggaacttgctctttactggtcacttaaaatgtcgcctgagaatggacaaactgcaattgaaaggaatgtcatattctatgtgtaccggtaaattcaaaatagtgaaagagatagctgaaacccaacatggtacaatagtcataagggtccaatacgaaggagatgggagtccatgtaaaattccgtttgagataacagatttagagaaaagacatgtgttaggacgtttaatcacggtaaatccgatagtaactgaaaaagactcgccggttaatatagaagctgaaccgcctttcggagactcgtatataataataggagtagaacccggccaactaaaactgaattggtttaagaaaggaagctcaataggacaaatgtttgagactaccatgagaggggctaaaagaatggctatcctaggcgacacagcatgggactttggtagtctaggaggagtattcacaagcataggaaaagcactccatcaggtatttggagcaatttatggcgcagctttttcgggagtatcctggaccatgaaaattctcataggagtcataataacatggattggtatgaactcacgtagtaccagcttaagtgtatctctggtgctagttggcgttgtgattctttatctcggagccatggtccaagccgattcaggatgcgtagtgtcttggaagaataaagaattaaagtgcggttcagggatattcattacggataacgtgcatacatggacagaacaatacaaatttcaacccgaatctccttcaaaattggctagtgccattcagaaagcccacgaagaggggatttgcggaatacgaagcgtaaccagattagaaaatctgatgtggaaacaaataactccagagctgaaccatatattaagtgagaacgaagtcaaattaaccatcatgaccggtgacataaaaggaataatgcaagcgggtaaaagatctctccgaccacagcctacagaactaaagtatagctggaaaacttggggtaaggcaaaaatgttaagtaccgaatctcataaccaaacatttcttattgatggacccgaaaccgctgagtgtccaaataccaacagagcatggaactcattagaagttgaagactatggttttggagttttcactacaaacatatggttaaaattaagagagaaacaggacgtattttgcgatagcaaattaatgagcgcagcaatcaaggataatagagcagtacatgcagacatgggctactggatagagtctgcattgaatgacacatggaaaatggaaaaagcgtcctttattgaagtaaaaagttgtcattggcccaaaagtcatactctctggtcgaacggtgttttagaatcagaaatgataatccctaagaattttgctggacctgtatcccaacacaactatagaccaggatatcacacacaaacagccggaccctggcatctagggaaattagaaatggatttcgatttatgtgaaggaacaacagtggttgtaactgaagattgtggaaatagagggccgtcgttgagaacgactaccgcctcgggtaaattaattactgaatggtgttgtcgttcctgtactttaccgcctctaaggtatagaggagaagatgggtgctggtatggaatggaaattcgaccattaaaggaaaaagaagagaatttagtcaactcactcgtcacagcgggacatgggcagatagacaatttttcattgggagttttggggatggcgctgtttctcgaagagatgttgcgtacaagaataggcaccaaacacgcaattttattagtggctgcttccttcgtaacattaataacaggtaacatgtcattcagggacttgggaagagtcatggtaatggtcggtgctaccatgaccgatgatatcgggatgggagtaacttatcttgccctgttagcggcattcaaggtacgacctacattcgccgctggccttttactgcgaaaattaacttcgaaagagctgatgatggctactattggcattgccttactgtcccaaagtactataccggaaagcatattagaattaaccgatgcactagcactcggaatgatggtactcaaaatcgtgcgaaacatggaaaagtatcagttagcagttactataatggcaataagttgtgtgcctaacgcggtaattctacaaaacgcatggaaagtgtcttgcacaatattggcagcagttagtgttagtcccttactgctgacttcttcgcaacaaaaggcggattggataccactagccttaacaataaaagggctcaacccgacagcaatctttctaacaacattaagtagaaccagtaagaaacggtcatggcccctaaacgaggcggtgatggcagtaggaatggtatcaatactagcttcaagccttctgaagaacgacatcccaatgaccgggcctctcgtggcaggcggattgctaacggtatgttatgttttaactggtaggtccgccgatcttgagttagaaagagcagccgacgttaagtgggaagatcaagcggaaatctcgggttcatcgccaattttatctatcactataagcgaagacggctcaatgtcaataaagaatgaagaagaggagcaaaccttaaccattctgatacgcactggattgctagtaattagtggggtatttccagtgtctatacccataacagcagcagcatggtatttatgggaagtaaagaaacaaagagctggcgtcctatgggacgttccaagtccaccaccagtcgaaaaagcggaattagaagatggcgcataccgaattaaacaacgaggtatccttggatactctcaaataggagcgggcgtttataaagagggtacatttcatacaatgtggcacgtaactagaggcgctgtcttgatgcaccgaggaaaacgaattgaaccgtcgtgggctgatgtcaagaaagatctaatatcctacggagggggctggaaattagagggcgaatggaaagaaggggaggaagttcaagtcttggcattagaaccggggaaaaacccaagagcagtccaaactaagccaggaatattcaagactaacaccggcaccataggcgccgtttcattggatttcagcccaggcaccagtggttctcctattgtcgatagaaaaggcaaagtagtgggtttgtatggaaacggagtagttactcgttcaggtgcctatgtatctgctatcgcccaaacagaaaagtctatcgaagataacctagagattgaagatgatatctttagaaagaaacgattaacaattatggacctacatccaggagctggcaaaacgaaaaggtatttacctgcaatagtaagagaagcgattaagagaggactacgtacgttgatccttgctccaacccgagtcgtagccgccgaaatggaggaggcgttaagaggtctaccaatcaggtaccaaacaccagcaattaaaacagaacatactggcagggaaatagtagacctaatgtgtcatgcaacatttacaatgagacttcttagccccgttagagttccgaactataatctaataattatggatgaagctcattttacagatccggcatctattgcggctaggggttacatcagtacaagggtcgaaatgggtgaagctgcaggaatcttcatgactgcgactccgcctgggtctcgggatccattcccccaatcaaatgcgcctataatggatgaagaacgggaaattccagaaagaagttggaactcaggacacgaatgggttacagactttaaagggaaaacagtgtggttcgttccgagcataaaagcgggaaatgacatagcagcctgtctgaggaaaaatggcaagaaagtgatacaattaagcagaaaaacctttgacagcgagtatgtaaaaactcgagctaacgattgggattttgtcgtcacgacggacatatcagaaatgggagctaacttcaaagcagaaagagtaatcgatcctagacgttgtatgaaaccagtcattctcacagatggcgaggagcgtgtgatactcgcaggacccatgccagtaacacatagcagcgctgcccaaagaagaggccgaataggtcggaatccaaagaatgagaatgaccaatatatttacatgggagaacctttggagaacgatgaggactgtgcccattggaaggaagccaagatgctcctcgacaacataaatacacctgaaggcataatacccagcatgtttgaacctgaacgagaaaaagtggacgctattgatggagaatatagacttagaggggaagccagaaaaactttcgtggatctaatgagaagaggagatctcccggtctggctagcctataaagtcgccgcagaaggaataaactacgcagacagaaaatggtgtttcgatggaatcaaaaacaatcaaatacttgaggagaacatggaagttgaaatctggactaaagaaggggagagaaagaaactaaaacctagatggttggacgcgcgtatctacagtgacccgctggcattaaaagaatttaaggagtttgcggctggtcgcaagagtttaacattaaatcttattacagaaatgggtcgcctaccgacgtttatgacccaaaaagctagaaatgcccttgataatctagcagtgctccatacagctgaggctggcggtcgtgcatacaatcacgctttatcagaattgcccgaaacactcgagacgctactattattaaccctattagcgacggtaaccggaggcatatttttatttctaatgagtggcaagggaattggcaaaatgacgttagggatgtgttgcatcataacagcaagcatattactgtggtacgcacaaatacaaccacattggatcgctgcaagtattatactcgagttcttcctaatagttttgctaatcccagaacctgaaaaacaaaggacgccacaagataatcagctgacatacgtagtgattgctattttaactgtagtggcagcaaccatggcaaatgagatgggctttttagagaaaacaaagaaagatttaggccttggatcaattacgacccaagaatcagaatccaacatattggatatcgacttacgaccagcaagcgcctggacattatatgccgtggcaacaacatttgtcactcctatgttacgtcattcaattgaaaacagtagtgtcaatgtaagcctaacagcaatcgcaaatcaagcaaccgtcctaatgggattaggtaaaggttggcctctgtccaaaatggatataggagtgccgttgttagctattggctgctattcgcaagtcaatccgattactcttacagcggcgttattgctgcttgtagcgcactatgctataattggtcctggtctacaagcgaaagcaacgagagaggcacagaaaagagccgccgcggggattatgaaaaaccctacggttgatggaattactgtaatcgatctagaacccataccttatgatccgaaatttgaaaaacagctcggtcaggttatgctcttaatattgtgcgttactcaagtactaatgatgaggactacatgggctttgtgcgaagcattgaccctagcaacaggccctatttctacgttgtgggaagggaacccgggtcgattttggaataccactatcgcagtaagtatggcgaatatattccgaggctcatatctagcaggcgcaggtttactattttcaattatgaaaaatactactaacacaagaagaggtacaggaaatataggtgaaactttaggagaaaaatggaaaagtagactgaatgcactcggtaaatctgaatttcaaatttataagaaatccgggatacaagaggttgaccggactctagcgaaagaaggtataaaaagaggtgagacagatcaccatgcagtaagtagaggatcagcgaaattgagatggttcgtagaaagaaatatggtgacaccagaaggtaaagtcgtcgacttaggatgtggtagaggtggatggtcctattactgcggtggattaaaagacgtacgagaagtaaaaggtttgacgaaagggggacctggccatgaagaacctattccaatgtctacatatggttggaatcttgttcgactacaatcaggaatagacgtcttctttacaccgccagaaaagtgcgacaccttactgtgcgatataggagaatcttcgcccaatcctaccattgaagctggacgcacgttgagagtcctaaacctcgtcgaaaattggttaaacaacaacactcaattctgcattaaagtgctaaatccttacatgccaagtgtgattgagaaaatggagacacttcagcgaaagtacggtggagcattggtacgcaacccattgagtaggaatagtacacacgaaatgtactgggttagcaacgccacaggaaacatagtaagttcagtaaatatgattagccgcatgttaattaacagatttacaatgaagcataagaaagccacgtatgaacctgatgtggacttaggttcaggaacaagaaatattggtatcgagtcagaaataccaaatctagacatcataggaaaacgtattgagaaaataaaacaagaacatgaaacttcatggcattacgaccaggaccatccgtacaaaacatgggcatatcacggatcatatgaaactaagcagacaggttcagcgtctagcatggtgaatggcgtagttcgactgcttacaaaaccgtgggatgtggttccgatggtaacacaaatggcgatgactgatacaactccatttggacagcaaagggtgtttaaagaaaaagtcgacacaagaactcaagaaccaaaagaaggtactaagaaacttatgaagatcaccgcggaatggttatggaaggaactaggcaagaagaaaacaccgcgaatgtgtactagagaagagttcacacgaaaagtacgatccaacgcagcactcggagccatattcacggatgagaacaagtggaaatcagcgagagaagcagttgaagatggcagattttgggaacttgttgaccgagaacgttcacttcatctcgaaggaaagtgtgaaacgtgcgtttacaacatgatgggaaagagagagaagaagttaggggagttcggcaaagctaaagggagcagggcaatctggtatatgtggttaggtgcgagattcttagagttcgaagctctcggtttcctaaacgaggatcattggttttctcgtggaaattcattgtctggtgttgagggtgaaggtctacacagattaggatatatcctcagagacgtaggcaagaaagagggtggtgcaatgtatgcagatgacactgcaggctgggatacgcgaatcaccttggaagacctcaaaaatgaagaaatggtaacaaaccacatgaagggggaacataagaaactagctgaggcgatctttaaattaacatatcaaaataaggtggttagagtacaaaggccaactccgagaggaacagttatggatataatatcccgtcgcgaccagagaggaagcggccaagttggaacttatggtctcaatacatttacaaatatggaggcacaacttatcaggcaaatggaaggtgaaggcatcttcaaaaacattcaacacctgaccgctacggaagaaattgccgtccaaaattggcttgcacgtgttgggagagaaagactttcacgcatggctataagcggtgacgactgtgttgtaaaaccaatcgatgataggtttgcatcagctctaacagcacttaacgatatgggtaaagtgcgcaaagatatacaacaatgggaacctagtcgtggatggaatgattggacacaagttccattctgttcgcaccacttccacgaattagtaatgaaagatggaagagttctggtagtaccatgccgaaatcaggatgaacttataggaagggcccgaattagccagggtgccggctggagcctaaaggaaacagcatgtctgggaaagtcttacgcgcaaatgtggacgttaatgtactttcacaggcgcgatctgagactggctgcgaacgccatctgcagtgctgtaccttcacattgggttccgactagccgcactacttggagtatacatgctaaacatgagtggatgactacagaagatatgcttgcagtatggaaccgcgtttggattcaagaaaatccatggatggaagataagactccggttgaatcatgggaggaggtcccatatttgggcaaacgcgaggatcaatggtgtgggagcttaattggactaacctcacgagcgacttgggctaaaaatatacagacggcgataaatcaggtcagaagtctcattgggaatgaggaatatacagattatatgccgtccatgaaacggtttaggaaagaagaggaagaagcaggagttttgtggtaa

SEQ ID NO: 22370 - RNA, 9876 nt, synthetic construct
  misc_feature 1..9876: note = derived and/or modified CDS sequence (opt6) from DENV-2__KJ189370__SS-prME
  source 1..9876: mol_type = other RNA
acggctggtgtaatcgtcatgctgattcctaccgcaatggcatttcatttaacaacgcggaatggtgaaccgcatatgattgtatcccgccaagaaaaagggaaatccttactattcaaaaccgaggatggggttaatatgtgcacactaatggcaattgatctgggggagttatgcgaagacacaattacttataaatgtccactactccgacaaaacgaaccagaagacattgactgctggtgcaattctacctcaacatgggttacgtacgggacctgcactaccactggggaacatcgaagggaaaaacggagcgtcgcattagttccacacgtgggaatgggactagagactcgaacagaaacctggatgtcatcagaaggagcttggaaacatgtccagagaattgaaacgtggatactaagacatccaggatttacgataatggcagcaattctcgcctatacaataggaactacacacttccaaagagccctcatatttatactcctaacggcagtagcaccatctatgacaatgaggtgtataggtatatctaacagggatttcgtcgagggtgtaagcgggggaagttgggtagacattgtattagaacacgggagctgtgtcacaacgatggctaaaaacaaaccaacactagactttgagttaataaaaactgaagctaaacagcctgcaacacttaggaaatattgtattgaagcaaaattaacaaatacaacaacagaaagtagatgcccgactcagggggaaccaagtcttaacgaagaacaggacaaaaggttcatatgcaaacactctatggtagacaggggttggggaaatggatgcggtttattcgggaaaggaggaatcgtcacttgtgccatgtttacttgtaagaaaaatatggaaggtaaagtagtccaaccagagaacctagaatatacaatagtaataacaccacacagtggagaagaacacgcagttggaaatgacacgggcaaacatgggaaagagattaaaataactcctcaatcaagcataacagaagcagaactaactggctatggcacggtgacgatggagtgtagtccgagaacaggacttgattttaatgaaatggtactgttacaaatggaagacaaagcgtggctcgtacatcgccaatggttcctagatttgccattgccgtggttaccaggggccgatacccaaggaagcaactggattcaaaaagagacgttagtaacattcaaaaatccacacgctaaaaagcaagatgttgtagtattagggtcccaagagggtgcgatgcatactgcattgactggtgcaaccgagatacaaatgagttctggtaaccttctattcactggacatctaaagtgtagattgcgtatggataaacttcagctcaaaggtatgtcatattcgatgtgcacgggaaagtttaaaatcgtaaaagaaatagccgaaactcaacacggaacgattgtaataagagtacagtacgagggagatgggtctccatgtaaaatcccctttgaaattacggatctggaaaagagacatgttctaggtaggctgatcactgtaaatccaatagtcactgaaaaagatagtccagtcaatattgaggcagaacctccatttggtgactcttatattattataggagtagaaccgggacaattaaagctcaactggtttaagaaaggatcatcaataggacaaatgtttgaaacaacaatgaggggagcaaagagaatggcgatattaggtgataccgcgtgggactttggaagtctaggcggcgtattcacatctatagggaaagcactacaccaagtctttggcgcaatttacggggcggccttctctggagtgtcgtggactatgaagatccttataggagttattataacttggatcggtatgaactcgcgaagcacctctctatcagtatcactcgtcctagtaggtgtcgtaacattatatctgggagcaatggtccaggctgattcaggttgtgtggtctcttggaagaacaaagagttgaaatgcggtagtggcatatttataaccgacaacgtacatacctggaccgaacaatacaaattccaacctgaatctccctccaaattggcaagcgccattcaaaaggctcatgaagaaggaatttgcgggataaggagtgtaaccagattagaaaatctaatgtggaagcagataacaccagaattgaaccatatattatcagaaaatgaagttaaattgacaataatgactggcgatatcaaaggaataatgcaggctggaaaaagatctttacgaccacaaccaactgaacttaagtatagctggaaaacttggggcaaagctaaaatgctaagcacagaatcgcacaatcagacatttttaattgacggtccagaaacggccgaatgtcccaatacaaatagagcgtggaactcactcgaggtcgaggattacggcttcggcgtctttaccactaacatatggttaaaattaaaagaaaaacaggacgtattctgcgatagcaaattaatgagtgcagctataaaagacaacagggcagtacatgcagatatggggtactggattgagtccgcacttaatgacacatggaaaatggaaaaagctagtttcatagaagttaagagctgtcattggccaaaaagtcatactttgtggagcaacggcgtgttggagagcgaaatgataatacccaaaaattttgccggtcctgtcagccaacacaactataggccaggatatcatacacagacagctggcccatggcatttgggcaagttagaaatggactttgatctgtgtgagggtactaccgttgtagttacagaggattgtggaaatcgcggacctagccttcgaactaccactgctagtgggaaactaataacggaatggtgttgcaggtcatgtacgctaccacctttaagatataggggtgaggacgggtgctggtatggtatggagataaggccgttaaaggagaaggaagaaaaccttgttaatagtctcgttactgcaggacatggacaaatagataacttcagtttaggagtcctaggaatggcgttgtttcttgaagaaatgttaagaactagaatcggaacaaaacatgcgatattattagtcgccgtatcgtttgttactctaatcactggtaatatgagctttcgcgacctggggcgcgtgatggtaatggttggcgctactatgacagacgacatcggtatgggtgtaacttacctggctctactagctgccttcaaagtgcgaccaacgttcgcagctggtttgttattgcgtaaacttaccagtaaagagctcatgatggcaactatcggaatagcattattatcacagagcacaataccagaaacgatactcgagttgacggacgccctagctttaggaatgatggtactcaaagtagtaagaaacatggaaaagtatcaacttgcagtaacaattatggcaatttcatgcgtaccgaatgccgttatattgcaaaatgcttggaaagtctcgtgcacaatcctcgcggcggtctccgtttcaccactattattaacttcgtcacaacagaaggctgactggatacctttagcgttgaccattaaaggtttaaaccctactgccatatttttaaccacattaagtcgaacgagcaagaaaaggagttggccattaaatgaagcgataatggccgttggaatggtaagcattttagcatccagcctacttaagaacgacattccgatgacgggtccgctagtggcaggaggactactaactgtatgttatgttttaactggcaggagcgcagacctggaattagaaagagcggctgacgtcaaatgggaggaccaagcagagatcagcggctcatcacctattctctccattactattagtgaagatggttccatgtctatcaaaaatgaagaagaagaacaaaccttaacaatcttaattcgaacaggactccttgtaataagtggcgtattcccagtaagtataccaatcacagctgcagcgtggtacctgtgggaagtgaagaaacaaagggcgggcgtactgtgggatgttccatcaccgccaccagttgagaaggcggaactagaagacggagcttacaggataaagcaaagaggcattctcgggtattcacaaatcggagccggtgtctacaaagaggggacattccatacaatgtggcacgtaacacgaggtgccgttttaatgcatcgtggaaagcgaatagaaccgtcctgggctgacgtgaagaaagatctaatttcctatggaggtggatggaagctcgaaggggaatggaaagaaggagaggaggtacaagtactagctctagaacccggtaaaaaccccagagcagtccagacgaaaccaggtattttcaaaactaacaccggaacaattggagccgtatcattagatttcagcccaggtacatccgggagtcccatagtcgaccggaaggggaaagtagtaggtctttacggcaacggtgtggtaacgaggagtggcgcctacgtttccgcaattgcccaaacagaaaagtctattgaagacaatcctgagatagaagacgatatattcagaaagaaacggcttacaataatggatttacacccaggagccggaaagacaaaaaggtaccttcctgcaatagtaagagaagctataaagagaggattaagaactttaatattagctccaacgagagtagttgcggcagagatggaagaggcacttcgaggtttacctatacgttaccagaccccagcaattaaggcagaatatacaggacgtgaaatagtcgacctgatgtgtcacgctacttttacaatgagactcctctcacccgttagggtgccaaattataacttaattataatggatgaagcacattttacggaccccgcaagtatagcagcaagaggctacattagtacaagggtagagatgggtgaagcagcagggatctttatgactgcaacgccaccaggtagcagagatccattcccccaaagcaatgctccgattatggatgaggaacgagagataccagaaaggagttggaactccggtcatgaatgggttactgattttaaaggaaaaaccgtttggttcgtcccaagtattaaagctgggaacgatatagcagcttgtctgcgtaaaaacgggaagaaagtaatacagttaagcagaaaaacctttgatagtgaatacgtcaaaactcgagcaaacgactgggattttgtagtaacaacagacattagtgaaatgggtgctaactttaaagcagaaagagtaatagaccctcgaaggtgcatgaaacccgtaattcttacagatggtgaagaacgtgtaatcctggctggacccatgcccgttacgcatagcagtgctgcgcaaagaagaggccgaattgggcggaaccctaagaacgaaaatgatcaatacatttacatgggtgaaccgctcgagaatgatgaagactgtgcgcactggaaagaagcaaaaatgttgctagataacattaatacacctgaaggtattatacccagtatgtttgaacccgaacgggagaaagttgatgctattgacggtgaatatagactccgcggagaagctaggaagactttcgtggacctgatgagacgaggagatttacccgtatggctagcctacaaggtagccgccgaaggcataaactatgcagacaggaaatggtgttttgatgggattaaaaacaaccagattttggaagaaaacatggaagtggagatatggaccaaagaaggtgaacgtaagaaacttaagcctaggtggctagacgccaggatctattcagaccctctagcactaaaagagttcaaggaatttgctgcagggcgtaaatctcttaccttaaatttgataacagaaatgggacggttaccaacatttatgacacaaaaagcacgaaacgcgcttgataatttggcagtgctccatacggctgaggctggagggagagcatacaaccatgcactaagtgaattaccagaaacattagaaacacttctgctattaacattgcttgcaactgttacgggcggtatattcctgttcctcatgtcaggtaaggggattgggaaaatgaccctgggtatgtgctgtattataacggcaagtatattattatggtacgctcaaattcagccacactggatagcagcttctataattctagagttctttctaattgttttactgattcctgaacctgaaaaacagagaaccccgcaagataatcaactcacatatgtggtaattgccattctgacagtagtggccgccacaatggctaatgaaatgggttttctagagaaaaccaagaaagatctgggattaggctcaattacaacacaagaatcagaaagtaacatattagacattgatttgagaccggcatccgcatggaccttatatgctgtggcaacaacgtttctcactcctatgttacgtcactcaatagaaaactcatcagtgaatgttagcttaacagcaatagcaaatcaagctactgtattaatgggattaggcaaaggatggcctctttcaaaaatggacataggagttccattattggccatcggctgttatagccaggtgaaccctataacactaactgcggcattattactattagtagcacactacgccattatcggcccgggtcttcaagcaaaagcgacgagggaagcacaaaaacgggcagcggcgggtattatgaaaaatccaactgtagatggtataacagtgatcgatctagatcctataccttacgatccgaaatttgaaaaacaacttgggcaggtcatgttgcttatcctttgtgtaactcaagttctcatgatgcgtacaacgtgggccctgtgtgaagcattaacactggcaaccggacccatcagcaccctatgggaaggaaacccgggcagattctggaacacgaccattgcagttagtatggccaatatatttagaggatcatatctagctggtgcaggtcttctatttagtattatgaagaataccacatcaactaggcgcggaacgggaaacataggtgagacattgggtgaaaagtggaaaagtcgactaaacgccctaggaaaaagtgagttccaaatttataaaaagagtggcattcaggaagtagacagaaccctggctaaagagggtatcaaaagaggtgaaactgaccaccatgctgtttcacgtggttcagcaaaactacgctggtttgtagaaagaaatatggtcactcccgaaggtaaggtagtggacttagggtgtggcaggggtggatggtcatactactgtggcgggctgaaaaatgttagagaagtaaaagggcttacaaaagggggacccgggcacgaggaacctattcctatgagtacctacggctggaatttggtccgattacaaagtggagtggacgtatttttcacgcctcccgagaagtgcgatacgctactatgtgacataggtgagtctagtccaaacccaactatagaagccggtcgtacgttaagagttttaaacctagtggagaattggctcaacaacaacactcaattttgcattaaagtactaaacccgtacatgccctctgttattgagaaaatggaagccttacaaagaaaatatggaggagccttagtacggaacccacttagcagaaattctactcatgagatgtactgggtttctaacgccactggcaacatagttagtagtgtcaacatgatctcgcgtatgttgattaatcgcttcacaatgaaacacaagaaagcaacatatgaaccggatgttgatctcgggagtggtactaggaatataggtattgagtccgaggtgccaaaccttgacattatcgggaaaagaatagagaaaattaaacaagagcatgaaacgtcctggcattacgaccaagatcacccttacaaaacatgggcatatcatggatcttatgaaacaaaacaaaccggtagcgcatcaagcatggtaaacggagtagtcagactgctaactaaaccgtgggacgtagtacctatggtgacgcagatggcaatgacagatactaccccctttggccaacaaagggtcttcaaggaaaaagtagatacacgtacgcaagaaccaaaagaaggcacaaagaaattaatgaaaataacggctgaatggctatggaaagaattagggaagaagaaaacgccacgtatgtgtacacgagaagaatttacacgtaaagtgcgatccaacgcagctttaggagcaatttttacagacgaaaataaatggaaatcagcgcgtgaagcggtagaagacggcaggttctgggaattagtggacagagaacgaaatttacatctggaaggtaaatgtgaaacatgtgtatataacatgatgggaaaaagggaaaagaaactaggggagtttgggaaagcaaaaggatcacgagccatttggtacatgtggttaggtgcacggtttttagaatttgaagcactaggatttttaaacgaagatcattggtttagcaggggcaacagtttaagcggcgttgaaggcgaaggactacatagattgggttacatactacgagaagtaggcaagaaagaaggcggggcgatgtacgcggacgacacggccggttgggacacacgtataacgctagaagatctcaaaaacgaagaaatggtaaccaaccatatgaaaggagaacataagaaactagcggaagcgatctttaaactaacgtatcaaaacaaggtcgtgagggttcaacgacccacacctcgtgggacagtcatggacatcataagtagaagggatcaaaggggttccggacaggtggggacgtacgggttaaacacattcactaacatggaagcacagcttattaggcagatggaaggagaaggtatatttaaatcaatacaacacctaactgcaacagaagagatagcagttcaaaattggcttgtacgagtcggtagagagcgcttatctcgcatggcgataagcggagatgactgcgtggtaaaacccatagacgacagatttgcctccgctctaaccgcgttaaatgacatgggcaaggtacgtaaagacatacagcagtgggagccttcaagaggttggaatgactggacccaagtgccgttttgttcacatcattttcatgaacttgttatgaaggatggcagagtactggtagtaccttgccgtaaccaggatgagttaataggccgcgcaagaattagtcaaggggcgggttggtcactaaaagaaacagcctgcctgggaaaatcatatgcacaaatgtggactctgatgtatttccatcgaagagatctacgcttagcggctaatgctatatgttcagccgtgccttcacactgggtacctacaagcagaaccacatggtctatacatgccaaacatgaatggatgaccacagaggatatgttggcagtatggaacagagtctggatacaggaaaacccatggatggaagataagactcccgtcgaaagttgggaggaagttccttatttagggaaaagagaagatcagtggtgcggatcactcatcgggttaacatcaagggctacttgggccaaaaatattcagacagcgattaatcaagtaagatcattgattggtaatgaagagtatactgattatatgccgagcatgaaacgttttagaagagaagaagaggaagccggtgtcttatggtag

SEQ ID NO: 22371 - RNA, 9876 nt, synthetic construct
  misc_feature 1..9876: note = derived and/or modified CDS sequence (opt6) from DENV-2__EU482620__SS-prME
  source 1..9876: mol_type = other RNA
actgcaggggttatagtaatgctaattccaactgcaatggcttttcacctaactactaggaatggtgaaccacacatgattgtgggacgccaagaaaaaggaaaatctttgctttttaaaacagaagatggagtcaatatgtgcacacttatggcaattgatctaggagaactatgtgaagatacgattacctacaaatgtccactactacgtcagaacgaaccggaagacattgactgctggtgtaatagtacaagtacttgggtaacctatggaacatgcaccaccacaggtgaacatcgaagagagaaaagatccgtagccctagtgccccatgtagggatgggtctggaaactagaacggaaacatggatgtcaagcgaaggagcatggaaacacgtacaacgaatagaaacatggatattaaggcatccaggttttacaataatggcggcaattttagcatacacgataggaacaactcattttcaacgagcattaatatttattttattgaccgcggtagcaccatcaatgaccatgcgatgtattggtatctcaaatcgtgatttcgtcgaaggtgtaagtggagggagttgggtagatatcgtattggaacatggatcatgtgtaacaaccatggctaaaaataaaccgacactcgatttcgaattaataaaaactgaagcgaaacaaccagcaacacttcgaaaatattgcattgaagcgaaactgaccaatacaacaacggaatcacgctgtcctacgcaaggcgaaccatcattaaatgaagaacaagacaaaagatttatttgtaaacactcaatggtcgacagggggtggggaaatggttgtggtttatttggaaaaggtggtattgtcacatgtgctatgtttacatgcaaaaagaacatggaaggaaaggttgtacaacccgagaacctcgaatacaccatagtaataacaccccacagcggagaagaacatgccgttggaaacgatacgggtaaacacggtaaagaaattaaaataacccctcaatctagcattacagaggcagagttaactggctacggaacagtaaccatggaatgttcaccaaggacaggcctcgatttcaatgaaatggttctcctgcaaatggaagataaagcatggctagtccatagacagtggtttttggatctccccctaccatggttacccggagcagacactcaaggctcaaactggatacagaaagaaaccctagtaacttttaagaatcctcatgccaagaaacaagatgttgtagtattggggtctcaagaaggagctatgcacactgcattaactggagcgactgagattcaaatgtctagcggaaatctattattcacaggtcatctaaagtgtagattgagaatggataagttgcaacttaagggaatgtcgtattccatgtgcaccggtaaatttaaaatagtaaaagaaatcgcagaaacccaacatggaacgatagtgataagagtacaatacgaaggcgatggttctccatgtaaaataccttttgaaataacggatttagaaaagagacatgtattgggtcgacttatcacagtcaatccaatagtcacagaaaaagactcaccagtgaatatcgaggcagaaccaccgttcggggattcatacatcatcattggtgtggaaccagggcaacttaaactgaattggttcaagaaaggatcttcgataggccagatgtttgaaactactatgagaggcgcaaagcgaatggcaattctcggtgatacagcctgggactttgggtcattaggaggtgtatttacctcaatcggtaaagcattacaccaagtttttggagcgatatatggggcagcgttttcaggtgttagctggacaatgaaaatattaatcggcgtcatcatcacatggataggcatgaactctagatcaacaagccttagcgtaagtttagtattggtgggcgtcgtaactttatatctaggggctgtagtgcaggccgactcgggatgcgttgtgtcatggaaaaataaagagctcaaatgtgggtcgggaatatttataactgacaatgttcatacatggacagaacaatacaaattccagcccgagtcaccgtcgaagctagcttcagctattcagaaggctcatgaagaaggcatatgtggtatcagatcagtaacaagactagagaaccttatgtggaaacaaatcacacctgaattgaatcatattttaagtgagaacgaagtaaaattgaccataatgacgggtgatatcaaaggaattatgcaagcaggaaaacgctcgcttcgtcctcaaccgacagaattaaaatatagctggaaaacatggggaaaagctaagatgttatcaactgagtcccacaatcagaccttcctgatcgatggaccagaaacggccgaatgcccaaatacaaaccgggcgtggaactcattggaagttgaagactacggattcggagtatttaccacaaatatttggttgaaactaagggaaaaacaagatgtattctgtgatagtaaattaatgtccgcagcaattaaagataatcgtgctgtacatgccgatatggggtactggatagaaagtgccttgaatgacacctggaaaatggaaaaggcctctttcattgaggtaaagtcctgtcattggccaaaaagccatactctatggtcaaacggagtgctagaatcggagatgattatacccaaaaatttcgcaggaccagtaagtcaacataattatagaccaggttatcatacacaaacggcgggtccctggcacttaggtaagctagaaatggatttcgacttttgtgaagggaccaccgttgtggtgactgaagattgcggtaatcgaggcccgagcttaaggacaactacggcatcaggaaaattaataacagaatggtgttgccgctcatgtacgttacctcctctgcgttaccgtggggaagatgggtgttggtatggtatggaaatacgacctctgaaggagaaagaagaaaacttggttaactcacttgttaccgctggccacggtcaaatagataatttttcacttggagtattaggtatggcactcttcctggaggaaatgctcaggacaaggataggaactaagcacgcgatacttttggttgcagtcagctttgtaaccctcattacaggcaatatgtcattcagggaccttggtcgcgtgatggtcatggtaggggccacaatgacagacgatatcggaatgggtgtaacctatcttgccttgctcgccgcatttaaagtaagacccacgttcgcagctggacttctcttgaggaaattaacctccaaagaattaatgatggcaacaatagggatagctttattaagccaaagtaccatacctgagactattctagagctaacagatgcacttgcattaggtatgatggttctaaagattgttcggaatatggaaaaataccaactagctgtcacaattatggctatcagttgtgtaccaaatgccgtaattctacaaaatgcgtggaaagtatcatgcactatacttgctgcagtaagtgtatcaccgttattgctaacaagctcacaacagaaagccgattggataccattagccctaactatcaaaggtctcaatcctactgcgatattccttacaacgcttagtcgtacaagcaagaaaagaagctggccattaaacgaagcaataatggctgtagggatggtatcaatattagcctcctcgttacttaagaacgatatcccaatgacaggaccgttagtagccggcggcctgttgactgtatgctatgttttaacgggtagatcagcagacctagagctcgaacgagcggcggacgtaaagtgggaagaccaagcggagatctcaggaagttctccaatattgtcaataactataagcgaagacgggtcaatgtctatcaaaaatgaagaagaagaacaaactttaactatcttaatacgtacaggtcttctagtaatttcaggtgtatttccagtaagtattccaattaccgcagccgcttggtatctatgggaagtcaagaaacagagagccggtgttttatgggacgtgccaagcccacctccggtagaaaaagcggaactggaagatggtgcgtacaggataaagcaaagaggaatacttggctattcgcaaattggtgctggagtatacaaagaggggacattccacactatgtggcacgttacgcgaggagctgtcctcatgcatagaggcaagcgaatcgaaccctcctgggctgatgttaagaaagatcttattagctacggtggagggtggaaattagaaggcgaatggaaggaaggcgaagaagtccaagtattagcactagaaccaggcaaaaatccgcgtgcagtacaaacaaaaccaggaatcttcaagaccaataccggaaccatcggtgccgtatctctggactttagccccggaacaagcggaagcccgatagttgaccgcaaaggcaaagtagtcgggctttacggaaatggcgtagtgacgagatcaggggcatacgtttcggcaatagcccagacagaaaaatctatagaggacaacccggaaatagaagatgatatatttagaaagaaaagacttactataatggatcttcatccgggtgcaggaaaaacgaagcgatatctcccagccatagttagggaagcgattaagagaggcttgcgaacgttaattttagcaccaacccgtgtggtcgcagcagaaatggaagaagcattgagggggttacctatcaggtatcaaacaccagcaattaaaacagaacacacaggacgagaaatagttgaccttatgtgtcatgcgacattcacaatgcggcttctcagccctgttagggttcccaactataacttaataataatggacgaagctcattttaccgacccagctagcatcgctgctcgaggatatatttcaacgcgagtcgagatgggggaggctgctggcatattcatgacagcaacacccccgggcagtagagatccctttccgcagagtaacgcaccaattatggatgaagaacgtgagatacccgaaagatcctggaacagcggacatgaatgggtgactgatttcaaagggaaaacagtctggtttgtaccaagcataaaagcgggaaacgacatagccgcgtgcctcagaaagaacggtaagaaagttattcaactaagccggaaaacgttcgatagtgaatatgtgaagacgagggcgaatgactgggattttgttgtaacaacagatatttccgagatgggtgcgaattttaaagcagaacgggtcatcgatccaaggcgatgcatgaagccagtaatactgactgatggtgaagaaagagtgatattagcaggacctatgccggttacccacagttcagctgcacagagaagaggtaggatcggacgaaatccaaagaatgaaaacgaccaatatatttatatgggggaacctttagaaaatgatgaagattgcgcacattggaaagaagcaaagatgctactagataacataaacactccagaaggaataatcccgtccatgtttgaaccagaacgcgaaaaagtggatgccatcgatggagagtatagattaaggggtgaagccagaaagacatttgtagatctaatgcgaaggggtgacttaccagtctggctagcgtataaagttgcagcagaaggaataaactatacggatagaaagtggtgctttgatggaataaagaacaaccagatattagaagaaaatatggaagtagaaatttggaccaaagaaggggaacggaagaaactaaaaccacgatggttagatgcaagaatttatagcgatccactcgctctaaaagaatttaaggaatttgccgcaggacgaaaatcacttaccctaaatttgataacagaaatggggagactgccgacttttatgacacagaaagcacgcaacgcattagacaatctagccgtattacacaccgctgaagctggagggagagcgtacaaccacgcgttaagcgaactaccagaaactttagaaacgcttttacttctgactctattggctacagtaacgggaggcattttcttatttttgatgagcggaaaaggcatcggcaaaatgacattaggcatgtgttgcattataacggctagtatcctactatggtacgcacaaatacaaccacattggatcgcagcaagcatcatactagagttctttcttatcgttttgttgatcccagaaccagaaaagcagcgaactccacaagataatcaattaacctacgtcgtaatcgcaatattgactgttgtggcggctacaatggccaacgaaatggggtttctagagaaaactaagaaagatttaggcttaggctcaataactacccaagaatcggagagtaacatattagatatagatctacgacccgcgagtgcgtggaccctttatgcagtcgccacaacatttgtcacccccatgctgcggcactcaatagaaaattcatccgtaaatgtatcgttgacagcaattgcaaatcaagctacggtccttatgggcttgggaaaaggatggcccttatccaaaatggatatcggagtacctcttctcgctattgggtgctatagccaagtaaaccccattacgttaacggcggcactgctgctcctagtagcacattatgcaatcattggccccggtttacaagcaaaagcaacacgagaagcacaaaaacgagcggccgctggcataatgaagaatccaactgtagacggtatcactgtgattgatcttgaaccaataccctatgacccaaagttcgaaaaacaattggggcaagttatgttattaatattgtgcgtgacgcaagtccttatgatgaggacgacatgggcactttgcgaagcactaacattagctaccggtcctatatctacattatgggaaggaaacccgggacgattttggaatacgaccatcgctgtatccatggcaaatattttcagaggatcatatttagctggagcaggcttattattttcgatcatgaaaaatacgacaagtacacgaagaggtactggtaatattggcgaaactttgggagagaagtggaaaagtcgactaaatgcattaggaaaatccgaatttcaaatatataagaaaagcggcattcaagaagttgataggacactggcgaaagaaggcatcaagaggggagaaactgatcaccacgcagtatctaggggtagtgcaaaacttaggtggtttgtagaacgaaatatggtaacccctgaaggcaaggttgtcgatctgggatgcggaagagggggctggtcgtattactgtgggggcttgaaaaatgtcagggaagtaaaaggattaactaaaggcggtccaggacatgaggagcctattcccatgtcgacatatggatggaatctagtgcgacttcaatctggtgttgacgtattctttactccaccagagaaatgcgacacgttactttgtgatatcggcgaatcctcgcccaatccaacaatagaggcaggtcgtacgcttagagttctaaacctcgtagaaaattggttaaataataacacccaattttgcattaaagtattaaacccctatatgccatcagtaatagagaaaatggaggctctacaaagacaatatggtggggcgctagtcagaaatcctcttagccgcaattctacgcacgaaatgtactgggtgtcgaacgcaacaggtaatatagtctcaagcgtaaatatgatatcacgaatgttaattaacagattcacaatgaagcataagaaagcaacctatgaaccggacgtagatttaggtagcgggacaaggaatataggcatagaatccgagataccaaatttagatatcattggaaagagaattgagaaaataaaacaagagcatgagatttcttggcattatgatcaggatcatccatataaaacgtgggcgtatcatgggtcctatgaaacaaagcaaacaggttcggcatcctcgatggtaaatggagtggtgagattattaaccaaaccatgggacgtagttccaatggttacacaaatggctatgacagacacaacaccattcggtcaacagcgtgtttttaaagaaaaagttgatacgcgaacacaggagcctaaagaaggcacaaagaagttaatgaaaataactgctgaatggttgtggaaagagttaggcaagaagaaaacacccaggatgtgcacaagagaggaatttacacgaaaagttcgatctaacgcagcgttaggagcaatatttactgacgagaataaatggaagtctgctcgtgaagcagttgaggatgggagattctgggagttagtagatagggaacgtaatttacatctagaaggcaagtgcgaaacctgtgtatacaacatgatgggtaaacgagaaaagaaactcggagagtttggcaaagctaaggggagccgtgccatatggtatatgtggttaggtgcccgctttttagaatttgaggcgctgggcttccttaacgaggatcattggttcagtagaggtaattctctatctggagtagaaggtgaaggcctgcacaggttaggatacatattacgtgatgttggcaagaaagagggcggagctatgtacgctgatgatactgctggatgggacacgagaataacactggaagatcttaaaaatgaagaaatggtaacgaaccacatgaagggtgaacacaaaaagttagcagaagcgatctttaaactaacataccaaaacaaagtagtaagagtacaaagacctactccacgcggaacggttatggacattatatcgcgccgagatcaaagggggagtggacaagtaggaacatatggactaaatacctttacaaatatggaagcgcagttaatacgacaaatggaaggtgagggaatattcaaatcaattcaacatcttacagcaactgaagagattgcagtacaaaattggttagctagagtcggaagagaaagattatctcgaatggctattagcggtgacgactgtgtcgtaaaaccgatagatgatagattcgcatccgccttaacagcattgaatgatatggggaaagtgcgaaaagacatacaacagtgggaaccgtcgcgaggatggaacgattggacccaagtccctttctgttcacatcattttcacgagctagttatgaaagacggtagggtattagtagtaccatgtcgtaatcaagacgaactaattgggagagcacgaataagtcagggagcgggatggtcattaaaagaaacggcatgcctaggaaaaagctatgcacaaatgtggaccttgatgtattttcatcggagagacttacgtcttgcagcaaatgcgatatgttcagcagtacctagtcactgggttccaacctcccgtactacatggtctatacatgcaaagcatgagtggatgaccacggaagatatgttggcagtatggaacagggtgtggattcaagagaacccttggatggaagataaaacccccgtagaatcatgggaagaagttccttatcttggtaaaagagaagatcaatggtgtggcagcttgattggactcacttcaagggcgacatgggctaaaaatatacagacagcgattaaccaggtaagatcactcatagggaacgaagaatatacagattacatgccatctatgaaacgtttccgaagggaggaagaagaagcaggagttttatggtaa

SEQ ID NO: 22372 - RNA, 9876 nt, synthetic construct
  misc_feature 1..9876: note = derived and/or modified CDS sequence (opt6) from DENV-2__FJ373300__SS-prME
  source 1..9876: mol_type = other RNA
acggccggggtcatagtcatgctaattcctacagcaatggcgtttcatttaacgaccaggaatggtgaacctcacatgattgttggacgacaagaaaaaggtaaatcactattattcaaaacagaagacggagtaaatatgtgtacactcatggcaatcgatctgggtgaattatgtgaagacaccatcacatacaaatgcccattgttaagacaaaatgaaccagaagatattgattgttggtgtaatagcaccagcacctgggtcacatatggaacatgtactacgacaggtgaacaccgtagggagaaaaggtccgttgctttagttccacatgtcgggatgggattagaaacaaggacagaaacatggatgtctagcgaaggagcttggaaacacgttcaaaggatagaaacttggatactcagacaccctggattcacaataatggctgcaatattggcttacaccataggtactacgcattttcaaagggctctaattttcatcctgctaactgctgttgctccaagcatgactatgcgttgtatcggaataagcaacagggatttcgtggaaggggtcagtggaggaagttgggtcgacatcgtattggaacatggaagttgcgtaacgaccatggctaaaaataaaccgactttggattttgaattgataaaaactgaagcaaaacaaccggccacacttcggaaatactgtatcgaagccaaacttaccaacacaactacagaatctcgatgtccaacacaaggggaaccttcattaaacgaagaacaagacaaacgattcatatgtaaacacagcatggttgatagaggatggggaaatggatgcgggctatttgggaaaggtggtatcgtaacatgcgcaatgtttacatgtaagaaaaacatggaaggcaaagtagttcagccggaaaacctagaatataccatagttataaccccacatagcggagaagaacatgcggttggtaatgatacaggtaaacatggaaaagaaataaaaattacaccccagtcttcaatcactgaagcagaattaactggctatggaactgtaactatggaatgcagcccaagaactggactggactttaatgagatggtccttctgcagatggaagataaagcatggttagtccataggcaatggtttctagatttacccctaccatggttacctggggctgacacacaaggcagcaattggattcaaaaagaaacactcgtaacttttaaaaatccacacgctaagaaacaagatgttgtagtgctgggttcacaggaaggagctatgcacacggcgttaacgggtgcaacagaaatacagatgagttcagggaatttattatttaccggacatttaaaatgtaggctacgtatggacaaactacagttaaaaggcatgagttatagcatgtgcacagggaagtttaagatagtgaaagaaatcgctgagactcaacatgggactattgtcataagagtgcaatatgagggcgatggatcaccatgtaagataccgtttgaaattacagatctagagaaacggcatgtactgggaagattaattacagtaaatcctattgtgactgagaaggattcgcccgttaacattgaagccgagcctccattcggtgacagttacattataattggagtcgaaccaggacaattaaaactaaattggtttaagaaaggtagttcaataggacaaatgttcgaaacaacaatgcgtggagcaaagcgtatggccatactaggggacactgcatgggattttggctcgctaggtggagttttcacctcaattggtaaggcactacatcaagtattcggcgcgatttatggggctgcgttcagcggggtttcctggacgatgaagatattaataggagttatcataacatggattggtatgaactcaagaagtacgtccttatcagtcagcctagtgctagttggagtagtaacactttatttaggcgctgtagtacaagcagatagcggctgcgtagtatcttggaagaataaagagctaaaatgcggaagcggaatttttataacagataacgtccacacctggacagaacaatacaagtttcagcccgaaagtccatccaaattggcttccgcgattcaaaaagcgcatgaggaaggtatctgtggtataagaagcgtcacgcgactggagaatttaatgtggaagcaaattacgcctgaattaaaccacatcctctccgaaaacgaagttaaattaacaattatgaccggggatattaaaggaactatgcaagcagggaaaagatccctcagaccacaaccgacagaactaaaatattcttggaaaacttgggggaaagctaaaatgttgtctactgaaagccataatcaaacatttttgatagatgggcccgaaactgctgaatgcccaaatactaatcgagcatggaatagcttagaggttgaagattacggatttggagtttttacaaccaatatatggcttaaattaagagaaaaacaagatgttttctgcgattctaaattaatgtctgcggcaataaaggacaaccgagcagtacatgccgatatggggtactggattgaatccgcgttaaatgacacatggaaaatggaaaaagcctcttttattgaagtaaagagttgtcattggccaaagtctcacaccctttggtctaatggagtcttagaaagcgagatgattatacccaaaaacttcgcaggaccagtatctcaacacaattatcgaccaggatatcacacacaaacagctggtccatggcacttaggaaaactggagatggactttgacttttgcgaaggcactactgttgttgtaactgaagactgcggtaatcgaggaccttcacttcgaacgacgacagcgtcgggaaaattaataactgaatggtgctgccggagctgtaccttaccgcccctgcgatatagaggcgaagatggttgttggtacgggatggaaatacgacctttaaaagaaaaagaagaaaaccttgtcaattcattagttaccgcaggtcatggtcaaatcgacaatttttctttaggcgtattaggcatggcattatttttagaggagatgttacggacacgtattggaactaaacacgcaattttactggtagcagtctcttttgtgacattaattaccggtaatatgagcttcagagatttaggcagagtaatggtaatggtaggtgctaccatgactgatgacattggaatgggagtcacatacttggcattattagctgctttcaaggtcagaccaacttttgcagctgggttattgctacggaagttaacatccaaagaactcatgatggcaactattgggatcgcgcttttaagccagtcaactatccccgaaactatcctagaactaacagatgcactagctttgggtatgatggttctcaaaatagtacgcaatatggaaaaatatcagctggcagtgacaatcatggcaattagttgtgtacctaacgcagttattcttcaaaacgcatggaaagtttcatgtacagtattagcagcggtttcagtatcaccattattactaacgagcagtcaacaaaaagcagattggataccattggcactaacaattaaaggtcttaatccaactgcaatatttttaacgactctctctaggacatcgaagaagagaagttggcctctaaacgaggccattatggcagtaggaatggtttcaattttagcatcttcactattgaaaaacgacattcctatgactggaccattagtagcgggcggacttctaaccgtatgctacgtgcttacgggtcgatcagcagatctggaattagaaagagcagccgatgtaaaatgggaagaccaagctgaaattagcggatctagtcctatcttatcaattactatatctgaagatggatcgatgtcaatcaaaaatgaagaagaagaacaaactctaacaattctaattagaacaggactattagttattagcggtgtctttcccgtaagtatccccataacggcagctgcttggtacctctgggaggttaagaaacaacgagcgggtgtcctctgggacgtaccaagcccaccaccagtagaaaaagccgagttagaagacggagcgtatagaatcaaacaacgaggaatcctaggttattcccagataggggccggcgtatataaagaaggaacttttcatacgatgtggcatgttacacgtggcgcagtactgatgcataggggaaaacgaattgaaccaagttgggcggacgtgaagaaagacctcatctcatatggcggtgggtggaaattagaaggtgagtggaaagagggagaggaggttcaggtcctcgcactagagccgggcaaaaatccacgagcagtacaaactaaacccggaatttttaaaacaaatacaggtacaataggcgcggtctctttagactttagtcctggaacaagtgggtctccaatagtagatagaaaaggtaaagtagttggtctatacggaaacggcgtcgttactagatctggggcctatgtgagcgccatagcacaaacggagaagtctattgaagacaacccagagatagaagacgatatatttaggaaaaagagattaacgatcatggatctacaccctggcgctggaaaaacgaaaagatacctgccggcaatagtccgagaggcaattaaacgggggcttagaactttgatactggctccaactagggtcgtagccgcagagatggaagaagcactacgaggtcttccaataaggtatcaaactccagctataaagacagaacatacaggacgggaaatcgttgatcttatgtgccatgcaactttcactatgaggttactaagccctgtacgagttccgaattataacctgattattatggacgaagctcattttacagatccagcaagtatcgctgccagaggctatatttcgacaagagtcgagatgggcgaagccgctggtatttttatgacagccactccgccaggttcaagagatccatttcctcaatccaatgcgcctataatggatgaggaacgagaaatcccagagagatcctggaactccgggcacgagtgggttacagacttcaaaggaaaaacagtatggtttgtaccaagtataaaagcggggaatgacatcgcggcctgtctgaggaaaaatggtaaaaaggtaatacaattgtcaagaaagacgtttgatagcgagtatgtgaaaactcgagcaaatgattgggatttcgtcgtaacaacagacatttcagagatgggggcaaattttaaagcagaacgcgtaatcgatccaagaagatgtatgaaacctgtcatattaaccgacggagaagaacgggtaattctggctgggcctatgcctgttacgcattcctctgcagctcaaagaaggggtaggatcggcaggaatcctaaaaatgaaaatgaccaatatatttatatgggggaaccactagaaaacgatgaagattgtgcacactggaaagaagcgaaaatgcttttagacaatataaatacaccagaaggaataataccaagtatgtttgagcctgaacgagaaaaagttgatgcaattgatggagaatataggttacgtggagaagcaagaaaaacatttgttgatctcatgcgaagaggggatttaccagtatggttagcttacaaagtagccgctgaaggtataaattatgcagatcgaaaatggtgtttcgatggcattaaaaacaaccaaatcctagaagagaatatggaagttgaaatttggactaaagagggagaacgtaagaaactaaaaccaagatggctagatgcacgaatatactccgacccccttgctctaaaagagtttaaagagttcgccgcaggtagaaaaagtttaactctaaatctaataacagaaatgggcaggttgccaacttttatgacacaaaaagcaagaaacgcgctcgataatttggcggtcttacatactgccgaagctggcggtagggcttataatcatgcgctatctgaattacccgaaaccctcgaaaccttactgttattgactcttttggcgacagtgacaggtggtatctttctattcttaatgtctggtaagggaatcggcaaaatgacacttgggatgtgctgtattattacagcgtcaatattactatggtatgcccaaattcaacctcactggatagcagcttccataatcttagagttctttttaatcgttttactgattccagaacctgaaaagcaaagaaccccacaggataaccaattaacatatgtcgtaattgccatcctaacggttgttgctgccacgatggcaaatgaaatgggtttcttagagaagacgaaaaaggatctcggattagggtcaattacaactcaagagagcgaatctaatattttagatattgatctacgtcctgcatctgcctggacattatatgcggttgctaccacttttgtcacaccgatgctacggcattcaatagaaaattcaagcgttaatgtgtctttaacggcgattgcaaatcaggcaactgttctcatgggtctagggaaaggatggccgcttagcaagatggacattggtgtacccctattagctattggctgctattcacaagtaaacccgataacattaacagctgcactactacttttagtcgcacactatgccattataggcccaggactccaggctaaggctacccgtgaggcccagaaaagagcggcagccggaataatgaaaaatccaaccgtagatggtattacagttattgatctagaaccaattccatatgatccaaaatttgaaaaacaattaggtcaagttatgctcttaattctatgcgtcacacaggtattgatgatgcgaactacttgggcactttgcgaagccttaacgttagcaacgggaccgatctctactctctgggaagggaaccccggaagattctggaatacgactatagcagttagtatggctaatatattcagaggatcgtatcttgcaggagcaggcctattgttttcaattatgaaaaacacaacttctacaagacgaggcactggtaacatcggagaaaccttaggagaaaaatggaaatcgcgtttgaatgcactcggtaagtccgagtttcaaatatacaagaagtccgggatacaagaagttgatcggacattagcaaaagaaggcataaaacgtggtgaaacagaccatcatgccgtatcgagaggttctgcaaaattaagatggtttgtggaacgaaatatggttacaccggaaggaaaagtagttgacttagggtgcggtcgtggagggtggtcttattattgtggaggtctaaagaatgtccgtgaagtaaaaggcttgaccaaaggagggccaggacatgaagaacccataccaatgtctacatatggatggaacctagtaaggttacaaagtggagtggatgtattctttactccaccagaaaaatgcgacactctattgtgcgacataggagaatcgtcaccaaatcccacgatagaagcggggcgaacattaagagtattaaacctagtagagaactggctgaacaacaatacacaattttgcattaaggtactaaatccttatatgccgtctgtgatcgagaaaatggaggctttacagagacaatacggaggagctttagtcaggaatccactttctagaaactccactcatgagatgtattgggtctcaaacgcaactggcaacatagtgtcctccgttaatatgatctcaagaatgctaattaaccgatttacaatgaaacataagaaagcaacctatgaacccgatgttgaccttggcagtggtacgagaaatattgggatagagtcagaaattccaaacctggatataattgggaaacgaatagagaaaataaagcaggaacatgaaatatcgtggcactacgaccaagaccatccgtataagacatgggcttaccacggaagctacgagaccaaacaaactggatccgcatccagtatggtcaatggcgtagtgcgtttattaactaaaccgtgggatgtcgtgcccatggtaactcagatggccatgactgacactactccatttgggcagcaaagagtattcaaagaaaaggttgatacacgaacacaagaaccgaaagaagggactaagaaattgatgaaaatcaccgccgaatggttgtggaaagaacttggtaagaagaaaaccccacgcatgtgcactcgtgaagagttcaccaaaaaggttagaagtaatgcagccctgggagcaattttcacagatgaaaataaatggaaaagcgcaagagaagcagtagaagacgggagattctgggaattagtagatcgcgaaagaaatttacacctcgaggggaagtgtgagacttgtgtatacaatatgatggggaagagagagaagaaattaggggaatttggtaaggcaaagggttctagagctatatggtatatgtggcttggggctcgtttcttagagttcgaggcattgggcttcctgaacgaagaccattggtttagcagagggaacagtctgagcggagtcgaaggtgaaggactacacagactaggatacatacttagagacgtaggcaagaaagaaggaggagctatgtatgctgacgatactgctgggtgggatacacgaataacactagaagacctcaaaaacgaagagatggttacgaatcacatgaaaggagaacataagaaattagccgaagctatattcaaacttacttaccaaaataaggtagtccgtgtacaacgtccaaccccgcgaggaactgtgatggacataatctcaagaagagaccaacggggaagcggacaagttggaacttatggccttaatacatttacgaatatggaggcccaactaataagacaaatggaaggtgaaggaatattcaaaagtatccaacatttgacagctaccgaggaaatagctgtgcaaaactggctagcacgcgtaggaagagaaaggttatctcgaatggccatttctggagacgattgtgtggtcaaacctatagatgatagatttgcgagcgctcttactgctttaaacgatatgggtaaagtgagaaaagatatccaacaatgggaaccgagccgtgggtggaacgactggacacaagttcccttttgcagtcaccactttcatgaattggttatgaaagatggacgtgttctcgtagtgccgtgtaggaaccaagacgaactcattggacgagcccgaatatcacaaggtgccggctggtcactaaaggaaacagcgtgtttgggtaaatcgtacgctcaaatgtggactctgatgtattttcatcgacgagatcttaggctagctgcaaatgcaatatgcagtgctgtccccagtcactgggtcccaacatccaggactacctggtcgatccacgctaagcatgaatggatgactactgaagatatgctagccgtctggaacagggtctggatccaggagaatccgtggatggaagacaagacacccgtagagtcgtgggaagaagttccatatcttgggaaacgagaggatcaatggtgtggctcactaatcggattgacttcaagggccacatgggccaagaatatacagacagctataaatcaagtgagatcactaataggcaatgaagaatacacagactacatgccctcaatgaaacgtttccgcagagaggaagaagaggcaggagtcctttggtaa

SEQ ID NO: 22373 - RNA, 9876 nt, synthetic construct
  misc_feature 1..9876: note = derived and/or modified CDS sequence (opt6) from DENV-2__EU596495__SS-prME
  source 1..9876: mol_type = other RNA
accgctggggtaattgtgatgcttattccgaccgctatggctttccatttaacaactagaaatggggaacctcatatgattgtaggacgtcaagagaaaggtaaatcgttattattcaaaacagaagatggagttaatatgtgcacgctaatggctatagacctaggagaattatgcgaagatacaataacttataaatgtccattacttaggcagaacgaaccagaagatatcgattgttggtgcaactcaacctcaacatgggttacctatggaacctgcacaacaacgggagaacaccgcagagaaaaaagatcagttgcgctagtaccacacgtcggaatgggactagaaacccgtacagaaacttggatgtcatcggagggagcttggaagcacgtacaaaggatagaaacctggatccttagacacccggggtttaccattatggccgcaattttggcctatacaattggtacaacacactttcaacgagctctaattttcatccttttaaccgctgttgcaccgtctatgaccatgcgttgtataggaattagtaaccgggacttcgtagagggagtaagtggtggttcatgggtcgatatagtactagagcacggatcatgtgtgacaacgatggcaaaaaacaaaccaacattagattttgaactaatcaaaacagaggcgaaacaacccgctacccttagaaaatattgtatagaagctaaactgacaaacacgaccacagagagtaggtgtccaacccaaggagaacccagtttgaacgaagagcaagataagaggtttatttgcaaacactcaatggtagatagaggatggggtaatgggtgtggactattcggaaagggaggaatagtaacatgcgctatgttcacgtgtaaaaaaaacatggaaggtaaagttgttcagccagaaaacttagaatatacgatagtaataactccccatagtggggaagaacatgcagtaggaaacgataccggaaaacacggaaaagagattaagattacgcctcaaagtagcataacagaggcggagttaacgggctatggaactgtcactatggaatgcagtcctcgaactggactagatttcaatgaaatggtactactacagatggaagacaaagcctggttggtacatcgacaatggtttcttgatttaccgctcccatggctaccaggagctgacactcagggatcaaactggatacaaaaagagactttggtaacttttaagaatcctcacgcgaaaaaacaagacgtagtagtactcggatcccaagaaggagcgatgcatacagcattaacaggtgcaaccgaaatccaaatgtcgagcggtaatttgctatttacgggtcatctgaaatgccggttaagaatggacaaactacaactaaaaggtatgtcctactccatgtgtacaggtaaatttaaaatagtaaaagagattgcagagacccaacatggaacaatagtaattagagttcaatatgaaggggacgggagcccatgtaaaatcccattcgagattacagacctggaaaaacgacacgtcttaggaaggttgattactgtgaatcctatagttactggaaaggactctccagtcaatatcgaagcagagcctccatttggggatagttacattataataggtgtagaaccagggcaattaaagttgaattggttcaaaaaaggttcaagtattggacaaatgtttgaaacaactatgcgaggtgcaaaacggatggccatactcggagataccgcttgggactttggttctcttggcggagtattcaccagtataggaaaggcactacaccaggtctttggagcaatttacggcgcagcctttagtggtgtttcatggactatgaaaattcttataggagttattataacttggataggaatgaactcgcgatcaacatcattatcagtatcattagtactagtaggagtagtaactttatatttaggagcagtagtacaggccgactcaggatgtgtagtctcttggaaaaataaagaattgaaatgtggatcaggtatatttatcacagacaatgtgcatacttggacagaacagtataaatttcagcccgaatccccgtcaaaactagcatcagctatacagaaagctcacgaagaaggaatttgtggtataaggagtgtcaccagactagagaacttgatgtggaaacagatcaccccggaattaaatcatattctgagtgaaaacgaagtaaaactaacgattatgaccggggacattaaaggtatcatgcaagctggaaaaagatccctacgaccacaaccaacagagttaaaatactcatggaaaacatggggaaaagctaaaatgctaagcactgaatcacataaccaaacatttctcatagacggtcccgaaacagcggaatgccctaatacaaaccgtgcttggaatagtctcgaagtggaagattatggctttggagtatttactacaaacatttggttaaaacttcgagaaaaacaagacgtattctgtgactcaaaattgatgagtgccgccataaaagacaacagagccgttcatgcagatatgggatattggattgagagcgcattgaacgatacctggaaaatggaaaaggcctctttcatagaagttaaatcatgccattggcctaaatcacatacactctggtcaaatggggtcttagagagcgaaatgattataccgaaaaactttgcgggcccagtatcacaacataactaccgacccggatatcatacacaaacggcagggccctggcacttaggcaaattagaaatggacttcgatttttgcgagggaacaacggtcgttgtcacagaagattgcgggaatagaggacccagcttgagaactacaaccgcaagcgggaagttaataacagaatggtgctgtagatcctgtacgctcccgccactaagatatcgtggagaagatgggtgctggtacggtatggagatccgcccccttaaagaaaaagaagagaaccttgtaaacagtcttgtgaccgcagggcacggtcagatagataatttcagcctcggggttctaggcatggcactttttttagaagaaatgctccggacaagaattggtacaaagcatgcaatcctattagtcgccgtgtcattcgtaactcttattacgggcaacatgtcattcagagatttaggtagagtaatggtaatggtaggagctactatgacagatgatatcgggatgggggttacgtacttggctcttctggccgcattcaaagtcagacctacattcgcggcaggcttactattacgaaaacttacgtccaaagaattaatgatggcaactataggtattgcgttgctaagtcagagcacaatacccgaaaccatattagaattaacagacgcattggcattgggtatgatggtcttaaaaatagtcaggaatatggagaaatatcaattagctgtaacaattatggctataagctgcgtaccaaacgctgtgatattacaaaatgcctggaaagttagttgcactattctggctgcggttagcgtatctccgctattattgacatcctcccaacagaaagcggattggattccattagcactaacgataaaaggtctgaatcccactgcaatttttctgaccactctatccagaactagtaagaaaagatcctggccactaaatgaagccattatggcggtcggaatggtttcaattttggcgtcctcactattaaaaaacgatatccctatgacggggccattggttgctggtggcctcctaacggtgtgctatgttttgaccggaagaagcgccgacttagaattagagcgagcggcagatgtgaagtgggaagatcaagcggaaatatcagggtcatcgcctatcctatcaattacaatatctgaagatgggtcaatgagcattaaaaacgaagaagaggaacaaactttgacaatattaatcagaaccgggctcctagtaatcagtggcgtgttcccagtttcgataccaataacggcagccgcatggtacctatgggaagttaaaaaacaaagagcaggggtcctctgggatgtcccgagcccacctccagtagagaaggcagaattagaagacggagcatatcgtataaagcaacggggcatattgggctactcgcagattggagccggagtatacaaagagggaactttccacacgatgtggcatgtaacacgcggagcagtgttaatgcatagaggtaaaagaatagaaccttcctgggcagatgtaaaaaaagatctcatatcctatggtgggggctggaaattggaaggtgaatggaaggagggtgaagaggtccaagtattggctttagaacctggcaagaacccgagagcggtccaaacaaagccaggaatattcaaaacaaatacgggcactataggcgccgtgtctctagattttagtccagggacaagtggttcgcccatagtagaccggaagggcaaggtcgtagggctttacggaaatggtgttgtcacgaggagcggagcctacgtaagtgctattgcgcaaaccgaaaaatcgattgaggacaacccagaaattgaagacgacatatttagaaaaaaaagactaactattatggatctgcatccaggtgcagggaagacaaaaagatacttacccgcaatagtgagagaagcaataaaacgtgggttacggacgttaatactcgcgccgacgagagtagtagcagccgaaatggaggaagcactacggggtctaccgatccgttatcaaactccagcaataaaaacagaacatacaggaagagaaatagtagaccttatgtgtcacgccacttttacgatgcgacttctgtccccagttagagtaccaaattacaatcttataattatggatgaagctcatttcactgatcccgcaagcatcgcagcgagaggttatatttcgacgagggttgaaatgggagaagccgcaggcatttttatgacagctactcctcctggtagcagagatccattccctcaatctaacgctccaataatggatgaagagagagagataccagagaggtcttggaattcaggacacgagtgggtgactgactttaaagggaagaccgtatggttcgtaccttctataaaggcgggtaatgatatcgcagcatgtttacgaaaaaacggaaagaaggtcatacaattatcgagaaaaacctttgactccgagtatgtaaaaaccagggcaaacgactgggacttcgtcgtaacgactgacataagcgagatgggtgcaaactttaaggctgaaagagtgatagacccaaggagatgcatgaaacctgtgatactgacagacggagaggaaagggtaatactcgcaggacccatgcccgttacacattcatcagcagctcaaagaagaggcaggattggacggaatcctaaaaacgaaaacgatcaatacatatacatgggcgaaccgctggaaaatgacgaagactgcgcccattggaaagaagctaagatgcttctagacaacataaataccccagaagggattataccaagtatgttcgagccagagcgtgaaaaagttgacgcaattgacggtgaataccgtctaagaggtgaagcacggaaaacttttgtcgacctcatgagaaggggcgacttacccgtatggttagcatacaaagtagcggcagaagggataaattacgctgatcgtaaatggtgttttgacggcataaaaaataatcaaatcctcgaagaaaacatggaagtcgaaatatggactaaagaaggtgaaagaaaaaaactaaagcctaggtggttagacgctaggatatattcagacccactagctttaaaagaattcaaagaatttgcagcgggacgcaaaagtttgactctcaacttaataaccgaaatggggcgtttacccacatttatgacacaaaaagcaagaaacgctctggataatttggcagtgctgcatacggctgaagcagggggtagagcatataatcacgctctaagcgaattacctgaaactctagaaacactactgcttctaacactattagcgaccgttacaggtggaatatttttgtttctaatgtctgggaaagggatcggcaaaatgacattaggtatgtgttgcataataacagcatcgatcttactttggtatgctcaaatacagccacattggatcgctgcctcgataatcctagaattcttcctcatagtactactcattcctgagccagaaaaacaacgaacaccacaggataatcaactaacgtatgttgtaatagcaattctaactgttgttgccgcaacaatggccaatgaaatgggattcttggagaaaacaaaaaaggatttaggattgggctcgataactactcaggagtcagaatcaaatatactggatatagatttacgaccagcatcagcttggacactttatgcagtcgcgactacctttgtaacaccaatgcttagacattcaattgaaaactcttcggtaaatgtgagccttacggcgattgcaaaccaagctactgttctaatggggctcggtaagggatggcccttatcaaaaatggatataggagtacctttactagcaataggatgttatagccaagtgaatccaataaccctaactgcagccttactactgctagtggctcactatgcaataataggaccgggtttgcaggctaaagcaacccgcgaggcacaaaagagagccgctgctggaattatgaaaaatccgacagtggatgggatcacagttattgatctagaaccaatcccatacgatcctaaattcgaaaagcaattagggcaagttatgctccttattttgtgcgtaacacaagtcctcatgatgagaactacctgggcattatgtgaagcgctaacgttagctacaggtcctataagcactttatgggaaggaaacccgggccgattttggaacactaccatagccgtctctatggcaaatattttccgaggatcttatttagctggagcagggctattgttcagtataatgaaaaatacaacatcaacgagaaggggcacgggaaacataggcgaaacattaggggaaaaatggaaatcaagattaaacgcattggggaaaagtgagttccagatatataagaaaagcggaatccaagaagtagacaggacactagcgaaagaaggcattaaacgtggggaaacagaccatcatgctgtctcgcgtggaagcgccaagctacgttggttcgtagaaaggaatatggtcacgccagagggaaaagtagttgatctcgggtgtggaagaggtggatggtcttactattgtggaggattgaaaaatgtaagagaagtgaaaggtttaactaaaggtggtcctggccatgaagaacctataccaatgtcaacatatggctggaacctcgtacgactacaatcaggtgtcgatgtatttttcacgccccctgaaaaatgcgatacactactatgtgacattggcgaaagttcacctaaccctacaatagaagctggaagaacattaagggttttgaacctagttgagaattggttaaacaacaatacacaattttgtattaaggtgctaaatccctacatgccaagtgtaatcgaaaagatggaggcattacaaaggcagtacggtggtgccctcgtcagaaaccctttatctcggaacagtacccacgaaatgtattgggtaagcaatgcaaccggtaatatagttagtagtgttaacatgatcagtcgcatgttaataaacagatttacgatgaaacacaaaaaggcaacatatgaacccgacgttgacctcggctccggcacaagaaacatcggtatagaatcggaaataccgaacttagacattattggtaagcggattgaaaaaataaaacaagaacatgaaatctcatggcattacgaccaagatcatccatataagacatgggcctatcatggatcttatgaaacaaagcaaactggatcagcgtcctctatggttaacggagtagtaagattgttgacaaaaccatgggacgttgtgccaatggtaacccagatggcaatgaccgatacaacaccctttggccaacaaagggtgttcaaagaaaaagtagacactcgaacacaagaaccaaaagaaggtacaaaaaagcttatgaaaatcactgcagagtggttatggaaggaattaggtaaaaaaaaaacgcctagaatgtgcactcgggaagaatttacaaaaaaagtgcgcagtaatgcagcgcttggcgcaatatttactgatgaaaataagtggaaaagtgcgagagaagcggtggaggatggaaggttttgggaattagtagatcgggagagaaacttacacctggaagggaagtgtgaaacatgtgtctataatatgatggggaagagagaaaaaaaactgggagaatttggtaaggccaaaggatcaagagcaatttggtacatgtggttaggcgctcggtttctcgaattcgaagctttaggctttttaaatgaagaccactggttcagccgcggtaatagtctatccggagtagaaggtgaaggcctgcaccgactaggttatatacttagggatgtggggaagaaagagggtggtgctatgtacgctgacgatactgcgggatgggatacaagaatcaccctggaggacttaaaaaacgaagagatggtaacaaaccacatgaaaggagaacataaaaaactagcagaagctatttttaagctaacttatcaaaataaagttgtgagagttcaacgaccaacacccagaggtactgtgatggacatcatttcgaggagggatcagaggggatccgggcaggtaggaacctatggtttaaatacattcacaaatatggaggcgcaattaataaggcaaatggaaggtgaaggcatcttcaaatcaattcaacacttgaccgcaaccgaagagattgcagtccaaaattggctagcacgagtagggcgggaaagattatcgagaatggcaattagtggggatgattgcgtagtaaagcccatagacgatagattcgcatctgcattgaccgcactaaacgatatgggtaaagtcagaaaagacattcaacaatgggaacctagcagaggctggaacgactggacgcaagtccctttttgctcacatcattttcacgagcttgtcatgaaagatggacgtgttctcgtggtaccatgtagaaatcaagacgaactcataggccgagcaagaatatctcaaggagctggctggtcgttgaaggaaactgcctgcttagggaagtcctatgcacaaatgtggaccttaatgtactttcacaggagggacttgagattggcggcaaatgctatttgcagcgcagtaccgtctcattgggtgccaacatcacgcaccacatggtcaatacatgccaagcacgaatggatgacaacggaagatatgttagctgtatggaatagagtatggattcaagagaatccgtggatggaagataaaacacctgtcgagtcgtgggaagaggtcccatatctcggtaagcgtgaggaccaatggtgtggctcactaatcggtctaacgtcgagggcgacatgggctaagaatatacagacggcgataaatcaagttcgatctcttattggcaatgaagagtatactgattatatgcctagtatgaagaggttccgaagagaagaagaagaggcaggtgtattatggtaa

SEQ ID NO: 22374 - RNA, 9876 nt, synthetic construct
  misc_feature 1..9876: note = derived and/or modified CDS sequence (opt6) from DENV-2__EU596497__SS-prME
  source 1..9876: mol_type = other RNA
actgctggagttatagttatgctgataccgaccgcaatggcctttcatttaacaacaaggaacggagaaccacacatgattgttggtagacaggagaaaggaaagtctttgctattcaaaacagaagatggagtcaacatgtgtacgttgatggcaatcgacttaggagagctgtgtgaagacacaataacttataaatgcccactattaagacaaaacgaaccggaagacatcgactgttggtgtaactcaacttcaacatgggtgacttacggaacttgcacaactacgggcgagcataggagagaaaaacgtagtgtcgctctggtcccgcatgtgggaatggggctagaaacgcggactgaaacatggatgtcctccgagggtgcatggaagcatgtacaacgaattgaaacatggatcctccgtcatccagggtttaccattatggctgcaattcttgcatacaccataggaacaacacattttcaacgcgcactcatatttatcctactaaccgcagtcgctccaagtatgacaatgagatgtattggcatctctaatcgcgatttcgtagagggtgtgagcggaggatcttgggtagacatcgtacttgaacacggctcatgcgtcacaacaatggctaaaaataaaccgacgctggacttcgaattgataaaaactgaagcaaagcaacccgctacactcaggaaatattgtattgaagcaaagttgacaaatacaattaccgaaagccgatgtcctacacaaggagagcctagcttaaacgaagaacaagataagcgcttcatatgcaaacattcaatggtcgatcggggatggggtaacggatgtggcctcttcggcaaagggggcatcgtaacatgtgcgatgtttacctgcaaaaaaaacatggaaggcaaggtagtccagccagaaaatctagagtataccatagtcataacaccacatagcggtgaagaacacgcagtcggcaatgacaccggaaaacatgggaaagaaataaaaatcactccacagagctctataactgaagctgaactaaccggatatggaactgtcacaatggagtgtagcccaagaacaggacttgactttaatgagatggtcctccttcaaatggaagataaagcttggctagttcaccggcaatggttcttggaccttcctctcccctggttacccggtgcagacacgcagggctccaattggatccagaaggaaacattagtgacgttcaaaaatccccatgcgaaaaagcaagacgtggtcgtactaggcagccaagaaggagcaatgcacaccgcactcacaggggcaacggaaatacaaatgtcatctggaaatctactcttcaccggtcatctaaaatgtcgactacggatggacaaactacagttaaaaggcatgagttacagcatgtgcacgggcaaattcaaaattgtaaaagaaatcgcagagacacaacacggaaccattgtaatacgagtacaatatgaaggagatggttctccatgcaaaataccattcgaaataacagatctcgagaagcggcatgtattgggtcgactaataaccgtaaacccaattgttacagaaaaagattcgcctgttaacatagaagctgagcctccgttcggggatagttacataataataggtgtcgaaccaggtcaattaaaattgaattggttcaaaaagggttcgtcgataggtcagatgttcgaaactacaatgaggggagcaaagagaatggccatcttaggggacacggcatgggattttggctcacttggtggtgtatttacaagtattggcaaagcgctacatcaagtgtttggtgctatatatggcgcggcattttctggtgtttcttggacgatgaagatcttaatcggtgtaataatcacatggatcggaatgaactcgaggagtacatccctatcagtcagtttggtccttgttggagtcgtaacgctatatctaggtgcagtagtacaagccgattcaggctgcgtagtaagttggaagaataaagaactcaagtgcggctcaggcatttttataaccgataatgtacatacctggacagaacagtataaattccaacctgaatcaccatcaaagctagcaagtgcaatccaaaaagcgcacgaagaaggaatctgcggaatacgcagcgttaccagattagagaatttaatgtggaaacaaatcactccggaattaaatcacatattatcggaaaacgaggtaaaactaactatcatgactggcgatattaaggggattatgcaagcgggtaaaagatcccttcgaccacagccgacagaactcaagtactcttggaaaacatgggggaaggcgaaaatgctgagcaccgaatctcataatcagacatttttaattgacggaccagaaaccgcagaatgcccaaacacgaatagggcttggaactcacttgaagtggaagattatggtttcggtgtttttacgaccaatatttggctaaagttacgagaaaaacaagatgtattctgcgattcgaaattgatgtccgcagctataaaggacaatagagctgtacatgccgacatgggatattggattgaaagtgccttaaacgatacatggaagatggaaaaagcatctttcatcgaggtaaagtcctgtcattggccaaaaagttacacattatggagcaatggcgtattagaatcagaaatgataatccccaaaaactttgctggaccagtaagtcaacacaattacagacccggctatcatacgcaaaccgcgggaccctggcatttaggaaaactggagatggatttcgacttctgtgaaggcaccacagtggtagtcacagaagattgtggcaacagaggcccaagtctacgaactacaactgcaagtggcaaattgataacagaatggtgttgtcgtagctgtaccctccctcccttgaggtacagaggtgaagatggatgttggtatggaatggaaatcaggcctctaaaagaaaaagaagaaaatttagtaaattcgttagttacagccgggcatgggcaaattgataacttttccctcggcgtactcggtatggctcttttccttgaagaaatgctaagaacaagaataggaacaaagcacgccatattgttagttgctgtctcctttgtcacgctaatcacaggtaacatgtcgtttcgtgatcttggtagggtcatggttatggtaggggcaacaatgacagacgatatcggcatgggcgtaacttatttggcattattggctgccttcaaagtaagacctactttcgctgcaggtctactcttacgaaaactaacaagtaaggaactcatgatggccaccattggcatagcccttttatctcaatctacaataccagagacaattttagaacttactgatgccctagcacttgggatgatggttcttaaaatcgtaagaaatatggaaaaataccaattagcagtcacaattatggcgataagctgtgtgccaaacgcggttatcttacagaacgcatggaaagtgtcatgtacaatactcgcagcggtatcagtctcaccgttgttacttacctcatcgcagcaaaaagcagactggatcccattagcgctaactattaaaggtttaaatcctacggccattttcttgaccaccttaagtagaacatcaaaaaagcgatcatggcctttaaatgaagctataatggcggttggaatggtcagtatcctagccagtagtctcttgaaaaacgacatcccaatgaccggaccgctggtagctggcggattacttacagtgtgctacgtattaacaggtagatcagctgatttggagctagaaagagcagcagacgtaaaatgggaagatcaagcagaaatcagtggcagttcacccatacttagcattaccatatcggaagacggtagtatgtcgataaaaaatgaagaagaggaacaaacactaacgatactaatacgcacagggttgcttgtaatatcgggggtatttcccgttagcattccaataacggctgcggcctggtatttgtgggaggtaaaaaaacaaagggcgggagtactttgggatgtgcccagtccaccgccagttgagaaagcggagttggaagatggagcgtatcgcataaagcaacgaggaatactgggatattcacaaataggcgcaggagtatataaggaagggactttccatactatgtggcatgtgaccagaggtgctgtccttatgcacagaggaaaacggatagaaccaagttgggcagacgtaaaaaaagacttaatatcctacggtggaggctggaaattggaaggcgaatggaaagagggtgaggaggttcaagtcctagccttagaacctgggaagaaccctagagccgtccaaactaagcctggaatatttaaaacaaacactggaacaataggggcggtatcactagattttagccccggcactagcggaagtccaatcgtagatagaaaagggaaagtcgtagggctatacgggaacggagtggtcaccagatctggtgcttacgtatcggccatcgcacaaactgaaaaatcgattgaagataaccctgagatagaggatgatatctttcgaaaaaaacgcttaacaattatggatcttcatcccggggcaggaaaaacaaaacgctacctccccgctatagtaagggaagctatcaagcgtggactcagaactttaatactagctcccactagggtggtcgctgctgaaatggaagaggctttacgtggccttccaatcagatatcaaacacccgctattaaaacggaacacaccggccgtgaaattgtagacttaatgtgccatgctacattcactatgagattattgagcccagtgcgcgttccaaactacaatttgataatcatggacgaggcacactttaccgatccagctagcattgccgcgagaggatatatatcgacaagggtggaaatgggggaagcggcaggaatatttatgacggctacaccacctggtagtagagaccctttcccacaatcaaatgctccgataatggatgaagaaagggaaatcccagaacggagttggaacagtggacatgaatgggtcacagactttaaggggaagaccgtgtggtttgtaccgtcaattaaggcgggaaacgatatagcagcatgtctcaggaagaacggaaaaaaagttatacaattgagccggaaaacatttgattcggagtatgtcaagactagggcgaacgactgggactttgtagtgacaactgatatcagtgaaatgggagctaattttaaagcagaacgtgttatagaccccaggaggtgcatgaagcctgtcatactgactgatggcgaggaacgggtgatactagcaggaccgatgcctgtgacacattcatctgcagcacaaagacgaggacgcataggaagaaacccgaagaatgaaaatgaccaatatatttacatgggagaacctcttgaaaacgatgaagattgcgcacattggaaagaggcaaaaatgttgcttgacaatataaataccccagagggtattatcccgagtatgttcgagccagaaagagagaaggttgacgctatcgatggagaatatagactacgtggtgaagccagaaaaacattcgtagatttaatgaggaggggagatctaccagtatggttagcatacaaagtagcagcagaaggtataaactatgcagatagaaaatggtgttttgatggaattaaaaacaatcagatattagaagaaaacatggaagtagaaatatggaccaaagaaggcgagagaaaaaaactaaaaccacgttggctcgatgctcgaatttactcagatcccttagccttaaaagagtttaaagagttcgcagcaggccgtaaaagtctaacactgaatctaataactgagatgggtagattgcctactttcatgactcaaaaagctcgcaacgctcttgataacctagccgtgctacacacagcagaagcgggaggtcgtgcatataatcatgcactatcagaactacctgaaacattggagaccctcctactgttgacactccttgcgacagtcactggaggaatatttcttttcttaatgtcaggaaaaggaatcggtaagatgacgttagggatgtgctgcataataacagcatcaatactcctatggtacgctcaaatacagccgcactggattgctgcgagtattattttagaatttttcctaattgtccttctaatacctgaaccagagaagcagcgtacgcctcaagacaatcagctaacatacgtagttatcgcaattttgacagtagttgctgctacaatggcgaacgagatgggattcctagaaaaaacaaaaaaggatctaggattaggctctatcacaacacaagaatccgaaagcaatatattagatatcgatcttagacccgcgtcagcttggacactatacgcggtagctacaaccttcgtaacgcctatgttaagacacagtatagaaaattcgtcggtaaacgttagtttaaccgccatagcaaatcaggccacagtattgatgggattaggaaaagggtggccattatcaaaaatggatattggggtgccactgttagcaataggctgctattcacaagtgaacccgataactcttactgcagctttacttctattagttgctcactatgcaataattggtcccggactacaagcaaaagcgactcgggaagcgcaaaaaagggccgctgcaggcattatgaagaatccaacggtggacggcataacggtgatagacctagaaccaataccatacgatcccaagtttgagaagcaattaggtcaagtaatgttattaatattatgtgtaacgcaagtgctaatgatgcgaacgacatgggcattatgcgaggccctcacactagccacgggaccaatttccactctttgggaaggaaatccaggcaggttctggaatacaactatagcggtgtcaatggcaaatatttttaggggtagttatttagcaggtgctggactactgttctcaataatgaaaaacacaacttcaacaagaaggggtactggcaatatcggagaaacactaggtgaaaaatggaagtctagactaaatgcgctcggcaaatcagaatttcaaatatataagaagtcaggaattcaagaggtggacaggacacttgccaaagaaggaataaagcgtggagaaacagatcatcacgctgtatcgcgaggcagtgcaaaactcagatggtttgttgaaagaaatatggtgacaccagaaggcaaggtcgtggatctgggatgcggaagaggtggttggagttactattgcggcggtctcaagaatgtacgcgaggtcaaagggttaactaaaggcggacccggtcacgaagagccaatcccgatgtcaacttatggctggaatctagtccgtcttcagtccggcgtcgatgtattttttactcctccagaaaaatgtgacaccctcttatgtgacattggtgaaagcagcccgaacccaacgatagaagctggtcgtactcttagggtattaaatctggtggagaactggttgaataataacacacaattttgtattaaggtactaaatccatatatgccctcagtcatagaaaagatggaagcgttacaaagacaatacggaggcgccctagtacgaaatccactatctagaaatagtacacatgagatgtactgggtgtctaacgctacgggaaacatagtatcaagcgtaaatatgatatcgcgcatgcttataaatagatttactatgaaacataaaaaagcaacatatgaaccagacgtagacctaggaagcggcactagaaatatagggatagaaagtgaaattcccaatttagatattatcgggaaacgaatagaaaaaattaaacaagagcacgaaatatcttggcattacgaccaagaccacccctataaaacgtgggcatatcatggttcgtacgagacaaaacaaacaggtagcgccagtagtatggtgaatggtgtcgtcagactgcttactaagccatgggacgtagtcccgatggtcactcagatggctatgacagacacgaccccctttggacaacaacgtgtatttaaagagaaagtagacacacgcacgcaagaacccaaagaaggaactaaaaagctaatgaaaataacagcagaatggctatggaaagaattggggaaaaaaaagacaccaagaatgtgcacaagagaggaatttacaaaaaaagttaggagcaatgcagcattaggagcgattttcacggacgagaacaaatggaagtcagctagagaagcggttgaagacggcagattttgggaactcgtggatcgcgaaagaaacctacacctcgaaggtaaatgtgaaacctgcgtgtataacatgatgggaaagcgggaaaagaaattaggcgagtttggtaaagccaaaggatccagagcgatatggtacatgtggctcggggctaggtttttagaattcgaagctctggggttcttaaatgaagaccattggttctcaagaggaaacagtctatcaggtgtagaaggagaaggattacaccggctgggctatatattgcgagatgtaggcaagaaagaaggtggcgcgatgtacgctgacgacacagcgggctgggataccaggattaccctagaagacttaaaaaacgaagaaatggtcaccaatcatatgaaaggagaacacaaaaaattagccgaagcgatatttaagttaacttaccagaacaaggtagtgagggtacaacgacctacaccaagaggtacggttatggacatcatctcgaggagagaccagagagggagtggacaagtcggtacgtatggactcaacacattcactaacatggaagcgcagttaataagacaaatggaaggagaagggatcttcaaaagtattcagcatttaacagcaaccgaagaaattgcagtgcaaaattggctagcaagagtaggaagagaacgactttcacgtatggcgattagtggagatgattgtgtggttaaacccattgatgacagatttgcaagcgcattaactgcgctcaatgacatgggaaaagtaagaaaggacattcaacaatgggaaccaagtcgggggtggaacgattggacacaagtccccttttgtagtcatcactttcatgaattagtcatgaaagatggtagagttctcgtagtaccgtgtcgaaatcaggacgaacttattggaagagcaaggataagtcagggtgcagggtggagtttgaaagaaacagcatgtctaggtaaaagctatgcgcaaatgtggacattaatgtactttcatcggagagatctgcgattggccgccaacgcaatatgttccgccgttccttcgcattgggtacctacgtcacgtacaacctggagcatccatgcaaaacacgaatggatgacgacagaggatatgctggcagtatggaatagagtctggattcaggaaaacccttggatggaagataagaccccagtagaaagttgggaagaggtgccctatctaggaaagagggaagaccaatggtgcggaagtctaatcggactgactagtagagcaacatgggcaaaaaacatacaaacagctataaaccaagtgcgatctctcatagggaatgaagaatacacggactatatgccctcgatgaaaagatttcgcagagaagaggaggaagcaggggtgctctggtag

SEQ ID NO: 22375 - RNA, 9876 nt, synthetic construct
  misc_feature 1..9876: note = derived and/or modified CDS sequence (opt6) from DENV-2__EU569695__SS-prME
  source 1..9876: mol_type = other RNA
acagcaggagtaatagttatgttaatacccacagctatggcatttcacttaacaacacgtaatggagaacctcatatgatagtgggaagacaagaaaaaggtaaatccttactattcaaaacagaagacggagttaatatgtgtacccttatggccatcgatctgggtgaactatgtgaagataccattacttacaaatgtccattattacgtcagaatgaaccagaagatatagattgttggtgtaacagcacgtcaacgtgggttacctatggtacgtgtactaccacgggagaacaccgtcgtgagaaaagaagtgtagcattggtcccacatgttggaatgggattagaaacacgcacggaaacatggatgtcgagcgaaggagcttggaaacacgtgcaacgtatagaaacttggatcttacgtcatccaggattcacgataatggcggcaattctagcatatacgatcggtacaacgcattttcagcgtgcattaatctttatactactgacagcagttgctccaagtatgactatgcgttgcataggtataagtaatagagacttcgtagaaggtgtctcagggggatcatgggtggacatagtccttgaacatggatcatgtgtcacaacaatggctaaaaacaaaccgacactagatttcgaacttataaaaacagaggccaaacaaccagcaaccttacgaaaatactgtatcgaggctaaattaactaacacaacaacggaatctagatgtccaactcaaggagagccctcgctaaatgaagaacaagacaaaagatttatatgtaaacacagtatggtagatagagggtggggtaatggatgtggtcttttcgggaaaggaggaattgtcacatgtgccatgttcacgtgtaagaagaacatggagggtaaagttgtgcaacctgaaaatctagaatacactatagtaataacaccccactccggggaagaacatgctgtcggaaatgacacagggaaacacggaaaagaaataaaaattacaccacagtccagcattacagaagcagaactaacaggatatggaacagtgaccatggaatgtagtcccagaacagggctcgattttaacgaaatggttcttctacaaatggaagacaaagcctggcttgtacatcgccaatggttcttggaccttccactcccctggctaccaggtgcagatacacaaggaagcaattggatacagaaagaaaccctagtgactttcaaaaacccacatgcaaagaagcaggatgtagtggtactaggatctcaagagggtgcaatgcatacggctctcacgggtgctacggaaatccaaatgagttccggaaatttgttatttactggacatctgaaatgtagattgcgtatggacaagctacaacttaagggaatgagctatagtatgtgtacgggaaaattcaaaattgtaaaggaaatagctgaaacgcagcatggtacaatagtaataagagtccagtatgaaggagatggatctccatgtaaaataccatttgaaatcacagacctagagaaacgacatgtattagggagattaataacggtaaacccaatcgttaccgaaaaagatagcccagttaatattgaagccgaaccaccatttggggactcatacatcataatcggtgtcgaaccaggacaactcaaattaaactggtttaagaaaggttcatctattggacagatgtttgaaaccactatgcgaggcgcaaaacgcatggcaatactcggggataccgcatgggattttggttcgttaggtggtgtattcacatctataggcaaggcactccatcaggtttttggcgcaatatacggcgctgcatttagtggagtatcatggacaatgaagatattaataggggtaataataacttggatagggatgaatagcagaagcacgtcactttcagtatcccttgtcctagtaggagtagtaacactatatctcggagcagttgtacaagcagactcaggctgtgtagttagttggaaaaataaggaattgaagtgtggtagcgggatattcattacagacaatgtccacacttggactgaacaatataagtttcaacctgaaagcccatcaaaattagcctcagcaattcaaaaagcacatgaggaaggaatttgtggtatcagaagtgtaacgagattagaaaaccttatgtggaaacaaatcacgcctgaactaaatcacattttgtcagaaaacgaagttaaactaactattatgacgggtgacataaaaggaataatgcaagcgggaaaaaggagtttacggccccaacctaccgaacttaagtattcgtggaagacatggggcaaagctaaaatgttgagtactgagtcccataaccaaacattcctaatagatggaccggaaaccgccgaatgtccaaatacaaaccgagcctggaactcattagaggttgaagactacggattcggagtttttacaacaaacatatggctaaagctaagagaaaaacaagacgtattttgtgactcaaaactgatgtctgcagctatcaaagacaatagagctgttcatgctgatatgggatactggattgaatccgctttaaatgatacatggaaaatggaaaaggcttctttcattgaagtaaaatcttgtcactggcctaaaagtcacacattatggtcgaatggagtgcttgagtcagaaatgataatacccaaaaacttcgcaggccccgtaagtcaacacaattatagacctggatatcatacgcaaacggcaggaccatggcacctcggtaaactggagatggattttgatttctgtgagggaaccactgtagtcgttactgaagattgcggaaatcggggaccttctttacggacaacaacagcctcaggtaaactaataacagaatggtgctgtagatcctgtaccctacctccacttagatatagaggggaagacggttgctggtatggtatggaaataagaccattaaaagaaaaggaagagaatcttgtaaacagtctggtaacagcaggacacggtcagattgataatttttctctaggagttttaggcatggccctatttctggaagaaatgcttagaaccagaatcggaaccaaacatgccatattattagtagcagtgtcattcgtcaccctaataaccggcaacatgtcattcagggatctaggcagagttatggtcatggttggagccactatgactgacgacataggaatgggagtgacatacttagcacttttggcagcctttaaagtacgccctacgttcgcagcaggtttattattgcgtaaattaacatcaaaagaattaatgatggccactatagggattgccctactaagtcaatcgaccataccagaaaccatcctcgagcttactgacgcactcgctctaggtatgatggtgctaaaaattgtgagaaacatggaaaaatatcaactagctgtaactattatggcgataagctgtgtgccgaatgctgtcatactacaaaacgcatggaaggttagctgtactatcttggctgccgtatccgtaagtccgttgttattaacaagttcgcaacaaaaagcggattggattccattggcattgaccattaaaggcctaaatccaacggctatctttttaactactctttcgcgaacatccaagaagcgtagctggcccctgaacgaagcaattatggccgtcgggatggtcagcatcttagcgagttcattattaaagaatgatattcctatgacgggacctttggtagctggaggtttactaacagtctgttatgttctaacaggaaggagcgctgatttagaacttgagagagcagcagatgttaaatgggaagatcaagcagaaatctctggaagcagtcccatattgtctattacaatctcagaagatgggtcgatgtccattaagaacgaagaagaagaacaaacgctaactattttgatcagaacggggcttttagtaataagcggcgtcttccccgtaagtattcctattactgcggccgcatggtatctgtgggaggtaaagaaacagcgggcaggggtcttatgggacgttccgtctcctcccccggtggaaaaggcagagctggaggatggagcataccgaatcaaacaaagagggatactgggttatagtcaaattggagcgggagtatacaaggaaggaacgtttcacaccatgtggcatgttacacgaggcgctgtactaatgcatcgagggaaaagaatagaaccttcttgggcggatgtcaagaaagatcttataagctatgggggagggtggaaactggaaggggaatggaaagaaggggaggaagtacaagtcttggcattggagcctggcaaaaatccaagggcagtccaaaccaagccaggtatattcaaaacgaacactgggactataggagccgtgtcacttgacttcagcccgggtacttcggggtcaccgatagtagaccgcaaggggaaagtagtaggactgtacggcaacggggtagttacacgaagtggggcatatgtgtctgccatcgctcaaactgaaaaatcgattgaggataatccggagattgaggacgacatattccggaaaaagcgactaacgataatggaccttcatccaggagcagggaaaacaaaaagatacctacccgcaattgtacgagaagcaattaaacgtggattaagaaccttgatattggcgcccaccagggtagtggcagcagaaatggaagaggcattaaggggtctcccaattagatatcaaactcctgctataaaaaccgaacatacgggaagggagatcgtggatttaatgtgtcatgccacatttacaatgagacttctatcgccagttagagtgccgaactataatttaatcattatggatgaagcacactttaccgatcctgcatctatcgccgctaggggatatatatcgactcgagtagaaatgggagaggccgcaggaatatttatgacagcaacacctcctggctctcgtgacccgtttcctcaatcgaacgctccgattatggatgaagagagggaaattcctgaaagatcatggaactccggtcacgaatgggtaacggacttcaaaggtaaaactgtctggttcgttccttctataaaagcgggtaatgacatagccgcctgtcttcgcaaaaatgggaagaaagttattcaattaagtagaaaaacgttcgatagtgaatatgtaaaaacacgggccaacgactgggacttcgttgtaacaactgatatttccgaaatgggagcaaattttaaagcagaaagagtaattgatccacggagatgcatgaaaccggttatactaaccgatggtgaagaacgagtgatattagctgggccaatgcctgttacacactcctctgctgcgcaacgtcgaggacgaataggaagaaatcctaaaaatgaaaacgatcaatatatatatatgggtgaaccactcgaaaatgacgaggattgcgcacattggaaggaggcaaaaatgctattggacaatattaacacgcccgaaggcataattccctctatgttcgaaccagagcgtgaaaaagtagacgcaatagacggcgaatacagactacgtggcgaggcgagaaagacattcgtagatctcatgagaaggggagatttaccggtatggttggcttacaaagtagcagcagagggaataaactatgctgatagaaaatggtgtttcgatggcattaaaaataatcaaatactagaagagaacatggaagtagaaatctggacgaaagaaggtgaacgaaagaaacttaaaccaagatggttggatgcgcgaatatacagcgacccactagcactcaaagaatttaaagagttcgccgcaggaagaaaaagtctcactctcaacctaattactgaaatgggacgactcccaacattcatgacacagaaggctaggaatgcactagacaacttagcagtactacacaccgcagaagctggtggcagagcatataatcatgctttatccgaattaccagaaactctggaaacattattacttcttacattacttgctaccgtcaccggtgggatatttttattcctgatgtcgggaaaaggaattggtaagatgaccctaggtatgtgttgtatcatcacagcttctattcttttatggtacgcacaaattcaaccacactggatagcggcatcaataatactggaatttttcttaatcgttcttttaatcccggagccagaaaagcaaagaaccccacaggacaatcaacttacctatgtagtaatagcgatactaacggtggtagcagctacaatggccaatgaaatgggatttcttgagaaaaccaagaaagacctagggctaggatcaatcacaacccaagaatcggaatctaatatattagatatagatttgcgtcctgcttctgcatggacgctctatgctgtcgcaacaacgtttgtaacacctatgttgcgccactctatagaaaactccagtgttaacgtctctctgacagctgtcgctaaccaggcgacggtactcatgggtttgggtaaaggatggccattaagtaaaatggatataggagtacctctacttgcaataggatgctactctcaagtcaatcccataaccttgacggcggctttgttactgttagttgcccactatgcaataatcggacccgggctgcaggcaaaagcgacgagagaagcacagaaaagagcggcggccggtattatgaaaaatcccacagtagatggtatcacagtgatagacttagagcctataccttatgatcccaaattcgagaagcaactagggcaggttatgctgcttatactgtgtgttacccaagtattaatgatgagaacaacatgggctctgtgcgaagcgctaacattggctacagggccaatatcaacgctatgggaagggaatccgggccgtttttggaacacgacaatcgcagtgagtatggctaatatattccgaggatcgtatctagcaggcgcaggtttgttatttagtattatgaaaaacacaacctcaaccaggcgaggaacaggaaatattggcgagaccctaggagaaaagtggaaatccagactaaacgcgttaggtaaaagtgagttccaaatatataagaaaagtggcatacaagaggtggatcgtactctagccaaggaagggatcaagcgcggagaaaccgatcatcacgcagtaagccggggttcagcaaaactcagatggttcgttgagagaaatatggtcacaccagaaggaaaagtcgtagacctagggtgtggccgtggaggatggtcctactactgtggagggctgaaaaacgtccgtgaagttaaaggattaaccaaaggtggaccaggacacgaagaacctatacctatgagcacttatggatggaatttagtcagactgcaatcaggagttgacgtattctttactcctccagagaaatgtgataccttactttgcgatattggcgagtcaagtccaaacccgactatagaagctggcagaacattgcgcgtcttaaatctggtggaaaattggctcaataataatacgcagttttgcataaaagtattaaacccttatatgcctagtgtaatagaaaagatggaggctttacaacgtcagtatggtggggctctagtcagaaatcctctgtcaagaaactccactcatgagatgtactgggtctcaaatgccactggtaatatagttagctctgtaaatatgatatcacgtatgttaattaatagatttacaatgaagcataagaaagccacctatgaacctgatgtagatctcggaagcgggacacgtaacattggaatagaaagcgaaatacctaatctagatataataggaaaacgaatagagaaaattaaacaagaacatgagattagctggcactacgaccaagaccatccgtataaaacgtgggcttaccatggcagttatgaaactaaacaaaccgggagcgcctcttctatggtcaatggagtagtacgactactgacaaagccctgggatgttgtaccaatggtaacccagatggctatgacggatacaactccttttggccaacaaagagtattcaaagaaaaagttgacaccaggactcaagaacccaaggaaggtaccaagaaactgatgaaaatcactgctgaatggttatggaaagagttaggcaaaaagaaaaccccacgtatgtgtacccgagaagagtttactaaaaaggtgcgttcaaatgctgcccttggagcgatatttactgacgaaaacaaatggaaaagcgcaagagaagcggtcgaagatggtaggttctgggaactggtagaccgagaaagaaacctacatctcgaaggcaaatgtgaaacttgtgtatataatatgatgggtaagagagagaagaaattgggcgagttcggcaaagcaaaaggtagcagagcgatatggtatatgtggttaggcgcacgatttctggaatttgaggccctcggatttctaaatgaagaccattggtttagtagaggcaatagtttatctggggttgaaggagaaggtctacaccgacttggttatatacttagggatgtgggcaagaaagaaggaggagcaatgtatgccgatgacactgcaggatgggatacaagaattacactggaggacctcaaaaatgaagaaatggtcacaaaccatatgaaaggcgaacacaagaaattagctgaagctatatttaagttaacataccagaacaaagtagtacgagtacaaaggcctaccccacggggtacagtaatggacataattagtagacgcgatcagagaggatctggccaagttggaacttacggcctcaatacattcaccaacatggaagctcaacttataaggcaaatggaaggggaaggaatctttaaaagtatccaacatttaacagctacagaagaaatcgccgtacaaaactggctcgcaagagttggcagagagagattatctcgcatggctatttcaggagatgactgcgttgttaaaccaatcgacgataggtttgcatcggctctaacagcattaaacgacatggggaaggttagaaaagacatccaacaatgggagccgtcccgggggtggaatgactggacacaagtaccattttgttcgcatcattttcacgaactcgtaatgaaagatggtagagtacttgtggttccatgtagaaaccaagatgaactaatcggtcgagcaagaatttcacagggtgcaggatggtctctaaaagaaacagcctgcttagggaaatcgtacgcccagatgtggaccttaatgtacttccatagaagggacttacgattagcagccaatgctatctgttcggcagtaccatcgcattgggtaccaactagcaggacaacatggagcatccacgcaaaacacgaatggatgacaaccgaagacatgctagcagtatggaatagggtttggatccaagaaaatccttggatggaagataaaactcctgttgaaagctgggaagaagtaccatacttgggtaaaagggaagatcaatggtgtggcagtcttataggactaacttctagagcaacttgggccaaaaatatacaaaccgcaataaaccaggtaagatcactgataggaaacgaagagtatactgactacatgccttcaatgaagcgtttccgaagagaggaagaagaggcaggagtcctttggtga

SEQ ID NO: 22376 - RNA, 9876 nt, synthetic construct
  misc_feature 1..9876: note = derived and/or modified CDS sequence (opt6) from DENV-2__EU482623__SS-prME
  source 1..9876: mol_type = other RNA
acagcaggcgttatagtaatgctaataccgacagcgatggcatttcatctaacaacacgaaacggagaaccccatatgattgtgggtaggcaagaaaaaggaaaatctctattattcaaaacagaagatggggtaaacatgtgtacgctaatggctatagatctaggtgaattgtgcgaagataccataacttacaaatgtcccctactacgacaaaatgaacctgaagatatagattgctggtgcaactccacatccacttgggtaacgtatggcacttgcacaactaccggagaacatagacgcgaaaaacgctcagtagcgctagtgcctcatgtcggtatgggtttagaaactcgaacagaaacatggatgagtagcgaaggagcatggaaacacgtacaaagaattgaaacgtggatactcagacatccaggtttcacgataatggcagccatactggcctatactattgggacgacacattttcaacgagccttaatcttcatccttttgacagcagtagcaccatcaatgacaatgcgttgtatcggaataagcaatagagattttgttgaaggggtaagtggaggatcttgggtagacatagtactagaacacggatcttgcgtaacaacaatggctaaaaacaaaccgacacttgatttcgagttaataaaaactgaggctaaacaacctgcaactttaagaaaatactgtatcgaagccaaactaacgaataccactacggaaagtcgatgcccaacacaaggtgaaccaagtctaaacgaggaacaagataaaaggtttatttgtaagcactcaatggtcgacagggggtgggggaacggctgtggattatttggaaagggaggaatcgttacatgcgctatgtttacgtgtaaaaagaatatggaaggaaaagtagtgcaacctgaaaatctggaatacacaatcgtaattactccacacagcggtgaggagcacgcagtgggaaacgacacaggcaaacacggaaaggagatcaaaattacgccgcaatcaagcattacagaagcagaactcacaggctatgggacagtaactatggaatgcagcccgagaacgggattagattttaatgaaatggtactactacagatggaagacaaggcgtggttggtacacaggcaatggtttttagaccttcctctaccatggttaccaggcgccgatactcaagaatcaaactggattcaaaaagaaaccctagtaacatttaaaaatccccatgccaagaaacaagacgtagttgtactaggttctcaagaaggtgcaatgcatactgctttaacgggcgcaactgaaatccaaatgagctctggcaacctactattcacaggacacctaaaatgcagactccgaatggacaaactacaattaaaagggatgtcatattccatgtgcacaggaaaatttaaaatagtaaaagagatagctgagacacaacacggtacaattgtgatcagagttcaatatgagggagacggcagtccttgtaaaataccttttgaaataaccgaccttgaaaaacgccatgtattaggtcgactcattaccgttaacccgatcgtgacagaaaaagattcacctgttaatattgaagcagagccaccgtttggagactcctatattataatcggggtggaacctggacaactcaaactgaattggttcaagaaaggttcctccatcggtcaaatgtttgaaacaacaatgcgaggcgcgaagagaatggccatacttggagacacagcgtgggatttcggaagtctgggtggtgtattcacgagtattggcaaagcactacatcaggtttttggggcgatatatggcgccgctttctccggcgtctcatggactatgaagattttaataggcgttattatcacatggataggaatgaacagtcgctccacttccctatcagttagcttggtactggtaggagtagtaacactttatttaggcgcggttgtacaagccgattcaggttgtgtcgtatcatggaagaacaaagaactaaaatgtggatccggaattttcatcacggataatgttcacacgtggacagagcaatacaagtttcaaccagagagcccatcaaaactagcatctgccatccaaaaagctcatgaagaagggatatgcgggataagaagtgtaactcgattggaaaatttaatgtggaagcaaattacgcccgagttaaaccacatattgtcggagaatgaggtaaaactcacaattatgacgggtgacataaaggggataatgcaagccgggaaaagatcactacgcccacagcctactgaactaaaatatagttggaaaacttggggaaaagcgaaaatgttatcaactgaatcacataatcaaacgtttctaatagatggacccgagacagcagagtgcccaaatacaaatcgtgcgtggaatagtcttgaagttgaggattacggtttcggggtatttacaacgaacatatggctaaaactacgggaaaagcaggacgtcttctgcgattcaaaattaatgtcggctgccattaaggacaatcgcgccgtacacgctgacatgggatattggatagaaagcgctctaaacgatacttggaagatggagaaagcatcattcatcgaagtgaagtcttgtcactggccaaaatcacacacgctctggtcgaacggagtactcgagagtgaaatgataatcccaaagaacttcgcggggccggtttcacaacataactaccggcctgggtatcatacacaaactgccggaccatggcatctcggaaaattagaaatggactttgatttttgcgaaggaactaccgtggtagtaacggaagattgcggcaaccggggacctagtctacgaacaaccaccgctagtggtaaacttataactgaatggtgttgtcgatcctgcaccttgcctcccttaaggtatagaggggaagatggctgttggtatgggatggaaatccgtccacttaaagaaaaagaagaaaatctagtgaatagcctcgttaccgcagggcatggacagatagataatttcagtttaggagtgctcggcatggccttgttacttgaagaaatgttacgaacgagaattggtaccaagcacgcgatactcctagtggctgtgagctttgtcacgctcataactggcaatatgtcattcagggatttgggaagagtgatggttatggtgggagccactatgacagacgacataggaatgggagtcacatatttagcacttttggctgcctttaaagtaagaccaacttttgcggcaggacttttgctccgaaaacttacatctaaagaattaatgatggctacaataggaattgcattgttgtcacaatcaacgataccagagacgatccttgaattgactgatgcactagctttaggcatgatggttcttaagatagttcgaaatatggaaaaatatcaactagcggtgactataatggcaattagctgtgtgccaaatgctgttatactacaaaacgcttggaaagtatcatgtaccatattagcggctgtaagcgtaagcccactacttttgacgtcatcacaacaaaaggctgattggatccctctagcgctaactataaaaggactaaatccaaccgcaatatttctaaccacactatcacgtacaagtaagaaaagatcctggcccttaaatgaagcaattatggcagtcggcatggtttccatattggctagttcactacttaaaaatgatatacccatgactggacctttagtagctgggggattactaacagtatgttatgttctaaccggaaggtctgcagatctcgaattagaacgagccgctgatgtgaaatgggaggaccaagctgagatcagtgggagtagcccaatactttcaattactatttcagaagacggcagtatgtcaatcaaaaatgaagaggaagaacaaacactaaccatcctcatccgtaccggcttgctagttatcagcggagtattccctgtttcaataccgataaccgcggcagcctggtatttgtgggaggttaagaaacaacgggctggagtcctatgggatgttccaagtccccctcctgttgaaaaagcagaactagaggatggcgcttatagaatcaagcaaagaggcattctcggatacagccaaataggagcaggggtttacaaagaaggtactttccatactatgtggcatgtaactcgaggagctgtactaatgcaccgagggaaaagaatcgagccgtcatgggccgatgttaagaaagacctaatctcatacggaggaggctggaaattagaaggagaatggaaagaaggggaagaagtacaagtactcgctctagaacctggtaaaaatcctagggcagtccagacgaaacctggaatattcaaaacaaactctggcactataggagccgtttctcttgatttctcacctggaacctcgggatcaccaatagtagaccggaaaggaaaggtggtgggtttatacggcaatggagtcgtaacgagatcaggcgcatatgtatcagcgatagcacaaactgaaaagtccattgaggacaacccagagatcgaagacgatatttttaggaagaaacggttaactataatggatctacatccaggagccggcaaaacgaaacgatatctaccggcaatcgtccgagaagccatcaaaagaggactaagaacgcttatattagccccaaccagagtagttgctgcagaaatggaagaagcattaagaggtttaccgatccgatatcaaactcctgcaataaagacagaacacactggaagagaaatagttgatctaatgtgccacgcgacatttacaatgaggctcttatcacccgtgcgagtaccgaactataatctgataataatggatgaagcgcactttacagatcccgcatcaattgcagcacggggatacatcagtacccgagttgaaatgggggaagcggcaggaatctttatgaccgcaacaccaccgggatcgagagatccttttccacaaagcaatgctccgataatggacgaggaaagggaaattccagaacgaagctggaactcaggccacgagtgggttacagattttaaaggaaaaaccgtatggtttgttccttcaatcaaagctggaaacgatatcgccgcatgtttaaggaaaaatggaaagaaagtaatacagctatcgagaaaaacgtttgattcagaatatgtcaaaactagagctattgattgggattttgtcgttactactgacatctcggaaatgggagcaaatttcaaagcggaacgtgtcattgaccccagacgttgtatgaaacctgttattttaacagacggcgaagaaagggtaatcctagcaggcccaatgccagtcacgcacagtagtgcagcacagagaaggggtagaattggtaggaaccctaaaaacgaaaatgatcagtatatctatatgggtgaaccactagaaaatgatgaagactgcgcacactggaaagaagccaaaatgctacttgacaatataaatacaccagagggtatcatacctagtatgttcgaacctgaaagagaaaaagttgatgcaattgatggggaatacagattacgcggcgaagctcgtaaaaccttcgtagacttaatgaggagaggcgatctacccgtatggcttgcatataaagtggcagccgagggaattaattatgcggacaggaaatggtgttttgacgggatcaaaaataaccaaattcttgaggaaaacatggaggttgaaatttggacgaaagagggtgaaagaaagaaattaaaaccaagatggttagacgctagaatatactctgacccacttgcactaaaagaatttaaagaatttgcagcagggagaaaatcattaacactaaatctcattacggaaatgggtcgtttgccaacctttatgacacaaaaagcaagaaatgcattagataatttggctgtgttacataccgcggaggcaggaggtcgcgcctataaccacgctctaagtgagttacccgaaacgttagaaaccctcctcctgcttacgctattggccacggtaacaggagggatattcctttttcttatgtccggtaaaggtattggtaaaatgacattgggtatgtgttgtattattacggcatcgattttactctggtatgctcaaatacagccccattggatagctgcaagtattatacttgagttctttttgatagtattgctgatacccgagccagagaagcaacgaaccccacaagataatcagctaacgtacgtagttatagctattttaacagtagtcgccgccactatggcaaatgaaatgggctttctagagaaaaccaagaaagatctcggcctcggttcaataacaactcaagaaagcgagagcaacatcctagacattgacctacgaccagcatctgcatggacactatacgctgtcgcaaccacgtttgtcactccaatgttgagacattccatagaaaacagtagcgtcaacgtttctttgaccgcaatagccaatcaagccacagtactcatgggactaggtaaaggttggccccttagtaagatggacataggggtaccgctactggccataggttgctatagccaagtcaaccccattactttaactgcagcgctattactattggtagcccattatgctattataggtcctgggttacaagcgaaagcgacgcgtgaggcacagaaaagggctgcggcgggcataatgaagaatcctaccgtagatggaataacagtcatcgatctagagccaataccatacgatccgaaatttgaaaaacaactaggacaagtaatgctcctcattctgtgcgttacgcaagtactaatgatgaggacaacatgggcgttgtgtgaggctttaactttagcgactggccccataagtactctgtgggaaggaaacccaggtagattttggaacactacgatagctgtgagcatggccaatatatttagaggctcttatcttgcaggagcaggcttactgttcagtataatgaaaaatactacatctacgcgtagaggaacgggtaacatcggagaaaccctcggggaaaaatggaaaagcaggttgaacgcattaggaaaatctgaatttcagatctataagaaatccgggatacaagaagtagacagaactttagcaaaagaaggaataaagcgtggagaaaccgaccaccatgccgtatcacgaggatctgctaaactaagatggtttgtcgaacgaaatatggtcacaccagaaggaaaggtagtggatttaggatgcggaaggggaggatggtcgtactattgcggaggactcaaaaatgtaagggaggtaaaagggctaacaaaaggcggtccaggacatgaagaaccaattcctatgagtacttatggttggaatcttgtacgactacagtcgggcgtagacgtcttctttacccctcctgaaaaatgtgataccttattatgtgatatcggtgaatcgtctcccaatccgacaattgaagccggcaggactttacgtgttttaaatctagtagagaattggcttaataataacacgcaattttgtataaaggtactaaatccttatatgcctagtgtaatagagaagatggaagcactccaaagacaatatggcggcgcgcttgtcaggaatccattatcgcgtaactcgactcacgagatgtattgggtatcaaacgcgacaggaaatattgtgtcgtccgtaaacatgatatcccgtatgttaataaaccgattcactatgaaacacaaaaaggcaacatacgaacctgatgttgatttaggctcaggcacaagaaatataggcatagagagtgaaattcctaatttagatataatcggtaaaaggatagagaagattaaacaagaacatgaaatttcctggcactatgaccaagaccatccatacaaaacgtgggcctatcacggatcatatgaaacaaaacaaactggttctgcgagcagtatggtaaacggggtggtgagactattaactaagccatgggacgtcgtaccaatggtaacacaaatggctatgacagatacaacaccatttggacaacagcgtgtatttaaagaaaaagtggataccagaacacaagaaccgaaggaaggtaccaagaaactaatgaaaataactgccgaatggctatggaaggagctcggcaagaagaaaactccgaggatgtgcacgagagaagaatttaccaagaaagtccggagcaacgcagccttaggagcgatctttaccgatgaaaataaatggaaatcagcacgagaagcagtcgaagatggccgcttttgggagctagtagaccgagagcgaaatctccatctagaagggaaatgtgaaacatgtgtttataatatgatgggcaaaagagagaagaaattaggcgaatttggtaaagccaaaggttctcgcgctatatggtatatgtggcttggtgcaaggtttttagagtttgaggcattaggcttcctgaatgaagaccactggtttagccgaggtaactcattatctggtgtcgaaggagaagggctgcataggctaggatatattctgagagatgtgggtaaaaaggaaggcggggcaatgtatgcagatgacaccgccggttgggacacacgtataacattggaggatttaaagaacgaggaaatggttacaaaccacatgaaaggagaacataagaaacttgcagaagctatatttaagttgacataccaaaacaaagtggttagagtacagagaccaaccccaagaggaaccgtcatggacataatatcccgaagagatcaaagaggttcaggacaggtgggaacgtacggtttaaacactttcacaaacatggaagcacaactcattagacagatggaaggagagggaatttttaagtcaatacaacacttaactgcaacagaagaaatagcagttcagaattggctcgccagagttggaagggagcgcttgtccaggatggcaatatcaggtgacgattgcgttgttaagcctatcgacgatagatttgccagtgcactaacggctttgaatgacatgggcaaagttagaaaagatatacaacaatgggagcctagtagaggctggaatgactggacccaagtgcctttctgttcacaccacttccacgagctagtgatgaaggatggtagggtcctagtggttccgtgtagaaatcaggatgaactaattgggcgtgctagaatatctcagggtgccggatggtccctgaaagaaacagcgtgtctaggaaaatcatatgcgcagatgtggactctaatgtacttccacagaagagatttacgtctagctgctaatgcaatatgcagcgcagtaccatcacattgggtaccaaccagccgtactacatggagtatacatgcaaaacatgaatggatgactaccgaagatatgctcgcagtgtggaacagggtgtggatacaggaaaatccgtggatggaagacaaaacccccgtcgaatcctgggaagaagtaccgtacctaggaaaacgtgaggatcaatggtgcggtagtctaattgggttgacaagtcgtgccacttgggcaaagaatatacaaacggccataaatcaagttcgatctctcattggaaatgaagaatacacagattatatgcctagcatgaaaaggttcagacgagaagaggaagaagccggtgtcctttggtaa

SEQ ID NO: 22377 - RNA, 9876 nt, synthetic construct
  misc_feature 1..9876: note = derived and/or modified CDS sequence (opt6) from DENV-2__EU569698__SS-prME
  source 1..9876: mol_type = other RNA
actgctggtgtcatagtaatgcttataccaaccgcaatggcatttcaccttactacgcgaaacggtgaaccacacatgattgttggaaggcaagaaaaaggaaagagcttattgttcaaaacggaagacggagtaaacatgtgtacgctaatggcaattgacctaggagaattatgtgaagatactataacttacaaatgtcctttactgaggcaaaatgaaccagaagatattgattgttggtgtaatagtacgtcaacctgggttacctacggaacatgtacgacaacgggagaacatcgtcgcgaaaagcgaagtgtggcgctagttccccacgtgggaatgggactggaaactagaacagaaacctggatgtcgtcggaaggtgcatggaaacacgtacaaagaattgaaacgtggattctgagacatccaggatttacaatcatggcagccattctagcatacactataggaacgacccatttccaaagagcgctaatatttattctattaactgctgtagctccatctatgacaatgcgatgtattggtatctcaaatcgcgactttgtagaaggagtcagtggtggatcttgggtagatatagtattagaacacggatcatgtgtaacaactatggctaaaaataaaccgacactagactttgaattaattaaaaccgaagctaaacaaccagcaactctgagaaaatactgcatcgaagctaaattaacaaacacaaccacagaaagccgttgtcctacccaaggagagccctcgttaaacgaggaacaggacaaaagatttatttgtaaacatagcatggtagacagaggatggggcaatggatgtggcctgtttggaaaaggtggaatagtaacttgcgccatgttcacatgtaagaaaaatatggaaggtaaagtggttcaaccagaaaacttagaatataccatagttataacaccccattctggagaagaacatgcagttggcaatgatacaggaaaacatggaaaagaaattaaaataaccccgcaaagctctataacagaagctgagttaacgggttacggcacggtaactatggagtgtagtccgagaaccgggctagactttaacgagatggtcctattacaaatggaagacaaagcgtggttagtacatagacaatggtttttagatttaccactgccctggctcccaggagctgatactcaaggttcaaactggatacaaaaagaaaccttagttaccttcaaaaacccacacgcaaagaaacaagatgttgtggtgctgggatcgcaagaaggagccatgcatacagctctgaccggtgcaactgagatacaaatgagcagtggtaacctcttatttacaggacatctaaaatgtcgactcagaatggacaaattgcagttaaaaggaatgtcgtatagtatgtgcactggtaaatttaaaattgtcaaagagattgcagaaacacaacatggaacaatagtaattcgagtacagtatgagggggacggaagtccttgcaaaatacctttcgaaatcacagatctagagaaacgacacgttttgggtcgcctcataacggtcaatcccattgtgactgaaaaagactcacctgtcaatatagaagccgagccaccttttggcgattcctacattatcataggtgtggagcctgggcagttgaaattaaattggttcaagaaagggagctctatagggcagatgtttgagacaacaatgagaggagcaaaaaggatggccattctaggagatacagcttgggattttgggtctttaggaggagtattcaccagcataggcaaagcattgcatcaagtgttcggcgcaatatatggtgcagccttctcgggcgtttcttggacaatgaaaatacttataggtgtaattataacgtggataggcatgaactctagatccacaagtttgagcgtaagcctagtattagtcggtgtcgtcactttgtatttaggcgccgttgtacaagcggattcaggatgcgtagtgagttggaaaaataaagaattaaagtgtggaagtggcatattcatcacagacaatgttcatacgtggacagagcaatataaatttcaaccagaaagcccctcgaagctggccagcgctatacaaaaagcacatgaagaaggtatatgtgggattcgatcagttacgcgactagaaaatttaatgtggaaacaaataactcccgaacttaatcacattctaagcgaaaatgaagttaaactaactatcatgactggagatattaaaggtattatgcaggcgggaaagaggagtttacgtccccaaccaacggagttaaaatacagctggaaaacgtggggtaaagcaaaaatgctatcgacagaatctcataaccaaactttcttaatagatggacccgaaactgccgagtgtccaaacactaatagggcatggaactcactagaagtagaggattacggatttggagtattcacgactaacatatggttaaaactccgagaaaaacaagacgtattttgtgatagcaaacttatgagcgcagcgattaaagacaatcgcgctgttcatgccgacatggggtattggattgaatcggccttgaacgatacctggaaaatggagaaggccagcttcattgaagtaaaatcttgtcattggccaaaatcacacacgttgtggagtaatggcgtacttgaatcagagatgataatacccaaaaatttcgctggcccagttagccaacataactatagacctggatatcatacacagacagcaggaccttggcatctagggaaattagaaatggactttgacttctgcgaaggaacgacagtcgtggtaacagaagattgtggcaacagaggaccatcgctgcgaaccacaactgctagtggaaaacttatcactgaatggtgctgtagatcctgtactctaccgcctctaaggtatagaggagaagatggatgctggtacgggatggagataagaccgcttaaagaaaaggaagaaaatttagttaattcattggtaacggcgggacatggacaaatagataactttagcctcggagtcctgggaatggcactatttctagaagaaatgctccgtactaggattggtacaaagcacgcaatcttattggtggccgtcagtttcgtgacactcatcactggaaacatgagctttcgagatctggggagagttatggtgatggtgggagctacaatgacagacgatatcgggatgggtgttacttatttagccctccttgcagcattcaaagtcagaccaacgtttgcggctggactattactacgaaaactcacatcaaaagaattaatgatggcaacaataggcatcgccctcctgtcccaatctacaataccagaaacaatattagaattaacagacgccttagcactgggaatgatggttttaaaaatcgtccggaacatggagaagtaccaactagccgtaactataatggctatcagctgtgtgcccaatgctgtgatattacaaaatgcttggaaggttagctgcacaatccttgcagcggtcagcgtctctcctctccttcttacaagctctcaacaaaaggctgattggattcctctcgccttgactataaagggactcaatccaacggctatatttctcacaacactgtccagaacatcgaaaaagagatcatggcctctaaacgaagcaataatggcagtaggtatggtttccatacttgcaagctcactactcaaaaacgatatacctatgacaggacccctagtagctggtgggttgttaaccgtatgctacgtgctaactggacgttcagcagacttagaacttgaacgagcagcagatgtcaaatgggaggatcaagctgaaataagtgggtccagtcccattctgtcgataactatctcagaagatggaagtatgtccattaagaatgaggaagaggaacagacattaaccatcttaatcagaacaggactcctagttataagtggcgttttccctgtgtcaattccaataacggcagcagcttggtatctttgggaagtgaagaaacaaagagcaggcgtcttgtgggacgttccaagcccacctccggtcgaaaaagcagaattggaagatggcgcctatcgtataaaacagagaggtatattaggatatagtcaaataggagcaggcgtatacaaagaaggaacctttcacaccatgtggcacgttacaaggggagcagttttaatgcatagaggcaagcggatagaaccgtcatgggccgacgttaagaaagacttaatatcatacggaggaggatggaaacttgaaggggagtggaaggaaggagaagaagtgcaggttttagctctagaacctggcaaaaatcccagagcagtacaaacaaaaccaggaatatttaaaaccaatacagggacgatcggggcagtgtcattagacttctcgccaggtacatccggttccccaatagtcgatcggaaaggtaaagtagtgggcttatacggaaatggagtagtcaccagaagtggggcttatgtctcagcaattgctcagacagaaaaatcaatcgaagataatcctgaaattgaggatgatattttcaggaagaaaagattgactatcatggatcttcacccgggtgcaggaaagactaaaagatacctacccgcgatagtacgtgaagcgataaagcgagggctgcgcacactaatcttggcacctactagagtagtggcagcggaaatggaggaggcattaagaggcttaccgataagataccaaacccctgctatcaaaacagaacacacaggccgagagatagtcgatcttatgtgtcatgcgacatttacgatgagacttttaagtcctgttcgagtacctaattataacctcataattatggatgaagcacattttacggaccctgcctccatagctgcaagaggttatatctcaacacgtgtagaaatgggtgaagctgccggaatatttatgacagcaacaccgcccggatcgcgagatagcttcccacagagcaatgcacccataatggatgaagaaagagaaataccggaaaggtcttggaacagcggacatgagtgggtaacagattttaaaggaaagaccgtatggtttgtaccgtcaataaaagcgggaaacgacattgctgcttgtttaaggaaaaatggcaagaaagtaattcaattaagccggaagacattcgatagtgaatatgtgaagactagagcgaatgactgggactttgtagtgaccactgacattagtgagatgggagcaaacttcaaagcagaacgggtaatagatccaagacgatgcatgaaaccagtaatattgacggacggtgaagaaagagtcatattagccggtcctatgccggtaacacattcctcagcagctcaacgacgagggcgaataggtagaaatcccaaaaatgaaaacgaccagtatatctatatgggagaaccactagaaaatgacgaggattgtgcccattggaaagaagcaaaaatgctgttggataatataaatacccccgaaggtattattccctcaatgtttgagcctgaaagggaaaaagtggacgcaatcgatggtgagtacaggctgaggggcgaagcaaggaaaacattcgttgacctgatgcgaagaggggatcttccagtctggttagcatataaggtggcggctgaaggaataaactatgcggatcgaaaatggtgtttcgacggcatcaagaataaccaaatattagaggaaaatatggaagtggaaatttggactaaagaaggagaaagaaagaaattaaaacctagatggctcgacgcaagaatctacagtgatccactggcattaaaagaatttaaggagttcgctgccggtcgaaaatctctcactttaaacttaataacagagatgggtagactaccaacgtttatgacgcaaaaagctcgaaacgcactagataatcttgctgtactacatacagcagaggctggtggacgagcttataatcatgcattaagcgaacttcctgagaccttagagacgctgttattactaacactactcgcaacagtgacaggaggaatcttcctctttttaatgtcggggaagggaataggaaaaatgaccctcggaatgtgctgtattataacagctagcatactcctctggtatgcgcaaatacaaccacactggatagcagcaagtataattttagagttctttttaattgtattactaataccagaaccggagaaacaaagaactcctcaagataaccaactaacttatgtagtgatagcgatccttactgtggtagcagcaacgatggcgaatgagatggggtttctagagaaaactaaaaaggatttgggcttagggtcaataacaacacaagaatctgagtccaatatacttgatatcgacttacgtccagcctctgcatggaccctatatgccgtggccactacattcgttactccgatgctccgtcacagtatcgaaaactctagcgtaaacgtaagtcttactgccatagcgaaccaagcaactgtattaatgggattaggaaaaggttggcccttgtcaaaaatggatattggagtacccctcttagctattggctgttattcacaagttaatccaattaccctgactgcagcccttctactgctcgtagcacattacgccattatagggcctggtctgcaagcaaaggctacaagagaagctcaaaagagagcagccgctggaataatgaaaaacccaaccgtcgatggaataactgtcatagatttggaacctattccttatgacccaaaattcgaaaaacagcttggacaagttatgttattaatactgtgtgtgactcaggtactaatgatgagaactacttgggcattgtgtgaagcattaaccttagcaacaggaccaatcagtacactttgggaaggtaatccaggcagattctggaatacaactatagcagtgagcatggctaacatatttcgtgggagctacctcgcgggagctggcttgttattttcaataatgaagaatactacgtctacaagaagagggacaggaaatatcggggagacacttggcgaaaaatggaaaagtaggctaaatgcactaggcaagtctgagttccaaatctataagaaaagtggcatccaagaagtggatagaacattagcgaaagaaggaataaaaaggggtgaaacggaccaccatgcggtatcaagaggcagtgcaaaactccgatggttcgtagaacgaaatatggtaacaccagagggcaaagttgtagatttgggttgcggcagaggagggtggagttattattgtggagggctcaaaaatgtccgtgaagtaaagggactaacgaaaggtggccctggacatgaggagccaatacctatgtcaacatacggttggaatctagttagactacaaagcggtgtagacgtatttttcactccgccagaaaaatgcgacaccctcttatgtgatataggtgaatcaagtccaaacccaactatcgaggcaggcagaactttacgcgtccttaatctagttgagaactggttaaataacaatacacagttttgtataaaagtgcttaacccctacatgccttccgttatagagaaaatggaggcccttcagcgccaatacggaggtgcactcgtaaggaacccattatcaagaaattcgacccatgaaatgtactgggtatcaaacgcgactggaaatattgtcagctccgtcaacatgattagcagaatgctaattaatcgatttacgatgaaacacaagaaagcaacgtacgagccggatgtggatctggggagcgggactcgtaatatcggaatcgagtctgagattccaaatttagacatcataggaaaacgaatagagaaaataaaacaagaacacgagattagctggcactatgatcaggaccacccgtacaaaacttgggcatatcatgggagctatgaaacaaaacaaactggatcagcttctagcatggttaacggagtagtacggcttttaacaaaaccttgggacgtagttcctatggtaactcaaatggccatgacggacaccaccccttttggacaacagagagtatttaaagaaaaagtagacacaaggactcaagagccgaaagaagggactaagaaactcatgaaaataacagcagaatggctttggaaagaactaggcaagaagaaaacgccacggatgtgcacaagggaggaatttacgaagaaagtacgaagtaatgctgcgttaggggcaatttttacagatgaaaataaatggaaatccgcccgtgaagcagtagaagacggaagattttgggaactcgtggacagagaaagaaatttacatttagagggaaagtgcgaaacctgcgtatacaatatgatgggcaaaagagaaaagaaacttggcgagttcggtaaagcgaaagggtcaagagctatctggtatatgtggttaggggctaggtttcttgaatttgaggcattagggttcttaaatgaagatcattggtttagcaggggaaacagcctttctggcgtcgaaggggaaggacttcataggctcggatacattctgagggacgtcggcaagaaagagggtggcgcgatgtatgcggacgatacggccgggtgggacactaggataacattagaagatctcaaaaacgaagaaatggtcacaaaccacatgaagggggaacataagaaactagcagaagcgatattcaaactgacttaccaaaacaaagtggtaagggtgcagagaccaacaccacgaggtacagtcatggacatcatctcgcgacgggaccagagaggaagtgggcaagtaggtacttacggattgaatacgtttacaaatatggaagcgcaactcataaggcaaatggaaggagagggcatttttaagtcaatccagcatctgacagcgactgaagaaatcgcagtccaaaactggctggccagagttggaagagaaaggctcagcaggatggcaatatccggagatgattgcgtcgttaaacctattgatgatcgtttcgcatcagcactgacagctctgaatgacatgggaaaagtaaggaaggatatccaacagtgggaacccagtcgtggttggaatgattggacacaagtaccgttttgttcacaccactttcatgaattagttatgaaagacggtcgggtcctagttgtcccatgccgaaatcaagatgaactgataggccgagcacgaatatcgcaaggtgctggatggtccttgaaagaaacggcttgtttgggaaaatcctatgcacaaatgtggacattgatgtatttccatcgtagagatttacgactagcagctaatgctatatgctccgcagtaccatcccattgggtaccgaccagtaggactacgtggtctatacacgcaaaacatgaatggatgaccaccgaagacatgctggccgtatggaatagggtctggattcaagagaatccatggatggaggacaaaaccccagttgagtcgtgggaagaagtaccctatctaggaaaacgggaagatcaatggtgtggttcacttataggcctaaccagtagagcaacttgggccaaaaatattcagacagctatcaaccaagtaagaagtttaataggcaatgaggagtacaccgactatatgcccagtatgaagagattcaggagggaagaagaggaagcaggagtattatggtaa

SEQ ID NO: 22378 - RNA, 9876 nt, synthetic construct
  misc_feature 1..9876: note = derived and/or modified CDS sequence (opt6) from DENV-2__EU569699__SS-prME
  source 1..9876: mol_type = other RNA
actgcaggagtgattgttatgctaatacctaccgcaatggcttttcatttaacaaccaggaatggagaaccccatatgatagtgggaagacaagaaaaagggaaatcattactgtttaaaacagaggatggtgtgaatatgtgcacactaatggcgatagacttgggtgagctatgtgaagatacaattacatataaatgccctttgctgcggcagaatgaaccagaagatatagattgttggtgtaatagcacctctacatgggttacgtatggaacttgtaccacaacaggggaacatagaagggagaaaagaagcgttgcacttgttccacacgtaggaatgggactagaaacacgtacagaaacatggatgtctagtgaaggagcatggaaacacgtacagagaatcgaaacatggatcttacgacatccaggattcactataatggcggcaatattagcatatacgattggtaccacccatttccaacgcgcactaatatttatcttgctcacggccgtggcaccatccatgacaatgagatgtataggtatatctaatagagatttcgtagaaggagtatctggaggaagttgggtggacattgtactcgaacatggaagctgtgtaacaacgatggccaaaaataaaccaacattagatttcgagctaattaaaactgaagcaaaacaaccagctacgttgagaaaatactgcattgaagcaaaattaaccaatactaccactgaatcacgatgtcctactcaaggggaaccgtcattgaatgaagaacaagataaaagatttatatgtaaacatagtatggtcgaccggggctggggcaacggatgtgggctctttggcaagggcggcatagttacatgtgcaaaatttacctgcaaaaagaacatggaaggtaaggtggtacaaccagaaaatttagaatataccattgttattactccacatagtggagaagaacatgcagtagggaatgatacaggcaaacatggcaaagagataaaaatcacgcctcaatccagtataaccgaagcggaattgacaggttatggcacagtaacaatggagtgttctccgcggacaggattagatttcaatgaaatggttttacttcaaatggaagataaagcatggttagtacataggcaatggttcttggacctacctttgccatggctccctggcgcggacactcaaggttcgaattggattcaaaaagagacattagtaactttcaaaaacccgcacgccaagaaacaagatgtagtggttctagggagccaggaaggagccatgcatacagctttgaccggggcgactgagatacaaatgtcaagtggtaatttattattcacgggacatctaaaatgcaggctaagaatggataagctccagctaaaaggaatgtcttattcgatgtgcacaggcaaatttaagatagtgaaagaaatagcagaaacccaacacggcacaattgtaattagagtccagtacgaaggcgatggaagtccatgtaaaatacctttcgagataacagacctggaaaaacgtcatgttctagggagattaatcacagtgaatcctatagtaaccgagaaagactctccagtaaacatagaagcagagccgccatttggcgatagctacattataattggggttgaaccgggtcaacttaaactaaattggttcaagaaaggcagctcgataggtcaaatgttcgagacaaccatgagaggcgccaaacggatggcaattctaggagatactgcatgggatttcgggagtctaggaggagtattcacctctattggaaaggcactccaccaagtatttggtgcgatttatggggcagccttttctggtgtatcttggactatgaaaatacttatcggagtgataattacatggattgggatgaactcccggagcacaagtctgtcagtatcattagtacttgtgggcgtcgttaccttatatttaggcgccatggtacaagcagactcgggttgtgtagttagctggaaaaataaggagttgaaatgcggatctggtattttcattaccgataatgttcacacttggaccgagcaatacaagttccaacctgaatcgccttccaaattggcttcggcaatacaaaaagctcacgaagaaggtatatgtggaatccgaagtgttacaaggttagagaacctaatgtggaaacaaataacaccggaattgaatcacatactgagcgaaaatgaagtcaaactaactatcatgaccggagatatacgagggattatgcaagctggtaaacgtagtctaaggccacaacctactgaattaaagtacagttggaaaacctggggaaaagctaagatgctaagcacggagtcgcacaatcaaacatttctaatagatgggcctgaaaccgctgaatgtccaaacacaaaccgtgcctggaacagtctagaagttgaagactatggatttggcgtcttcaccactaatatttggttaaaattacgggacaagcaagatgtgttttgtgattcgaaacttatgtctgcagccataaaagataatagggcggtacacgccgatatggggtattggatagaatcagcactgaatgatacatggaagatggaaaaagcgagcttcattgaagtgaaatcctgtcattggccgaagtcgcatactctatggagcaacggagtactagaaagcgaaatgattataccgaaaaactttgcaggaccagtatcacaacacaattatagacctggttaccatacacaaaccgcaggtccgtggcacttaggcaaactagaaatggactttgatttatgtgaaggtaccacagtcgttgttactgaagattgtgggaacagaggaccatcacttcgcacaactacagcatccgggaaattaataacagaatggtgctgccgatcctgcacactaccaccacttcggtaccgtggagaagatgggtgttggtatggtatggagataagacctttaaaggagaaagaggaaaacctagtcaatagccttgttactgcaggacatggccaaatagacaacttttcactaggagtcctcggtatggcactgctactagaagagatgcttcgtacccgaatcggaactaaacacgcaatattgttagtggccgtgagcttcgtaacgctgataacaggtaacatgagcttccgagaccttggacgtgtcatggtcatggtaggtgcaacaatgactgatgacataggcatgggagtcacatatcttgctttgttagccgctttcaaagttcgaccaacattcgcggccggcttgttgctccgtaaattaaccagtaaagagttaatgatggccaccattggtatagcattgctttcgcagtcgacaattccggaaacaatacttgaattaaccgatgccttagccctagggatgatggtactcaaaatagtaagaaatatggaaaaatatcaacttgccgtgacagtgatggcgattagttgcgttcctaacgcagtaatactacaaaatgcttggaaagtgagttgcactatcctcgctgcggtctccgtttccccacttctattaacctcaagccaacaaaaagcagattggattcctctcgcattgaccataaaaggattaaatccaacagccatttttcttacaacgttatcgaggacttcaaagaaacgatcatggcccttaaacgaggcgatcatggcagtaggaatggtttcaatactagcctcatcactattaaagaatgacataccaatgacaggccccctagtggcgggtggtttattaacagtatgctatgtcttaacaggccgatccgcagatctcgagttagagcgcgcagctgacgttaaatgggaggatcaagcagagataagtggaagttcacctatattaagcattacaatctcagaagatggtagtatgagcattaaaaatgaagaagaggaacaaaccctcacgatattgataagaactggtttactcgtgatatcaggtgtgtttcctgtctcaatacccattacggccgcggcatggtatctgtgggaagtcaagaaacaacgtgctggagtcctgtgggatgtaccatctcctcctccggtagagaaagcagaactggaagatggggcgtatcgaataaaacaaagagggatcttgggctattcacagataggggccggtgtatacaaagagggtacctttcacacgatgtggcacgttacaagaggggctgtattaatgcaccgaggcaaacgcatagagccgtcgtgggcagatgtcaagaaagaccttataagttatgggggaggctggaagttagaaggtgagtggaaggaaggagaagaagtacaagtacttgcattagaacctgggaaaaatccacgagcggtccagacaaaaccgggtatattcaagacaaacacaggtaccataggagccgtaagtcttgatttctctcctggaacttctggatcacccatagtcgacagaaaaggaaaggttgtagggctttacggaaacggcgtagttacacggagtggagcatacgtatcagctatagcacagactgagaaaagtatagaagacaaccccgaaatagaggatgatatttttagaaagaaacgactaaccatcatggatcttcacccaggggcaggcaagacaaaacggtatttaccagctatagtcagagaggcgataaaacgcggtctgcgcacattgatattagctccaacgagggtagtcgccgcagagatggaagaagcacttagaggtttgcctatacgatatcagacaacggctataaaaacagaacatacaggtagggaaatcgtcgatcttatgtgtcatgcaacattcacaatgcgtttactatccccagtaagagtgccaaattacaatttaatcattatggatgaagcacactttacagatccggcaagtatagcagcccgtggatatatatcgacaagagtagaaatgggggaagcagcgggcatatttatgacagctacaccaccaggctccagagatccctttccacagagcaacgcgcctataatggacgaagaaagggaaatacctgaacggtcttggaactcaggccatgaatgggtgacggattttaaaggaaagacagtatggtttgtgccctcaattaaggcaggaaatgatatagccgcatgtttaaggaaaaatggtaagaaagtgattcaattatcacgcaaaacttttgatagcgaatacgtgaaaactagggccaatgattgggactttgtggtcacaacagacattagtgaaatgggagctaattttaaggcagaacgcgttatcgacccccgcagatgcatgaaaccagtaatactcacagacggagaagaacgcgttatattagccggaccaatgcccgtaacgcattcatcagcagcgcaacgacgaggaagaataggtaggaatcctaagaacgaaaatgaccaatatatatatatgggagagccgctagaaaatgatgaagactgcgcacattggaaggaagcgaaaatgttactggacaacataaatacaccagaaggtataataccaagcatgttcgaacccgaaagagaaaaagttgatgcgatcgacggtgaatatcggctccgtggagaggcacgtaaaacatttgtggatctaatgcgcagaggggatctacctgtttggcttgcttataaggtagctgctgaagggatcaactatgccgataggaaatggtgttttgacggaatcaagaataatcagatactagaggaaaatatggaagttgaaatatggacaaaagaaggagaacgtaagaaactaaagccaagatggttagacgccagaatatacagcgatccattggctttaaaagagtttaaggagttcgcggcgggcaggaaatccttgacacttaatttaattactgaaatggggaggttgcctacattcatgacccaaaaagcacgaaacgcactggacaatcttgcagttttacataccgcagaagcaggcggtagagcatataaccatgccctaagtgaattacccgaaacactagaaacgctactattattgaccctattagccaccgtaactgggggcatatttctcttcctaatgagtgggaaaggaataggaaaaatgacccttgggatgtgttgtataataactgcctccatactgctctggtatgcccagatacaaccacattggatcgcggcaagtattattctggagttctttctcatagtgctgttgatccctgaacctgaaaaacagagaacaccgcaggataatcaactgacctacgtagttatagcaatattaacagtagtagcagcaaccatggcaaacgaaatgggttttctagagaagacgaagaaagatctaggattaggatccataacaactcaagaatctgaaagtaatatactcgacatagacttaagaccagcatcggcctggacactctatgcagtagctacaacatttgtaacaccaatgctaaggcacagcattgaaaattcgagtgtgaatgtatccctcactgcgattgcaaatcaagcaaccgtccttatgggtttgggtaagggatggcctctctcaaaaatggatataggggtacccttgcttgctattggttgttattcacaggttaatccaataacccttactgccgctcttttactactcgtagctcactatgcgataataggtccgggtctacaagcgaaagccactcgtgaggcccagaaaagggcagcggctggcattatgaaaaatcccaccgtagacgggataacggttatagacttagagccaataccatatgaccccaaatttgaaaaacagttaggtcaggtgatgcttttgattctctgcgtgacacaggtcctcatgatgcgcacgacatgggcgttgtgcgaggctttgaccctggcaacggggccaattagtacattgtgggaaggaaatcccggtagattttggaatacaacaatagctgtaagtatggcgaatatcttccgaggtagttacctagctggcgcaggcctgctattttcaatcatgaaaaacacaacaaatacccggagaggaactggcaacataggagaaacgttgggagaaaaatggaagagtcggctaaatgcattgggaaaatccgagttccaaatctacaagaaatcaggcattcaggaagttgatagaacattggcaaaagaaggaatcaagcgcggcgagacagaccatcatgcagtatcacgaggttctgcgaaattaagatggtttgtagaaaggaatatggtaacaccagaaggcaaagtagtagatttaggctgcggccgtgggggttggagctactactgtggaggactcaaaaacgtgagagaagttaaaggactaacgaaagggggtccgggacacgaagaaccaatacctatgtctacatatgggtggaacttggtcagattacaatcaggggttgatgtattcttcacacctccagaaaaatgtgatacgttattatgtgatatcggtgaaagctcacctaacccaacaatagaagctggaaggaccctaagagtgttgaacttagtagagaattggttaaacaataatacacaattctgcattaaagtattaaacccatatatgcccagtgtgatagagaaaatggaagcactccaaaggaagtatggaggagcacttgtacgaaatccattaagcagaaatagtacacatgagatgtactgggtaagtaatgcgactggaaacatagtttcgtcagttaacatgatttcgaggatgctaatcaataggttcaccatgaaacacaaaaaggctacatacgaaccagatgtagatttgggttctggtaccagaaacatagggattgaatcggaaatacctaatttagatataataggcaaaagaatagaaaagataaaacaagaacatgaaacatcctggcattacgaccaggatcacccatataagacatgggcatatcatggtagttatgaaacgaaacagacaggaagcgcaagttcaatggtaaatggtgttgttagattactaactaaaccatgggatgttgtgccaatggtcacacaaatggcaatgacggatacaacacctttcggtcaacaaagagtattcaaagaaaaagtggatacaagaacacaagagcccaaagaaggaacaaagaaactaatgaaaataactgctgagtggttgtggaaagagctaggcaagaagaaaacaccaagaatgtgtactcgcgaagaatttacaagaaaagtacgatccaacgcagcactaggtgcaatatttacggatgaaaataaatggaaaagtgcccgtgaagctgtggaggatggtagattttgggaactggtcgatcgggagaggaacttacatcttgaaggaaagtgtgaaacgtgtgtatacaacatgatgggtaaaagagaaaagaaattaggggaatttggaaaagcgaaagggagtagagcaatctggtatatgtggctaggagctagattcctagagttcgaagcattaggttttctaaatgaggatcactggttctccagaggcaattcactgagtggggtcgagggggaaggtctacataggttaggttacattctacgcgacgtaggtaagaaagaaggaggtgcaatgtatgctgatgacaccgcagggtgggacacacggattaccctagaagatcttaagaacgaagaaatggtcacaaatcatatgaaaggtgaacataaaaagctagcagaagcaatttttaagctcacttatcagaacaaagtcgtacgagttcaaagaccgacaccacgaggaacggtaatggacataatttcaaggcgcgatcagagaggttccggacaagtaggaacatatgggttaaacacgttcaccaatatggaggcgcaactaattcgacagatggaaggggaaggaatcttcaagtcaatacaacacctcacggccatagaagaaatagctgtgcaaaactggttagcccgcgtaggcagagaacgcttatcaagaatggctatatcaggcgatgattgcgtcattaaaccgatagatgacagatttgcctcagcacttacggcattaaatgatatgggaaaagtaagaaaggatatacaacaatgggagcctagcagaggttggaacgactggacacaagtcccattctgttcgcatcattttcatgaacttgtaatgaaagatggcagggttttagtagtaccatgcagaaaccaagatgaactaatcgggcgagcaagaatcagccaaggagcaggttggtcgctaaaagagactgcttgtctcggaaaatcctatgcccaaatgtggacacttatgtactttcataggagagacctaaggctagcagccaacgcaatctgcagtgcagtgccaagtcactgggtacctaccagcagaacaacatggagcattcacgctaaacatgagtggatgactactgaagatatgttagcagtgtggaatagagtgtggatacaagagaacccttggatggaagacaaaacacctgtagagtcgtgggaggaagttccctatctaggaaaaagggaagatcaatggtgtggtagtttgataggactgacgagccgagcaacatgggcgaaaaatattcaaactgctataaatcaggtaaggagcctaatagggaacgaagaatatactgactatatgcccagcatgaagagattcagaagggaagaagaagaagcaggagtactatggtaa

SEQ ID NO: 22379 - RNA, 9876 nt, synthetic construct
  misc_feature 1..9876: note = derived and/or modified CDS sequence (opt6) from DENV-2__KF955366__SS-prME
  source 1..9876: mol_type = other RNA
acagcaggagtcatagtaatgctaattcctacagcgatggcatttcacttaacaactcgaaacggagaaccacacatgatagtaggtcgtcaagagaaaggaaagtctctactgttcaaaacagaagatggagtaaatatgtgcaccttgatggctattgatttaggggaattgtgtgaggatactataacttataaatgcccgttattaagacagaatgaacccgaggatatagattgctggtgcaactcaacttccacttgggtcacatacggaacgtgcacgacaaccggagagcaccgaagagaaaagagatcagtcgcattagttcctcatgttggcatgggactcgaaactagaacagaaacatggatgagctctgaaggcgcatggaaacatgtacaaagaatcgaaacgtggatccttagacaccccggtttcaccattatggcggccatattggcgtacacaataggaacaacccacttccaacgtgcgttaatctttattctgctaacggcagtagcacccagtatgacgatgcgttgtatcggaatttctaatagagattttgtggaaggagtcagcggcggctcttgggtagatattgtattggaacatggttcttgtgtaacaacaatggccaaaaataagccaacattggactttgaactaataaaaactgaagctaaacagcccgcgacactaagaaaatattgtatagaggctaagttaactaatacaacaacggaatctcgttgccccacccaaggagaaccatcattaaacgaggaacaggataagagatttatatgtaaacactcaatggttgacagaggttggggaaacggttgtggattattcggcaagggggggattgtgacgtgcgcaatgtttacttgtaaaaaaaatatggaaggcaaagttgttcagccagaaaacctcgagtatacaattgtcattacaccacatagtggagaagaacacgcggttgggaacgacactgggaaacacggaaaggaaattaaaataaccccgcagagttcaatcacagaagcagaattaaccgggtatggtactgtcacaatggaatgttcgccacgaacaggcctagacttcaatgaaatggttttactacaaatggaagataaagcttggttagtacataggcaatggtttttggatttgcccttgccatggcttcctggagccgatacgcagggatcgaattggattcaaaaagaaactttagtaactttcaaaaaccctcatgcaaagaaacaggatgtcgtggtcctagggagtcaggaaggtgctatgcataccgcgttaactggtgcgactgaaatccaaatgagcagcgggaacttactcttcacaggacatctcaaatgccgactaagaatggacaaattacaactgaaaggtatgtcctattctatgtgtaccggtaaatttaaaatagtaaaggaaatagcggaaacacaacacgggacgatagttatcagagtacagtacgagggagacggaagtccttgtaagataccgtttgaaataactgatctagaaaaacgacatgtattaggaagattaataactgtaaatcctatagtgacggagaaagacagtccagtaaacatagaagcagaaccaccttttggagattcatacataataataggggtcgaaccgggtcaacttaaactgaattggttcaaaaagggttcgtctataggacaaatgtttgaaactacaatgcggggagctaagagaatggctattttaggagacacggcctgggacttcggcagcttgggaggagtattcacttcaataggaaaagcactacatcaagtatttggtgcaatatacggtgctgcattctcgggagttagttggaccatgaagattttaatcggagtaataataacttggattggtatgaattcaagatcaacttctctatctgtaagtttagttcttgttggtgtggtcacactatatctaggcgcggtggtccaagcggatagcggttgcgtagtgtcgtggaagaacaaggaactgaaatgtggatcaggaatttttattacagataatgtacatacttggactgagcagtataaatttcaacctgaaagtcctagcaaactagctagtgcgatacagaaggcccatgaggaaggcatctgtggaattaggagtgtaacaaggctagaaaatttgatgtggaagcaaataacacccgaactaaatcacatactgagcgaaaatgaagtaaaactaactattatgacaggtgacataaaaggaataatgcaggcggggaagagaagcttaagacctcaaccaactgaactaaaatattcatggaagacttggggaaaagcaaaaatgcttagcaccgaatcccacaatcaaacattcctcatcgatggcccagagacagcagaatgcccaaacacaaatcgcgcgtggaattccttggaagttgaagattatgggtttggtgtctttacaacgaatatttggcttaaacttcgtgagaaacaagatgttttttgcgattcaaaattaatgtcagccgccataaaagacaatagagcagtacatgctgatatggggtattggatagaaagtgcactaaatgatacgtggaaaatggaaaaagcatcattcatcgaggtaaagtcttgccactggcctaaatctcatacattatggagtaacggtgtgctcgaatcagaaatgataataccaaagaattttgcaggtcccgtaagtcaacacaattataggccagggtatcatacacaaacggcaggaccatggcatctaggcaagttagagatggattttgacttctgcgagggaacaacggtcgtagtaactgaagattgcgggaaccgcggcccttcgctacgcaccaccacagcatccggaaaacttataacagaatggtgttgcaggtcctgcacgttacctcctttgcggtaccggggtgaagatggatgctggtatggaatggaaattagaccattaaaagaaaaggaagagaacttagttaactccctagtaacggcgggacatggacaaatagataacttctcgctaggtgttttaggtatggccttatttttggaagaaatgcttcggaccagaataggtacaaaacacgcaatattactagtggcggtctcatttgtaactttaattacaggcaatatgtcgttccgagatcttggacgagtcatggttatggttggagcaacgatgacggatgacatagggatgggggttacttatctagcgttattagctgcctttaaagtccgcccaacttttgcagctggcctacttctcagaaagctgacttcaaaagaattaatgatggcaacaatagggatagcccttttatcccaatccaccattccagaaaccatcctagagttaacagatgcattagcgttaggaatgatggtattaaaaattgtgaggaatatggaaaaatatcaattagccgttacaattatggcgatatcgtgtgtgccgaatgctgttatactgcagaatgcatggaaagtctcatgcacaattctcgccgctgtcagtgtaagtccattattgctaactagtagccaacaaaaagcagattggataccattagctttaacaatcaaaggtctaaatccaactgctatatttttaacgacgctgtcacgaacatctaaaaaaaggtcttggccacttaacgaagcaatcatggcagttgggatggtgtccatacttgccagtagtttactcaaaaatgatatccccatgacaggacccctagtagctggtggcctcctaacagtctgttatgttctgacaggcaggagcgccgatcttgaattagaacgagcagcggatgtcaaatgggaagatcaggcagagataagtggatcatcccccattctctcaatcacaatcagcgaggacggaagcatgagtataaaaaacgaggaagaagaacagacactaaccatcttaataaggactggattattagttataagcggagtatttcctgtgagtataccaataaccgcagcagcttggtatctatgggaagtgaagaaacaaagggccggggtattatgggacgtcccatctccacctcccgttgaaaaagcagaattagaggatggggcttatcgaataaaacaacggggtatattagggtattcacaaataggggcaggtgtgtacaaggaaggcacattccacactatgtggcacgtaacaagaggagcggtacttatgcatcggggaaagaggattgagccatcatgggctgatgtcaaaaaagatttaatcagttacggtggtggatggaaactcgaaggagaatggaaagagggtgaagaagtacaagtattagctcttgaacctggaaaaaatcctagagccgtgcaaactaaacccggaatttttaaaaccaacacagggacgataggcgcagtgtctcttgatttctcgccaggaacaagtggctcacctatagtagatcggaaaggaaaagtagtgggactgtatggtaatggagtggtgactcggtcgggtgcctacgtgagtgctattgctcaaactgagaagtcaattgaagataaccctgaaattgaggatgacatctttcgaaaaaagagattaacaataatggatttgcacccaggcgccggtaaaaccaaaaggtacctacctgcgatagttcgagaagcaataaaacgaggactgaggactctaatactagctcccactcgagttgttgcagcggaaatggaggaagcactaagggggttgcccataagatatcaaacacccgcaatcaaaaccgagcataccggacgggaaatagtagatttaatgtgccacgcaacttttactatgagactattatcacccgtaagggtacccaactacaatctaataattatggatgaggcacatttcactgatcctgctagcatcgccgctagaggctatattagcactagagttgaaatgggagaggcagccggcatattcatgactgcaacatccccgggctccagggatccattcccccaaagtaatgcgccaattatggatgaagaaagagaaattccagaacgctcgtggaacagcggccacgaatgggttactgactttaaaggaaaaaccgtatggttcgtgccgtccattaaagcgggaaatgacatagcggcatgcttacgaaagaacggaaaaaaagtaatacaattaagtagaaaaactttcgattcagaatatgttaaaacaagggctaatgactgggacttcgttgtaacaacggatataagtgaaatgggggctaacttcaaagcagagcgagtcatagatccgcgtcggtgtatgaaacccgtaattctaaccgatggagaggaaagagtcattttagcggggccgatgcctgtaacacatagctcagccgctcaacgtcgagggcggataggcaggaatccaaaaaatgaaaatgaccagtatatatatatgggtgaaccactagagaatgacgaagattgcgcacattggaaagaagcaaaaatgttgctagataatataaacaccccagagggcattattccaagtatgtttgaacctgaacgcgagaaagtagatgcaatagacggtgagtatcggctgaggggagaagcaagaaaaacctttgtcgacttaatgcgaagaggggacctacctgtatggttggcctataaagtcgcagcggaaggaataaactacgcagaccgaaaatggtgcttcgatgggatcaaaaataaccagattttggaagaaaatatggaggtagaaatctggactaaggaaggcgaaagaaagaaactaaagcctagatggttggacgcgcgaatttacagcgatccactcgcactaaaggagtttaaagaatttgcagccggaaggaaatcgcttactctaaatcttataactgaaatgggcagactacccacgttcatgacacaaaaggcaagaaatgccttagacaatctagccgttttacatactgcagaagctggtggaagggcctataatcatgcattatctgaattaccggagactttagaaacgctgcttctattaaccttactagcaacagtaacgggcggaatatttttattcttaatgtctggaaaggggataggcaaaatgacacttggaatgtgttgtattataacagcaagtatactactatggtacgcacaaatacaaccgcactggatcgctgcgagtataatattggagttttttttgatagtattattaatcccagaaccagagaagcaaagaaccccgcaagacaatcaacttacgtatgtcgtaattgccattcttacagtcgtagcggccaccatggccaatgaaatggggttcctggaaaaaacaaaaaaagacttgggcttgggatccatcacaacacaagaatcagagagtaacatattggatattgacttaagaccagcgagtgcttggactttatatgccgtagccacgacttttgtaactccaatgcttcgtcacagtatagaaaattccagtgtcaacgtatctttgacggctattgcgaatcaagcaaccgtattaatgggattaggcaaagggtggcctttaagtaaaatggacattggcgtaccattacttgccataggctgctattctcaggttaacccaattactttaaccgcggcactcctgctattagtcgcccactacgccattattggcccaggtctccaggcgaaggcaacacgcgaggcccagaaacgagcggccgctggaatcatgaagaacccaacagtggatggaataacggtaatcgacttagaacccattccatatgaccctaaattcgaaaagcaattaggccaagtaatgctcctaatattgtgcgtaacccaagtactaatgatgaggacaacatgggccctgtgcgaagcgctgacgttagcgactggtccaatatccacattatgggagggcaatccggggcgattttggaatacaactatagcagttagcatggctaacatattcaggggatcatacctagcgggggctggattactattttccattatgaaaaacacaacatcaacaagaagaggtactggtaacataggagaaacacttggcgaaaaatggaagagtagattgaatgctctagggaagagcgaatttcaaatatacaagaaaagcggaattcaagaagtcgatagaacattagcgaaagaagggattaaaagaggggagacagaccatcatgcagtatctagaggctccgcgaaattaagatggtttgtagaaagaaacatggtgacaccagaagggaaggtagtggatttaggatgcggtcgtggaggatggtcgtattattgcggaggtttaaaaaacgtccgcgaggtcaaagggcttactaagggtggtccaggccatgaggaaccgatacccatgagcacatatggatggaacctcgtgcggttacaaagtggtgtggacgtcttttttacccctcctgagaaatgcgacacgctgttatgtgacataggagaatctagcccgaaccctacaattgaagcagggcgcacacttcgtgttcttaatctagtagaaaattggttaaataataacacacaattttgtatcaaagtattgaacccttacatgcctagcgtcattgaaaaaatggaagctttacaacgacagtacggtggagcacttgtacgcaatccactctccagaaattctacacacgagatgtattgggtaagtaacgccacaggaaatatagtatcctcggttaacatgatttcaagaatgctaatcaaccgcttcacgatgaaacacaaaaaagcaacctatgaaccagatgttgatctaggttcgggtaccagaaatattggtatcgaatccgagattcctaatctcgacatcattggaaagcgaatagaaaaaatcaaacaagaacacgaaatttcgtggcattacgaccaagatcatccatataaaacgtgggcctatcatggctcatacgaaacaaaacaaaccggttcagctagcagtatggtgaatggagttgtgaggctgcttacaaaaccatgggatgtagttcctatggttactcagatggctatgactgacacaacaccttttggtcagcagagagtatttaaagaaaaagtcgataccagaacacaggagcctaaagaaggcactaagaaactaatgaaaataacagctgaatggctttggaaggagctaggcaaaaaaaaaacccccagaatgtgtacaagagaggagtttacgaaaaaagtacgttcgaatgctgcgttaggtgctatatttactgatgaaaataaatggaagtcggctcgtgaggcagtagaagatggacgtttttgggaactagtagaccgtgaacggaatttacatctagaagggaaatgtgagacatgcgtttataatatgatgggaaaaagagaaaaaaagctaggtgaatttggaaaagcaaaaggaagtcgcgcaatatggtatatgtggttaggcgcaagatttctggaatttgaagcgctaggttttttaaatgaagaccattggttttcaagaggaaacagtcttagcggtgttgaaggcgaaggcttacaccgcttaggttatatcttgcgagacgtaggcaaaaaagaagggggtgcgatgtatgctgatgatactgctgggtgggacacaagaattacgctagaagacctgaaaaacgaagaaatggtcacaaatcacatgaaaggagaacataaaaagcttgcagaagcaattttcaaactgacatatcaaaataaggtggtcagggtccaacggccaactcccaggggcactgttatggacataatatcgcgcagagaccaacgaggttcaggacaagtcgggacttatgggttaaatacgttcactaacatggaagcacaattaataaggcaaatggaaggcgagggcatatttaaatccattcaacacttgactgcaacagaagaaatcgcagtgcaaaactggcttgcccgcgtaggacgggaacgattaagcagaatggccatatcaggtgacgattgcgtcgtaaaacctatagatgatcgtttcgcttcagctctcactgctttaaacgatatggggaaggtcagaaaagatatccaacagtgggaaccatctcgaggttggaacgattggactcaagttccattctgtagtcatcattttcatgaattagttatgaaagatggtcgggttctagttgttccatgtagaaaccaggacgaattaatcggtagagctagaatatcacagggagcaggttggagcctaaaggaaacagcctgtctaggaaaaagttatgcacaaatgtggacactgatgtattttcacaggagagatctaagattagctgcaaatgcaatctgcagcgcagttccatcacactgggttccaacgtcgcgaacaacatggtctatacatgctaagcacgaatggatgaccactgaggatatgttagcagtgtggaatagagtttggatacaggaaaatccgtggatggaagacaagacacctgtagaaagttgggaggaagtaccatacctaggaaagagagaagatcagtggtgcggtagcctaattggattaacaagtagagcaacatgggcaaaaaatatacaaactgctataaatcaggtacgtagtctgatcggaaacgaagagtatactgactatatgccatcaatgaaaaggtttagaagagaagaagaggaagctggcgtactttggtga

SEQ ID NO: 22380 - RNA, 9876 nt, synthetic construct
  misc_feature 1..9876: note = derived and/or modified CDS sequence (opt6) from DENV-2__EU569700__SS-prME
  source 1..9876: mol_type = other RNA
acagcaggggtaatagtgatgctaattcccaccgccatggcatttcatctaacgaccagaaatggagaaccccacatgatagtaggaagacaagaaaaaggcaaatcactgctgttcaaaaccgaagatggagttaacatgtgcacactaatggcgatagatcttggagaattatgcgaagacaccatcacatacaaatgtccgttgctacgccagaacgaaccagaagatatcgattgctggtgtaattcaacttccacgtgggtaacttatggaacatgtaccaccacaggggaacatcgacgcgagaaaagatcagttgctttggtaccacacgtagggatgggactagaaacacgtacagaaacgtggatgtcgtcagaaggagcctggaaacacgtgcaacgaatcgaaacatggattctccgacatccggggtttaccatcatggccgcgatcttagcttataccattgggaccactcattttcaacgagcattgatcttcatattactaacggccgtagctccatcgatgactatgaggtgtatagggatatccaatagagatttcgtggaaggcgtaagtggtggatcttgggtggatatcgtactagaacatggctcatgcgttacaacgatggccaaaaacaaacccactctcgacttcgaacttataaaaactgaagcgaaacaaccggctacgctcagaaaatattgcatagaagcgaaattaacaaatacgacaacagaaagcagatgtcctactcaaggagaacccagtcttaacgaagaacaggacaaaagatttatatgtaaacattccatggttgatcgaggatggggcaatgggtgcggtttattcggtaaagggggtatagtgacatgtgcaatgtttacatgtaagaaaaacatggagggcaaagttgtccagccagaaaatttagaatacacaattgtaatcacacctcattctggagaagaacacgcagtgggcaacgacaccgggaaacacggaaaagaaataaaaataacgccccaatctagtatcactgaagctgaactaacgggatacggaacagtaacaatggaatgctcaccgcggacaggactagattttaacgaaatggtactactacagatggaagataaagcatggctagtgcatagacaatggttccttgatttaccgctgccctggttacctggtgcagacacacaaggtagcaactggatccaaaaagaaacactcgttacattcaaaaatccacacgctaagaagcaagacgtggtagttctggggtcacaggaaggcgcaatgcatactgcgttaactggagcaacggagattcaaatgtcttctggaaatttgttattcactggtcatttaaaatgccggcttcggatggacaaattacagttaaaaggaatgtcatattctatgtgtaccggtaaattcaaaatagtaaaagagatagcagaaacgcaacatgggactatcgttattcgagtacagtatgaaggtgacggaagtccatgtaagataccttttgagattacggacttagagaaacgacatgtattaggccgccttatcacggtaaatccaatcgtaactgaaaaggatagtccagtgaatatagaagcggagcctccatttggcgatagttacataatcataggagtagaaccaggacaactcaagttaaactggtttaagaaaggtagcagtataggacaaatgtttgaaactacaatgaggggtgctaaacgaatggcaatacttggtgacacagcatgggacttcggcagcctagggggcgtttttacaagtattggcaaggcgcttcatcaagtattcggcgctatctatggagctgcattttctggagttagctggaccatgaaaattctaattggtgttatcataacatggataggaatgaatagcagaagcacgtcattaagcgtttccttagttctcgtaggggttgttactttatatcttggcgccgtcgtgcaagcagatagcggctgtgtagtctcatggaaaaataaggaattgaagtgtggttcagggatattcataactgacaacgtacatacttggactgaacaatacaaatttcaaccagaatcaccttcgaaattagcttcagcgatccaaaaggctcatgaagaaggaatatgtgggataagaagcgtaacacggttagaaaatctaatgtggaaacagataacccctgaattaaatcatatactgtcagaaaatgaagtaaaacttaccattatgactggagatataaaaggtattatgcaagcaggtaaaagatctttaagaccccagcccacggagctcaaatacagttggaaaacatggggtaaagcaaaaatgttgtctacggaaagccacaatcaaacctttttaatcgatggtccagaaacagcggagtgccccaacactaatagagcctggaatagtcttgaagttgaggactacggattcggtgtttttacaacgaacatttggttaaaactaagagaaaaacaggatgtattttgcgactcaaaattgatgagcgccgcaattaaagacaacagagctgttcatgctgatatgggatattggatagagtcagcacttaacgatacttggaaaatggagaaggctagtttcattgaagtaaagagctgtcactggccgaaatcacatacactttggagcaatggagtgttagaaagtgaaatgataattcctaaaaattttgcaggaccagtatcacaacataattatcggcctggataccatactcagacggcagggccttggcaccttggaaaacttgagatggattttgacttttgtgaaggaacaaccgtcgtagttacggaagactgcggaaatagaggcccgtcattaagaactacaacagcaagcggcaagttaatcactgaatggtgctgcagatcttgtacacttccacccttgagatacaggggtgaagatggatgctggtatggaatggaaatacgaccattaaaagaaaaagaagaaaatcttgtaaatagcttagtaacagcaggacatggacaaatagacaacttctcattaggagttctaggaatggcactgttcttagaagaaatgctccggaccagaataggaacaaaacatgctatcttactcgtagccgtaagtttcgtgactctaataacaggaaacatgagtttcagagatttaggtcgtgtaatggtaatggttggtgccacaatgaccgacgatataggtatgggagtaacttacctagcactcttagcagctttcaaggttaggccaacattcgcagcgggactactattaaggaaattaacgtctaaagaattgatgatggcaacaattggtatagccctattatcacaatcgacaattccagaaacaatcttagaactaactgacgccctcgccttaggtatgatggtgcttaaaattgtacggaatatggaaaaatatcagctagcagttactataatggctataagttgtgtaccaaatgcagtgatactacaaaatgcgtggaaagttagctgcaccatattggcagctgtttctgtcagcccattactactcacctcctcgcaacaaaaggcagattggattccgttggcccttaccattaaaggacttaatccgactgcaatatttctaacgaccttgagccggacgtccaaaaagagaagctggccacttaacgaagcaataatggctgtcggaatggtaagtatattggcaagtagccttttgaaaaatgacatccccatgaccggacctctagtggcgggcggcttactaacagtctgttatgtcctcacagggcgaagcgccgatttggaactagaacgagcagcagacgttaaatgggaggatcaggctgaaatatctggaagtagtccaatacttagcatcacgattagtgaagatggatctatgtcaatcaaaaatgaggaagaggaacaaacgttaactattttaatccgcactggcttgctcgtcatttcaggtgtttttcccgtctcaatacctataacggcggcggcctggtatctttgggaggtcaagaaacagagggcaggggttctgtgggatgtaccatcgccaccgccagtagaaaaagcagaattggaagatggggcatataggataaagcaaaggggaatactaggctattctcaaattggagccggtgtgtacaaagaaggaactttccatacaatgtggcatgtcactagaggcgcagtcttgatgcatcgcggaaagcgaatagaaccctcttgggcggatgttaagaaagaccttatcagttatggagggggttggaaactagaaggagaatggaaggaaggagaagaagttcaagttcttgcactagaaccaggcaaaaatccacgggcagtccaaactaagccgggaattttcaagacaaacaccggaaccataggagcagtatccttagatttctcaccaggtacatcaggtagtccaattgtagatagaaaagggaaagtagtaggtttatatgggaacggcgtggtaacacggtcgggtgcttatgtatcagcaatagcacagactgaaaaatctatagaggataacccagaaattgaagacgacatctttcgtaagaaacggttgactattatggacttacatcccggagcgggtaaaacaaagagatatttgcctgccattgttagagaggccattaagagaggattacgaaccctaattttagcccccactagagtcgttgccgcagaaatggaagaagcgctgcggggcttgccgattaggtaccaaacacccgcaataaagaccgaacatacaggaagagaaatagttgatttaatgtgccacgcgacgtttacaatgcgcctactctccccagttagagtaccaaactacaatctaataatcatggatgaggcacactttacagatcccgcctcgatagcagcaagaggttacatctcaaccagagtggaaatgggtgaagcagcaggtatttttatgaccgcaactccacccggctcccgagacccttttccacagagcaatgcgcccattatggatgaggaacgtgagattccagagcgatcttggaatagtggacacgagtgggtaacagatttcaagggtaaaactgtttggtttgtaccatcaatcaaggcgggaaacgacatagccgcttgcctacgtaaaaacggaaagaaagtgattcaactcagcagaaaaaccttcgacagtgagtacgtaaagacacgcgctaatgattgggacttcgtagttacaaccgatatttccgaaatgggagcgaacttcaaagcggaacgcgtcatcgacccacgtagatgcatgaaacccgttatcttaaccgatggcgaagaacgagtaatattagctggtccaatgcctgtgactcattcgtcagctgctcagaggcgagggcggataggaagaaaccccaaaaacgaaaatgatcaatatatatatatgggtgagccattagaaaatgacgaggattgtgctcactggaaagaagctaaaatgctattagacaatattaacaccccagaaggcattataccaagcatgttcgaaccagaaagagaaaaagtagatgcaatagacggggaatacagactccgaggagaagccagaaagacattcgttgatcttatgcgcaggggagatcttccagtatggttggcctacaaagtcgcggctgaaggtataaactacgcggacaggaagtggtgctttgatggaatcaaaaataatcagatccttgaggagaatatggaagtcgaaatttggaccaaagagggagaacgaaagaaacttaaacctcgatggctagacgcaagaatatattccgatcccctagcgttgaaagagttcaaagaatttgcagcgggcagaaaaagccttaccttaaacctcattaccgaaatggggagattaccgacattcatgacgcaaaaagctagaaatgccctagacaatctagccgttttgcatacagcggaagccggtgggagagcatataatcacgctttgagcgaattacctgaaacactagagactttattattgttaacgttactcgctactgttacaggcggtatatttctcttcttaatgagcggcaagggaatagggaaaatgactctgggaatgtgttgtataattacagcgtcaattctactatggtatgcccagattcagccacactggattgcagcgtccataatactcgagttcttcctaatagttttgctgatcccagagcctgagaaacaaaggacaccccaagacaaccaactaacttatgtggttatcgccatcttaacagtagttgctgccaccatggccaacgaaatgggctttctcgagaaaacgaagaaagatctaggccttggatcaatcactacgcaagaaagtgaatctaatatattagatatagacttacgtcctgcctcagcatggacactctatgcagtggcgacaacctttgttacacctatgcttcgccactcaattgaaaattcttctgtaaacgtaagtcttaccgccatagctaatcaggcaacagtgttgatgggcttagggaagggatggcccctaagtaaaatggatataggtgtaccactgcttgccattgggtgttattcacaggttaacccaataacactaacagctgcgttgctacttttggttgctcattatgccattattggaccagggttacaagcaaaagctacaagggaagcgcaaaaacgcgcggcagcgggcataatgaagaatccgacagtagatggaattacagtaattgatttagaaccgataccgtatgatcctaagttcgagaaacaactggggcaagtaatgctacttattctttgcgtaacgcaggttctaatgatgagaacaacttgggctttatgcgaggctttgacgctcgcgacgggaccaatttctacattatgggaaggaaatccaggaagattctggaataccacgatagctgtctcaatggcaaatattttccgcggctcatacttggctggagctggattattatttagcataatgaaaaatacgacatcaaccagaagagggacgggcaatataggagaaacattaggagaaaaatggaagagtagactaaatgccttaggaaaaagtgaatttcaaatatacaagaaatcgggaatacaagaggttgatagaactcttgccaaagagggcatcaaacgaggtgagactgatcatcacgctgtatcacgaggtagcgcaaagttaaggtggtttgttgaaagaaatatggttacccctgaggggaaagtggttgatctcgggtgtggaagaggagggtggtcttactattgtggcggactcaaaaacgtgagagaggtgaaaggtttgacgaaaggaggacccggtcatgaagaaccaattccaatgagtacatacggatggaatttggtacgtttacaaagtggtgtcgatgtattctttacacctccagaaaaatgtgatacactattgtgtgatataggagaatcaagcccgaatccaactattgaggcagggcgtacattacgagtgctaaatctagtcgaaaactggttaaacaataatactcaattctgcatcaaagttctaaacccatacatgccaagcgttatagaaaagatggaagcactacagcgacaatacggcggagcacttgttaggaacccattaagtagaaatagtacacatgagatgtactgggtcagcaatgccacagggaatatagtatcatcagttaatatgatctcaaggatgctaattaacagattcacgatgaagcataagaaagcaacttacgagccagacgttgacttaggtagtgggacaagaaatataggaattgagtcagagatcccaaacctcgacataataggaaaacgaatcgagaaaataaaacaagaacatgaaatcagttggcattacgaccaggatcatccctacaaaacctgggcctatcacggttcttacgagacaaagcaaacaggtagcgcgagctcaatggtcaatggcgttgttcggttgctcactaaaccttgggatgtagtacctatggtcactcagatggctatgacagatacgaccccttttgggcaacaacgagtattcaaagagaaagtcgatacgcgaacacaagaaccaaaagagggtactaagaaactaatgaaaataactgcagaatggctctggaaagaactcggcaaaaagaaaacacccagaatgtgtactagagaggagtttactaagaaagtacgttccaatgcagctttaggagctatttttacagatgagaataaatggaaaagtgcaagagaagcagttgaagacggacgcttctgggagctagtcgacagagagagaaatttacacctggaaggcaaatgtgaaacgtgcgtgtataatatgatgggaaaaagggagaagaaactaggagagtttggtaaagccaaaggctcaagagctatttggtatatgtggttaggagctcgattcctagagtttgaagcactaggatttctaaacgaagatcactggtttagcaggggaaatagtttatcaggcgtagaaggtgaaggccttcatagattgggctacattttacgggatgttgggaagaaagaaggaggagctatgtatgccgatgatacagcaggctgggacacgcgaataactctagaagacctaaagaacgaagagatggtcaccaatcacatgaaaggtgaacataaaaagctagcagaagctatatttaaattaacataccaaaataaagtcgttcgcgttcaaagaccgacaccacgcggaacggtcatggacattatatcaagaagagatcagcgaggaagcggtcaagttgggacttacggtctcaacacatttacaaacatggaagcacaattaattaggcagatggaaggggaaggcattttcaaaagtattcagcatcttacagccaccgaagagattgcggtgcagaattggctggcacgggtaggaagggaacgacttagtagaatggcaataagtggtgatgactgtgtagtaaaacctattgacgacagatttgcttcagcactaacagctttaaatgatatgggtaaagtccgaaaagatatccaacagtgggaaccatcgcgtgggtggaacgactggacacaggttccgttttgtagtcaccatttccacgagctagtgatgaaagatggacgtgtcttagtagtaccctgccggaatcaagatgaattgattggaagggcccggatctcacaaggagcgggatggagtctaaaggagaccgcttgtttagggaaaagctacgcacaaatgtggactttgatgtattttcaccgcagagatttgaggttagctgcgaatgcgatctgctcagcagtaccgtcacattgggtaccaacatcacgaacgacatggagtattcatgcgaaacacgaatggatgactactgaggatatgctagccgtttggaatagagtatggatacaagaaaatccatggatggaagataagacccctgttgagtcgtgggaggaagtcccctacttgggaaaaagagaagaccaatggtgcggcagtcttattggattaacttcgagagctacatgggccaaaaatatccagaccgcaattaatcaggtgcgttctttaataggtaacgaagaatatacagactatatgccctcaatgaagcgatttagacgtgaggaagaggaagctggcgtattatggtga

SEQ ID NO: 22381 - RNA, 9876 nt, synthetic construct
  misc_feature 1..9876: note = derived and/or modified CDS sequence (opt6) from DENV-2__KF955369__SS-prME
  source 1..9876: mol_type = other RNA
actgcaggagttatcgtaatgttaataccaacagcaatggccttccatttaactacaaggaacggcgagccgcacatgattgtaggaagacaagagaaaggaaaaagtctgttatttaaaacagaggacggcgtaaatatgtgcactcttatggcaatagacctgggtgaactttgcgaggatactatcacatataagtgtccactattaagacaaaacgaaccagaagatatagattgttggtgtaattcaacaagtacgtgggtaacatacggcacatgcacaactacaggggaacaccgtcgagaaaaacgaagcgtcgccttggtgcctcacgttggtatggggctggaaacccgtacggaaacgtggatgtcaagcgaaggggcgtggaaacatgttcaaaggatagagacatggattctaagacacccgggtttcactataatggcagcaatactagcttacaccatagggaccactcactttcaaagagcactaatattcattttattaacaacagtagctccatctatgaccatgcgatgtattgggattagcaacagagatttcgttgaaggagtgtcaggcgggtcatgggtcgatattgtactggaacatggatcatgtgtgacaactatggccaaaaataagccaacattagactttgagctaattaaaactgaggctaaacaaccagctacgctaagaaaatattgtattgaagcaaaactaactaacacaacaacggaaagtcggtgcccaacacaaggagagccctccctaaatgaagagcaggataaacgcttcatctgcaaacattctatggtagatcgtggttggggaaatggatgtgggctttttggcaaaggtggcatagtaacctgtgctatgttcacatgcaagaaaaatatggaaggtaaagtcgttcagccagaaaacttagagtatacaattgtaattacccctcactcaggtgaagaacacgctgtcggaaatgatacgggaaaacatggaaaagaaataaaaataacacctcaatcctcgattacagaggctgaattaaccggatatggtacagtaactatggaatgtagtccacgcacaggtttagatttcaatgaaatggtattattacaaatggaagataaagcgtggcttgtacataggcaatggtttctagatttaccactcccatggcttccaggagctgacacgcaaggatcgaattggatccagaaagaaactcttgtcacgtttaaaaacccacatgctaagaaacaggacgttgtagtattgggatcccaagaaggggctatgcataccgcactaacaggcgcgacagaaatccaaatgagctcagggaatttattatttacaggacatttaaagtgccggctaagaatggataaactgcaacttaaaggaatgtcttacagcatgtgcacagggaagttcaaaattgttaaggaaattgcagaaacacaacacggtacaatcgtaattagagttcaatatgaaggagatggaagtccatgtaaaatcccctttgaaatcactgatctcgaaaagcggcatgtacttggccgattaattaccgtgaatcccatagtgactgaaaaagattcaccagtaaatatcgaggcagaaccaccattcggcgacagctatatcataataggagtagaacctggccaactaaagcttaattggttcaaaaagggctcttctattggccaaatgttcgaaactacaatgcggggtgctaaaaggatggcaatactcggggatactgcttgggactttgggtcattggggggtgtgtttacaagtatcggaaaagcgttacatcaagtattcggggcaatttatggggctgcgttctctggcgtttcatggacaatgaaaatactgattggagttattattacttggatcggaatgaattcgcgttcaaccagtttgtctgttagtctagtattggtaggtgtcgtaactttatatttaggagcagtcgtacaagctgactcgggctgtgtagtttcatggaaaaacaaagaattgaaatgtggcagtggaatatttataaccgataacgtacacacctggaccgaacagtataaatttcaaccagagagtccaagcaaactcgcatcggctatacaaaaagctcatgaagaagggatatgcgggatacgaagtgtaacgaggttagaaaatttaatgtggaaacaaatcacgccagaattaaatcatatattaagcgaaaatgaagtaaagcttaccattatgacaggagatattaagggcattatgcaggctggaaaaagatccctaagaccgcaaccaacagaattgaaatattcctggaagacctggggcaaagccaaaatgttatctacagaatctcataatcaaacatttttaatagacggtccagaaactgccgaatgtccaaatacgaacagagcgtggaattcacttgaggtagaagactatggcttcggggtattcacaacaaacatatggcttaaactcagagaaaagcaagacgtgttctgtgatagtaaacttatgtctgcagccattaaggacaaccgggcagttcatgctgatatgggctattggattgaatcagcactaaacgatacatggaaaatggagaaagcgtcgttcattgaagtcaaaagctgtcactggccaaagtcacatacgttgtggtcaaacggtgtactcgaatccgagatgatcataccaaagaactttgcggggccagtctcacaacacaattatcggcccggatatcacacccaaacggcgggcccgtggcatcttggaaaactcgaaatggattttgacttttgtgaaggtactacagtcgtagttactgaagattgtggaaatcgtggaccatcgttaagaacgaccactgcgagtggcaagttaattacggaatggtgctgtcgtagctgcactctacctccattacgttacagaggagaagacggttgctggtatggtatggagatacgcccattgaaagaaaaggaagaaaatcttgttaacagcctcgtaacagcaggtcacggacaaattgataatttcagtttaggtgtgctaggaatggcgctctttctagaggagatgcttcgaactcgaatagggacgaaacacgcaatattactagtagctgtaagttttgtaactttaattacaggaaatatgtcgtttcgcgacttagggagagtaatggtaatggtaggagcgactatgactgatgacattgggatgggggtaacttacctagcattgctagccgctttcaaggtgagacccacgttcgctgccggattgcttttacgaaaattgacctcaaaagaacttatgatggctacaattggcatagcgctattatcacaatcaaccatcccagaaacaattctagaactaactgatgctcttgcgcttggtatgatggtactaaaaatcgtaaggaacatggaaaagtaccaacttgcagttacaattatggctatatcatgtgtgccaaatgcagtcattctgcaaaatgcttggaaggtatcttgcactatactcgctgctgtgagtgtgtctccactacttttaacatcatcacaacaaaaagctgattggattccactagcgttaacaattaaaggtttaaaccccaccgcgatatttttaacaacgttatcaagaacctcaaagaagcggtcatggcccctcaatgaagcaataatggccgtagggatggtgagtatactcgcgagcagcttgttaaagaacgatataccgatgaccggtcctctggtcgccggaggacttctcactgtgtgctacgttttaacagggagatccgcagacctggaactcgaaagggcagcagatgttaagtgggaggatcaagccgaaatatctggttcatccccaatcctatctataacaatatccgaagacgggagcatgagcataaagaacgaagaagaagaacaaacgcttactatactaataagaacagggctattagtgatttctggtgtattcccggttagtattcctataaccgccgcagcgtggtacttgtgggaagtaaaaaaacaacgtgcaggggtgctatgggacgtaccatccccgccaccagtagaaaaagcagaattagaagatggcgcatatagaataaagcaacggggaattttaggctactcacaaataggagcaggtgtatacaaagaaggtacctttcacacaatgtggcacgtgacaagaggagcagttctaatgcacaggggtaaacgtatagaaccttcttgggcggacgtcaaaaaagatttgatctcttacggaggtggttggaaactagaaggcgaatggaaagaaggggaagaagtccaggtcttagctctggagcccggcaaaaatccaagggcagtacaaacaaaaccaggcatatttaaaactaatacaggtaccataggcgcagtaagcctagatttttccccaggaactagtggatctcctatcgtggataggaagggtaaggttgtaggactttacggcaatggtgtagtcacgagaagtggcgcgtacgtgtcagctattgcgcaaactgaaaaatcaatcgaagataatccagaaattgaagatgacatctttagaaaaaaacgattaactataatggatctgcacccgggtgcaggaaagaccaaacgatatttgccggctatagtacgtgaggctataaaaaggggcttgagaacattgatacttgcaccaacccgtgtcgtcgcagcggagatggaagaagcactacgtggcctacctatccgatatcagacacccgcaataaagactgaacatactggcagagaaatcgtagatctaatgtgtcatgctacatttacgatgagactcttgtcgccggtacgagttccaaattacaacctgattataatggatgaggcccattttacagacccagcctctatagcagcacgggggtacatttcaacaagagttgagatgggagaggcggctgggatatttatgacagcaaccccacctggatccagggatccttttccacaaagcaatgctccaataatggatgaagaaagggagatccctgaaaggtcctggaatagcggacatgaatgggtgacagattttaaaggtaaaacagtctggttcgttcctagtataaaagcaggcaatgacatagctgcatgcctacgaaaaaatggtaaaaaagtgatccagcttagccgaaaaacgttcgacagcgaatacgttaagacaagagcaaacgattgggacttcgtagttacaacagatattagtgaaatgggtgctaactttaaagcagaaagagtcatagacccccgtaggtgtatgaaacctgtaatacttacagatggtgaagaacgcgtcatactagctggcccgatgcctgttacacattcttctgcagcacagcgtagaggtaggattggtcgaaatcccaagaacgaaaatgaccagtacatctacatgggtgaacccttagaaaatgatgaagactgcgcccattggaaagaggccaagatgttgttagataacataaacaccccagaaggtataataccgtctatgtttgagccagaacgtgaaaaagtagatgccattgatggtgaatatcgtttaaggggagaggcccgaaaaactttcgtagacctaatgaggagaggtgatctaccggtatggttagcgtacaaagtcgcagcagaagggatcaattatgcggacaggaaatggtgcttcgacggtattaaaaacaaccaaattttagaagaaaacatggaggtggaaatatggacaaaagaaggtgaaagaaaaaaactcaaaccccgatggttagacgcaagaatctactccgatcccttagctttaaaagaatttaaagaatttgctgccggaagaaaaagcctaaccttaaatctgataacagaaatgggccgattaccgacattcatgacccaaaaagctagaaacgccttagataacctcgcagtgctccatacagcagaagcgggtggccgagcatacaatcacgcgctttccgaattacccgagacattagaaactcttttactactaacattactagcaactgtaactggaggaatatttttattcctgatgtctggaaaaggtattggcaaaatgaccctaggcatgtgctgcataataacggcatcaattctgttgtggtatgctcagatacaaccacactggatcgccgcgtcgataatacttgaattcttcttaatagttttactgataccagaacccgaaaaacagcgcactccacaagataatcaactaacctacgttgtgatagctatactaacggtagtggccgcgaccatggcgaatgaaatgggattcttggaaaagacaaaaaaggaccttgggcttgggtctataacgacccaggaatcagaatcaaacatactagacattgatctccgcccagcatccgcgtggactctatatgcagtagctacaacattcgttaccccaatgttaaggcattcgatagagaattcgagtgtgaacgtgagtttaacggctatagctaatcaggcaacagtactaatgggactaggaaaaggttggccactaagtaagatggacattggagtgcctctattagcaataggctgctatagccaagtaaatccaataacgctcactgcagcattactgttattggtcgcacattatgcaataatcggacctggattgcaggcaaaggcgactcgcgaagcacaaaaacgtgccgcagcaggaataatgaagaatccaacggtagacggaatcaccgtcatagatttagaaccgattccatatgatcccaagttcgaaaagcaactgggacaggttatgcttttaatactctgcgttacacaggtactaatgatgcggactacctgggctttatgtgaagcattaactttagctacaggccccatatcaactttgtgggaagggaacccagggaggttctggaataccacaatagcagtgtcgatggccaatatttttagaggatcttatttagccggcgctggattactgtttagcataatgaaaaacacaacttcgacacgcagaggcacaggaaatattggagagacattaggagaaaaatggaagtcccgtttaaatgcactcggcaagagtgaatttcaaatatataaaaaaagtggaattcaagaagttgatagaacattggcaaaagaaggtattaaacgtggggagactgaccaccatgctgtttcgcgtggaagtgctaaacttagatggttcgtagaacggaacatggttactccagaaggaaaagtagtagacctaggatgtggtagaggaggttggtcttattattgtggaggcctcaaaaatgtgcgtgaagttaaaggactaacgaagggggggcctgggcacgaggagcccataccgatgtcaacatacggctggaatctagttaggctccaatccggtgtagacgtattttttaccccgccagaaaagtgtgatacccttctctgcgacattggcgaatcttcaccaaacccaacaattgaagctgggcgaacattacgagtattaaaccttgtagaaaactggctaaacaacaacacccagttctgcataaaagtacttaatccctacatgccatccgtaattgaaaaaatggaagcattacaacgccagtatggtggagccctagtacgcaatccccttagcaggaattcaactcacgagatgtactgggtatcaaacgctacaggtaatatagtatcaagtgtcaacatgataagccgcatgctaataaatcggtttacaatgaaacataagaaagctacctatgaacctgacgttgacttaggttcagggacgcggaacattggtatcgaaagcgaaatacctaatctagatatcattgggaaacgaatagaaaaaataaagcaagagcatgagatttcttggcactacgatcaggaccatccttataagacatgggcctatcatggaagttatgaaactaaacaaacagggagtgctagcagcatggtaaatggcgtggtccgacttctcacaaaaccttgggatgtcgtcccgatggttacccaaatggcgatgacagatacaactccttttggacaacaacgagtattcaaggaaaaagtagacacacgaacacaagaacctaaggaaggaaccaaaaaattaatgaaaataactgcagagtggttatggaaggaattgggtaaaaaaaaaacgccgcgaatgtgtactagggaggagtttaccaaaaaagtcagaagcaacgcagccttaggtgcaatattcactgatgaaaacaagtggaaatctgcaagagaagctgttgaagatggtcgtttttgggaactagttgatcgagaacggaatctacatctcgaaggcaaatgcgagacatgtgtctacaatatgatgggaaaaagggaaaagaaattaggagaattcggaaaagctaaaggttctagagccatatggtatatgtggcttggcgcccgatttctcgaattcgaagcattaggcttcctaaatgaagatcattggttcagtcgaggaaactcattgagcggcgtagagggtgaaggattacatcgtcttggctatatactaagagacgtaggtaaaaaggaaggaggcgcaatgtatgcagatgataccgcaggctgggatactaggataaccttagaagatttgaaaaatgaagaaatggtaaccaaccatatgaaaggcgaacataaaaaattggcagaagccatatttaagttgacataccaaaacaaagtagttcgcgtccagagacccacacctagaggtaccgtaatggacataatttcacgaagagatcaacgcggttcgggccaggtcggaacatacggtctaaatactttcaccaatatggaagcacaactaataagacaaatggaaggagagggcatttttaaatctatacagcaccttactgcaacagaagagatcgcagtacaaaattggctggcccgagtcggtagggaaagactttcacgcatggcgatatccggggatgattgcgtcgtaaaaccaattgatgatagatttgcttcggctttaacagcactaaacgatatgggaaaagtacgaaaagatatccagcaatgggagccatcacgaggatggaacgattggacgcaagtgcccttctgttcacatcacttccatgaacttgtaatgaaagacggccgtgtgctagtcgttccgtgtcgtaaccaagatgaattaatagggagagcgcgcatctcacaaggcgcaggttggtcgctgaaagaaacagcgtgcctaggtaaatcatatgctcaaatgtggacactgatgtatttccatcgaagagatcttcggttagctgcaaacgccatatgttcagcagttcctagccactgggtacccacctctagaacaacatggagtattcatgcgaaacatgaatggatgactacagaagacatgttagcagtttggaatcgagtatggatacaggaaaatccatggatggaagacaaaacacctgttgaatcttgggaagaagtaccatatctcggtaaaagggaggatcaatggtgtggctcgcttattggcttaacatctagagctacttgggcaaaaaatattcaaacagctataaatcaagttcgtagtttgataggaaacgaagaatatacggattatatgccttcgatgaaaagatttagaagggaagaagaagaagcgggcgtcctatggtag

SEQ ID NO: 22382 - RNA, 9876 nt, synthetic construct
  misc_feature 1..9876: note = derived and/or modified CDS sequence (opt6) from DENV-2__EU569702__SS-prME
  source 1..9876: mol_type = other RNA
accgcaggcgtaatagttatgctaataccaacggctatggcatttcatttgacaacacgaaacggtgaaccgcacatgatagtaggacgacaagaaaaaggcaagagcttgttattcaaaacggaagatggcgtcaatatgtgtacccttatggcaatcgacctaggagaactatgtgaagatactatcacttataaatgcccattactgaggcaaaatgaaccggaagacatagattgttggtgtaattctacaagtacatgggttacttatggaacgtgtacaaccaccggggaacaccgacgggaaaaacgcagcgtcgctttagtgccacacgtagggatgggattggaaactcgtacagaaacgtggatgtcatcagaaggagcatggaaacatgtacaacgaatcgaaacttggattttacgtcaccccgggtttactattatggcggcaatacttgcatacacaataggtacaacacatttccagcgagcgcttatattcatattgcttacggcagtggcgccgtctatgacgatgaggtgtattggtatttcaaaccgggactttgtcgaaggggtctccggaggtagctgggtcgacatagtattggaacacggatcatgcgtgactacaatggccaaaaacaaaccaacgctagattttgagcttataaaaacagaggccaaacaaccagcaactttaagaaaatattgtatagaggcaaaactaacgaacaccaccacggaatcccgctgtccaacacaaggagaaccttcgctaaatgaggaacaggataaaaggtttatttgtaaacactcgatggtggacagaggatgggggaacggctgcggtctttttggcaaaggaggaatagtgacctgtgcaatgttcacgtgtaagaaaaatatggaaggaaaagtagtgcagccagaaaacttggaatatacaatagtgattacgcctcattcaggggaagaacacgccgtaggcaatgacactggaaaacatggaaaagaaattaaaataacacctcaatcgtccattactgaagctgaattaacaggttatggaaccgtaacaatggaatgttctccccgcacgggattggactttaatgaaatggtactactgcaaatggaagacaaagcatggttagtacaccgtcagtggttcctcgatttacccttaccttggttaccgggagctgacacacagggtagcaactggatacaaaaagagacactggtgacgtttaaaaacccacatgccaagaaacaagacgtcgttgtactaggatcccaggaaggcgcaatgcacacagcattaactggggcgactgaaattcagatgagtagtgggaacttactctttacaggccatctaaaatgcagattacgaatggataaactgcaactaaaaggtatgtcatatagcatgtgtactggaaaatttaaaatagttaaagaaattgctgaaacgcaacatggtaccatagtgatcagagtgcaatatgaaggtgatggaagtccatgcaaaataccattcgaaataacagaccttgagaaaagacatgttctaggaagattaatcacggttaatccaatagtaacagaaaaagacagcccagtcaacatcgaagctgagccaccgtttggtgattcgtatataataataggtgttgaaccagggcaattaaaactgaattggttcaagaaaggatcgagcattggacagatgttcgagacaactatgcgcggagcgaaaagaatggcgatacttggggacaccgcgtgggatttcggatcactgggaggtgtatttacaagcataggaaaagcacttcaccaagtgttcggagccatttatggtgcggcctttagtggtgtatcatggacaatgaaaatactaatcggtgtaataataacctggataggtatgaactcgagaagtacaagtctgtcagtttcacttgtcttggttggcgttgtaactttatatctaggagccgtagttcaggcagatagtggctgtgttgtgtcctggaaaaataaagaactcaagtgcggatcaggtatcttcataacagacaatgttcacacgtggacagagcaatacaaattccaaccagaatctccttcaaagttggccagcgctatacagaaggcccatgaagaaggcatctgcggaatccgtagtgtaacgagactggaaaatttaatgtggaaacagataacaccggaattgaatcatatactatcagaaaatgaagtaaaattaacgataatgacgggcgatatcaaagggatcatgcaagctggaaaacgttcgctgcgacctcaacctactgaacttaaatacagttggaagacatggggaaaggccaaaatgctttcaaccgaaagtcacaatcagacattccttatcgatggtcctgaaacagcagaatgccccaatacgaatagggcctggaactcattagaagttgaggactacggatttggagtttttacaaccaatatttggcttaaactaagagaaaaacaagatgttttctgtgatagtaaactgatgtctgcggctataaaagacaaccgagcagttcacgcagatatgggctattggatagaaagtgcactaaatgatacttggaaaatggaacgagctagctttatagaggtaaaatcatgtcactggccaaaaagtcacactctatggtcaaacggagtgttggagtcagaaatgataattcccaagaatttcgcaggaccagtatcccagcacaactatcgaccaggataccacacacagacagcaggaccgtggcacttgggcaaactagagatggactttgacttctgtgagggaaccacagttgtagttaccgaagattgtggaaataggggtccatcattacgaacaacaacagcctcaggaaaacttattacagaatggtgttgcagaagttgtacactacctccccttagatataggggagaagatggctgttggtacggtatggaaataaggcctttaaaggaaaaagaagaaaacttagtaaattcgctagttacggcaggacatggacagatcgacaattttagcttaggagtactcggaatggctctatttttagaagaaatgttacgaacacgaattgggaccaaacatgcaatcctattagtagcagttagttttgttacacttattacaggaaatatgtcatttagagacctagggagggttatggtgatggtcggagcaacaatgacagatgacattggcatgggtgttacgtatctagcattactcgcagcattcaaagtacgcccaacctttgcagcaggtttgttactgcggaaactgacgagcaaagaactaatgatggcaacaataggaatagcgctattatcacaaagcacgatacccgaaactattctagaattaacagacgctttagcgttgggtatgatggtccttaaaattgtgcgaaacatggaaaagtatcaactagcggttacaatcatggctattagctgtgtgccgaacgcggtgatactgcaaaatgcttggaaagtttcgtgcacaatactggctgcggtatcggtgagcccgctattgttaacgtcttcacaacaaaaagccgattggataccattagccttaactataaagggactgaaccctacagctatctttttaacaacgctaagtagaacgtcaaagaaaagaagctggccattaaacgaagctataatggctgtcgggatggtcagcattctagcatcctcattactcaaaaatgatatacctatgacaggtccactcgtcgcgggaggacttctaacagtatgctatgttttaacgggtagatcagcggatttagaactagaacgagccgcggacgtaaaatgggaagatcaagcagagataagtggatcctcacctatactatcaattaccattagtgaggatgggtcaatgagtatcaagaacgaagaagaggagcaaacgcttactatcttaataagaactgggctacttgtaatcagtggggtattcccggtctcaatacctataacggccgcagcttggtatctctgggaagtgaagaaacaaagggctggtgtcttatgggacgttccgagtccacctcctgtagaaaaggcagagttagaagatggcgcctacagaataaagcaaagaggaatactagggtattcgcaaattggggctggtgtatacaaagagggcacatttcatacaatgtggcatgttacaagaggagcagtccttatgcacaggggaaaacgcattgagccctcatgggcagatgttaagaaagatttgattagttatggtggtggatggaaattagaaggagagtggaaagagggcgaagaggtacaagtattagcattagaaccagggaaaaatccaagagcggtgcaaacaaagccaggtatctttaaaacaaacacaggaactatcggagctgtaagtttggatttcagtccaggaacatcgggaagccctattgttgacagaaaaggtaaagttgtagggttatacggtaatggagttgtaacaagatccggagcgtacgtctcagcgatagctcagacggaaaaatcgattgaagataaccccgagatagaagatgatattttccggaagaaacggctaacaataatggacttacaccctggagctggcaaaacaaaaaggtacttacctgcgatcgtaagagaagcaataaaacggggactccggaccctcatactagctcccactagggttgtagccgcagaaatggaggaggcattgcgaggacttccaatcagatatcaaacaccagcgataaaaactgaacacacaggtcgagaaatcgtcgacctaatgtgtcatgccactttcacaatgagactattgtcaccggttcgagtacccaactacaatttaataatcatggacgaggcgcacttcacagatcccgctagcatagccgcacgaggttatatatcaactcgagtcgagatgggtgaagcagctggaatatttatgactgcgacaccacctggaagcagagatccatttccacaaagtaacgcacccataatggacgaggaaagagaaattcctgaaagaagttggaactccggtcatgaatgggtaaccgacttcaaaggaaagacagtctggtttgttccttcaatcaaagctgggaatgacattgccgcatgcctaaggaaaaatggcaagaaagtcatacaactttccagaaagacctttgacagtgagtacgtaaaaacaagggcgaacgactgggattttgtggtaaccacagacatatccgagatgggagctaattttaaagcagaacgtgtaatagatccaagacgctgcatgaaaccagttattctgacggactccgaagaaagagtgattcttgctggcccaatgcctgtaacccattcatcagccgcgcaaagacgagggagaataggaagaaacccaaagaacgaaaacgaccagtatatatatatgggagaacctttggagaacgacgaggactgtgcgcattggaaagaagctaagatgctactcgataatataaatacacctgaagggataatcccgtcaatgtttgagcctgaacgagagaaagtagatgcgattgacggcgaatatagactaaggggagaggctaggaaaaccttcgtcgacttaatgaggaggggagacctaccagtctggttggcatacaaggtagctgcggaaggcatcaactacgctgaccgtaaatggtgttttgacggaattaagaataaccagatactagaggaaaatatggaagtagaaatttggacaaaagaaggcgagagaaagaaactaaaaccacgatggttagacgcaagaatatactcggatcctttagcactaaaggaatttaaggaatttgctgcaggacgaaaatcgctaacactaaatctcatcacagaaatgggaaggttaccaacattcatgacacagaaagcgaggaatgccctcgataacttagcagttctacatacagcggaagccggaggtcgcgcttacaaccatgccctgtcggaattgcccgagaccttagaaactctgttactactcaccttactagcgacagttaccgggggaatctttctattcttaatgtcaggaaagggtatcgggaaaatgacattaggtatgtgttgcattatcactgcatccatacttttatggtatgcacaaatacaaccccactggatcgcagctagcattatactcgaatttttcctgatcgtactcctaataccagaaccagaaaagcaaagaacaccacaagataaccagcttacatatgttgtgattgcaattttaacggttgtggccgcaactatggcaaatgaaatgggctttcttgagaaaaccaagaaagacctgggacttggaagcataacaacccaagaaagtgaatcaaatatcctcgatatagatttacgacctgcatcggcctggaccttatatgcggttgctacaactttcgttacccctatgctcagacacagtatcgagaacagcagcgtgaatgtgtcccttacagcgatagccaatcaggcaacagtactgatgggtttgggcaaaggttggccgttaagcaaaatggacattggtgtacctttgctagcaattggttgttacagccaagttaatcctataactttgacagcagcgcttttgctattagtagcacattacgctattattgggccaggcttacaagcaaaagcgacaagggaggcacagaaaagagccgctgcaggtataatgaagaatcccactgttgatgggattacggtaattgacttagaacctattccatacgatccaaaattcgaaaaacaactggggcaagttatgttattaatactatgtgtaacccaagtattaatgatgagaactacgtgggcgctctgtgaagcgttgactttagcaacggggccaatttcaacattgtgggaaggaaaccctggtagattctggaatactactatagcagtctctatggctaacatttttcgaggttcatacctagccggtgctggattattgttttcaatcatgaaaaatacgaccagcacaaggagaggcacaggaaatataggagagacactaggagaaaagtggaaatcaaggttaaatgcattagggaaatcagagttccaaatttataagaaatccggaatacaagaagttgaccgcaccctagcaaaagagggaatcaagagaggagaaacggaccatcacgcagtatcacgaggaagcgcaaaactacgttggttcgtggaaaggaacatggtcacaccggaaggtaaagttgtggacttagggtgtggaagagggggatggtcatactattgtgggggactcaaaaatgtgagggaggtcaaagggttaacaaaaggaggaccaggtcacgaagaacctataccaatgtcaacatatggctggaatctagtccgcttacagagtggagtcgatgtcttctttaccccaccagaaaaatgtgatacacttttatgcgatatcggggaatcaagcccaaacccaacaatagaggcaggccggacactaagagtattgaatctagtagaaaattggttaaacaataatacacagttctgcataaaagtattaaatccgtacatgcccagtgtaatagagaaaatggaagcattacagagacaatacggaggtgcattagttagaaacccattaagccgaaattctacacatgaaatgtattgggtctctaacgcaaccggcaatattgtatctagtgtcaacatgataagcagaatgctgataaatcgtttcactatgaaacataagaaagcaacctatgaacccgacgttgacctcggttcgggaacaaggaatataggcatagaatcagagataccgaatcttgatattataggaaagagaatcgagaaaattaaacaagaacatgaaatatcatggcattacgaccaggatcatccatacaaaacatgggcgtaccacggtagctatgaaacaaagcaaactggctctgctagttcaatggtcaacggagttgtcagattattgacaaaaccctgggatgtggtaccaatggtgacacaaatggcaatgacggatacaacaccgtttggacagcaacgtgttttcaaagaaaaggttgatactaggacacaagaaccgaaagagggaactaagaaattaatgaagatcactgctgaatggctgtggaaagagctaggaaagaagaagactccccgaatgtgcaccagagaagaatttactaagaaagttcgatcgaatgcggcactaggcgcaatcttcacggatgagaataaatggaagtccgcccgtgaagcggttgaagacgggaggttctgggaattggtagaccgagaacgaaatttacaccttgaagggaagtgcgaaacttgcgtatataatatgatgggaaagagagagaagaaactcggcgagttcgggaaggccaaaggtagcagggctatatggtacatgtggttaggagcaaggttcctcgagttcgaagctcttggattcttaaacgaggatcactggtttagtcgcggcaatagcctgagcggagtagaaggagaaggtctccatagactaggatatatactacgggatgttggcaagaaagagggaggcgcaatgtatgctgatgatactgcgggatgggatacccgaattactctagaagacttaaagaacgaagaaatggtcacaaatcacatgaaaggagagcataagaaactcgctgaagctattttcaaactgacatatcaaaacaaagttgtaagagtgcaaaggccaacaccaagaggcactgtaatggacatcatttcaagaagagaccagcgcggatctggacaggtagggacatacggacttaatacatttacaaatatggaggcacagttaataagacaaatggaaggagaaggtattttcaagagtatccaacatttaaccgccactgaagaaattgcagtacaaaactggctagcacgggttggtcgcgaaagactctcaagaatggcgatatcaggtgacgactgcgtagtcaaacccatagatgacagatttgcgtcagcattaacggcgctgaatgatatgggaaaagtaagaaaagatattcagcaatgggaacctagtcggggctggaacgattggacacaagtaccattttgcagccaccattttcacgagctagtcatgaaagatggtcgggttcttgtagtgccatgtcgtaatcaagatgaattaataggaagggcacgcatctcacaaggtgctggatggtcgttaaaggaaacagcttgtttaggaaaatcttacgcgcaaatgtggacactcatgtacttccatagacgagacttacgtttggcagcaaatgcgatatgctcagcagtaccctcccattgggtacccacgtcgagaacaacctggagtatacatgcaaaacatgaatggatgacaactgaggacatgttagcagtttggaatcgagtgtggatacaggaaaacccatggatggaggataaaacaccagttgaaagttgggaagaagtaccatacctgggaaaaagagaagatcaatggtgcggaagccttataggtctaacctccagagcaacgtgggccaaaaatatacagacagcaataaaccaagtgagatcactaattgggaacgaagaatatactgattacatgccatcaatgaaaagatttaggagagaagaagaagaagccggcgtcctgtggtag

SEQ ID NO: 22383 - RNA, 9876 nt, synthetic construct
  misc_feature 1..9876: note = derived and/or modified CDS sequence (opt6) from DENV-2__EU482624__SS-prME
  source 1..9876: mol_type = other RNA
acagcgggtgtaatagtaatgctgataccaacagctatggcttttcatctaaccacacgaaatggcgagccccatatgatagtaggccggcaggagaaagggaaatcattactctttaaaaccgaagatggagtaaatatgtgcactctaatggcgatcgatttaggagaattatgtgaggacacgataacttataaatgtcccttattgagacaaaatgagcccgaagacatcgactgttggtgcaattcgacaagcacatgggtaacgtatggaacctgcacgacaactggagaacatcggcgcgaaaaacgatcagttgcgctcgtaccccacgtaggcatgggacttgagacgagaacagaaacttggatgtctagtgaaggcgcatggaaacatgtgcaacggatcgagacatggatattgagacaccccgggttcactattatggcagcaattcttgcaaatacaataggaaccactcatttccagagagctctaattttcatactgctcacagctgtagcaccgtccatgactatgcgatgtataggcatatctaatagagatttcgtagaaggtgtgagcggcggaagttgggtagatatagtcttagaacacggatcatgtgtaacaactatggctaaaaataaaccgacacttgatttcgaattaattaaaacagaagctaaacaacctgcgacactcagaaaatactgcattgaagcaaaattaaccaacacaacaacggagtcgcggtgtcctacacaaggagaaccaagtttaaatgaagaacaggataaacgttttatatgtaaacatagcatggtcgacagaggatggggcaacggctgtggattattcggtaaaggtgggatagtaacatgcgcaatgttcacatgcaagaaaaatatggaaggaaaagtggtgcaacctgaaaatctagaatatacaatagtaattactccacattccggcgaagaacacgctgttggtaatgacacaggtaaacatggcaaagaaatcaaaattaccccacagagttccattacagaagctgaactcaccggatacggaacagttactatggaatgttctcccagaaccggacttgacttcaatgaaatggttctcctgcaaatggaagacaaagcatggttagtgcaccgacaatggtttttggaccttcccttgccatggctaccaggtgccgatatacagggaagtaactggatacaaaaagagactttagtaacgtttaaaaatccgcatgctaaaaagcaggatgtagtggtattagggagccaagagggcgcaatgcacacagcactaaccggcgccacagaaattcagatgagcagtggaaatcttctttttacaggtcatctgaaatgtagactaagaatggataagttgcaactaaagggcatgtcgtattcaatgtgtacgggaaagtttaaaatagttaaagaaatagcggaaacacagcatggcacgattgtaattagagtccagtacgaaggagacggttccccctgtaagataccatttgagatcacagatctagagaaacgacatgtactaggtcgacttattacggtcaaccctatagtaacggagaaagatagtccggtaaatattgaagctgaaccgccatttggcgatagctacatcatcataggagtcgaaccaggacaattaaaactaaactggtttaagaaaggatcatcaataggacaaatgttcgaaacaactatgcgcggagctaaaagaatggcaatacttggagataccgcatgggatttcggtagcctcggaggagtattcacatctattgggaaagctctacaccaagtttttggtgctatatacggcgcagcattcagcggtgtcagctggaccatgaaaatattaatcggagtcattattacttggatcggtatgaactcgagatctaccagcttatcagtctcgctggtattagtaggagttgttaccttgtacctcggagcagttgtacaagcagattctggctgcgtggtatcttggaaaaataaagaattaaaatgcggaagtggtatatttattactgacaatgttcatacgtggacggaacaatataagtttcaaccagaaagtcctagtaagttggcgtcagcaatacagaaggcgcacgaagaaggaatctgtggaattagaagtgtaacaagactagaaaatcttatgtggaagcagataactcctgagttaaatcatatcctctctgaaaacgaagtaaaattgaccatcatgacaggagatatcaaaggtatcatgcaagcgggaaaaaggtcattacgaccgcaaccaacggaattaaaatatagctggaaaacatggggaaaagctaagatgttgagtacagaaagtcacaatcaaacattcctgatagatgggccagaaacggccgaatgcccaaataccaacagagcatggaactccctagaggttgaagactacggcttcggagtcttcaccacaaacatatggttaaaacttagagaaaaacaagacgtattctgtgactcgaaactgatgtccgccgccatcaaagacaacagggctgtgcacgccgatatggggtattggattgaaagcgctctgaatgatacatggaagatggaaaaagcctcttttattgaagttaagagttgccattggccgaaatcacatacactgtggtccaatggtgtattagaaagtgagatgattattccaaagaactttgccggccccgtaagccagcataactacagacctggttatcacacacaaacagcaggtccttggcatctaggtaaattagagatggattttgatttttgtgagggaacgacagttgtggtaaccgaagactgtggaaatagaggaccaagtcttcgtaccacaacagcatcaggtaagctaattactgagtggtgttgtcgcagttgtaccttgccaccccttagataccgtggagaagacgggtgctggtacggaatggagataagaccacttaaagaaaaggaagaaaatttagtaaattctcttgtgaccgctggtcatggacagatcgataatttctcattgggtgtactaggaatggctctgtttctagaggaaatgttaagaaccaggataggtacgaaacatgctatcttgctagttgctgtcagctttgttacacttattactggtaacatgtcgtttagagacttgggtagagtaatggttatggttggagcaaccatgacagacgatataggaatgggagtgacctatctagccctactagccgcctttaaagtaagaccaacgtttgcagcaggtttgttactgcgcaaactaacaagcaaagagctgatgatggctacaattggtatcgccttactcagtcagtctacgatacctgaaacgatcttagaactaacagatgctttagcactcggaatgatggttttaaagatagtaagaaatatggaaaaatatcaactagcagtcacaatcatggcaatatcatgcgtccctaacgcggtaatactacagaatgcctggaaagtaagttgcacaatcttagcagccgttagcgtctcgccgttgcttctaacgagttcacaacaaaaggctgattggattccactggcactaacaataaagggcctcaaccctacggccatatttttgacaacactcagccggacttcaaagaaacgtagctggcctttaaacgaggccataatggccgttgggatggtcagtatactggcatcctctctactcaaaaacgatatccccatgacaggccccttagtggcagggggattgctcacagtgtgttatgtactcacaggtaggagcgcagacctagaattagagagggcggctgacgtcaaatgggaagatcaagctgaaatatcaggatcttctccaatattatcaattacgatatcggaagacggttccatgagtattaaaaatgaagaggaagaacaaacactgaccattttaataagaacgggtctattagtaatctccggggttttcccggtgtcaatacctatcacagcggccgcatggtacctatgggaagtaaagaaacagagagccggtgtattgtgggatgttcctagtccaccgccagtagaaaaagcagagctcgaagatggagcgtataggatcaaacagagaggaattttaggatattctcaaataggcgctggtgtatacaaagaaggcacttttcacaccatgtggcatgttacccgtggagctgttctaatgcatagaggtaaacgaatcgaaccttcatgggcagatgtcaagaaagatctaatttcgtatggtggcggatggaaattagaaggggaatggaaagagggtgaagaagtacaagtattagctctagaaccagggaaaaatccgcgagccgtacagacaaaacccgggatatttaaaacaaacaccggtactattggagcggtttctctagatttttcccctggtacgtcaggatcaccaatagtggacaggaaaggaaaagtagttggactatacggaaatggggttgtaaccaggtcaggcgcctacgtttcggccatcgcccaaactgagaaatctatagaagataatccagaaattgaagatgatattttcaggaagaaaagactgacaataatggatttgcacccaggcgcaggcaagacgaaaaggtacttaccagcgatagttcgagaagccataaaacgaggacttagaacgctaatactagcaccgacaagagtggttgcggcagagatggaagaggcattaagaggacttccaatacgatatcaaactccggcaattaaaactgaacacactggaagagaaattgtagacttgatgtgtcatgccacatttaccatgcgcctattaagtccagtaagggttccaaattacaatcttataataatggatgaagcacactttactgatccagcatctatagccgcgcgaggatatatcagcaccagagtagaaatgggggaagcggctggtatttttatgacagccacacccccgggaagtcgagatccatttccgcagtcgaatgcaccaattatggatgaggaacgtgaaattcctgagcgtagctggaatagtggacatgaatgggtaacagatttcaagggcaaaactgtatggttcgtgccaagtataaaagcaggtaatgatattgcggcctgcctaaggaaaaatggtaagaaagtaatccagctaagcagaaaaacgtttgactcggaatacgtcaagaccagggcgaacgactgggattttgtagtcactaccgatataagtgaaatgggagcaaatttcaaggcagaacgagtaatagatcctcgacgctgcatgaagccagtaatattgaccgacggggaagagagggtgatacttgcaggtccgatgcccgtaacacactctagtgctgcacaaagaaggggaagaatcggtagaaaccctaaaaatgaaaatgatcaatatatttatatgggtgagccactagagaatgacgaagattgtgcccattggaaagaggcaaagatgttacttgataacataaatactccagaaggcattattccgtctatgtttgaaccggaaagagagaaagtagatgcgatagacggtgaataccgtctcagaggtgaggctcgaaaaacgtttgttgacctaatgcgcaggggagatctaccagtgtggcttgcttataaagtagcagcggagggtattaactatgcggataggaaatggtgcttcgatggtattaaaaacaaccaaatacttgaggaaaacatggaggtagagatctggacaaaagagggcgaaaggaagaaacttaaaccacgatggctggatgccagaatctactctgaccctctagctctaaaggaatttaaagaatttgcagcaggcagaaaatccctcacgttgaatttaatcacggaaatgggaaggctacctacctttatgacacaaaaagcacgtaatgcgctagataacttggcagtgcttcatacagcagaagcagggggcagagcctataatcacgccctatctgaattacctgagaccctagagacactacttttactgactctattagcaaccgtaactggtggtatatttcttttcttgatgtcaggaaaaggtatcggaaaaatgacgcttggaatgtgttgcataataacagcatcaattctgctatggtatgcacagatacaacctcactggatcgctgcatctataatcttagagttctttctaattgtacttttaatacctgaaccagaaaaacaacgcacaccacaagataatcaactgacttacgtcgttatagcgattcttaccgttgtagcggctacaatggcgaacgaaatgggatttttagaaaagactaagaaggatttgggcttaggaagtatcactacacaagaatcagaatcaaacatattagatattgacttacgacctgcgtcagcatggacattatatgcggtagcgactacattcgtaacaccgatgttgcggcacagtattgaaaattctagtgtgaatgtctctctaactgctatagctaatcaagccaccgtcctcatgggacttggaaaaggatggcctctttcaaagatggatataggtgtgccgttactcgccattggatgttacagtcaagtaaatccgattaccttaacggcagcgttactcttactggtcgcgcattatgcaattataggaccaggactccaagcgaaagccacccgcgaagctcagaaaagagcggcagccggaataatgaagaacccaactgtggatgggattactgtgattgatctcgaacccattccgtatgatccaaaatttgaaaaacagttaggacaggttatgttattgatcctatgtgtgacacaggtcctaatgatgaggactacatgggcgctttgcgaagcgcttactctagcaacaggcccaatctcaactctgtgggaaggaaaccctggcagattttggaacacgactatcgcagtatcgatggcgaatatttttagggggagttatcttgccggggcaggactactatttagcattatgaaaaatacaacgagtacaagaaggggcacagggaatataggggaaacactaggagagaaatggaagagtagacttaatgcattaggaaagagcgaatttcagatttacaagaaatccggtatccaagaagtagatagaacactcgcaaaagaggggataaaacgcggagaaacagatcatcatgcagttagtagaggtagtgccaagctacgttggttcgttgaaaggaacatggttacaccagaaggtaaagtagtagatttgggttgtggtcgcggcggttggtcctactactgtggaggactgaaaaatgttagagaagttaaaggactcacgaaagggggtcccggacacgaagaacctatcccaatgagcacgtatggctggaatttagtaagattgcaaagtggagtagacgtattcttcacacctcctgaaaaatgcgacacactcttgtgcgatatcggggaatcaagtccaaaccccacaattgaagcaggacggacactacgtgttttgaatctagtggaaaattggttgaataacaatacacaattctgtatcaaggtgttaaacccatacatgccctcagtaattgagaagatggaagcattacagagacagtatggcggcgcattggttagaaaccctctaagtcgcaatagtacgcacgaaatgtactgggtcagcaatgccacaggtaatatcgtctcatcagtgaatatgataagtagaatgctgattaacagattcacaatgaaacataagaaagcaacgtatgaaccagatgtggatctaggatcaggaaccagaaacattgggattgaatcggaaatacctaatttagatatcatagggaagagaattgagaaaattaagcaagagcatgaaataagctggcactacgaccaagaccatccctataaaacttgggcatatcacggcagctatgaaaccaaacaaaccggatctgcttcctccatggttaatggagttgtgcgactacttacaaagccttgggacgtagtccccatggtaacacagatggcaatgaccgacacaacgccattcgggcaacaaagggtcttcaaagagaaggttgacacacgaacgcaagaacctaaagagggtactaagaagctaatgaaaataacggccgaatggctttggaaagaattaggtaagaagaaaacacctagaatgtgtaccagggaagagttcacaaagaaagtaagaagcaacgccgccttaggagcaattttcactgacgaaaacaagtggaagtctgcaagagaagcagtagaagacgggagattttgggagttagtagatagagaacggaatttgcatttagaaggtaaatgtgagacctgtgtatataatatgatgggtaaaagggagaaaaagttaggagagtttggtaaggcaaaaggatcacgcgccatatggtatatgtggttgggagctaggtttctcgagtttgaagcattaggctttttaaacgaagatcattggttcagcagaggaaattctcttagtggcgtagaaggcgaaggactacatagattaggttatatactgagagacgtaggtaagaaagaaggaggtgctatgtacgccgatgacacagctggttgggatactagaattacactggaagaccttaaaaatgaggaaatggtcacgaaccacatgaaaggcgaacacaagaaactagcagaagcaatatttaagttaacgtaccaaaataaagttgtcagagttcaaagacctacacctcgaggcacggttatggacataatctcaagaagagaccaacgtggttcaggacaggtcggaacgtacggccttaacacatttacaaatatggaggcccaactaatcaggcaaatggaaggagagggaattttcaaatctattcaacatctcacagcgactgaggaaattgcagtgcagaactggctagcacgtgtaggcagggaacgtctctcaagaatggctatttcaggtgacgattgtgtagtcaaaccaatagacgaccgatttgcttctgcactaacagcccttaatgacatgggtaaagtgcgaaaagatattcaacaatgggagccatctagaggatggaatgattggacacaagtaccattttgttctcaccacttccacgagctagtcatgaaggatggcagggtcctcgtagtcccctgcagaaaccaagacgagctcatagggagagcccgtattagtcaaggtgccgggtggagtctaaaagaaacggcatgtcttggcaaatcttacgcacaaatgtggacccttatgtatttccaccggagggatctaagattggcagcaaacgctatatgctcagcggtccctagccattgggtacctactagcagaacaacctggagtattcatgctaagcatgaatggatgaccacagaagatatgctagcagtatggaaccgcgtatggatacaagaaaatccctggatggaagataagacacctgtagagagttgggaagaagttccatatctcggtaaacgggaagatcagtggtgcggttcattaataggattaacttccagagctacatgggcgaaaaacatccaaacagcaataaaccaagtacgcagtttaattggcaatgaagaatacacagattatatgccgtcaatgaaaagattcagaagggaagaagaggaagctggagttctatggtag

SEQ ID NO: 22384 - RNA, 9876 nt, synthetic construct
  misc_feature 1..9876: note = derived and/or modified CDS sequence (opt6) from DENV-2__EU596500__SS-prME
  source 1..9876: mol_type = other RNA
acagctggtgtcatcgtgatgttaatacccacagctatggcatttcaccttacaaccagaaatggagaaccacatatgatagttggccgccaagaaaaaggcaaatcactcttattcaaaaccgaagatggtgtgaatatgtgtaccttaatggcaatagacttaggagaactctgtgaagataccattacatacaaatgcccactattaagacagaatgaacccgaagatattgactgttggtgtaactccacaagtacttgggtcacatacggtacatgtacgacaacaggtgaacatcgaagagaaaaacgttccgtcgcattagtaccgcatgtaggaatgggattagaaacgagaaccgaaacttggatgagctccgaaggcgcatggaagcacgtacaaaggatcgaaacttggatcctccggcaccccgggttcacgataatggcggcaattctagcatataccataggaacgactcactttcaacgtgctttaatatttatattgttaacggccgttgcccctagtatgacaatgagatgtattggcatcagcaaccgagatttcgttgaaggtgtttctggtggatcctgggtggacattgttttagagcatggatcttgtgttactacaatggctaaaaacaaacccacgttggactttgaattgataaaaacagaagcaaaacaaccagccacgttgagaaaatattgcattgaggcgaaactaacgaatacgacaacagaaagtcgctgcccaacgcagggggagcctagtttaaacgaggaacaagataaacgctttatatgtaaacactcaatggtagacaggggatggggtaatggatgtggactatttggtaaaggagggattgtcacttgcgctatgttcacgtgtaagaaaaatatggaaggcaaagttgtacaacccgagaatctggagtacacaatagtaataacccctcatagcggtgaagaacatgccgtgggaaatgatacgggtaagcacggcaaagaaattaagataacaccccaatcttccataacagaagctgagctgacgggatacggaactgtaacaatggaatgcagcccaagaacgggactggacttcaacgaaatggtcctattacaaatggaagacaaagcctggttagttcacagacagtggtttcttgacctaccgttgccgtggttacctggagccgatactcaaggttcaaactggattcaaaaagaaacgctagtaacatttaaaaaccctcatgcaaagaaacaggatgtagtagtcctagggtcacaagagggagcaatgcacacagccttgacaggagcaacagaaattcagatgagtagcggaaatctactttttactgggcatctaaaatgcaggctgcgtatggataaacttcaattgaaaggaatgtcatactctatgtgtactggtaagtttaaaatagtgaaagaaattgcagaaacacagcacggaacaatcgtaatacgcgtacaatacgagggagacggaagcccatgtaaaattccttttgaaatcacagacttggagaaaagacacgtattaggcaggttgataacagtgaaccctatagtaacagaaaaagacagcccagtaaatatagaagcggaaccaccctttggagattcatatataattataggggttgaaccaggtcaactaaaacttaactggttcaagaaaggttcgtctataggacaaatgttcgagacgacaatgcgaggggctaaaagaatggcaatactgggggatacagcatgggatttcgggtctttgggaggtgtcttcacttcaatagggaaagcgctacatcaagtattcggagcaatttatggggctgcattttccggagtttcatggacaatgaaaatactaattggagttattatcacctggatcgggatgaactcccgatcgacatccctaagcgtatcactggtgcttgtaggcgttgtgacattatatttaggggcagtcgttcaggcagattctggatgtgtagtttcctggaaaaataaggaactcaagtgtggcagtggtatatttataacagacaatgtacacacctggacagaacaatacaagttccaaccagaatcaccatctaagctagcttcagccatccaaaaggcccatgaagaaggtatatgtggcataagatctgtgacgaggttggagaaccttatgtggaaacaaattactccagaacttaatcacatacttagtgaaaatgaagtaaaacttacaataatgacaggcgacataaaaggaatcatgcaggcaggtaaacgctcacttcggccacaaccgacagaactaaaatattcgtggaaaacgtggggcaaggcaaaaatgttgtccactgagtcacacaatcaaacatttttgatcgacggacctgagaccgcagaatgtcctaacactaacagagcttggaactccctggaggtagaagattacggctttggcgtcttcacaacaaacatctggttaaaactaagagaaaaacaggatgtattctgcgatagcaaactaatgtcagctgccataaaggacaacagagctgttcacgcagatatgggttactggatagaatctgccctgaatgacacatggaaaatggaaaaggcaagttttatagaagtgaagtcgtgccattggccaaagtcgcatacactttggagcaacggggttttagagagtgagatggtaattcctaaaaattttgcaggccccgttagtcaacacaattacagacccggttaccacacacaaacggcaggaccatggcatttgggaaaacttgaaatggacttcgacttctgtgaagggacgactgtagtagtaacagaggactgtggaaacaggggaccctcacttagaacgactactgcaagtggaaaattaataactgagtggtgctgcagaagttgtactctaccacccctcagatacagaggtgaagatgggtgttggtatggtatggaaatacgacctttaaaagaaaaagaagaaaatctagtaaacagcttggtgactgcgggacatggtcaaatcgacaactttagtctgggagtcctcggcatggctctctttttagaggaaatgttaagaacaagaataggcacaaaacatgctatcctgctagtagcagtcagtttcgtcacattaatcaccgggaacatgtcgttccgagatctcggacgtgtaatggtaatggtgggtgcaaccatgacggatgacataggcatgggtgtaacgtatttagcccttttggcagcctttaaagttcgacctacatttgcggcaggattactcctaaggaaacttactagcaaggagctaatgatggccaccataggtattgccttattatcacaaagtaccatccccgaaacgattttagaacttacggacgctttagctctcgggatgatggtattgaaaatcgtaaggaacatggaaaaatatcagctcgctgtgacaattatggcaatatcatgtgtgccgaacgcagttatactacaaaatgcctggaaagtatcttgcacgatactagccgcagtgtcagtttcgccattattgttaacttctagccaacaaaaagcagactggataccacttgcattaacaataaaaggtctcaatccaactgccatttttcttacgactctatctcgtacaagtaagaaacgatcttggcccctgaatgaggcaatcatggccgtgggcatggtatctatattagcatctagtctgcttaaaaacgacattccaatgactggacccttagtggcaggaggactactaacagtctgctacgttctgaccggacggtcagcagatctagagctggagcgagccgcagatgtaaaatgggaagaccaagccgagatttctggatcatcgccaatcctgagtataacaatttctgaagacggatccatgtccatcaaaaacgaagaagaagaacagaccctaaccatactaataagaacaggccttctggtaatatcgggagtatttccagtaagtattcccatcaccgcagcagcctggtatttatgggaagtaaagaaacaaagagcaggagtcctatgggatgttcctagtccacctccagtggaaaaagctgagttagaagacggtgcttacagaataaaacaacggggaatcctaggttattcccagataggggccggagtctacaaagagggaaccttccacacaatgtggcatgtcacaagaggagctgtcctaatgcataggggtaaaagaatagaaccttcgtgggcagatgtcaaaaaggaccttatttcatatggtggaggatggaagctagaaggagaatggaaagaaggcgaagaagttcaagtcttagcactcgaaccaggtaaaaaccctagagcggttcaaacaaagccgggtatatttaagacgaataccggaacaataggcgcagtatcgctagacttttctccaggcacttcaggaagtcctatagttgaccgtaaaggaaaagtagtcggcctgtatggtaacggggtagtaacaagatcaggtgcatacgtgtctgccatcgctcagacagaaaagtcaatagaagataacccagagatagaagatgatatctttagaaagaaacgtttgacaattatggatcttcatcctggggcaggcaaaacgaaacgatacttaccggcaatagtaagagaagccattaaaaggggtcttagaactttaatactagctccaacaagagtagtagctgcagaaatggaagaggcattaagaggcctaccaatccgttaccaaacacccgcaatcaaaactgagcatacgggaagagaaatcgttgatctcatgtgtcatgcaacgtttacaatgaggttactaagccctgtcagggtaccaaactacaacctcatcataatggatgaggcccatttcacagatcctgcctccattgcggcaaggggttatatatcaactagagtggaaatgggagaggcagccggtatattcatgacggccactccaccaggaagtagagacccgttccctcaatcaaacgcaccgataatggacgaagaaagggaaatcccagaacgatcctggaacagtggacatgagtgggtcactgatttcaaagggaagacagtatggttcgtgcccagtattaaagcaggaaacgatatagcagcatgtctaaggaagaacggaaagaaggtcatacagctaagcagaaaaacatttgatagtgaatatgtaaaaacgagagccaatgattgggattttgtagtaacaaccgacatatcagagatgggagcaaactttaaagcggaacgagtaatagacccccgtcgttgcatgaaacccgtaattctaacagatggagaagaaagagtaattctagctggtccaatgcccgtaacgcacagctcagcagcccaaagacgcggacgaattgggagaaaccctaagaacgaaaatgatcaatatatatatatgggagaacctctagaaaatgatgaagattgcgcgcattggaaggaagcgaagatgttgttagataacatcaatacacccgaaggaataattccatcaatgtttgaacctgaacgtgaaaaagtcgatgctattgacggagagtataggctgcggggtgaagctagaaagacattcgttgatttaatgagaagaggagatctgccagtctggttagcctataaagtcgccgcggaaggaatcaactacgctgacagaaagtggtgttttgacggcatcaaaaataatcagatcttagaagaaaatatggaagttgagatatggactaaggagggcgagcgaaagaaacttaagccgcgctggcttgatgccagaatatattcggatcctttggctctaaaagaatttaaagagttcgcggccgggcggaaatcactgaccctaaatttaataacggaaatggggcggctccctactttcatgactcaaaaagcccgcaacgcactcgacaatttagcagtactacacaccgcggaagctgggggacgagcttataatcatgccctatctgagctgccggaaacgttagagactctattgttactaactttactggcaactgtcacaggcgggattttcctatttctaatgagtgggaaaagtatagggaaaatgaccctgggaatgtgttgtataattacagcgtcgatcctactttggcatgcacaaattcaacctcattggattgcagcctcgataatattagagttctttttgatagtacttctaatacctgaaccggaaaagcaaagaacccctcaagacaatcaattaacatacgtagttatcgctatcctaacagtagtagcagcaacaatggcaaatgaaatgggttttctggagaaaaccaagaaagatttaggacttggatctataacgacgcaagaatctgaaagcaacatactcgacatagatttaagaccagcttcagcgtggactttatatgcagtggctactacgtttgtaaccccgatgcttcgtcatagcatagaaaattcctctgtaaatgtttcacttaccgccatcgccaatcaagcgacagtattaatgggattaggaaaaggttggccattaagcaagatggatattggcgtccctttatttgccataggatgttattatcaagtaaaccctataacactcacagcggcgcttctactactggttgcgcataacgccataataggtcaaggcctgcaagcaaaggcaacaagggaagcccaaaaacgagcagcagcaggtatcatgaaaaatcctacggtagatggtataacagtaatagatctagaaccaattccatacgatcccaaatttgagaaacagctgggccaagtgatgttactcatattatgcgtaacacaagttctgatgatgcgtactacgtgggccttatgcgaagcgttaacacttgcgactgggcccatatccactctttgggaggggaacccgggcagattttggaataccacaatagctgttagcatggcaaatatatttcgaggttcatatctagctggagctgggctactattcagtatcatgaaaaacacaacctcaacaagaagaggcaccgggaatataggcgagactttaggagaaaagtggaaatcaagactgaatgccctaggtaaatcagagttccaaatatacaagaaatctggcatacaggaagtagaccgcacactagccaaagagggaattaaacgaggagaaacagatcatcacgcagtgagtagaggttccgcgaaacttagatggttcgttgagcggaatatggtaacaccagaaggaaaggtagtcgatttaggatgtggacgcgggggatggagttattactgtgggggtttgaaaaatgtaagagaagtaaaaggcctaactaagggtgggccaggacacgaagaacctattcctatgtcaacttacggatggaatttggtgaggctgcagtctggagttgatgttttcttcactccaccggaaaaatgtgataccctattgtgcgacataggagaatcatccccaaatccaactatagaagcaggcagaaccttaagagtactcaatttagttgaaaattggctaaataataatacccagttttgtattaaagtactaaacccatatatgcctagtgtaatcgagaaaatggaggctttacaacgacaatatggaggtgctttagttcgtaacccattgtcgagaaacagcacgcacgagatgtattgggtctcaaacgcaaccggaaacatcgtatcatcagtgaatatgattagtcgcatgctaatcaaccgatttaccatgaaacataagaaagcgacatatgagccagacgttgatctcggttcaggtacgcgcaatataggaatagagaatgagatcccgaatttggacatcataggcaagagaattgagaaaataaaacaagaacacgaaatatcctggcattacgaccaagatcacccatacaaaacatgggcatatcatggctcatacgaaacgaaacagactggaagtgcaagcagtatggtaaatggagtagtaagactactcaccaaaccttgggatgtagtacccatggtcacacagatggcaatgacagatacaacacctttcggacaacaacgagtcttcaaagagaaagtggatacaaggacacaggaacctaaagaaggcaccaagaaattaatgaagataaccgcggaatggctctggaaagaactgggtaagaagaaaactcccagaatgtgcacaagagaagagttcacaagaaaagtaagaagtaatgcagcattgggggcaatatttacagacgagaataaatggaaaagcgccagagaagctgttgaagacggaagattttgggaacttgtcgacagggagcgaaaccttcatctagaaggtaaatgtgaaacgtgtgtatataacatgatgggtaaacgtgagaagaagctcggggaatttggaaaggcgaaaggtagtcgagcaatctggtatatgtggctcggcgcacggtttctggagttcgaagcactagggttcctaaacgaggatcactggttttcaagaggaaattcccttagtggagttgaaggtgaaggactacatcgccttggatacattttgagagatgtaggaaagaaagagggtggggcgatgtacgccgacgatactgcgggatgggacacgcggataactttggaagaccttaaaaacgaagaaatggttaccaaccatatgaaaggcgaacacaagaaattagcagaagcaatatttaaattaacctaccaaaataaagttgtcagagtacaacgtcccacgccgagaggaacagtaatggatataataagtagaagggaccagaggggatcaggacaagtcggcacttacgggctaaatacatttacaaatatggaagcccaattaattcggcagatggaaggcgaaggaatatttaaaagcatacaacatttaacggctacagaagagatagctgtacagaactggttggctcgagtgggacgagaaaggctaagtcgaatggcaattagtggagatgactgtgtggttaaacccattgatgataggttcgcttcagcactaacagcactaaacgacatgggtaaagttaggaaggatattcaacaatgggagccgagtagaggatggaacgactggactcaagttccgttttgtagtcatcattttcacgaattggtaatgaaagacggcagggttcttgttgtaccatgtaggaaccaggacgaattaatcggtcgagcacgtatctctcaaggtgctggatggagcttaaaagagaccgcttgcctaggcaaatcatatgcacaaatgtggactcttatgtactttcatagacgagatttaagactagccgctaacgccatttgctctgctgttcctagtcattgggttccaacatcgagaactacatggtcgattcatgcaaagcatgaatggatgacgacagaagacatgctagctgtatggaacagggtttggatacaagaaaacccctggatggaagataaaacgccagtagaaagttgggaagaggttccatatcttgggaagcgagaagatcaatggtgcggttcacttataggattgacatctcgtgcaacctgggcgaaaaacatccaaaccgcaatcaatcaagtaaggagcttaataggaaatgaggaatatacggattatatgcccagtatgaaaagattcaggagagaagaggaagaggcgggggtactttggtaa

SEQ ID NO: 22385 - RNA, 9876 nt, synthetic construct
  misc_feature 1..9876: note = derived and/or modified CDS sequence (opt6) from DENV-2__EU482626__SS-prME
  source 1..9876: mol_type = other RNA
acagctggggttattgtgatgttaataccgaccgctatggcattccacttgaccaccagaaatggagaaccacatatgatagttgggcgacaggaaaaaggaaaatcgttgttatttaaaaccgaagacggtgttaatatgtgtacgttaatggcaatagatctcggagaactctgcgaagacaccataacatacaaatgcccgcttttgagacagaatgaacccgaagatattgactgttggtgtaactcgacatcaacgtgggtgacatacggtacttgtacaaccactggagaacatcggagagaaaaacgaagtgtagccttggtgccccatgtaggaatgggacttgaaacaagaacggaaacatggatgtcatcagaaggtgcatggaaacatgttcaaagaattgaaacatggatccttagacatccaggatttactataatggcagccatcttagcatacacaatcggaacgacgcacttccaaagagctctcatttttatcttattaacagctgttgcgccctccatgacaatgcggtgtataggaatatcgaacagagattttgtagaaggagtaagtggaggtagttgggtcgacatagtcctggaacatggtagttgtgtgacaactatggccaaaaacaaaccgacactggattttgaactaattaaaacggaggcaaaacaaccggcaactttgcgcaaatactgtatagaagctaaattaacaaatactaccaccgaatcacgttgccctacccagggagaacccagtctcaatgaagaacaggataaaaggttcatatgcaaacatagtatggttgataggggatggggaaatggatgtggactttttggaaaaggaggtatagttacctgcgcaatgtttacatgcaagaaaaatatggaaggtaaagttgtgcaacctgaaaacttagaatatacaattgtaataaccccacatagcggtgaagaacacgcagtgggaaatgacaccgggaaacatggaaaagagatcaaaataacgccacagtcatctattacagaggccgagcttactggatacggaacagtaacgatggagtgcagcccacggacaggattagactttaatgaaatggtattattacaaatggaggataaagcatggttagttcatcggcaatggttcctggacttacctttgccctggctacctggagctgatatacaaggatcgaattggatccaaaaagaaacattagtaactttcaaaaacccgcatgctaagaaacaggacgttgtagttttaggttcacaagaaggtgcaatgcatacagcgctcacgggggcaacagaaatacagatgtcatctggtaacttactcttcacagggcatctaaaatgtcgactaaggatggataaattacagctgaagggaatgagctacagcatgtgtaccggcaaattcaaaatagttaaagaaatagccgaaacccaacacggtactatagtaataagagtacagtatgaaggggatggaagcccctgtaagattccattcgaaattacagatttagaaaaacgacatgtcctaggccggctaattactgtaaaccctattgtaactgaaaaggactcacctgtgaatattgaagcggagccaccctttggggacagttatataattattggagtcgaaccaggtcaattgaagttgaattggttcaagaaaggttcatctattggccagatgtttgaaactacaatgcgtggagcgaaacggatggcgatactaggcgatactgcttgggactttggaagccttggaggtgtattcacatctattggaaaggctctacaccaggtattcggagcaatatatggcgcagctttctcaggagtttcatggactatgaagattttaataggggttattataacctggatcgggatgaatagtcgaagtacaagtttaagcgtatcacttgttttagtcggtgtcgtaacattatacctcggtgcggtagtacaagctgacagtgggtgtgtcgtttcatggaaaaataaagaactgaaatgtggctcaggcatatttataactgacaacgtacatacttggacggagcaatataagttccaaccagaatccccaagtaagctagcatcggcaatacaaaaagcacacgaagaagggatttgtggcattcgaagcgtcacaagacttgaaaatcttatgtggaaacaaattacaccagaattaaatcatattctcagtgaaaacgaagtcaaacttactatcatgaccggagatataaagggaataatgcaagcaggaaaaagaagcctacgaccacagccaacacaattaaaatattcttggaaaacatggggcaaagcaaaaatgctatcgacagagagccataatcaaactttcctcatcgatgggcctgaaacggcagaatgtccaaatacaaatagggcatggaactcacttgaagtggaggattacggtttcggagtatttactactaatatatggttgaaattaagagagaagcaagacgtattctgtgattcgaaactaatgtcagctgcaatcaaggataaccgtgcggttcatgcagatatgggatattggattgaatcagcactaaatgacacctggaagatggagaaagcatcttttatagaagttaaaagctgtcattggcccaaaagtcatacactatggagcaatggagtacttgagagtgaaatgattatacccaaaaatttcgcgggtccagtatcacagcataattatagaccaggataccatactcaaacggcgggaccttggcatctaggcaaacttgaaatggattttgacttttgtgaggggacgacagttgtggttacggaggattgtggtaaccggggcccatcactacgaacaactacagcatccgggaaattaataactgagtggtgttgtaggtcctgcactctaccacctttaaggtaccgaggtgaagacggttgctggtacggcatggaaattagacctcttaaagagaaagaagagaacctagtaaattctttagtaactgccggacatggtcagattgataactttagtctaggtgttctgggcatggcattattcttagaagaaatgcttagaacacgcatcgggacaaagcacgcaatattgctggtggcagttagctttgtaacattaatcactggaaacatgtcgtttagggatttaggaagagtaatggtgatggttggtgccactatgactgacgatataggtatgggggtaacttacctagcattactggccgctttcaaagtccgtccaacgtttgctgccgggcttttgttacgaaaattaaccagcaaagaactcatgatggcaacaatagggatagcgctgctttctcagagcactatacccgaaacaatccttgaactaacggatgctctagcactgggaatgatggttctcaaaatagtaagaaacatggaaaaataccaactagcagtgacaataatggctatatcatgcgtacccaatgccgttatcttacagaacgcatggaaagtaagttgcacgatactagcggccgtatcggtaagtccgttattattaacaagtagtcaacaaaaagcagattggattcctttggcattgacaattaaaggtctaaatcctactgcaatttttcttacaacgctgtcaagaacaagtaagaaacgaagctggcctctaaacgaggccattatggccgtagggatggtgtccatactagcaagcagcttactaaagaacgacattccaatgacgggtccattggtggcgggcgggttactaactgtttgttacgtcttaacaggaaggtctgccgatttggaattagaacgagcagcagacgttaaatgggaggaccaagcagagatatcaggatcaagcccaatcttatccataacgatctcggaagatggtagtatgagtatcaaaaatgaagaagaagaacaaacattgaccatattaataaggacaggtttattagttatttcaggcgtattcccggtctcaatacccataacggctgcggcatggtatctttgggaggttaagaagcaacgtgcaggcgtgttatgggatgttccatcaccgccacccgtcgaaaaagcagagttagaagatggcgcatatagaataaagcagcgtggaattttgggctatagccaaataggtgcgggagtttataaggaaggaacatttcacactatgtggcatgttactcgaggcgcggtattaatgcaccgaggaaaaagaatagaaccctcatgggccgatgttaagaaagatttaataagctatggcggtggttggaagttagaaggggagtggaaagagggagaagaagtacaagttctggccctagaacccggcaaaaaccctagggcagtacaaactaagcctggaatattcaaaacaaatacaggaacgataggagctgtaagcctagatttctcacctggtacgtcaggttcgccaattgtagatagaaagggaaaagttgttgggctatacggaaacggtgttgtaactagatcaggcgcatacgtatcggctattgctcaaacagagaaaagtatagaggataatccagaaatagaggacgacattttcagaaagaaacgattgacaattatggacttacacccaggagcgggcaaaacaaaaaggtatctccccgcgattgttcgtgaagcgatcaaaagaggattgagaacattaatcttggcaccgactagagtagtcgcagcagaaatggaagaggcactcagaggacttccaattcgatatcaaacccccgcaataaaaacagaacataccggaagggaaatagttgatttaatgtgtcatgctacatttacaatgcgtctacttagccccgttcgggtgcccaactacaatttaataattatggatgaagcacactttactgaccctgcttcaattgccgcgaggggatatatttcaacgagagttgaaatgggagaggccgctggaatttttatgacggcgacgccaccaggatccagagaccctttccctcaaagcaacgcaccgattatggacgaagaacgtgaaatccctgaacgaagctggaactccggacatgaatgggttaccgatttcaaagggaaaacagtatggtttgttccatcaataaaagctgggaatgatattgcagcctgcctgaggaaaaacgggaagaaagtgattcaactgtcgcgcaaaacatttgattcagaatatgtaaaaactcgtgccaacgattgggatttcgtggtcacaactgatatttcagaaatgggagcaaatttcaaagcagaacgtgttatagatcctagaagatgtatgaagcccgtaatcctcactgatggtgaagaaagagtgattttagcgggcccaatgcccgtaacgcattcatcggcagcacaacgtcgtgggagaataggcagaaatcccaaaaatgagaatgaccaatacatttacatgggggaaccactggagaatgacgaagattgtgctcactggaaagaagcaaaaatgttactcgacaatataaatacacctgagggtataatccctagcatgtttgaaccagaaagagaaaaagtagatgccattgatggggaatatagattacgaggtgaggcacgaaaaacttttgtggatctaatgagaagaggggacctcccggtatggttagcatataaagtagctgccgaaggtatcaattatgccgaccgtaagtggtgcttcgacggaataaagaataaccagatacttgaagaaaatatggaagtagaaatatggactaaggaaggagagcgtaagaaacttaaacctagatggttagacgcccgcatttattcagatcctctggctcttaaagaatttaaagagttcgcagcgggcaggaaaagcctcacacttaatttaataactgaaatgggacgcttaccgacatttatgacacagaaagcacgaaatgcgttagataaccttgcagttctacatacggctgaagcaggaggacgcgcatacaaccatgctctaagcgaacttcccgaaacactagagactcttttactcctgaccttattagcgactgttacgggaggaatattcctgttcttaatgtctgggaaaggtataggaaaaatgacgcttgggatgtgttgtattatcacggctagcatactcttatggtacgctcaaattcagccgcattggatcgctgcaagcataattctagagttctttcttattgtactactaatccctgaaccagaaaaacagcgcacgccgcaagacaaccagctgacttacgttgtcattgctatactaacagtcgtcgccgccactatggccaatgaaatgggcttccttgaaaagacgaagaaagaccttggactcggaagcataactacccaagaaagtgaatcaaatatcctagacatcgacttaagacctgcatcggcgtggaccttatatgcagtcgcaactaccttcgttacacctatgcttagacacagcatagaaaatagcagtgtgaatgtatccttaacagcaattgcaaatcaggctactgttttgatgggtttgggaaaaggttggccactatccaaaatggatataggggtcccactacttgctataggatgctattctcaagttaatccgataactttaaccgccgcattacttctgctagtggcccactatgcgataataggtcctgggctacaagccaaagcaactagagaagcccaaaagagagcagccgctggaataatgaaaaacccaactgttgatggcataaccgtaatagatctcgagccaattccctacgacccaaaattcgaaaaacaactcgggcaagtaatgcttttaatcctatgtgttacacaggtccttatgatgcggacaacttgggctctttgcgaggcccttacactagctacaggacctattagcacattgtgggagggaaatccaggccgtttttggaatactactattgctgtttccatggccaatatttttagggggagttatctcgcgggagctggcttgttattttctataatgaaaaacacaacaagtacacgtaggggaacggggaatatcggagaaacactaggtgaaaagtggaaatctaggctaaatgcattagggaaaagtgagttccagatctataaaaagtcaggcattcaggaagttgatagaacgttggcaaaggaaggcataaaaagaggagaaactgatcaccacgctgtatcgcgaggatccgctaaactacgttggtttgtggagaggaatatggtaacgcctgagggcaaagtagtcgacttaggatgtggtagagggggatggagttactattgtggaggccttaaaaacgtccgagaggtaaaaggtctaacaaaaggtggcccgggtcacgaagaaccaataccaatgtctacgtacggctggaatctggtacgccttcagtccggggtagacgtcttctttactccacctgagaaatgtgacactctactctgcgacataggagaaagctcgcctaacccaacaattgaggctggacgcactctacgggttctcaatctagtagaaaattggctcaacaataatacgcaattttgcattaaagtcttaaatccgtacatgccaagtgttatagagaaaatggaagcgctgcaaagacagtacgggggagccctagtgaggaatccattgagtagaaactcaacacacgaaatgtattgggtatcaaatgcgacaggaaatatcgtaagttcagtaaatatgatctcgagaatgctaattaacaggtttaccatgaaacacaagaaagcaacatatgaaccagatgttgacctagggagtgggacacgcaacataggaatagaatcagaaattccaaacttggatataattgggaagcgtatagaaaagataaagcaagagcatgaaattagctggcattatgatcaagatcacccttacaaaacctgggcatatcacggcagctatgaaactaagcaaaccggatcagcttcgagtatggtgaatggagtagtcagactactgacaaaaccatgggatgtggtacctatggtcactcagatggccatgacagacacaactcctttcggacagcagagagtttttaaagagaaagtagatacacggacgcaagaaccaaaagaagggaccaagaaactgatgaaaataacggctgagtggctctggaaggaattagggaagaaaaagacacctaggatgtgtacgagagaagaatttactaagaaagttagatcaaatgcggctcttggagcaatatttacagatgaaaataaatggaaaagtgcacgagaagcagtagaagatggtcgattctgggaattggtagacagagaaagaaatctccacttagaaggtaaatgtgagacctgtgtgtacaatatgatgggcaaaagagagaagaaattgggtgagttcggcaaagcaaaaggctctagagccatatggtatatgtggttaggagcaagattccttgagttcgaagcactaggcttcttaaacgaagatcattggttttcacgcggcaattccctatcaggcgtggagggcgaaggcctacacagactaggatacattttgcgggatgtgggtaagaaagagggcggagcaatgtatgcggacgacacagccggatgggacactagaattacactggaagatttaaagaacgaagaaatggtcacaaatcatatgaaaggcgaacacaagaaactagcggaagctatatttaaactaacatatcaaaacaaagtagtaagagtacagagacctacaccaagggggacagtcatggacattatatctcgtagagaccagcgaggcagcggacaagtaggaacatacggattaaacacatttactaatatggaagcgcaacttataagacagatggaaggcgaaggcatttttaaatcgattcaacatttaacagccacagaagagatagccgtacagaactggttggcacgagtaggacgagaacgtttaagcagaatggcaataagtggagatgactgtgtagttaaacctatagacgacagattcgctagtgccctgacggcgcttaacgacatgggaaaagtaagaaaagacattcaacaatgggaacccagtcgaggctggaatgactggactcaggtacccttttgctctcaccactttcacgagcttgtaatgaaagatggtcgagtactggtggtaccatgtcgcaatcaagacgaattgataggcagagcacgaatatctcaaggagcaggatggtcactcaaagaaactgcatgtctaggtaaatcgtatgcgcaaatgtggactctaatgtatttccacagacgtgatctgagactggcagcgaatgccatatgcagtgctgtcccaagtcactgggttccgaccagtcgaactacgtggtcaatacatgccaaacacgaatggatgacgacagaagatatgttagcagtgtggaaccgagtctggatccaagaaaatccgtggatggaagacaaaacaccggtggaaagctgggaagaagtaccttatcttgggaagagggaagaccagtggtgtggttcacttattgggctaacctcaagagccacatgggccaaaaacatccaaacggcaatcaatcaagtaaggtccttaataggtaatgaagagtacacagactatatgccttcgatgaagagatttagaagagaagaagaggaagctggagtcctatggtag

SEQ ID NO: 22386 - RNA, 9876 nt, synthetic construct
  misc_feature 1..9876: note = derived and/or modified CDS sequence (opt6) from DENV-2__EU482629__SS-prME
  source 1..9876: mol_type = other RNA
acggcaggcgtgatagtaatgttgataccaacagctatggcgtttcacttaacaacgagaaatggcgaaccgcatatgattgtaggccgacaagaaaagggaaaatcactattatttaaaaccgaggacggtgtaaacatgtgtacgctcatggctattgacctaggagaattatgtgaagatactattacgtacaaatgtccactcctcagacaaaatgaaccagaagacatagactgttggtgcaatagcactagcacgtgggtaacatatggaacatgtactacgacaggtgaacatcgaagagaaaaacgttccgtagctttagtcccgcacgtaggtatgggactagaaacaagaacagaaacatggatgtcgtctgaaggagcttggaaacacgtgcaaaggatagaaacctggattcttagacatccaggctttaccataatggctgccattctcgcctataccattgggactacccatttccaaagagcacttatttttatacttcttactgctgtcgcgccaagcatgacaatgcgttgtatagggataagcaatcgtgattttgttgaaggagtgtccggtggaagttgggtcgatatagtattagagcatgggagttgtgtcaccaccatggcaaagaacaaaccgacgttagattttgaattaattaagactgaagctaaacaaccagcgacactcagaaaatattgtatagaagcgaaattaacgaacaccacaactgaatctcgatgcccaacacaaggtgaaccttcattaaatgaagagcaagacaaaagatttatatgtaaacattctatggtggaccgcggctggggaaatggttgtgggttattcgggaaagggggaatagtaacgtgtgcaatgttcacctgtaagaagaatatggaaggaaaaattgtccaacccgaaaatttggaatacacaatcgtaatcacaccccattctggtgaagaacacgcggttggtaacgatacaggaaagcacgggaaagaaatcaaaatcacgccacaaagtagtataaccgaagccgaattaaccggatatgggacagtgacgatggaatgtagcccacgtacaggcctagacttcaacgagatggtactactacaaatggaggataaagcctggctagtacataggcaatggttcctggatctcccgttaccgtggctacctggtgccgatacccaaggtagtaattggatacaaaaagaaacactagttacttttaaaaacccacatgcaaaaaaacaagacgtcgtagtcctaggaagtcaagagggggcaatgcacactgctctgaccggagcaacagaaattcaaatgagtagtggaaacctgcttttcacaggtcatctaaagtgtcgactcaggatggataaattacagctgaaggggatgtcctattcgatgtgtacgggtaaatttaaaatcgtaaaagaaatagcggaaacccaacacgggacaatagttattagagtacaatacgagggagacgggagcccatgcaaaataccgtttgagatcactgacctggaaaaaagacatgttctaggtcgattgatcacggtgaacccaatagtaacagaaaaagattcccctgttaatattgaagccgaaccaccatttggagactcgtatataattataggagtggagcctggtcaactaaagttaaattggtttaaaaaaggatcgagtataggccaaatgtttgaaacgacgatgcgcggcgctaagcgaatggccatcttaggggacactgcatgggactttggtagtttaggaggtgtcttcactagtattggaaaagcactgcatcaggtatttggagcaatctatggagctgcattttccggtgtatcctggacgatgaagatcttaattggagttatcataacttggataggaatgaacagcagatcaactagcttgtccgtaagcttggtacttgtaggggtagtaactttatacttaggagcaatggtgcaagccgattcaggatgcgtagtttcttggaaaaataaagaactcaaatgtgggtcaggcatatttataacggataacgtacatacgtggacagagcaatacaaatttcaaccagaatcaccttccaagttagcatccgctattcaaaaagctcatgaagaaggaatttgtggcataagatctgtaacgagactcgaaaatttgatgtggaagcagataacgcccgaattaaatcatatattatccgagaatgaggttaaactcacaattatgacaggtgatataagaggcataatgcaagcaggtaaaaggagcttaaggccacagcccactgaactaaagtacagttggaagacttggggcaaggcaaaaatgttatcaacagaatcacataaccagacgtttctgattgatggacctgagaccgcggagtgtcctaatacgaacagagcatggaatagtttagaggtagaggattacggattcggtgtgtttacaactaacatatggttgaagttaagagagaagcaggacgtattttgtgatagtaagttaatgagcgcagcaataaaagataatagagctgtccatgcagacatgggctactggattgaaagcgctttgaatgacacatggaaaatggaaaaagccagtttcattgaagtaaaatcctgccactggccaaaaagtcataccttatggtccaatggggtactagaaagcgaaatgataatacctaaaaattttgcaggtcccgtatcacagcataattacagacctggataccacactcaaacggcgggcccttggcacctaggaaaattagagatggatttcgatctgtgcgaagggacgacggtcgtggtgacagaagattgtggaaatcgcggtccctcactccgaaccaccacagcttctggaaaattaataacagaatggtgttgtcgttcgtgtaccctcccgccgcttaggtacagaggcgaagatggatgttggtacggaatggaaataagacccctaaaagaaaaggaagaaaacctcgtaaatagcttagttactgcgggccatggacagatagataattttagtttgggggtcctgggcatggcactattcttagaagagatgctacgaacacgtattggcacaaagcatgctattttgctcgtagccgtttcatttgtaacgttaataaccgggaacatgtcatttaaagatcttggtcgggtaatggttatgatgggtgcaaccatgacagatgacataggaatgggagtcacatatttagcccttttagcggcatttaaggtaaggcctacgtttgcagcaggtctgcttttgcgtaagctgacgtcaaaagaattaatgatggccacaattggaatagcattattgtcccaatcgactattccagaaacaatcttagaactgacggacgctctcgccttaggtatgatggtactaaagatagttcggaatatggaaaaatatcagctcgccgtaacgataatggcaattagttgtgtccctaatgcagtaatcttgcagaacgcttggaaggtttcatgtactatacttgccgctgtgagcgttagcccattactgttaacatcatcacaacaaaaagctgactggattcccctggcattaacaataaaaggactgaatcctacggcaatttttcttacgactctatctagaacatcgaaaaagagatcatggcctcttaatgaagcaattatggctgtgggcatggtatcaatccttgcaagctccttactaaaaaatgacattccaatgacagggcccctagtcgcaggcggactcctcactgtgtgttacgtcttgacgggacgcagtgctgatttagaactagaacgcgcagcggacgtgaaatgggaggatcaggcggagattagtggatcctcaccaattctaagtattacaattagtgaggatggctcaatgagtattaagaacgaagaggaagaacagacattaacaatactcataaggaccggactcttagtaataagtggagtattccctgtatccatccccattactgcagcagcgtggtacctatgggaagttaaaaaacagagagccggggtattgtgggatgtaccatcacctccaccagtagaaaaggcggaactagaagatggagcatatagaataaagcagagaggaatattaggatattctcaaataggtgctggtgtctataaagaaggaacatttcatacgatgtggcatgtaacacgtggagcagttcttatgcacagagggaagcgcatcgaaccaagctgggctgacgtcaagaaagatctaataagctatggaggaggatggaaattagaaggagaatggaaagaaggtgaagaagtgcaagtcttagccctagaaccagggaaaaacccccgcgcagttcagaccaaacccggcattttcaaaactaacacagggactatcggagccgtatcattagatttcagtcctggcactagtgggtcgcccattgtcgatagaaaaggaaaagtagtcggcttgtatggcaacggtgtcgtgactcgatcaggagcttacgtgtccgcaatagcccagacagaaaagagcatagaagataacccagaaatagaagatgatatattcagaaaaaaaaggctcactattatggacttacaccccggtgccggtaaaactaaaagatacctccctgcaatagtaagggaggcgattaaacggggactaaggactttaattctagcgcctactcgggtagtggcagcggaaatggaggaagctctcaggggactaccaatacgttatcaaacaacagccattaaaacagaacatactggaagagaaattgtagatttaatgtgccacgcaactttcaccatgagacttctgagcccagtacgcgttccgaattataatcttatcattatggacgaagcgcactttactgatccagcctccatagcagcgcggggttatatatcaactagggtagaaatgggagaagcagcgggtatattcatgactgctacacctcccggaagtagagatccttttccgcagagtaatgcgcctataatggacgaagaacgcgagatcccggaacgatcctggaattctggacatgaatgggtaacagatttcaaaggaaaaacggtctggtttgtaccttcaataaaagcaggcaatgacatcgcagcatgccttcgaaagaatggcaaaaaagtaatacaattgagcagaaaaacattcgactccgaatacgttaaaactagagcaaacgattgggatttcgtggtaacaacagatatatcggaaatgggagcgaatttcaaagcagaaagagtaatcgacccacgcaggtgcatgaagcctgtcatattgacggacggggaagagcgagtcatattagccggacccatgccagtaacgcattcaagcgcggcgcaacgcagaggtcgaattggaagaaatcccaaaaatgaaaatgaccagtacatttacatgggagaacctttagagaacgatgaagattgcgcacattggaaagaagcaaagatgttactagataacatcaacacaccagaaggtataatacccagtatgtttgaaccagagcgagagaaagtggacgcaattgacggtgaatacagattacgaggagaagcgagaaagacatttgtagacctaatgcgccgcggagacctaccagtctggttggcatacaaagtggcggctgaaggaattaattacgcagatcggaaatggtgctttgatggtattaaaaataatcaaattcttgaagaaaacatggaagtcgagatctggacgaaagagggtgaaagaaaaaaattgaagcctaggtggttagatgcgcgaatttacagcgaccctttggcacttaaagagtttaaagaatttgccgctggacgtaaatccttgactcttaatttaattacagagatggggcgtttacccactttcatgacacaaaaagcccgtaacgcattagataatctggctgtcctacatacggctgaggcaggtggacgcgcttacaatcacgcactgagcgaattaccagagaccctggaaacgctattgctactaactttattagctacagtgactggaggcatatttctctttctcatgagcggcaaggggataggtaaaatgacactcgggatgtgttgcattataacagcatcaattctcctatggtatgcccaaatacaacctcattggattgcagcaagtattatattagagtttttcctgatagtattactaatacctgaaccagaaaaacaacgaacaccgcaagacaatcaattgacatatgtggtgattgcaatcttaacagttgtcgcagctactatggcaaatgaaatgggattcttagaaaaaacaaaaaaagatctaggtctcggcagcataacaacacaggagtcagaaagtaatatccttgatatcgatttaagacccgcgagcgcttggactctttatgctgttgcaaccacttttataactccaatgttaaggcattcaatcgaaaacagcagcgtcaatgtaagtttaacagccatcgcaaaccaggctacggtccttatggggcttggcaaaggatggccattatcaaaaatggatataggagtgcctcttttggccatcggttgctatagtcaggttaatccaataacactgaccgccgcgctactactactagtagcgcattatgcgatcatcggacccggattacaagctaaagcaacgcgagaggctcaaaagagagccgccgcgggaatcatgaagaacccgacggtagatggcatcaccgtcatcgacttagaacctatcccgtatgaccctaagtttgagaaacaactcggacaagtaatgctcctcatactatgtgtcactcaagttttaatgatgcgaacaacatgggctttatgcgaagcattgacattagctactggacctatatcgaccttatgggagggaaatccaggaagattctggaacacaaccattgcagtatcaatggcgaatatctttcgcggctcttatctagcaggtgctgggctattatttagtattatgaaaaatacgacaaacacacgcaggggaaccggaaacatcggagaaactctaggagagaaatggaaaagccgtctgaacgccctgggaaagtcagaatttcagatatacaagaaatcaggaattcaagaagtagaccgaacactagcaaaagaaggtattaagcgaggagaaacagatcaccatgcagtttctcgagggtcagcgaaattaagatggtttgtcgaacgtaacatggttacgcccgagggaaaagttgttgatcttgggtgtggaagaggcggttggtcatactattgcgggggattaaaaaatgtaagagaagttaagggactaactaaaggtggccccggacatgaggagcccatacctatgagtacgtacggctggaacctggtcagactccaatcaggggttgatgtatttttcacgccacctgagaagtgcgataccctattatgtgacatcggtgaatctagcccaaaccccacgatagaggccgggcgtactctaagagtactcaatttagtagagaattggctcaacaataatacacaattttgtatcaaagtattaaacccctatatgcctagtgttattgaaaaaatggaagctttacaacgaaagtatggaggagcgctagtaaggaatccactctctagaaattcaacacatgaaatgtactgggtttctaatgcgacaggaaacatagttagttcagtcaatatgatatcaagaatgcttataaataggtttacaatgaagcacaaaaaagctacatacgaaccagacgtcgatctaggaagcggaacacgaaatattggcattgaatcagaaatacccaatttagatatcataggaaaacggatagaaaagataaaacaagagcacgaaacaagttggcactacgatcaagatcatccttacaaaacttgggcgtaccatggctcctacgagacgaaacagacaggatccgcttctagtatggtaaatggagtggtaagactacttacaaaaccatgggatgttgtgccaatggtgacacaaatggcaatgacagatactactccgtttggacagcaaagagtgtttaaggagaaagtagatacaagaactcaagagccaaaagaggggacaaaaaaattaatgaaaattacagcagaatggctgtggaaagaactagggaaaaagaagactccacgcatgtgcactcgtgaagaatttacaaggaaagtgcgctcaaatgcagcactaggagcaatattcacagatgagaataaatggaagtctgctcgggaagcagttgaggatggcagattttgggaattagtagacagagaaagaaatttacacttagagggcaaatgtgagacttgtgtttataatatgatggggaagagggaaaaaaaattaggagagttcggtaaagccaaaggatctagagccatctggtatatgtggttaggcgcacgattccttgagttcgaagccttaggtttcctaaatgaagaccattggttctcacgaggaaactcattatcaggtgtagaaggggaaggcttacacaggctaggttacatcttgcgtgatgtgggaaaaaaagagggtggtgcaatgtacgcagacgatacagcaggttgggacacaagaataacgttagaagacttaaagaatgaagaaatggttacgaaccacatgaaaggcgagcataaaaaacttgctgaggcaattttcaaactaacgtaccaaaataaggtggtacgagtccaacgtccaaccccaaggggaaccgtcatggatatcatttctcgtagggatcagagaggaagcgggcaggtgggtacttatggtttgaatacctttacaaacatggaggctcaattaatacgacagatggagggcgaaggcatattcaagtctatacagcacctaactgcaacagaagaaatagccgttcaaaattggctagcccgagtgggacgagaaaggttgagtcgaatggctatttcgggtgacgactgtgtagtcaaaccgatagatgacaggtttgcatccgcactgaccgcacttaacgacatgggcaaaataagaaaagatattcaacaatgggaaccgtcacgtggctggaatgactggacgcaagtaccgttttgcagtcatcacttccatgaacttgtaatgaaagatggaagagtattagtagtcccttgccgtaaccaagatgaacttatagggagagcgcgcatctcacagggagcaggctggtctttgaaggaaacagcatgccttggaaagtcatatgctcaaatgtggacactaatgtatttccaccgtcgagatttgagacttgctgctaatgcaatatgcagcgcggtgccaagccattgggtaccaacaagccgtacaacttggtctattcatgcaaagcatgaatggatgacaactgaggatatgttagcggtttggaatagagtttggatccaagaaaacccttggatggaggataaaacaccagttgagtcgtgggaagaggtaccatacttagggaaaagagaagatcaatggtgcggatcacttatcggtttaactagccgagcaacttgggcgaaaaatatacaaaccgcaattaaccaagtacgaagcctaataggaaatgaggaatacactgactatatgccatcaatgaaacgctttcgtagagaagaggaagaagcgggggttctttggtga

SEQ ID NO: 22387 - RNA, 9876 nt, synthetic construct
  misc_feature 1..9876: note = derived and/or modified CDS sequence (opt6) from DENV-2__FJ390390__SS-prME
  source 1..9876: mol_type = other RNA
acggccggggttattgtaatgttaattccaaccgcaatggcatttcatttgacaactaggaatggagaacctcatatgattgtgggaagacaagaaaaagggaaatcactactctttaaaacagaagatggtgtaaatatgtgcacgctcatggctatagatctaggagaactatgcgaagacactattacatataaatgcccactactacgtcaaaacgaaccagaagatattgattgttggtgcaatagcacatcaacgtgggtaacatatgggacatgcacaacgacaggagaacatagaagggaaaaacggagcgttgcattagtaccccatgtaggaatggggttggagacacgaacggaaacatggatgtctagcgaaggagcctggaaacatgttcaaaggatagagacctggatattaagacatcctggatttacgataatggcggcaatactggcttatacaattggcacaacgcattttcaaagagcactaatatttatcttgttgacagctgtggctccttcgatgaccatgagatgcatcggtatatcaaaccgggactttgtagagggggtatcaggaggatcttgggtagacatagtattagaacatggctcgtgcgtaacaacaatggcgaaaaacaaacccacacttgacttcgaattgataaaaaccgaagctaaacaaccagctacattaaggaaatattgtatcgaagctaaactaactaacacgacaactgaatcccgttgccctacccaaggtgagcctagcctaaacgaggaacaagataaaagatttatatgcaaacatagcatggtagacaggggatggggcaatgggtgcggactcttcggcaaaggaggaatagtaacctgtgcgaaatttacgtgtaagaaaaatatggaagggaaagttgtacaacctgaaaatttggaatatactatcgtaatcactcctcattctggggaagaacatgctgttggcaatgatactggcaaacatggtaaagagataaaaataacgccacagtcttcaattactgaagcagaattaacaggctatggaactgtaacaatggaatgttcacctaggactggactagattttaacgaaatggtactacttcaaatggaagacaaagcatggctagttcatcgacaatggtttttggatctaccattaccgtggcttccgggggctgatacacaggggtccaattggatccaaaaagaaacgttagtaacatttaaaaacccacatgcaaagaaacaagatgtagtggttttggggtcccaagaaggagccatgcacacagctttaactggagctaccgaaattcaaatgagtagtggaaacctattattcacgggtcatttaaaatgtcgtctcagaatggataaacttcaattaaaaggaatgtcttatagcatgtgtacagggaaattcaaaatagtcaaggaaatagcagaaacgcaacacggtaccatagttatacgagttcaatatgaaggagatggaagtccatgtaagattccatttgaaataacggatctagaaaaacgacacgttttggggcgacttattacagtaaacccgattgtgactgaaaaagatagccccgtcaatatagaagccgaaccacccttcggagactcctacataattataggagtggaacctggacagttgaaattaaattggttcaagaaagggtcttccattggtcaaatgtttgaaaccacgatgagaggagcgaaaaggatggccattttaggtgacactgcttgggatttcggttctctaggaggagtctttacaagcatcggtaaagcgctccaccaggtttttggtgcaatctatggagctgcgttctctggcgtgagttggactatgaaaattttgattggggtgataattacttggataggaatgaactcaagatcaacatctttaagtgtatcactcgtgttagtaggtgttgttactctataccttggagcaatggtccaagcagattcggggtgtgtggtgtcttggaagaataaagaacttaagtgcggctcaggaatattcattactgataatgtgcatacatggaccgaacaatataaatttcaaccagaatcaccgtccaaattggcctcagcaatccagaaagctcatgaagaagggatatgtggtatacgtagtgttacaagactcgagaatttaatgtggaaacagattaccccagaattgaaccacattttatctgaaaacgaagttaaacttacaattatgacaggggatattagaggaataatgcaggctggcaaaagatcattgcgcccgcaaccaacggaactcaagtactcatggaaaacctggggcaaagcaaaaatgttatcaacagagtcacataaccaaacgttcttgatagatggcccagaaacagctgaatgtccaaatactaatagagcatggaactcactggaagtcgaagattacggatttggcgtttttacgactaatatatggttaaaactccgagacaagcaagatgtattttgtgatagtaaattgatgagcgcagctatcaaggacaaccgtgctgtccacgctgacatgggctactggatagaatcagcgttgaacgacacctggaagatggaaaaggcttcattcatagaagtaaaatcatgtcattggccaaaatcacatactctttggtcaaatggagtattagaatcggagatgataataccaaagaactttgcaggtcctgtgagccaacataactaccgccctgggtaccacactcaaacggcaggcccatggcatttagggaaattagaaatggattttgacttgtgtgaagggaccaccgtagtagtgacagaagattgcggaaaccgaggaccaagcctgcgtacaacaacagcttcaggtaagctaattactgaatggtgttgcagatcttgtactcttccccctctgcggtacagaggagaagacggttgctggtacgggatggaaatcagacctttgaaggagaaagaagaaaacttagtcaatagcctagtcacagcgggccacggacaaatagacaatttttcattaggcgtattaggaatggcgttattgttagaggaaatgttacggacacggattggtacgaaacatgcaatattgctcgtagccgtcagctttgtaacgctaatcaccggaaatatgagtttcagagacttagggagagttatggtcatggtgggggcgactatgacagatgacataggtatgggtgtaacatacttagccttattagccgcattcaaagtgagacctacattcgccgcaggcctattgttacggaaattgacaagtaaggagctaatgatggcgaccattggtatcgcgctgctatcacagagcacaatccctgaaaccattctagaacttacagatgcgctagccttagggatgatggtgcttaaaatcgtacggaacatggagaaatatcaactagcagtcacagtgatggcaatctcatgtgtgcctaatgccgtcatattacaaaacgcgtggaaggtaagttgcacaattctagcagcagtttcggtcagtccactactactaaccagctcccagcagaaagcggactggataccgctcgcactaaccattaaagggttaaatccaacagcaatatttttgacaacactatcaaggacaagtaagaaaaggagctggccactaaatgaggctatcatggcagttggaatggtgtctattctagcgtcttcactgcttaaaaatgacattccgatgacaggccccttagtagcgggaggtttgctgaccgtttgttacgtacttacagggcgctctgctgacttagagctggaaagagccgcagatgtaaaatgggaagatcaagcagaaatttctgggtcctcaccgatactgagtataacaatatcagaagatggtagtatgagcatcaaaaatgaagaagaagaacaaacattaaccatattaataagaacgggactattagtaatatccggggtattccctgtaagcattcccataacagcagccgcatggtatctttgggaagtcaagaaacagcgggccggcgtcttatgggacgttccaagtcctccacctgtagagaaagcggaattagaagacggagcatatagaataaagcaaaggggaatactcggatattctcaaattggggccggagtttataaagagggtacatttcataccatgtggcatgtaactcgaggtgctgtcttaatgcacagagggaagagaatagaaccctcctgggcagacgtcaagaaagatttgatatcatacggtggtggttggaagttagagggcgaatggaaggaaggagaggaagtacaagtattagcattagaacccggcaagaatccgcgagcagtacaaacaaaaccaggtatatttaagaccaatacaggaacaattggtgccgttagcctggacttttcacccggaacttctggaagcccaattgtcgataggaaaggtaaagtggtaggactatatggcaatggcgtagtaacaagaagtggggcttacgtctcagccatcgcacaaacagaaaaatccattgaagataatcccgaaattgaagatgatatcttccgcaagaaaagactaacaataatggatcttcaccctggagcggggaaaacgaaacgatatctaccagcaatagtaagagaggcgataaaacgaggtctacgtaccttaatacttgcaccaacacgagtagttgcagcagaaatggaagaagcgctgagaggactacctattcgctaccaaacaaccgccataaagacggaacatacaggaagagagattgtggacctaatgtgtcacgcgacttttactatgcgtctattaagtcccgttcgagtaccaaattacaatttgattataatggacgaggcccattttaccgaccccgcatcaatcgcggctcgaggctatatcagtacacgggtggaaatgggggaggctgctggaatttttatgacggcgacgccgcccggaagcagagatccgtttccgcaaagtaatgcgccgatcatggatgaagaaagagaaataccagaacgatcatggaatagcggtcacgaatgggttaccgactttaaaggaaaaacggtatggttcgttccctccattaaagccggcaacgacattgcagcttgcttacgtaaaaacgggaagaaagtcattcaattatcaagaaagacatttgacagcgaatatgtcaagacaagagcaaacgactgggactttgtagttacaactgacataagtgaaatgggagctaacttcaaagcagaaagagttatagacccaaggagatgcatgaagcccgtaatactcacggatggtgaagagagggttatacttgccggaccaatgccggttactcattctagcgcggcacagaggagagggaggataggaagaaatcctaaaaatgaaaacgaccaatatatatatatgggagaaccacttgagaatgacgaagattgtgcacattggaaagaggccaagatgctactggataatatcaacaccccggaaggaataataccaagtatgtttgaacctgaacgtgaaaaagtggacgcaatagatggagaatacagattaagaggggaagccaggaaaacattcgttgatctaatgagacggggtgatttaccggtctggctagcatacaaagtcgcagccgaaggcataaattatgccgacagaaagtggtgtttcgatggaattaaaaataatcaaattcttgaagagaatatggaagttgaaatttggactaaagaaggcgaaagaaagaagttgaagccacggtggctcgatgcacgcatttactcggatcccttggccctaaaagagttcaaagagttcgctgcaggtcgtaaatcacttactctcaaccttatcacagaaatgggcagactcccaacattcatgacacagaaggccagaaacgcccttgacaatttggccgtgctacatacagcggaagctggaggcagagcatataatcatgcattatcggaacttccggaaacgcttgaaacactgctattattaacccttctggctactgtaacgggaggaattttcctgtttttaatgtccggtaaaggcataggtaaaatgactcttggtatgtgctgcattattactgcttcgattttactatggtacgcgcaaatacaaccacattggatcgctgcgtcaataattcttgagttctttctaatagtattactgataccagagccggaaaaacagcgaacaccccaagataatcaattaacttatgtcgttatcgccatattaacagtcgtcgcggcaacaatggccaatgaaatggggtttttagagaaaaccaagaaagatctaggtctaggttcaataactacacaagaatctgaaagtaatatattagacatcgatttgagacctgcaagtgcatggacattatatgcggtagcaacgacattcgttactcccatgcttagacacagcattgaaaattcgtcagtaaacgtatctttaacagctattgcaaatcaagcaacggtactaatggggttaggaaaagggtggcctttgagtaaaatggatattggagtacccttacttgctattggatgctactcccaagttaacccaattacactaactgctgcactcctactattagtagctcattacgcaataatcggccctggcctgcaagccaaagctactcgtgaagcccagaaaagagctgcggcaggaattatgaaaaacccaacagtggatggaatcacagtaatagatttggaaccgattccgtatgacccaaaattcgaaaaacaattaggacaagtcatgttactcatattatgtgtaacccaagtacttatgatgcgtactacatgggctctatgtgaagcgctaacactagcaacgggaccgataagtacattgtgggaaggtaatccgggtagattttggaacactacaatagcagtgtcaatggccaacatattcagaggatcttatttggctggggctggcttactcttttctatcatgaaaaataccaccaacacgcgtcgtggaacaggaaacataggcgagactttaggagaaaagtggaagagtcgactaaacgctctagggaaaagtgaatttcaaatatataagaaaagtggcattcaagaagtagacaggacactagcgaaagaaggtattaagaggggcgaaacagaccaccatgcggtttcaagagggtcagcaaaattacgatggtttgttgagcgaaatatggttacgcctgagggaaaggtggtcgacttaggttgcgggcgcggtggatggtcttattattgtggcgggctcaaaaacgtcagagaagtgaaaggactaactaaaggaggacctggtcatgaagaaccaataccaatgagtacgtatggatggaatctcgtacgacttcaatcaggtgttgatgtgttcttcacccctccagaaaagtgcgatacattattatgtgatataggtgaaagttcaccaaacccgaccattgaagcaggacgaaccttgcgcgttctaaacctcgttgaaaattggctaaataataatactcaattttgcatcaaggtgttaaatccctacatgccctcagttattgagaaaatggaggccctgcaaagaaagtatggcggagcgcttgtgcgaaatccactatcaagaaacagcacacacgaaatgtattgggtctcaaatgcaactggaaacatcgttagctctgtaaatatgataagtcgaatgttaattaatcgtttcacaatgaaacacaagaaagccacatatgaacctgatgtagacctaggaagtggcacaagaaatattggaattgagagtgaaatccccaatctagatataataggaaagagaatagaaaagataaaacaagaacatgaaacgtcttggcactatgaccaagatcacccgtacaaaacgtgggcataccatggctcttacgagacgaaacagacgggatcagcaagtagcatggtgaacggagtagttcgcctactaaccaaaccatgggatgtagtaccaatggtgacccaaatggcgatgacggatacgacaccttttggacagcagagagtttttaaagaaaaagtagataccaggactcaagaaccaaaagagggaacaaagaaacttatgaaaataaccgcagaatggttgtggaaagaattaggcaaaaagaaaacaccgagaatgtgtactcgagaagaatttacgagaaaagtcaggagtaacgccgcgttgggggccattttcacagatgaaaacaaatggaagagtgcgagagaagcggtggaagacggtaggttttgggagctagtagatagagaaagaaatctgcatttagaaggtaagtgtgaaacatgcgtttataacatgatgggaaaaagagaaaagaaactaggagagttcgggaaggcaaaaggtagccgagccatatggtacatgtggctaggtgctagattcttagagttcgaagccctaggctttcttaacgaagatcattggttctcgaggggcaacagtttgtcaggagtcgaaggggagggactacaccgattgggctatattctacgggacgtagggaagaaagaaggaggggcaatgtatgcagacgacacagctgggtgggatactcgaataactttagaagatttaaagaacgaagaaatggtaacaaaccatatgaaaggcgagcacaagaaactagcagaagcaatttttaaattaacatatcaaaacaaagtagttagagtacagcgaccgaccccgagaggcacagtgatggacattatttcaagacgtgaccagagaggatccggacaagtaggtacctatggtttaaatacatttactaatatggaagctcaactaatacgccaaatggaaggtgaaggaatattcaaaagtatacaacatttaaccgccacagaagagatagcagtccagaactggctagcaagggttgggcgagaacggttgagtcgtatggcaatatcaggagacgactgtgtagtgaaaccgattgacgacagatttgctagcgcacttacagctttaaatgatatgggaaaagtgcgcaaggacatccagcagtgggaacccagtagaggatggaatgactggacacaagttcctttttgctcccaccactttcacgagttagtaatgaaagatggtagagtacttgtcgtaccctgccgcaaccaggatgagttaataggcagagcaagaatatctcagggagctggttggtctttaaaagaaactgcttgtcttgggaaaagctatgcacaaatgtggacattaatgtattttcatcgccgagatctccgcttggcggctaacgcgatatgtagcgctgtcccgtcccactgggtcccaacttctcgtacaacatggtccatccacgcgaaacacgaatggatgacgaccgaagacatgctagcagtatggaatagggtatggatacaagaaaacccttggatggaagataagactcccgtagaatcatgggaagaggtaccttatttagggaagcgtgaggaccaatggtgtggatcactaattgggttaacgagtagggctacttgggctaagaacatacagactgccataaatcaagttcgcagtctaattgggaacgaagagtatacagattatatgccttcaatgaaacgattccgaagagaagaagaagaagctggagttttatggtaa

SEQ ID NO: 22388 - RNA, 9876 nt, synthetic construct
  misc_feature 1..9876: note = derived and/or modified CDS sequence (opt6) from DENV-2__FJ390391__SS-prME
  source 1..9876: mol_type = other RNA
actgctggtgtgatagtcatgctcataccaactgctatggctttccatctaaccacgcgaaacggagaaccgcatatgattgtaggaaggcaagaaaaagggaaaagtctactattcaaaacagaggatggagttaacatgtgcacgcttatggcgatagatttgggcgagctctgcgaggacactatcacctataaatgtccattactgcgtcagaatgagcctgaagatatagactgctggtgtaactccacatccacctgggtcacctatggcacatgtaccacaacaggagaacatagaagggagaaaagatcagtcgcattggtcccacacgtcggtatgggattagagacgagaactgaaacctggatgtccagtgaaggtgcatggaagcacgtccaacgtatagaaacctggatattacgtcacccaggcttcacaataatggcagctatcttagcatacaccataggtaccacgcatttccaacgtgcgttaatttttattttattaactgcggtggccccttctatgactatgcgttgtattggcataagcaaccgtgattttgttgaaggtgtttctggaggatcatgggtagacatagttctagaacacggcagctgtgttacaactatggccaaaaataaaccaactttagactttgagctaataaaaactgaagccaaacaacccgccactcttagaaagtattgcatagaggcaaagttgactaataccacgacagaatctaggtgtccaacacaaggggagcccagtttgaatgaagaacaagataaaagatttatatgtaaacatagcatggtcgaccgcggatggggaaatggatgtggactattcggcaaaggtgggatcgtaacttgcgcaatgttcacatgcaagaaaaatatggaagggaaagttgttcagcccgaaaacctagagtacactattgttatcacaccgcatagcggtgaagaacacgcagttggtaatgatacaggcaaacatggcaaagaaataaaaataacacctcaatcgtcaataaccgaggccgaattaaccggctatggaaccgtaacaatggagtgcagcccgagaactgggctggattttaacgaaatggtacttcttcaaatggaagacaaggcctggctcgtacatcgacagtggtttctcgatctccccttaccatggctgccgggtgcagacactcaaggatcaaattggattcaaaaagagactcttgttacttttaaaaatccacatgccaagaaacaagacgtagtagtcctaggaagtcaagaaggagcaatgcacaccgcgcttaccggcgcaacggagattcaaatgagctccgggaatctgctgtttactggacatttgaaatgtcgacttagaatggacaagctacaactaaaaggaatgtcatattctatgtgtacaggaaaattcaaaatagtaaaagagattgcagagacgcaacatggaaccatagtgataagagtgcaatacgaaggagatggctcaccttgtaagataccctttgagataacagatctcgagaaacgacatgtactaggcagattaataacagtaaatccaatcgtaactgaaaaagactctccagtaaacattgaagcggaaccacctttcggagactcatacatcataataggggtggaacctggacagttaaaattaaattggtttaagaaaggtagcagtattggacagatgtttgaaaccacaatgcgtggagctaaaagaatggccattctaggtgatacagcatgggattttggttccctaggaggtgtatttacttccataggaaaagccttacatcaagttttcggagcgatctatggagccgcgtttagcggagttagctggaccatgaaaattctcataggagtaataataacatggatagggatgaactctagatcaacaagtctttcagtaagtctagtcttggtcggagttgtcacactataccttggtgccgtcgtacaagcagactccggatgtgtagtgtcatggaagaataaggaactcaaatgtgggtcaggaatattcattaccgataatgttcatacctggacagaacaatacaaattccaaccagaatcaccctccaaactagcatccgcaattcaaaaggcgcatgaagaggggatctgtggcatcagatcagtaacaagattggaaaacctcatgtggaaacagataaccccagaattaaatcacattctatctgaaaatgaggttaaattaactataatgactggggatattaaaggtataatgcaggcaggaaagagatcactccgacctcagcccacagaacttaaatactcttggaaaacctggggaaaggcgaagatgctgagtacagaaagtcataatcaaacatttttaattgatggccccgagacagcggaatgtccgaacacaaatcgtgcgtggaatagcttagaagtagaggattatggcttcggggtattcaccactaacatttggttaaaattaagagagaagcaggacgtattctgcgactctaaacttatgtctgcagcgatcaaagataaccgagcagttcatgctgacatgggatattggattgaatcagccttaaacgatacctggaaaatggagaaagcctcctttatagaggtcaaatcgtgtcattggcctaagtctcatacgttatggtctaacggcgttctagaaagtgaaatgatcattcccaaaaatttcgcaggcccagtgtcacaacacaattataggccgggctatcacacacaaacagctggtccatggcacttaggtaaattagagatggatttcgatttttgcgagggaacaacagtggtagttacagaagattgtggaaaccgaggtccatcgttacgaacaactactgcatcaggaaaacttataacggaatggtgttgccgatcatgcacattaccacctttacgatatcggggagaagatggatgttggtatggcatggaaatccgccctctaaaagagaaagaagaaaacttagttaactctttagtaaccgcgggtcatggtcaaatagacaatttctccctgggcgtactaggaatggccctattcctagaagaaatgcttagaacaagaattggaactaagcatgcaatactccttgtagccgtgtcctttgtaacactgattacaggtaacatgtcttttagagatcttggacgggttatggtcatggtgggagcgactatgaccgatgacattggcatgggggtaacttatctagcacttttggcagcattcaaagtccggccaaccttcgcggcagggctcctattaaggaagttaacatcaaaggaattaatgatggctactataggcatagccctcttaagtcaatctactataccagaaacaatattcgaactgacagatgcattagcattggggatgatggttctcaaaatagtgcgcaatatggaaaaataccaactagccgtaacaattatggccatttcatgcgtacccaatgcagtgatattacagaatgcgtggaaagtctcatgtacaatattagcagccgtcagtgtgagtcccctcttgctaacgtcctcgcagcaaaaggctgattggataccgttggcattgacgatcaagggcttaaatccaactgcaatatttttgactactttatcgcgaaccagtaagaaaagatcatggccacttaatgaagcaattatggctgtaggtatggtttctatccttgcaagttctctgttgaaaaatgatattccaatgacgggaccattagtagcaggagggctgctaactgtatgctacgttttaactgggcgatcagcagatttagagctagaacgtgcggctgacgtaaaatgggaagaccaagcagaaatatcagggtcaagcccaattctatcaatcacaatttctgaagacggttcgatgtctatcaaaaatgaggaagaagaacaaacccttacgattttaattagaactggattacttgtaatctcaggcgttttcccagtttctattccaataacagcagctgcttggtatttatgggaggtaaagaagcaacgcgccggagttttatgggacgtaccttcacctcctccagtggaaaaggctgaacttgaggatggtgcgtatagaatcaaacaacgtggtatactaggatacagtcaaataggtgcgggtgtttataaagaaggaaccttccataccatgtggcatgtaacacgaggtgcagttctaatgcatcggggaaagaggatcgagccatcgtgggcggacgtcaagaaagatctaatatcatatggagggggctggaaacttgaaggtgaatggaaggaaggcgaagaagtgcaagtcctagccttagaaccgggaaagaacccaagagctgtacaaaccaaaccgggaatatttaaaacaaatacgggaaccatcggagcagtgagtcttgatttctctcccggaactagcgggagccccattgtagataggaagggaaaagtagttggtctctatggtaacggcgtagtgactaggtcgggagcttatgtatccgcaatagcgcaaactgaaaaatctatagaagataatccagaaattgaagatgatatttttagaaagaaacggctaactataatggacttacatccgggagccggcaaaacaaaacgatatttacctgcaatagtcagagaagcaataaaaagaggtctgagaaccttgattttagcacctacacgagtcgttgcagctgaaatggaagaagcgttacgtggattaccaataaggtaccaaaccccagcaataaaaacagaacatacaggtcgtgaaattgtagacttgatgtgtcacgcgacctttacaatgagattgctgagccctgtcagggtacccaattataaccttataatcatggacgaagcccatttcacagaccctgctagtatagcagcacgagggtatattagtactagagtggaaatgggtgaggccgctggtatattcatgacagctacaccaccaggatcacgagatccattccctcaaagtaacgcaccgatcatggatgaagaaagagagatacctgaacgatcgtggaactctggtcatgagtgggtcactgattttaaaggaaaaacagtatggttcgtgccaagtatcaaggcagggaatgacattgccgcttgtttacggaaaaatgggaagaaagtgatacaactcagccgcaagacattcgattcggaatatgtaaaaactagggcaaatgactgggatttcgtagtaactaccgatatatcagaaatgggggcaaactttaaagctgaacgtgtaatagatccaagaagatgtatgaaacccgtgattttaactgacggagaagaaagggtaattctggctggacctatgcctgtaactcacagttccgcagcacaacgaagaggaaggatagggagaaacccaaagaacgaaaatgaccaatatatctacatgggagagccccttgaaaacgacgaagattgcgctcattggaaagaggcaaaaatgttgttggacaacattaatactccggagggtatcataccaagtatgtttgaaccggaacgtgagaaagtagatgcaatagatggcgaataccgtttaagaggagaagcccgaaaaacattcgtagatctgatgagaaggggagatctgccagtatggcttgcttataaggtggctgcagaaggtataaattatgccgacagaaaatggtgttttgacggaatcaaaaacaatcaaatcctggaagaaaatatggaagtagagatctggacgaaagaaggtgagcgaaagaaattgaaaccgaggtggctggatgcacgtatctactcagatccgctagctttaaaagaatttaaagagttcgccgccggacgaaaaagcctaacacttaacctcataaccgaaatgggcagattaccgacgttcatgacacagaaggcaaggaatgccttagataatcttgcagttctgcatactgctgaagcgggtggtcgagcctataatcatgcattatcagaactgccagaaacactagaaacacttttattactgacactcctggcaaccgttacaggaggaatatttttattcctcatgagcggaaaaggtataggaaaaatgaccttagggatgtgctgcataataactgcttcaatattgctgtggtacgcacaaattcaaccgcattggatagcggctagcataatattagaatttttcctaatagtgttattaataccagagcccgaaaaacagagaacacctcaagataatcaacttacgtacgttgtcatcgcaatattgactgtagtagctgcaacaatggcaaatgaaatgggttttctagagaagaccaaaaaggacctcgggttaggttctataacgacacaagaaagcgaatcaaatattctggatatagatttaagaccagcaagtgcttggacactttacgcagtagcaacaacttttgtaacacctatgttgcggcattcaatagaaaattcttcagtgaatgtctccctgacagccatagcaaatcaagctacggtactgatgggattaggcaaagggtggccattatcgaaaatggacatcggggttcccctactagcgatcggttgttacagccaggtaaatcctataactctaacggcggcgttgttattattggttgctcactatgccattattggacccggattacaagcaaaagccacaagggaagctcagaaacgagcagcagctggaataatgaaaaatcctacagtggatgggatcacggtgattgacttggaacctataccttacgatcctaagttcgaaaagcaattgggtcaagtaatgcttctgattttatgtgttacacaagtgttaatgatgagaacaacctgggcactttgtgaagcactaacattagcaacaggaccaataagcacactttgggaaggaaacccaggcagattctggaatactacaattgctgtgtctatggcaaacatattccgaggctcatatcttgcaggagctggattattattctcaataatgaagaacaccacatcaacacgaagagggacaggaaatataggtgaaacactcggagaaaagtggaagtcgagattaaacgcccttggtaaaagcgaatttcagatctataagaaaagcggcattcaagaagtagaccgtaccttagcaaaagaaggaatcaaacgaggagagacggatcaccacgcggtgagtaggggttcagccaaattacgatggtttgtagaaagaaatatggtaacaccggaaggaaaagtagtggacctaggatgtggcagaggagggtggagctattactgcggaggactgaaaaatgttagagaagttaaagggctcactaagggtggccccggacatgaagaaccaatccccatgtccacatacggctggaatttggttagacttcagtctggggtagatgtattctttacgcccccagaaaaatgcgacactttattgtgcgatattggtgaatcgtcacccaacccaacaatagaagcagggcgaactctacgcgtgctaaatttagtagaaaactggttaaataacaacacgcaattttgtataaaagtactcaacccgtatatgcctagcgttattgagaaaatggaagctctacaacgacagtatggtggggccttagtgcgaaacccgctcagtagaaattccacacatgagatgtattgggtttcaaatgcaacaggaaacattgtgtcatctgtaaatatgataagcagaatgctaatcaataggtttacaatgaaacataagaaagccacgtatgagccggatgttgacttgggctcaggaacccggaatatcggaatagaaaatgaaattcccaacttagatattattggtaaacgcatcgagaaaattaaacaggaacacgaaatcagttggcattacgaccaggatcatccatacaaaacatgggcctatcatggcagttacgaaaccaaacagactggaagcgcatcaagcatggttaacggtgtcgtccgactacttacaaagccgtgggacgtggtaccaatggtaacacaaatggctatgacagatacaacaccttttgggcaacaaagggtctttaaagaaaaagtagatactcgaacgcaggaacccaaagaaggtactaagaaattaatgaaaataacagcggaatggttgtggaaagaactggggaaaaagaaaactccaagaatgtgtactcgagaggagttcactaagaaagttagatctaacgcagcgttaggagcaatatttacagatgagaataaatggaaaagcgcaagagaagccgtcgaggacggaagattctgggaattagtggatcgtgaacgaaatctacatctagaaggaaaatgtgaaacgtgcgtttataatatgatgggtaaaagggaaaagaaacttggagagtttgggaaagccaaaggaagtcgtgcgatatggtatatgtggctcggtgcacggttcttagaatttgaagcacttggatttctaaatgaagatcactggtttagtcgtggaaattcactgtcaggtgtggaaggagaagggctacatagacttggttacatcttaagggatgtcggtaagaaagaaggaggggcaatgtatgctgatgacaccgccggctgggatacaagaataacgttagaagatctgaaaaacgaggagatggtgactaaccatatgaaaggagaacacaaaaagctagcggaagccatctttaaactaacataccaaaataaagttgtccgagtgcaaagaccaaccccacgtggaacagtaatggacatcataagtcgccgagatcagcgaggtagcggtcaagtcggtacatacggactaaatacattcactaatatggaggcccaactaataagacaaatggaaggtgaaggtatattcaaatcgatacagcacctaacagcaaccgaggaaatagcggtccaaaattggttagcaagggtcggaagagagaggctttctagaatggctataagcggtgatgattgtgtagttaagccaatagatgacagatttgcgtccgctctaacagcgttaaacgacatgggcaaagtacggaaggatatacagcaatgggaaccgtcaagaggatggaatgactggacgcaggtccctttctgttcccatcattttcacgaattagttatgaaagatggccgagttctagtagtgccatgccgaaaccaagacgaacttattggtcgagcaaggatcagccaaggcgcaggatggtcattaaaagaaacagcctgcctgggtaaatcttatgcacaaatgtggaccctaatgtacttccatagacgagatttacggcttgcggctaacgcaatctgttctgcagtaccttcacattgggtccccacttcaaggaccacgtggtccattcatgccaaacatgaatggatgacaacagaggatatgctggcggtatggaatagagtctggattcaagaaaatccttggatggaagataaaacacctgtagaatcatgggaagaagtcccatacttaggaaaacgcgaagatcaatggtgtgggagtctgataggacttacgagtcgggccacatgggctaagaacatacagacagcaataaaccaggtaagaagtcttataggtaatgaagaatacacagattacatgccgtccatgaaacgattcaggcgagaggaggaagaagccggagtcctatggtaa

SEQ ID NO: 22389 - RNA, 9876 nt, synthetic construct
  misc_feature 1..9876: note = derived and/or modified CDS sequence (opt6) from DENV-2__FJ882593__SS-prME
  source 1..9876: mol_type = other RNA
acagctggagttatagtaatgttaataccgaccgcaatggcattccacctgaccacacgaaacggtgaacctcatatgattgtagggagacaagaaaaagggaaatcattactcttcaaaacggaagatggcgtgaatatgtgtacattgatggctatagatctaggcgaattatgcgaagacactataacatacaaatgtccgctactacggcaaaacgaacccgaagacattgactgttggtgcaactcaacaagcacatgggtgacgtatggaacttgtactactaccggcgaacatcgacgggaaaaacgcagtgtggcacttgtaccccatgtagggatgggactagaaacaaggacggaaacttggatgagtagtgaaggagcgtggaaacacgtccaaagaatagaaacatggattctaagacaccccggctttacgataatggcagcaatattagcatacaccatcggtacaacgcatttccagagagcattaatatttatactcctaacagctgtagctccctctatgacgatgagatgcataggaattagtaatcgagattttgttgaaggagtaagtggcggctcatgggtagatattgtgctagaacatggcagttgcgttacaacaatggccaaaaataaaccaacattagactttgaacttatcaaaacagaagcaaaacagccagcaacattaagaaaatactgtatagaagcaaaacttaccaacaccacaacagaatctagatgcccaacacaaggcgaacccagtttaaacgaagaacaagataaaagattcatatgtaaacattcgatggtagaccgaggttggggaaacggttgcggattattcggaaaaggagggatagtcacttgtgcaatgtttacgtgtaagaaaaatatggaaggtaaagtagtgcaacccgaaaatttagaatacaccattgtgataacccctcactctggcgaagaacacgcggtagggaacgacaccggcaaacatggaaaagaaataaaaataacaccacagagttcgattactgaagcggaactaaccgggtatggtacggtgacaatggagtgcagcccacgtacaggattagatttcaatgagatggtattgcttcaaatggaggataaagcgtggctagtgcataggcaatggttcctagatctaccacttccgtggttaccaggagctgacacacaggaaagtaattggatacaaaaagagacacttgtaacttttaaaaacccacacgccaagaaacaggatgtagttgtcttgggatcacaagaaggagcaatgcacacagctctcacaggagcaactgaaattcaaatgtcctcaggcaatctcttgttcactggtcatctaaaatgccgcttacgaatggacaaactacagctgaagggtatgagttattctatgtgtaccggtaagtttaaaattgtaaaagaaattgcagaaacccagcatggtacaattgtaatccgagtacagtatgaaggcgatggtagcccgtgtaaaattcccttcgaaataacagatttagagaaaagacatgtcctcgggagattgattactgtgaatcctattgtcacagaaaaagatagtccagtgaacattgaggctgaacctccattcggagattcctatatcatcataggtgtcgaaccaggtcaacttaaactaaactggtttaagaagggatcgagcattgggcaaatgttcgaaacaacgatgcggggtgccaaaaggatggctatcctaggtgatacagcttgggatttcggctcactaggtggagtcttcacgtctataggaaaagcacttcaccaagtctttggcgcgatttatggggcagcgttttcgggtgtatcatggactatgaaaattttgataggcgtaataataacatggattggaatgaatagtcgtagcacgagtctaagtgtctctttggtattggtaggtgtggtgacgctgtacctaggagctgtcgttcaagcagacagcggatgtgtggtgagttggaaaaataaagaactaaaatgtggatcaggaatatttataacggacaacgtccatacttggacagaacaatataaatttcaaccagagagcccaagcaaactagcatcggcaattcaaaaagcacatgaagagggaatctgtggtattcgtagtgttacacgacttgaaaatctgatgtggaaacaaatcacaccggagcttaatcatattctgagcgaaaatgaagtgaaactaacaataatgacaggcgacataaaagggatcatgcaagcgggtaagagaagtctacgacctcagccgacagaattaaaatattcctggaagacttgggggaaggcaaaaatgttatcaacagaaagccacaatcaaacgtttttgatagatggaccggaaacagcagagtgccccaacactaatcgtgcttggaactcattagaagtggaagactatggattcggagtatttacaacaaatatatggctaaaacttcgagagaaacaggatgttttctgtgattccaagttaatgtctgccgcaattaaagacaacagggcagtacatgcggatatgggctactggatagaaagcgcgttaaacgatacctggaagatggaaaaggctagtttcatagaagtcaaaagttgtcattggcctaagtcccataccttatggtctaacggtgtactcgagtccgaaatgataatacccaaaaactttgcgggaccagtcagtcagcataattatcgaccaggttaccatacacaaacagctggaccttggcacttgggaaaactcgaaatggactttgatttttgtgaaggaacaaccgtggtcgtcaccgaagactgcggcaataggggaccgtcattgcggacaactacagccagtgggaagttaatcacggaatggtgttgtaggtcctgcactcttcctcctctacgttatagaggggaagacggatgctggtatgggatggagattaggccgttaaaagagaaagaagaaaacttagtaaattctctagttacggctggacacggacaaatagataatttttcattaggcgtattaggaatggcgttgtttttggaagaaatgttaagaacccgcattggaactaaacacgcgatattactcgtagccgtttcttttgtaaccttaataacgggaaacatgagcttcagagacctaggccgagtgatggttatggttggggcaacaatgacggatgatatagggatgggggttacgtatcttgcattactagcagcctttaaagttcgtccaacgttcgcagcaggacttctgttgaggaagctcaccagcaaagaactcatgatggctacaataggcatagctctactttctcaatcgacgataccagaaacaatattagagctaacggatgcattagctctaggtatgatggtattaaagatcgtgcgcaacatggaaaaatatcaattagccgtaaccataatggccataagttgcgtgcctaatgcagtcatacttcaaaatgcttggaaagtgagttgtacaatcctggcagccgtgagtgtcagcccgttattattaacctcttcacaacaaaaagcagattggatcccattagccctcacgatcaaagggctcaaccccactgcaatcttcctaacgacactaagcagaaccagcaagaaaagaagttggccgttaaacgaagctataatggcagttgggatggtttcaatattagcatcgagtctattaaagaacgatataccaatgactggacctctggttgcaggagggttgctcacagtatgttatgttttaacagggcgatcagcagacttagaattggaaagggccgcagacgtaaaatgggaggatcaggctgaaatatctggcagctcaccgatcttgtcaattacgatatctgaagatggctccatgagcatcaaaaatgaagaagaagaacaaactctcactattttaatccgtacaggacttctagttataagtggagtattccctgtatcaattccgattactgctgcagcatggtacctttgggaggtcaagaaacagagagccggcgtgctctgggacgtaccctctccaccacccgttgagaaagcggagctagaggatggagcatatcgaattaagcaaaggggcatactaggatatagccaaattggggcgggcgtatataaagaaggaactttccatacaatgtggcatgttaccagaggtgcagttctaatgcatagaggaaaaagaatagaacctagttgggcagatgtcaaaaaggatttaatatcttatggcggaggatggaaattagaaggagagtggaaagaaggcgaggaggtacaagtattagcactagagccaggcaaaaatccgagagccgtgcaaacgaaacctggcattttcaagacaaatactggtacgataggtgcagtttcactcgatttttctccagggacctcaggaagtcctatcgtggatcgtaaaggcaaagttgttggcctctacgggaatggagtcgtaacccgttcaggagcgtacgtatcagcaatagcgcaaacagaaaagagtattgaagacaatcctgaaattgaagatgacatcttcagaaagaaacgcctaactatcatggatctacatccaggcgcgggcaaaaccaaaagatatctaccagcaattgtgcgtgaggctataaaaaggggattgcgaacactaatattagccccgaccagagtagtagcagctgaaatggaagaagcacttagaggcctacccataagataccaaacaccagcaataaaaaccgagcataccggaagagaaatagttgacttaatgtgtcatgcaacgttcacgatgcgtttactatctccagtacgagtgccaaattacaacctgataataatggatgaagctcatttcacggatccagcatccattgcagcaagaggatatatatccacgcgagttgaaatgggcgaagcagcaggtatattcatgacagcaacaccgcctggatcccgagatccttttccgcagagtaacgcaccaattatggacgaagaacgtgaaatccctgaaaggtcgtggaactcaggacacgaatgggttactgattttaagggtaaaacagtatggttcgtgccttcaataaaagctggaaatgatatagcagcttgtttaaggaaaaacgggaagaaagtaattcaactgagtaggaagacgttcgactccgagtatgtaaaaactcgagcaaacgactgggatttcgttgttactactgacataagcgagatgggtgctaatttcaaagcagagcgagtaattgatcctaggcgatgtatgaaaccggtgattctaacagatggagaagaacgggtgatcctggcggggccaatgccggtaacacactcgtcagcggcacaaagaagggggcgaatcgggagaaatcccaaaaatgaaaatgatcaatacatttatatgggagaaccgctagaaaatgatgaagattgtgcacattggaaagaagccaagatgttacttgacaacataaatacgccggaaggcatcataccatcaatgtttgagccagaaagagaaaaggtggatgccatagacggagaatacagattgagaggtgaagcgcgaaagacctttgtcgatctaatgagacgcggagatcttccagtatggctagcttataaagtggctgccgaaggaatcaactatgcagatcgaaaatggtgttttgatggtatcaaaaataaccaaattctagaggaaaacatggaagtagaaatctggaccaaagaaggagaaaggaaaaagctaaagccaagatggttagacgcgagaatatattctgatccattggcactaaaagagttcaaagaatttgctgctggaagaaaatctctaaccttgaacctgatcacagaaatgggccgtttacccacgttcatgacccagaaagctagaaacgctctagataatctagcagtattacatacagcagaagcaggagggagagcatacaatcacgctttatcagagttgcccgaaactttagaaaccctacttctcttgacattactcgcaacagttacaggtggtatattcttgtttctaatgtccggtaaaggtataggtaaaatgactctcggaatgtgttgtattattacagcatctatattactttggtacgcacagatccagcctcactggattgccgcttctattatactggagttctttttaatagtattattaattccagaacccgaaaaacagaggactccacaagataaccagctaacatacgttgtaattgctatattaactgtcgtagcagcaactatggccaatgagatgggatttttagagaaaacaaagaaggatctaggtttaggaagcataaccactcaggaaagtgagtcaaatatacttgatattgatctacgcccggcatctgcatggacactatatgccgtagcgactactttcgtaactccgatgttaagacactccattgaaaatagcagtgttaacgtctcgttgacagcaatagccaatcaagcaactgtgcttatgggactcggtaagggctggccgctctccaaaatggacataggagttccacttttggcaattggttgctattcacaagtaaatcccattacactaacggctgctttactactactggttgctcattatgctattataggtccaggtttacaggcaaaggcaacacgagaagctcagaagcgagcagccgcaggaataatgaaaaatcctactgtagacggcattacagtcattgatctggaaccaataccctacgaccccaaatttgaaaaacaactaggacaagtaatgctactaatattatgtgtcacacaagttctaatgatgcgcacgacatgggctttatgtgaggccttgaccttagccaccggacccatatcaacgctctgggaagggaacccaggtagattctggaatacaaccatagccgtaagcatggccaatatctttcgaggttcttatttagctggtgcaggtcttctcttttcaattatgaaaaatactactagcacgcgtcgaggcacaggtaatataggcgaaacacttggcgaaaaatggaaaagcagactaaatgcgttgggaaagtccgagttccaaatctataagaaatcaggtatccaggaggtggatagaacattagcaaaagaaggtattaaacgaggagaaacagaccatcacgcagttagtcgaggaagtgctaaactcagatggttcgtagaacgaaatatggttactccagaaggaaaagttgttgacttgggttgtggaagaggaggttggtcttattactgcggaggattgaaaaacgtaagagaagtaaagggcctaacgaagggaggaccaggtcatgaagaaccgataccgatgagcacatacggatggaacttagtaaggttacaaagcggtgtagatgtgtttttcacacctcctgaaaaatgtgacactctactgtgtgacattggagaatcatcaccgaatccgacaatagaagcaggacgaacattacgggttttgaatttggtcgaaaactggttaaacaataacactcaattctgtataaaagttttgaatccctatatgccatccgtaatagagaaaatggaggctttgcagcgtcagtatggtggagcactcgtacgaaatccactctctcgaaattcaacacacgaaatgtactgggtgtctaacgctacagggaatatagtatcatcagtaaatatgatttcacgaatgcttataaataggttcactatgaaacacaagaaagcaacgtacgaaccagatgtcgatttgggatcaggaacacgtaacataggaatcgaatctgaaatccccaatttagatataattggcaaaagaatagagaaaataaagcaagagcacgaaatatcctggcattatgatcaggatcatccttataagacatgggcttatcacggatcctatgaaacaaagcaaactggtagcgccagttcaatggtaaatggcgtagtcagattattgaccaagccctgggatgtcgtccctatggtaacacaaatggctatgacagacacaaccccttttggccaacaaagggtttttaaagaaaaagttgacacaaggacacaagaaccgaaagagggcacaaagaaactcatgaaaataaccgctgaatggttatggaaagaattaggaaagaagaagacacccagaatgtgtactcgtgaggagttcactaagaaagtcaggagcaatgctgcattaggtgcaattttcacagatgaaaacaagtggaaaagtgcccgcgaagctgttgaggacggaaggttctgggaattagtagatcgggaaagaaatttacatctcgaaggcaaatgcgaaacatgtgtatataatatgatgggcaaaagagagaagaaactaggtgaatttggaaaagcaaaaggatctagggcgatatggtacatgtggttgggagcaagatttttagagttcgaagccttagggttccttaacgaagaccactggttttcacgaggaaactcgctgagcggagtcgaaggcgagggactgcaccgtctaggttatatactccgcgatgtcggcaaaaaggaaggaggagcaatgtatgcagatgatacggcaggttgggatacaaggatcaccttggaagatctgaaaaacgaagagatggtaaccaatcacatgaaaggagagcataaaaagttagcagaagcaatattcaagttaacataccaaaataaggttgtacgtgtacaaagaccaacaccgcgtgggacagtcatggacatcatatcacgaagagaccaaaggggatctggccaagtaggtacttacggcttaaacacattcactaatatggaggcccaattaatacgtcaaatggaaggtgagggaatctttaaaagtattcaacatcttacggcgacagaagagatagcagtgcaaaattggctcgcacgagtgggaagggagagactaagtaggatggctatatcaggggatgactgtgtcgtgaaacccatagatgatagattcgccagtgcgttaaccgcgcttaacgatatgggtaaagtaagaaaagacattcaacaatgggagccatctagaggttggaatgattggacacaagtacccttctgctcgcaccacttccatgagctggttatgaaggacggtcgagttttagttgtgccatgtcgcaaccaagacgagttaataggtagggcgcgaatcagtcaaggagccggttggtcccttaaagagacggcttgcctaggaaaaagctatgcacaaatgtggacactaatgtattttcacagaagagacttgcgactggctgcgaacgcaatttgttcggcggtcccaagccattgggtacccacaagcagaacaacatggtccatacacgcaaagcatgaatggatgacaacagaagatatgttggctgtctggaatcgagtgtggatacaggagaatccatggatggaagataaaacaccagttgaatcatgggaagaagttccatacctaggtaaaagagaagatcaatggtgcggctcacttattgggctgacttcccgtgcgacatgggcaaagaatatacagacagcaatcaaccaagtacgatcattaataggtaacgaagagtatactgattatatgccaagcatgaaaagatttagacgagaagaagaagaagcaggcgtcctatggtaa

SEQ ID NO: 22390 - RNA, 9876 nt, synthetic construct
  misc_feature 1..9876: note = derived and/or modified CDS sequence (opt6) from DENV-2__FJ182014__SS-prME
  source 1..9876: mol_type = other RNA
actgcgggggtaatagttatgttaataccaacggcaatggcatttcacttaacgaccagaaatggggaacctcatatgattgtagggagacaagaaaaaggtaaaagtctactgttcaaaacagaagatggggtaaatatgtgtacccttatggcgatagatctgggagaattatgcgaagacacaataacttataaatgtccattcttgcgccaaaatgaaccggaagacatcgattgttggtgtaactcaacaagtacatgggttacatatggaacgtgtacgactacgggtgaacatagaagagagaaaagatcagtcgctttagtcccgcatgtaggaatgggattagaaacgagaacagaaacatggatgtccagtgaaggcgcgtggaaacatgttcaacgcatcgaaacgtggatccttagacatcctgggtttactattatggccgcgatattagcatacacaattggcacgacacactttcaaagagctctcatatttatattgttaacagctgtagcaccatcaatgacaatgcgatgtataggtatatccaatagggactttgtagaaggggtctcaggaggcagctgggtagatatcgttttagaacacggatcatgcgtaacaacgatggctaaaaacaaacccacccttgattttgaactcataaaaaccgaagctaaacaaccagcaacactacgaaaatattgcattgaagccaaattgaccaacaccacaaccgaatcaagatgtccaacgcaaggagaaccctccctaaacgaagaacaagataaaaggttcatctgtaaacactcaatggtagatcgaggttggggcaacggttgtggtttatttggtaaagggggtattgtaacttgcgcgatgtttacgtgcaagaaaaatatggaaggaaaagttgtccagcctgaaaacttagaatatacaatcgtcattactccacattcaggcgaagaacatgcagtagggaacgacacaggaaaacatggtaaagaaataaaaatcactccgcagagctcaattacggaagctgaactaaccggatatggaactgttacgatggaatgcagtcctcgaactggcttagacttcaatgaaatggtcttattacaaatggaagataaagcctggttagtacaccgacagtggtttttggatttgccattaccttggttacctggtgcagatactcaaggctccaattggatacagaaagaaaccctagtaacattcaaaaatccacacgccaagaaacaggacgtggtcgttcttggaagccaggaaggagccatgcacactgcattaacaggggcaacagaaattcaaatgagcagcggtaatcttctttttactggacatctaaaatgccgtttacgcatggacaaattacaactaaaaggaatgtcttacagtatgtgtactggaaaatttaaaatagtaaaagaaatagccgaaacgcaacacggaacgattgttattcgcgtacaatatgaaggagatggcagcccttgtaaaatccctttcgaaattacagaccttgagaaacgtcacgttttaggaagacttataaccgtaaatcctatagtaaccgaaaaagatagcccagtcaacatagaagctgagccgccattcggagacagttacattattattggagtggaaccgggacaactaaaactaaactggtttaagaaaggtagttcgattggacaaatgtttgagacaacaatgagaggagcaaaacgtatggcaatacttggcgatacagcatgggattttggttctctaggaggggttttcacaagcataggaaaagcattgcaccaagtgtttggggcgatctatggtgctgcattcagtggcgtgtcatggaccatgaaaatacttattggggtcataatcacctggataggaatgaactcacgatcaacatcactttcggtatctttagttttagtgggcgttgtaacattatatttgggagcagttgtgcaggcagacagcggttgtgtagtgagctggaaaaacaaagaattaaaatgcggatccggtatttttataacggataatgtacatacatggacagagcaatataaatttcagccggaatctccttcgaaactagcatcggctatccaaaaagcacacgaagaaggaatatgtggaatacgatccgtcacgagattagagaatctgatgtggaaacaaatcacccctgaattaaatcatatattaagtgaaaacgaagttaaactgacaataatgacaggtgatataaaaggcattatgcaggcgggtaaaagaagccttcggccacaaccaaccgaattaaaatattcgtggaaaacttggggcaaagcaaaaatgttatctacggaatcgcacaatcagacttttctaatcgacgggccggaaactgctgagtgcccgaacacaaacagagcatggaactcattagaagtggaagactatgggtttggcgttttcacgaccaatatttggctaaaactccgtgagaaacaagacgtattttgtgattcgaaattaatgagcgcggctataaaagacaacagagcagttcatgcagatatgggatactggatagaaagtgcactaaatgacacctggaaaatggaaaaggcttctttcattgaagtaaagtcatgtcattggcccaaatcgcatactctatggtctaatggggtattagagtcagagatgatcataccaaagaattttgcaggtccagtatcccaacataactaccgtccaggataccatacgcaaacagcaggcccttggcatctcggaaaacttgaaatggattttgatttttgtgagggcacaacagttgtagtaaccgaagactgcggaaatagaggaccgtcactaaggacaacaacagcaagtggtaagttgatcaccgagtggtgctgccgtagttgtacactgcctccgcttcgttatcgaggtgaggacggttgttggtacggtatggaaatcaggcccttaaaggaaaaagaagaaaacctggtgaacagtttagtaactgcaggccatggacaaatagataacttttcattgggagtcttgggcatggcgttgttcctagaagagatgctgagaacacgaataggaacaaaacatgctatacttttagttgccgtgagctttgtaacgttaataactggaaatatgtcattcagagatctaggacgggtaatggttatggtcggtgctacaatgactgatgatattggcatgggtgtaacttatctggcattactagccgctttcaaagtgagaccgacttttgcagcaggactattgttaaggaaactgaccagtaaagagttaatgatggccacaataggcatcgcactcctttctcagtcaacaatccctgaaaccattctcgaacttacagacgcccttgcacttggaatgatggtcttgaaaatagtccgaaacatggaaaaatatcagctggcagttaccataatggctatatcatgcgtaccaaatgctgtaatattacagaatgcctggaaggtatcttgtactatattagcagccgtgagtgtaagtccattactattgacttcttctcagcagaaagcggactggataccgctagctcttacgattaaaggcttgaacccaactgcgatcttcctcactacgctaagcagaaccagtaagaaaagaagttggccgttaaatgaagccatcatggctgttggcatggtttcaatcttggccagttccctgctgaaaaatgacatcccgatgactggtccgctagttgctggaggacttttaacggtctgctacgttttaacaggtcgttcggcagatcttgagttagagagggctgcagatgtcaagtgggaagatcaggctgagatctcaggatcatcgccaatattatcgataattatatcggaagacgggagcatgtcaattaagaatgaggaagaggaacaaacattaacgatactaataagaacaggtctcttagtaatcagtggagtctttccagtttctatcccaataacggctgcagcatggtacctctgggaagtcaagaaacagagagcgggggttttatgggatgtaccgtctcctccaccagtagaaaaagctgaactagaagatggagcctatagaataaagcaacgaggaatattaggatattcacaaataggagcaggagtatataaagaaggaaccttccatactatgtggcatgttaccagaggggctgttttaatgcatcgagggaaaagaattgaaccttcctgggccgatgtcaagaaagacctcatttcatacggtggaggttggaagttagagggtgaatggaaagaaggtgaggaagttcaggtcctggctttagaacctggcaaaaatccaagagcagtccaaacgaaaccaggaatatttaaaacaaacactggaacaataggcgcagtgagcctagacttttcaccaggcacgagcggatccccgatagtggatcgcaaggggaaagtcgttggattatatggaaatggcgtcgttactagatcaggagcatatgtgtcggcaattgcgcaaacggagaaaagtatagaggataacccagaaatagaagacgacatctttcgcaagaaacgtctaaccataatggacctgcacccaggtgcgggaaagactaaaagatacctgcctgcgatcgttagagaagccattaaacgaggattgagaacattaatcctggctcctactcgggttgttgctgcggaaatggaagaagcgctacgaggactaccgattcgataccagacacccgctattaagacagaacataccgggagagaaatagtggatcttatgtgccatgctacctttacgatgagacttctcagtcctgtgcgagtaccaaattacaatctaattataatggacgaagcacatttcacagatcctgcatcgatagccgctcgagggtacataagtacgagagttgaaatgggagaagccgcaggcatctttatgacagcaacgccaccaggctctcgagacccgtttccccaaagcaacgcgccaattatggatgaagaacgagaaataccggagcgcagttggaacagtgggcatgaatgggtgaccgactttaaaggcaaaaccgtttggttcgttccatctataaaagctggcaacgatatagccgcatgtttacgtaaaaacggcaagaaagtaattcaattaagtcgtaaaacatttgatagtgagtacgtcaagactcgagcaaatgattgggatttcgttgtaaccactgacattagtgaaatgggggctaactttaaagcagaacgagtgatagacccaaggcggtgtatgaaaccagtaattctgacagacggggaagaacgggtgattctggctggtccaatgcccgtaacacatagttccgccgcacaaagaaggggtcgaattggaagaaaccccaaaaatgaaaacgaccagtacatatatatgggagaacctttagaaaatgatgaagactgcgcacactggaaagaagcaaaaatgttgttagataacatcaacacgccagaaggtattatcccaagcatgtttgagccggaaagagaaaaagttgacgcgatagatggcgaatatagattgcgaggagaggctcgaaagacgtttgtcgacttaatgagaagaggagacctaccagtatggctcgcgtataaggtagccgctgaggggataaactatgcggacagaaagtggtgcttcgatggtataaagaacaaccaaatcctagaagagaatatggaagtggaaatctggaccaaagaaggggagcgaaagaaattaaaaccgaggtggcttgacgctcggatttatagcgatcctctagcacttaaagagttcaaagaatttgcagccggccgcaaaagtcttacactaaacttaataacagagatgggcaggcttcctacgtttatgacacaaaaagcaagaaacgcattggataacctcgcggttttacacactgcggaagctggtggtagagcatataaccatgcattatcagaactcccggagactctcgaaacgctactgttattaacattgttagccacagttacgggaggaatatttttgtttctgatgtccggaaaaggtatagggaaaatgaccctaggaatgtgctgtattatcaccgcttctatacttctatggtatgctcaaattcaaccccattggattgccgcatcaattatacttgaatttttcttgatagtgttactaatccccgaacccgagaaacagcgtacaccacaggacaaccaactaacctatgtcgtgatagcaatactaaccgtggtagcagcaactatggctaatgaaatgggttttctagagaaaaccaagaaagacctaggattgggaagtataactactcaagaaagtgaatccaacatcttagatatcgatttacgacctgcctcagcttggacactctatgctgtcgccacaacttttgttacacctatgctgcggcacagcattgaaaacagcagtgtaaatgttagcctaaccgccattgccaaccaagccaccgtactaatgggcctcggcaaaggatggcccttatcaaaaatggacataggtgtacccttgttggcaataggatgctactcacaagttaaccctataactcttacagcagcattacttcttttggtggcacattatgcaatcattgggcctggattgcaggcgaaagctacacgggaagcacagaagagagctgcagcaggcatcatgaaaaatccaaccgtggatggaattaccgtgattgatttagaaccgataccttacgatcctaaatttgaaaaacagctaggacaggtaatgctattaatactctgtgtaacacaggtgttaatgatgagaaccacttgggcactatgtgaagctctcactttagcaactggtcctatttctactctatgggaaggtaatcctggaagattctggaatactacaatagctgtatccatggcaaacatttttcgaggaagctacctcgcgggagcaggattgcttttctctataatgaagaatactacatcgacccgaaggggtacgggcaatataggagaaactcttggagaaaaatggaaatcacgattaaatgctttgggaaaatccgagttccagatatataagaaatccggcattcaggaagtcgacagaactctagctaaggaaggtattaagcgtggagaaacggaccatcacgctgtctctcgtggaagcgccaaattacggtggtttgtagagcgcaatatggtaacaccggaaggtaaggttgttgaccttggatgcggacgaggaggctggagttattattgtgggggtttgaaaaatgtaagggaagtaaaaggtttaacaaaaggcggaccaggacatgaagaacccatccccatgtccacatacggatggaatctagtgcgacttcaaagtggcgttgatgtattctttactccaccagaaaaatgtgacacgctactatgcgatatcggtgaatccagcccaaatcctactattgaggccggtcgaaccctgagagtattgaacctggttgaaaactggcttaacaacaacactcaattttgtataaaggttctaaatccctatatgccctctgttattgaaaagatggaagcgcttcaaagacagtacggaggcgctttagtaaggaatccgctatcaagaaactcaacccatgaaatgtactgggtctcaaacgcgacaggtaatattgtaagttcagtaaatatgatttctcgaatgttaataaaccgattcactatgaaacataagaaagccacatatgaacctgatgttgacttgggatccggaacaaggaatataggcattgaatcagagataccaaacctagatatcataggcaagaggatagagaagataaaacaggaacatgaaataagttggcattatgatcaagaccacccatataagacatgggcataccatgggtcttacgaaactaagcagacaggttccgcatcaagtatggtaaacggagtggtgcggttgctaacaaaaccatgggacgttgtcccaatggtaactcagatggcaatgactgatactacgcccttcggacaacagagagtctttaaagaaaaagtagatacgagaactcaagaacctaaggagggtactaagaaactaatgaagataacagcggaatggctgtggaaagaactaggcaagaagaaaaccccaagaatgtgcactagggaagaatttaccaagaaagtaaggtcaaacgcggcactaggcgcaatctttactgacgaaaataaatggaaaagtgcaagggaagcagttgaggacggaaggttttgggagctagtagacagagaacggaatttacatttagaaggaaaatgcgaaacatgcgtctataatatgatgggaaaacgtgagaagaaactaggcgagttcgggaaggctaagggttcccgtgccatatggtacatgtggttaggggccaggtttctggaatttgaggcactaggcttcctcaacgaggaccactggttctctaggggaaattctctatctggtgtggaaggtgagggtttacataggctaggatatattctaagggatgtcggcaagaaagagggcggagcgatgtatgctgacgataccgcaggatgggacactcgtataaccttagaagatttgaaaaatgaagagatggttacaaaccatatgaaaggagaacataagaaactagcagaggctatattcaaattaacataccaaaacaaagtagtaagagtgcaacggcctactcctcgtggaactgtaatggacattatatcacgcagggaccagcgagggagcggccaggtgggcacgtatggtttaaatacttttacaaatatggaggctcaactaataagacaaatggaaggagagggtatatttaagtcaatacagcatctgactgcaaccgaagaaattgcagtacagaattggcttgcacgtgtaggaagagaacgcctttctagaatggcaataagtggtgacgattgcgtagtgaagcccatagatgatagattcgcatcagccttaacagcattaaatgacatgggaaaagtacgtaaggatattcaacaatgggaaccgagtcgagggtggaacgattggacacaagttcctttttgttcgcatcattttcacgaattagtaatgaaagatggaagagtgctcgtagtcccatgtagaaaccaggacgaattaataggacgtgcaagaatttcacaaggagctggatggtcgttaaaagaaaccgcttgtttgggaaaatcatatgcgcaaatgtggacgttaatgtattttcatcgacgagatttacgactagctgcgaacgcgatttgtagcgcagtcccatcacattgggtaccaacatccagaacaacatggtcaatacatgctaaacacgaatggatgactactgaagacatgttggcggtatggaacagggtctggatacaagaaaacccttggatggaggacaaaacgcccgtagaatcttgggaagaagtcccctatctaggaaaaagagaggaccagtggtgcggcagtttaataggcctcacaagccgagcaacttgggctaagaatatacaaacagctataaatcaagtacgatccttgatcggtaatgaagagtatacggattatatgcccagtatgaaacgattcagaagggaagaagaagaggctggtgttctttggtag

SEQ ID NO: 22391 - RNA, 9876 nt, synthetic construct
  misc_feature 1..9876: note = derived and/or modified CDS sequence (opt6) from DENV-2__FJ547090__SS-prME
  source 1..9876: mol_type = other RNA
actgcaggcgtgattgtcatgctaattcccacagcgatggcttttcatttaacaacacggaatggtgaaccacatatgatcgtgggacgccaagaaaaagggaaatccctattgtttaaaactgaagatggagtaaatatgtgcacattaatggctatcgatttaggggaactatgtgaagacacaataacgtacaaatgtccccttctgagacaaaacgaacctgaagatattgactgttggtgcaatagtacttcaacttgggtaacatatggaacatgtacgacaacaggtgaacataggcgtgagaaaagatccgtggccctagttccacacgtagggatgggactagaaactagaacagaaacttggatgtcttcagaaggtgcatggaaacacgtccaacgcatagaaacatggatattaagacatccggggtttacaatcatggctgctatattggcatacactattggaaccacacactttcaacgagcactcattttcattcttctcacagctgttgcaccgagtatgactatgcgttgtataggaatatcaaacagagactttgttgaaggcgtgtcgggtggatcctgggtagacatagtactagaacatgggtcctgtgttacaacgatggccaaaaataaaccaacattagacttcgaacttattaaaaccgaagcaaaacaacctgcaactttacgaaaatattgcatagaagctaaacttacaaatactactacggaaagtagatgccccacacagggggaaccgtcacttaatgaagaacaagacaaaagatttatttgtaaacatagtatggttgatcgaggatgggggaatggctgtggactgtttggaaaaggagggatagtaacgtgtgctatgttcacatgcaagaaaaatatggaaggaaaagtagtgcaaccggaaaacctagaatatacgatcgttataacaccacatagcggagaagaacacgcagtaggcaatgacacgggtaaacatggtaaagaaatcaaaataacacctcaaagttccattaccgaagccgaattaaccggctacggcactgtaactatggaatgctcaccgagaactgggttggatttcaatgaaatggtcttattgcagatggaagacaaggcttggctggtccatcggcaatggttcctggatctgccactgccctggctaccaggagccgatacacagggatccaactggatacagaaagaaaccctagtaacatttaaaaacccacatgccaagaaacaagatgtggttgttttaggctcccaggaaggagccatgcacaccgcacttaccggtgcgactgaaatccagatgagtagcgggaatctactattcacaggccatttgaaatgtaggctaagaatggataaactccaattaaaaggaatgtcctactcaatgtgtactggcaaatttaaaatagtaaaagaaatagcagaaacacagcacggcactatagtaatcagagtacaatatgaaggcgacgggagcccgtgtaaaataccgttcgaaatcacggacctagaaaaacgacatgtcctaggccgattaattacagttaatccaatagttaccgaaaaagattcaccagttaacattgaagctgaacctccttttggtgattcatacatcataatcggagttgaaccaggccaacttaaacttaattggttcaagaaaggaagcagtattgggcaaatgtttgaaactactatgagaggtgctaaacgaatggccatattgggagatacagcatgggattttggatccttaggaggggtattcacttccataggcaaagcactacatcaagtctttggggccatttatggtgcagctttttcaggcgtaagttggactatgaaaatattaattggtgtaatcattacttggattggaatgaacagcagaagcacttcgttaagtgtctcacttgttctagtgggtgtagtgaccttatacctaggtgctgtcgtccaggcagactcaggatgtgtagtgtcatggaagaataaggaactgaaatgcggttcaggcatttttattacggacaatgtacatacatggaccgaacagtataaatttcaaccagaatctccttctaaactagcgagtgccattcaaaaagcacacgaagaaggtatttgcggaattagaagcgtcacaagattagagaatttaatgtggaagcaaataaccccagaactaaaccatatcctcagcgagaatgaggtaaagctcacaataatgacaggagatataaaagggataatgcaagccggaaaacgaagtctgcgtccacaacccactgaactgaaatatagttggaaaacatggggaaaggcgaaaatgctaagtactgaaagccataatcaaacattcttgatcgatgggccagaaacagcagagtgcccgaacaccaatagagcgtggaacagtttagaagtggaagactatggatttggcgtgttcacaaccaacatatggttaaaactgcgcgaaaaacaggacgtattttgtgattctaagttaatgtcggcgacaattaaagataacagagccgtccatgcagacatgggatattggattgaaagcgccctgaatgacacgtggaaaatggaaaaagcatcttttatagaggtcaaatcatgtcattggcctaaatcacacactctgtggtcaaatggagttttagaaagtgaaatgataatacctaaaaattttgctggtcctgtatcacagcataattatagattgggttaccacactcagactgcaggcccttggcatttgggaaaacttgaaatggattttgacttttgtgaaggaaccacagttgtagttacagaagattgcgggaaccgaggacccagcttaaggactacaaccgcatcaggaaaactaatcacggagtggtgttgtagatcgtgcacattaccccctctaaggtacagaggagaggatggatgttggtatggtatggaaattcgaccactaaaagagaaagaagaaaatttagtgaactctcttgtgacagctgggcacggacaaattgataatttcagtctcggagtactcgggatggcattatttcttgaagagatgctaagaacgagaatagggacaaaacatgctatcttattagtcgcggtcagctttgtaactttaattactggaaatatgtcatttcgggatttaggacgagtaatggtcatggtaggggcaaccatgacagatgacattggaatgggtgtcacctacttagcgttactagcagcatttaaagtgaggccaacattcgcagcagggctattactaaggaaattaacttcaaaagaacttatgatggcaacgattgggatagcattattaagtcagtctaccatcccggagactatattagaactaacagacgcactcgcactaggtatgatggtgttaaaaatagttaggaatatggagaagtatcaattagcagtaactattatggctatttcttgcgtaccaaatgcggtcatactacaaaatgcgtggaaagtcagctgcactatattggcggcagtatccgtatcgccattattgcttacctcaagtcaacaaaaggccgattggattccactggcactaaccattaaaggacttaacccaactgcgatatttttaacaaccttaagccggaccagtaaaaagaggtcttggcctctgaacgaagcaataatggccgtgggcatggtaagtattcttgcctcatcattactgaagaatgatatccctatgactggtcctttagtagctggagggcttttgactgtatgctacgttctaactggacgctctgccgatctagagctcgagagagctgccgatgtaaaatgggaagatcaagcagagatatcaggctcatcccctattttgagtataacaatatcagaagacggttcaatgagtatcaaaaacgaagaagaagaacaaacccttactatcctcataaggactgggctattggtaatatcaggagtatttcctgtatcaatacccataacggcagcagcgtggtatttatgggaagtcaaaaagcaacgtgcaggagttttatgggacgtaccgagtccaccccctgtcgaaaaagcagagcttgaagacggagcataccgaataaaacagcgtggaatattgggatacagtcaaattggagccggtgtctacaaagaaggcacatttcacactatgtggcatgtaactcggggcgcagttttaatgcatagagggaaaagaatcgaaccctcatgggccgacgttaagaaagatctcatcagctacggaggtgggtggaaactagaaggagaatggaaagagggagaagaggttcaagtacttgcattagaaccaggaaagaacccacgagcagttcaaacgaaaccaggcatattcaagactaatacaggcactattggagctgttagtctcgacttcagcccgggaacaagtggttccccaatagtggatcgtaaaggcaaagttgtaggattatatggtaatggagtagtcactcgcagtggggcatatgtatcggcgattgcgcaaaccgagaaaagtattgaagataatcctgaaattgaggacgatatttttcgtaagaagaggctaaccataatggatctacatccaggtgctgggaaaactaaaagatatttaccggcgattgttcgcgaagctatcaaacgaggcttaagaacgttaatattagctccaacacgagttgtggcggctgaaatggaagaagccctgcgtggccttccgataagatatcagaccccggcaattaaaacagaacacacaggtagagaaattgttgacctgatgtgtcatgctacatttacgatgagattactttcacccgttagagtacctaattataatcttataataatggatgaagcccacttcaccgacccggcaagtatagcagcaaggggatatatttcgacgagagtagagatgggagaagcggctggtatattcatgaccgctacacctccgggtagtagagacccattcccacagtcaaatgccccaataatggacgaagaaagggagataccggagaggagttggaactctgggcacgaatgggtaactgattttaaaggcaagacggtatggtttgtaccatcaataaaagcaggcaatgacatagcagcttgcttgaggaaaaatgggaaaaaggttattcaactttccaggaaaacttttgactcagaatatgtgaaaacccgtgcaaacgattgggactttgttgtgactactgatatttccgaaatgggtgccaattttaaagcggaacgggtgatcgatccacgaagatgtatgaagcccgttattttaaccgacggcgaggagcgggttatattagctggacctatgccggtgacacacagcagtgcagctcaaaggcgcgggagaataggaagaaaccctaaaaatgagaatgaccagtatatttatatgggagagcccttagaaaacgacgaggattgtgcgcattggaaagaagccaaaatgttattagataacattaatacaccagaaggaattatcccaagcatgttcgaaccagaaagggaaaaagtagatgcaattgatggggagtatagactccgtggtgaagcgcgaaaaactttcgttgatttaatgagacgaggagacttgcccgtatggcttgcctataaagtagcggcggaaggaataaactatgcggataggaaatggtgcttcgatgggatcaaaaataaccaaatcctagaagaaaacatggaagtagaaatctggacaaaggaaggtgagcgcaagaaattaaaacccagatggttggatgctagaatttatagtgaccctctggccttgaaggagttcaaagaatttgctgcagggagaaagtctctgacactaaatttgatcacagagatgggtcgactccctacattcatgacacaaaaagccagaaatgcattagacaacctcgcagtgttacatacagctgaagcaggagggagggcatataatcatgcattgagtgagttaccagaaacacttgaaactttgttactcttaactttgctagccacagttacgggcggtatttttctattccttatgagtggaaaaggtattggaaaaatgactctcggaatgtgctgcataattacagcaagtatattgttatggtacgcacaaattcagccgcattggatagccgcttcaattatcctagagttctttctgatcgtccttttaattccagaaccagaaaagcaaaggactccacaggataatcagttgacttatgttgtaatcgcaatcttaacggttgtcgcagccacaatggcaaatgaaatgggatttttggagaaaacaaagaaagatttagggttagggtccataactacacaagaaagcgaaagcaacatactagacattgacctgcgacctgcgtcggcctggaccttatatgcagttgcgactacttttgtgacaccaatgctacgtcactcaatcgaaaatagctcggttaatgttagcctaacagcgatagcaaatcaggcaacagtactgatgggattagggaaaggttggccactttccaaaatggatataggggtacccttgctagcgattggttgttacagtcaggtgaatccgataactctcactgcagctctactgttattagtcgcgcattacgcgattataggtccgggcctacaggcaaaagctacccgagaagcgcagaaaagagctgcagcgggtataatgaaaaatccaacagtagatggcattactgttattgatctcgaaccaatcccatatgatccaaaattcgaaaaacagttaggacaagtaatgttgttaatcctatgcgtgacgcaagttctaatgatgagaacaacatgggccctatgtgaggcactcactttggcaactggaccgatatcaacattatgggaaggtaatccaggaaggttctggaacacaaccattgcagtatcaatggctaatatttttagggggtcatatttagccggtgcagggttactgttcagtatcatgaaaaataccacatcaacacgacggggtacgggtaatatcggggaaacgttaggagaaaaatggaagagtagattgaacgcattaggcaaaagtgagtttcaaatatataagaaaagcggtatccaagaagtagatcgaacattggctaaagaaggaattaaaagaggggaaacggatcatcacgctgtatcaagaggtagtgcgaagttacggtggtttgtagaaagaaacatggtaacacccgaaggtaaagtagtagacctaggttgcggcagaggcgggtggtcgtactactgtgggggacttaaaaatgtaagagaggtaaaaggactaactaaaggaggccctggtcatgaggaacctataccaatgtcgacgtatggatggaatttagttagattacagtctggcgtggacgtattctttaccccacccgaaaagtgcgatacactgctttgcgacataggtgagtcaagccccaacccaacaatagaagcaggcaggactctcagagtattaaacttggtggaaaattggctaaataataacactcaattctgtattaaagtcctgaatccgtacatgccgagcgtgatagagaaaatggaagcattacaacgacaatacgggggcgccttagttcgcaacccactttcacgtaattcaacccatgaaatgtattgggtgtcaaatgcgacaggaaatattgtatcgtcagtaaacatgatatctagaatgttaataaatcgatttacaatgaaacacaagaaagccacatatgaaccagacgtagatttgggtagtggaactaggaacattggtatagaatctgaaataccaaatctagatataataggaaagcggatagagaaaataaaacaagaacatgagatttcgtggcattatgaccaagatcacccgtacaaaacctgggcttatcacgggtcgtatgagacaaaacaaacgggatcggcatcgtcaatggtgaatggtgtggtgcggttactgacaaagccttgggacgtggtgcctatggttactcaaatggcgatgacagatacgacaccatttggacagcagagagtatttaaggagaaagtggacacacgaacacaggaacccaaagagggaacaaagaaacttatgaagataaccgcagaatggctgtggaaagagctcggcaagaagaaaacaccacgcatgtgtacacgcgaagaatttactaagaaagtccgctctaatgcagcacttggcgctatattcacggacgaaaataaatggaagagtgcaagggaagcagttgaagatggaagattttgggaactcgtagaccgtgaaagaaatctccatctagaaggaaagtgtgaaacttgtgtttataacatgatgggaaagcgagagaagaaattaggagagttcggaaaagcaaaaggcagcagggctatatggtacatgtggctaggagccagatttttggagttcgaagcactcggctttctaaacgaagaccactggttttcacgaggaaacagcctcagtggagtagaaggtgaaggtttacatcgattaggttacattctgcgcgacgttggtaagaaagaaggcggtgcaatgtatgcggatgatacagctggatgggacacccggataacgttagaagatttaaagaatgaagagatggttactaatcatatgaaaggagaacacaagaaactagctgaagccatatttaaattaacatatcaaaacaaggttgtaagggtacaacggcccactccacgcggtacagttatggacataattagtagaagggatcaacgtggttccggccaagtaggaacttacggattaaacacatttactaatatggaagcacagttgataaggcagatggaaggagaagggatatttaaatccattcagcatttgacggctacagaagagattgctgtacaaaactggctagccagagtagggagagaaagattatcgaggatggcgatatcaggcgatgactgcgtagttaaacccatagacgataggtttgccagtgccctcacagctctaaatgacatgggaaaggttaggaaagacattcaacaatgggaacccagccgaggctggaatgactggacacaagtgccgttctgtagtcatcattttcatgaattagttatgaaagatggtagagtgcttgtagtcccatgtagaaaccaagacgaattgatcggtagggctcggataagccaaggagctggttggtccttaaaagagaccgcatgccttggtaaaagttacgcacaaatgtggacacttatgtattttcaccgcagagacttacgacttgcagcaaacgcaatatgtagcgcggttccttctcattgggtacctacttcgagaacaacctggtcaatacacgctaaacatgagtggatgaccactgaagatatgttagcagtttggaatcgagtctggatacaagaaaatccatggatggaagataagaccccagttgagagttgggaagaagtcccatacctaggtaagagagaagaccaatggtgtggatcattaattgggttgacaagcagggcaacttgggcaaagaacatacaaacagcaatcaatcaggttaggagcctgattggaaatgaagaatatacggattatatgccgtccatgaaaagattcaggcgcgaagaagaagaagctggggttctctggtga

SEQ ID NO: 22392 - RNA, 9876 nt, synthetic construct
  misc_feature 1..9876: note = derived and/or modified CDS sequence (opt6) from DENV-2__EU482630__SS-prME
  source 1..9876: mol_type = other RNA
acagcaggagttatagttatgttaattcctactgctatggcatttcatttaacgacgagaaatggagagcctcatatgatagtaggaaggcaggaaaaagggaaatccctactatttaaaacagaagacggagtaaatatgtgtacattaatggccatagatttaggagaattgtgtgaggataccataacttacaaatgcccgttccttaggcaaaatgaaccggaagacatagattgttggtgcaactctacaagcacgtgggtcacttatggtacatgtacaacaacgggtgaacatcgtcgggagaaaagaagtgttgctctagtaccacatgtaggaatgggcctggaaactaggactgaaacgtggatgagttctgaaggagcttggaaacatgttcagaggatagagacatggatactaaggcaccccggcttcacaataatggcggcgatcctagcgtatacgataggcaccactcacttccaacgggcgctaatattcattttattgacagctgtagcacctagtatgacaatgaggtgcataggaatatcaaacagagattttgttgaaggggttagcggcggatcatgggtggatattgtattagagcatggttcatgcgtaacgaccatggcaaaaaataaacccactcttgactttgaacttatcaagaccgaagcgaagcagccagcgacattgagaaaatattgcatcgaagcaaaactaactaatactacaacagaaagcagatgtcctactcagggagaaccttctctaaatgaggagcaagataaaagatttatctgtaaacacagtatggttgacagaggatggggaaatggctgcggcttattcggtaagggaggaatagttacttgcgctatgtttacatgtaaaaaaaacatggagggaaaggtcgtacaacccgagaatctagaatacacaattgtcatcacaccacactccggggaagaacacgccgtagggaacgacacaggtaaacacggtaaagagatcaaaatcaccccacagagtagtattaccgaggccgaactgacaggatatggtacagtcacgatggaatgttcgccacgtacagggttagactttaacgagatggtactgcttcaaatggaagataaggcgtggttggtacacaggcaatggttcttagatttacccctgccatggttgccaggagcagacacccaaggatcaaactggattcagaaagaaactctagtaacttttaaaaacccgcacgcgaagaaacaagatgtagtagtacttggctcacaggagggtgcgatgcacacggccttaacaggggccacagagattcagatgagctctggcaaccttcttttcacaggacatcttaagtgtaggctaagaatggataaattacaattaaaaggaatgagttattctatgtgtacaggaaaattcaaaatagttaaagagatagcagaaactcagcatggtaccattgttataagagtgcaatatgaaggagacggctcaccttgtaaaattccattcgaaattaccgatttagaaaaaagacacgtattaggccgattgataaccgtaaatcctattgtaactgagaaagattccccagttaatatcgaagcagaacccccttttggcgactcatatattatcataggtgtagaaccagggcagttgaaattgaactggttcaaaaaaggcagttctataggtcaaatgttcgaaacaactatgaggggagctaaacgcatggccattctaggtgacactgcatgggattttggatccttaggaggagtgtttacaagtataggaaaagcattacatcaagtcttcggtgccatatatggtgctgcattcagtggagtaagctggacaatgaaaattctaataggtgttataataacatggataggaatgaattcaaggtcaacgagcctttcggtatctttggtccttgtaggtgtcgtgaccttataccttggagccgtggttcaggcagatagtggatgtgtagtgagttggaaaaataaagaattaaaatgtggttcaggcatttttatcacggacaacgttcatacatggaccgaacaatataaattccaacctgaatctccaagcaaacttgcttcagccattcagaaagctcatgaagaaggaatttgcggaattagatcagtcacccggttggaaaacttaatgtggaaacagataacgccagaattaaatcacatattgtcagagaatgaagtcaagttaaccattatgacgggtgatattaaggggataatgcaggccggaaaacggtcactgcgtccccaaccaactgaattaaaatattcatggaaaacttggggaaaggctaaaatgcttagtaccgaatctcataaccagacatttctcatagacggcccagaaaccgctgaatgtcctaatacaaatcgcgcatggaattctttagaggttgaagactacgggtttggggtctttaccactaatatctggcttaaactacgagaaaaacaagacgtattctgcgattcgaaattaatgtcagctgctataaaggacaacagagccgtacatgcagacatgggatattggatagagtcagcattgaatgacacatggaaaatggaaaaagcaagctttattgaagttaaatcgtgccactggccaaaatcacatacactttggtccaatggggttttagagagcgaaatgatcataccaaaaaacttcgctggacctgtatcacaacacaattaccgaccaggttaccatacacaaacagccgggccttggcatctaggaaaattagaaatggattttgatttctgcgaaggaacaaccgtagtcgtcacagaagattgtggaaatagagggccatctcttagaaccacgacggcatcaggtaaattaataacagagtggtgttgtagatcttgcacactacctccgctgaggtacaggggtgaagatggttgttggtatggaatggaaattagacccctgaaggaaaaagaggaaaacctagtcaattctctggttaccgcaggacacggacaaatagataatttctcactaggtgtactgggtatggctctctttttagaagagatgttaaggacacgtataggtacgaaacatgcaattctgttggtggcagtcagttttgtaacgctaataacagggaatatgtcgttccgtgatctgggtagagttatggtcatggttggagcaacaatgacggatgatatcggcatgggtgtaacctacttagcacttcttgctgcctttaaagtaagaccgacatttgcagccggtttgctgctcagaaaattaactagtaaagaattaatgatggcgaccataggtattgctttattgtcacaaagtactattcctgagacgatacttgaactaactgatgctttggcattgggcatgatggtgttgaaaatagtaaggaacatggagaaatatcaattagccgtcacgataatggctatttcatgtgtaccaaacgcagttattctacaaaatgcatggaaagtatcatgtactattctggcagcagtatctgtttcaccattattgttaacgagtagtcaacaaaaggcagactggatacccttagcgttgacgataaaagggctaaatcctaccgctatttttttgacaactctatcacgcacatccaagaaaagatcctggcctctcaacgaagcaataatggccgttgggatggttagcatacttgccagttctcttctgaaaaatgatatacccatgaccgggccattagtagcaggcggactgctaactgtatgttacgtactaactggtcgatctgcagatctagagctggaaagggccgctgacgtaaaatgggaagaccaggcagaaataagtggcagtagcccaatcttatcgattacaatatctgaagacggttcgatgtcaattaaaaacgaagaagaggaacaaactttaacaattttaatacgtaccggattattagtaatctcgggagtatttccagtcagtattccaattacagcagcagcatggtacctatgggaagtgaaaaaacaacgagccggagtcctgtgggacgtaccttccccaccaccagtcgaaaaggccgaactcgaagatggtgcatatagaattaaacagagaggaattctgggatacagccagataggtgcaggtgtgtataaagaaggtacatttcatacaatgtggcacgtgacaagaggagcggtcttaatgcatcggggtaaaagaattgaaccctcctgggcagacgtaaaaaaagacctcatatcttacggaggcggatggaaactcgagggagaatggaaagaaggagaggaagtacaagtcttagcccttgaaccaggtaaaaatccgagggcagtgcaaaccaagccaggaatttttaagacaaacaccggaacaatcggtgctgtctcactagatttctcacctggtacaagcggatctccaattgtagacagaaaaggaaaagttgtaggactttatggaaatggtgtggtaactcgatcaggagcatatgtttctgccattgctcaaaccgaaaaatcaatagaagataatccagaaatcgaggatgatatcttcaggaaaaaaagattgactatcatggacttacatccgggagcaggtaaaacaaaacgttacttgccggcgatcgtcagagaggccataaagcggggattacgaacgctcatcctagcacccactcgagtagtggcagcagaaatggaagaggcgctccgtggcttgccaatcagataccaaacaccagcaatcaagacggaacatacaggtagagaaatcgtagatttaatgtgccatgccacattcacaatgcgattactctctcccgtacgcgtcccaaattacaatttaataataatggatgaggcacatttcacagatcccgcatctatagccgcaaggggttatataagtacacgagtagagatgggtgaggctgcagggatctttatgactgccacaccccctggttcaagagatccgttcccacagagtaatgctccaatcatggatgaagaaagagaaatccctgagagatcatggaactctggacacgaatgggtaacagactttaaaggaaaaactgtctggtttgtaccctctataaaagcaggcaacgatatcgcggcatgcttaaggaagaatggaaaaaaggttatccagttaagcagaaaaacgtttgattctgaatacgtcaaaactcgagcgaatgattgggactttgttgtgactacggatatatcagaaatgggtgcaaatttcaaagctgaacgagtgatagatcctagacgttgtatgaaaccggtaatcttaacagatggcgaagagcgtgttatattagcgggaccgatgcccgtcacacattcaagtgcagctcaacgacgaggacgtataggacggaatccaaagaacgaaaatgaccaatatatatatatgggggagccccttgaaaacgacgaagactgcgcgcactggaaagaagctaagatgttactagataacataaatactccagaaggaataataccatcaatgtttgaacctgaacgagaaaaggttgacgctatagatggagaatatagacttagaggagaggcacggaaaacatttgtcgacctgatgcgtagaggggatctgcccgtatggctagcgtacaaggttgcagcagaaggtataaattacgccgatagaaaatggtgttttgatggcataaaaaataaccaaatattggaagaaaatatggaggtagaaatttggacgaaggaaggtgaacgaaaaaaattaaagcctaggtggctggacgcacgcatttacagcgacccactagctctaaaggaattcaaagagtttgcagctggtagaaaatcactaacgttaaacctgataaccgaaatgggaagactgcccacttttatgactcaaaaggcacgcaatgcccttgacaatcttgcggtattacatacagcagaggctggtggcagagcatataatcacgcgctaagtgaattgcccgaaaccctggagacgttgctattattaacactactagcaacagtcacaggtggaattttcctatttttaatgtcaggtaaaggaatcgggaaaatgactctagggatgtgctgtattataacagccagcatactcctctggtacgctcaaatacaaccacactggattgcagccagcattatacttgaattcttcctgatagtattactaatcccagagccggaaaaacaacgaactccacaagacaatcagcttacctatgtcgtaatagcaattttgacagtggttgcagctactatggcaaatgaaatgggattccttgaaaaaaccaagaaagacttagggctaggaagtataactacccaagagtctgaatcaaatatcttagacatcgacctaagaccggcgagcgcgtggaccttatatgcagtagctacgacatttgtgactccaatgctacgacactcaattgaaaatagttcggtcaatgtatcactcacagcaatagcaaatcaagctacagttctaatgggacttggaaaaggatggcctcttagtaaaatggatattggggtaccccttctcgcgataggttgctattctcaggtaaatcctatcacactaaccgctgcgttactcttattagtagcacattatgcgatcataggtccaggacttcaagcaaaagcgacccgagaggcccaaaagcgagcggccgctggaataatgaaaaaccccactgtagatggaattacagttatcgacttggagccgataccatacgatcccaagtttgaaaagcaacttggacaagtaatgctcctaatattatgtgtaactcaggtcctcatgatgaggacgacatgggcactttgcgaagctttaacacttgcaacagggccaatatcgactctatgggaaggtaacccagggcgcttttggaacacaaccatagccgtcagtatggctaacatttttcgcgggtcatatttggcaggcgccggtttattattcagtataatgaaaaacacaacgtctacgagaaggggtacaggtaacattggggaaacacttggggaaaagtggaaaagtagacttaatgcattaggcaaaagcgaatttcaaatttataaaaaatccgggatccaagaagtagatagaaccttagcaaaagaaggaataaaacgtggagaaacggatcaccatgcagtctctcggggatcagctaaacttagatggtttgtagaaagaaacatggtcacaccagaagggaaggttgttgatctaggatgtggaagaggcggatggagctactattgtggaggattaaaaaatgtgcgggaggtaaaaggattaactaaaggaggaccaggtcacgaagagcctattccaatgtcgacttacggatggaatcttgtacgtttgcaatctggggtcgatgtattttttacaccacctgagaaatgcgacactctactttgtgacataggagaatctagcccaaaccccacaatagaggcaggaaggacgttgagagtcttaaacctagtggagaactggttaaataataacacgcagttttgcatcaaagtgctaaacccctacatgccatctgtaattgagaaaatggaagcactacaacgtcagtacggtggggctctagtgcgaaatcctctatcccgaaattcaacacatgaaatgtattgggtcagtaacgcgactggaaatatagtgtcgagtgtaaacatgatatcgagaatgttaataaacagatttactatgaaacataagaaagcaacgtacgagccggatgtcgatcttgggagtggaacacggaacataggtatagagagtgaaataccaaacctagacattatagggaaacgcatagaaaaaattaaacaagaacatgaaatatcatggcattacgatcaggatcatccgtataagacttgggcatatcatggatcatacgaaaccaaacaaaccggaagcgcatcatctatggttaatggcgtggtccggctactgacaaaaccatgggatgtggttcccatggtaacacaaatggcgatgacggatactacgccctttgggcaacagagggtttttaaagagaaagttgacacaagaacgcaagaacctaaggagggcacaaaaaaattaatgaaaatcacggccgaatggttatggaaggaattgggcaagaaaaaaactcctagaatgtgcacccgagaagaatttacaaaaaaagttagatctaatgctgcgttaggggctattttcacggacgaaaataagtggaagtcggctagagaagcagtcgaggatggaaggttctgggaactggtagatagagagcgaaatctccatttagaaggtaaatgtgaaacatgcgtatataacatgatgggtaagagagaaaaaaaactaggcgaattcgggaaggcaaaaggatcgcgcgcaatttggtatatgtggctgggtgccaggttcttagaattcgaagcgctaggctttcttaatgaggatcattggtttagccgaggtaacagcctctcaggagtagaaggtgagggtctacatagattgggttacattctaagggatgtagggaagaaagagggtggcgctatgtatgccgatgacacggcaggatgggatacccgtataacgctagaggatttgaaaaacgaggagatggtcacgaatcacatgaaaggggaacataaaaaactagccgaagcgatcttcaaactaacttaccaaaataaagtggtacgtgtacagagaccgactccacgaggtactgtcatggacattataagcagacgagaccagcgaggtagcgggcaagttggtacatatgggttgaacacattcaccaatatggaggctcaactaatacgacaaatggaaggtgaaggcatttttaaatcgatacaacatttaaccgcaacagaagaaatcgcagtacagaactggttagcaagagtgggtagagaaagattaagtcgaatggctatatctggtgatgattgcgtagttaaaccgatagacgaccgtttcgcaagtgcattaactgctctaaatgatatgggtaaagtccgaaaagacattcaacaatgggaaccaagcaggggatggaatgactggacacaagtgcctttctgttcgcatcattttcacgaactcgttatgaaagatgggcgtgtattagtagtcccgtgtagaaaccaagatgagttaataggccgcgctaggatttcccagggtgctggatggtcactaaaagaaacggcatgcctaggaaaatcatatgctcaaatgtggacactaatgtatttccatagacgagatctccgattagccgcaaacgcaatatgtagcgcggtgccaagtcattgggttcctacaagtcgaacaacctggtctatacacgctaaacacgaatggatgacgacggaagatatgcttgccgtatggaacagagtatggatacaagaaaacccttggatggaagataaaacaccagtagagagctgggaagaggttccatatttagggaagcgtgaagaccagtggtgcggatctctaataggtttaacttctcgtgcaacctgggccaagaatattcagacggccatcaatcaagttcgttcattaattggcaacgaagaatacacagattacatgcccagtatgaaacgattcaggagagaagaagaggaagctggtgtattatggtaa

SEQ ID NO: 22393 - RNA, 9876 nt, synthetic construct
  misc_feature 1..9876: note = derived and/or modified CDS sequence (opt6) from DENV-2__FJ882594__SS-prME
  source 1..9876: mol_type = other RNA
acggctggagtaatagtaatgttaatacctacggcgatggcatttcaccttacaactcgtaatggagaacctcacatgatagttggtcgacaagaaaaaggtaaatcattgctattcaaaacggaagacggagtaaacatgtgtacacttatggctatagatttaggagaattatgcgaagataccataacatataaatgcccactactgagacaaaacgaaccagaagacatagattgttggtgcaattcaactagcacttgggtaacatatggaacttgtactacaacgggtgaacatagaagagaaaaacgatctgttgcgttagttccgcatgtaggaatgggattagaaacacgaactgaaacgtggatgagtagcgaaggtgcatggaaacacgtacaacgaatagaaacttggatattacgacatcctggctttaccattatggcggcaatattggcatacacgattggaaccacacactttcagcgagcccttatatttatacttttgacagcagtcgcaccatcaatgacgatgcgatgcatcggtatatcgaatagagacttcgtagaaggtgtctccgggggtagttgggtagacatcgtgctagaacatggtagctgtgttacgacaatggcgaaaaataaaccaaccctggatttcgaattaattaaaactgaagcaaaacaaccagccacattacgtaaatactgcatagaagcaaaactgactaatacgacaaccgaatcacgatgtccaacacagggcgaaccatcattgaatgaggaacaagacaaacggttcatatgcaaacacagcatggtagatcgggggtggggtaatggctgtggacttttcggtaaaggcggcatcgtaacttgcgccatgtttacttgtaagaaaaatatggaaggaaaagtagttcagccagaaaacttagaatacaccattgttatcacaccacactctggagaggaacatgcagtaggaaacgacactggaaaacatggcaaagaaattaaaatcacacctcaatccagcattacagaagcagaactaaccggctatgggacagttacaatggaatgctcgccaaggacaggcctagatttcaatgaaatggtgctactgcaaatggaagacaaggcttggctggttcacagacaatggtttttggatctaccattaccttggttaccaggagcagatacacagggatccaactggatacagaaagagaccctagttacctttaaaaacccacatgcaaagaaacaagacgttgtcgtcctaggcagtcaagaaggagccatgcatacagccttaacaggagccactgagattcaaatgtcgagtggtaatttattgttcacaggacacctaaaatgtagattaaggatggataaactacagttaaaaggaatgtcatattccatgtgcaccggtaaattcaaaatagttaaagaaatagccgaaacacagcatggaacgatagttataagggtgcaatacgagggcgatggatcgccctgcaaaataccttttgaaattacagatctcgaaaaacgtcacgtactaggacgcctaataactgtaaatccaattgtcactgaaaaagactcacctgtcaacatagaagctgaaccaccgtttggagattcatatataataataggagttgagccaggacaattaaaattaaattggtttaagaaaggatcttccattgggcaaatgttcgaaactacaatgagaggagcaaaaagaatggcaatactaggagataccgcatgggactttggcagtttaggtggagtattcacgagcatcggaaaagctctacatcaggtatttggtgcgatttatggtgctgcattctcgggtgtttcatggacaatgaaaatcctcatcggggtgattataacatggataggcatgaactcccggtcaacttcactcagcgtatcactggtactcgtaggcgttgtaacactgtatcttggagctatggtacaagcagattcaggatgtgtagtcagctggaaaaacaaagaactaaaatgcggaagcggaattttcatcacagataatgtacatacttggacagaacaatataaattccaacctgaaagcccgtcaaaattagctagcgccatacaaaaagctcacgaagaaggcatatgtggtatacggagtgttacaaggctagaaaacctaatgtggaaacagataactccagaattaaaccatatactgtctgaaaacgaagtaaaacttactatcatgactggtgacattagaggaatcatgcaagccggaaaacgctcactcagaccacaaccaacagaactcaaatattcttggaaaacatggggtaaagcaaaaatgctatcaactgagagtcataaccagactttcttgatagacggacccgaaaccgcagaatgtccaaataccaaccgagcatggaacagtctcgaggtagaagattatgggttcggagtgttcacaacgaatatatggctaaaattacgagaaaaacaagatgtattttgcgatagcaaacttatgtctgcagcaataaaagataacagagccgtacacgcagacatgggttattggatagaatctgcactaaacgacacgtggaaaatggaaaaagcgtcattcatagaagtaaaatcatgccactggccgaaaagtcatacactatggagtaacggagtcctagaatccgaaatgattatccccaaaaactttgcaggacccgtatctcaacataattatcgcccaggttaccacacacaaactgcagggccatggcacctagggaagctcgagatggatttcgatttatgtgaagggaccaccgtagttgtgacagaagattgtggaaatcgaggtccctcgttgaggaccacgacggcatctggtaaactgataactgaatggtgctgcagaagttgtactcttccgccgcttagatatcgaggcgaagatggttgctggtatgggatggagataagaccgctgaaggaaaaagaagaaaatttagtaaattccttagtaactgcaggacatggacaaatcgataatttcagtttaggggtacttgggatggcattattcctggaagaaatgttacggactagaatagggacaaaacatgccatacttttagttgcagtatcatttgtaacactcatcacaggaaacatgagctttagagaccttggtagagttatggtgatggtcggagctacaatgacagatgacataggtatgggggtcacatatcttgcattgttagcagcttttaaagtgcgtccaacatttgctgcggggcttttactgcgtaagttaacaagtaaggaactcatgatggcaacaataggaatagcattgttatcccaatccactatcccagaaaatatattggaattgactgacgccctcgcacttggtatgatggtacttaagatagtgaggaatatggaaaaatatcaattagccgtcacaatcatggctattagttgcgtgccgaacgccgtcatccttcagaacgcttggaaggttagttgcacgattcttgcagctgtatcagtgagtccgctcctattaacctcttctcagcaaaaagcagactggatacccttggctttaaccataaagggactgaatcctactgcaatcttccttacaaccctaagcagaaccagcaagaaacgtagctggccgttaaatgaagcaataatggcagtgggaatggtgtcaatattagcctcttcgttactgaaaaatgatatcccaatgacaggtcccttagtagcgggaggcttattaacagtctgctatgttttaacaggaagatctgcagaccttgagctagagagagcggcagacgttaaatgggaagatcaagctgagatatccggttcttcgccaatactgtcaataacgatctcagaggatggatccatgtctatcaaaaacgaagaggaagaacaaacgcttacgattttgatcagaacaggcttgctcgtgatatctggagtattccccgtcagcataccaatcaccgcagcggcctggtatctatgggaagtaaagaaacagcgagcaggagtcctttgggatgtaccctcaccgccaccagtggaaaaagcagagttagaagatggagcctataggataaaacagagaggaatactaggctatagccaaatcggagctggggtatataaagaaggaaccttccatactatgtggcacgtcacgagaggagctgtgcttatgcatagaggtaaacggatcgaaccctcatgggcagatgtcaagaaagacttaataagttatggaggcggatggaaactcgaaggggagtggaaagagggagaagaggttcaagttcttgctcttgaacccggcaaaaaccctcgcgccgtacaaacaaaaccaggcatattcaaaactaatactggaacaattggagctgtttcactagatttcagcccaggaacatctggctccccgattgtagacagaaaaggaaaagtggtcggattgtacggtaatggtgtagtaaccagatctggtgcatatgtaagtgccatcgcacagacagaaaagtccatagaagataatccagagatagaagatgacattttcaggaagaagcgattaaccattatggacctacatccaggggccggtaaaactaaaagatatcttcctgctattgtcagagaagccattaaaagaggactccgaacccttatattggctccaaccagggttgtagctgcagaaatggaagaggctcttagaggattacctatcagatatcaaacgacagccataaagactgagcatacgggcagagaaatagtcgacctcatgtgtcatgccacattcactatgcgactactatccccagtacgtgtaccaaactataatttgattatcatggacgaagctcatttcacggaccccgcctcgattgcagcaagaggctatatatcaacccgagttgaaatgggagaagcagcgggaatatttatgacagctacacccccaggctcaagggatccttttccccaatcaaatgctcctatcatggatgaagaaagggaaatccccgaaagaagctggaacagtggtcacgaatgggtgaccgatttcaagggaaaaactgtatggtttgtgccttcgatcaaggcaggtaacgacattgcagcctgtttacgtaaaaacggaaagaaagtaatacaactctcacgcaaaacatttgattctgagtacgtaaaaacccgcgctaacgattgggactttgtggttacaactgatatctcggaaatgggggcaaattttaaagcagaaagagtcattgaccccaggcgatgtatgaagcccgtgatcctaactgacggtgaggagcgagtcattctagcaggacctatgcctgtaacacattcgtccgcagcccaacgcagaggaagaatcggtagaaatcccaaaaacgaaaacgatcaatacatttacatgggagaacctctagagaacgatgaagactgtgctcattggaaagaggcgaaaatgttattggacaatataaatacgccagaaggaataataccgagtatgtttgaacctgagagagaaaaggtagatgcaatcgacggagagtatagactcaggggcgaagctagaaagacgttcgtagatctaatgcgtagaggggatctcccggtatggttagcgtacaaagtagctgccgaaggtattaattatgcagatcggaagtggtgctttgatgggattaaaaacaatcaaattcttgaggaaaatatggaagtggaaatttggacaaaagaaggtgaaaggaagaaactaaaaccaaggtggttagacgctagaatatattctgatcctttagcgttgaaggaatttaaagagttcgcagctggaagaaaatctctcactttgaacttaataaccgaaatgggcagactgcccacgttcatgacacaaaaagctaggaacgctctagacaatctggcagttctgcacacagccgaagccggagggcgggcatacaaccacgctttatcagaactccctgaaaccttagagacgctccttttattaactttgctcgcaacggttacaggaggcatctttctatttttaatgtcaggaaaaggaattggcaagatgactctagggatgtgttgtataattactgcgtccattttactttggtacgctcaaatccaacctcattggatagcggcaagtataattttggagttctttcttatcgtattattgatccctgaacccgaaaaacaacgaacgccacaagataaccaattaacatacgtggttatcgccatattaacagttgtggccgctacgatggccaatgaaatgggtttcttggagaaaactaagaaagacttgggcttaggatcaattacgacacaggaatcagaaagtaacatattggatatcgatctaagaccggcatcagcctggacgctttatgccgttgcgactacgtttgtgacaccgatgttacggcattcaatcgaaaactcatctgtaaacgtaagtttgacagcaatagccaaccaggctacagttctcatgggactgggaaaaggatggccattaagtaaaatggacataggagttccattattggcgataggctgctattctcaagtaaatcctatcacactaaccgcagcactactactcttagtggcccactatgctattattggcccaggactacaagcaaaagcgacaagagaagcgcagaaaagagctgctgctggaataatgaagaatccaaccgtagatggaataacggttatagacctagaacctataccgtacgacccaaaatttgaaaaacaactgggtcaagtcatgcttttaattctgtgcgttacacaagtactcatgatgcggacgacatgggctttgtgcgaggctttaactctggcgacaggacctatttcaacgctttgggaagggaatccagggcgattttggaatactactattgcggttagcatggcgaatatattcagaggatcttacctcgcaggggctgggttgctattctctattatgaaaaacacaacaaatacacgacgaggaactgggaacataggtgaaaccctcggtgaaaaatggaaatcacgattaaacgccttaggtaaatcggaatttcaaatttacaagaaatcaggcatacaagaggtagaccgcacattagcgaaggagggaattaaacgtggtgaaaccgatcaccacgcagttagtcggggtagtgcaaaacttcgatggtttgtggaacgtaatatggtaacccccgagggcaaagttgtagacctagggtgcggccgtggtggttggtcctattattgcggagggctcaagaacgttcgtgaggttaagggactcacaaaaggtggccctggacacgaagaaccaatcccaatgagtacttacggatggaatttagtacgattacagagtggcgttgacgtattctttacaccacctgagaagtgcgatactttgttgtgcgacataggggaatcatcgcctaacccaactatagaagctggacgaacacttagagttctaaacctggtggaaaattggctcaacaataatacacagttctgtataaaagtcttaaacccatacatgccatccgttattgagaagatggaggcattacaaagaaaatatggaggagccttagtccggaacccgctgagcagaaatagtacgcatgaaatgtattgggtcagcaatgcaacgggtaacatagtgtcatcagtaaatatgatatcaagaatgctcattaacagattcactatgaaacataagaaggcaacatacgaaccagatgtagatttaggctctggaaccaggaatatcggaatagagtcagaaatcccaaacttagacataatcggaaaaagaatcgagaaaattaaacaggaacacgaggccagttggcactatgaccaagaccacccatacaagacatgggcgtatcacggttcatacgaaacgaagcagacgggctccgcaagtagtatggtaaacggtgtggtacgactgctaactaaaccctgggatgtagtaccaatggtcacgcaaatggcaatgactgacacaacaccgtttggccaacaaagagtattcaaggaaaaagtggacaccagaacacaagagcctaaagaaggaaccaagaaactaatgaagattacggcggaatggctgtggaaagaactgggcaagaagaaaacaccacgaatgtgtactcgggaagagtttacgaagaaagtaagaagcaatgcggccctaggggcaatattcactgatgagaataagtggaaatcggctagggaagctgtagaagatgggaggttttgggagttagttgatcgggaaaggaatctacacttagaaggaaaatgcgaaacatgcgtctacaacatgatgggtaaaagagagaagaaactaggtgaatttggacgcgcgaaaggaagtagggcaatttggtatatgtggttgggagcacgattcctcgagttcgaggcactcggatttttaaatgaagaccactggttctcaaggggtaattcactatctggtgtagagggtgaagggctccaccgactcgggtatatacttcgagatgtaggcaagaaagaaggcggcgccatgtacgctgacgatactgcaggttgggataccaggatcactctagaagatctaaagaatgaagagatggttactaaccacatgaaaggtgaacacaagaaattagcagaagctatatttaaactgacctaccaaaacaaagttgtgagggtacaaagacccacacccagaggaacagttatggatatcataagtcggcgcgatcaacgcggatcagggcaagtgggtacatatggcttgaatacgtttactaacatggaagcccagcttatacgacagatggaaggtgaaggaatatttaaaagtattcaacatctcacggctacagaagaaatagcagtacaaaactggctagctagagttggaagagaacgactatctcgaatggctatatcaggggatgattgtgtagtaaaaccgattgacgataggttcgccagtgcactaacagcattgaatgatatgggaaaagttcgtaaagatatacaacaatgggaacccagtcgcggctggaatgattggacacaagtaccattctgctcgcatcactttcatgaactcgtaatgaaagatggcagggttttagttgtaccttgcaggaaccaagacgaattaataggacgggccaggatatcccaaggtgctggatggtcactaaaagaaacagcatgcctagggaaaagctatgcccaaatgtggactttaatgtacttccatagacgggatctgcgtctagctgcaaatgcgatttgttcggcggtaccctcacattgggtcccgacaagtagaacgacatggagcattcacgcgaaacacgaatggatgacaacagaggatatgttagcagtatggaaccgtgtttggatccaagagaacccgtggatggaagataaaacgcccgttgagtcatgggaagaggtcccatatttagggaaaagagaagaccaatggtgtggcagcttgatcggtttaacgagcagagctacatgggccaaaaatattcaaaccgcaatcaatcaggtacgcagcctgataggcaacgaagagtatacagattacatgcccagcatgaaaagatttaggcgagaggaggaagaggctggagtattatggtag

SEQ ID NO: 22394 - RNA, 9876 nt, synthetic construct
  misc_feature 1..9876: note = derived and/or modified CDS sequence (opt6) from DENV-2__FJ205885__SS-prME
  source 1..9876: mol_type = other RNA
accgcaggagtcatagttatgttaatcccaactgccatggcattccatctaactactcgcaatggagaaccacacatgatcgtggggagacaagaaaaaggaaaatcgcttcttttcaaaacagaagatggtgttaatatgtgcacacttatggccatagatcttggagaactatgtgaagacacaataacatacaaatgccctttattaaggcagaatgaaccagaagatattgattgttggtgtaattcaacatcaacatgggtaacatatgggacatgcacgacaacaggtgaacaccgtagggagaaaaggtcagtggccttagtcccacacgtaggaatgggactagaaaccagaactgaaacttggatgtccagtgaaggagcatggaaacacgtccaaaggatcgaaacttggatactacgacaccctggtttcacaattatggctgccatattagcctatacaataggtacaacgcactttcaaagagctctaatattcatactgctaaccgcagtagcaccgtcgatgactatgcgttgcattgggatctcaaacagggacttcgtcgaaggagtcagtgggggtagttgggtagatattgttcttgaacacggatcatgtgtcacgaccatggccaaaaataaacctacgttagattttgaattgataaaaactgaagctaaacaaccagccacgttacgaaaatattgtatagaagcaaaactaacgaacacaacgacagaatcgagatgtcctacccaaggtgaaccttcactcaatgaagaacaggataaaagattcatctgcaaacattctatggttgacagaggttggggaaacggctgtgggctatttggaaaaggaggaattgtaacctgtgcaatgttcacatgtaagaaaaatatggaaggcaaagtagtccagcctgaaaacttagaatacactattgttattactccacacagtggggaagaacacgcagtcggaaatgacacaggtaaacatggcaaagaaataaaaattactccgcaaagtagtataaccgaagcagaacttactgggtacggaacagtaaccatggaatgcagtccacgcaccggcctcgactttaacgaaatggtgctgctacaaatggaagataaagcctggctagttcacaggcagtggttcttggatctccccctaccctggttacctggtgctgacactcagggatccaactggatacaaaaagaaactttagtaacgttcaagaatcctcacgctaagaaacaagatgtcgtagtcttgggaagtcaagagggggcgatgcatactgccctaaccggcgctacagagatacaaatgagcagtggaaacctattatttactgggcatttaaagtgtcgtttaagaatggataaactgcaattaaaaggtatgagctacagtatgtgtacaggtaagtttaagatagtaaaagagatcgcggaaacacaacatggtaccatcgtaataagggtacagtatgaaggagatggatccccatgcaaaattccatttgagattacggatcttgaaaagaggcacgttctaggaaggctaattacggttaacccgattgtaactgaaaaagacagcccagtcaatatagaggcggaacctccttttggcgatagttatattattatcggggttgagcctggacaattaaaactaaattggtttaaaaagggatcttctattggacagatgtttgaaacaactatgagaggagcaaagcgtatggccatactaggggataccgcttgggattttggttcattaggtggtgtcttaacatcaatcggcaaggccctgcaccaagtatttggcgcaatctatggcgccgcgttctcgggcgtatcttggaccatgaaaatactcattggggtcataataacatggattggtatgaactccaggtctacctctctctcagtatcactcgtattggtgggtgtagtgacattgtacttaggcgctgttgttcaagctgattcgggttgtgtagtttcttggaagaacaaagaactaaaatgtggttctggaatatttataaccgataatgttcacacttggaccgaacaatacaaattccaacctgaaagccctagcaaactggcgtcagcaatccagaaagcacatgaagagggtatttgtggtatacgatcagttacacgactcgaaaacttaatgtggaaacaaattacaccagaattaaaccacatcctgagtgaaaacgaagtaaaacttactattatgacaggagatataaaagggattatgcaagcagggaaacgtagcttaagaccacaaccaacagaattaaaatatagttggaaaacatggggaaaagcgaagatgctatctactgaaagccataatcaaactttcctaatagacggtcctgagactgctgaatgtcctaacacgaatcgagcgtggaactcattggaagtagaggactatggtttcggcgtatttacaaccaatatctggctgaaactcagagagaaacaagacgtcttttgcgatagcaagttaatgtcggccgcaataaaggacaatcgcgctgtgcatgcagacatggggtattggatcgaatcagcattgaacgatacctggaaaatggaaaaggcatcatttatagaagtaaaatcatgccattggccaaaatcgcatactctatggtcaaatggagttttagaaagtgaaatgataatacctaaaaatttcgcgggccctgtttcacaacacaattatagaccaggttatcacacacaaacagctggtccatggcatctaggtaaactcgaaatggattttgatttttgcgaaggcacaactgttgtagtaactgaggattgcggaaacaggggaccgtcactgcgtacaacgactgcgtccggcaaactaataacagagtggtgttgccgttcatgcacactgccgcctttaagataccgaggtgaagatggttgctggtacgggatggagattagaccattaaaagaaaaagaagaaaatctagtaaatagcctggttactgctggtcacgggcaaatagataactttagccttggagtgcttggaatggccctcttcttagaagaaatgctgcgaacaagaattggtacaaaacacgccatactattagtagccgtctctttcgtgaccttaataacaggcaacatgagcttccgagatctcggacgagtaatggtcatggttggagcaactatgacagacgatataggaatgggtgtaacatacctcgctctacttgccgctttcaaagtaagacctacatttgctgcagggttactattaagaaagctgacatcaaaggaactaatgatggcaactataggcattgccctactttctcaatcaacaatacctgaaaccatcctagagctaacggacgctcttgcattaggcatgatggttctgaaaatcgtgaggaacatggaaaagtatcaattagccgtaacaataatggcgatttcgtgcgtgccgaacgcagtaattttacaaaatgcatggaaagtaagttgcactatccttgcagctgtgtcagttagtcctctactattgacgtcttctcaacaaaaagctgattggatacctttagcattaacaataaaaggtcttaatccaaccgcgatatttctcactacattatcccgaacaagtaagaaaagaagttggccccttaacgaggcaatcatggcagtaggaatggttagtatactggcgtcttcattgttgaaaaatgatatcccaatgacagggcccttagttgctggaggtctattaactgtatgctacgtattaacgggaagatcggcagatttagaattagaaagagcggcagatgttaaatgggaagaccaagcagagatttctggctcaagtcccatactaagtatcacaatctcagaagacgggtcaatgagcataaagaacgaagaagaagaacagaccttaacaatattaatcaggacaggcctgctagtgatctcaggtgtgtttccggttagcattccaataacagcagctgcgtggtatctatgggaagtcaaaaagcaaagagctggagtgttgtgggatgttccaagtccacctcctgttgagaaagcagagttagaagatggcgcctatcgaataaaacaaagaggtatattgggttactcacaaataggtgctggcgtctacaaggaagggaccttccataccatgtggcatgtaacaagaggggcagttttaatgcacagagggaaaagaatagaaccgtcatgggctgatgtgaagaaagacctaatctcatacggagggggatggaaactcgagggtgagtggaaagaaggagaagaagttcaagtgttagcattagagccaggtaaaaatcctcgtgctgttcaaacaaaacctggtatcttcaaaacgaacacgggcaccatcggcgccgtttccttggatttttcaccaggtacaagtggttcaccaatagtagatcgcaaaggaaaagtagtgggcttatacggaaatggggtagttactcggtctggagcttatgtctctgcaatcgcgcaaaccgagaaatcaatagaagataatcctgaaatcgaagatgatatattcaggaagaaacgattaactataatggatttgcaccctggcgctgggaagacaaaacgatacctaccagcaatagtacgagaagctattaaaagaggattgcgaacccttattttagcccctacacgcgtagtcgctgctgaaatggaagaagcacttagaggcctacccattaggtatcaaacacccgcaataaaaactgagcatacaggcagagaaattgtagatttgatgtgtcacgccacgttcaccatgagattactgtccccagtgagggtgcccaactataatcttataataatggacgaagcacattttacagatccagcttctatagcagctcgtggctatatttcaacgagagttgaaatgggtgaagcagcgggtatttttatgacagcaacacctccgggaagtagggatccatttccgcagagtaatgccccgataatggatgaagaaagagaaataccagaaagatcttggaactctggtcatgagtgggttactgactttaagggaaaaacagtatggttcgtaccatcgataaaagcgggaaatgacatagcggcttgtttaaggaaaaatgggaagaaagtaatccaactgtcaagaaagactttcgattctgaatacgttaaaacacgcgcaaatgactgggattttgttgtgactactgatatatcagaaatgggagcaaattttaaagcagaaagagttatagatcctagacgttgtatgaaaccggtcatattaacggatggggaggagagggttatattagccggacctatgccagttacccattcaagtgcagcccaacgtagaggcaggataggaagaaatcccaagaatgaaaacgatcaatatatatacatgggagaacccctggagaacgatgaggattgtgcacattggaaagaagctaagatgttactggacaatatcaacacacccgagggaataattccgagcatgttcgaacctgaaagggaaaaagttgacgcgatagacggcgaatataggcttaggggagaggcacggaaaacgtttgttgatcttatgaggaggggtgatttgccagtatggctggcttacaaagtagctgccgaaggaataaactacactgatagaaaatggtgctttgatggaataaagaataatcaaatacttgaagaaaacatggaagttgaaatttggacgaaagaaggagaaaggaagaaacttaaaccacgttggttagatgcaagaatctattcagacccactagcactgaaagagttcaaagagttcgctgccggcagaaaatctctaactttaaacctcatcaccgaaatgggacggttaccaacttttatgactcagaaggcacgcaacgcactggataacttggctgttttgcatactgcagaagcaggaggacgcgcatataatcacgctctatcggaactgccagaaacactcgagacattactactacttacattactcgcgaccgttaccgggggcatttttctgttcctcatgtcgggtaaaggaattggcaagatgactctaggtatgtgctgtataataactgcttcaattctcctatggtatgcacaaatacaaccacattggatagcggcgagtataatactagagttcttcctaattgtactattaatacccgaacctgagaaacaaagaacacctcaagacaatcaattgacatatgtagtaatcgcaatactgacggtagtcgccgcgacaatggccaatgaaatgggtttcttggagaaaacgaagaaggatttgggacttggttcaataactacccaggagagcgaaagtaatattttggatatagacctgagacccgccagcgcatggaccttatatgcggtcgctacaacttttgtaacccctatgctaagacatagcattgaaaattcatcagtaaatgtcagcttaacagcaattgctaaccaagcgacagtcctaatgggattgggaaaagggtggcctctgtctaaaatggatataggcgtacccttactcgccattggctgctattcacaagtaaacccgatcacacttacagcagcactgcttctcctcgtggctcactatgcaatcattggtccagggctgcaagcaaaggctactagagaagcacaaaaacgggcagccgccggaataatgaagaaccctacagtagatgggatcacggtaatagaccttgagcctataccctacgatccgaaatttgaaaagcaattgggtcaagttatgctgctaatactctgtgtgacacaagtacttatgatgcgcactacttgggcattgtgcgaagccttaacacttgccactggacctatatctactttgtgggagggaaatcccggtagattttggaatactactatagctgtctccatggcaaacatttttagaggctcatacctcgccggtgcaggactactcttcagtataatgaaaaacactacatctacccgacgaggcacgggaaatataggcgagaccttaggagaaaaatggaaaagtagacttaatgcgctaggtaaatctgaatttcaaatttacaagaaatcaggtatacaagaagttgacagaacactcgccaaagaaggtattaagagaggggagactgaccatcatgcagtctcacggggttcagcgaaattacgttggttcgtagagagaaatatggtaactccagaaggaaaggttgtcgacctaggatgcgggcgtgggggttggtcatattactgtggtggtctcaagaatgtgagggaagttaagggactcacaaagggtggcccaggacacgaggagccaatccccatgtccacgtatggctggaatcttgttaggttgcaaagtggagttgacgtattcttcactcccccagaaaaatgcgacaccttattgtgtgacattggggaaagctcaccaaatccgacaattgaggcaggacggaccctacgtgtgttaaatctagtcgaaaactggttaaataacaacactcaattctgcataaaggttctgaatccatatatgccatcagtgatagagaaaatggaagcactacagcgacaatacggaggggccttagtaaggaaccccctttcaagaaactctacccatgaaatgtactgggtatcaaatgcaacaggaaacatcgtatcaagtgtaaacatgataagtagaatgttaataaatagatttacgatgaaacacaagaaagcaacctatgaacctgatgtagacctagggtcagggaccagaaatatagggattgaatccgaaataccgaacctagatattattggcaaaagaatcgagaaaataaaacaagaacatgaaatttcatggcactatgaccaagatcatccttacaaaacttgggcttatcacggtagttatgaaaccaaacagacagggagtgcatcctctatggtaaatggagtggtacgtttattaacaaagccctgggatgtagttcccatggtcactcaaatggccatgacagacacaaccccatttggacagcagagagtatttaaagaaaaggtagacacaagaacacaagaaccgaaagaaggaactaagaaattaatgaagattactgcggaatggctctggaaggaacttggaaagaagaaaacacccagaatgtgcactagggaggagttcacacgaaaagttagaagtaatgcagcattgggagccattttcactgatgaaaataaatggaaatcagcaagagaagcggtagaagacggcagattttgggagctggtagatagggaacgtaatcttcatctggaaggcaaatgtgagacgtgcgtatacaatatgatggggaaaagggagaagaaattaggagaatttggaaaagcaaaaggttcacgcgctatttggtatatgtggctcggggcaaggtttctagagttcgaggccctcggatttttaaacgaagatcattggttcagcaggggaaacagtctctctggagtggaaggcgaagggttacatagacttgggtatatcctccgagatgtgggcaagaaagaaggaggtgcaatgtacgctgacgacactgcgggttgggacacaagaatcacccttgaggacttgaaaaatgaagaaatggtgacaaatcatatgaaaggtgaacacaaaaagttagctgaagcaatattcaagttaacataccaaaataaagtagtcagagtacaacggcccacacccagaggtacggtcatggatataatttcaagaagggatcaaagaggaagcgggcaggtaggaacctacggacttaacacctttaccaatatggaggctcaactaataagacaaatggaaggagagggtatatttaaatcaatccaacatttgacagccacggaagaaatcgcagtccaaaattggctcgctagagttggcagagaaagactaagcagaatggcaataagtggagacgattgtgtcgtcaaaccaatcgacgatcgctttgcatcagccctaaccgcactcaatgacatggggaaagtaaggaaagacatacaacaatgggagccttcccgaggttggaacgactggacacaggtgcctttctgttcacatcactttcacgagctagtaatgaaggatggacgagtgctggttgtcccatgtagaaatcaggatgaacttataggacgagcaagaataagccaaggagcaggttggagtttgaaagagaccgcgtgcttggggaaaagctacgcccagatgtggacacttatgtactttcaccgcagagaccttagactagctgcgaatgctatatgttcggcagtaccttcccattgggtaccaacatctcgaaccacgtggtccattcacgcgaaacatgaatggatgacaacagaagatatgctagcagtgtggaatagggtatggatacaagagaatccgtggatggaagacaaaacgcccgtcgagtcgtgggaagaagtaccgtaccttgggaaacgtgaggatcaatggtgtggatcactaataggactaacatcacgagcgacatgggcgaaaaacattcaaactgcgataaaccaagtaaggtcattaatcgggaacgaagagtacacagattacatgccatcgatgaaacgatttagaagggaagaagaggaagctggtgtactctggtaa

SEQ ID NO: 22395 - RNA, 9876 nt, synthetic construct
  misc_feature 1..9876: note = derived and/or modified CDS sequence (opt6) from DENV-2__FJ744743__SS-prME
  source 1..9876: mol_type = other RNA
acagcgggggtaattgtcatgttaattcccacagcaatggcatttcatctaacaacaagaaatggagaaccccatatgatagtgggtagacaggaaaaaggaaaaagcctactatttaaaacagaagacggtgtaaatatgtgcacacttatggcaatagatctaggtgaactatgtgaagatactatcacttataaatgtccattgttaaggcaaaatgaacccgaagatatagactgttggtgtaacagcactagcacatgggtaacatatgggacatgtacaacaactggagaacatcgtagggagaaacgatctgtcgctcttgtacctcacgtaggcatgggtctggaaacacgtacagaaacttggatgtcgagtgaaggcgcatggaaacatgtgcagagaattgaaacttggatactgaggcatcccggctttacaatcatggcagcaatattagcatatacgatcgggactacacactttcaacgcgctctaatatttattctgttaacagcagtcgcgccctcaatgacaatgcggtgcatcggtatatccaatagggactttgtagaaggtgttagtggtggcagctgggttgatatagtgctagaacatgggtcatgcgttacaaccatggcgaaaaacaaaccaacgttagacttcgaactgattaaaacggaagcaaaacaacctgcaacattgagaaaatactgtattgaagctaaacttactaataccactacagagagtagatgtcctactcagggtgagccctcgctaaatgaagaacaagacaaaagatttatatgtaaacactcaatggtcgatcgcggatggggcaatggatgcggcctatttggaaaaggcgggatcgtaacttgtgcgatgtttacctgtaaaaagaacatggaaggaaaggtagtacaacctgaaaacttagaatacactattgtaatcaccccacatagcggagaagaacacgcagtcggtaatgatacgggtaaacacgggaaagaaataaaaattaccccacaatcaagcattacagaggcggaattaacagggtatggtactgtcactatggaatgctctccacgcaccggcttagactttaacgaaatggtgctgctacaaatggaagacaaagcgtggcttgtccacagacaatggtttctagacctcccactaccttggttgcccggagctgatacacaaggctcaaattggatccaaaaagaaactctagtaacgtttaaaaatccccacgccaagaaacaagatgttgtggttttaggaagtcaagaaggtgcaatgcacactgcactgacaggtgctaccgagattcaaatgtcaagtggaaacctcctattcacaggacatttgaagtgccgtttaaggatggataaactccaactgaaaggaatgagctattcgatgtgtacaggaaaattcaaaatagtaaaggaaatagcagaaacgcaacacggaacaatcgtaattagagttcaatatgagggcgatggtagcccttgtaaaatcccattcgagattacagatcttgagaaaagacatgtgttaggtagactaatcactgtaaacccgatagtaaccgggaaagactcacctgtaaacatagaggctgaaccaccttttggcgattcttacataattattggtgttgagccgggtcagttgaaactcaactggttcaagaaaggtagttcaattgggcaaatgttcgaaacgaccatgcgaggagcgaaaaggatggcaatactaggagacacagcctgggacttcggcagtttgggaggggtatttacatcaatcggaaaagccctacatcaagtatttggagcaatatacggagctgcgttcagtggagtgtcttggacaatgaagatcttaatcggagtgatcatcacatggatcggaatgaacagccgatccacttctttaagcgtctcattggtcctagtaggagtagtaacactttacctaggggccgttgtgcaggccgatagcggttgtgtagtatcctggaagaataaagaattaaaatgcgggtcaggtatatttattacggacaacgtgcacacatggactgaacaatataaattccaaccagagtcacctagtaaattagcctctgccatacaaaaagcacacgaagaagggatttgtggaatacgatccgttacaaggttagaaaacctaatgtggaaacaaatcaccccagaactaaaccatatactttcagaaaacgaggttaagttaacaataatgacaggcgacataaaaggcataatgcaagcaggaaagagatcactatggccacagccaactgagctaaaatatagctggaaaacatgggggaaggctaaaatgctaagcacagaaagccacaatcaaactttcttaatcgatggaccggaaacagcagaatgcccaaacaccaatagagcatggaactccttagaagtagaagactatggcttcggggtattcactactaacatatggcttaaattgcgggaaaaacaggatgtattctgtgattcaaaactcatgtctgctgctatcaaagacaaccgagctgtacacgccgacatggggtactggatagaatcggcactgaatgacacatggaaaatggaaaaagcgtctttcatagaagttaagtcgtgccattggcctaaaagccacactctgtggtcaaatggtgtacttgagtctgaaatgataataccgaaaaattttgcgggtccagtatcacaacataactataggccgggttaccatactcaaaccgctggaccatggcacttgggcaagctcgaaatggattttgatttttgtgaaggcacaaccgttgtagttaccgaggactgcggcaaccgtggaccatcacttcgtacaactacggcgagcggcaaacttataacagaatggtgttgcaggtcctgtacccttcctccactacgatatagaggagaggacggctgttggtacggcatggaaatacgaccactaaaagagaaagaagaaaacttagtaaatagtctagtcactgcaggacatggacagattgataattttagcttaggcgtcctaggtatggccctatttttagaggaaatgttgcgtacccgcattggaaccaaacatgcaatcttgttagttgcagtcagtttcgtaacactaattactggaaatatgtcattcagagacctaggaagggtaatggttatggtaggagcaactatgaccgatgatatagggatgggggtaacttacttagccttactagcagcattcaaagtccggcctacatttgcagccgggctactattaagaaaactcacctccaaagaattaatgatggctacaataggcatagctctactaagccaaagtacaataccagaaactatcctagaattaacggacgctctcgcgctaggcatgatggttctaaaaatcgtgcggaacatggaaaaatatcagttggccgtgaccatcatggcaatatcttgtgtaccgaacgctgttattctacaaaatgcgtggaaagtcagctgtacgatcttagcagctgttagtgtatccccgctactcctaacatcatctcagcagaaagctgattggataccattggcattaacaataaagggtctgaatccgactgctatttttcttacaactttatcacgaaccagcaagaaaagatcgtggcccctaaatgaagccattatggcagtaggaatggtatcaatactggcctccagtcttttaaagaatgacattcctatgacaggtccgctagtagccggaggtctactaaccgtttgttacgtactgacgggcagaagtgcggacctagaactagaaagagcggcggatgtaaaatgggaagatcaagctgaaattagtggcagttctcccattctatcgataacgatctctgaagatggttctatgtcaattaaaaatgaggaagaagaacaaacattaaccattttaattaggaccggccttttggtcatctcaggtgtgttcccagtaagcattcccataactgccgccgcttggtacttgtgggaagtaaagaaacaaagggccggtgtgttatgggacgtccctagccctccgcctgtagaaaaagctgagttagaagatggggcatacagaataaaacaacgagggatattaggctactcacaaattggagcaggagtctataaagaaggtacatttcatacgatgtggcatgtaaccagaggagcggtcttgatgcatagaggtaaaaggatagaacctagttgggccgatgttaagaaagacctaatcagttatggaggaggttggaaattagaaggagagtggaaggagggtgaagaagtacaagtactcgcattagaaccaggcaaaaatccccgcgccgtccagacgaagccaggaatttttaaaacaaatactggtacgataggagctgttagtctagacttctcacccggaactagcggctcaccaatcgtagacagaaaagggaaagtagttggattatatggtaacggggtcgtaacacggtcaggtgcatatgtctcggcaatagcacagacagaaaaatcaattgaggataatcctgaaatagaggatgatatattcaggaagaaacgactcacaattatggacctacatccgggcgcagggaaaactaaacgctatctccctgccatagtaagagaggcgatcaaacgaggattaagaacactaatactagctccaacacgagtagtcgctgccgagatggaagaagcgttacgaggattacctattaggtatcagacccctgcaatcaaaactgaacatactggtcgggagattgtggatctaatgtgtcacgcaacattcacaatgaggctgttaagtccagttcgagtgccaaactacaacttaataataatggacgaagcccattttacagacccagcaagcatcgcagcaagaggatatatctctacgagagtcgaaatgggtgaagcggctggtatatttatgaccgccacgccacccgggtcccgagacccgtttccacagtcgaatgcacctataatggatgaggaaagggaaatcccagaaagatcatggaactcggggcatgaatgggtcacagatttcaagggaaaaacagtttggttcgtaccaagcataaaagcaggaaatgacattgctgcttgtctaaggaaaaatggcaaaaaggtaattcaattaagcagaaagacctttgatagcgaatacgtgaaaacacgagcaaatgactgggatttcgtagtaacaactgacatatctgaaatgggcgcaaacttcaaagctgaacgtgtaattgatccaagaagatgtatgaaacccgtaatattaacagatggcgaagaacgtgtaatacttgcaggcccaatgccggttacacattcctctgccgcgcaaagaagaggaaggataggaaggaaccctaaaaatgagaatgaccaatacatctatatgggagaaccactcgagaatgatgaagattgtgcacattggaaggaagcaaaaatgttacttgacaatataaatacgcctgaaggaattataccatcaatgtttgaacccgagcgggaaaaggtagatgccatagacggagaataccgtttaagaggggaagcgcgaaaaacattcgtagatttaatgaggcgaggcgatctccccgtgtggctagcgtataaggtagcggcagaaggcatcaattacgcggatagaaaatggtgttttgatggaattaaaaataatcaaattctggaagaaaatatggaagtagaaatctggacaaaggaaggtgaacgtaagaaacttaaaccacgctggttagacgccaggatatactcggacccacttgcgcttaaagaatttaaagagtttgctgctggtagaaaatcattaacgctgaacttaataaccgagatggggcgcttaccgacgttcatgacccaaaaggctagaaatgcattagacaatttggctgtgttacacaccgcggaggccggtggtagagcctataaccacgccctttccgaactacctgagaccctggaaactctattactactcaccttattagcaaccgtcacaggaggtatatttttgttcttaatgtctggaaagggcatagggaaaatgacactcggaatgtgctgcattataacagcaagcatattactgtggtacgcgcaaatccaaccgcactggatcgcagctagtattatacttgagttctttcttattgttttactaattcccgaaccagaaaaacaaagaacaccgcaggacaatcaactcacctacgttgtcatagcaatattgaccgtagttgccgccacaatggcgaatgaaatggggtttctagagaagaccaagaaagatttaggactcggaagtgtaacaacacaggaatccgaatcaaatatactagatattgacttacgaccggcttcagcatggacgctatacgccgtagcgaccacgttcgtaacaccaatgctaagacactctattgaaaattctagtgttaatgttagcttgacagcaatagccaaccaggcaacagtcctaatgggtttaggaaaaggatggccattaagcaaaatggacataggagtgccactgctagcaataggttgttatagtcaagttaatccaatcacgctaaccgccactctgttaaggttcgtggctcaatacgccataatcggtcctggactacaggctaaggcaacgcgcgaagcacagaaaagagcagccgcgggcataatgaagaacccgacggtcgatggtataacagtcatagatcttgaaccgataccatatgacccgaaatttgaaaagcagctaggacaggtaatgctattaattctttgcgttacacaggtactcatgatgagaaccacgtgggccttatgcgaggctttgacacttgctaccggacccatctcgactctatgggaaggaaatccgggacgattctggaacactacgattgccgtctccatggctaacatctttaggggatcttatttagctggggccggtcttttattttcaattatgaaaaatacaacttcaacaagaagaggaacggggaacataggggaaactttaggtgagaaatggaaatcaagactgaatgccttaggaaagagcgaatttcaaatttacaagaaaagcgggattcaagaagtagaccgaacgctagcaaaggaaggcattaaaagaggagagaccgaccatcacgccgtctccagagggagcgcaaaattgagatggttcgttgaaagaaatatggtaacacccgagggaaaagttgtagatctcggctgtggtcgaggaggttggagttattactgcggtggtttaaagaatgtacgtgaggttaaagggttaacaaaagggggacctgggcacgaagaaccaatacctatgtctacctacggatggaatttagttagactacaatcaggtgtggatgtattctttactccgccagaaaaatgcgataccttattatgcgatatcggggaaagttcacctaatcctacaattgaagcaggtagaaccttaagagttctcaatctggtagaaaattggctcaataataatacacaattctgtataaaagtactcaacccatatatgcctagtgtgatagagaaaatggaggctctacaaagacaatatggaggtgccctcgttcgaaatcctttatcgcgaaattcaacacatgaaatgtactgggtaagcaacgcaactgggaacatagtttcctcagttaatatgatttcaagaatgttaataaatcgatttactatgaagcataagaaagcaacttatgaacctgatgtggacttgggtagcggaacaagaaatattggaatagaaagtgaaattcccaatttagacataattggaaaacgcatcgagaaaataaaacaagaacatgaaataagttggcattacgaccaggatcatccatataagacatgggcataccatggaagctatgagacaaagcaaacaggtagtgcgtcatcaatggtaaatggtgtagtccgcctcttaacaaaaccatgggatgtggttccgatggtcacacaaatggcaatgacagatactacccccttcggacagcaaagagtatttaaggaaaaagtcgacaccagaacccaagagcctaaagaaggaaccaagaaactaatgaaaatcacggcggagtggttatggaaagagcttggtaaaaagaaaaccccacggatgtgcacgagggaagaatttacaaagaaagttaggtcaaacgctgcactaggagccatatttactgacgaaaataaatggaaatccgcaagagaagcagtggaagacggtcgtttctgggaactggttgatcgcgaacgcaatcttcatctggaaggcaaatgcgaaacctgtgtatataacatgatgggcaaaagggagaagaaattaggtgaatttggcaaggcaaaaggatctcgggcgatatggtacatgtggctaggggccaggtttttggaatttgaagcactgggtttcctcaatgaagaccactggtttagtcgaggtaatagtctgagcggtgtcgagggtgaaggcctacatagactgggatacattctccgagatgtaggcaagaaagaaggcggagcaatgtacgcagatgatacagccgggtgggatacccgtataacccttgaagacctaaagaatgaagaaatggtgactaatcatatgaaaggagagcacaagaaattagcagaagcaatattcaagctcacttatcaaaacaaagttgtaagagtgcaaagaccaacaccaagaggaacggtaatggatataatctcacggagagatcaaagaggttcgggacaagttggaacatacggtctgaatacttttactaatatggaagctcaactgataagacaaatggaaggtgaaggtatatttaaatctattcaacatcttacggcaatagaagaaatagcagttcagaattggcttgcaagggtaggtcgagagagactgtcccgaatggcaatatctggggatgactgtgtcgtaaagccaatcgacgatcgcttcgcgtcagcgcttacggccctaaatgatatggggaaagttcgcaaagatatacaacaatgggaaccatccagaggatggaacgactggacacaagtccccttttgctctcatcatttccacgaattagtaatgaaagatggacgagtgctagtagtaccttgccgaaaccaagacgagttgatcggtcgcgccaggatatcacagggagctggatggagccttaaagaaacggcgtgcctagggaaaagttacgcacagatgtggacacttatgtattttcatcggagggatttaagattagctgcaaacgcaatttgttccgccgtaccctcacactgggtaccaacatcgagaactacttggtcgatccatgcgaaacatgagtggatgacgacggaagatatgcttgcagtatggaacagagtatggatccaagaaaacccatggatggaagacaaaaccccagtcgaaagttgggaagaagtaccgtacttaggaaaaagagaagatcaatggtgtggttcgcttataggactcacaagtcgcgcaacgtgggcgaaaaatatccagaccgctataaatcaagtcagatcattaataggaaacgaagaatatacagactacatgccgagtatgaaacgttttagaagagaagaagaggaagcgggagtactttggtag

SEQ ID NO: 22396 - RNA, 9876 nt, synthetic construct
  misc_feature 1..9876: note = derived and/or modified CDS sequence (opt6) from DENV-2__JN819424__SS-prME
  source 1..9876: mol_type = other RNA
acagccggagtaatcgtgatgttaataccgactgctatggcctttcacttgacaacaagaaacggtgaaccacacatgattgtaggacgacaggagaaaggaaaatctttgctatttaaaacagaagacggagtaaacatgtgtactctaatggcgatcgatcttggagaactatgcgaggacacgataacatacaaatgtccactactaagacaaaatgagccagaggatatagactgctggtgcaatagtacatcaacttgggtaacatacggaacttgtactacaacaggagaacatcgaagagagaaaagatctgtagccttagttccacacgtaggcatggggctggaaacaagaactgaaacgtggatgagctcggaaggggcttggaaacacgtacaacgaattgaaacatggatactgagacaccccggctttacaatcatggcagcaatactagcatacaccataggaactacccactttcagagagctctaatatttatattacttactgctgtagcacccagtatgaccatgcggtgcataggaatatcaaacagagatttcgtagaaggcgtatccggcggatcttgggtagatatcgtattggaacacggaagttgtgttactacgatggccaaaaataaaccaacattagactttgaattgattaaaacagaggcgaaacaaccggccacattaagaaaatactgcatagaagcaaaactaacgaacacaacgacagaaagtcgatgccctactcaaggtgaacccagcttaaacgaagaacaagataaacgatttatctgcaaacattcaatggtagaccgtgggtggggaaacggttgtggcttattcggaaaaggcgggattgtcacgtgcgcgatgtttacatgcaagaaaaatatggaaggaaaagtggttcaaccggaaaatttggaatatacaatagtaattacgccacatagtggcgaagaacacgccgtgggaaatgatactgggaaacacgggaaagagataaaaattacgccacaatcatcgattactgaggctgaattaactggttacggaacagtcacaatggagtgttccccacggacgggtctagacttcaatgaaatggtcctcttacagatggaagacaaagcatggctcgtacatagacaatggttcctggatctgccgctaccatggttacctggagctgatacccagggatcaaactggatacaaaaagaaaccttagtaacttttaaaaaccctcatgctaagaaacaggatgttgttgttttgggcagccaagaaggtgccatgcatactgcactaaccggagcaacagaaattcagatgagtagcggaaatttattattcaccggtcacctcaaatgccgactacgtatggacaaactgcaactaaaaggaatgagctacagcatgtgtaccggcaaatttaaaatagtaaaagagatcgcagaaacacaacatggaaccattgtaataagggtgcagtacgaaggagatggttctccatgcaaaatacctttcgaaataacagatttagagaaacgacacgtacttgggcgcctaattactgtcaatccaatcgtaacagaaaaagatagtccagttaacatagaggcagaaccgccattcggagactcctatatcataataggagtagagcctggacaattaaaattaaattggtttaagaaagggtcatcaataggccagatgtttgaaactacaatgcgcggggctaaaagaatggccatattaggtgacactgcttgggactttgggtcattaggcggagtttttaccagtatcggaaaagcactccaccaggtattcggagctatctacggagccgctttttccggagtttcttggaccatgaaaatcctgataggcgtaataattacgtggatagggatgaactcaagaagtacgtcactatcagtatcacttgttttagtcggagtggtaactttgtatctcggcgcggtagtccaagctgactcagggtgtgtagttagttggaaaaataaagaactcaagtgtggatctggtatatttataaccgataatgtacatacctggacggaacagtataagttccaaccagaatcgccaagcaaattggcctcagcaatccaaaaggcacacgaagaagggatatgcggaatacgttcggtcacaagattagagaacttaatgtggaaacaaataacaccagaactgaaccatatcctgtcggaaaatgaagtaaaactaacgataatgacaggggacatcaaaggcattatgcaggcgggaaagaggagtttacgaccccaaccgactgaactcaaatatagttggaaaacatggggaaaagcaaaaatgctctcgactgaatcccataatcaaacgttcttaatagatggacccgaaacagcagaatgccctaacaccaatcgtgcctggaactcattagaagtggaagattacggttttggtgtattcaccacgaatatttggctaaaactacgggaaaaacaagatgtgttttgtgatagcaaattaatgtcagcttcaagcatcgataatagagcagtgcacgcagatatggggtactggatggaatctgccccaagtgatagttgtaaaatggaaaaagcgagttttatcgaggacaaatcatgctattggccaaactcacaacacctatggtcaaatggtgtcttagagagcgaaatgatttttcccaagaacttcgcagggccggtgtcgcaacatatttataggccgggttatcatacgcaaactgctggcccgtgtaacctaggtaaactagagatggactttgacttttgcgaaggtaccactgtggttgtaacagaagattgtggaaatcggggcccgtctctgagaacaacgactgcttcaggaaaattaatcacagaatggtgttgtcgttcatgtactctaccaccgcttaggtatcgaggagaagatggttgttggtatggaatggaaatacgacccctcaaagaaaaagaagaaaatctagttaatagtctggtgacagctggccacgggcaaatcgacaacttttctttgggtgtactaggaatggcgttattcctagaagaaatgttaagaacccgcataggcactaaacatgctatattgctcgttgccgtttcttttgtgacattaataacaggaaacatgtcatttagagacctaggtagagttatggtgatggtcggagctacgatgaccgatgatatcggtatgggtgtcacatatttggccttactggcagcttttaaagtacggccaacttttgcagccggcctcctcttacgaaaattaacaagcaaagaactaatgatggctaccataggaatagctttattaagtcaatccacgataccagaaacaatccttgaactgacggatgcgctcgccttgggaatgatggttctgaaaatagtaagaaacatggaaaaataccagctagcggtgacgatcatggcgattagctgcgtacctaacgcagtaattttgcaaaatgcttggaaagtgagttgcaccatattagctgccgtttcagtgtcgcctttgttacttacgtcaagtcaacaaaaagcggactggataccactcgcactgacaattaaaggtttaaacccaacagcaattttccttacaacacttagtagaacctcaaagaaacgatcatggccactgaatgaagctatcatggcagtaggaatggttagtattctggccagtagcttactcaaaaacgatattccaatgactggtcccttggtagctggaggacttctaacagtttgttacgtattgacggggcgatcggcagatttagaattagaaagggcggccgatgttaaatgggaggatcaagcggagatatccggaagtagtccaatattatccatcacgatttcagaggatgggagcatgagtataaagaacgaagaagaagaacaaaccttaactattttaatacgcactggtctacttgtaatctctggtgtttttcccgtatcgatacctatcacggccgcagcatggtatctttgggaagtcaagaaacagagagccggtgtcctttgggatgtgccgtcaccaccgcccgttgagaaagcagagttagaagatggagcctacaggataaagcaacgtggtatattaggatattcacaaatcggtgcaggagtgtacaaggaggggacatttcataccatgtggcacgttacaagaggtgcagtcctgatgcacagaggcaagcgtatcgaacctagctgggccgacgtcaagaaagacttaataagttatggtggtggttggaaattagagggagagtggaaagaaggggaggaagttcaagtgctggctttagaacctggcaaaaatccaagggcggtccaaaccaagccgggaatctttaaaactaatacgggcacgattggagcagtgagtttagactttagtccagggacaagcggaagcccaatcgtggatagaaagggtaaagttgtgggcctatacggaaacggagtagtaacgagaagtggtgcatatgtcagcgccatcgcgcagacggagaagagtatagaagataatcctgaaatagaagatgatattttcaggaagaaacggctaacaattatggatctacatcctggagctggcaaaactaaaagatacctgccagcaatagttcgagaagccataaaacggggactaagaactttaattctagcacctacgcgggtggtagctgctgaaatggaagaggcattaagaggattgccaataagatatcaaacgccagcgattaagaccgaacataccggtcgtgaaatcgtagatttaatgtgtcatgccactttcacaatgcgtttactatccccagtaagggtcccgaattacaatcttataatcatggacgaagctcattttacagaccccgcatcaatcgccgctagaggatacattagtacaagagtagagatgggcgaagcagctggaatatttatgaccgctacaccaccgggctcacgagaccctttccctcaaagcaatgctccaattatggatgaagaaagggagatacctgagaggagctggaacagtggccatgaatgggtaacggattttaagggaaagactgtgtggtttgtgccaagcattaaagccggtaacgacattgccgcatgtttacggaagaatgggaagaaagtcatacaactaagcagaaaaacattcgattcggaatacgttaaaactagagctaatgactgggattttgtcgtgactacagacattagtgagatgggagcaaactttaaagcagaaagagttattgaccctagacgatgtatgaagcctgtcatactaactgacggagaagaaagagtcattttggcaggtcctatgcctgttacccatagttccgcggcacaacgtagaggtagaattggcagaaaccctaaaaatgaaaatgatcaatatatctatatgggagagcccttagaaaacgatgaggattgtgcccattggaaggaggcaaaaatgttgttagacaacataaacactccggaaggaattattccatctatgttcgaacccgaaagagaaaaggtggaggcaatcgacggcgaatatcggttgagaggtgaagcgagaaaaacattcgtagatttaatgagacgtggagatttacctgttcgtcttgcttataaagtagctgcagaaggcataaattatgccgatcgaaagtggtgttttgatggaatcaaaaatagccaaatactggaagaaaacatggaagtagagatatggactaaagagggcgagagaaagaaattaaaaccaaggtggttagatgcaagaatttatagtgatcccctggccttgaaagagttcaaagagtttgctgcaggtcgaaaatccctaactctcaacttaattacagagatgggaagactcccaacttttatgacacaaaaggcccggaatgccttggataacttagccgtcctacacacagcggaagccggaggtagagcatataaccatgctctttccgaactaccagagacattagaaactctccttctgcttacgcttttagcgaccgtgacaggagggatatttttgtttctaatgtctggaaaaggaataggcaaaatgacattaggcatgtgctgcataattactgcatctatcttgttatggtacgcacaaattcaacctcattggatagcagcgtcgatcattttggaatttttcttaatagttcttcttatacctgaaccagaaaagcagagaacacctcaagataatcaattgacgtatgtagtaattgctatcttaaccgtagtagcagccaccatggctaacgaaatgggattcctagagaaaacaaagaaagatctagggctaggatcaatcacaacgcaagagagtgaatccaatatattagatatagacctcaggcccgcttcagcttggactttatacgcagtcgcaacaactttcgtgactccaatgctacgtcatagtatcgaaaattcatccgtgaacgtgtccttgactgcaattgcaaaccaagccactgttttaatgggattaggcaaaggttggccgttgtcaaaaatggacatcggagtacccttattagcaatcggatgttatagtcaggtcaacccaataacattaacggctgctttattgctattagtagcccattacgctattattggccccggcctacaggctaaggcaactcgtgaagcccaaaaacgagcagctgcgggtataatgaaaaatcccactgtagatggtatcaccgttatcgacctagagcccataccatatgaccccaaatttgagaaacagctaggtcaagtgatgttactaatactatgcgtgacccaagttctaatgatgaggactacttgggctctatgcgaggcactgactctggccactggaccaataagtaccctgtgggaaggtaaccctggacgattttggaatacaacaatcgcagtcagcatggcaaatatattccgtggaagttacctagcaggagctggattgttattttccataatgaaaaatacgacatcaactcgaagaggtacgggcaatattggagagacattgggagaaaaatggaaaagtcgactaaacgcgctgggtaaaagtgagttccagatatacaagaaaagtggcatacaggaagtagaccggacattggccaaggaaggaatcaaaagaggagaaacggatcaccatgcggtatcaaggggaagcgcgaaactaagatggttcgtagaacgcaacatggttacacccgagggcaaggtagttgatttagggtgtgggcgaggtggatggtcttattattgtggaggattaaagaacgtcagggaagtcaaaggattaaccaaaggcggaccgggtcatgaagaaccaatcccgatgtcaacctatggatggaatctagtgagactacaaagtggcgttgatgtattctttacacctccagaaaaatgtgacacactattgtgtgatataggagagagctcaccaaatccaacaatagaagccggaagaactcttcgtgtcttaaacctagttgagaattggctaaacaacaacactcagttctgtataaaagttctgaatccatatatgccgagcgtcatagaaaagatggaggccttacagagacaatatgggggagcgcttgttagaaaccccttaagccgcaactcgacacacgaaatgtactgggtgagcaatgccaccggaaacatagtatctagtgttaatatgatatccagaatgttgattaataggtttacaatgaagcacaagaaagctacgtacgaacccgatgtagacctaggaagcggcacaaggaatataggaattgaatctgaaatacccaatctagatataatcgggaaacgtatagagaaaattaaacaggaacatgaaatttcatggcactatgatcaagaccacccttataaaacttgggcgtatcatggctcatatgaaactaaacaaaccggaagtgccagcagcatggttaatggtgtagtaagattactaactaagccatgggatgtggtcccgatggtaacacaaatggcaatgacagacaccacaccttttggacagcagagagtattcaaagaaaaagtcgatacacgcacccaagaaccgaaagaaggtactaaaaagttaatgaaaattaccgctgaatggttatggaaagagttaggcaagaagaaaacacccagaatgtgcacgagagaagaatttaccaagaaagtaagatctaacgccgctctaggggcaatatttacagatgaaaataaatggaaatcagccagagaggctgttgaagatggacgattttgggaattagttgatagggaaaggaacttacatttagaaggcaaatgcgagacatgtgtttataatatgatgggtaaaagggaaaagaaactcggtgaatttggaaaagcaaaaggcagcagagctatatggtacatgtggttaggggcccggttcctagaatttgaggcgctcgggtttctgaacgaagatcattggttctcaagaggaaatagtctgtctggtgttgaaggagaagggctacataggcttggctacatattgagggacgtagggaagaaagaaggaggagctatgtatgcggatgacactgcgggatgggatacacgtataacactcgaagaccttaaaaacgaagagatggtaactaatcatatgaaaggggaacataagaaattagccgaagcaatttttaaactaacttatcaaaataaggtcgttcgtgtacaaaggccaactccccgtgggacagtgatggatataataagtcgtcgagaccaacggggctccggccaagtaggtacgtacgggttaaacacatttacgaatatggaggctcaactcattcggcaaatggaaggtgaaggtatctttaaaagtattcaacatctcaccgctacagaagaaatagcagtccaaaattggctcgcacgagtaggaagagaaagattatcgagaatggctatctctggggacgattgtgtcgttaaacctatagatgatagatttgctagcgcattaaccgcacttaatgacatgggaaaggtacgaaaagacatccaacaatgggagccaagtaggggttggaatgattggacacaagttcccttctgttcacatcattttcatgaacttgtgatgaaagatggtcgtgtcctagtagttccttgtagaaaccaggacgagctaattggcagagcaaggatttctcaaggcgcgggatggagcctgaaggaaaccgcgtgtttgggtaaatcatatgcacaaatgtggaccttgatgtacttccatcgcagggatctgagattagcagccaacgcgatatgtagcgccgttccaagccattgggtacccacctcacggaccacttggtcgatccatgcgaaacatgaatggatgacgaccgaagacatgctggcagtatggaacagagtgtggatccaggaaaacccttggatggaagacaagacaccggtggagtcgtgggaggaagtaccataccttgggaagagagaagatcaatggtgtggcagtttaatcgggctaacttcacgcgcaacgtgggccaaaaatatacaaacagccattaatcaagtacgttctttaataggcaatgaagaatacactgattatatgccaagcatgaaacgatttcggcgagaagaagaagaagccggagtgctgtggtga

SEQ ID NO: 22397 - RNA, 9876 nt, synthetic construct
  misc_feature 1..9876: note = derived and/or modified CDS sequence (opt6) from DENV-2__FJ744741__SS-prME
  source 1..9876: mol_type = other RNA
acagctggagtgatagtaatgttaatacccacggccatggcatttcatcttactacacgcaatggagaaccgcatatgattgtcgggcgtcaagaaaaaggaaaatcgttattgttcaaaactgaagatggcgtaaatatgtgtactcttatggctatagatttgggcgaactgtgcgaagacacgattacgtataaatgtcctctcttgagacaaaacgaaccagaagatattgactgctggtgcaactctacaagtacatgggtgacatatgggacatgcacgactaccggagaacatagaagggaaaaacgtagcgtagcactggttccacacgtcggaatggggttggaaactagaacggaaacatggatgagttctgagggggcttggaaacacgtacaaagaatagaaacctggattctaagacacccaggttttacaattatggcggcaattctagcatacaccatagggactactcattttcaaagggcactaatctttatccttttgaccgcggtagcgccatcgatgacaatgaggtgcataggcatatctaaccgggactttgtggaaggggtatcaggcggatcttgggtcgatatagtactcgaacatggtagttgcgtaactacaatggctaaaaataaaccgaccttggacttcgaactaataaaaacagaagcaaaacagccggcaacactaagaaaatattgtatagaagctaaactgacaaatactacgacagagagcagatgtccaactcaaggtgaaccatcacttaatgaagaacaggacaaaagattcatttgcaaacatagcatggtagacagaggctggggaaacggttgtgggctttttggaaaaggcggaatagttacatgcgctatgtttacctgtaagaaaaatatggaagggaaagtagtccaacctgaaaacctcgaatatacaatagtgatcacccctcattcaggcgaagaacatgcagtaggaaacgatacagggaaacacggcaaagaaataaaaattactccccagtcaagtataacagaagctgaactcacaggatatgggacagtgaccatggaatgttccccacggacaggtctcgatttcaatgaaatggtcttactacagatggaagataaggcttggttagtacacagacaatggttcttggatctccctttaccatggttaccgggagcagatacgcaagggtctaattggattcaaaaagagactttggtcactttcaaaaatccacacgccaagaaacaagatgtagtcgtcctgggctcacaagagggcgcgatgcatacagcgctgactggagcaacagaaatacaaatgtcctctggaaatctgctttttaccggccatttaaaatgtcgactgagaatggacaaattacaattgaaaggaatgagttatagcatgtgcacaggaaaatttaaaatagtaaaagaaattgccgaaacacagcatgggaccattgttatacgagtacaatacgaaggcgacggatcaccctgcaaaataccttttgaaataacggacctagagaaaagacatgtattaggacgattaatcacagttaaccccattgtaactgaaaaagactcgccggtcaacatcgaagcggagccgccctttggagatagttacatcatcatcggagtggaaccaggacaattgaaattaaattggttcaagaaaggttctagtataggtcagatgttcgaaactacaatgaggggagccaaacggatggcaattttaggagatacagcatgggactttgggagcttaggaggggtatttacatcaatcggaaaagccctacatcaggtgttcggagcaatatatggagccgcattttcaggagtttcttggaccatgaaaatcctaataggagtcataattacatggattgggatgaactctcgctcgacaagcctatcagtgtcacttgtattagtgggagtcgttactctatatttgggagcaatggtccaagccgactcaggatgtgtagtttcgtggaaaaacaaagagctcaaatgtggtagtggtatttttataacagacaacgtccacacgtggacagagcaatacaaattccaacctgaatcaccgagtaaactcgctagtgcaattcaaaaagcccacgaagaaggtatttgcggaatccgttcggtaacccggttagaaaatctgatgtggaagcagataacccctgaattaaaccatatactgagcgaaaatgaagttaaactaacaataatgactggagatattagaggtataatgcaagcaggtaaacggtctctcaggccacaaccaactgaactaaaatactcctggaaaacatggggaaaagcaaagatgctgtcgactgaaagccacaaccaaacatttcttatagatggtccagaaacagcagagtgtccaaacacgaatagagcatggaatagtctcgaagtagaggattatggctttggggtgttcaccacgaacatttggttgaaacttcgcgaaaaacaagacgtattttgtgacagtaagttaatgtctgcagcaataaaagataaccgtgcagttcacgccgacatggggtattggatagaatcggctctaaacgacacctggaaaatggaaaaagcatctttcattgaagtaaagagttgccattggccgaaaagccacacactatggagtaacggtgtattggaaagcgaaatgataattcctaaaaacttcgcaggaccggtctcgcaacacaattaccgccctggctatcacactcaaacagccggaccgtggcatttgggaaaactcgagatggactttgacctatgtgaaggaacaacagtcgtggttacagaagattgcggtaatcgaggcccctcacttaggacaaccacagcaagcggaaaattaataactgagtggtgttgccgcagttgtacattgcctccactccggtacagaggcgaggatgggtgctggtatggcatggagattaggcctttaaaagagaaagaagaaaacctggttaattctttagtaacagcagggcatggacaaattgataatttttccctaggtgtattgggtatggccttgtttctagaagagatgctaaggactcgaattggaactaagcatgcaattctattggtagctgtgagttttgtgacattgattacgggcaatatgtcattccgggacttaggaagggtgatggtaatggtgggcgcgacaatgacggatgacataggaatgggtgtaacttatttagcccttttggcagcgtttaaagtaagaccaacattcgcggctggtctcctactaagaaaactgacctcaaaggagttgatgatggcaactataggaatcgctcttttatcgcaatcaaccataccagaaacgatattagaactaactgacgcactcgcgttaggtatgatggtcctcaaaattgtccgaaacatggaaaaataccaacttgccgtgacaatcatggcaattagctgtgtcccaaatgcggtgattctacaaaatgcatggcgcgtaagctgcacaattttagccgcagtttccgtatcgcctttgcttttaacctcctcccagcaaaaagctgattggattcccctcgcattaacaataaaaggactaaatcctacggcaatattcttaacaaccctaagtcgcacgagcaagaaaagatcctggcctctgaacgaggcaataatggccgttgggatggtgtcaatattagcctcctcgttattgaagaatgatattccaatgacagggccgctagtagcaggaggcttactgacagtatgctatgtattgacagggaggtcggcagaccttgagctagaaagagccgccgatgtgaaatgggaagatcaagcggaaatatcgggttcttcccctatacttagtataacaatatcagaagatggatcaatgtcaatcaaaaacgaggaagaggaacaaacactcacaatactcattcgtacaggacttttagtgatctccggggtcttcccagttagtataccaattactgcggcagcgtggtacctgtgggaagtcaagaaacagcgcgctggcgtattatgggatgtaccttctccacccccggtagaaaaagcggaattagaagatggtgcatatagaatcaaacaaagagggatattagggtactcacagataggggcgggtgtgtacaaagaaggcaccttccacaccatgtggcatgtaactcgcggagcagtgctaatgcacagaggcaagcggattgaaccatcatgggcagatgttaagaaagacttgatttcttatggtgggggctggaaacttgaaggtgaatggaaggaaggagaggaggtacaagtgttagcactcgaacctgggaagaatccaagggctgtacagaccaagcctggaatctttaaaacgaatactgggacaatcggagctgtttcgctagattttagcccgggtacttctggatcacccattgtagatcgaaaaggaaaagtggttggtttatatgggaacggagtagtaacaagaagcggagcgtatgtgtcagcaatagcacaaacagagaagtccatagaagacaatccagaaatagaagatgatatttttcgaaagaaacgccttacgataatggatctccatcccggagctggaaaaacaaagcgatatctacccgccatagtaagggaagcaataaagagaggtctccgcaccctaatcttagcaccaacccgcgtggtagcggcagaaatggaagaggccctaagaggattacctattagatatcaaaccaccgctatcaaaacagaacatacaggacgagaaatagtcgacctgatgtgtcacgcgacatttaccatgcgtctattaagcccagttagagtgcccaattataatctcataataatggatgaagcgcattttactgatccagcttcaattgcagcacggggatatatttccactagagtcgagatgggcgaagcggcgggcatttttatgacagctacacctccaggctcaagagacccattccctcaaagtaatgcgccaataatggatgaagaaagagagatacctgaaaggtcatggaatagtgggcatgaatgggtaacagattttaaaggaaaaactgtttggtttgtaccttcaatcaaggctggcaacgacatagcagcttgtttacggaaaaatggtaagaaagtaattcaactgtcaagaaaaacgtttgattcagaatacgtaaagactcgagcaaacgattgggactttgtagtaactacagatatatctgaaatgggcgcaaactttaaggctgaaagggtaatcgaccctagaagatgtatgaaaccagtgatattaactgacggagaagaacgagtcatactagcaggtccaatgccggttacccatagttcggcggctcaaagacgaggtaggataggacgaaatcccaagaacgaaaacgatcaatacatttacatgggggaaccactagaaaacgatgaagattgcgcacattggaaagaagcgaagatgttattagataacataaatacccctgaagggataataccatcgatgttcgaacctgaaagagaaaaggtggatgcaatagatggagaatatagactaagaggcgaagcacgtaaaacttttgtagatttaatgcgcaggggagatttacccgtatggctcgcatataaagtagcggcagaggggataaactatgctgacaggaaatggtgttttgatggcattaagaataatcaaattctagaagagaacatggaggtggaaatttggactaaagaaggtgaaagaaagaaacttaaacccagatggttagatgcgagaatatactcggatcctttagcactaaaggaatttaaagaatttgcggcgggaagaaagtcactaacgctaaatctaataacggaaatgggaagattgccgacatttatgactcagaaagctagaaacgcgttagataatttagctgtgctacatacagccgaagctggtgggagagcatataatcatgcattaagtgaacttccagaaacattagaaacgctactgttattaacgttactagcaacagttaccggcggcatattcttgtttctaatgagtgggaaagggataggaaaaatgactctcgggatgtgttgtattataactgccagtatactactttggtatgcgcaaatacagccacattggatagcggcttcaataattctagagttcttcctgatagttttactaataccagaaccagagaaacagcgcacgccacaggataaccagcttacgtacgttgtgatagcaatactaactgtagttgcagcaacaatggctaacgagatgggatttttagagaagactaagaaagatctcgggcttggtagcattactacacaagaaagtgaatcaaacatattagatattgacctgcgacctgcctcagcttggactctatacgccgtcgcgactacgtttgttaccccgatgttaagacattcgatagaaaattcatcggtgaacgtatcacttactgcgatagcaaaccaggccaccgtactaatgggacttgggaaaggatggcctttgtctaaaatggacattggtgttccgctacttgcaatcggatgttacagccaggttaacccaataactctaactgctgcactattactattagtagcgcactacgcaataataggccccggtcttcaagctaaagctaccagagaggctcagaagcgagcagctgctggtataatgaaaaacccaacagttgatggaataacagtaatcgaccttgaaccgattccttatgaccctaaatttgaaaaacaactcgggcaggtaatgctgcttatactatgcgttacgcaagttttaatgatgaggacaacatgggcactatgtgaagccctaacactcgcaacgggtccaatatctacgctgtgggaaggcaatccggggaggttttggaatacgactatagctgtatctatggcaaacatatttagaggaagctatcttgctggcgcaggcctattatttagcatcatgaagaataccacaaacacaagaagggggactggaaacataggggaaacattaggggaaaaatggaaaagtagactaaacgcattgggcaagtcggagttccagatatataagaaatctggaatccaggaggtcgatagaacgttggccaaggaaggtataaaacgaggggaaacggatcatcacgcggttagcagaggtagcgctaagctacgctggtttgtagaacgaaatatggtaacacctgaaggtaaagtagtcgacttaggttgtggcagagggggttggtcatactactgtggaggtcttaaaaatgttcgtgaagtaaaggggctaacgaaaggcggacctgggcacgaagaaccaatacccatgtcaacgtacggatggaacttagtcagattacaatcaggcgtagatgtattctttactccaccagaaaagtgtgataccctactttgcgacattggagaatcgtcgccaaatcctaccatagaagcaggtagaacattaagagttctcaatttagtagaaaactggctaaataataatacacaattctgcataaaagtactaaacccttacatgcctagcgttatagagaaaatggaggcactgcaaaggaaatatggcggcgcattagttcggaacccgcttagcagaaactcaacgcatgaaatgtactgggtctccaatgcaacagggaatatagtcagttcagtcaatatgatatcaagaatgctaattaatcggtttacgatgaaacacaagaaagccacatatgagccagatgttgacttggggtcaggcacccgaaacataggcatagaatcagaaataccaaaccttgacattattggaaaaaggatcgagaaaattaagcaagaacacgagacctcatggcactatgatcaagatcacccatacaaaacgtgggcctatcacggatcatatgaaaccaaacaaaccggtagcgcatcttcaatggtgaatggcgtagtcaggctcctgacaaaaccgtgggatgtagttcctatggtaacacaaatggcaatgacagatactactcctttcggtcaacagcgagtatttaaagaaaaagtcgacacacggactcaggaaccaaaagaagggaccaagaaactaatgaaaattacagcggaatggttatggaaggaattagggaagaagaaaactccaaggatgtgcaccagggaagaatttacgcgaaaggtacggagtaacgcagcgttaggagcaatattcactgatgaaaataaatggaaaagcgcaagagaagcagtcgaagacgggagattttgggagttagtcgacagagaaagaaatttacacttggaaggaaaatgtgaaacctgtgtgtataatatgatgggcaagagagagaagaaacttggtgaatttggaaaggcgaaaggatcacgggccatatggtacatgtggttaggagcccgatttttagagtttgaagcattaggattcctaaatgaagaccactggttctccagaggcaacagtctatctggagtcgaaggtgaaggtctccatcgactgggatacatactccgcgatgtgggaaagaaagagggtggcgccatgtatgctgatgacacagctggatgggatacaagaatcacattagaggacttgaaaaacgaagagatggtcactaatcatatgaaaggtgaacacaagaaactcgccgaagcaatattcaaactcacatatcagaataaagttgtaagggtacaaagaccaacacctagaggaacagtcatggatataataagtcggagagatcaaagaggttcaggccaagttggaacatatggtctaaacacgtttacaaatatggaagcacaactaattagacagatggaaggcgaaggcatatttaaatcaatccagcatctcacagccaccgaggaaatcgcagtacaaaactggttggcgcgtgtagggcgcgaaagacttagtaggatggcgatctccggggatgactgtgtagtaaagcctattgatgatagatttgcatcagcattaaccgcacttaacgatatgggtaaagttcgtaaagacattcaacaatgggagccatcacgtgggtggaacgattggactcaagtacctttctgctctcaccactttcacgagttagttatgaaagatggccgggttctagttgtaccatgcagaaatcaggatgaactaatcggtcgagcaaggatatcacagggggccggatggagtttgaaagaaacagcttgcctaggaaaatcatatgcacaaatgtggacactaatgtatttccataggcgggacctaagactagccgcaaacgctatatgcagcgcagttcctagtcactgggttccaacatccaggactacatggtcgatacacgccaaacacgaatggatgactacggaagatatgttagcagtttggaatagagtatggatccaagaaaacccctggatggaagataaaactccagttgagagctgggaagaagtaccctaccttggaaaaagggaagatcaatggtgtggcagcttaataggcttaacctctagagcaacgtgggccaaaaatatacaaactgcgataaatcaagtaaggagtctgatagggaatgaggaatatacagactacatgccgtcaatgaagcgattcagaagggaggaggaagaggctggcgttctttggtga

SEQ ID NO: 22398 - RNA, 9876 nt, synthetic construct
  misc_feature 1..9876: note = derived and/or modified CDS sequence (opt6) from DENV-2__FJ744703__SS-prME
  source 1..9876: mol_type = other RNA
acggctggagtaatagttatgttaatcccgactgcaatggcatttcatttaacgactcgtaatggagaaccccacatgatagtgggtcgtcaagaaaaagggaaatcacttttatttaaaactgaagatggagtgaatatgtgcactttaatggctatagatttgggtgaactatgtgaagacactattacctataaatgcccccttcttagacaaaatgagcccgaagacatcgactgctggtgcaatagcacgtctacctgggttacttatggaacatgtaccactacaggagaacacagaagagagaaaaggagtgttgctctagtcccccacgtcggtatgggacttgaaaccagaactgaaacgtggatgagcagcgaaggtgcatggaaacacgtacaaagaatagaaacctggatattgaggcatccaggatttacaattatggcggcaatcctcgcatacactattggaacaacacactttcaaagagcgttaatctttatattgctgactgcggtagcaccctctatgacaatgcgttgcattggaatctcgaatagggactttgttgagggggttagtggaggatcatgggtggatatagtactagagcacggatcctgtgttactacaatggcgaaaaacaaacctacactagatttcgaactaattaagacagaggcaaagcaaccagcaaccttgaggaagtattgcatcgaagcaaaactgactaataccactacagagagccgttgccccactcagggagagcctagtctaaatgaagaacaagataaaagattcatatgcaaacacagtatggttgatcgaggatggggtaacggatgtggtctattcggaaaaggcggcatagttacttgcgcaatgtttacttgtaagaaaaacatggaagggaaagttgttcaaccggaaaacctagaatatacaatcgttataacaccacactccggtgaagaacatgcagtaggtaacgacacgggcaaacacggaaaagaaataaaaatcacgccgcaaagctcaataactgaggcagagttaacaggttatggaaccgtaactatggaatgtagtcctcgcactggtttagattttaatgaaatggtattgctacaaatggaagataaggcatggttagtgcaccgacaatggtttttggatttgcccttaccttggttaccaggcgcggatactcaaggaagcaattggatacaaaaagaaactttagtaacatttaaaaatcctcacgccaagaaacaagacgtcgtagttctcggatctcaagaaggggcgatgcatacagctttaaccggagcgacagaaatacaaatgtcatcaggcaatcttctttttacaggtcatcttaaatgcagattacggaccgacaaacttcaattaaaagggatgtcatattccatgtgtacaggtaaatttaaaattgtaaaagaaattgcagagacacaacatggaacgatagtaataagggtacagtacgaaggggacgggtctccatgtaaaataccatttgaaataacagacttagagaaacgacacgtacttggcagactcatcactgtgaatcccattgttacagagaaagattcgccagtcaacatagaagcggaacctcctttcggagacagctacataataataggagtcgaacccggacaattaaaacttaactggttcaaaaaggggtcatcgataggacaaatgttcgaaactacaatgaggggagcaaaacgaatggccatcctgggcgatacagcttgggattttggttcgttaggaggtgtattcacatcgattggaaaagcactgcatcaagtttttggagcaatttatggagcggcttttagtggtgtgtcttggaccatgaaaatattaatcggcgttataatcacctggataggtatgaactctaggtcaacaagtctatcggtaagtctagtattagtaggtgtagtaacattatacctaggagcggtagtacaagcagactccggctgtgtagtatcatggaaaaataaagaattaaagtgtgggtcgggaatatttatcacagataacgtccatacatggacagagcaatataaatttcaacccgagtcaccgtctaaactggccagtgcgattcaaaaagcgcacgaagaagggatctgtggaataagaagtgtcacccggttagaaaatctgatgtggaagcaaatcacaccagagctaaaccacatacccagtgagaatgaagtaaaattgacaatcatgacaggtgacataaaaggtattatgcaggctggtaaacgatctttacgacctcaaccgacggaacttaaatactcatggaaaacgtggggtaaagctaaaatgttgagtacagagagtcacaatcaaacattcctcattgatggtcctgagacagcagagtgcccaaacacgaatagagcctggaactctttggaagtagaagactacggttttggggtatttactactaatatatggctgaaactccgagaaaagcaagacgtattttgtgatagcaaattgatgagtgcggccataaaggataaccgcgctgtgcatgctgatatgggttattggatcgaatcagccttgaatgatacatggaagatggaaaaagcgagtttcatcgaagtaaaatcctgccattggcccaaatctcacactctttggtctaatggagtcttagaatctgagatgataatacccaaaaattttgcaggccccgttagccagcataattatagacctggataccatacccaaactgctggaccgtggcacctaggaaaactagaaatggacttcgacttctgtgagggtaccacagtagttgttacagaagattgtgggaacagaggaccatcgcttagaacaacaacagcctcgggtaaactgattacagaatggtgttgtaggagttgtaccctaccacccctcaggtaccgtggagaggacggctgctggtatgggatggaaataaggcctctgaaagaaaaggaagaaaacctcgtgaatagtctagttacggcaggccacggtcaaatagataacttcagcttaggtgtattaggcatggctttgtttttggaagaaatgcttaggactagaattggaacaaaacacgcaatattgctcgtagcagtatccttcgttacactcattacaggtaatatgtcattccgagatttaggacgagtgatggtgatggtaggagctactatgacagatgatattggaatgggggttacctatctagcattacttgctgcatttaaagttcgaccaacttttgctgccggacttttattacggaaactgacgtctaaagaattgatgatggctactataggaatagcgctgctatcacagtccacgataccagaaacaatattggaactaacggatgctttggccctaggcatgatggtactaaaaatagttcgaaatatggagaaatatcaactagcagtaacgataatggcgatcagctgtgtaccaaacgctgtcatattacaaaatgcgtggaaagtatcatgcacaatattagctgcagtctcagtttctccactcctactgacctcatcacaacaaaaggcggactggatcccgttagcactcaccataaaagggttaaatccaactgcaatatttctaacaaccctatctcgtacttctaagaagagaagctggccactaaacgaagcgattatggcagtaggtatggtatcaatattagcgagttcccttttaaagaatgatattccaatgactggtcctttagttgcaggaggattactgaccgtctgctacgttctaacaggaagatctgctgacctagagctcgaaagggcagcagatgtgaaatgggaagaccaggccgaaatttcaggcagtagcccaattctttctatcaccatttcagaagatgggtcaatgagcattaaaaacgaagaagaagaacaaaccctaaccatattgattagaacgggtttactggtaatcagcggagtatttcctgtatccataccaataactgctgcagcttggtatttatgggaagtgaagaaacaacgggcgggagtcttgtgggacgtacctagcccaccaccagttgaaaaggcagaactggaagacggcgcctatcggataaagcagagaggtattctgggatatagtcaaataggtgcaggggtatataaagaggggacctttcatactatgtggcacgtaacaaggggagctgtgctaatgcacagaggcaaacgaattgaacccagctgggctgacgttaagaaagacttaatcagttatggagggggttggaaattggagggagaatggaaagaaggtgaggaggtccaagttctggctcttgaaccaggaaagaacccaagagcagtgcaaaccaagccgggaatttttaaaacaaacacaggaaccattggtgccgtaagtcttgatttttcgcccggaacgtctggatctccgattgtcgacagaaagggaaaagttgtaggactgtatggaaacggtgttgttaccagatcaggggcttacgtctccgcaattgcacaaacagagaaaagtattgaagataatccggaaatagaagatgatatttttcggaagaaaaggttaaccataatggacctgcacccaggtgctggaaaaaccaaacggtatcttccagcgattgtcagggaagctatcaagagaggtcttagaactttgatccttgcccccactcgagtcgttgcagcagaaatggaggaggctttacggggacttccgattaggtaccaaactcccgccattaaaactgaacatacaggtagggagatagtagatttaatgtgtcatgcaacgttcaccatgaggctgttatcgcctgtaagagtaccaaactataatttaatcattatggatgaagcccattttacggatccagcaagtattgcggcaagaggttatatttcgacacgtgtggaaatgggtgaagctgctgggatttttatgaccgcaacaccacccggttccagagacccattcccacagtcaaatgccccaatcatggacgaagaacgcgagatacccgaacgctcatggaactcaggtcacgaatgggtgactgactttaagggtaaaacggtatggtttgtgccatctattaaggcagggaatgatatcgctgcttgtctaagaaagaacgggaagaaagtaatacagctctccagaaaaacatttgattcagaatacgtcaaaacacgagcaaacgactgggattttgtagtaacaacagacatctcggaaatgggagcaaactttaaggcggaacgtgtcatagatccaagaagatgcatgaaaccagtaatcttaactgacggcgaagaaagagttatacttgccgggccaatgccggtcactcattcgtcagcagcgcaacgacgaggaagaatcggccgaaatcctaaaaatgaaaatgatcaatatatatatatgggagagcccctagagaacgatgaagactgtgcgcactggaaagaagcaaagatgttattagataatataaacacccctgaaggaataataccatcgatgtttgaacctgaacgggaaaaagtagatgcaatagatggagaatatcgattacgtggagaagcaagaaaaacgttcgtcgacctaatgagaagaggggacctcccagtatggttggcgtacaaagtcgcagctgagggaattaattatgcagatcgcaaatggtgctttgacggaattaaaaacaaccaaatattagaagaaaacatggaggttgagatatggacaaaagaaggggagaggaagaaacttaaaccacgctggttagacgcgcggatatatagcgatccgttagccttaaaagaatttaaagaatttgctgcaggcagaaaatcattaaccttgaatcttataaccgaaatgggaagattacctactttcatgacccaaaaagcacgcaatgccctagataatttagccgttctgcatactgcagaggctggaggaagggcctataatcatgcattgtctgaattgcccgaaacgctggaaacactgttattattaacgttattggcgacagtgacaggtgggatattcctatttttgatgagcggcaaaggcataggaaaaatgacgcttggaatgtgctgcattattacagcatctatattactttggtatgctcaaatacaaccgcattggattgccgcttcgataatattggaatttttcttaattgtactactgatcccagaaccagaaaaacaaagaacaccacaggataaccagcttacatatgttgtgatcgcaatcctaactgttgtagcggcaacaatggcaaatgaaatgggatttttagagaaaaccaagaaagatctaggtctcggcagtataactacacaagaatcagagtcgaacatattagacattgatttgcgaccggcgagcgcatggacgctatatgcagtagcaacgacgttcgttactccgatgctcagacattctatagagaatagttcggtcaatgtatcgctaacagctatagcgaatcaagctacggtattaatgggcctgggtaaggggtggcccctgagcaaaatggatattggtgttccattactagcaatcggttgttattctcaagtaaatcctataacactaacagcagcactcctattattagtagcacactacgccataatcggccctggattacaagcaaaagctacacgagaggctcagaaaagggctgcagcaggtatcatgaaaaatcctacagttgatgggatcacagttatagatcttgaaccaataccgtacgatccaaaatttgaaaaacaattgggacaggtcatgttattgatactttgtgtcacgcaggtattaatgatgagaactacgtgggctttgtgcgaagcattaaccctcgcaactggaccgataagcacactctgggaaggaaacccgggacgtttctggaatacaaccattgccgtcagtatggcaaatatttttaggggtagttatttagcgggggcgggattattgttttctataatgaaaaacactacatcaacaagacgtggtacgggaaatataggcgaaacactcggagaaaaatggaagtcacgactcaatgctctaggcaagtctgaatttcaaatatacaaaaagtctggaatccaagaagtcgatcgcacactggctaaagaaggtattaagcgtggagaaactgatcaccacgcagtatcccgggggagcgctaaattaaggtggttcgttgaacgcaacatggtaacacccgaaggcaaagtagtggacctaggatgtggtcgaggcggctggtcttattattgtggcgggttgaaaaatgtaagagaagtcaaggggctaactaaaggcggacccggacatgaagaaccaattcctatgtccacatatggttggaatttggtgcgacttcaaagcggagtagacgtattctttaccccaccggaaaagtgtgatacactactttgcgacataggagaatcgagtcccaacccaactatagaagccggtcgaacgttaagagtattaaatcttgtagaaaactggctaaataataatacacagttttgtattaaagtattaaatccatacatgccatctgtaattgagaaaatggaggcactacaacgtcaatatggaggcgctcttgtgcgtaatcctttgtctcggaatagtacacatgaaatgtactgggtgtcaaatgcaactggaaacatagtcagctcggtgaacatgattagcagaatgctaataaaccggttcacgatgaagcataagaaggctacgtatgaaccggatgtcgacctaggtagtggaactcgcaatattggaatagagagtgaaatacctaatttggacattatagggaaaagaattgaaaagattaagcaagaacatgaaatctcttggcattatgaccaagaccatccatacaaaacgtgggcttatcatgggtcttatgaaacaaagcagactggcagtgcatccagtatggtcaacggtgtggtacgcctattaacaaaaccatgggatgttgtgcccatggtaacacagatggctatgacggacacaacaccatttggtcaacaacgagtctttaaggagaaggtcgacacaaggactcaagaacctaaagaaggtactaaaaagctcatgaaaataacagcagaatggctttggaaagagttaggcaagaagaaaaccccaagaatgtgtaccagagaagaatttaccaagaaagtcagatcaaacgcggctctcggggcaatttttacagatgaaaataaatggaaaagtgctagagaagcagtagaagatggtagattttgggaacttgtcgatcgcgagagaaatctacatttagaaggtaaatgtgaaacttgcgtatacaatatgatgggaaaaagagagaagaaattgggagagtttgggagagcaaaagggagcagagccatatggtacatgtggctcggagcgcgttttctggaatttgaagcacttggttttctcaacgaggaccattggttctcccgcgggaactctttatccggggtggagggggaaggacttcatcggctcggttacattctgagagacgtgggaaagaaagaaggcggcgctatgtatgcagatgacactgctggatgggatacaagaattaccttagaagatctaaagaatgaagaaatggtcacaaaccacatgaaaggagaacataagaaactagctgaagccatctttaaattaacataccagaacaaagttgtacgagtacaaagaccaacgccgcgtggcacagttatggacataatttctagaagagaccagaggggctccggacaagtagggacatatggcctaaacacattcacaaacatggaagcacaattaatcaggcaaatggagggggaaggtatctttaaatctatacaacatcttacagcaacagaggaaattgccgttcaaaattggctcgctcgagttggaagagaaaggttgtctcggatggccatctcgggggacgattgtgtcgttaaacccatagatgataggttcgcttccgctctaacagcattgaacgacatgggtaaagtaagaaaagatatccagcaatgggaacccagcagaggctggaatgattggactcaagtaccattttgtagccaccatttccatgaacttgtaatgaaagatggtcgagtcctagtagtaccttgccggaaccaggatgaattgataggtagagcccggatatcacaaggtgcaggatggtcacttaaagaaacagcatgtctaggtaaatcgtatgcacaaatgtggactctaatgtattttcacaggcgagatctcaggcttgctgcaaacgccatttgctcagctgtcccgtcccattgggtaccaacaagcagaacaacatggtcgatacatgcaaagcatgaatggatgacaacggaggacatgttggcagtctggaacagggtttggatacaagagaacccatggatggaagataaaacacctgtagaaagttgggaagaagtcccctatttaggtaaaagggaggaccaatggtgtggatcattaattggcctgacatcacgagcaacatgggccaaaaatatccaaacggctataaatcaggtgaggtccttaatcggcaacgaggaatatactgattacatgccctcaatgaagcgatttcgcagggaagaagaagaagccggtgtgctctggtaa

SEQ ID NO: 22399 - RNA, 9876 nt, synthetic construct
  misc_feature 1..9876: note = derived and/or modified CDS sequence (opt6) from DENV-2__FJ850067__SS-prME
  source 1..9876: mol_type = other RNA
acagcaggggttatagtaatgcttattccgaccgctatggcttttcatcttaccacgagaaatggagaaccacatatgattgtaggaagacaagaaaaagggaaatccctattatttaaaacagaagatggtgtaaatatgtgtacgttgatggctatagatctaggagaactatgcgaagataccattacttataaatgtccattattacgacaaaacgaacccgaagacatcgattgttggtgcaattcgacatcaacgtgggtgacatatggaacatgcacaaccacaggggaacatcgtcgtgagaaaaggagcgtggctttagtaccacacgtcggaatgggattagaaacaaggaccgaaacttggatgtcctcggaaggggcttggaaacatgtccaaagaatcgaaacatggatcttaagacatccaggtttcacgatcatggcagcaattttagcgtacacaataggaactacacactttcaaagagcgctaatctttattttattaactgcagttgctccatcgatgacaatgagatgtataggaatctcaaaccgagatttcgtagaaggggtatccggaggctcatgggttgacatagtattggaacacggatcttgcgtgacgaccatggccaaaaataaacctactttagattttgaacttatcaaaacggaagctaaacaacctgcaacgcttaggaaatattgtatagaagctaaactaacgaatacaactacggaatcacgatgtccgactcagggagaaccatcattaaacgaagaacaagataaacgttttatatgcaaacactcaatggtagatcgagggtggggaaatggctgcggactatttggaaaaggaggcatagtcacatgtgcaatgttcacatgtaagaaaaatatggaaggaaaagttgtacagcctgaaaatctagaatatacaatcgtgattacacctcacagcggtgaagaacatgcagttggtaatgacaccggaaaacacggaaaagaaattaaaatcacaccacagtcaagcataacagaagcagaactaacaggatatggtacggttacaatggaatgctcaccacgtacaggtctagactttaatgaaatggtactattacaaatggaggataaagcatggttagtccacagacaatggtttttggacttgccattgccatggctacctggcgcagatacccaagggtcgaactggatacaaaaagaaaccctagtaacgttcaaaaatccccatgccaagaaacaagacgtagtagttttaggatctcaagagggagctatgcacacggctttaacgggcgctaccgaaattcagatgtcatcaggcaacttactatttacaggacatttgaaatgcaggttgcggatggacaaattgcaattaaaaggtatgtcatatagcatgtgtacaggaaaatttaaaatagtcaaagagatagcagagacccagcatggaacgatagtaattcgagtacaatatgaaggagacggttcgccatgtaaaattccttttgagatcacagacttagaaaaacgacatgtactcggacgactaataactgtaaaccctatagtaacagaaaaagactcaccagtaaacatcgaagcggaaccaccttttggcgactcatacataataataggagttgagcctgggcagctcaaactcaattggtttaagaaaggaagttctattggacagatgttcgagacaaccatgagaggagcgaaaaggatggctatcctaggcgacacagcttgggattttggatcgttaggtggagttttcacaagtattggaaaagcgttacaccaggtcttcggcgcaatttacggagcggcgttctctggagtaagctggacaatgaaaatattaataggagttattatcacatggattggaatgaatagcagatcaacatcactatcagtgtcattggtcctagtgggggtagtcacactatatttaggagcaatggtccaagctgatagtggctgcgttgtaagttggaaaaacaaagaacttaaatgtggaagcggcattttcataactgataatgtacacacttggaccgaacaatacaaatttcaaccggaatcaccgtctaaattagcttccgcaattcaaaaagcgcatgaggaaggaatctgtggcattcgttcggtcacacggcttgagaaccttatgtggaaacaaataacacctgaattaaatcacatactctcggaaaatgaagtaaaacttacaataatgacgggagacatccgcggaatcatgcaagcaggtaaacgtagcctaaggccgcaacctacagagctcaaatacagttggaaaacatggggcaaagccaaaatgctctcaacggagtctcacaatcaaactttcttgatagacgggccggaaaccgcagagtgtccgaatacaaaccgtgcgtggaactcattagaggtagaggattacgggtttggggtttttacaaccaatatatggttaaaattgagagaaaaacaggacgttttctgcgatagtaaactaatgagtgccgctataaaagacaacagagctgtccatgcagacatgggttattggattgaaagtgcgttgaatgatacttggaaaatggaaaaggcttcattcatcgaagttaaatcgtgccattggcctaaatcacatacattatggagcaatggcgtacttgaatcagaaatgataatacccaaaaatttcgcaggaccggtatcacagcataattatagacctggctaccatacgcaaacggcgggcccatggcatttgggtaaactagaaatggactttgatttgtgtgaaggtacaacggtggttgtaactgaagattgtggaaacagaggaccttcgttgagaacaacgactgcttcagggaaacttattacagaatggtgttgtaggtcctgtacgttaccacctcttagataccgcggggaagacggctgctggtatggaatggaaataagaccgttaaaagagaaagaagaaaatttggtaaattcattagtaaccgcaggtcatgggcaaatcgataatttcagcttgggagttttaggtatggccctatttttagaggagatgttgcgaacacgcataggtacaaaacacgctatacttttagttgccgtgtcgttcgtgactctaattactggtaatatgtcttttagggatttaggacgagtaatggttatggtaggtgctacaatgacagatgatattggaatgggagtaacttacttggcactattagcagcatttaaagtcagaccgacatttgcagcaggcctccttcttcgaaaattaacaagcaaagaacttatgatggccactataggaattgcgctcttaagccagagtactattcctgagacaattcttgagctaacagatgctctcgcattgggcatgatggttttgaaaattgtaagaaacatggagaaataccagctagctgtcacgataatggcaataagctgtgtccccaatgcagtgattctacagaatgcatggaaagttagttgtactatcctagcggcagtttcagtttcaccgttgctcttaacaagttctcagcaaaaagctgattggatccctctagctctaacgatcaaaggactaaatcctaccgctatatttttgacgactttgagtagaacttccaagaaacgctcctggccactaaatgaagccattatggcagtaggaatggtaagcatactggcgtcatccttattgaaaaatgacattcccatgaccggacccttagttgccggaggattattaaccgtgtgttatgtgctaacaggtcggtccgcagacttggaacttgaacgcgctgcagatgtaaaatgggaggaccaagctgaaattagcggatcctctccaatattgagcattactatttcagaagacggctctatgagtataaagaacgaagaagaagaacaaacactgaccatattgatacgaacaggtcttttagtaatatccggcgtatttccagtctctataccaataactgctgcagcgtggtatctttgggaagtcaagaaacaaagagcaggagtactttgggacgtgccgagtccaccaccagtagaaaaagctgagttggaagacggagcttacagaataaaacaaaggggtatattgggatattcccaaataggtgcaggcgtttataaagagggaacgtttcacacgatgtggcatgttacgcgaggagcggtccttatgcacagaggtaaacgaatcgagccgtcatgggccgacgtgaagaaagacctcattagttatggtggcggttggaaattagaaggtgaatggaaagagggggaggaagtccaggttctggcattagaacccggcaaaaacccacgggctgtgcaaacaaaaccaggtatatttaagaccaacaccggaacaataggagccgtatcgctagattttagcccaggaacgtctggatcgcctatagtagacagaaagggaaaagtagttggtttatatggtaatggagttgtgacacgatcgggtgcctacgtttcagctattgcgcagacagaaaagtcaattgaggacaatccagaaatagaggacgatatattccgaaagaaaagactcactattatggacctacatcctggagccggaaagactaaaaggtacttacccgccatagttcgtgaagcaatcaaaagaggactcagaactttaatacttgcgccgactagggtcgtagcagcagagatggaagaggcactgcgcggcctacctatacgatatcagacgacagcaattaagactgaacataccggtagagaaatagttgatctcatgtgtcatgcaacatttaccatgagacttttatctccagttcgcgtaccgaattataatttaataataatggatgaagcacattttaccgatccagcttcaatagcggcacgaggttatatctcgacacgagtggaaatgggagaagccgcagggatatttatgacagcaacacccccaggaagccgagatccatttccgcagtcaaacgcacctattatggacgaagaacgcgaaattcctgagcgctcgtggaactcgggacacgaatgggtaaccgacttcaaagggaaaacagtttggtttgtccctagcataaaagctgggaatgacatagcggcctgtttacggaagaatggcaagaaagtcattcaactctcacgtaaaacctttgattctgaatatgtcaaaactagagcaaatgattgggacttcgttgttaccacagatatatcagaaatgggagcaaattttaaagcagagcgagttatagacccaagaaggtgtatgaaaccggtcatattaacagatggcgaagaacgagtaattctagcaggaccaatgccagttacgcatagttctgcagctcaaagacgtggccgcatcggacgcaaccctaaaaatgaaaatgaccaatatatatatatgggtgaacccttggagaacgatgaggattgtgcccactggaaagaagccaagatgttattagataatattaatactccagagggaattatacccagtatgttcgaacctgaacgagaaaaagtggatgcaatagatggtgaatataggttgcgaggagaagcacgaaaaacattcgttgatctgatgaggcgcggggacctgcctgtgtggctggcttataaagttgcagccgaaggcataaattacgctgataggaagtggtgttttgacggaatcaagaacaaccagatattagaggaaaacatggaagttgagatttggacaaaggaaggagagaggaagaaactgaaacccaggtggttggacgcaagaatatatagcgatccactcgcactgaaggaatttaaagaatttgctgcgggacgcaaatcgctcacacttaatctaataactgagatgggcaggctccccacttttatgacccaaaaagctcgtaacgcattggataacttagccgtactacatacggcagaagccggtggccgtgcatataaccacgcattgagcgaacttccagaaactttagaaacgcttttattattgacactactagcaacagttacaggcggcatatttctgtttttgatgtcgggaaaagggataggaaagatgaccttaggaatgtgttgcataataaccgcgtccattttattatggtatgcgcagatacaacctcactggatagctgcgtcgataatacttgagttctttttaattgttctcttaattccagaaccagaaaagcaaaggaccccacaagacaaccagctaacttacgttgtcatcgctattctaactgttgtagctgcgactatggcaaatgaaatggggttccttgagaaaaccaagaaagatctaggtctcggctccataaccacccaagaatcggaatcaaatatactagacatcgacctacggccggcctcagcatggacactatatgcagtagctactacacttgtaactcctatgttaagacattccatagaaaactcttcggtaaatgtctctctaaccgcgatagcaaaccaggcaactgtactaatgggtctaggtaaaggttggcccttaagtaagatggatataggcgtaccattactcgctataggctgttacagccaagttaatccaataacactcacagccgcgttgctactcctagtcgcccattacgccattataggacctggcctccaagctaaggctacccgggaagctcagaaaagagctgctgctggtattatgaagaaccccacagttgacggaataacagttattgatttagaaccaatcccttatgacccaaaattcgagaagcagctaggtcaagtaatgctgcttatactttgcgttacgcaagtgctgatgatgcgaacgacatgggccttgtgtgaagcattaactcttgcgacaggacctatttctacactctgggaaggtaaccctgggcgtttctggaacacaacaatagctgtatcaatggcaaatattttccgtggatcttaccttgcaggggcaggtcttttattctccattatgaaaaatacgaccaacacccgcagaggaacgggaacaatcggcgaaacgctgggtgaaaagtggaaaagcagattaaatgcgttaggcaaaagtgagttccagatttataagaaatccggaatacaggaagttgacagaacactggcgaaagaaggtattaaacgcggagaaactgaccaccatgcagtttccagggggagcgcaaagctcagatggtttgtcgaaaggaacatggtcacgccagagggcaaagtggttgacctaggatgtgggagagggggttggtcctattactgtgggggactgaaaaacgtaagagaagtaaagggtcttacaaaaggcggacctgggcacgaagaaccaatacccatgtcaacttatggatggaacttagttcggctacagagtggtgtcgatgttttctttacgccaccagaaaaatgcgaaaccttattatgcgatataggggagagctcaccaaaccctacaatagaagcaggacgcacccttagagtactgaaccttgtagagaactggttaaacaataacacacaattctgtataaaagtactcaatccctatatgccctctgtaattgaaaagatggaggctttacagagaaaatatgggggcgccctggtgaggaatcctctatcgaggaactcaactcacgagatgtactgggtgtcaaatgcaacaggtaatatagtttccagcgtaaatatgatatcaagaatgcttataaataggtttacgatgaagcacaagaaagctacttatgaacctgacgtggaccttggaagtggaacgaggaacatcggaatagagagtgaaattccaaatttagatataataggtaaaaggatagagaaaatcaagcaggaacatgaaacaagctggcactatgaccaagaccatccctacaaaacttgggcataccatggttcctacgagactaaacagactggatccgcctcatctatggttaacggagttgttagactattaactaaaccctgggatgtagtacctatggttactcaaatggctatgacagacactacacctttcggacagcaacgagtatttaaagaaaaagtagatacccgcactcaggaaccaaaggagggaactaagaaattaatgaaaattaccgcagaatggttatggaaagaattaggcaagaagaaaacgccaagaatgtgtactcgtgaggagttcacaagaaaagtgaggtctaatgccgcactaggtgcaatcttcacagatgaaaacaaatggaaatccgcgcgggaagcagtagaagacggacgattttgggaactcgttgacagagaacgaaatttacatctagaaggaaaatgtgaaacatgcgtgtataatatgatgggaaagagagaaaagaaacttggtgaatttggtaaagccaaagggtcaagagcaatatggtatatgtggctaggcgcaagatttctggagttcgaagcattaggctttctcaatgaagatcattggttctcaaggggtaacagtttaagcggagttgagggagaaggactacaccgtttaggctatatacttagggacgtcggcaagaaggaagggggagccatgtatgccgatgatacggctggttgggataccagaattacgttggaagacctgaaaaacgaagaaatggtaaccaatcatatgaaaggcgagcataaaaagctagcagaagctattttcaaactcacttaccagaataaggtagtgcgtgttcaaagacctaccccacgaggaacagttatggacataataagccgacgtgatcaacgtggaagtggacaagtaggaacttatggtctaaatacattcacaaacatggaagcccaactaataagacagatggagggagagggtatatttaaatctattcaacacttaactgccaccgaggaaatagcagtacagaactggttggctagagtcgggagggagaggttaagtcgtatggctatatcaggggacgactgtgttgtgaaaccaattgatgatcggtttgctagtgcacttacagcactgaatgatatggggaaaatccgcaaagacatacaacaatgggagccatctcgcggatggaacgactggacacaggttccattctgtagccaccattttcatgaattagtaatgaaggacggaagagttttggtcgtgccttgcagaaaccaagacgaactaattggtcgagcacggatatcacaaggagctggatggtcattaaaggagaccgcatgccttggaaagtcatatgcacaaatgtggacattaatgtatttccaccggagggatcttagactcgcagctaatgctatatgctccgccgttccatctcactgggtccccacatcaagaacaacctggagtattcatgcgaaacatgaatggatgaccacagaagacatgttggctgtttggaaccgggtttggatccaggaaaacccttggatggaggataaaactccagtcgagtcttgggaagaagtcccgtatcttggtaaaagagaagaccaatggtgcggttccctgataggcctaacgagtcgggcaacttgggctaaaaatatacaaacagcgattaatcaggtaaggagccttataggaaacgaggagtataccgactatatgccaagcatgaaacggtttcgaagggaagaagaggaggctggagtgttgtggtaa

SEQ ID NO: 22400 - RNA, 9876 nt, synthetic construct
  misc_feature 1..9876: note = derived and/or modified CDS sequence (opt6) from DENV-2__FJ850060__SS-prME
  source 1..9876: mol_type = other RNA
actgctggagtgattgtgatgttaattcccactgcgatggctttccacctaacaacaagaaatggtgaaccccacatgattgtaggaagacaagaaaaagggaaaagtctactttttaaaacagaagatggagttaatatgtgtactctgatggcaattgatctaggagagttatgtgaagataccataacctataaatgtcccttactaagacaaaacgaacccgaggacattgattgttggtgcaactccacttcaacttgggtgacatatggaacgtgtaccacaacaggtgaacatcgacgtgaaaaacggagtgtagctctggtcccgcacgtaggaatgggattagaaacacgaacagaaacatggatgtcttcagaaggagcatggaaacacgtccagagaatagagacctggattttacgtcaccctggattcactattatggctgcaatattagcatacacaatcggtactacccactttcaacgagcgttgatttttatattattgacggcggtagcacccagtatgacaatgcgatgtataggcatcagcaacagggattttgttgaaggcgtttcgggaggttcctgggtcgatatagtattagaacatggatcctgtgttacaacgatggctaagaacaaaccaactcttgattttgaattaattaaaactgaagctaaacaaccagctacgctgaggaaatattgcattgaagcaaagctgacaaacacgactacggaaagtcggtgccccactcaaggagaaccgagcctaaatgaagaacaagacaaacgtttcatttgcaagcattcaatggttgataggggatggggtaatggatgtggattatttggtaaaggaggcatcgtcacttgcgccatgttcacgtgtaagaaaaacatggaaggaaaagtagtccaaccggaaaacctcgagtacacaattgtaataacaccacattcgggggaagaacacgctgtagggaatgacacgggtaaacacgggaaagaaatcaaaataacgccccaatcttcgataacagaggctgaactcacaggatacggaacagtaacgatggagtgctcaccaagaaccggtttggattttaatgaaatggttttgttacaaatggaagacaaagcatggctggtgcatcgacaatggttcctggatctgcctttaccctggttacccggggcagatacgcaagggtcaaactggatccagaaagagaccctagtgactttcaagaacccacacgctaaaaagcaagatgtagttgtcctaggttcacaagaaggcgctatgcacacagccttgacgggtgctacagaaatccaaatgtcttctggcaacctattatttacgggacacctaaagtgtagattaagaatggacaaactacaattgaagggcatgagttattccatgtgtaccggaaagttcaaaatagttaaagaaattgctgaaacgcaacatggaacaatagtaattagggtacaatacgaaggagacggtagtccatgtaagatcccattcgaaattacagatcttgagaaaagacacgtgctcggaagattaattacagtcaatcccattgtaactgagaaagattcacccgtaaacatagaagcagaaccccctttcggagacagttacatcattattggagttgaacctgggcaactgaaattaaactggtttaagaaaggtagctctattggccaaatgttcgaaacaacaatgcgaggagctaaaaggatggcaatacttggagacacagcctgggactttggtagtctaggaggagtattcacatcaataggaaaagcgctccatcaggtatttggagctatctatggtgcagctttctctggggtgtcttggacaatgaaaatcttaatcggagtaattattacatggattggtatgaatagcagaagcacaagcctctccgtatctttggtattagtaggggttgtcacactatacctaggggcaatggtacaagctgatagcggttgtgttgtatcttggaaaaacaaggagttaaaatgcggttccggaatttttataacagataacgtacatacttggacggaacagtataaatttcaaccggagtcaccaagcaaattagcgagcgcgattcaaaaagcacacgaggaaggaatatgcggtataaggagcgtgactcgactagaaaacctgatgtggaaacaaataactcctgaactaaaccatatactaagtgaaaatgaagtaaaactaactattatgaccggagacataaagggtattatgcaggcaggaaaaaggagtcttaggccccagccaacggaattaaaatactcatggaaaacatggggcaaggcaaaaatgttatctaccgaatcacataaccagacatttttaatcgatggtcccgaaactgcggaatgcccaaatactaatcgtgcatggaacagcttggaagtagaggactatgggttcggagtctttacaaccaacatatggttaaaactgcgcgaaaaacaggacgtattttgcgacagtaaattgatgtcagcggcaataaaagataatcgggcggtacatgccgacatgggctactggatagaaagtgcattgaatgacacctggaaaatggaaaaagcatcattcattgaagttaagtcatgtcactggccaaaatctcatactctgtggagtaatggagttctagaatcagagatgattataccgaaaaacttcgcggggccggttagccagcataactaccgaccaggataccatacccaaactgctggtccatggcatctaggcaaattggagatggactttgatttgtgtgaaggaacaacggtcgtcgtaacagaagattgtggaaacagaggcccatcgcttcgcacgaccacggcttcagggaaattaataacagaatggtgttgccggtcatgtacgctgccacccttgagataccgtggagaagatggttgttggtatggcatggaaatccgccccttaaaagaaaaggaagaaaacctagttaacagcttggtgacggccggtcacggacaaattgataatttctccttaggcgttttgggcatggcactattccttgaagaaatgctaagaacaaggataggtacgaagcatgctatattattagttgcagtttcatttgtaacattgatcactggaaacatgtcttttagagatctaggaagagtaatggtaatggtaggagccactatgaccgacgatatagggatgggtgtaacgtatttagcattattagctgccttcaaaatcagaccaacgtttgcagcaggattattattgcgaaaattaaccagtaaggaactaatgatggctacaattggaatagctttattaagtcagtcaaccatccctgagactatattagagctaactgatgctttagcattgggcatgatggttttaaaaattgtgagaaatatggaaaagtatcaactggcagtcactataatggcaatcagttgtgtacctaatgccgtaattttgcaaaatgcgtggaaagtatcctgtgcgattctggctgcagtctcagtatcgcctttactcttgaccagttctcagcaaaaagctgactggataccacttgcgctgaccatcaaaggcctcaacccgacggctattttcttaacgactctatcaagaacatctaagaaaagatcatggcccttaaatgaggctgttatggctgttggtatggtgagcattcttgcaagcagcttactcaaaaatgacatacccatgacaggaccattagtcgcaggaggtttattaacggtatgttatgttttgacgggtcggagcgctgacctggaactggaacgcgctgccgacgtgaaatgggaagatcaagcggagattagtgggagcagtcctatattatcaatcacaattagtgaagacggttccatgtcaataaagaacgaggaagaagaacaaactttaacaattctaattaggacaggtctgctagtaatatccggagtatttccagttagcatcccaataaccgctgcagcttggtacctatgggaagtcaaaaagcaaagagcaggagttctatgggacgtcccatctccaccgcctgttgaaaaagccgagttggaggatggtgcatatagaataaaacagaggggtatattaggatatagccagataggtgcaggggtttataaagaaggaactttccacaccatgtggcacgtaactcgaggagcagtcttaatgcatcgagggaagagaatagaaccctcctgggcagatgttaagaaagatttaattagctatggcggaggttggaaactagagggtgaatggaaagaaggtgaagaggtgcaagtattagccttagaaccagggaagaacccaagggcagttcaaactaagcccgggatttttaaaactaatactggaacaatcggggcagtatctttagacttcagtcccggaacaagtggaagtcccatagtagaccgtaaagggaaagttgtaggcttgtatgggaatggcgttgttacacggtcaggggcatacgtaagcgccatagcccaaacagaaaaatcgatagaagataatccagaaattgaagatgacatttttaggaagaaacgattaacaattatggatttacacccgggtgctggaaaaaccaaaagatatttaccggctatagttcgcgaagctattaagaggggccttcgcacgctcatattagcgcccacgagggtagttgcagccgaaatggaagaagcattacggggtttacctataagatatcaaacgccggcgattaagacggaacatacaggaagagagattgtcgacttaatgtgtcatgcaacctttaccatgagattattatctcctgtccgtgtacctaattataatttaataatcatggacgaagcacattttacggaccctgcttccattgccgcccgtggatatatcagcacacgggtcgaaatgggagaagctgctggaatttttatgacagcaacaccaccaggtagcagagacccctttcctcaatccaacgccccaataatggatgaggaacgggaaatacctgaacgatcgtggaactcaggacatgagtgggtgacagattttaaaggaaaaacagtttggtttgtaccgtcaataaaagctggaaatgatatagccgcgtgcctcagaaagaatggcaagaaagtgatacaactatcgcgaaaaacatttgattcggaatacgtcaagacacgagcaaatgattgggattttgtcgttacaaccgatatatcggagatgggggccaattttaaagcagaaagggttatagaccccaggaggtgcatgaaaccagtcattctgaccgatggtgaagaaagagtaatcctcgcaggccctatgccagttacacactctagtgccgcgcaaagaagagggagaatcgggcgtaaccctaaaaatgagaacgatcaatatatatacatgggagaacctctagagaacgatgaggactgtgctcattggaaagaggccaaaatgctactagataatatcaatacacccgaagggataatccccagtatgtttgaacctgaaagggaaaaagttgacgccatagatggtgagtaccgactgagaggtgaagcgaggaagacttttgtagacctgatgcggcgaggagatttacccgtttggctggcatacaaggtagcagcagaaggaattaattatgctgatagaaagtggtgttttgatggtatcagaaacaatcaaatccttgaagagaatatggaagtcgaaatatggacaaaagaaggagagcgaaagaaattaaaaccgagatggcttgacgcacggatatactctgatccattagcgctgaaggagtttaaggaatttgccgcaggaaggaaatctctaactctgaatctcatcacggaaatgggtaaattacctacattcatgactcaaaaggcaagaaatgcgctcgataacctcgctgttctgcacacagcggaggctggcgggagggcttataaccatgcgctttcagagttgcctgaaacattggagaccctgttactgctgacattacttgccacagtaactgggggaatcttccttttcctaatgtccggaaagggaataggtaaaatgacgcttggcatgtgctgtattataactgcgtcaatactattatggtacgctcaaatccagccccactggatagctgcaagtattatcttagagttcttcttgatcgtcctactaattccagaacctgaaaaacaaaggacccctcaggataaccaactcacttacgtagttattgcaatactaactgtagtagcggcaacaatggccaacgaaatgggattcctggagaaaacaaagaaagacctcggactaggctcgataaccacgcaagaatcggaatccaacattcttgacatagacttaaggccggcaagtgcatggactctttatgcagtagccactacattcgtaacacccatgctgaggcattccatagaaaattcaagtgtcaacgttagcctgacagctatagcaaaccaagccacggtattaatgggcttaggtaaaggatggccgttaagtaaaatggacataggtgtgcctttgttagcaataggatgctattcacaggtgaatcccatcacgcttacggcagcactcctgttattggtggcccattacgcaataataggtcccggtttgcaagcaaaagcaacccgtgaggctcagaaacgagcagctgctgggataatgaaaaaccctactgtagacggcattacggtcatagacctagagcctataccatatgaccccaagtttgaaaaacaattgggacaagttatgctactaatactttgtgttacgcaagttctcatgatgagaactacatgggcattgtgtgaagctctaacgctcgctacaggtcctataagtacgctatgggaaggcaacccaggtagattctggaatacaacaattgcagtaagcatggcaaatatttttagaggaagctacctcgccggtgcaggcctactattctctataatgaaaaatacaactaatactcggcgaggaacgggtaatattggtgaaacattaggtgaaaaatggaaaagtcgtctaaacgctttaggaaagagtgagttccaaatttacaagaagtcgggaatacaggaggtagatcgaacactagctaaggagggaattaaaaggggagaaacagatcaccacgctgttagccgaggcagtgcgaaactacgatggtttgtcgaaagaaacatggttaccccggagggaaaggtcgttgatttaggatgtggaaggggaggatggagttattattgcggaggactaaagaacgttagagaagtaaagggactaacgaaaggcggccccggacatgaagaaccaatacctatgagcacgtatggatggaatctagtcagacttcagtcaggcgttgatgtattctttacacccccagagaaatgcgataccctactttgcgacataggggaaagcagtcccaaccccacaatagaagccgggaggaccttaagagttctgaacctcgtagaaaactggcttaacaataatacacaattctgcataaaagtcctgaatccatatatgccaagtgtaatagagaaaatggaagcattacaacgaaagtatggtggagccctagtacgcaatccgttgagtaggaatagcactcatgaaatgtattgggtgtcaaatgccactggaaatatcgtttcctctgttaatatgatctcaaggatgttgataaacagatttaccatgaaacacaagaaggccacttatgaaccggacgtagatttagggagtggtactcgaaatatcggtatcgagtcggagataccaaacttagacataataggtaaacgtatcgagaagataaaacaggaacatgaaacaagttggcactatgatcaagaccacccttacaaaacttgggcatatcatggctcttacgaaaccaaacaaactggatcagcaagttccatggtaaacggagtagttcggttactaacaaagccatgggatgttgtacctatggtgacacaaatggcgatgacggatacaaccccttttggacaacaacgcgtctttaaagaaaaagtggatacaaggacacaagagcctaaggaaggtactaagaaacttatgaaaataaccgcagagtggctctggaaggaactaggcaagaagaaaacgccccgtatgtgtacgagagaggaatttacaagaaaggttagaagcaatgcagcattgggtgctatcttcaccgacgaaaacaaatggaaaagcgcacgtgaagcggtcgaagacggaagattctgggagctcgttgaccgagaacgaaatttacaccttgaagggaaatgtgagacgtgtgtgtataatatgatgggaaaaagggaaaagaaactaggtgagttcgggaaagccaaaggctcaagggcaatatggtatatgtggctgggcgcaaggttcctagaatttgaagcattaggatttttaaacgaagaccactggttcagccgcggaaacagcttatccggggtggaaggggaagggctacaccgattaggttacatcctaagagacgtgggaaagaaagagggaggtgcgatgtatgcggatgacactgcaggatgggacacaaggataactcttgaagacctaaagaatgaagaaatggtaacaaatcatatgaaaggcgaacacaagaaactagctgaagcaatctttaaattaacctatcaaaacaaagtagtcagagtacaaagacccacgccacgaggaactgtcatggatataatctcccgtcgagaccagagaggatcaggacaagtgggaacatatggtctaaatacttttacaaacatggaagcacaactcattcgtcaaatggaaggagagggaatctttaaaagtatacaacatctaaccgcaacagaagagatagctgtacaaaattggctggcgcgggtaggaagagagagactaagcagaatggctatctctggtgacgattgtgtcgttaaacctattgacgatagattcgcgagcgctcttacagctctcaacgacatggggaaagtaaggaaagatattcagcaatgggagccttctcgcggatggaacgattggacccaagtaccattttgcagccaccattttcatgaactcgtaatgaaagatggaagagtattagtggttccatgcagaaatcaagatgaattgattggacgagcacgaataagccaaggagcaggatggagtctaaaagaaactgcatgtctaggaaaaagttatgcacaaatgtggactttgatgtactttcaccgtagggacctaagattagccgcaaacgcgatttgcagcgcagtccctccccattgggtaccgacgtcccgtactacctggtctattcatgcaaagcacgaatggatgactacagaagatatgttagcagtatggaatagagtatggatccaaggaaacccctggatggaggacaaaactcctgtggaaagttgggaagaagtaccatatttaggcaagagagaagatcaatggtgcggaagtctaattggtttgactagcagagccacatgggccaagaacatacaaactgccattaatcaagtgaggagcctaattggaaatgaagaatacacagattacatgcccagtatgaaacgctttcgacgcgaggaagaagaagcaggcgttttatggtaa

SEQ ID NO: 22401 - RNA, 9876 nt, synthetic construct
  misc_feature 1..9876: note = derived and/or modified CDS sequence (opt6) from DENV-2__FJ850061__SS-prME
  source 1..9876: mol_type = other RNA
acggcaggggttataataatgctgatacctacggcaatggcttttcacctgaccacaagaaacggagaacctcacatgattgtaggaagacaggaaaaaggtaaaagtctattattcaaaactgaggatggggtaaatatgtgtactttaatggcaatagacctaggagagctctgtgaagatacaataacatacaaatgcccacttttgaggcaaaacgaaccagaagatatagactgttggtgtaactctacaagtacctgggtaacctatggcacatgtacgactaccggggagcatcgacgagagaaaagatcagttgcgctagtgcctcatgtaggtatgggacttgaaacaaggaccgaaacatggatgtcctctgaaggcgcatggaaacacgtccaaagaatcgaaacatggatcttaaggcatccaggatttacgatcatggctgcaatactcgcatatacaattggtactacacattttcagagggcattaatattcatcctactaactgcagtggcaccgagtatgacaatgagatgtatcggaatatcaaatagagattttgtggaaggagtaagtgggggaagttgggtagatatagtactcgaacatgggtcatgcgtaactacaatggccaaaaataaacctactctagactttgagttaataaaaactgaggctaaacaacctgctacacttagaaaatattgtatagaggcaaaacttactaacacaacaacagagagcagatgtccaacgcagggtgaaccaagtctaaacgaagaacaagataaaagattcatatgtaaacacagcatggtagaccgaggctggggcaacgggtgtggattatttggaaaaggtggaatagtaacatgcgcaatgtttacatgcaagaagaatatggaagggaaagttgtacaacctgagaacttggaatatactatagttataacccctcattccggtgaagaacatgctgtcggaaatgataccggtaaacatgggaaagaaattaaaattacaccacagagttctattacagaagcagagctgactggttatggtacggtaacaatggagtgtagtccccgcacgggactagattttaatgaaatggtactattacaaatggaagacaaagcatggttagtgcatagacaatggtttctagatctccccttaccgtggctcccaggagctgatacacagggatcaaattggattcaaaaagaaacattggtaacttttaaaaacccacatgctaagaaacaggacgtggtagtactaggaagtcaagagggtgcaatgcatacagcattgacgggtgcgactgaaattcaaatgtcgtcaggcaatttattatttacggggcatttaaaatgtaggctacgtatggataaattacagctaaaaggcatgtcttacagcatgtgtacaggtaaatttaaaatagtcaaagaaattgcagaaacacaacacgggacaatagttatacgtgtacaatatgaaggcgacggatcaccgtgtaaaataccttttgagattacagacttggaaaaacgccatgttttagggcgtctcattacagtaaatccaatagtaactgagaaagatagtccagtaaatatagaagctgaaccgccattcggtgacagttatataattataggggtagaaccggggcaattaaaactgaactggtttaagaaaggctcatccataggacaaatgtttgctactacaatgcgcggtgctaaacggatggccatacttggggatacagcatgggactttggatcgcttggaggtgtattcacaagtatcggaaaggctttgcaccaggtatttggtgctatttatggcgctgcattctctggtgtatcttggactatgaagatattaatcggtgtcataattacttggatcgggatgaactctagatctacatcgttatccgtgagcttagttcttgtaggagtcgtaacgctatatctcggggcaatggttcaagctgatagcgggtgtgtagtaagctggaagaataaggaattaaaatgcgggagcggcatctttataactgataacgtccatacatggactgagcaatataaattccaacctgagagcccatcaaagttagcatcagcaattcaaaaagcacatgaagaggggatatgtggcatcaggtcggtgacaaggctcgaaaatttgatgtggaaacaaatcactccagaactcaaccacatactaagtgaaaatgaggttaaactaacaattatgaccggagacataaagggaatcatgcaagcgggtaaaaggtctctgcggcctcaaccgacggaactcaaatacagttggaaaacctgggggaaagcaaagatgctgtctacagaatcgcataatcagacgtttctgatcgatggaccggaaacggctgaatgccctaacactaatagggcatggaacagcttagaagtagaagattatggatttggtgttttcacgacgaacatctggttaaaacttagagaaaagcaagatgttttctgcgactcaaaattgatgagtgcagcaataaaggacaatcgtgctgttcacgcagacatgggatattggatagaatccgccctaaatgacacctggaaaatggaaaaagcatccttcatcgaagtcaagagttgccattggccgaaatcgcatactctgtggagtaacggggttttagaaagtgagatgataattccgaagaactttgcaggtccagtgtcacagcacaattaccgaccagggtatcatacacaaacagcaggaccttggcatctcggaaaattagaaatggacttcgatctatgcgaaggcaccacagtcgtagtaacagaagattgcggaaatcgcggtcccagcttacgtacaacaactgcctccgggaagttgataacagaatggtgttgcaggtcctgtaccctaccgcctctacgctatcggggagaggatggttgttggtatggcatggaaattagaccactcaaagaaaaggaagaaaacctggtaaacagcttagttacagcaggccacggtcaaattgataacttctcactaggtgtactaggtatggctctgttccttgaagagatgctccgaacaagaatcggaacaaagcatgccatcctgttagtagcagtcagcttcgtaacactcataacaggaaacatgtcatttagagacctcggacgggtgatggtgatggtaggtgcgacaatgactgatgacataggaatgggagttacttatttagccttgttagcggcgttcaaggtcaggcccacatttgctgcagggttactcttgagaaagttgacgtccaaagaactaatgatggcaaccatcggcatagcacttctgagtcaatccacaataccagaaacgatactcgaactaacagacgcacttgcgctgggaatgatggtactgaagatcgtaagaaacatggagaagtatcagctggcagtaacaataatggcaatcagctgcgtaccgaatgcagtaattctacagaatgcatggaaagtttcctgtacgatattagcggcagtgtcggtttcaccactactcttaacatctagtcaacaaaaggcagactggattcccctggccctaacaataaagggtctcaaccccactgcaatatttctaactactctttctcgaacaagtaagaaaagatcgtggccgctcaatgaggcgataatggcggttggtatggtatcaatcctagcatccagtctattaaagaacgatatcccaatgaccgggccccttgttgcaggcggtctattaacagtatgctacgtattaacgggaagaagtgccgacctcgaactagagcgagccgcagacgtcaaatgggaagatcaagcagagatatcagggagcagtcctatcctaagcataaccattagtgaagacggatcgatgagcatcaaaaatgaagaggaagaacagacgctaacaatactaattagaaccggcttgctagtcatatcgggagtgtttcctgtaagtatccctataacagctgccgcctggtatctctgggaagttaagaaacaacgagctggtgtgttgtgggatgtaccctcaccgccacccgtcgagaaagcagagttagaagatggtgcatatagaattaaacaacgaggcattttaggatattcgcaaataggtgccggtgtgtacaaggaggggaccttccacactatgtggcatgtaacgcgaggagcggtcctaatgcacagaggtaaaaggattgagccctcgtgggcagatgttaaaaaggacctaatttcctacgggggaggatggaaattggagggagagtggaaagagggtgaagaagtgcaagtgttggcactggaacctgggaaaaacccccgcgccgtacaaactaaacccggaatattcaaaacaaacacaggaaccataggtgcagtttcattagatttctcgccagggacgagcggcagccccattgtggatcgcaaaggaaaagtagtcggattatatggaaatggagtagtgactagatcaggagcgtacgtgtctgccattgcgcaaactgaaaagtccattgaagacaatccagaaatagaagacgatatttttcggaaaaagcggttgactataatggacctacatccaggcgcagggaaaaccaaacgatacctccccgccatcgtacgagaagcgattaagaggggtcttagaactctaattttggcacctacaagagtagttgcagcagaaatggaagaagccttaagaggtctgccaatcagatatcagactccagcaatcaaaaccgaacatacaggccgcgagattgtagacctcatgtgtcatgcaacatttacgatgcgactattaagcccagtcagagtgcccaactacaatcttataatcatggatgaggctcacttcacggatccagcttcaatcgcagctagaggttatatatcaaccagagtagaaatgggagaagccgccggcatattcatgactgcaacaccaccggggagtagagatccatttccgcaatccaacgctccgataatggacgaggaacgggaaatcccagaaagaagctggaactcgggacatgagtgggtcaccgactttaaaggcaagacagtttggttcgttcctagtataaaggctggaaacgacatagcagcatgcttgaggaaaaatggcaagaaagtaatacagctatctcgaaaaacatttgacagcgaatatgtcaaaacaagggctaacgattgggatttcgttgtaactacagatattagcgaaatgggagcaaattttaaagctgaaagggtaatcgatccgagacggtgtatgaaacctgtaatactaactgacggcgaagaacgagtgatattagcaggtccaatgcccgtgactcatagtagtgcagcccaaaggagaggcagaatagggcgaaatccgaagaacgaaaatgatcagtatatatacatgggtgaaccccttgaaaatgatgaggattgcgcacactggaaagaagcaaaaatgctcttagacaacattaatacacccgaaggaataatcccatcgatgttcgaaccggagcgcgagaaagtagatgcaattgacggagagtatcgattacgtggcgaagccagaaaaacattcgtggatcttatgaggcgaggtgacttgccggtttggctcgcatataaggttgcggccgagggaattaattatgcagatcgaaaatggtgttttgatggaattaaaaataatcaaatactagaagaaaatatggaagtagagatttggacaaaagaaggcgaaaggaagaaattgaaaccaagatggctagatgctcgaatttactctgatccactggctttaaaagaatttaaagagttcgcagccggtaggaagtctctgactttgaacctgatcacagagatggggcgattaccgacattcatgacccaaaaagccagaaatgcactagacaatttagcagtgttacataccgccgaagcaggagggagagcatataatcacgccctgtctgaattaccagaaacactagaaactttattattattgacactattagcaacagtaactgggggcatatttttattcttaatgtccggaaaagggataggaaaaatgaccctcggcatgtgttgtattattacagcaagcatcctattatggtatgcccaaatacaaccgcattggatagcagctagtatcattttagagtttttcctaattgtactattaataccagagccagaaaaacaacgtactccacaagataatcagcttacttacgtggttatagcaatactgaccgttgtagctgcgacaatggcaaacgaaatgggcttccttgaaaagaccaagaaagatttgggactaggtagtataactacccaagagtccgagtcaaacatactagacatagacctaagaccggcgtcggcatggaccctctatgcagtcgcaactacattcgtaaccccaatgctgcgacattcgattgaaaacagttcagtgaatgtttctttaactgctatcgccaaccaagcgaccgtcctcatgggactaggaaaaggctggccgctatccaaaatggatataggcgttccattgttagcgattggatgttatagtcaagtgaaaccaattacatttacagcggcactattactcctcgtagcacattatgctattatcggcccaggcctacaagcaaaagctccaagagaagcacagaaaagagctgccgcaggtataatgaaaaatccaacggttgatggcattacagtaatagacctcgaacctataccctatgatccaaaattcgaaaaacaattagggcaagtaatgttattaatattatgtgtaacacaagtacttatgatgagaactacttgggcattatgtgaggctttaacgctagccaccggacccatatctactttatgggaaggcaaccctggtcggttctggaatacaacaatagcagttagcatggccaatatttttcgtggcagttatctagcgggagccggactgctttttagtatcatgaaaaatacgacaaatacacgtagagggaccggtaatataggcgagaccctgggagagaaatggaaaagtagactaaatgcacttggtaagagcgagttccaaatatacaagaaatcgggaatacaagaagtagatagaacattagcaaaggaaggcataaaaaggggcgaaactgaccatcacgccgtaagtagggggtccgctaaattaagatggttcgtggaacgaaacatggtaacgcctgaagggaaggtcgtagacctaggctgcggacgaggtggttggtcatattactgtggaggattgaaaaacgtgagagaagtaaaaggcttaacaaaaggagggccaggacatgaagaaccaataccaatgtcaacatatggttggaatctggtcagactacaaagtggtgttgatgttttcttcacacccccagaaaaatgcgacacacttttatgcgatattggcgaatcatcgccaaatcctacgatcgaagcaggtcgaactctgagggtattaaatttagtagaaaattggctgaacaacaatactcaattttgtattaaagttctgaatccatatatgccgagcgtaattgagaagatggaggccctacaaagaaaatatggcggggctctggtccggaacccgttatcccgaaacagcacacacgaaatgtattgggtttccaacgcgaccggaaacatagtctcgtctgtcaacatgataagtaggatgctcatcaatcgatttaccatgaaacacaagaaagctacatatgaacctgatgttgatctcgggtctggaacaagaaatattggcatagaatctgaagtaccaaatttggacattatcggaaaaaggatagagaaaataaaacaagaacacgagacctcatggcactatgatcaagaccatccatacaaaacgtgggcctatcatggctcatatgaaacgaaacaaactggcagtgcttcatcaatggtaaacggggtagttagactattaactaaaccttgggatgttgtcccaatggtaacccaaatggcaatgacagatactactccttttggtcaacagcgagtctttaaagagaaagtagatacccgaacccaggagcccaaagaaggcactaagaaattaatgaaaataaccgccgaatggttatggaaagaactcggcaagaagaaaactccccggatgtgcacccgagaagagttcacacgaaaagttcgaagtaatgctgcattgggggcgatttttacagatgaaaataaatggaaaagcgcacgcgaagctgttgaagacggaagattttgggagctagttgaccgagaaagaaatctgcatctagaaggtaaatgtgaaacatgtgtatacaatatgatgggtaaaagagagaagaaattaggagaatttggcaaagcaaaaggtagccgtgctatatggtacatgtggctgggagccaggttcctcgagttcgaagctctggggtttctaaacgaagaccattggttttctagaggtaattccctatctggcgtcgagggggaaggattacaccgactaggctatatactaagagacgttggcaagaaagaagggggagcgatgtatgcagacgatacagcaggatgggacacgagaataactttagaagatctcaaaaatgaggaaatggtaacaaatcatatgaaaggagagcacaagaaattagccgaggcaatcttcaaactaacataccaaaacaaagtcgtaagagtacaaaggccaacgcctcgtggtaccgtcatggatataatatcaagacgtgatcaaagagggagtggacaggtagggacatatgggttgaacaccttcaccaatatggaagcacagttaataaggcaaatggaaggggaaggaatcttcaaatcaatacagcacttaaccgcaacagaggaaatagcagtacaaaattggctcgcccgagtagggagagaaaggctatcgcgaatggcaatttctggtgatgattgtgtagtaaaaccaatagatgaccgattcgcttctgccctaacagcgttaaacgacatggggaaagtgcgaaaggacatccagcagtgggaacctagccgtggttggaatgattggactcaagtgcctttctgctctcatcactttcatgaattagtaatgaaggatggtcgtgtcttggtcgttccatgtcgtaatcaagacgagttgataggacgggcaagaataagccaaggagccgggtggtccctgaaagagaccgcttgtttaggaaaaagctacgcacagatgtggaccttaatgtattttcacaggcgggatctacgattagctgcaaacgcaatatgtagcgcagttcccccacactgggtacctaccagcagaactacttggtcgattcacgcaaaacacgaatggatgacgaccgaggatatgttggccgtctggaacagagtgtggatccaagaaaacccttggatggaagataaaactcctgtcgaaagctgggaggaagtcccatacttaggaaaaagggaagaccaatggtgtggtagcttaattggtttaaccagcagagcaacttgggccaaaaacatacaaacggccataaaccaagtaagaagtctgataggaaacgaagaatacacggattacatgccaagcatgaagcgatttaggagagaagaagaggaggctggtgtactctggtaa

SEQ ID NO: 22402 - RNA, 9876 nt, synthetic construct
  misc_feature 1..9876: note = derived and/or modified CDS sequence (opt6) from DENV-2__FJ744709__SS-prME
  source 1..9876: mol_type = other RNA
actgctggggtcatcgtcatgctgataccgacagcgatggcatttcatctaacaacgaggaatggagaaccacacatgattgttggaagacaagagaaaggaaaatcccttttgtttaaaactgaagacggcgtcaatatgtgcacattgatggcaattgacttgggagaattatgtgaagatacaatcacatataaatgcccactgctgagacaaaatgaaccggaagatatagattgttggtgtaacagcacttcaacgtgggtaacatatggaacatgcaccacaacaggtgaacatcgaagagaaaaacggagtgtggccctagtacctcacgtcggcatgggattagaaactcgaacagaaacttggatgagctcagaaggggcatggaaacatgtacagaggatagaaacatggattctcaggcaccctgggttcaccataatggcagcggtactggcttacacaataggcactacccactttcaaaaggctttaatatttatattattaacagcggtagctcctagcatgacgatgaggtgtataggaatatctaatcgcgactttgttgaaggagtctcaggaggaagctgggttgacatcgtattagaacacggaagttgcgtaacgacaatggctaaaaataaaccgacgttagactttgaactaattaaaactgaagcgaaacaaccggccactttgaggaaatattgtatagaagccaaactaacgaatacaactacggaatcacggtgtccaacccagggtgagccttcattaaacgaggagcaagataaaagattcatttgtaaacattccatggtagatagaggttggggtaatggatgtggtttattcggcaaaggtggtatagtcacgtgtgcaatgtttacctgcaagaaaaatatggagggtaaagtggtgcagcccgaaaacctcgaatacacaatcgttattacaccacactcgggagaagaacatgccgtgggcaatgatactggtaaacatggcaaagagatcaaaatcacgccacaatctagtataacagaagcggagttgactggatacggaactgtgaccatggagtgtagccccaggacgggcctcgatttcaacgagatggtcctattgcaaatggaagacaaagcatggttagtacacagacaatggttcttagatctcccgttaccatggctccctggtgccgatacacaaggttctaactggatacaaaaagaaactttagttacattcaaaaacccacatgcaaagaaacaagatgtagtagtcctgggaagccaagagggggcaatgcatacagcattgacaggtgccaccgaaatacagatgtcatctggaaacctgctattcacaggtcacctcaaatgtcggctgcgaatggacaaacttcaattaaaaggaatgtcgtatagcatgtgcactggaaaatttaaaatcgttaaagaaattgctgaaacgcaacatggtacgatagtaataagagtacaatatgagggggatggttcgccctgcaaaataccgttcgaaattacggatctcgagaaacgacacgtattggggcgattaattacagtgaaccctatagtaacagaaaaagacagtccggtaaatatcgaagccgaaccgccttttggtgattcatacataataatcggtgtcgagcccgggcaactcaaactaaattggtttaagaaaggtagttcaattggacaaatgttcgaaacaacaatgagaggagctaaacgaatggctatcctaggagacactgcatgggacttcggatccttagggggagtattcacaagtatcggaaaagcgttgcatcaagtgttcggagcgatttatggtgcagccttttctggagtttcatggactatgaaaattttgattggagttatcataacatggattggaatgaactccagaagcacgtctttgtcggtaagccttgtgttagtaggagtcgttactctttatctaggcgcggtagtacaagcagacagtggatgcgttgtatcatggaaaaataaagaattaaaatgcggatcaggaatattcatcacagacaatgttcatacgtggaccgagcaatacaaatttcagccggaatctccatctaagctagccagtgcaatccaaaaagcacacgaagagggaatatgcggcattagatcagtcacgcgtttggaaaaccttatgtggaagcaaattaccccagaattaaaccacattttatcggagaacgaggtaaagttaacaataatgacaggcgatattaagggaataatgcaagctgggaaacgatccctgagaccacaaccgactgaactaaagtattcttggaaaacatggggaaaggcaaaaatgctgagcacagaatcccacaatcaaacgtttttaatcgacggtcctgaaactgcagaatgtccgaatacgaatagagcatggaacagtctcgaagttgaagattatggtttcggagtcttcactactaatatttggttaaaactaagagaaaaacaagatgtgttttgtgactctaaactaatgtccgcagcgattaaagacaatcgcgctgtacacgctgatatgggatattggattgaaagcgcacttaatgatacatggaaaatggagaaagcgagctttatagaagtaaaaagttgtcattggcctaaatcgcacactctttggagcaatggggtactagaatcggaaatgataatacctaaaaattttgcaggcccagtatcacaacacaattatagaccaggttatcatacacaaacagcagggccgtggcatctcgggaagctagaaatggattttgatttttgcgaaggtactacagtggttgtgacagaggattgcgggaaccgcggaccgagcctcagaactaccacagcctcgggaaaactaatcacagagtggtgttgtcgtagctgcacattacctcctctcagatacagaggagaagatgggtgttggtacggaatggaaataagaccgctcaaagaaaaagaagaaaacctagttaatagtctagtaacagcaggccatggtcaaatagacaacttttctttaggcgtacttgggatggctcttttcctcgaagaaatgttaagaacccggataggtactaagcatgcgatcctgctggtagcagtaagtttcgtgactcttataactggaaacatgtcattcagagacctcgggagagtgatggtcatggtcggagcgacaatgacagatgacataggtatgggtgtgacatacctagcgttacttgcagcctttaaggtccgtccaacattcgccgcaggtctattattacgtaagttaacttccaaagaacttatgatggcgaccattggtattgcattattaagtcaaagcacgatacccgaaacaatattagaactgacggatgctctagcactaggtatgatggttctgaaaatagtccgaaatatggaaaaataccaattggccgtcacgataatggctatatcatgtgttcccaacgctgtcattctacaaaacgcgtggaaagtatcgtgcacaattcttgcagcagttagtgtgtcacctttactgctaacatctagccaacaaaaggcagactggatacccctagccttaactattaaaggtctgaaccctaccgcgatatttttaacaacactatctcggacgtcaaagaagagatcgtggcccttaaatgaagcaatcatggcagtcggaatggtatcaatactggcgagttcactactcaaaaatgatatacctatgaccggacctctagtggcaggaggactactaacggtttgctatgtcttaacgggacgaagcgctgatttagagctagaaagagctgcagacgtaaaatgggaagaccaggctgaaataagtggttcttcacccatactttccataactatatcagaagacggttctatgtcaatcaaaaatgaagaagaagaacagacactaactatactaatccggactggattgttagtaatctcagggatttttcctgtatcaatcccaataacagccgcagcttggtacctctgggaggtaaagaaacagagggcaggggtgttatgggacgtaccaagtccacccccagttgaaaaagccgaattggaagatggtgcctaccgtataaaacagaggggaatactaggttatagccaaattggtgctggggtatataaagagggtacctttcatactatgtggcatgtcactagaggggctgtattaatgcatcgaggcaaaagaattgaaccatcatgggcagatgtgaagaaagacctcatatcatacggagggggatggaaactggaaggcgagtggaaagaaggtgaagaagttcaggttctagctttagaaccagggaaaaatccgcgagccgtacagactaagccaggtatatttaaaacaaacactggaacaattggagcggtgtctcttgatttcagtcctggtacgtcagggtcccccattgtggatagaaaaggaaaggttgtcggactctacggcaacggtgtagtaactaggagtggtgcctatgtgagtgcaatagcacaaactgagaaatctatagaggacaatcctgagattgaagatgatatttttcgtaagaaaagactaactatcatggacctacaccctggagctggaaaaactaaacgctatctgccagccatagtaagagaagcaattaaacgaggactaaggacattaatcctggctccaactagagtagtagcagctgaaatggaagaagcattaagaggtctaccgatacgttaccaaactcctgctattaaaacggagcacacaggtagagaaattgtcgatctaatgtgtcatgcaacctttactatgcgactattaagtcctgtaagagttcccaactataatctgataattatggacgaggcccattttactgatccagcttcgatagcggctaggggttatatctcgactcgtgtagaaatgggcgaggctgcgggaatatttatgacagctactcctccaggaagtcgagatccttttcctcagtcaaacgcaccaataatggatgaggaaagagaaattccagaaaggtcatggaactctggccatgaatgggtaacagatttcaaagggaagacagtatggtttgtcccatcaattaaggcaggtaatgacatagcagcatgtttaaggaaaaacgggaagaaagtaatacaattatcgagaaaaacattcgatagcgaatacgttaaaacacgagccaacgactgggattttgtggttactactgacatcagcgagatgggagcaaattttaaagcggaaagggtaatcgaccctcgtcgatgtatgaaaccagttatattgacagatggggaagaaagagtcattctagcaggaccaatgccagtaacacactcctcagctgcgcagagaagaggccgtatcggaagaaatccgaaaaatgaaaatgaccagtacatttacatgggagaacctttagaaaatgatgaagattgcgcccactggaaagaagcaaagatgttgttagacaatattaatacccctgaaggaataataccaagtatgtttgaaccagaaagagaaaaagtcgatgcaatagatggagaatacagacttcgtggagaagcaagaaaaacatttgtcgatctaatgagaagaggagacttgccagtgtggttagcttacaaagttgcggcagaaggcataaattatactgacaggaaatggtgtttcgacggtatcaaaaacaatcaaatactcgaagaaaatatggaggttgagatatggacaaaggagggcgaaagaaagaaactgaagccccgttggcttgacgcgcgaatatacagtgatccgctagcattaaaggaatttaaagagtttgcagcagggagaaaaagtttaaccctaaatttaattacagaaatgggtcggctcccaacattcatgacacaaaaagcaaggaatgccctagacaatttggcagtattacatacggcagaggcaggagggagggcttacaatcatgcattatccgaacttccagaaactctagaaacactattattattaactctacttgcaaccgtgactggagggatcttcctatttttaatgtctgggaaaggtataggcaaaatgacattaggcatgtgttgtatcataacagcttctattctactctggtacgcacagatacaaccacactggatagctgcatcgattatattagagttctttctgatagtattgcttataccagaacctgagaagcaacgaactccccaagataaccaattaacctatgtagtcattgcaattcttacagtagttgcggctacgatggcgaatgaaatgggatttttggagaaaaccaagaaagacttaggcctcggtagtataaccacccaagaaagcgagagtaatatactggatatagatttacgtccggcttcggcctggactctttatgcagtagctaccacattcgtaacacctatgcttcgccattcaatcgaaaactcatctgttaatgtttcgttaacagcaattgctaaccaagctacagttctcatgggcctaggtaaagggtggcccctatcaaaaatggatataggtgttcccttactcgcgataggatgctactcacaagtaaatcccataactttaaccgccgctctattattattggtagctcattatgctataatcggtccaggactgcaagcaaaagcaacaagagaagcacagaaaagagcggcggcaggtataatgaaaaatccaacagtagatggtattacagtaattgatctcgaacctataccatatgatcctaaatttgaaaagcaattaggacaggttatgctcttgattctatgtgttacgcaggttctaatgatgaggactacttgggcattatgtgaggcacttaccttagcgactggtccaattagtacgctatgggagggcaatccaggtagattttggaacacaaccattgctgtatcaatggctaacattttcaggggatcttatctagctggagctgggttgctcttttcaattatgaagaacacaacttcaaccaggagaggcacaggaaacattggcgagacacttggagaaaagtggaaatcgagactaaacgcattgggtaaaagcgaatttcagatctacaagaaaagcggaatacaggaagtagacaggacgttagcaaaagaggggataaaaagaggggaaacggatcatcatgcagtcagccgagggagtgcaaaacttagatggtttgtcgaacgtaatatggtgactcctgagggaaaggtcgtcgacctgggatgcggcagaggcgggtggtcctactactgtggagggttgaaaaacgtaagagaggtaaaaggtctcacaaagggtgggcccggacacgaggagcctataccgatgagcacgtacggttggaatttggtaagactacaaagcggcgtagacgtgttctttaccccaccggaaaaatgtgacaccctactttgcgatataggggagagttcaccgaatcctactatcgaggctggaaggactcttcgagtactaaatttggtagaaaactggctaaataataatacgcaattttgtattaaagttttaaatccttatatgccctccgtgatcgagaaaatggaagcacttcagagacaatacggaggagctcttgtacgtaacccactatcccgtaattccactcacgagatgtactgggtatcaaacgcaactggtaatatagtgagttcagtgaacatgattagtcgaatgctgataaacagatttactatgaagcataaaaaggcaacgtatgaacccgacgtcgatcttgggagcggtacccgcaatataggaattgaaagtgagatccctaatctagacatcattggtaaacggatagaaaagataaaacaggaacacgaaatctcgtggcattacgaccaggatcacccttataaaacatgggcatatcatggatcgtacgaaactaaacaaaccggttccgcaagcagtatggtaaacggagtggtgcgtctattaactaaaccatgggacgtcgtacccatggttactcaaatggccatgacagatacaaccccatttgggcaacaaagagtatttaaagagaaggtcgatactcgaacccaagagccaaaggaggggactaagaaacttatgaaaataactgctgagtggctctggaaagaactcggaaggaagaaaacaccgagaatgtgtaccagagaagaatttactagaaaagttagatcaaatgcagcattgggagctattttcacagatgaaaataaatggaaatcagctcgcgaagcagtagaagatgggagattttgggaattagtggatcgcgaaagaaaccttcatttagaaggaaaatgtgaaacttgcgtatacaatatgatggggaaaagagagaagaaacttggtgaatttggaaaagcaaaagggagtcgagctatctggtacatgtggctaggtgcaaggtttctggaatttgaggcgcttggctttttaaatgaagatcactggttctcgagagagaactcgttatccggggtagaaggcgaaggattgcataggttaggatatatattgagagatgtcggtaagaaagaaggcggagcaatgtatgccgacgacacggcaggttgggacactagaattacactggaggatctcaagaatgaagaaatggtcacaaatcatatgaaaggagaacacaagaaactggcagaagcgatatttaagctaacttaccaaaacaaggtcgtaagagttcaacgacctacgccgagggggacagtcatggacataatctcaagaagggaccaaagaggaagcggacaagtgggaacctacggactaaatacgtttacaaatatggaagcacaattaatcaggcaaatggagggagaaggtatatttaagagcatccaacacctaactgcaacggaagaaattgcagttcaaaactggcttgcaagagtcggccgtgaacgtctctccagaatggcaataagcggtgacgactgcgtagtaaaaccaattgacgaccgctttgcatcagctctaacagcactaaatgacatgggaaaagtaaggaaagatattcagcagtgggaacccagcagaggttggaacgactggacacaagtacctttctgcagtcaccactttcatgaacttgttatgaaagatggcagagtattagtagtaccttgtagaaatcaagacgaattaataggaagggcaagaataagccaaggagctggctggtcattaaaagaaacggcctgtcttgggaaatcatacgcccaaatgtggactttaatgtacttccaccgcagagatttacgacttgctgctaacgctatatgcagtgctgtaccatcacactgggtcccgacttccaggacaacatggagtatccacgccaagcatgaatggatgacaacagaggatatgttagcggtatggaacagagtgtggattcaagaaaatccatggatggaggataaaacgccagtagaaagttgggaagaagtaccctatttagggaaacgggaagaccagtggtgcggatcactaataggcttgacttcacgagcaacttgggctaaaaatatacaaacggccatcaaccaagttcgttccctgatagggaatgaagagtatacagattacatgccatcaatgaaaagattcagaagggaagaggaagaagcaggagtgttatggtaa

SEQ ID NO: 22403 - RNA, 9876 nt, synthetic construct
  misc_feature 1..9876: note = derived and/or modified CDS sequence (opt6) from DENV-2__FJ744708__SS-prME
  source 1..9876: mol_type = other RNA
actgctggagttattgtaatgttgattcctacagcgatggcgtttcacttaacaacaagaaatggagaaccgcatatgatagttgggagacaggaaaaaggcaaatcgctattgtttaaaacagaagatggtgttaatatgtgcacgttaatggcgatagacttgggtgaactatgtgaagacacaattacttataaatgtccattgttgagacagaatgaaccagaagacattgactgttggtgtaattcaacctctacttgggtaacatacggaacctgtacgacaacaggagaacaccgtagagagaaaagaagtgtcgcactcgtgcctcatgttggaatgggtttggaaacacgcacagaaacttggatgagctcagaaggcgcatggaaacatgtgcagagaatagaaacgtggatcctccgtcacccaggttttacaattatggcagcaattctagcatatacgataggaacaacacacttccaaagagcgttaatcttcatattactcaccgcagttgccccttcaatgacaatgcgatgcatcggtatcagtaaccgtgactttgtagaaggtgtcagtggcggttcatgggttgatatcgtattggagcacggttcttgtgttactaccatggccaaaaataaacctactctcgactttgaattaatcaaaacagaggcaaaacaacctgcaacattacgtaaatattgtatagaggcaaaactaactaatacaacaactgaatcaagatgtccaacccaaggcgaaccaagtcttaacgaagaacaagataaaagattcatatgtaaacatagcatggtagacagaggttggggtaacggttgcggactattcgggaaaggcggtatagtgacatgtgcaatgtttacctgtaagaaaaatatggaaggaaaagttgtccagccagaaaatctggaatacacgatagtcataaccccacattccggtgaggaacacgccgtaggtaacgatacgggaaaacacgggaaagaaataaaaattactcctcaaagttcaataacagaagcagagctaacaggttatggaacagttactatggaatgctcccctagaacgggattggatttcaatgagatggtgttattgcaaatggaggataaagcatggcttgtccatagacaatggtttttggacctcccactaccgtggctgccaggagccgacacacaaggaagcaactggatccaaaaagaaaccctagtgactttcaaaaatccccacgccaagaaacaggacgtagtagttcttggttcgcaggaaggcgcaatgcatactgcgttaaccggagctaccgaaatacaaatgagcagcggtaatctattgtttacgggccacttgaaatgtaggttaaggatggacaaattacaattaaaaggcatgagctactctatgtgcactggtaaattcaaaatagtgaaagaaatagcagagacccagcatgggactatagtaatacgtgtacagtacgagggtgatgggtcgccttgtaaaatcccttttgaaataaccgacttagaaaaacgtcatgtactaggtagattaataactgtgaatccaatagtaaccgaaaaagattcaccagttaatatagaggcggaaccaccatttggagactcctatattatcataggggttgaacctggacagttaaaattaaattggtttaagaaaggctcatcgatcggccaaatgtttgagacgaccatgcgtggagccaaaaggatggccatactgggggacacagcatgggatttcggatcgttaggcggcgtgttcacctcaataggaaaagcgttacatcaagtctttggagcaatatatggagctgcgttcagtggagtatcttggactatgaaaattcttatcggtgtaataataacctggataggtatgaactcccgatcgacatcgttgtcagtcagtcttgttcttgtaggagttgtaacgttatatctcggggccgtagtgcaagctgattcgggttgtgtagtatcgtggaaaaataaagagctgaaatgtggttcaggcatatttattacagacaatgtgcacacctggactgaacagtataaatttcaaccagaatcgccaagtaaacttgcaagcgctatacaaaaagcccacgaagaaggaatctgcgggataagatcggtaactcgcttagagaatctaatgtggaaacaaataacgccggaattgaatcatatcttgagtgagaacgaagtcaagctcactatcatgactggtgatattaaggggattatgcaagcagggaagagaagtctgcgtccgcaacctacggaattgaagtactcttggaaaacctggggtaaagctaagatgcttagtacggagtctcacaaccaaaccttccttattgacggtcctgaaacggctgagtgcccaaacacaaacagagcttggaactccttagaggttgaagattatggatttggagtgttcacaacgaacatctggctcaaattgagagagaaacaggatgtattttgtgattccaaattgatgtctgctgcaattaaagacaatagggcagtgcacgcggatatgggatactggattgaatctgccttaaacgatacatggaagatggaaaaggccagctttattgaagtaaaatcgtgtcattggccaaaatcccataccctttggagtaacggagtattagagtctgaaatgataatacccaaaaattttgcagggcctgtatcacaacacaactatagaccaggatatcacacccaaacagcaggaccgtggcatctaggaaaattggaaatggattttgatttctgtgaagggacaacagtagttgttacagaggattgtgggaaccgaggcccttcattgagaactacaacagctagtggtaaactcattactgagtggtgctgcagaagttgtacattgccaccactaagatatagaggagaggacggttgttggtacggcatggaaatcaggccactaaaagaaaaagaagaaaatttagttaatagtttggtgactgcgggtcatggacaaatcgataatttttcattgggtgtgttggggatggccttatttttggaagagatgttacggactagaatcggtacgaaacatgcaatcttattagttgcggttagcttcgtgactctgatcacggggaacatgagctttcgagacctcggaagagttatggtaatggttggagcaactatgactgatgatataggtatgggagtcacatatttagcccttcttgcagcattcaaagttaggccaacgttcgcagcgggtttactactaagaaaacttacatcaaaagaattgatgatggctacgattgggattgccctcttatcacaatccactataccagaaacaatactagaactaaccgacgctctagcactcggaatgatggtattaaaaatagtcagaaacatggaaaaataccagttggcagtcacaatcatggcgataagttgtgtacctaacgccgtgatcctacaaaatgcttggaaagtaagctgtacaatacttgcagcggtgtctgtctccccactccttttaaccagctcgcagcaaaaagctgattggatacctttagcattgacgattaaaggactaaatccaacagccatatttctgaccaccctatctagaacatcaaagaaaagaagttggcctttaaatgaggctattatggcggtcggaatggtttctatactggcatcatcattacttaaaaacgatataccaatgacaggaccattagtagcagggggactattaacagtctgttacgttcttacagggcgtagtgctgacctagaactagagcgcgcagcggatgtcaaatgggaagatcaagcagagataagtgggtcctcccctatattatctattacaatcagtgaagatggctcgatgtctatcaaaaacgaagaagaagaacagaccttgacaatattgattagaactggacttctggttatatccggggttttcccagtttcaataccaataacagctgccgcatggtatctttgggaagtcaagaaacagagagctggagttttatgggatgttccaagcccacctccagttgaaaaagcagaactagaagacggtgcgtatagaattaagcaacgaggtatcctcggatactcccaaatcggtgcaggagtttacaaagaggggacatttcacaccatgtggcatgtgaccagaggagcagtactaatgcatcgaggaaagcgcatagaacctagttgggcggacgttaagaaagatctaatatcctacggtggcggatggaaacttgaaggtgaatggaaggaaggtgaagaagtacaggtattagcattagaaccaggtaaaaaccctcgagcagttcagactaagccgggaatctttaaaaccaatacgggaacaatcggagcggtatctctagacttttcaccaggcactagcggatcaccaatcgttgatagaaaaggtaaagtcgtaggactatacgggaacggagtagtaacaagatcaggagcatatgtatcggcgattgcccaaacagaaaagtccatcgaagacaatccggaaatagaagatgacatttttcgcaagaaaagacttacaataatggaccttcacccaggggcaggcaagactaaacgatatctaccggcgatagttagggaggccattaaaagaggattacgtacactgatactcgctccaacaagggtcgttgcagcagaaatggaagaagctctccgcggcttacctattagatatcaaacaccagcgataaagactgagcatacgggcagggagatagttgacctaatgtgtcatgcaacgtttacaatgcgcctgctttcaccagtacgtgtccccaattataatcttataattatggatgaagcacatttcaccgatccagccagtatcgccgcacgaggttatatttctacgagagtagaaatgggcgaggccgcggggatctttatgacagctacaccacctggttctcgagaccccttcccgcaaagcaatgctccgataatggacgaggaaagagaaattcctgaaaggagttggaatagcgggcacgaatgggttacagattttaaagggaagacagtatggtttgtgccgagcatcaaagcgggcaatgatattgcagcttgccttaggaaaaatgggaagaaagttattcagctgagcagaaaaactttcgactcggagtacgtaaaaacaagagccaacgactgggactttgtagtgacaactgacattagcgaaatgggggcaaatttcaaagcagaaagagttatcgatccaaggaggtgtatgaagccagtcatattaacggacggagaggaacgagtaattctcgccggacctatgcccgtaactcactcgagcgcagcgcaaagaaggggaaggataggccgtaaccccaagaacgaaaatgatcaatatatatatatgggtgaacctttagagaatgatgaagactgtgcacattggaaagaggcaaaaatgcttctcgataacattaacacgcccgagggaataatcccgtccatgtttgaacccgaacgagagaaagtagacgcgatagatggagaatacaggctcaggggtgaagcaaggaaaacgtttgtggacctaatgagacgtggtgacttacctgtatggctagcttacaaagtggcagcagaaggtattaattatgctgaccgcaaatggtgctttgatggaatcaaaaacaaccaaatattagaagaaaacatggaagttgaaatctggaccaaggagggagagagaaagaaacttaaaccacgctggttagatgcacgaatatactcggacccattagcactgaaagagttcaaagaatttgcagctggaagaaaaagccttacacttaacttaattacagaaatggggcgtctgccgacatttatgacacaaaaagcaaggaacgcactagacaaccttgctgtactacacacagccgaagcaggaggacgcgcgtataatcacgctctctcggaacttccagaaactttagaaactcttttattgcttacacttctagcaacggtaactggaggtatctttttgttcctaatgagcggcaaaggaataggtaaaatgaccctcggcatgtgttgtataatcacagcaagtatcttactctggtacgcagaaatccaacctcattggatcgctgcttctataatcttggaatttttcttaatagtactattaattccggaacccgaaaagcagagaacgcctcaagacaaccaactaacctacgtagtcatcgcaatattaacagttgtggcagccaccatggctaacgaaatggggttcctagagaaaactaagaaagacctcggtttaggcagcataacgacgcaagagagcgagtcaaatatattagacattgatttaagacctgcaagcgcatggacgttatatgccgtagcaactacgttcgtaactcctatgctaaggcattcaatcgaaaacagcagcgtaaatgtatccctgactgctatcgccaatcaggctacagttcttatgggattaggtaaaggatggcctttaagcaaaatggatatcggtgtaccgctgttggcaatcggctgctatagccaagtcaatcctataaccctcaccgctgcgctactgttacttgtagcacattatgctattataggcccaggtttacaggctaaagcaactcgtgaagcccaaaaacgtgctgcagcaggtatcatgaaaaatccaacggtagatggtattactgtgatagacttagaaccaataccatatgatccaaagttcgaaaaacaactcggacaagttatgttactcatcctatgtgtaacccaagtactaatgatgcgtaccacgtgggccctatgtgaagcattaactctagctacaggcccaatatcaactttatgggagggtaaccctggcaggttttggaatacgacaatcgctgttagtatggtaaatatattttctggtagttaccttgcaggagccggtctgcacgtccccttacgtaaaaacactctacgtacccgtcgcgggactggaaacacaggagaaactttaggcgaaaaatggaaatcaagacttaacgccctcggcaaatccgagttccagatttataagaaaagcggaatccaggaagttgatagaacccttgccaaggaggggattaaaaggggcgaaaccgatcatcatgcggtttcacggggtagcgctaaattacgatggttcgtcgagagaaacatggtcacgccagaaggcaaagtagtggacttaggctgtggccggggtggatggtcgtattactgcggtggcttgaaaaacgtgagggaagtgaaaggacttaccaaaggcggacctggacacgaggagcccataccgatgtcgacatatggatggaatttggtgcgactgcagagtggagtagatgtattctttacgccaccagaaaaatgcgatacactcttatgtgacataggcgaaagcagccctaatcccacgattgaagccgggagaacactaagagtattaaatttagtagaaaactggctgaataacaacacacaattctgcataaaggtgttaaatccatatatgccaagcgtcattgagaagatggaagcattacaacgtcaatatggtggagcattggtgagaaatcctttatccagaaattctacccacgaaatgtattgggtaagcaatgcaacggggaacatagtgagctcagttaacatgatatctcggatgttaataaacagattcacaatgaaacataagaaagcaacctacgaaccagacgtagatttaggctctggcacaaggaacattggtatagagtctgaaatcccaaatttggatatcattggtaaacgaatagagaaaattaaacaggaacatgaaatatcgtggcattatgatcaagatcacccttacaaaacctgggcttatcatggatcttacgaaaccaagcagactggtagtgcgagttcaatggtaaatggagttgttagattacttactaaaccgtgggatgttgtacccatggttactcagatggctatgacggacacaaccccctttggacaacaaagagtatttaaagaaaaagtagatacaagaacacaagaaccaaaagaaggaacaaagaaactaatgaaaataacagctgagtggctatggaaagagcttggtaagaagaaaactccgagaatgtgtacaagagaagaatttactaagaaagttcgttcgaacgcagcgcttggagctatctttactgacgaaaacaaatggaaatccgctcgagaggcagttgaagatggtagattttgggaactcgtagaccgcgaaagaaatctacatcttgagggcaaatgtgaaacatgtgtctataatatgatgggtaagagagagaagaagttaggtgaatttggaaaagcaaagggatcacgagcaatctggtatatgtggttaggggcaagatttcttgagttcgaagccttaggctttttaaatgaagatcactggttttcacgaggtaactctttaagtggcgtcgaaggcgaagggctccatcgattaggatatatcttacgagatgtaggaaagaaagaaggtggcgcaatgtacgcagacgatacagctggatgggacacaagaattacactagaagatcttaaaaatgaagagatggttacaaatcacatgaaaggcgaacataagaaattggcagaagctatctttaaattaacataccaaaacaaagtcgtgcgagtacaaaggccaacacctcgaggaactgtcatggatattattagcagaagagatcaacgaggatcaggccaggtcgggacatacgggttaaatacatttactaatatggaagcacaattaatcagacaaatggaaggcgaggggattttcaaatcaatccaacatctcaccgcaacagaggaaattgcagtacaaaactggttagcgcgtgtgggaagagaaagactttcacgaatggcgattagtggagatgattgcgttgtcaaaccgattgatgataggttcgcatctgcattaaccgcacttaatgacatgggaaaagtaagaaaagatatacaacaatgggaaccgagtcgaggctggaatgattggacgcaagttccgttctgttcacaccattttcacgagctagtgatgaaagacgggcgagttctcgtggtaccgtgtaggaatcaagatgaattgataggcagagctagaataagccagggagctggatggagcctgaaagaaacggcatgcctcggcaagtcatacgctcaaatgtggacactaatgtactttcataggagggatctgagattagcggctaatgctatatgctccgctgtaccatctcactgggtacctactagccgtactacctggagcatacacgcaaaacacgaatggatgacaacagaagatatgttagcggtgtggaatcgagtatggatacaagaaaatccatggatggaggataaaacacccgtagaaagttgggaagaagtaccatacttaggtaaaagagaagaccaatggtgcggcagcttaattggcctaacaagtcgggcaacttgggctaaaaatatacagactgcaattaatcaagtaagatcactaattggtaatgaggaatatactgattatatgccttcgatgaaaaggtttagaagagaagaggaagaagcaggggtactttggtga

SEQ ID NO: 22404 - RNA, 9876 nt, synthetic construct
  misc_feature 1..9876: note = derived and/or modified CDS sequence (opt6) from DENV-2__FJ810418__SS-prME
  source 1..9876: mol_type = other RNA
actgctggagtaatagtaatgcttattccgactgcaatggcttttcatttgacaacaaggaatggggaacctcatatgattgtaggtcgacaagaaaaaggcaagagcttactatttaaaacagaagatggagtgaacatgtgtacgcttatggcaattgaccttggggaattatgtgaagacacgataacgtacaaatgtcccttactaagacaaaatgaaccggaagatatagattgttggtgcaattctacatcgacatgggttacttacggtacttgcacaactacaggagaacaccgaagagaaaaacgctctgttgcactggtaccgcatgtggggatgggtttagaaacgagaacggaaacctggatgtcatcggaaggggcatggaaacatgtacaaagaatagaaacatggattttaaggcatccaggtttcactatcatggcagcaattttggcatacacgattggtacaactcactttcaacgcgcactcatattcatattgttgacggcggtagcaccttcaatgacaatgagatgtattggtataagtaatagagacttcgtggaaggcgtttcaggaggttcatgggtagatatagttctagaacacggctcctgtgtgacaactatggccaaaaataaaccgacgttagatttcgaactaataaaaacagaggcaaaacaaccagcaacattgagaaaatactgtattgaagctaaacttacgaacactacaactgaaagtaggtgcccaactcaaggtgaaccaagcctcaatgaagaacaagataaaagatttatttgcaaacactccatggttgatagaggatggggaaatggctgtggcttgttcggcaaaggtgggatagtaacatgcgcgatgtttacttgcaagaaaaacatggagggaaaagttgtccaaccagaaaacttagaatacacaatcgtcataacgccccacagcggtgaagaacatgctgtaggtaacgatacgggaaaacacggaaaagagataaaaatcactccacaatcgtcaatcacggaagccgaattaacggggtatggaacagttacaatggagtgtagcccgcggacaggattagatttcaatgaaatggtattactgcaaatggaagacaaagcatggctagtacaccggcaatggttcttggatctaccgctaccttggctaccgggtgctgatactcaaggttctaactggattcagaaagaaacattagtcacattcaaaaatcctcatgcgaagaaacaggacgtagtagtgttaggctcccaggaaggtgcaatgcatacagcattgacaggcgctacagaaatacaaatgagtagtggtaatctactgtttacagggcatttaaaatgcaggttgaggatggataaactacaacttaaaggtatgtcgtattcgatgtgtacaggtaagtttaagatagtaaaggagatagcagaaacgcagcacggcactatagtaatacgagttcaatatgaaggagatggctctccatgtaaaataccctttgaaattacagatttagagaaacggcatgttctaggaagactaatcacagtaaacccaattgttactgaaaaagacagcccagtcaatatcgaagcagaaccaccctttggagactcttatataatcataggagtagaaccaggacagttaaaactaaactggtttaagaaaggtagttctattggacaaatgtttaagactacgatgcgtggagccaaaagaatggctattttgggagatactgcctgggatttcggatccctaggtggtgtattcacatccataggaaaagcgttgcatcaagtttttggggccatctatggagcggcttttagtggagtaagctggacaatgaaaatactaatcggggttgttattacatggataggaatgaactcgagaagtacatccttatctgtgtctttggttttagttggcgttgtaaccttatacctaggggctgttgtccaagctgatagtgggtgtgtagtaagctggaaaaataaagagttgaagtgtggtagtggaatattcataacggataacgtacatacatggacagaacaatataaatttcaacccgagagtccaagtaaactcgcttcggcgattcagaaggcacatgaggaaggcatctgcggcattagaagtgttactcggctcgaaaacttaatgtggaaacaaataacaccagagttgaatcatattctgagcgagaatgaagtaaaattgactatcatgactggagacatcaaaggtataatgcaagcaggtaagagaagtttacgaccgcaaccaacagaactcaaatacagttggaaaacttggggtaaagccaaaatgctttccactgaaagtcacaatcagacttttctaatagacggtcccgaaacagcagaatgtccaaacacaaaccgggcgtggaactccttggaagtagaagattatggttttggtgtatttacaacaaatatatggttgaaactcagggaaaagcaagacgtcttctgcgattccaaacttatgtcagcagccatcaaggacaacagagcggttcacgcggatatgggttattggatagaaagcgcactcaacgatacttggaaaatggagaaagcatcttttatcgaggtgaaaagttgccactggccaaaaagtcatacgctgtggtccaacggagtgttggagtcagaaatggtaataccgaagaattttgcgggccctgtaagccaacacaactatcgacccggataccatacgcaaacagcaggtccttggcacttgggaaaattagaaatggattttgatttttgtgagggcacgactgttgttgtaacagaagattgtgggaacagaggaccgagccttcgcaccacaacagcatcgggaaaactcataacagagtggtgttgtagaagctgcacactaccccctttacggtacagaggcgaagatggatgctggtatggaatggaaattaggcccctaaaagaaaaggaagaaaatttagtaaacagcttagttactgccgggcacggacagatagataattttagtcttggagttctagggatggctttattcctagaagaaatgctcaggacccgcataggcaccaaacatgcaatattgttagtagcagtcagttttgttaccttaattaccggaaatatgagctttcgggatcttggtagagtaatggtaatggtaggagcgaccatgacagatgacataggaatgggcgtcacctatttagcgcttctagcggccttcaaagtccgtcccactttcgcggctggattactactgagaaaactaacctctaaagaactaatgatggcaacaataggcattgcccttttgagccaaagcacaattccagaaacaatattggaattaactgatgcactagccttaggaatgatggtactaaagatagtacgcaatatggaaaagtatcagcttgcagttacgataatggcgattagttgtgtgcccaatgcagttatattacaaaatgcctggaaagttagttgcacaatactggcggctgtatcagtaagtcccctattgctaacatctagtcaacaaaaagccgactggattccacttgccttaacgataaaaggcttaaatccaacagcaatattcctaacaacattatcaaggactagcaagaaaaggtcttggccgcttaatgaagcaataatggcagttggaatggtaagtatactagcatcatccctacttaagaatgatattccaatgacgggaccactcgtggcagggggactacttaccgtgtgttatgtcctaaccggaaggagcgctgatctcgaattagagagagcggccgatgtgaaatgggaggaccaagcagaaatatccgggtcttcccctatactatccataacgatatctgaagatggatcaatgtcaattaaaaacgaggaagaggagcagacattaacaatactaatccgaacgggtttgctggtaatatcaggtgtcttcccagtctccataccaattactgcggccgcttggtatctttgggaagtcaagaaacaaagggccggcgtgttatgggatgtcccttcacctcctcctgtagaaaaagcggaattggaagatggagcttacagaataaaacagcgaggcattctaggttacagtcaaataggggcgggagtttacaaagaaggtactttccacactatgtggcatgtcacacgaggcgcagtactaatgcacaggggcaaaagaattgaaccttcgtgggctgacgtaaagaaagacttaatttcatatggcggaggttggaaacttgaaggtgaatggaaggaaggcgaagaagtccaagtcctagccctagaaccaggtaaaaatccccgggccgtacagaccaaaccagggatattcaaaactaatactggaacaataggtgctgtaagtctagatttcagccctggcacaagtggatcccccatagtagatcgtaagggcaaagtagttggactttacggaaatggagtagtcacccgaagtggagcatacgtttcagcgattgcacaaacagaaaaatcaattgaagataatcccgaaattgaggacgatatattccgtaagaaacgacttaccattatggacctccacccaggagcaggcaaaacgaaacgctatttacctgcaatagtacgagaggcaatcaaaaggggtctaagaactttaattttagcacctacaagggtagtagccgcggaaatggaagaggcacttagaggcttacccattcgttatcagacccccgcaattaaaaccgaacatacaggacgtgaaattgttgatctgatgtgtcatgcaacgtttaccatgcggttgctaagtccagtaagagtccctaactataaccttataataatggacgaagctcatttcacagacccggcttctattgctgcaagaggttatatatcaaccagggtagaaatgggagaagcagccggaatatttatgactgctacacctcccggaagtcgtgatccgttccctcaaagcaatgccccgattatggatgaagagagagaaattccagagaggtcttggaactctggccacgaatgggtaacagattttaaaggcaaaacagtatggtttgtcccatctataaaagccgggaatgatatagcggcatgtcttaggaagaatggtaagaaagtgattcaactgtcaaggaaaactttcgattccgaatacgtaaaaacaagggccaacgactgggatttcgtagtaacgacagacatatcagaaatgggtgcaaattttaaagctgaaagggtaattgacccacgtagatgcatgaaaccagtgatccttacagatggtgaagaacgggtaatactagcaggtcctatgcctgtaacacacagctccgcagcacagcgaaggggacgtatagggcggaatcctaaaaatgaaaatgaccagtatatatacatgggagaaccgttagagaacgatgaagactgtgcgcattggaaagaggcgaaaatgctactagataatataaatacgcccgaagggataatcccatctatgtttgaacccgaacgcgagaaagttgatgctatagacggggaatatagactccgcggcgaagctagaaaaacatttgtagacctaatgagaagaggagacttacccgtatggctagcatataaagtggccgccgaaggaataaactatgcagaccgaaaatggtgtttcgatggcatcaaaaacaatcaaatattagaggagaatatggaggtagagatatggaccaaagaaggcgagcgaaagaaattgaaacctagatggctagatgcaaggatatattccgatcctcttgctttaaaagagttcaaagaatttgccgcaggacgtaaaagccttacgcttaatctgataactgagatgggacgtctgccaacatttatgactcagaaggccagaaacgctctcgacaacttggcagtattacacactgccgaagcgggtggtcgggcttataatcatgcattatctgaattacccgagactttggaaacattacttctacttacattactggcaacagtaacgggtggaatatttctatttctgatgtctgggaaagggataggaaaaatgactttaggaatgtgttgcattataacagcgagcatactactttggtatgcgcaaatacagccgcattggattgccgcctcaattatattggaatttttcttaattgtattattgattccagaaccagaaaaacaacgcacaccgcaggataatcaacttacatacgttgtaattgctatcttaactgttgtcgctgctacaatggcaaatgaaatgggattcctcgaaaagaccaagaaagacctagggcttggctccataaccacgcaggaatcagaaagtaatatattagacatagacttaaggcctgcgagcgcatggactttatacgctgtagcaactacattcgtaactcctatgctccgacattcgatagaaaatagctcagttaatgtatcactaacagcaatcgctaaccaagctacggttttaatggggttagggaaaggctggcctttaagcaaaatggatatcggtgtacctttattagcaataggatgttactcacaggtcaaccctatcacacttacggcggccctattactacttgtagcacattatgctataatagggccagggcttcaagcaaaagctacacgtgaagcccagaaaagagcagcagctggaatcatgaaaaatccaaccgtggatggcataacagttatagacttggaaccaatcccatatgatccaaaattcgaaaagcaattaggacaagtaatgttactcatactgtgtgtcactcaggtgctaatgatgcgcacaacctgggctttgtgcgaggcactaacattggcgacgggaccgatatcaaccttatgggaaggaaatccggggagattctggaacactactatagctgtatcaatggctaacatatttagagggagttatctagccggagcaggtttgctatttagcataatgaagaatacaactagcactagacgcggcactggcaatataggagaaacgctcggcgaaaaatggaaatctcgattaaatgcattaggaaaaagtgagttccagatatataagaaaagcggtattcaggaagtagaccggacattggctaaagaaggaataaaaaggggagaaactgatcaccacgctgttagtcgggggtccgcaaagttgcgctggtttgtagaacgcaatatggtaacgccagaaggtaaagtcgtagacttgggatgcggaagaggaggttggagctattattgtggaggattgaaaaacgttagagaagtgaaaggtctcactaaaggaggaccaggccacgaagaaccgataccaatgtcaacatatgggtggaatcttgtacggttacaatctggtgtagatgtatttttcacgcctcctgagaaatgtgacacactactctgcgatatcggggagtccagtccaaatccaacaatcgaggccggtcgcaccctgagagtgttaaatctggtcgaaaattggttgaacaataatactcagttttgtatcaaagtactaaacccctacatgccttccgttatcgagaaaatggaggcactacagaggcaatacggaggtgctctagttaggaatccattgtcaagaaattccacgcacgaaatgtactgggtttccaatgctaccgggaatattgtttccagtgttaacatgatcagccgcatgttgattaacagatttacaatgaaacataaaaaggcaacatatgaaccagatgtcgatctagggtcaggaacccgaaatattggaatcgaatcagaaattcctaacttggatattataggtaaaaggatagagaaaataaaacaagaacatgaaatctcatggcattacgatcaagatcatccgtataaaacatgggcatatcacggctcttacgaaactaaacagactggtagtgcgagctcgatggtaaatggagttgtaaggctactgaccaaaccttgggacgtagtacctatggtaactcaaatggcaatgactgatacaacgccctttggacagcaaagggttttcaaagaaaaggtagacacccggacccaagaaccgaaagaagggaccaagaaattaatgaaaatcaccgcagagtggttatggaaagaattgggtaaaaagaaaacgccacgaatgtgcacacgggtagaatttactaaaaaggtccgaagtaacgcagcacttggagctatatttacagatgaaaataaatggaaaagtgcacgcgaagctgtagaggacggaagattctgggagctggtggatcgcgaacgtaatttgcatctagaagggaaatgcgaaacatgtgtgtacaatatgatgggtaagcgagaaaagaaattaggcgaatttggaaaggccaaaggatcacgtgcaatatggtacatgtggctaggtgccaggtttctcgaatttgaagcattaggatttttaaatgaggaccattggttttcacgcggtaattctcttagtggagtagaaggagaaggcctccataggttaggctacattctgagagatgttggcaagaaagaaggaggcgccatgtatgctgatgatactgcgggatgggacacaagaataacactagaagacctcaaaaacgaagagatggtaacaaatcatatgaaaggtgaacataagaaattggcagaagcgatctttaaactcacctatcaaaacaaggtagtccgtgtacaacgacctacacctaggggcactgttatggatatcataagtcgaagagaccaaagaggttcgggccaggtagggacatatggtttaaacaccttcacaaacatggaggcgcaactaatacgtcaaatggaaggtgaaggtattttcaagagtatccaacatcttacggccacagaggagatagctgtacaaaattggctagcgcgagtaggacgagaacgattatcaagaatggcaataagtggagatgactgcgtcgtaaaaccaattgacgatagattcgcttcagcgcttactgctctaaacgatatgggcaaagtccgtaaggacatacagcaatgggaaccctcaagaggatggaatgattggacacaagttccgttttgtagtcatcatttccatgagctagtaatgaaagatggaagagtcctagtggtgccttgtcgtaatcaggatgaattaattgggagagcaagaatatcgcagggtgcgggatggagtctaaaagaaacagcatgccttggtaaaagctatgcgcaaatgtggacactgatgtatttccaccgacgtgatctgcgactcgcagctaatgctatttgctctgcagtccctagccactgggttccaacaagcagaacaacatggtcgatacatgccaaacacgaatggatgacaacagaagatatgttggccgtgtggaatcgagtctggattcaagaaaatccatggatggaagataaaacgccggttgagagttgggaggaggtaccgtatcttgggaaacgtgaagatcaatggtgcggtagccttataggactaacgtcgagagcgacatgggccaaaaacatacaaacagcaataaatcaggtccgttctttaataggaaatgaagaatacaccgattacatgccatctatgaaaagattccgcagagaagaagaagaagctggcgtactatggtaa

SEQ ID NO: 22405 - RNA, 9876 nt, synthetic construct
  misc_feature 1..9876: note = derived and/or modified CDS sequence (opt6) from DENV-2__FJ639835__SS-prME
  source 1..9876: mol_type = other RNA
acggccggtgtcattgtaatgctaataccgactgcaatggcttttcacttaacaactcgaaacggagaaccacatatgattgtggggcgacaagaaaaaggaaaatctctactttttaaaactgaagatggagtgaacatgtgcactttaatggcaattgatttaggagaattatgcgaagacacgattacatacaaatgtcctttgttaagacagaatgaaccggaagatatagactgttggtgcaatagtacgtctacttgggtaacgtacggaacgtgtacaacaactggagaacatcgcagagagaaaagatctgtagcgctggtaccccatgtcggtatgggtttagaaacgagaacagaaacttggatgagctctgaaggggcctggaaacacgtacaaagaattgaaacatggatactaagacatccaggatttactataatggctgcaattttggcatatacgatcgggaccactcactttcaacgggcactaatattcattttactaacagctgtagctccgtcgatgacaatgagatgcataggaatatcaaacagagactttgtggaaggagtcagtgggggtagctgggttgatatagtactggaacacggatcatgtgtaaccactatggcgaaaaataaacctactctggattttgaattaataaaaacagaagccaaacaacctgcaacacttcggaaatattgtattgaagcgaaattgacaaatacaacgactgaaagccgatgtccaacacaaggtgaaccaagtctaaacgaagaacaggacaaacgctttatatgtaaacacagcatggtagatcgtggatggggaaatggatgcggtctcttcggaaaaggaggaatagttacttgtgcgatgtttacctgcaagaaaaacatggaaggtaaagtcgtacaaccagagaaccttgaatacaccatagtgataacgccgcattcaggggaggaacatgctgtcgggaatgacacagggaaacacggaaaagaaataaaaattactccccaatcttcgattacagaagccgaactcactggatatggcactgtaactatggagtgcagccctagaacaggattagatttcaatgaaatggttctcttacaaatggaggataaggcttggctagtacaccgacagtggtttttggacttaccgcttccatggttgccgggcgccgatactcagggttcaaactggatccaaaaagaaacattagtcacatttaaaaatccacatgccaagaaacaggatgtagtcgtactaggatcacaagaaggcgctatgcacactgcactgacaggcgcaacagaaatacaaatgtcaagcggtaatctacttttcacaggccacctgaaatgccgcttaagaatggataaattacaactgaaaggtatgagctatagtatgtgtacagggaaattcaaaatcgttaaagaaattgcagaaactcagcatgggactattgttataagagtgcagtacgaaggggatggcagtccatgtaaaatcccctttgagataactgatcttgagaaaagacacgttctaggtaggttaattaccgtaaacccgatagtgaccgaaaaagactccccagttaatattgaggctgaaccgccattcggtgattcttatattataataggcgtagagccaggtcaattgaaattaaattggtttaagaaagggtcatccatagggcagatgtttgaaaccacgatgcgtggagcgaaaaggatggcaattctaggtgacaccgcgtgggactttggaagtctaggaggggttttcacaagtataggcaaagcattacatcaagttttcggagcgatttacggggccgctttctcaggtgtaagctggacaatgaaaattctaataggagttataatcacctggataggaatgaactcaaggtccacctccttatctgtcagcttggtcttagtaggagtcgtaacactatacttgggagccgtagtccaagcagacagtgggtgcgtagtcagctggaagaacaaagagctcaagtgtggatcgggaatattcataaccgacaatgtacatacttggacagaacaatataaattccaacccgaatctccgagtaaattggcgtcggcgatacaaaaagcgcatgaggaaggaatatgcgggattagatcagtaacgaggctagaaaatctcatgtggaagcaaataacaccagagttaaaccatattctatcggaaaacgaagttaaactgacaataatgactggcgacataaagggtatcatgcaagctggcaaacgatctttaagaccccaaccaactgagctgaagtacagctggaagacttgggggaaggcaaaaatgttatcgacagaaagtcataatcaaacattcttaattgacggtccagaaaccgctgagtgcccaaatacaaaccgcgcctggaatagcttagaggtagaggattatggattcggtgtatttacaactaacatatggttgaagctgagagagaaacaagacgtattttgcgactccaagttaatgtctgcagccataaaagataatagggcggttcacgcggacatgggctattggatcgaatcagctttaaatgacacgtggaaaatggaaaaagcctcttttatagaggtaaaatcatgccattggcccaaatcacatacattgtggtctaacggagtcctcgaatctgaaatggttatacccaaaaatttcgcaggtccggtatctcaacacaattaccgacccggataccacacacaaactgcaggaccttggcacctagggaaactagaaatggactttgacttttgtgaaggaacaacggttgttgtaacagaagactgcggaaatagagggccatctctcaggactacaacagcatcaggaaagctaatcaccgaatggtgttgcagatcctgtaccctaccaccattacgatatagaggcgaggacggatgttggtacggtatggaaatacggccactaaaagagaaggaggagaatcttgtaaactcactcgtaactgcggggcacggtcaaatcgacaacttctcattaggagtcttgggaatggcactttttctagaagagatgcttcggacacgtattggaactaagcatgccatattgttggtagctgtaagttttgtgaccttaatcactggaaatatgagttttcgggatttaggacgagtaatggtcatggtaggcgcaacgatgaccgacgacataggtatgggcgtaacatacttagccctactagcggcttttaaagttaggcctacatttgcagcaggactcctattgagaaaactcaccagtaaagaactgatgatggcgacaataggaatagcacttctatcacaatcaacaatacctgaaactatccttgaattgactgatgcacttgctcttggtatgatggtactcaaaattgtccgcaatatggaaaaatatcagctagccgtgactattatggccatttcatgtgttcctaacgcagtcatactacaaaacgcttggaaagtctcttgtacaatcttagctgcggtctcggtaagtccgttattacttacaagctcacaacaaaaagcggattggatcccactggcattaactataaaaggtcttaatccaaccgctatatttctgactactttaagcagaacttccaagaaaagatcgtggcctctaaatgaagcgataatggccgtcggtatggtaagtatcttggctagttcattgctaaagaatgacattccgatgacaggacctttagttgccggaggactgctaacagtatgttacgtattaaccggccgatcagcagacttagaacttgaacgtgccgccgatgtcaaatgggaagatcaggcagaaatctcaggatcttcccctatattatctataactatttcagaagatgggtcaatgtctattaaaaatgaggaagaagaacaaacgttgacaatactaataagaaccgggttattagtaatctccggagtgtttccggtctcaatacctataactgcagcagcatggtatttatgggaagttaaaaagcagcgagctggagtcttatgggacgtcccaagcccaccaccagtggagaaagctgaacttgaggatggggcatatagaataaaacagcgcggtattttgggatatagccagataggagcaggagtgtataaagaagggacatttcatactatgtggcatgttactagaggcgcagtgcttatgcacagaggaaaaagaattgaaccttcttgggctgatgttaaaaaggatttgatttcatacggcggtggatggaagctagaaggggaatggaaagaaggggaggaggttcaagtcctggccctcgaacccggcaaaaatccacgagctgtacaaacaaagcctggcatttttaaaacgaataccggaactataggcgctgtctcgttagacttctcccccggaacatcaggaagccctatagtcgatcgaaagggtaaagtggttggcctgtatggcaacggtgttgtcactcgttccggagcatacgtatctgcgatagcgcaaacggagaaatctattgaagataatcctgaaatagaggacgacatttttaggaagaaacgcttgaccataatggacctgcacccgggagcaggaaaaacaaaacgctatctacctgctattgtcagggaagccataaaaagaggcctacgaactctaatcttggcgcctacacgtgtcgtggcagctgaaatggaagaagcgctcagggggctcccaataagataccaaacgcctgctataaagacagaacatacaggacgtgaaattgtagacttaatgtgccacgcaacttttacgatgcggctattatcacccgtccgagtaccaaattataatcttataataatggacgaggcacacttcacagatcctgcttcaatagccgcacgtggttatatatctactcgagtggaaatgggagaagccgccggtatttttatgacggccactccgccaggttctcgtgatccatttcctcaatcgaatgctcctataatggatgaagaaagagagatacccgagcgctcttggaactcaggccatgaatgggttacagactttaaaggtaagacggtgtggtttgttccatcaataaaagccggtaatgatatagcagcctgtctgaggaaaaatggcaagaaagtcatacaactaagccgtaagacattcgacagtgaatacgtaaaaacaagagcaaacgattgggatttcgtcgtaacgactgatatatcagaaatgggtgcaaatttcaaggcagaacgggttatagatccaagaagatgtatgaaaccggttatactaacagacggagaagaacgcgtaatcctagccggtccaatgccggtcacccatagctctgctgcgcaacgacgaggaagaattggcagaaatcccaaaaatgaaaacgatcaatatatttatatgggcgaacctctagaaaatgacgaggactgcgcgcattggaaagaagcaaagatgctattggacaacataaacactcccgaagggatcatcccgagtatgttcgagccggaacgtgaaaaggtggatgcaatagatggagaataccggcttagaggggaggcaagaaaaacattcgttgatcttatgagaagaggagatttaccagtatggttagcctataaagttgctgctgaaggcataaattatgcggacagaaaatggtgttttgacggtatcaaaaataatcaaatattagaagaaaatatggaagtagaaatatggacaaaggaaggagaacgtaagaaattgaaaccacggtggctagatgcacgtatatatagcgaccccctagcgctaaaagagttcaaagaatttgctgcaggacgaaaatcacttactttgaacctaattacggaaatgggacgactaccaacatttatgactcaaaaagctagaaacgccctagataatctcgccgtactgcacaccgccgaagcaggcggtagagcttacaaccacgcgttaagtgagcttccggaaacattagaaacacttctactattaaccttattagcaactgtcacagggggcatatttctgttcttgatgtccggcaaaagcataggaaaaatgactttaggcatgtgttgcataatcactgcttcaattttgctctggcacgcccaaatacaaccccattggatagccgcgagtataattctagaatttttcttgatagtactattaataccagaaccagaaaaacaaagaacaccacaagacaatcaattaacctatgtcgtgatagcgatattaacagtagttgcagcaacaatggcgaatgaaatggggttccttgagaaaaccaagaaagaccttggactaggctcaataacgacgcaagagtcagagagcaatatattagacattgacttacgacccgcatccgcatggactctctacgctgtcgccacaacgtttgttacaccaatgttgcgccactcaatagaaaactcttccgtaaatgtatctcttacagcaatagccaatcaagccactgtcctaatgggtttgggcaaagggtggccattaagtaaaatggacattggggtaccccttctagctataggttgttactctcaggtcaatccaattacactgacagcagccttattattgctggtcgcgcactatgcgataatagggccagggcttcaggcaaaagctactcgcgaagcacaaaagcgagctgcagctgggataatgaaaaatccaactgtagatggaattactgtcatagacttagaaccaataccatatgatcctaaatttgaaaaacaactaggacaagttatgctattgattttgtgtgtaactcaagttttaatgatgaggactacatgggctttatgcgaagctctgacactagcaaccgggcctataagtaccttatgggaaggaaatcctggccgattctggaataccactatcgcggtatcaatggcaaatattttccggggcagttacttggctggtgcaggactgctattctcaataatgaagaatacaactagcacaagaagagggaccggaaatattggtgaaacattaggcgagaaatggaagtcaagactgaacgctcttggaaaaagtgaatttcaaatctataagaaatcaggaatacaagaagtggatagaactttggcgaaggaggggattaagagaggtgaaacggaccaccatgcggtttcaaggggttctgcaaaattgcgttggttcgttgaacgtaacatggtgacaccagaaggaaaggtggttgatttaggctgtggacgaggtgggtggtcatactactgtggtggacttaaaaatgttagagaagtgaaaggcttgacaaaaggcggacccggacatgaagaaccaattccaatgtctacatatgggtggaacctggtaagactacagtcaggagtggacgtgttcttcacccctccagagaaatgcgatacactactatgtgatataggtgagtcctcaccgaatcccacaatcgaagctggtagaacgttaagagtattaaaccttgtagaaaactggttaaataacaacacacagttctgcataaaagttctcaatccttacatgccctcagtgattgagaaaatggaagcactacaaagacaatatggaggagcattggtcagaaatccgttatcaaggaacagtacgcacgaaatgtattgggtaagcaatgctacgggaaacatcgtgtcgagcgtaaacatgatttcaagaatgcttataaatcggttcacaatgaaacacaagaaagcaacgtatgaaccagacgttgacctaggatccggcacgagaaatataggaatagagaatgagattccgaatttggatataattgggaaaagaatcgagaagatcaaacaggaacacgaaattagctggcactatgatcaagaccacccctataaaacttgggcataccatggttcatatgagacaaagcaaacaggtagtgcatcgagtatggtgaacggtgttgtcagattgctgacgaaaccctgggacgttgtgccaatggtaacacagatggcaatgacagatacgacacctttcggtcaacagagagtctttaaggaaaaagtagatacacgtacacaagaaccaaaggaaggcactaagaaattgatgaaaattaccgcagaatggctgtggaaagaattaggcaagaagaaaaccccgcgcatgtgtacgagagaagaatttactcgcaaagttcgaagtaatgcagctctaggcgccatttttacagatgaaaacaaatggaaaagtgctagagaagcagtcgaggatggaaggttttgggagctggtagatagagaaagaaacttacatctagaaggtaagtgtgaaacttgcgtgtacaacatgatggggaaaagagaaaagaaattaggtgagtttggtaaagctaaagggtcaagggctatctggtatatgtggttaggagcaagatttttagagtttgaggcgttaggctttcttaatgaagaccactggttttctaggggaaactcgttaagtggagtggagggcgagggcctccatcgattgggttacatattaagggatgtaggtaagaaagaaggaggagcaatgtatgcagatgacactgcaggttgggacacaagaatcacccttgaagatttaaagaatgaggaaatggtaaccaatcacatgaagggagaacacaagaaattagccgaagccatatttaaattaacgtatcagaataaggttgtacgcgtacaaagacccacacctcgtgggactgttatggatataatcagtagaagagaccaaagagggagcggtcaagttggaacgtacggcttaaatacatttacgaatatggaagcccagctaattcgacaaatggaaggagaaggaatattcaaatcaattcaacatttgacagcgacggaagagatagcggtacaaaactggctagcgcgtgtgggtcgagaaaggttatcgaggatggcaatcagtggagatgactgtgtggttaaacctatagatgatagattcgcgagtgcacttacggcactcaatgatatgggtaaagtgagaaaagacattcaacaatgggagcctagccgaggatggaatgattggacacaagtccccttctgttcacaccatttccatgagctcgtgatgaaagatggacgagttttagtagttccatgtcgaaatcaagatgaacttattgggagagcacgtataagtcaaggtgccggatggagcttaaaagaaaccgcttgtttgggaaagagttacgcacaaatgtggacactaatgtactttcatcgtcgtgacttacgactggctgcgaatgctatatgcagcgccgtaccatctcattgggtccccaccagtagaacaacttggagcatacacgctaaacatgaatggatgacgacagaagatatgctcgcggtttggaatagagtatggatacaagaaaacccttggatggaagacaaaactcctgtagaatcatgggaggaagttccataccttgggaaaagagaagatcaatggtgtggttcactaataggattaacttcccgcgcaacctgggctaaaaatattcagacagccataaatcaagtccgtagtcttattggaaatgaagaatatacagactacatgccatcaatgaaacggttccgtagggaggaagaagaagcaggcgtgctatggtaa

SEQ ID NO: 22406 - RNA, 9876 nt, synthetic construct
  misc_feature 1..9876: note = derived and/or modified CDS sequence (opt6) from DENV-2__FJ850050__SS-prME
  source 1..9876: mol_type = other RNA
acagccggtgtcatagtcatgttgataccgacggcaatggcattccacttaacaactagaaatggagaacctcatatgatcgtaggtagacaggaaaaaggaaaaagtctattattcaaaacagaagatggagtaaacatgtgcacacttatggcaatagatctaggagaattatgcgaagacactattacgtacaaatgtcctttactaaggcaaaacgaacctgaagatattgactgctggtgcaacagtacgtcgacgtgggtgacatatggaacttgcacaacaacaggggaacacaggcgtgagaaaagaagtgttgcattagtcccacatgtcggaatgggactcgaaacacgaaccgaaacgtggatgtcttccgaaggagcatggaaacacgtccaacggatcgaaacgtggatcctaagacatcctggattcacaataatggcagcaatactggcatacacaattggcactactcacttccagagagcactaatttttatcttactaacggccgtagctccttccatgacgatgagatgcataggtatttcaaatagggactttgtagaaggtgtttcaggaggaagttgggtagatatcgtattagaacatggtagctgtgttacgacaatggccaaaaataaacctacacttgatttcgaattgatcaaaaccgaagctaaacaaccggccacattgcgcaaatattgtatagaagcaaaactaacgaatacaactacagaaagccgttgtcccacacagggggaaccaagtcttaatgaagaacaagacaaaagattcatatgcaagcatagcatggtagatcgagggtggggaaatggctgtgggttatttggcaaaggaggtattgtaacgtgcgctatgttcacctgtaagaaaaatatggaaggcaaggtggtgcaaccagaaaatttagaatataccattgtgataacaccacattcaggagaagaacatgcggtaggtaacgacacaggtaaacacggaaaggaaattaaaataacgccccaaagtagtataacagaagcagaattaactggttacggtaccgtaactatggaatgcagtccaaggactggactcgactttaatgaaatggtactactacaaatggaagataaagcatggctagtacaccggcaatggttcttggacttaccgcttccgtggctacctggagcggatacgcaggggagtaactggatacaaaaagagaccttagttacgtttaaaaatccacatgcaaagaaacaagacgtagtcgtgttaggcagccaagaaggggctatgcatactgctttaacaggtggtacagagatacaaatgtcctctggtaacctcttattcacaggacatctaaaatgcagattgagaatggacaaattgcaacttaaaggaatgtcatatagcatgtgcactggaaaatttaaaatagtgaaagaaattgcagaaacacaacatggaacaatagtgatccgagttcaatatgaaggagatgggagtccatgcaagatacctttcgaaataacagatctggagaaaagacacgtattaggaaggctaattacagttaatccgattgttacggaaaaggacagcccagtaaatattgaagcagagccaccattcggggattcatacataataattggagtagagcccggtcagctaaagttaaattggtttaagaaaggatcaagtatcggacagatgttcgaaacaacaatgagaggagcaaagagaatggcaattcttggtgacacagcttgggatttcggaagcctgggcggcgtgtttaccagtataggtaaggcgttacaccaagtatttggtgcaatatacggagctgctttctcgggagtgtcatggacaatgaagattctgatcggagttataattacctggattggaatgaactcgcgctctacaagcctatccgtgagcttagtattagtaggagtagtcaccttatatcttggagctgtggtacaagctgacagtggatgtgttgttagttggaaaaataaggagttgaagtgcggaagtggaatatttataacagacaatgtgcatacgtggaccgaacagtataaattccagcctgaatcaccatctaaactcgctagtgccatccaaaaagctcatgaagagggaatatgcggaatccgctcggtaactcgattagaaaatctgatgtggaaacagataacacccgaattaaatcacattctatctgagaatgaagttaaactaactatcatgaccggtgatattaagggcatcatgcaagccggcaaaaggtcacttagaccacagccgacagaacttaagtatagctggaagacttggggtaaagcgaagatgttgagtacggaatcacataatcaaacttttctcattgatgggccagaaactgcagaatgtcccaacacgaatagagcatggaactcattagaagtcgaagattacggctttggagtatttacgacaaacatctggttaaaattgagagaaaagcaggatgtattctgcgatagtaaacttatgtcagcggctatcaagtataatagagccgtacatgcagacatgggctattggatagaaagtgcaccgtgtgattcttgggaaatgcaaaaagcatcattcattgaagtcatttcctgtcattggcctaaaagtctgactttatggtcgaatggagtgcttgaatccgaaatgataatccccaaaaacttcgcagggcctgttagtcaacataattacagaccaggataccatacccaaactgccgggccatggcacctaggaaaactggaaatggattttgatttttgcgaagggactaccgtagtagtgactgaggattgtgggaaccggggaccgagtttacgaacgacaaccgcatctggaaaattgataacggaatggtgttgtaggtcatgtacactacctcccctaaggtacaggggagaggacgggtgctggtatggcatggaaattaggccactgaaagaaaaagaagaaaatctggtaaacagccttgtaacggccggtcatggacaaatagataacttctcattgggagtcttaggaatggccctatttttggaagagatgctccgaacaaggataggaaccaaacatgcgatattgcttgtagcagtttcatttgtaactttgataacgggcaacatgagttttcgtgatctcggtcgggtaatggttatggtaggagcgactatgaccgacgatataggaatgggcgtaacatatttagcgttgttagcagcatttaaggtgagacctacttttgcagcaggcttgctattacgaaaattaacgagcaaagagttaatgatggccacaataggtatagcactattatcacaatctactataccagagacgatattagagttaacggatgcccttgcattagggatgatggttctaaaaatagtcagaaatatggaaaaataccaactggcagtaacaataatggcaatctcatgtgtccccaacgcagtgatcttacaaaatgcctggaaagtttcatgcacaattttagctgcagtgtctgttagccccttgttattaacaagttcacaacaaaaagcagattggattccacttgcattgacgataaaagggttaaatccgaccgcaatctttctaactaccttatctaggacgtccaagaaacggagctggccactaaatgaggcaatcatggctgtgggtatggtatcaatactcgcgtcctcgttgctaaagaatgacataccaatgactggaccattggtagcgggtggacttttgacagtatgttatgtgctaacgggaagatctgcagatttggaattagaacgagcagctgatgtaaaatgggaggatcaagcagagatatccggctcgagtccaatactaagcataacaattagtgaagacggatcgatgagtattaagaatgaggaagaagaacaaactctaacaattctcattcgaacgggacttctcgttatcagcggcgtattcccagtatcgattccaataacagctgcagcgtggtacttatgggaagtgaaaaagcaaagagccggcgtactatgggacgtacccagtccccctcctgttgaaaaagctgaactagaggatggtgcatacagaattaagcaacgagggatactaggttacagtcagataggtgctggagtttataaagaaggaacttttcacacgatgtggcacgttacacgcggagctgtcctgatgcacaggggtaaaaggatagagccatcttgggcagacgttaagaaagatctaataagctatggtggtggatggaaacttgaaggagaatggaaggagggtgaagaagtacaggttctcgcgttggaaccaggcaaaaatcctcgcgcagttcaaactaaaccgggaatattcaaaactaatacaggaacaattggtgcagtttcgctggattttagccctggcacttcgggatcccccatcgttgatcggaagggtaaagtcgttggattatatggtaatggagtcgttacaaggtcaggagcatatgtaagcgcgattgcccagactgaaaaatcaattgaggacaatcccgaaatcgaagatgacatattcaggaaaaagcgtttgaccattatggatttacatccaggtgctggaaaaacaaaaagatatctgccagcaattgtgagagaagctataaagcgaggcttaagaactcttattttggcgcctacgagagtagtagccgcagaaatggaagaggctttaagaggtttaccgataagatatcagaccccggcaattaaaacggaacacaccggccgggagatcgttgacttgatgtgccacgcgacatttacaatgcggctgctatcgccagtaagagtacccaattacaaccttataattatggatgaagctcattttactgacccagctagtatagctgctcgaggttatattagcacgcgcgttgagatgggagaggcagctggcatattcatgacagcaacaccacctgggtcgcgagatccttttccacaaagtaatgctcccatcatggatgaagagagagagatacctgagagaagctggaactcaggtcatgaatgggtaaccgactttaaaggtaagactgtttggtttgtaccttccataaaagcaggcaacgacatagctgcatgcctaaggaaaaatggcaagaaagttatacaactaagtcgcaagacattcgattccgaatacgttaaaacaagagcaaacgattgggattttgtagtaacgaccgatataagtgaaatgggagcaaattttaaagcggaaagagttatcgaccctcgtcgatgtatgaaaccagtgattctcacagacggagaggagcgtgtaatattagctgggccaatgccagtcactcactcaagtgcagcacaaaggagggggaggatcggtagaaatcctaaaaatgaaaatgaccaatatatatatatgggtgaaccattggaaaatgacgaagattgtgcacattggaaggaagcaaagatgttattagataatataaacactcctgaaggaattataccaagtatgttcgaaccggaaagggagaaggtagatgcgatagacggagaatatcgattaagaggagaagcaagaaaaacattcgtagatctaatgcgtagaggcgatttaccagtatggctagcatataaagtagcagctgaaggaatcaattatgctgatagaaaatggtgctttgatggcatcaaaaataatcaaatactcgaagaaaatatgcaggaacaaatctggacgaaagagggtgaacgtaagaaattgaagccacgttggctagatgcgaggatctattcagacccgttggcattaaaagaatttaaagaatttgcagctggaagaaaatcattgacactaaaccttataaccgagatgggacggttgcctacgtttatgacacaaaaagcacgaaacgcattagacaatttagccgtgctacacactgcagaagccggaggtagagcgtataaccatgcactttcagaactacctgaaacattggaaaccttgttgctactaactttactagcaactgtcacagggggaatttttctatttttgatgtcgggaaaggggataggaaaaatgacacttggtatgtgttgtatcataactgcatccatactattatggtatgctcaaatacagccacattggatagcggcaagtataatattagagttcttcctaattgtactattaattcccgagcctgaaaagcaaagaactcctcaagataaccaattaacctatgtagtcattgccatacttacggtagtcgctgcaaccatggctaatgaaatgggatttttggagaagaccaagaaagacctaggcctcggaagtataacgacccaagaatcggaaagtaatattcttgacatagacctacgcccagcatcagcatggaccctgtatgccgtcgcaaccacctttgtaacaccaatgttacgacattcaattgaaaactcatctgtaaatgtaagtttaactgctattgcaaatcaggcaacggttttgatgggattaggaaaaggttggccattatcgaaaatggacatcggcgtacccttactggctataggctgctattcgcaagtaaacccgattacactcaccgcagcattactactattagtagcacactacgcaattatagggccgggactacaagcaaaagcgactagagaagcacagaaaagagccgcagcaggaataatgaaaaatccaacagtggatggaattacagtaatagacttagagccaataccatacgatccaaaatttgaaaagcaattaggacaagtcatgcttcttatcttatgtgttacacaagtcttaatgatgcgaacgacatgggcactatgtgaggctttaaccttagcaacaggacccatctcaactttgtgggaaggcaacccgggacgattctggaatactacgatagcagtctccatggcaaatatattccgtggttcttacttggctggcgccggactattattcagtattatgaaaaatacaacgtctacgagacgtgggacgggcaacataggtgagaccttgggcgaaaaatggaaaagcagactaaacgctcttgggaaatccgagtttcaaatatacaagaaatcgggaatccaagaagtcgacagaacgcttgcaaaggagggtatcaagcgtggagagacagaccaccatgctgtgtcaaggggatcagccaaactaagatggttcgttgaaaggaacatggtcacaccagaggggaaggtggtagacttaggatgcggaaggggaggatggagttactactgcggtggcctcaaaaatgtgcgggaggttaaagggttaacaaaaggaggaccgggacacgaggaaccgataccaatgtcaacatatggatggaatctggtgaggcttcaatcaggggtcgatgtattctttacgcctccggaaaaatgtgataccctactatgcgacattggggaatcaagtcccaacccaactatagaagcagggaggacgttaagggtattaaacttggttgaaaattggttgaacaataatactcaattttgtattaaagttttgaatccatatatgccatctgtaattgagaaaatggaagcgctacaaagacaatacgggggagcccttgtcaggaatcctttatcgcgaaattccactcatgagatgtattgggtatctaatgctactggcaatatcgtgtcttcagtcaatatgatctcaaggatgctaatcaacaggtttacaatgaaacacaagaaggctacttatgaaccggatgtagaccttggatctggaacaagaaacataggtatagaaagcgaaatcccaaatttagatattatcggaaagcgcattgagaaaataaaacaagaacatgaaatatcttggcattatgaccaagaccatccatacaaaacttgggcataccacgggagttatgaaacaaaacagacaggttctgcgtcttctatggtaaacggggttgttcgcctcctaaccaaaccctgggatgtagtaccaatggtcacgcagatggcgatgactgatacaacgccctttggacaacaaagagtatttaaagaaaaggtagatacaagaacgcaggagccaaaagaaggcactaagaaattgatgaaaattacagctgaatggctgtggaaagaactaggaaagaagaaaacccctcgtatgtgtacgagagaagaatttaccaagaaagtaagatcaaatgcagccctcggtgctatatttacggatgaaaataaatggaaaagcgcgagagaagcagtcgaagacggaagattctgggaacttgtagatcgggagcgaaacttgcacctagaaggcaaatgcgaaacatgtgtatataacatgatggggaaacgagagaagaaattgggcgagttcggcaaagcgaaaggcagcagagcaatttggtatatgtggctaggagcgagattcttggaatttgaggccctaggattcctaaacgaagaccattggttctcaagaggaaactccctatcaggtgtagagggagagggcctacatagattaggatacatactaagagatgtaggaaagaaagagggtggagctatgtatgcagatgatacagctggttgggatactcgaattactctggaagatcttaaaaatgaggaaatggtcacaaaccatatgaaaggcgaacataagaaattggcagaagcgatattcaaactaacgtatcaaaataaagtcgtgagagttcagaggccgacaccaaggggaaccgtcatggatattataagcagaagagaccaaagggggagtggacaagtaggaacatacggccttaacaccttcactaacatggaagcgcagttgataaggcaaatggaaggtgaaggaattttcaaaagcatacagcacctcactgcaactgaagaaattgctgtccaaaattggctagcacgggttggaagggagagactaagtcgtatggcaatctcaggagatgattgtgttgtcaaacctatcgatgatagattcgcatccgctctgacagcgctaaacgatatgggaaaagtcagaaaagacatccagcaatgggaaccgagtcgggggtggaatgactggactcaggttcccttttgttctcatcactttcatgagctagtaatgaaagacggtagagtattggttgttccttgcagaaaccaagatgagttaatcggtagagctagaatttcgcagggcgcgggatggtctttgaaagaaacagcatgcttggggaaaagctacgcccagatgtggacactaatgtactttcatagaagggatctaaggctagcagcaaacgccatctgctcagcagtacctagtcactgggtaccgacatcccgcacgacttggtcgattcatgcaaagcacgaatggatgacaacagaggatatgttagctgtatggaacagagtctggattcaagaaaatccatggatggaagataagactccagtagagtcttgggaagaagttccctacttgggaaagagagaggatcaatggtgtggctcgctaatcgggctaaccagtagagcaacatgggccaaaaacattcaaactgctataaaccaagtcagatcacttatcggaaacgaggaatatacggactatatgccttcaatgaaacgttttagaagagaagaagaggaagccggagtcttgtggtag

SEQ ID NO: 22407 - RNA, 9876 nt, synthetic construct
  misc_feature 1..9876: note = derived and/or modified CDS sequence (opt6) from DENV-2__FJ639837__SS-prME
  source 1..9876: mol_type = other RNA
acggcaggagttatagttatgctgataccaaccgctatggcttttcatttgactactcgaaacggagaacctcatatgatagttggacgtcaagaaaaaggaaaatcccttttatttaaaaccgaggatggtgtgaatatgtgcaccttgatggcaattgatttgggtgaattgtgcgaagatactattacgtataaatgtcctctgttgcggcagaatgaacccgaggacatagactgctggtgtaactccacctcaacgtgggtaacttacgggacatgtacgactacaggggaacaccgcagagagaaacgttctgttgcactcgtaccacatgtgggaatgggtttagagactagaaccgaaacctggatgtcttcggaaggtgcatggaaacatgttcagagaatagagacatggatacttagacatcccggatttacaataatggctgctatattagcatacactattggaacgactcattttcagcgtgcgttaatattcatcctacttacagcagtagcaccaagtatgacaatgcgatgtatcggaatatcaaatcgcgattttgtggaaggagttagcggcggttcatgggttgacatagtactagaacatggttcgtgtgtcaccactatggcgaaaaataaacccactttagactttgaactgattaaaacagaagccaaacagcctgcaacgctgcgtaaatactgtatcgaagcaaaactaacaaacaccacgactgaatccaggtgtcctactcaaggcgaacccagtctaaacgaagaacaagataaacgcttcatctgcaaacattcaatggttgaccgcgggtggggcaatgggtgcgggctttttgggaaaggaggaatagttacgtgcgctatgtttacgtgcaagaaaaacatggaaggaaaagtagtgcagccagaaaacctagaatatactattgtgataacgcctcatagcggagaagaacatgcagttggaaatgataccggcaaacatggcaaagaaataaaaattacaccacaatcgtcaataacagaggcagaattaacgggctatgggacggtcactatggaatgcagtccaagaacgggattagattttaatgagatggttttactacagatggaagataaagcatggttagtacatcgacaatggtttttagacctccctcttccctggctacctggtgcagacacgcaaggatcaaattggattcaaaaagagaccttagttacgttcaaaaacccgcacgccaagaaacaagatgttgttgttttgggatcccaggagggagcgatgcacacagctttaactggagccacagaaattcaaatgtcgagtggaaatttactgtttacggggcatttaaaatgtcgtttgcggatggataaacttcagctaaaaggcatgagttactctatgtgcaccggaaaattcaaaattgtcaaagagattgctgagacacaacacggaacaatcgtcatccgtgtgcaatacgaaggcgatggcagtccatgtaaaattccgttcgagattactgatttagagaaaaggcatgtactaggacggttaataacggtaaaccccattgtaaccgaaaaagattcacccgtaaacattgaagcagaaccgccctttggtgacagctatataataattggagtggagccgggacaattaaaacttaattggtttaagaaaggatcaagtataggtcaaatgtttgaaaccaccatgcgtggtgcaaaaaggatggcaatcttaggagatacagcatgggacttcggctcattaggaggagtttttacatcaattggaaaagctctgcaccaagtatttggcgcaatttacggcgcggctttttctggtgtatcatggacaatgaaaattctgatcggcgtcataatcacatggataggcatgaatagtagaagtacgtcattgagcgtgtctctggtattagtaggagttgttactctttacctgggtgcagtagtgcaagccgactcaggctgtgttgtgagctggaaaaacaaagagttgaaatgcggctcaggaatctttattacagataatgtacacacttggacagaacagtataaatttcagcccgaaagtccatctaaattagcttctgctatacaaaaagcacatgaagagggaatttgtgggattcgctcagtcactcgattagaaaatttaatgtggaaacaaataacgccagagttaaaccatattctaagtgaaaacgaggtaaaattaaccataatgacgggagacatcaaaggaatcatgcaagctggaaaacgctccttaagaccacaacccacagagttgaagtattcatggaaaacgtggggtaaagctaaaatgctgtcaaccgaaagtcacaaccagacattccttattgatgggcccgaaacggcagagtgcccgaacactaatagggcatggaactccttagaggttgaagactacgggtttggagtttttactacaaacatatggcttaaattgcgagaaaagcaggacgtattttgtgatagtaaattaatgagcgcggctataaaagataacagagcagttcatgcagatatggggtattggattgaaagtgcacttaacgacacgtggaaaatggaaaaagcatccttcattgaagtcaaatcttgccattggccaaaatcacacacattatggtcgaacggggtactcgagtcagaaatggtaatccccaaaaattttgcgggaccggtttcacaacacaactatagacccggttaccacacccaaactgccggaccttggcatctgggaaagttagaaatggatttcgatttttgtgaaggaaccaccgttgtagtaacggaggattgcggcaatcggggtccttccttaagaaccacaacagcatctggaaaattaataaccgagtggtgttgtaggtcatgtactttacccccgttaagatatagaggagaggacggctgctggtatggtatggaaataaggcctttgaaggaaaaagaggaaaacttagttaacagtcttgtcacggcaggacatggccaaattgacaattttagtttaggagttcttggcatggcattgtttctcgaagagatgttaaggaccagaatagggaccaagcatgccatattattagtcgcagtatccttcgtaactctaataacgggtaatatgtcctttagagacttaggaagggtaatggttatggtcggtgcaacaatgacagatgacatcggtatgggtgtaacctatttagcactcttggctgcatttaaagtcagaccgacattcgcagcaggcctattattgagaaaactaacaagtaaggaattaatgatggcaacaataggtatcgcattactcagccagtcaactatacccgaaaccatacttgagttaaccgacgctctagcattaggaatgatggtgcttaaaatagtcagaaatatggaaaaatatcaacttgctgtgacaataatggcgatctcttgtgtgccaaatgccgtaatactacaaaatgcctggaaggtaagctgtacaatactggctgcagtgagtgtatcaccgttactactaacttcaagtcagcaaaaagctgattggatcccactagcactcacgattaaaggattaaatccgactgcaatcttcttaacaacccttagcagaacatccaagaaacgaagctggccactcaacgaagctataatggcagttggaatggtatctatattagcgagcagtctgttaaagaacgacattccaatgacagggccattggtcgcaggaggacttttgacagtatgttatgtattgacggggcggagcgccgatttagaattggaaagggcagctgacgttaaatgggaagatcaggcagagatatctgggagttctcctatattatcaataacgataagtgaagacggaagtatgtctatcaaaaatgaagaagaggaacaaactctgaccatactcattagaactggtttactggtcatctcaggtgtatttccggtctcgattccaattacagcagctgcatggtacttgtgggaggttaagaaacagagagctggagttttatgggacgtaccaagcccaccgccagtcgaaaaagctgagttagaagacggagcctacagaattaagcaacgaggtatattaggttactcccagattggggcgggcgtatataaagaaggtacattccatacgatgtggcatgtaacgcgtggtgcagttctgatgcatcgaggaaagcggattgaaccgtcttgggccgatgtcaagaaagatttaatttcatacggcggtggctggaaattagaaggagaatggaaagaaggcgaggaagtccaagttctagccttagaaccaggcaaaaaccccagggctgtacagacaaaaccaggaatattcaaaaccaatacaggtactataggggcagtaagtttagacttttcaccaggaacttcggggtcccccatcgttgacagaaaaggaaaagtagtagggttatatggtaatggcgtcgtaacacgctctggagcgtatgtatcggcgatagctcagacagaaaaatcaatcgaggataaccccgaaattgaagacgatatttttagaaagaaacgattgacaattatggatttacaccccggcgctggaaaaacaaaaagataccttcctgccatagtgcgcgaagctattaaacgcggcttaaggactctaatattggcaccaacgcgagttgtcgctgctgaaatggaagaagcgcttagggggctcccaatacgttaccaaacgcctgcgattaaaaccgaacacacaggtcgcgaaattgtcgatctaatgtgtcatgctacctttactatgcgcctcttatcccccgtccgtgtaccaaattacaacctaattataatggatgaagcacatttcactgacccagcttcaatagctgcaagagggtacatatcaacaagggtagaaatgggagaagcagccggtatttttatgacggctacaccgcctggtagcagagaccctttcccacaatccaatgcacccataatggatgaagaacgggagataccggaaagaagttggaactctggacatgaatgggtaacagactttaaaggaaagaccgtctggtttgtgccgagtataaaggctgggaacgacattgctgcttgcctacgtaaaaacgggaagaaagtaattcaattaagccgaaaaaccttcgattcagagtatgtaaaaacacgagctaatgactgggattttgtagttacaacggatatttcagaaatgggagcgaacttcaaagccgagcgtgttatagatcctagaagatgtatgaagccggtaattttgaccgacggtgaggagcgcgtaattttggctggaccaatgccagttactcacagcagtgcggcacaaagacgagggcggataggacgcaatcccaaaaatgaaaacgatcaatatatttacatgggagaacctttggaaaacgacgaagattgtgcacattggaaagaagcgaaaatgttgctagataacattaatactccggaaggaattataccctccatgttcgaaccggagagggagaaggtagatgctattgatggtgaatatagattgagaggggaagccagaaaaacattcgtcgacttaatgagacgcggcgatcttccggtatggctagcgtacaaagtagcagcagaaggtattaactatgcagatagaaaatggtgcttcgacgggattaaaaataaccaaatcttagaagagaacatggaagttgaaatctggacaaaagaaggagaaaggaagaaactaaaacccagatggttagatgcacgaatatactcagatccgctggctttaaaagaatttaaagaatttgcagccggtcgtaaatccctaacattaaacttaattacagaaatgggaagattaccaacctttatgacgcaaaaagctagaaacgcattagataaccttgcagtactacacactgcagaagccggaggcagagcatacaatcatgctttatcggaacttccagaaaccttggagacgttgctgctgctaaccctactagcaacggttacaggtggaatatttctatttcttatgtccggcaagtcaataggaaaaatgacactaggaatgtgttgtattataacagcatccatactcctatggcacgcccaaatacaaccacattggatagcagcatcaataatcctagagttctttttaatagtactactcatcccagaaccggaaaaacagagaaccccacaagataatcaattaacgtatgtggtaatagccattctcacggtagtagcagcaacaatggcaaatgagatgggattcctagagaaaaccaagaaagatttaggtcttggatcgattaccacacaagaatctgaatcaaatatattagacatcgatcttaggcctgcaagtgcttggactctgtacgctgtagccacaacctttgttactcctatgctacgacacagcatagaaaacagttccgtaaatgtcagtctaactgcaatagccaaccaagccacggtattaatgggattgggaaaaggctggccgctttcaaaaatggacataggagttcctttacttgcaataggatgttacagtcaagtaaacccgataacattaactgcagcgttactacttctagttgcccactacgctatcataggtccaggattacaagcaaaagctacacgtgaggcacagaaaagagcagcagccggaataatgaaaaatcctactgtagacgggataactgtaatagacttagcgcctataccctatgatcctaaatttgaaaagcaactaggacaagtaatgctcctaattctatgtgtaacacaagtgttaatgatgcgaacaacatgggcattatgtgaggccttaactttagctacaggaccaataagcacattgtgggaaggtaaccccggtagattttggaatactacgatcgccgtttctatggcgaatatatttcgaggttcataccttgcgggggctgggctcttattctctatcatgaaaaacactacaagcacaagaagaggtaccggcaatataggtgaaacactaggagaaaaatggaagtctcggttaaatgcattgggtaaatctgaatttcaaatatataagaaaagcgggatacaagaagtggatcgaacactggccaaagaggggattaaaagaggggaaacagatcaccatgctgtatcaaggggatctgcaaaactccggtggtttgtcgagcgtaatatggtaacgccagaggggaaagtcgtcgacctaggatgtgggcgtggtggatggtcatattattgcggtggtttgaaaaacgtaagagaggtaaaaggtctaactaaaggaggcccgggtcacgaagaacctattcctatgagcacatacggatggaatctagtccggcttcaaagtggagtagacgtattctttacaccacccgaaaaatgtgataccctattatgcgatatcggtgaaagctccccaaatcccaccattgaagccggaagaacattaagggtcttaaacttggtagaaaattggctcaataacaatacccaattttgtatcaaagttttaaacccttacatgccctccgtgattgaaaagatggaagcattacaaagacaatatggaggggcgcttgtacgaaatccgctcagcagaaacagtactcatgaaatgtattgggtatcgaacgcaaccggcaatatcgtttcttcagtaaatatgataagtagaatgttaataaatcgatttaccatgaagcataagaaagcgacttacgagccagatgtggatttagggtcgggtaccagaaatataggaatagaaaacgaaattcccaacttagatataattggcaaaagaattgagaagataaaacaggaacacgaaatatcttggcattatgaccaagatcacccatataaaacatgggcttaccatggtagctacgaaacaaagcaaaccggtagcgcttccagtatggtgaatggtgttgtacgattactaacaaagccttgggatgtagtccccatggtaacgcaaatggcgatgactgacacaactccatttgggcaacaaagggtgtttaaagaaaaggtcgacacaagaactcaagaacccaaagaaggaaccaaaaagctgatgaaaataacagctgaatggctttggaaggaattgggcaagaagaaaacaccacgaatgtgtacacgtgaagagtttacgcgtaaagttagaagcaacgcagcattaggagcaatctttacggatgagaataagtggaaaagtgcacgcgaagcggtagaagacggaagattttgggagttggtagatagggaacgaaacttacacttagaaggaaagtgcgagacgtgtgtctataatatgatgggaaaacgtgagaagaaacttggtgagtttgggaaagcgaaaggctctagagctatatggtacatgtggttgggggccagattcttagaatttgaagcactgggattcctgaacgaagaccattggttctcccgaggaaatagtctcagcggcgtcgaaggggagggtttacacagactaggatatatacttcgggacgtcgccaagaaagaaggaggggctatgtacgccgacgatacagcaggctgggatacaaggataacgctcgaggatttaaagaatgaagaaatggttaccaatcacatgaaaggggagcacaaaaagctagccgaagcgatttttaaactcacctaccaaaataaagtcgtacgtgtacaacgtccaacgccaagaggcactgtaatggacataatatccaggagagaccaaagaggatcaggacaggtgggcacctacggacttaataccttcactaacatggaggcacagttaatacgacaaatggaaggtgaaggtattttcaaatcaatacaacatctaaccgcaaccgaagaaatagcggtacaaaattggttagcacgtgtagggagagaacggctgtcgcgaatggctataagtggcgacgattgcgtggttaaaccgatcgatgatagattcgcatcggcacttacggccctaaatgatatgggtaaagttagaaaagatatacaacaatgggaaccatctcgtgggtggaatgattggacccaggttccattctgtagccaccactttcacgagctggtaatgaaagatggcagagtactcgtagtaccttgcagaaatcaggatgaattgattgggcgggctagaataagtcaaggggcaggctggtcgttaaaagaaacagcatgcttaggcaagtcatacgcacaaatgtggactcttatgtacttccataggagagacctcagacttgcagccaacgccatctgtagtgctgtgccttcccattgggtaccaacttctagaacaacgtggtcaattcatgcaaaacacgaatggatgaccacggaagacatgttagctgtttggaacagagtctggatacaggagaacccatggatggaggacaagactcccgtagaatcatgggaggaagtcccctacctaggaaaacgagaagatcaatggtgtggttctctaatcgggctaacctcacgagcaacctgggctaaaaacatacaaacagcaatcaatcaagttaggtcgttaatcggaaacgaagaatacactgactatatgccttcaatgaaacggtttagacgtgaggaagaagaagcaggggtgttatggtaa

SEQ ID NO: 22408 - RNA, 9876 nt, synthetic construct
  misc_feature 1..9876: note = derived and/or modified CDS sequence (opt6) from DENV-2__FJ744706__SS-prME
  source 1..9876: mol_type = other RNA
actgcaggagtgattgtaatgttaatacctacagcaatggcatttcacttgaccacaagaaatggagaacctcatatgatagtagggagacaagaaaaaggcaaatcactgttatttaaaacagaagatggagtcaacatgtgtacattaatggcaatcgatcttggagaattgtgcgaagacactattacttacaaatgcccgctactaagacaaaatgaacccgaagatatagactgttggtgtaattctacatcgacatgggtaacctatggaacttgcaccacgacaggagaacacagacgagagaaaagaagcgtagccttggttccacacgtgggaatgggcctggaaacaaggacagaaacatggatgtcatccgaaggcgcctggaaacacgttcaacgaatagaaacatggattttacgacacccaggatttacaataatggcagcaatcttggcatacactataggaactactcattttcaaagagcattaatatttattctactaacagccgtcgccccctcaatgaccatgcgctgtatcggtatatcaaatagagatttcgttgaaggggtatcagggggtagttgggttgatatcgtgttagaacatggctcttgtgtcaccaccatggctaaaaataaaccaaccctagactttgaactcataaaaacggaagctaaacaacctgcaacgcttcgcaaatactgtatagaagctaaattaaccaatacaactaccgaatctagatgtccaacccaaggagaaccgagtttgaacgaagaacaagacaaacggtttatatgcaaacattcaatggtagacaggggatggggaaacggctgtggtctttttggtaaaggaggaatcgtaacttgcgctatgttcacatgcaaaaagaacatggagggcaaagtggtacaacctgaaaaccttgaatatacaattgtaataactcctcacagtggagaggaacatgctgtggggaatgacacagggaaacatgggaaagaaattaaaattactcctcagtcgtctattactgaagctgaactcacgggttatggaaccgttacaatggaatgttcaccgaggaccggcctggactttaatgaaatggttctacttcagatggaagataaagcatggctcgtgcatcgacagtggttcctagacctacctctaccttggctacctggagcagacactcaagggtcgaactggatacagaaagagacgctcgtgactttcaaaaatccacatgccaagaaacaagatgtagttgttcttggatctcaagaaggagcgatgcacacagcgctaacaggagccactgaaattcaaatgagctctgggaatctcttgtttacaggacacctaaaatgccgattaagaatggataaattgcaattaaaaggaatgtcatatagcatgtgcacggggaaatttaagattgtcaaagaaatagccgaaactcaacatggcacaatcgtaattcgggtacaatatgaaggtgatggttctccatgtaaaattccatttgagattacagatctagagaaaagacacgttttaggaaggctcataactgtaaatccaattgtaactgagaaagactcaccagtgaacatagaggcagaaccaccatttggcgattcctatatcattataggagtagaaccaggacagctaaaattgaactggtttaagaaaggatcttcgataggacagatgtttgaaactacaatgagaggggcgaaaagaatggcaattttgggtgatactgcatgggatttcggctcactagggggtgtattcacaagcattgggaaagcgcttcatcaggtattcggcgcgatatatggagctgcattttctggcgtctcatggacgatgaaaatactgataggggttattataacttggattggaatgaactctagaagcacttcactctcagtaagcctggtgctggtaggtgtggttactctatatcttggcgccgtggtgcaagccgattccggatgtgtggtcagctggaaaaataaagagctaaaatgtggctctggtatatttatcacggacaatgtacatacctggactgagcaatacaaatttcagccagaatctccctcaaaattagccagcgctatacagaaagcccatgaggagggtatatgtggtattcgctcagttactcggctggaaaacctcatgtggaaacagataactccggagctaaatcatatcctgtccgaaaacgaggttaaattgaccataatgaccggagatattaaaggaataatgcaagcaggcaaaaggagccttcgcccacaacctaccgagctaaagtattcgtggaaaacatggggtaaagctaaaatgctaagcaccggaagtcataaccagacatttttaatagatggtccagaaacagccgaatgtccaaatacaaatcgagcttggaactctctggaggtcgaagactacggattcggcgtatttaccactaatatatggctaaaattacgtgaaaaacaagacgtcttttgcgattcaaagctcatgagcgccgctataaaagataatagagccgtacatgctgacatgggatactggattgagagcgctcttaatgacacttggaaaatggaaaaagcaagtttcatcgaagtaaagagttgccactggcctaaatcccatactctatggtccaatggcgtactagaatcagaaatgataataccgaaaaattttgcaggtcccgtaagtcaacataactatagaccgggctatcatactcagacagcaggtccttggcatctgggtaaattggaaatggattttgatttttgtgaaggtacgacagttgtagttaccgaagattgcggaaatagagggcctagtttacggactacaactgcaagtggaaaacttataaccgaatggtgttgcaggtcatgcactctaccaccattacgatatagaggagaggatggttgctggtacggaatggaaatcaggccattaaaggaaaaggaagagaatttagttaattcattagtcaccgcaggacacggccagatagataacttttcactgggggtactgggaatggcattattcttagaagagatgttacgaacgcgtattggaactaaacatgcaatactgttggtggcggttagctttgtaaccttgataacgggtaacatgtcatttcgcgatttaggcagagtaatggttatggtaggagctacgatgaccgatgacatcggtatgggagtaacgtacctagcattgctagcggccttcaaggttcgacctacatttgccgcgggcttgcttttacgcaaattaacgtcaaaagaactaatgatggcaaccataggtattgcgttattaagtcaaagtacgatacccgagacaatattggaactaactgacgcactggctctaggaatgatggtactaaaaatagttagaaatatggagaaatatcaactagctgtcaccataatggcaataagttgtgttccgaacgcagttatactacaaaatgcatggaaagtgagttgtactatattagcagcggttagtgtaagtccccttttactaacatcatcccaacaaaaagctgactggataccgctggcattaacaataaaaggattaaatccaacagcgattttcttaacaacgctttctcggacaagtaagaaaagatcatggccattaaatgaagcaattatggcagtaggaatggtctccatcttagcttcctctctacttaagaatgacataccaatgacgggacccttggttgctggcggtctattaaccgtatgttatgtccttaccggacgatccgccgatctagaattagaaagggccgcagacgtgaagtgggaggatcaagcagaaatatctggtagtagtccaatactaagtattactatcagcgaggacggatcgatgagtatcaaaaatgaggaagaagaacaaacattaacaatcctaattagaactggactcttagttattagtggggtgtttcctgtatccatacccataactgcagctgcctggtatctatgggaagtcaagaaacaaagagccggggtgttatgggacgtaccaagtccccctcctgtcgaaaaagcggagttagaggacggagcgtacagaattaaacaaaggggcatattaggatactcacaaataggagcaggcgtatataaagaaggaacattccacacaatgtggcatgttactaggggagctgtactcatgcacagaggtaaaaggatagaaccatcttgggccgacgtcaagaaagatttaatttcatacgggggcggatggaaactagagggcgagtggaaagaaggcgaagaagtacaagtgttagcattagaacccggcaaaaatccgagagcagtacaaactaaacctggtatattcaaaacaaatactggcactataggtgctgtcagtttggatttcagccccgggacaagtggctcacccatagtagacaggaaaggaaaagtagttggactatatggcaatggtgtggtaacgcgttccggagcgtatgtaagtgctatagcgcaaaccgagaaaagcatagaagataatccggaaatcgaagatgatatctttcgtaaaaagaggctcacaataatggacctacatcctggagcaggaaagaccaaaagatacttgccagcgatagttagagaagccatcaaacgaggcctaagaactttgatacttgcaccgactcgcgttgtagcagcggaaatggaagaggctttacgtggtcttccaatccgctatcaaactcctgcaattaaaaccgagcataccggaagggagatcgtcgacttaatgtgtcacgcaactttcacaatgagattattatcacctgttcgagttccaaactataacctaataataatggacgaagctcattttactgatccagcgagtatcgcagcaagaggttatatttccacaagagtcgaaatgggagaggcggcaggaatttttatgacagccaccccgccaggtagtagagatccatttccacaaagcaatgcaccaatcatggacgaggaacgtgaaatacctgaacgtagctggaactcaggacatgaatgggtaactgatttcaaaggaaaaacagtttggtttgttccgtcaataaaagccggaaatgacatagccgcatgcttgcgtaaaaatggtaagaaagtaatccaactaagtaggaaaactttcgactctgaatatgttaaaacacgagccaacgactgggattttgttgtaacaactgatatttctgagatgggcgccaacttcaaagcggagagagtaatagacccacgacgctgcatgaagcctgtaatactaacagatggcgaggagcgtgttatactggcagggccgatgccagttacacactcttctgcagctcaaagaagaggaaggatcggtcgaaatcctaaaaatgaaaacgatcaatacatctacatgggtgaaccattagaaaacgacgaagattgtgcccattggaaagaagcaaaaatgcttttggataatataaacacacctgaaggtataatacctagtatgttcgaaccagaaagagaaaaggtcgatgcaatagatggggaataccgacttagaggggaggcaagaaaaactttcgtagacctgatgaggcggggtgacctaccggtgtggctcgcgtacaaggtggcagctgaaggtataaattatgcagataggaaatggtgcttcgatggtatcaaaaataatcaaatacttgaggaaaatatggaagtcgaaatctggaccaaggaaggtgagcggaagaaattaaaacccagatggttggatgctaggatctactcagatccattggcactaaaagagttcaaggaatttgcagcaggccgaaaatcattgactttaaatttaataactgaaatgggtaggctaccaactttcatgacccaaaaagcacgcaatgcactagataatttggcagtactacacaccgcagaagctggaggcagagcatataatcacgcgctaagtgaactaccagaaacactggagacattactcctgctcactttgttggcaaccgttacaggtggtattttcctattccttatgtcaggcaaaggaattggcaagatgacactaggaatgtgttgtattataacagcaagcattctactatggtacgcacagatacaaccccattggatagctgcatcaatcatattagaatttttcttaatagtcttactaatcccggagcccgaaaagcagagaacaccccaagacaatcagctgacatacgtagtaatcgcaatattaaccgttgtagcggcaacaatggccaacgaaatgggatttttggaaaagacaaagaaagatttagggttgggttctattacaactcaagaatcggaatcgaatatactcgacatagacctgaggccagcgtctgcatggactttatatgcagtggcaactacatttgtaacgccaatgcttcgtcatagtatagaaaatagttcggtcaatgttagtctcacggcgatagctaatcaagcaacagttctaatgggattaggtaaaggatggcctctgtcgaagatggatatcggcgtaccccttttagcgatagggtgctatagccaagtcaatcccatcaccttaacagcggctttattgttactcgtagcacattatgcaatcatcggacccggtctacaggcaaaagcaacgcgggaagcacagaaacgggcggcagctggaataatgaagaatcctactgtagatggaattaccgtaatagaccttgaacctattccatatgatccaaaatttgaaaaacaattaggacaagtgatgctcctaattttatgtgtcacacaagtactcatgatgagaactacatgggctttatgtgaagctcttacactagctactggccctataagcactctctgggaaggtaacccgggaaggttttggaataccacgatagcagtgagcatggctaatatttttaggggttcttatctcgctggcgcaggcttactcttttcaatcatgaaaaacacgacaagtactcggaggggaacgggaaatattggcgagacactcggcgaaaaatggaaatccagattgaacgcactcggaaaatccgaatttcaaatttacaagaaaagcggtatccaagaagttgatcgtacacttgcaaaagaaggaatcaaaagaggcgaaactgatcaccacgctgtcagtagaggttcggccaagctaaggtggtttgtggagagaaacatggttacacctgaaggcaaagttgtggacttaggatgtggaagaggagggtggtcttattactgtgggggactcaaaaatgtgagagaagtaaaaggattaacaaaaggaggaccgggtcatgaagaaccgataccaatgtctacgtatggttggaatctagtgagactccaaagtggtgttgacgtattctttacaccgccagaaaaatgcgatacgttattatgcgacataggggaatcctctcctaaccccacaatagaagcagggaggactcttcgggttttaaatctagttgaaaactggctaaataataatacacaattttgtattaaggttttgaatccttatatgccatccgttatcgaaaagatggaagcattacagagacaatatgggggtgcgctagttaggaatcctttatctcgaaactctacacacgaaatgtactgggtaagtaatgcaacagggaacattgtttcgagtgttaacatgatttcacgaatgttaattaaccgatttacaatgaaacacaagaaggcaacatatgagccagatgttgatttaggaagtgggactagaaacatcgggatagaaagtgagataccaaacttggacattatagggaaaaggatagagaaaattaaacaagagcatgaaataagttggcactatgatcaagaccatccttataaaacctgggcttatcatggatcatacgaaacaaaacagacaggctccgcctcaagtatggtaaatggtgtggtacgcttacttaccaaaccatgggacgtggtccctatggttacccagatggcaatgactgatacaaccccctttggtcagcagcgggtcttcaaagagaaagtagatacgcgaactcaagagcctaaagagggtactaagaaacttatgaaaatcacagccgaatggttatggaaagaattaggtaagaagaaaacaccaaggatgtgtacacgtgaagagtttactaaaaaggtaagaggtaacgcagcccttggcgcgatattcacagacgaaaacaagtggaaatcagctcgcgaagctgtcgaagatgggagattctgggaattagtggatcgggaacgaaacttacacctagaaggaaagtgcgaaacatgtgtatataatatgatgggcaaaagagaaaagaaattaggagagttcggaaaagcaaaaggtagcagggccatatggtacatgtggcttggagcacgtttcctagagttcgaggctttaggattcttaaatgaggatcactggttcagtaggggtaattcgctatcaggagtagagggtgaagggctccatagattgggatacattctaagggacgtcggtaagaaagaaggtggtgcaatgtacgcagatgataccgcaggatgggacacaagaataaccttagaggatctaaagaacgaagaaatggtaaccaatcatatgaaaggtgagcataagaaattggcagaagcaatatttaaactcacctatcagaacaaggttgttagagtccagcgacctactcctagagggacagtcatggatatcatctcgagaagagaccaaaggggctcaggacaggtgggaacatacggtttaaatacttttactaacatggaggcccaattaattagacaaatggaaggcgaaggtatatttaaaagcatacagcacttaacggccacagaagaaattgcagttcaaaattggctcgcaagggtaggacgggaaagactctctcggatggctatatcaggggacgattgtgtagtcaaaccaatagatgatcgttttgcaagtgcgttaactgcactgaatgacatgggtaaagttcgtaaagacattcaacaatgggaaccctctcgcggttggaatgactggacccaggtacctttttgttcacatcacttccatgaattagtaatgaaggatggtagagtgctggtagtcccttgccgcaatcaggacgagcttataggcagagcaagaatatcacagggcgccggttggagtctgaaggagacggcttgtttgggaaagtcatacgcgcagatgtggacattgatgtactttcaccgacgggacctcaggctggctgctaacgccatctgttcagcagtcccttcccattgggtccctacatcgagaacaacatggagcattcacgccaaacatgaatggatgacgacagaagatatgttagctgtatggaatagggtgtggatccaggagaacccatggatggaggacaaaacaccagtggaaagctgggaagaggttccttatttgggaaaacgtgaggatcagtggtgtggatcactgattggactaacttcgcgtgctacgtgggctaaaaacattcagacagcaattaatcaggttcgatccttaatagggaatgaagaatataccgattacatgccttccatgaagagatttcggcgagaagaggaagaggctggagttctgtggtga

SEQ ID NO: 22409 - RNA, 9876 nt, synthetic construct
  misc_feature 1..9876: note = derived and/or modified CDS sequence (opt6) from DENV-2__FJ744707__SS-prME
  source 1..9876: mol_type = other RNA
acggctggtgttatagtcatgctcattccaacagcgatggcatttcatcttactacccgtaatggagaacctcacatgatcgtgggacgacaagaaaaaggtaaatcgctactatttaaaactgaagatggtgtcaatatgtgtacccttatggcaattgatttaggagaactctgcgaagataccattacttataaatgtcccttattaagacaaaatgaacccgaagatatagattgctggtgcaattccacgtcaacatgggtaacctacgggacgtgtacaaccacgggagaacatagacgtgagaaacgatctgtagctctcgtcccccatgtaggaatgggattagaaactagaactgaaacatggatgtcgtcggagggggcatggaaacatgtacaaagaatagagacttggattttacgccatcccggattcactatcatggctgcaatcttagcatatacaatcggcacgactcattttcagcgggctttaatattcatactacttactgcagtagcgccatctatgacgatgcgttgtataggaataagtaaccgagattttgtagagggtgttagtggaggaagctgggttgacatagtattagaacatggtagttgcgttactacaatggccaaaaataaacctaccctagactttgaattaataaaaactgaagcaaaacaaccggcgacattaagaaaatactgtatagaagcaaaattgacaaacaccacaacagaatcgcgatgcccaacacaaggagaacccagtctaaatgaagaacaggacaaaaggttcatatgcaaacattctatggtagacagaggatggggcaacggttgcggtctattcgggaaaggtggtatagtaacgtgtgccatgtttacatgtaagaaaaacatggaaggaaaagtcgtgcagccggaaaatttagaatacacgattgtgatcacccctcatagtggcgaggaacatgcagtaggcaatgatacaggtaaacatggaaaagagatcaaaatcacaccccaaagttccataactgaagcagaacttacaggttatggcacagttaccatggaatgtagcccgcgtaccggcttagattttaatgaaatggtgcttttacaaatggaggataaagcgtggttagtacatagacaatggtttttagatctcccattgccatggctgccaggagctgatactcagggtagcaactggatccaaaaagaaactctcgttacgtttaaaaatccgcacgctaagaaacaagatgtggttgtgttaggaagccaagagggggcaatgcatacagcgttaacgggagcaaccgaaattcaaatgtcgtctggaaatctactatttactggacatctaaaatgtcgactaagaatggacaaattacaactcaaaggtatgagttattcgatgtgcacaggaaaatttaaaatagtgaaagaaatcgcagagacacaacacggaaccatcgtaatccgagtccagtatgaaggagacggctcaccttgcaaaataccttttgaaattacggacttagaaaaacgacatgtattaggaagactaattacggtaaatcctatagtaacagaaaaagacagtccagtaaatatagaggcagaaccaccatttggtgactcatatatcatcatcggcgttgaacctggacagttaaaactaaactggtttaagaaaggcagcagcatagggcagatgttcgaaactaccatgagaggagccaaacgaatggcaattttaggagatacagcgtgggactttggatcacttggaggagtctttacaagcataggaaaagcacttcatcaggtatttggggctatctacggtgcggcgttttcgggagtatcatggacaatgaaaatattgatcggagttattatcacatggataggtatgaactcaagatccacatcgttgtccgtgagtctagttttggtaggcgtagtaacactgtatttaggagcggtcgtacaagcagatagtggttgcgtggtcagctggaagaataaggaactaaaatgtggttcaggcatctttataacagataatgtccacacatggacggaacagtataaattccagcccgaaagcccgtcaaaactcgcttccgccattcaaaaagcacacgaggaaggaatctgtggtataagatcagtaacacgcctcgaaaatttaatgtggaaacaaataacgccggaattaaatcatatactatcagaaaatgaagtcaaattgactatcatgacaggggacatcaaaggtataatgcaagctggcaagagatcactaaggccacagccaacagaattaaagtactcttggaaaacctggggtaaagccaaaatgttatcaactgaatcgcataatcaaacatttctcatagatggtccggaaaccgccgaatgtccgaataccaatagggcctggaatagtttggaagtagaagattatggtttcggtgtcttcacgacgaatatatggttaaaattacgtgaaaaacaagacgtattttgcgattccaagctaatgtcggcagctattaaggataaccgtgccgtccacgccgatatgggctattggattgaaagtgcattaaatgatacatggaaaatggagaaggcttcatttatcgaagttaagtcatgccattggccgaaatcccacacattatggtccaatggcgtactagaaagtgaaatgataatcccgaaaaacttcgctggacctgttagccaacacaattatagaccaggataccacacccaaacagccggtccctggcatttaggaaagttggaaatggattttgatttctgtgagggtacgacagttgtagtaactgaagattgtggaaatagggggccgagtttaagaacaactactgcttcaggtaaattaataaccgagtggtgttgtagatcatgtacgctacccccactgagatatagaggtgaagacgggtgttggtacggtatggaaataagaccgctgaaagagaaagaagagaacctggtaaattccttagttaccgcaggacatggacaaattgacaactttagtttgggagtcttaggtatggcacttttcctcgaggaaatgctgagaacgagaatcggaaccaaacatgctatactgctagtggctgtgtcatttgtaacactcataacgggaaatatgtcgtttcgagacctaggtagagtcatggtcatggtaggtgcgactatgacggacgatattggaatgggagtaacctatctggcgcttctagcagcattcaaagtgaggcctacattcgccgccggactactgcttcggaaattaacgtcgaaagaacttatgatggcaactatagggattgctctactgagtcaatcaacaatacccgagacaatattggaactgacagacgctcttgctctgggaatgatggtcctaaaaattgtgcggaatatggaaaaatatcaacttgccgtaaccataatggcaataagttgcgtacctaacgctgtgatattacaaaatgcatggaaagtcagctgcacaatactagctgcagtctcagtatcacctttattactgacaagctcacaacagaaagctgactggatacccttagccctaaccataaagggactaaatccaaccgctatatttttaacaacactatcgcgtacttcgaaaaagagaagctggccgcttaacgaggcaataatggccgttggtatggtgtcaatattggcatctagcctgttgaaaaatgatataccaatgacgggacccttagtggcgggtggtctcctgactgtatgttatgttctgactggaagatcggcagatctggaactagaacgagccgcagatgtaaaatgggaagaccaagccgaaatcagtgggagttcacccatcctatcaattactatctcagaagatgggtccatgtcgataaagaatgaggaagaagaacaaacattaacgatattgatacgcacaggtttgttggtgattagcggcgtttttcccgtgtcgatacctattacagcggctgcttggtatctctgggaagttaaaaagcaacgggcgggggtattgtgggacgtaccaagccctccaccggtagagaaagcggaactcgaagacggggcgtacagaattaaacaacgtggcatactgggttattcccaaattggggcaggcgtttacaaagaaggcacgttccataccatgtggcatgtgacacgaggtgctgtattaatgcataggggcaaacggatagaaccaagttgggctgatgtgaagaaagacctaatttcttacggcggaggatggaaacttgaaggcgagtggaaggaaggagaagaagttcaagtgctggcactggaaccaggcaaaaatccaagagctgtgcaaaccaaaccaggaatttttaaaacaaacaccggcaccataggtgcagtaagcctagacttcagtcccggaacaagtgggtcaccaatagtagacaggaaaggaaaggtcgtgggattatacggaaatggagtagttacacgtagtggcgcgtatgtatctgcaattgctcaaaccgaaaagtcaattgaagacaatcccgaaatagaagacgacatatttagaaagaagaggctcactattatggatctgcatccgggagcaggaaaaacaaagagatacttaccagcaatagtcagggaagctataaaaaggggcttgcgtactctaatactagcaccaacgagagtagttgcagcagaaatggaagaagccctcagaggactgccgatacgttatcagactccagcaattaaaacagaacatacagggcgggaaatcgtagacttgatgtgccacgctacattcacaatgaggctactttctcctgtgagggtaccaaattataacttaattataatggatgaagcgcactttaccgacccggcgagcatcgcggctcgaggttatatcagcacacgcgtagaaatgggcgaagctgcagggatatttatgacggcgacgcctcctggcagtagagaccccttcccccaatctaatgcgccaatcatggacgaggaacgggaaattccggaacgtagctggaactcaggtcatgaatgggtgacagactttaaaggaaaaacggtgtggtttgtaccatctatcaaagcaggtaacgacatcgcagcttgcttgaggaaaaacggtaagaaagtgatccaactatcacggaagacattcgacagtgaatatgtgaaaacacgagcaaacgactgggattttgtagtaaccactgatataagtgaaatgggcgcaaatttcaaagctgaacgagtaatcgatccaagaagatgcatgaaaccagtcatcctgactgacggtgaggaaagggtgattctagcaggtccgatgccggtcacccattcgagcgcagcacagcgtagaggtagaattggacgcaacccgaaaaatgaaaacgatcagtacatttacatgggagaaccactagaaaatgatgaagactgtgctcactggaaagaggcaaagatgttacttgacaacattaacacaccagaaggaataattccatcaatgtttgagcccgaaagagaaaaggtagatgcgattgatggagagtacaggcttcgcggggaagcgcgaaagacattcgtagatctcatgagacgtggtgacttgccagtgtggcttgcctacaaggtagcagctgaagggattaactatgctgatagaaaatggtgcttcgacggaatcaaaaataaccaaatattagaagaaaatatggaagtagagatatggaccaaggaaggagaacgaaagaaactaaaaccacgttggctcgatgcaagaatttatagtgaccctctagccctaaaagagttcaaagagtttgcagctggtcggaagtcactcacactaaatctaattacggaaatgggaagattacctactttcatgactcaaaaggctaggaatgctctagataacctggcggtacttcatacggcagaagcaggagggagagcgtacaatcacgcactatcagagctaccggagactttagaaaccctactcttgttaaccctgttagcgactgtgaccggcgggatattcctcttcctaatgtccggaaaaggtattggaaaaatgacattagggatgtgttgtattataaccgcaagtattttactttggtacgctcaaattcaaccacactggatagcagcatctataatcctcgaatttttcctgatagtactactaattccggaaccagaaaaacaacgaaccccacaagacaatcaattaacatacgtagtaatcgccatattaactgtagtagctgccacaatggccaatgaaatgggatttctagagaaaactaagaaagatctaggtttaggatcgattacaacacaggaaagcgagagtaatattctagatatagatcttagaccagcatcagcttggacattatacgcagtggcaacaaccttcgtaacaccaatgcttagacactctatagagaatagctcagttaatgtgagccttacggcgatagcaaatcaggcaaccgtgctaatgggtttaggtaaaggttggcctctttcgaagatggatataggtgttccactcttagctattggatgttatagtcaagtaaatccaataacgttaacagctgccctattgttattagttgctcattatgcaatcataggacccggactacaggcaaaggcaacaagggaagcgcaaaagagggccgcagcagggattatgaaaaatcccactgttgacggcatcacagtcattgacttagaaccaataccctacgatcctaaattcgagaagcagttaggacaagtgatgttattaatactatgcgttacgcaagtgctaatgatgcgaaccacatgggcactatgtgaagccttaacactagccacaggaccaatatcaacgttatgggaaggtaatcctgggcgcttctggaatacaacaatagcagtatcaatggctaacatatttaggggaagctatttagctggcgcgggactactatttagtattatgaagaatactacgagtactcgcagaggaaccgggaatataggggagaccttaggtgaaaaatggaaaagcagactgaatgcattgggaaaatcagagttccaaatatataagaaaagtggtatacaagaagtagatcggacattagcaaaagagggaataaaaaggggtgaaactgatcaccacgctgtgtctcgcggcagtgcaaaattacgatggtttgtcgagcggaatatggttacacctgagggaaaggtagtcgaccttggctgtggtcgtgggggatggtcttattactgcggtggactgaaaaatgtaagagaagttaaaggacttacgaaaggaggtcctggtcatgaagaacctatacccatgtctacatatggctggaatctagtaagattgcagtcaggagtagacgtgttctttacacccccagagaaatgcgataccttactatgcgatataggagaatcctcgccaaacccgactatagaagccggacggacgttacgagttttaaacttagtggaaaactggcttaataacaacactcaattctgtataaaagtattaaacccatacatgccttccgtaatagagaagatggaggcactacagagacaatatggaggagcattggtgagaaatccactgagtagaaactcgacacacgaaatgtattgggtttcaaacgcgactggtaatatcgtttcatctgtaaatatgatttcacgaatgctaattaaccgcttcacaatgaaacataagaaggcgacttatgagcccgacgtagacctaggatcgggtactagaaacattgggatagaatcagaaatccccaacttggatatcataggtaagcgaatcgagaaaataaaacaagaacacgaaatatcctggcattatgaccaggatcacccatataaaacatgggcataccatgggagctacgagaccaaacagaccggatccgcttcttcaatggtgaacggagttgttagactactaacaaaaccgtgggatgttgtccccatggtaactcaaatggctatgaccgacacaacacctttcggacaacagcgcgtgttcaaagagaaagtagacacgagaactcaagagcctaaagaaggaactaagaaattaatgaaaataactgccgaatggctgtggaaagaactagggaaaaagaaaaccccaagaatgtgtacacgagaagaatttaccaagaaagtccggagtaacgctgcgcttggtgcaatatttacggatgaaaataaatggaaatcagctagagaagcggttgaggacggtaggttttgggagttagtcgaccgcgaaaggaatctccatttggagggtaagtgcgagacatgcgtatacaacatgatgggcaagcgggagaagaaactaggcgaatttggtaaagctaaaggatcacgcgctatatggtatatgtggctaggagcaagattccttgaatttgaggcactcggctttttaaatgaggaccattggttttcaaggggaaactccttatctggagtagagggagaaggattgcacagattgggatatatcctacgtgatgtgggcaagaaagagggcggtgcaatgtacgcagatgacacagccgggtgggatacccgaatcaccttggaggacttgaaaaacgaggagatggttacaaatcacatgaagggcgaacacaagaaactagcagaagctattttcaaactgacgtaccaaaataaagttgttcgggtgcaaagacctacgcctagaggtaccgtaatggacatcatttcaagaagagatcaacgaggcagcgggcaagtaggtacatacggactaaatacgttcacaaatatggaggcacagctaatcagacaaatggagggggaaggtattttcaagagtatacaacatttgactgcaacggaagaaatagcggtacagaactggctagccagagtaggtagggaaagactatcgaggatggctatatcaggtgacgactgtgttgtaaaaccaatcgatgatagatttgcaagtgcattgaccgctttaaacgatatgggcaaagtgagaaaagacattcagcaatgggaaccttcccggggatggaatgactggacccaagttccgttttgttcacaccattttcatgaacttgttatgaaagacgggcgagttttggtagcgccatgtcgaaatcaagatgaattaattgggcgagcgagaatctcgcaaggcgcgggatggtctttgaaagaaacggcttgcttaggtaaatcatatgctcaaatgtggacattaatgtacttccataggagagatctcagactggcagcgaacgcaatttgtagcgcagtaccatcgcattgggtaccaacatcacgaactacatggagtatccacgcaaagcatgaatggatgacaacggaggacatgttagcagtgtggaaccgagtgtggatacaagaaaacccgtggatggaagataaaacacctgtagaatcatgggaagaagtcccatacttaggtaaacgcgaagatcaatggtgcggcagcttaattggattaacatcaagagctacttgggcgaagaatatacaaaccgcaataaaccaagtacgttcattaatcggtaacgaagagtatacagattacatgcctagcatgaaaagatttaggcgagaagaagaggaggcaggagtcttatggtaa

SEQ ID NO: 22410 - RNA, 9876 nt, synthetic construct
  misc_feature 1..9876: note = derived and/or modified CDS sequence (opt6) from DENV-2__FJ744704__SS-prME
  source 1..9876: mol_type = other RNA
acggcaggagttatagttatgttaataccgacagccatggcattccatcttacaacccgcaacggtgaaccacatatgattgtaggaagacaagaaaaaggaaaatcattgttattcaaaactgaggatggtgtgaatatgtgtaccctaatggccatagacctgggggaattatgcgaagataccattacatacaaatgtcccctgctaaggcaaaatgaaccggaagatattgattgttggtgtaattcaacaagtacttgggttacttacggaacctgtaccacgaccggtgagcacagaagagaaaaacgaagtgtagcattagtacctcacgtggggatgggcttagaaacacgcacagaaacatggatgagctcagagggagcctggaaacatgtacagagaatagagacatggatattaaggcatccaggattcactattatggccgcaatcttagcctacacaatcggcactactcatttccaaagggctctaatctttatactacttactgccgtcgcgccctccatgactatgaggtgcataggtatcagcaaccgagacttcgttgaaggtgtctcaggcgggtcatgggttgacatcgtacttgagcacggcagttgtgtcaccacaatggccaaaaataaacctaccttagactttgaattaattaaaactgaagctaaacaaccagctactttaagaaaatattgcattgaagccaaacttacgaatacgacaaccgaatcccgatgccccacacaaggtgaaccgtcgttgaacgaggagcaagataaacgtttcatttgtaaacacagcatggttgacagaggatggggaaatggctgtggcttatttggtaaaggaggaatcgtaacatgtgccatgtttacttgtaagaaaaatatggaaggcaaagtagtacaaccagaaaatctagaatacacaatcgttataactccgcactcaggcgaggaacatgcggtagggaatgacacagggaaacatggaaaagaaataaaaataacaccccaaagcagtataactgaagcagaattaactggatacggcacagttacgatggaatgttctcccaggacgggattagactttaacgaaatggtattacttcaaatggaggacaaagcatggctcgttcatcgtcaatggttcttagatctcccattaccttggttaccgggagcagacacacagggtagtaattggatacaaaaagaaactttagtcacatttaaaaacccgcacgcaaagaagcaagacgtagtcgtattgggatcccaggaaggggctatgcacacagcgttaacaggcgcgaccgaaattcaaatgtcatctggaaatctcttatttaccggacacttgaaatgcagactacggatggataaactgcaactaaaaggaatgtcatactcgatgtgcaccggtaaatttaagatagttaaagagatcgccgagactcaacatggaacaatcgtaattagggtacaatatgagggggatggcagcccatgtaaaataccctttgaaataacagatctcgagaaacgccatgtcctaggacgactaataacagttaatccaatagtaacagagaaggattccccagttaatattgaagctgagcctccattcggtgattcttatataatcataggagtggaaccaggccaattaaaactaaattggttcaagaaagggagttcaataggacaaatgttcgaaacaaccatgaggggagctaagagaatggcaattcttggagacacagcgtgggatttcggtagtctagggggagtctttacttcaatcgggaaggctttgcaccaggtgttcggtgcaatctacggagctgctttttcgggggttagctggaccatgaaaatattaatcggcgttatcataacctggataggcatgaactcaagaagcacaagtctatcggtatccttagtattagtaggagtagttactttatatttaggagcgatggttcaagcagactcaggttgtgtcgtctcatggaaaaataaagaattaaagtgtggttctggaatcttcattaccgataatgtacacacatggacagaacagtacaaatttcaaccagaatccccatccaagctagcgtcagcgatacaaaaggcgcatgaagaaggaatctgtggaataagatcggtaactagattagaaaacttgatgtggaagcaaatcaccccggaattgaaccacatcctgagtgaaaatgaagttaagttgacaattatgacaggggatataagaggaataatgcaggccgggaaaagatcgcttcgtccccaaccaactgaactcaagtactcatggaaaacttggggcaaagctaagatgctatccacagaaagtcataaccaaacatttctaattgatggacctgaaacagcagaatgtccaaacaccaacagagcatggaatagtttagaagtcgaagattatggcttcggtgtattcacaacaaacatatggctaaaactacgagaaaaacaagacgtgttttgtgactccaagctaatgtccgcagcaatcaaagataatagggcagtccatgcagatatgggttactggatagagagtgcgttaaacgatacgtggaagatggaaaaagcatctttcatcgaagttaaaagctgtcactggccgaagtctcacacattgtggtctaatggtgtcctcgaaagtgaaatgataatacctaaaaatttcgctgggcccgtttcacaacataactataggcctggataccatactcaaactgcaggtccctggcatctcggtaaacttgaaatggatttcgacttatgtgaaggcacaactgtcgtagtaactgaagattgtggaaaccgagggcctagtttaagaacgacaactgcttctggtaagctaataacagagtggtgttgtaggagctgcactttaccacccttgaggtataggggagaagacggatgttggtatggtatggaaataagacccctgaaggaaaaggaggaaaatctggtcaactcacttgtcactgcaggtcatggacaaatcgataattttagtctaggagtactaggcatggcactatttcttgaagaaatgctccgaacaagaataggtacaaaacatgcaatactattagtggcagtatccttcgtcaccttgataactggtaacatgagttttcgagatctaggtagagtcatggtaatggtcggagcaacaatgacagatgacataggaatgggggttacgtatttggcactgctggcagcattcaaagttaggcctaccttcgcagccggattattactacgaaaactgacaagtaaagaactcatgatggcaacaataggaatcgcattgctgagtcagtcaacaattcccgagactatcctggaactgactgacgcattagcacttggaatgatggttcttaagattgtgcgaaacatggaaaaatatcagctagctgttacaattatggctatatcatgcgttcctaacgctgtaattttacagaatgcttggaaagtcagttgtacgatattggctgctgtaagtgtatctcccctactgctaacttcctctcaacaaaaagcagactggatcccattggcccttacaattaaaggtcttaaccctactgcaatatttttaacaacactatcacgaactagcaagaaacggtcatggcccctaaatgaggctatcatggctgtaggaatggtgtctatcttagcatcatccctcctaaagaatgacattcctatgacaggtcctctagtggcgggtggtctgctgacagtgtgttatgtacttactgggagaagcgcagatctagaactcgaacgagcagccgacgtgaagtgggaggatcaagccgaaataagcggtagtagccctatattgtcaataacaatcagcgaagatggatcgatgagcatcaaaaatgaggaagaggaacagacactcacaattctaataagaacaggtctattagttataagtggagtattcccggtgtcaatcccaataaccgctgcagcatggtatctgtgggaggtaaagaagcaaagagccggggtgctatgggatgttccatcacccccaccagttgaaaaagcggagcttgaagatggagcatacagaatcaaacaaagagggatcctaggttacagccaaataggagcgggagtatacaaagaaggcaccttccatacgatgtggcacgttactcgaggggctgttctcatgcaccgagggaagaggatcgagccatcttgggcggatgtcaagaaagacctaatctcgtatggtgggggttggaaactcgaaggagaatggaaagagggagaagaagtgcaagtactggcactagaacccggcaaaaatccacgggcagttcaaactaaaccaggtatgttcaaaaccaatactggaacaataggagcggtatcccttgactttagcccggggacaagtggatcaccaatagtagatcgtaaaggtaaagtggtgggtctttacggtaatggggtagtgacacgaagtggtgcgtacgtttccgcaatcgctcagacggagaaaagcattgaagacaatccggaaattgaagacgatatatttcgtaagaaaagactgaccataatggaccttcacccaggggcaggcaagaccaaaagatacttgccagcgatagttagagaagcaattaaacgaggcttgagaaccctaatattagcacccacacgagttgtcgcagcagaaatggaggaggcattgagaggactacccataagataccaaactcctgctattaagaccgaacacaccggtagagagatagtggatcttatgtgccacgcaacctttacaatgcgattattaagtcctgtcagagtaccaaattataatttaataataatggatgaggctcacttcactgacccagccagcatcgcagctagaggctatatatctacgcgagtcgaaatgggagaagcagctggcatattcatgactgctacaccaccagggtcgagagacccctttccacagagtaatgcaccgataatggatgaagaacgtgaaattcctgaaaggtcgtggaatagtggtcatgagtgggtgactgatttcaaaggtaaaacagtgtggtttgtaccatcaattaaagcaggtaatgatatagctgcatgtcttaggaaaaacggcaaaaaggtaattcagctctccagaaagacatttgactcagaatatgtcaaaacgcgagccaatgattgggattttgttgtgacgaccgacatcagcgaaatgggagccaacttcaaagctgagcgagtgatcgacccgcgaagatgtatgaaacctgttatactgaccgatggcgaagagagagtcatactggctggcccaatgccagtaacacactcaagtgcagctcaaagaagaggtcgcattggtagaaatccgaaaaatgaaaatgatcagtacatctatatgggagaacctttagaaaatgatgaggactgtgcccattggaaggaagcaaagatgttactcgataatattaacacaccagaaggaataattccaagtatgtttgaacctgaacgagaaaaagttgacgcaatagatggagaatacaggctgagaggggaagcaagaaaaacattcgtagatctaatgagacgaggtgatctacctgtatggctcgcctataaagttgcagctgaaggaataaactatgcggaccggaaatggtgctttgacgggattaagaacaatcagattttagaagagaatatggaggttgaaatttggactaaagagggtgaaagaaagaaactaaaaccgagatggctagatgcccgaatatattcagacccgttagcactgaaagaatttaaagagttcgcagctggtagaaaatctttaactctcaatcttataacagaaatgggtagacttccaacattcatgactcaaaaagcacgcaatgcattagataacctagccgttctacataccgccgaagccggtggcagagcttataaccatgccctaagcgaactaccagaaactttagagacactccttctgttaactctactagcaacagtgactggaggaatattcctatttctgatgagcggaaaaggaatagggaaaatgacgcttggaatgtgttgcatcatcacagcgagtatccttttatggtatgcccaaattcaaccacactggatcgcggcctctatcatactggaatttttcctaatagtgttactcatacctgagccagagaaacaacgaaccccacaggataatcaattaacttatgttgtgatagctattcttacggttgtagcagcaactatggcaaatgaaatgggttttctcgagaaaacaaagaaagatttgggtttaggaagtataacgacacaagaatccgaaagcaatatactcgacatagacttacgacctgcgtcagcttggactttgtatgctgtagccacaacgttcgtaacacccatgttacgacacagcattgaaaatagctcagtgaatgtatcattgactgctattgcgaatcaggccaccgtactaatgggtttaggaaaaggatggccactctccaaaatggatattggagtccccttgctagccataggttgttattcgcaagtaaaccctataactcttacagcggcactattgctcctggtagcccactacgccattataggcccaggactgcaggccaaggcaacacgggaagcccagaaaagagcagcagcgggtataatgaagaatccgaccgttgatgggataaccgttatcgacctagagccaatcccttatgacccaaagtttgaaaagcagttaggtcaagttatgctccttatcctatgcgtcacccaagtgcttatgatgaggaccacttgggcactctgtgaagcattaacattggcaaccggcccaatatctactttgtgggaggggaatccagggagattctggaatacaacaatagcggttagtatggctaatatttttcgtggctcttatttagcaggagctggactcctattttcaataatgaagaacacaacaaatactcgacgtggaacaggaaatataggagaaacacttggcgaaaaatggaaaagtagactaaacgccttgggcaaaagcgaatttcaaatctataaaaagagcgggattcaagaggtcgatcgcacactggcgaaagagggcattaaacgaggtgagactgatcaccacgccgtcagtagaggatcagctaaacttaggtggttcgtagagagaaacatggttacccccgaggggaaagtagttgatcttggttgcggtcgcggcggatggtcatattattgcggagggctcaaaaatgtaagagaagtcaaaggcttaactaaagggggaccaggtcacgaagaaccaataccgatgagcacatacggatggaatttagtaagattacagagtggtgtagacgtattctttacgcctcccgaaaaatgtgatacattactttgtgatataggagaatccagcccgaacccgacaatcgaagcaggcagaacactacgagtactcaacttggttgaaaattggctaaacaataatacccaattttgtattaaagttctgaacccatacatgccctctgttatagagaaaatggaggcactccagcgaaaatacggtggtgcattagtaagaaatcctttatcaagaaatagtacccatgagatgtactgggtttctaatgccactggcaacatcgtcagcagtgtaaatatgataagtcgaatgctaatcaatagattcaccatgaaacacaagaaagcaacttacgagccggatgttgatctaggaagcgggactcgaaatattggaattgagagtgaaattcccaatctagatatcataggtaagagaatagagaaaattaagcaagaacatgaaacgtcctggcattatgaccaagaccacccttataaaacatgggcgtatcatggatcttatgaaaccaagcagacgggatcagcgagttccatggtaaacggagtagtaagactattaactaaaccatgggacgttgtgcccatggtcacccaaatggcaatgacagacacaaccccgttcggccaacaaagagtatttaaagaaaaagtcgatacaaggacacaagaacctaaggaaggcacaaagaaactcatgaaaatcacagctgaatggttatggaaagaattagggaagaagaaaacaccaagaatttgtactcgggaagagtttaccagaaaagtcagatccaatgcagcgcttggagcaatattcactgacgaaaacaaatggaaaagcgccagagaagcagttgaagacggaagattttgggaattagtagaccgagagaggaaccttcatttagaaggaaaatgtgaaacttgcgtatataacatgatgggcaaaagggagaaaaagttaggtgaatttggtaaagcgaagggtagtcgcgctatatggtatatgtggcttggagcacgctttctagaatttgaggctttaggattcttaaacgaagaccattggttttctcgcgaaaattctctaagcggagttgaaggagaaggtctccatcgtctcgggtatatattacgagatgttgggaaaaaggaaggaggcgcaatgtacgcagacgacaccgcgggttgggacacaaggattacattagaagacctcaaaaatgaagaaatggtcacgaaccacatgaaaggggaacataagaaattggctgaagcaatcttcaaacttacttaccagaacaaggtagtacgagttcagagacccacacctagaggaacagtaatggacataatatcaagaagagatcagaggggatctggtcaagttggtacgtatggactgaacacctttactaatatggaagctcaattgatacgacagatggagggtgaaggcatatttaagtctatacaacatcttactgcaacagaagaaattgctgtacaaaattggttagccagagtaggaagagaaagattaagccggatggctatatcaggagatgactgcgttgtgaaaccaatagatgatcgtttcgctagtgcccttactgccctaaacgacatgggcaaagttagaaaggacatacaacagtgggagccaagtagaggatggaacgattggacccaggtacccttctgtagtcaccatttccacgaattggtaatgaaagacgggagggtacttgttgtcccatgcagaaatcaagatgaacttattgggagagcacggatatcacaaggggcgggatggtcgctcaaagaaactgcctgccttggaaagtcatacgcacaaatgtggacattaatgtacttccatagacgagatctgagattagctgcaaacgctatatgttctgctgttccaccacattgggtacctacttcacggacaacatggtcaattcacgcgaaacacgagtggatgacgacggaagatatgctagcagtatggaatcgagtgtggatacaggaaaatccatggatggaggataaaactccagtagaaagttgggaagaagtaccatacctgggcaagagagaagatcagtggtgcgggagtcttataggactcacgtctcgcgctacttgggccaaaaacattcaaacagccataaatcaggttagaagtttaatcggaaatgaagaatatacagattacatgccatccatgaaaagatttaggagagaagaagaggaagcaggcgtactatggtaa

SEQ ID NO: 22411 - RNA, 9876 nt, synthetic construct
  misc_feature 1..9876: note = derived and/or modified CDS sequence (opt6) from DENV-2__FJ744745__SS-prME
  source 1..9876: mol_type = other RNA
accgccggggttatagtaatgttaatcccaaccgccatggcctttcatctaacaacccgtaatggggaaccacatatgatcgtaggacgtcaagaaaaaggtaaaagtctacttttcaaaacagaagacggagtaaatatgtgtacactaatggctattgatttaggtgaactatgtgaagatactatcacatataaatgtccactattaagacaaaatgaacccgaagacattgactgttggtgcaatagtacttctacatgggtaacctacggaacatgcactactactggggaacatagaagagagaaaagatctgttgccttagttccgcacgtaggcatgggactagaaacacgaacggaaacttggatgtcttcagaaggagcatggaaacatgttcaacggatcgaaacctggatcctaagacaccctggctttaccattatggcagctattcttgcttatacaattgggactacgcatttccaacgagctctgatatttatcctactgacagcggtcgccccaagcatgacaatgagatgtattggaattagcaacagagactttgttgaaggagttagcggtggatcttgggtagatatagtattggaacatggcagttgtgtaacgacaatggctaaaaataaaccaaccctcgatttcgaactaattaaaactgaagccaaacaacccgctactctacgaaaatattgcatcgaagcgaaactaactaatacaactactgagagccgttgccctacgcagggagaaccgagtttaaacgaggaacaagacaaacgctttatatgtaaacattctatggtggatcggggctggggaaatgggtgcggactttttgggaaaggcggcatagtaacgtgtgctatgtttacttgcaagaaaaatatggaagggaaagtcgttcaaccggaaaacctggaatataccattgttattactccacattcaggagaagaacacgcagtaggcaatgatactggcaaacacggaaaagaaataaaaataactccacaatcatcgataacggaagctgagctaacaggatatggaaccgtgaccatggagtgtagcccacgaacgggtttggatttcaatgagatggtactactgcaaatggaagataaagcctggctggtgcatcgacaatggtttttagacctaccgttaccgtggctacccggagcagatacacaaggcagcaactggattcagaaagaaaccctagtaacgttcaaaaacccgcacgcgaagaaacaagatgtagtagtattaggatctcaagaaggcgcaatgcatactgcattaactggagccacggaaatccagatgagttcaggtaatttactttttactggacacttaaaatgcagattaaaaatggataaactacaacttaaaggaatgtcatattcaatgtgcacaggaaaatttaaaatcgtgaaagagatcgcagagactcaacacggaactattgttattcgtgtacaatatgaaggcgacggatctccatgcaaaatcccatttgaaataacagatttggagaaaagacacgtcctaggaagattaattacggtcaatcctatcgtaacggaaaaagacagtcctgtcaacatagaagcggaacctcctttcggagatagttatatcataatcggtgttgaaccaggtcaactaaagctgaactggttcaagaaaggatcgtctatcggccagatgttcgaaacaactatgagaggcgcaaaaagaatggcaatactaggcgatacagcctgggatttcggttctttaggcggtgtttttactagcatcggaaaagcattacaccaggtttttggagcgatctacggggcagcattctcaggcgtaagctggacaatgaagattctgataggagtcataattacatggataggcatgaactctagaagtacatcgctttcggtgagtcttgtgctagtcggtgtagtcacactttatcttggggctatggttcaagcagactctggctgtgtagtgagttggaaaaataaagaactaaaatgtgggtccggtatattcattactgataatgttcatacgtggacagagcaatacaaattccaaccagaaagtccatccaaactcgcaagtgccatacagaaagctcacgaagaaggtatatgtggcataagatcagttacaagacttgaaaacctaatgtggaaacaaatcactccagaattaaatcatatattatctgaaaatgaggtgaaattaacaattatgacaggagatattagaggaataatgcaagcaggtaagcgttctttgcgtccacaaccaactgaattaaaatattcatggaaaacatgggggaaagcaaagatgctctctactgaatcacataatcaaactttcctgatagacggcccggaaacggccgaatgtccaaatactaatagagcatggaactcactcgaggtagaagactatggatttggcgttttcactaccaacatatggctgaagttaagagagaaacaggatgttttctgcgatagtaagctgatgagcgctgcaattaaagataatcgtgctgtccacgcagacatgggatattggatcgaatcagcccttaacgatacatggaaaatggaaaaagcaagttttattgaagttaaaagttgtcattggccaaaatctcatacattgtggtcaaacggagtgctagaaagcgagatgattatacccaaaaatttcgcgggacccgtttctcaacacaactacagaccgggataccacacgcaaactgcggggccctggcatcttggcaaacttgagatggacttcgacctatgtgaaggcaccactgtagtagtaacagaagattgtggcaatagaggtccgtcgttgagaaccacgactgcgagtggcaagctaataacagagtggtgctgcagatcatgtacgttaccgccattgcgatatcgtggtgaggatggctgttggtacggaatggagataagacctctaaaggaaaaggaagaaaacctagtgaatagccttgttactgcaggccatggacaaattgataattttagcctaggagtactgggtatggcattatttttagaggaaatgttacgcacacgaatagggacaaaacacgcaattttgttggtcgctgttagttttgtgacattaatcacaggtaatatgagtttcagagatctaggacgcgtaatggtaatggtaggtgcaacaatgacagatgatattggtatgggagttacttacctagcactgttggctgcctttaaagtgcgcccaaccttcgccgcaggcttactcctcagaaaactcacttccaaagagttgatgatggccacaataggaatcgcactcctgtcacagtcaactatcccagaaactatcctcgaacttaccgatgcactcgccttgggaatgatggtcttgaaaatcgtaaggaacatggaaaaatatcaactagcggtaaccataatggcaatttcgtgcgttcctaatgccgttatccttcaaaatgcatggaaagtaagttgtaccattttagccgccgtcagtgtaagtccgttgttgcttacatcatcacagcaaaaagctgactggattcccctagccctaactattaaaggtctcaatccgacggctatatttttgactactctcagcagaacatcaaagaaaaggagctggcccctgaacgaagctataatggctgtaggaatggtaagcatacttgcttcatctctgcttaaaaatgatatccctatgaccgggccattagtagcgggtggtttattgacggtgtgttatgtattaaccggtagaagcgctgatctggaactcgaacgtgcggccgatgtaaaatgggaagaccaagctgagatatcagggagcagcccaattttgagcatcacaatcagtgaggatggctctatgtcgatcaaaaacgaagaggaggaacaaacattaactattctaatccgtactggcctattagtgattagtggcgtatttccagtctcaataccaataacagccgcagcctggtatttatgggaagtcaagaaacagcgcgccggtgttctatgggatgtaccttcaccccctcccgttgaaaaagccgaacttgaagatggagcgtatcgaataaaacaaagaggaatattgggttattcccagatcggcgccggcgtatacaaggaaggtacattccacacgatgtggcacgttacccgaggcgcggttctcatgcaccgaggaaaaagaattgaaccaagttgggcagacgtcaagaaagatcttatatcgtacggaggcggatggaaactggaaggagaatggaaagagggcgaagaggtacaagtgcttgctctggaacctggtaaaaacccacgagcggttcaaaccaaaccaggcattttcaagacaaatacgggtacaattggagctgtaagtttagacttctcacccggaacaagtggatcaccgatagtagacagaaaagggaaagtagttggactatacggaaatggtgtcgtgacaagatcaggagcatatgtaagtgctatagctcaaacagagaaaagcatagaagataatccagaaatagaagacgatatatttagaaagaaacgattaaccatcatggatctccatcccggagctggaaaaacgaaaagatatcttccagccatagtccgagaagctattaagcgaggactcaggaccctcatactagcgccgacaagggtagtcgcagccgaaatggaagaagcattgaggggtctaccaatacgatatcaaacacccgcgataaaaaccgagcatactggtagagagatcgtagacctcatgtgccatgcaactttcactatgaggttactatctccagtcagagtccccaattataatcttatcataatggatgaagcacacttcactgatcctgccagcattgcggcgagaggttatatttcaacaagagtggagatgggcgaagccgcaggaatattcatgacagccacaccacctggaagtagagacccattcccgcagtcaaacgcgcccattatggacgaggaacgtgaaatcccagagcgatcatggaactccggtcatgagtgggtaacagacttcaaaggaaaaacagtgtggttcgtaccaagcataaaggccggaaatgacatcgctgcttgtttacgtaaaaatgggaaaaaggtaattcaactaagtcgcaaaacctttgattcagaatatgttaaaacgcgagctaatgattgggatttcgtggtaactaccgatatatccgaaatgggggcaaattttaaggctgaacgtgtcatagatcccagacgttgtatgaagcccgtaatattaacagatggagaagaaagagtaattctcgccggaccgatgccagtaacgcattcatctgcagcacaacgtcgagggcgaataggccgaaaccctaaaaacgaaaatgaccaatatatatacatgggcgaaccactggagaacgacgaagattgcgcacattggaaggaggccaaaatgttactagacaacatcaatacacctgaaggcatcattccgtcaatgttcgaaccggaaagagagaaagtagatgcgattgatggtgaatatagattaagaggagaagcaaggaaaacatttgtagatcttatgagacgaggagacttaccagtatggttagcgtataaagtagcagcggagggtataaattatgctgaccgaaaatggtgttttgatggtatcaagaacaatcagatcttagaagaaaatatggaagtcgagatttggactaaagagggtgagaggaagaaactaaaaccccgatggttggatgctagaatatattctgaccccctagctttaaaggagttcaaagaatttgcggcaggcagaaagtccttaaccctgaacttaataacagagatggggaggctaccgacattcatgacacagaaagcacgcaatgctctggacaacttggcagtattacacaccgcagaagctggagggagagcttacaatcatgcgctcagcgaactaccagaaacacttgaaacgttactactacttacactcttggcaactgtaaccggtggcatatttttatttctaatgtcaggtaagggaattggaaaaatgactctcggaatgtgttgcatcatcactgcatctacgctgctatggtacgcacaaatccagcctcattggattgcagcgagtattatcctcgagttctttctaatagtcctcttaatcccagaaccggaaaagcaacgcaccccgcaagacaatcagttaacatatgttgtaatagcgatactaaccgtggtagcagcaacgatggcaaacgaaatggggtttttggagaaaactaagaaagatctgggcctaggttcaataacaacccaggaatcagaaagtaacatcctcgatatagatttacgcccagctagcgcatggacattgtatgctgtagcaaccacttttgtgacacccatgctacgccatagcatagaaaatagtagtgtcaatgtttcgttaacagcaattgcaaatcaagctacagtcctaatgggtttgggaaaaggatggcctctatccaaaatggacataggagtgccgcttctagcaataggatgctactcacaagtaaacccaatcacactaacagcagctttattactcctagttgcacactatgcaatcattggtccaggtttacaagcaaaggcaactagagaagcccagaaaagagcagctgcaggaattatgaaaaatccaacggttgacggcataacagtgatcgatctagagccaataccatatgaccccaaatttgaaaagcaattgggtcaagtaatgcttcttattttgtgcgttacccaggtactgatgatgcggaccacctgggccttatgtgaggcactaacattagctacaggacctatatctactctctgggaaggaaaccctggccgattttggaacactacaattgccgttagtatggcgaatattttcagggggagctatttggcgggcgcaggattattattttccataatgaaaaacacgacaaacaccagaagaggaacggggaatataggtgagacactgggagaaaaatggaaatccagactaaacgcacttggtaagtcagaatttcaaatttacaagaaatcaggcattcaagaagtcgatcgcacattagcaaaagaaggaatcaaacggggcgagactgatcatcatgcggtctccagaggttccgctaaactacgatggtttgtcgagcgtaatatggtgacaccggaaggaaaagtagtggacctaggatgtgggagaggtggatggagttattattgtggaggcctgaagaatgttcgagaggttaagggacttaccaagggtggaccagggcacgaagaaccaattcctatgagtacatatggatggaacttagtaaggcttcagagtggggtagatgtattcttcacacctcctgagaaatgcgatacacttttatgcgatataggcgaatcatcccctaatccaactatcgaagccgggcgcacgctcagggtgttaaatttggtagaaaattggttgaacaacaacacacaattttgtattaaggtattaaatccgtacatgcctagcgtcattgagaaaatggaagcacttcaaagaaaatatggtggagccctagtaagaaatccattgagtagaaactccacgcacgaaatgtattgggtatccaatgcgagtggaaacatagtgtctagtgttaatatgatcagtcgaatgttgataaacagatttactatgaaacacaaaaaggctacttatgaaccagatgtagacttagggtccggaactagaaatataggaattgaatcagagatacccaatcttgatatcattggaaagcgaatcgagaaaattaaacaagagcatgagacatcatggcactatgatcaagatcatccatacaaaacatgggcttaccacggaagttacgaaacaaaacaaacaggatccgctagctcaatggttaatggggttgtgcgtcttttaactaaaccttgggacgtcgtgccaatggtaacacagatggcgatgacggatacaactccttttggacaacaaagagtctttaaagaaaaagtagatacacgcacccaagaaccgaaagagggcaccaagaaattaatgaaaatcactgcagaatggctatggaaagaattgggcaagaagaaaaccccacgaatgtgtacaagggaagagttcaccagaaaagtgagatcgaacgctgcactgggagcaatttttacggatgaaaacaaatggaaatcggcgcgcgaagccgtagaggacagcaggttctgggaattagtagatagggaacgaaatttacatctcgaaggaaaatgtgaaacatgtgtgtacaacatgatgggaaaaagggagaagaaattaggtgaatttggaaaggctaagggatcaagagcaatctggtacatgtggctgggtgcaaggtttctagagtttgaagctctcggtttcctaaatgaagatcattggttctcccgtggcaattcactaagcggtgtggaaggggagggtttacataggttagggtatatattgagggatgtcggcaagaaagaaggaggggctatgtatgcagatgataccgcggggtgggatacgagaatcaccctagaggaccttaaaaatgaagaaatggtcaccaaccatatgaaaggtgagcataaaaagctagccgaagcaattttcaagttaacatatcaaaataaggtcgttagagtccaacgtccgacgccaagagggaccgttatggatataatcagtagaagagaccagaggggatcaggccaggtgggcacatacggccttaatactttcactaatatggaggcgcaattaataagacaaatggagggagaagggatcttcaagagtattcaacatctaactgcaacagaagagatcgcagtgcagaactggttagctcgagttggacgggagcgacttagtcgaatggctattagcggagatgactgtgtagtaaaacccattgatgatcggtttgccagcgcactcacagcattaaatgatatgggtaaggtaagaaaagacatccaacagtgggagccgtcaaggggctggaatgactggacacaagtcccattttgctctcatcactttcacgaattagtcatgaaagatggccgtgttttagtcgttccatgtagaaaccaggacgaactcatcgggcgagcgagaatatcccaaggtgcaggatggtctttaaaagaaacagcttgcttaggaaaaagttacgcacaaatgtggacacttatgtatttccatagaagagatcttaggttagctgccaacgccatatgttcggcggtccctccccattgggtcccaacttctcgtactacctggtctatacatgcaaaacacgaatggatgacgactgaagacatgctagcagtttggaaccgagtttggatacaagaaaatccttggatggaggacaaaacacccgttgaaagttgggaagaggttccctatctaggaaaaagagaagaccaatggtgtggcagcttgataggtctaacaagtcgagccacctgggctaaaaacattcaaaccgcaattaaccaagttaggagcttaattggaaatgaagaatacaccgactacatgcccagtatgaaaagatttagaagagaagaagaagaagcaggcgtcttatggtag

SEQ ID NO: 22412 - RNA, 9876 nt, synthetic construct
  misc_feature 1..9876: note = derived and/or modified CDS sequence (opt6) from DENV-2__FJ744705__SS-prME
  source 1..9876: mol_type = other RNA
acagccggggttatagtcatgcttatacctactgcgatggcgtttcacctaaccaccaggaatggagaaccacatatgattgtggggcgccaagaaaaaggtaaatcattgctattcaaaacagaagacggggtaaatatgtgtactcttatggcgatcgatcttggagaattatgcgaagacacgataacttacaaatgcccgctgttacgacaaaacgaacctgaagacattgactgttggtgcaatagtactagcacttgggtaacctatggtacttgcaccactactggtgaacatcgaagagaaaaacgatcagtagcgcttgtaccccatgttggaatggggttggaaacgcggactgaaacatggatgagctctgaaggggcatggaaacacgtacaacgaattgaaacctggatattaagacatcccggatttacaattatggcagccatattggcttatacaattggcactacacactttcaacgtgcgttaatttttattctattgacagcagttgcacctagcatgacaatgagatgtattggaatttcaaatcgagattttgtcgaaggggttagtggcggtagttgggtagacattgttctcgaacacggcagctgtgtcacaacaatggccaaaaataaacccactttagactttgaactaataaaaacagaagcaaaacaaccggccacactcagaaaatattgcattgaagccaaactaactaataccacaacagaatctagatgtccgacacaaggggaacctagcctcaacgaagaacaggataaaaggtttatttgtaaacattcaatggtggaccgtggatggggcaacggttgtgggttattcggtaaaggagggattgtaacctgcgccatgttcacatgtaagaaaaacatggaaggaaaagttgtgcaacccgaaaatttagaatacacaatagttataacaccacacagtggggaagaacacgcagtaggaaatgatacggggaaacatggaaaagaaataaaaattaccccacaaagtagcataacggaagcagaattaaccggatacggaacagttacaatggaatgtagtccgcgaacaggtttagacttcaatgaaatggtattattacaaatggaagacaaggcttggctagtccatcgacaatggtttcttgatttgcctctaccatggcttccaggcgccgacacgcaagggtccaattggattcagaaagaaaccctagttactttcaagaatccccatgccaaaaagcaagatgtagtcgtcctaggatcacaggaaggcgcaatgcacaccgcgctaacaggagcgacagagatacaaatgtcatcaggtaatttactatttactggacacctaaaatgtcgcctgcggatggataaactacaactaaaaggcatgtcgtacagcatgtgcacgggaaagttcaaaattgttaaggaaatcgcggagacccaacatggaactatcgtaattagggtccaatatgaaggcgatgactcaccttgcaagataccatttgaaatcactgatctagaaaaacgacatgttttaggacgattgattaccgttaatccgattgtcacagaaaaagattctcctgtcaatatcgaagctgaacccccattcggggatagttacattataattggagttgaacctggacaactaaaattgaattggttcaagaaaggttcaagtatagggcagatgtttgaaacaactatgaggggagcaaaaagaatggcaatccttggagatacagcttgggatttcggcagcctaggaggtgtattcacgtcaattggcaaagccttacatcaggtattcggcgctatatacggtgccgcattttccggtgtatcatggaccatgaagatactgattggagtaattataacgtggataggaatgaactcacgcagcacatcactatctgtgagcttagttctcgtaggtgtagtgaccttataccttggagctatggtacaagcggatagcggatgcattgtttcttggaaaaacaaagaactaaaatgcggatccggtatattcataactgacaacgtacatacgtggacagaacaatataaatttcaaccggaatcaccttcgaaattagcatctgccatccaaaaggcacatgaggaaggtatatgtggcatacgttctgtaacacgattagaaaatctcatgtggaagcaaattacacctgaacttaatcatatattgtcagagaatgaagtcaaactgacaataatgacaggagatatacgtggcataatgcaggcggggaaacgatccttaagacctcaacctaccgagctaaaatactcatggaaaacctggggtaaagcaaaaatgttaagtacggaaagtcataatcagactttccttattgacggaccagagacagtagagtgtccgaatactaacagagcctggaactcactcgaagttgaagactatggtttcggagtattcacgacgaatatatggttaaaattaagagaaaaacaagatgtattttgtgactcaaaactaatgtcagcagccataaaagacaatagagctgtccatgccgatatggggtactggatagaaagtgcccttaatgatacttggaaaatggaaaaagcatcgttcatcgaagtaaaaagctgtcactggcctaaaagtcacaccttgtggagtaacggcgtcctcgaatctgaaatgataatacctaaaaacttcgcggggccggtatcacaacacaattatcgaccaggctatcatacgcaaacagcaggaccgtggcacctaggaaaactcgaaatggattttgatttatgcgaaggtactacagtagtagtcacagaagactgtggaaatcgtggaccatctctgaggacaactacagcaagcggcaaactaatcaccgagtggtgctgcagaagctgtactctaccacccctacgatacaggggagaagatggatgctggtacggaatggaaataagaccactaaaggaaaaagaagaaaatctggtaaatagcttagttaccgcaggacatgggcaaatcgataactttagtttgggagtattaggtatggcgttattcctagaagagatgctccggacccgcataggtactaaacatgctattctattggtagcagtttcgtttgtgaccttaataactgggaatatgtcttttcgagatctgggtcgtgtcatggtaatggtcggtgcaacaatgactgacgatataggaatgggtgttacctatttagcactactagctgctttcaaggttaggccaacatttgcagccgggctattactacgaaagctaacatcgaaggagcttatgatggcgaccataggtattgccctgctcagccagtcaacaatacccgaaactatactagaattaaccgatgctctagctttaggaatgatggtgctcaaaatagtacgtaatatggaaaaatatcaattagcagtcaccataatggctatatcatgtgtacccaatgcggtaatcttgcaaaatgcgtggaaggtttcatgcacgatattagcagccgttagtgtatccccattattattaacctcatctcagcagaaagccgattggataccactcgctctaacaataaaaggattaaaccccacagctatattcttgaccacgctgtcccggacaagcaagaaacgaagttggcctttaaatgaagcaattatggcggttgggatggtatcaatactggcatcaagccttttgaaaaacgatataccaatgacaggaccattggtagctggaggactattaaccgtgtgttatgtacttacgggacggtcagcggatttggaattggaaagggcagccgacgttaaatgggaagaccaagcagaaattagtggttcaagtccaatactttctattaccattagcgaagacggttctatgtcgattaagaatgaggaggaagaacaaacattaaccattcttataagaacaggcctattagtaataagtggtgttttcccagtatcgatacctataacagctgcagcttggtacctatgggaagttaagaaacaaagggccggtgtactttgggatgtaccgagtccacctccagtcgaaaaagcggaacttgaagacggagcttatcgaataaaacagagaggaattttgggatattcacagataggcgctggtgtatacaaagaaggtacatttcatacaatgtggcacgtaaccagaggcgccgtgttaatgcatcgtggaaaaaggatagaaccttcctgggcggacgtcaagaaagatctaatctcctatggtggtggctggaaattagagggggagtggaaagaaggtgaagaggtccaggtactagcactcgaaccaggcaaaaatccaagagctgtacaaacaaaacctggcatattcaaaaccaatacaggtactataggggcagtatcattagatttttcgccaggtacgagcggtagtcctatcgtggatagaaaaggtaaagtagtaggattatacggcaacggagtagtaacgcgatccggtgcgtatgtaagtgcgatagcacaaactgagaagtcaattgaagataacccggaaattgaggatgacatatttcgaaagaaacgccttaccataatggatctacatcccggggcaggaaaaactaaacgatatttacccgcgatcgtaagggaggcaataaaaagagggctacgtacacttatactagctccaactcgtgtcgtcgcagctgaaatggaagaggctttgcgaggcctacctattcgatatcaaacgcccgctataaagaccgaacatactggtagggaaattgttgatctaatgtgtcacgcgacattcacgatgcggttactttcccctgtaagagttcctaattataacttaattattatggatgaagcacatttcacagacccagcatcaattgcagctaggggttacataagcacacgagtagaaatgggagaagcagcgggaatttttatgacggctacgcctccagggagtagagacccgttcccgcagtccaatgctcccataatggatgaagagagagaaatccccgagagaagctggaactcaggtcatgaatgggtcacagattttaaaggtaaaacagtatggtttgtcccttccatcaaagcgggaaatgacatagctgcgtgtttacgaaagaacggcaagaaagttattcagctatctagaaaaacatttgattcagaatacgtgaaaacaagagcaaacgattgggacttcgtcgtcacaacagatatctctgaaatgggtgcaaactttaaagctgaaagagtaatagaccctcgaagatgcatgaaaccggtcatactaaccgatggcgaagaacgggtaatccttgccggcccgatgcccgtaacacactcctcggcagctcaacgtcgaggaaggattggtaggaacccaaagaatgaaaacgaccaatatatatatatgggtgagccgctagagaacgatgaagattgtgcccattggaaagaagctaaaatgttattagacaatattaatacccctgaaggaatcataccatcgatgtttgaaccggaaagggagaaggtcgacgcaattgatggagaatatcgtttaagaggtgaagcaaggaaaacgttcgtggacttgatgagacgcggtgatctacccgtctggcttgcttataaagttgccgcggaaggtattaattacgcggatagaaaatggtgtttcgacggaatcaaaaacaatcagatccttgaggaaaatatggaagtagaaatttggactaaggaaggagaaagaaagaaattaaaaccaagatggttggacgcgagaatttattccgatccattagcattaaaggagtttaaagaatttgctgccggacgaaaaagtctaactctaaacctaattactgaaatgggcagactccctacttttatgacacaaaaagctagaaatgcactcgataatttagcggtccttcatacagcagaagcgggaggacgagcgtacaatcacgccttgtcagagcttcctgagactcttgaaacacttctgctattaacacttttagcaacggtcactgggggcatattcttatttttaatgagtggtaagggtataggaaagatgactttgggaatgtgctgcatcattacagcttctattcttttatggtacgcacaaatccagccacactggatagcggcatctataatattagagttcttcctaattgtcttactcatacccgagccggaaaaacaacgtacacctcaggacaaccagctaacttatgtagtaatagccatactaaccgtagtagcggccacaatggcgaatgaaatgggtttcttagaaaagactaaaaaggatctaggtttaggtagcattacaacacaggagtcagaatcaaatatactagatattgatttgcgtcctgcctcggcatggacactatacgcggttgcaacaacatttgtaactcctatgctcagacactcaattgaaaatagctctgtaaatgtctccttgacagctattgcgaaccaagcgacggtattaatggggttaggaaaaggttggccgctgtcgaaaatggatataggagttcccttactagcaattggttgttattctcaagtcaatccaatcacattgacagccgcgttgcttttgttggtggcgcattatgcgattattggaccagggctgcaagccaaagcaacaagagaagcccagaaaagagcagcagctggtataatgaaaaacccaactgtagacgggataaccgtaatagacttggaaccaataccatatgatccgaagttcgagaaacagttaggacaagtcatgctactcatcttatgtgtaacccaagttcttatgatgagaacgacttgggctctatgtgaagctcttacactagccacaggtccgataagcaccctgtgggaaggtaatccaggaagattttggaacacaacgatcgctgtgtctatggcaaatattttcaggggcagttacctagccggagcagggctactattttctatcatgaaaaatactactaacacccgcagaggtaccgggaatattggggaaacattaggagaaaaatggaaaagtcgcttaaacgctttaggaaaaagtgagttccagatctacaagaaatccgggatacaagaagtagaccgaacactagccaaagaaggaattaagagaggggaaactgatcatcatgccgtatcgagaggatccgccaaactcagatggtttgttgaacgaaatatggtaaccccggaaggcaaagtggtcgatttaggctgcggtcgaggagggtggagctactattgtgggggattgaaaaatgtcagagaagtaaaagggttaactaaaggagggcccgggcatgaggaaccgatacctatgtcgacctacggatggaatttagtaagattgcaatcgggtgtagatgtgtttttcacgccaccagaaaaatgtgatacacttttatgtgacattggcgagagtagccctaacccgactatcgaggctggaaggacactgagagtattgaatctggtggaaaattggttgaacaataatacccaattttgtatcaaagtactaaatccatatatgccttccgtcatcgagaaaatggaagcgctacaaaggaaatatggaggagccctagtaaggaatcccttatcaagaaattctacacacgaaatgtactgggtctcaaatgcaacaggtaatatagtctccagtgtaaatatgatatcacgtatgcttataaatcgattcaccatgaagcacaagaaagctacatatgaaccagacgtggatttagggtcaggtacacgcaatataggaatcgagtcagaaatacccaacctagatataatagggaaaagaattgaaaagataaagcaagagcatgagacatcctggcattacgatcaagatcacccttataaaacatgggcatatcatggctcttatgaaacaaaacaaaccggatcggcgtcatcgatggtaaatggcgttgttagactattaaccaagccatgggatgtagttccaatggtaacacaaatggctatgaccgatactactccgtttggtcaacaaagagtctttaaagaaaaagtagatacgcgcacgcaagaacccaaggaagggacaaagaaattaatgaaaatcactgcagaatggttatggaaggaactgggcaagaagaaaacgcccaggatgtgcacacgggaggagttcacaaggaaagtgagatctaatgctgcccttggggcaatatttacggacgaaaataaatggaaaagtgctcgagaagctgttgaagacggtagattttgggaattagtagacagagaacggaatctgcatcttgaaggaaagtgtgaaacgtgtgtgtacaatatgatgggaaaacgagagaagaaattgggagagttcggtaaggcaaaaggatctagggcgatatggtatatgtggttaggcgctagattcctagagtttgaagcactggggtttttaaacgaagaccattggttcagcagaggtaacagcttatctggagttgaaggtgaaggacttcataggcttggatatattctccgagatgtagggaagaaagaaggaggtgcaatgtatgcagatgacaccgctggatgggatacgagaatcactttagaagatttaaagaacgaggaaatggtgaccaatcacatgaaaggagaacataaaaagttagcagaagccatatttaaactcacatatcaaaataaagtcgtaagagtgcaacgtccgactcctagaggaaccgttatggacattattagtaggagagaccaacgcggcagcggtcaagtcggaacctacggactaaacacttttaccaatatggaagcgcaacttattagacaaatggaaggggaagggatctttaaaagcattcaacatttgacggctacagaagaaatcgcagttcagaactggctagcccgagttggacgcgagcgtctttctcgtatggctataagcggagacgactgtgtagtcaaacccattgacgatagattcgctagtgccttgacagcgttaaacgatatgggcaaagtaagaaaagatatccaacagtgggaaccctctagaggttggaatgactggacccaagtaccattttgttctcaccactttcacgaattagtaatgaaagatgggcgggtcttagtcgtgccttgcagaaaccaagacgaattaataggcagagcaagaatatctcaaggagcgggttggtctctcaaagagacggcatgcctcggaaaatcatacgcccaaatgtggactctgatgtactttcatagaagagatttaagacttgcggctaatgcgatatgttctgctgtaccaccacactgggtcccgacatctagaactacatggtccatacacgcaaaacacgaatggatgactaccgaggatatgttggccgtgtggaacagggtatggattcaggaaaatccatggatggaagataagacgccagtagaaagctgggaagaggtaccatacctaggcaaaagggaggaccagtggtgtggatcactcataggtttgacgagccgcgcgacatgggcaaagaacatccaaacggccataaaccaggtcagaagcctaatagggaatgaggaatatacagactacatgcctagcatgaaacgatttcgccgggaagaagaagaggctggggttctctggtga

SEQ ID NO: 22413 - RNA, 9876 nt, synthetic construct
  misc_feature 1..9876: note = derived and/or modified CDS sequence (opt6) from DENV-2__FJ744744__SS-prME
  source 1..9876: mol_type = other RNA
acagccggtgttatagtaatgcttattcccacagcgatggcatttcatctgacgacccgaaatggagaaccacacatgatagtaggaaggcaggaaaaagggaaatccttactatttaaaactgaagatggtgttaatatgtgtacgctaatggctatagaccttggagaactatgcgaagatacaataacgtataaatgcccactgctacgacagaatgaacccgaagatattgactgctggtgtaatagcacatcaacgtgggtcacgtatggaacatgtactactacaggagaacatagaagagagaaaagaagtgtggctctggtccctcatgtgggcatggggttagaaacacgtacggaaacgtggatgtcaagcgagggagcatggaaacatgtccaacgaattgagacgtggatattaagacatccaggatttacaataatggcagcaatacttgcatacaccattggcacgacgcatttccagcgagctttgatatttatactactaacggccgtagctccctcaatgactatgagatgcatagggatctccaatagagatttcgtcgaaggggttagtggcgggtcttgggttgatatagtccttgaacacgggagttgtgtgacaaccatggctaaaaataaaccaacattagattttgaattaataaaaaccgaagcgaaacaacccgctacattaaggaaatactgtatagaagcaaaactaacgaatacgacaaccgaaagcagatgtccaacccagggagaaccctcactgaatgaggaacaagataaacgattcatttgcaaacatagcatggtcgacagagggtggggcaatggatgtggtctatttggtaaaggaggcatagttacatgtgctatgttcacgtgcaagaaaaatatggaagggaaagtagttcaaccagaaaatctggaatatacgatcgttatcaccccacactccggtgaggaacacgctgtcggaaacgatacaggaaaacatggtaaagaaattaaaatcacaccgcaaagttcaataaccgaagcggaactaacagggtatgggactgtcaccatggagtgctcgccacgaacaggactagattttaatgaaatggtacttcttcagatggaagacaaagcatggctagtccaccgtcaatggtttttagatttgccactaccatggctaccaggagctgacacccaaggctcaaattggatccaaaaagaaacgttggttacattcaaaaacccccatgcaaagaaacaagatgtagtagtacttggatctcaagaaggagcgatgcacactgcacttacaggggcaactgaaattcaaatgagtagcggaaatctgctattcacgggccatttaaaatgtaggctgaaaatggacaaattgcaactcaaaggcatgtcttattcaatgtgtaccggtaaatttaaaatagttaaagaaattgcggaaacacaacatggcacaattgtaataagagtccaatacgaaggagatggaagtccgtgtaagataccatttgaaataacggaccttgaaaagcggcacgtgctgggtaggttgataactgtaaaccctattgttacagagaaagactcacctgtgaatattgaagcagagcctccatttggagattcgtatataattataggtgtcgaacctgggcagttaaaactaaactggtttaagaaaggttcgagtatcggacagatgttcgaaacaacgatgagaggagcgaagagaatggcgatactaggagatactgcttgggacttcggtagcttgggaggcgtttttacgagtataggaaaagcgctccatcaagtattcggagcaatatacggtgcagcttttagtggagtgagctggacaatgaaaatattgattggtgtgatcattacttggattggaatgaatagtagaagcacatcactttctgtaagtcttgtacttgttggtgtagttacactatatttaggagctatggttcaagcagatagtggatgcgtagtaagctggaaaaataaggagctaaagtgcgggagcggaatatttattacggataatgtacatacatggacagaacagtataaatttcaaccggaaagtccatctaaactcgcctcagccatacaaaaagcacatgaagaaggtatatgtggaatacgaagtgttactcgacttgaaaacttgatgtggaaacagattactcccgaactaaatcacatcctatcagaaaatgaagttaaacttacaataatgacaggggatattaggggtataatgcaagcggggaaaaggagtctaagaccacaacccacagaactgaaatactcatggaagacttggggtaaggccaaaatgctttcgacagaaagtcataaccaaacctttctaattgacggtccagagacggctgaatgtcccaacactaacagggcatggaactcattggaagtcgaagactatgggtttggagtattcacgacaaatatatggttaaaactcagagaaaaacaagatgtattttgcgattcaaaactaatgtctgcggcaataaaagataatcgcgcggtccatgcggacatgggttactggatagaatcagcactcaacgacacctggaaaatggaaaaagcaagtttcattgaagtaaagtcgtgtcactggcccaaaagtcacactctttggagtaatggagtacttgaatctgaaatgatcataccgaagaactttgcgggacctgtgtcacaacacaattatcgtccaggctaccatactcagactgcaggaccttggcatttaggaaaacttgaaatggatttcgacctgtgtgaaggcacaactgtcgtggttacagaagactgtggaaatagaggtcctagcttgagaactacaacagcgtcgggaaaattaattacggaatggtgctgtagatcgtgcactttaccacccttacgctatcgaggcgaagatgggtgttggtatggaatggaaataagaccactaaaagagaaagaagaaaatctcgtaaacagcctggtaaccgcagggcacggacaaattgacaacttcagtttgggtgttttaggaatggcattatttcttgaagaaatgcttcgtaccagaataggaactaaacatgcaatcttactcgtggccgtatctttcgtcacattaataactggtaatatgtctttccgagatcttggacgggtcatggtaatggtaggggcaacgatgaccgatgacattggtatgggggtaacttatctggcactactagcagctttcaaagttcgaccgacatttgccgtaggcctactgcttagaaaattgacgtccaaagaattgatgatggcaactattggtattgcgctcttatcacaaagtacaattcctgaaactatactagaattgactgacgcgctagctctcggaatgatggtactaaaaatagttcgtaatatggaaaaatatcaactagctgtgacaataatggcgatatcatgcgtacctaatgcagtgatactgcagaatgcttggaaagtatcttgcactatactcgccgtcgtgtcagtcagccccttgttactgacctcgtcgcaacagaaagcagattggatcccattagcattgacgatcaaaggtctgaatccaacagccatatttctcactacattaagtcgtacttctaaaaagagaagctggccattaaatgaagctatcatggctgttggaatggtatcaatcctggcatcttctctcctaaagaacgatatacctatgactggccctttagtggccggaggcttattaacggtttgttatgtcctaactggacgaagcgcggacctagaattggaacgagcggctgatgttaaatgggaggaccaagcggagatatccggttcatcgccgattttatcaataaccatctcagaagatggatcaatgtcgattaagaatgaagaggaagaacaaactttgaccatccttatacgaacgggactgttagtcatctccggagtttttcctgtcagtatacctatcactgccgcagcctggtacctatgggaggttaaaaagcaaagagccggtgtattatgggatgtaccgagtcccccgccagtcgaaaaggcggaactcgaggatggggcatatagaataaagcagcgaggtatattaggatatagccaaataggcgccggagtatataaggaaggaacatttcatacgatgtggcatgtaacacgcggagctgtactgatgcatagaggaaaaagaattgaaccctcctgggcagacgttaagaaagatttgattagttacggtgggggatggaagttagaaggagaatggaaagaaggtgaagaagtacaagtattagctcttgagccagggaaaaacccacgtgcggtacaaacgaaaccaggtatattcaaaacaaatactgggacaataggggctgtaagcctagactttagtccaggcacaagcggttctcctatagtggatagaaaaggtaaagttgtaggcttatacggaaacggtgtggttacaagatcaggtgcctacgtatccgcaatcgcacaaacagagaaaagtatagaggataatcctgaaatagaagatgatatattccgaaagaaaaggttaacaatcatggatttgcatcccggagccgggaaaacaaagagataccttccagcgattgtccgggaagcgattaaacgaggtctccgtacgttgatacttgctcctacgagagtagttgctgcagaaatggaagaagcactaagaggtttaccaatccgatatcaaactccagccataaaaacagagcatacaggcagagaaatagtcgaccttatgtgccatgctacatttacaatgagactcttgtctccagttagagtaccaaattataatttaataataatggacgaagcacacttcacagacccggcgagcatagcggcaaggggttatatttcgacaagggtggaaatgggcgaagccgccggtatatttatgacagcgactcccccaggctcccgagatcctttcccacaaagtaatgcgccaattatggatgaagaacgagaaatccctgaaagaagttggaacagcggacatgaatgggtaacagactttaaagggaagacagtctggtttgtcccatcaatcaaagccggaaacgatatagctgcgtgcctaaggaaaaatggtaagaaagtaatacagttatccagaaaaactttcgacagtgaatatgtaaaaacgagagcgaacgactgggattttgttgtcacaacggacataagcgaaatgggtgctaatttcaaagccgaaagagtaattgacccaaggagatgtatgaagccagtcatactcacagacggtgaagaaagagtaatccttgcggggcctatgcccgtaacgcattcaagcgctgcccaacgaagaggacgaattggcagaaatcctaagaatgaaaatgaccaatatatatacatgggagaaccgttggaaaatgatgagaattgtgcacattggaaagaagcgaaaatgttattagacaacattaacactcccgaaggtatcataccctctatgttcgaacccgaaagggagaaggtagatgccatagatggagagtacagattaagaggcgaggcccgaaagacgtttgtcgacttaatgagacgaggagacctacctgtatggctagcgtataaggtcgcagccgaaggaattaattatgccgaccgaaaatggtgttttgatggaataaagaataaccaaatcttagaagaaaatatggaagtagaaatatggactaaagaaggagagagaaagaaacttaaaccaaggtggctggatgcaaggatctatagcgatccactagcattgaaagaatttaaagaatttgcagctggtagaaagtcattaacactgaacctaataacagaaatgggcagattgccaacatttatgacccagaaagctagaaacgctcttgacaacttagcagtattgcacactgcggaagcgggaggcagagcatataatcacgctctcagcgagctacctgaaacattggaaacactactgctacttacactcctcgcaaccgttacaggaggtatattcctcttcttgatgtcaggcaagggaattggtaagatgactctgggaatgtgctgcataataacagctagcatcctactctggtacgcacagatacagccacactggatagctgcaagcatcatactcgagtttttcctaatcgttcttttaataccagaaccagaaaaacagagaacacctcaggacaaccaattgacgtatgtcgtaatagcaattttaaccgtagtagctgcaacaatggccaacgagatgggatttcttgaaaagacaaagaaagatctaggattaggtagcataactacgcaagagtcggaatcaaatatattggatattgatttaaggccggcatctgcatggacactttatgcggtcgcgacaacattcgttacaccgatgcttagacatagcattgaaaattcctctgtaaacgtcagtttaacggcaatagcaaaccaagcaacagttttaatgggtttaggaaaaggctggcccttgtctaaaatggacatcggagtgcctttgttagctattggatgttatagtcaagtaaatccgatcacattaactgcagcgctattattgcttgtagctcactatgccatcatcgggcccggtctacaggctaaagcgacacgagaggcgcagaaaagggcagcggcggggatcatgaagaacccgactgtagatggtataacagtaatagatcttgagcccataccatacgatccaaaatttgaaaaacaactaggacaagttatgttactaatactctgtgtgacacaggtactaatgatgagaaccacttgggcgctatgcgaagccttaactctagcaacaggaccaatatccacgttatgggaagggaacccaggccgtttttggaatacaacaattgcagtaagcatggcaaacatttttagaggtagttacctggcaggagctgggctcttattctctatcatgaaaaatactaccaatactaggcggggaaccggtaacatcggggaaacgttaggagaaaaatggaagtcaaggttaaacgcactagggaaatccgaatttcaaatatacaagaaaagtggcattcaagaagtcgacaggacattagctaaagagggcatcaaacgtggagagacggaccaccacgctgtctcacgtggatcagccaagttgcgctggtttgtagaaagaaatatggtgacccctgagggtaaagtggtagacctaggatgtggccggggtggatggagttattactgcggcgggctcaaaaatgtcagagaagtgaaagggttaacaaaaggcggacccggacatgaagaacctatcccaatgagcacatacggatggaatttagtccgacttcagagcggggtggatgtcttctttacgccgcctgaaaaatgtgacactttactgtgtgatattggtgaaagctcacccaatccaaccattgaagcaggaagaacattaagggtactaaatcttgttgaaaattggcttaacaacaacacccaattctgcattaaagttttaaatccttatatgccgtctgtgatagagaaaatggaggcgttacaacgaaaatatggaggtgccctcgtaaggaatcccctctctcgaaactctacccatgagatgtattgggtctctaatgcttcggggaatatcgtatcaagcgtaaatatgatatctagaatgttaataaacagattcaccatgaaacacaagaaagccacgtatgagcctgatgtagacttagggagtggcaccagaaatataggaatcgagagtgaaatcccaaacctcgacatcataggaaaacgaattgagaagatcaaacaagaacacgaaaccagctggcattacgatcaggatcacccctataaaacctgggcgtatcatggctcatacgagacaaaacagacgggtagcgcctcatcgatggtaaatggagtagtccgtctgttaactaaaccatgggatgtagtaccgatggttactcaaatggcgatgacagatacgacaccatttggacagcagagagtatttaaagaaaaggttgacactcgtacacaagagccaaaagaaggcacgaagaaacttatgaaaattactgcagagtggttgtggaaagaattgggcaagaaaaagaccccaagaatgtgtacgagggaggagttcacacgtaaggtacgctctaacgccgcactaggggctatatttacagacgagaacaagtggaagagtgcaagagaggcagtggaagactctcgattttgggagctagtagatcgagaaaggaatttgcatctcgaaggcaaatgcgagacgtgcgtctataatatgatgggtaagagagagaagaaattaggagagttcgggaaggccaagggatcccgcgcaatatggtacatgtggctaggagcacgctttctcgagttcgaagccctcggattcttaaatgaagaccattggttttcccggggcaatagcctttctggagtagaaggtgaagggctccacagactggggtacattctaagggatgttggtaagaaggaagggggagctatgtacgccgatgatacagcaggttgggacacaaggattacattagaagatttgaaaaatgaagaaatggtaacaaatcacatgaagggagaacataaaaagctggcagaagcgatatttaaactcacatatcagaataaagtagtaagagtgcaaagaccaacacctaggggtacagtaatggatattatctcacgtagggatcaaagagggagcggtcaagttgggacgtatgggctcaacacgtttacaaatatggaagcgcaactaattcgtcaaatggaaggagaaggaatttttaagtcaatccagcaccttacagcaacggaggaaatagcggttcaaaactggttggcaagagttggacgcgaaagactatctagaatggctatttccggtgatgactgcgtagttaaacctatagacgacagattcgcttcggcgctaactgcattgaacgacatgggtaaagtaagaaaggatattcagcaatgggaaccgagtaggggatggaatgactggacgcaagttcccttctgctcacatcatttccacgagctagtaatgaaggacggtagagtattagttgtaccatgtaggaatcaggatgagctcataggacgtgcacgtatcagtcagggtgctggttggtcattgaaagagactgcctgtctaggtaaatcgtacgctcaaatgtggacattaatgtatttccataggcgcgatctaagattagccgctaatgcaatttgtagcgccgttcctccccactgggtgccaacctctcgaacaacttggtcaatacatgcaaaacatgaatggatgacaacagaggacatgctagctgtatggaatagggtttggatacaagagaacccgtggatggaagataaaacgccagttgagtcatgggaggaagttccatatttagggaaaagagaggatcaatggtgtggaagtctaattggtttaacctcacgagcaacatgggccaagaatattcaaactgcaatcaatcaagtgagatcgttaatagggaatgaagaatacacagactacatgccatcaatgaaaagatttagaagggaggaagaagaagccggtgtgttatggtag

SEQ ID NO: 22414 - RNA, 9876 nt, synthetic construct
  misc_feature 1..9876: note = derived and/or modified CDS sequence (opt6) from DENV-2__GQ868646__SS-prME
  source 1..9876: mol_type = other RNA
acagcgggtgttattgtaatgttgataccaacagcaatggcctttcacttaacaacgcgaaatggtgaaccacacatgattgtaggaagacaagaaaaaggaaaatccttactatttaaaacggaagacggtgtaaatatgtgtaccctaatggcaatagacttaggagaactatgcgaagatacgattacatataaatgtccattacttagacaaaatgaaccagaagatatcgattgttggtgcaactcaacttctacatgggtaacgtatggaacatgcacgacaacaggagaacatcggagagaaaaacgtagcgtagccttagtaccgcatgtcggaatgggactggaaacaagaaccgagacatggatgagcagcgaaggagcatggaaacatgtgcaacggatagaaacctggattctgcgtcacccaggattcactattatggcagcaatactagcatacactatcggaacaactcactttcaacgagcattaatatttatccttctaaccgctgttgcgccatcgatgacaatgaggtgcattggtattagtaatagggacttcgtagagggagtttcagggggttcatgggtggatatagttttagagcacggaagttgtgttacaacaatggcgaaaaataaaccgaccttagattttgaactaataaaaaccgaagcaaaacagccagctacattgcgcaaatattgtatagaagctaaactaacaaatactactaccgaatcaagatgtccgactcagggtgaacccagcctaaatgaagaacaagacaaacggttcatttgcaaacacagtatggtagatagaggatggggaaatggttgtggcttattcggaaaagggggaatagtaacatgtgctaaattcacatgtaagaaaaacatggaaggaaaagttgttcagccagaaaatttagaatataccatcgttattactccccattcaggtgaggaacatgcggtcggaaacgatacgggaaaacatggcaaagaaatcaaaataactccgcagtcttcaattacggaagcagaattaacaggctacgggacagtaacaatggagtgcagtcccagaacaggactagatttcaatgaaatggtactattgcagatggaagacaaagcatggctagtccatcgacagtggttcttagatctacctttaccctggctaccaggtgccgacacccaaggatctaactggattcaaaaagaaactttagtcacgtttaaaaatccacatgccaagaaacaagacgtagtagtgctaggaagtcaagaaggagcaatgcacactgcgctaactggggcgaccgagattcagatgtcctccggaaatttattatttaccggtcaccttaagtgccgattaagaatggacaagctgcaacttaagggtatgtcatatagcatgtgcacaggaaaattcaaaattgttaaagaaatagcagaaacgcaacatggaactatcgtcataagagtacaatatgagggcgacggaagcccatgcaagataccgttcgaaataacagatctagaaaagaggcatgtactgggacgcctaatcactgtaaacccaatcgtcaccgaaaaagattcacccgtaaacatagaggcagaaccacctttcggagactcatacattatcattggggtggagcccggtcagctgaaacttaactggttcaagaaagggagctccatcggtcaaatgttcgaaacaacaatgagaggcgctaagagaatggcaattctgggggatactgcatgggactttggctcattaggtggtgtctttaccagtatcggtaaagctctacatcaggtatttggtgcgatttacggagccgcattttcaggcgtatcgtggactatgaaaatactaattggagtaattattacatggataggtatgaactcaaggagtacttcattgtcagtcagcttagtgctggtaggtgtagtaaccctatatttgggagccatggttcaagctgattcaggatgcgttgtgtcatggaaaaacaaagaactgaaatgtggctccgggatattcattaccgataacgttcatacgtggactgaacaatataaatttcaaccagaatccccgtcaaagctggcatcagctatacagaaagcccatgaagaaggcatttgtggaatccgatcagttacaagactagagaatttgatgtggaagcaaattacgccagaactgaatcacattctgtcagaaaatgaagtgaaattaaccataatgactggagatatccggggaataatgcaagcggggaagcgaagcctacgaccccaacccaccgaattaaaatattcatggaaaacatggggaaaggctaaaatgttatcaacggaaagccacaaccaaactttcttaatcgacggcccagagacagcagaatgcccaaatacgaatagagcttggaactcacttgaagtagaagattatggttttggtgtatttaccactaatatttggctaaaattacgagacaagcaagatgtcttctgtgactcaaaattaatgtcagccgccattaaggacaatcgtgcagttcatgctgacatgggctattggatagaaagtgcgctgaacgatacatggaaaatggagaaagcgtcgttcattgaagtgaaatcttgccactggccgaagtctcacacattgtggtcaaacggtgtacttgagtccgaaatgatcatacccaaaaatttcgcaggacccgtatctcaacataattataggccgggctatcacacacagacagctggaccatggcaccttggtaagttagaaatggacttcgacctatgcgagggtaccacagtggtagtaacagaggattgtggaaatagaggaccgtcactacgtaccacaacagcgagtggaaaactaatcacagaatggtgttgtagatcatgtacattgcctccgctcagataccgtggagaagatggctgttggtacgggatggagattcgacctctaaaagagaaggaagaaaatttagtgaactctctagtcacagccggacatggacagattgataactttagcttaggcgtactggggatggcccttctcttagaagaaatgttaagaaccagaatcggaactaaacatgctattctcctagtagctgttagctttgtcacactaataactggaaacatgagttttagagacttaggccgagtaatggtcatggttggtgctacgatgacagatgacataggaatgggagtcacttacttagcacttttagcagcattcaaagtccggcctactttcgcggccggtctcctattaagaaaattaacatctaaagagctaatgatggcaacgattggtattgcattactatcccagagcacaattccggagaccattctcgaactaacagatgctttagcgcttggtatgatggtactgaaaattgtcagaaatatggagaaataccagctagcagtaactgtaatggcgatatcatgtgtccctaatgctgtcatcttacagaatgcgtggaaagtatcttgcacgatcctggctgcagtaagtgtaagccctctactattgacttctagtcaacagaaagcagactggataccattggcacttactattaaaggattaaatcctacagcaatctttttgactactcttagtagaactagcaagaaacgttcatggcctttaaacgaggctattatggccgttggaatggtgagtatcctagcaagttccctgttaaagaatgacataccaatgacaggccctctagtagcgggtggattattaacagtctgttatgtattaacaggtcgttccgcagacctcgagttagaacgcgctgctgatgtaaaatgggaagatcaagcggaaataagtggaagttcaccgatactgtccatcacaataagcgaagacgggtcaatgtcaataaagaatgaagaagaggaacagacactgacgatattaatccgaacaggacttttagtaatctcgggggttttccctgtgagtattccaatcacggcagcagcgtggtatttatgggaagtcaagaaacaaagggccggtgtcctatgggacgtaccctctccacccccagtggaaaaagcggaattggaagacggagcatacagaataaaacagaggggaatattgggatactcacagatcggcgctggagtatacaaagaggggacgtttcacaccatgtggcatgtaacaagaggagcagtcctaatgcatcggggcaagagaatcgaaccgtcatgggcggatgtgaaaaaggatctaataagttatggcgggggatggaaattagagggcgaatggaaagaaggtgaagaagtgcaggtactagcattagaaccaggaaagaatccacgagctgtgcaaactaaaccgggcatattcaagacgaacaccggaacaataggtgcggtaagtcttgatttttcgccaggtacatcaggttccccaatcgtagatcggaaaggaaaagttgtcgggctttacgggaacggagtagtcactaggtccggagcttacgtgagcgcaatcgctcaaacggaaaagagtatagaggacaatcccgagattgaagatgatattttcaggaagaaacgattaacaatcatggacctacatccaggagctggtaaaactaaacgctacttgcctgcaattgtacgtgaggctataaaaagagggttacgaactctcatactagctccaaccagagtggttgctgccgaaatggaagaggcattaagagggctaccaattcgctatcaaacaacagcgataaaaacagagcacacaggacgtgaaatagtagatctaatgtgccatgctactttcacaatgagacttctgagcccggttagagtacctaattataatttaataattatggatgaagcgcattttacagatccagccagcatcgcagcacggggttatatatccaccagagtcgaaatgggagaagctgcaggtatttttatgacggcgactccacccggaagccgtgatccctttcctcaatcgaacgcgccaataatggacgaagaaagagaaatacctgaacggtcctggaactctggccatgaatgggtaacagatttcaaaggtaaaacggtatggttcgtaccatcgataaaagctgggaatgacatagcagcatgtcttaggaaaaatggcaagaaagtaatacaattgagcaggaagacatttgacagcgaatatgtaaaaacacgtgcaaatgattgggattttgtagtaactactgacataagtgaaatgggggcaaattttaaagcggaaagagtcatagaccctagacgatgtatgaaaccagtaatactaactgatggagaagagagggtaatacttgcaggtccaatgcctgttacccattctagtgcagctcagaggcgtggacgcattgggcgaaaccccaaaaatgaaaatgaccaatacatatatatgggggaaccgctggaaaatgacgaagactgcgcccattggaaagaagcaaagatgttactagataacatcaataccccagaaggaataattccttccatgtttgaaccagagagagagaaagttgacgcaatcgatggggagtatagactgagaggggaagcccgaaaaacatttgtggatcttatgcgacggggagatctacctgtctggttggcttataaggttgcagcagaggggattaattatgcagatagaaaatggtgtttcgacggaattaaaaataaccaaatattggaagaaaacatggaggtcgaaatatggaccaaagaaggagaaaggaagaaacttaaacctaggtggttagatgctagaatatactcagacccactagcacttaaagagttcaaagaatttgctgcaggacgtaaatcgttaactttgaatctaattacagagatggggaggttacctacattcatgacgcaaaaagctcggaatgctctagataatttggctgtccttcataccgcagaagcagggggccgtgcctacaaccacgcgctctcagaactacctgaaacactggaaacgcttcttcttttaacattactagctacggtaacaggaggtatatttttgtttttaatgagtgggaagggcattggaaaaatgactttaggaatgtgctgcattattactgcatctatattattgtggtatgcccaaatacaaccccattggatcgcagcgtcaataatcctcgagttctttttaatagtcttgctgataccagaaccagaaaaacagagaactcctcaagacaatcaactaacatatgttgtaatcgcgatactgactgtggtagccgccaccatggctaatgaaatgggatttttagagaaaaccaagaaagacttaggcctgggaagcataacaactcaagaaagcgaaagtaacatattagacattgatcttaggccagcctcagcatggacattgtacgctgtcgccacaaccttcgtaaccccaatgctacgacactcaatcgaaaattcatcagtcaatgtatcattaacagctatagcaaaccaagcaacagtactaatgggtttgggaaaaggttggccattgagtaaaatggacatcggagtccccttattagcaatagggtgttattcacaagtcaacccaattacgctaaccgcagcgctattgctcctagttgcccactacgcaattatagggccaggactacaagctaaggcaacaagagaagcacagaagagagcagcggctggaataatgaaaaacccgacagtagatggaataaccgtgatagatcttgagcccataccctatgaccctaaatttgaaaaacaacttggtcaagtgatgttattaatattatgtgtaacgcaggtactaatgatgcggacaacatgggcgttatgtgaagccctaacattagctacaggcccaatatcaacactctgggaagggaacccaggaagattttggaacactacaatagctgtatccatggcgaatatctttcgcggaagttaccttgccggtgcaggattactatttagtataatgaaaaacactacaaatactagacgcggtacaggaaatatcggagagaccctcggagaaaagtggaaaagccgattaaacgctctaggtaagtcggagttccagatatataaaaagtctggcattcaagaagttgatcgtacactggcaaaagaaggaataaaaagaggggaaactgaccatcatgctgtttctaggggctctgctaaattaagatggtttgtagaaagaaatatggttacaccggaaggtaaggttgtagatctaggttgtggacgtggtggatggagctattactgtgggggcctcaaaaatgttcgtgaggtaaaagggttaactaaagggggacctggtcatgaggagccaattcccatgagcacatatgggtggaatcttgtccgactgcaatcgggagtagatgtatttttcaccccgccggagaaatgcgatacattattgtgtgatataggtgaaagttccccaaatccaacaattgaagcagggcgaaccctccgagtcctaaatcttgtagagaactggctaaataacaatacacaattttgtataaaggtgcttaacccatatatgccaagcgttatagagaaaatggaggctttgcaaagaaaatatggaggagcattagtgaggaatccgttaagtagaaacagtacacatgaaatgtattgggtgagcaacgccacagggaatatcgtttcatctgttaacatgattagtagaatgttaattaatcggtttacgatgaagcataagaaagcgacttacgagcctgacgtagacttgggttcgggaacaaggaatattggaatagaatcagaaatccctaatctggacataattggaaagagaatcgagaaaataaaacaagagcatgagacttcatggcactatgaccaagaccatccctacaaaacatgggcgtatcacggctcctatgagactaaacaaacaggaagtgcttcttcaatggtaaacggagtcgttcgtctcttaacgaagccgtgggatgtagtcccaatggtaacacagatggcgatgacggacaccacaccgttcggacaacaaagagtatttaaagagaaagtagatacaagaacacaagaacccaaggagggaacgaaaaagttaatgaaaatcacagcggaatggttatggaaggaactaggtaaagagaaaacaccaagaatgtgtacgagagaagagttcacaagaaaggtgaggagtaatgccgcgttaggggccatcttcacggatgagaacaaatggaaaagcgcacgtgaggcagtcgaggatggaaggttctgggaattggtagatagagaacgaaacttacaccttgaaggaaaatgcgaaacttgtgtttataatatgatgggaaagagagagaagaaattgggtgagtttggaaaagcaaagggctcacgagccatatggtatatgtggctaggtgcaagatttctggagttcgaggcattgggatttctaaatgaagatcattggtttagcaggggcaattcactatctggagtcgaaggcgaaggcttgcatagattgggatacattttacgcgatgtagggaaaaaggaagggggtgctatgtacgcagacgacaccgctggctgggacacacgaataactctagaagacctgaagaatgaagagatggtaacgaaccatatgaaaggtgaacataagaaacttgcggaggcaatctttaagttgacgtatcagaacaaagtggttagagtacaaagaccaactccccgaggaacagtcatggatataatatcgcggcgagatcagcgcgggagtggtcaagtcggaacatatggcttgaacacattcactaacatggaagcacagttaatccgccaaatggagggtgaaggaattttcaagtcaattcaacacctgacggcgacagaggaaatcgccgtacaaaattggttagctcgagtcggacgagaaagattgagtcgcatggcaatcagtggggacgattgcgtcgttaaacccatagatgacagatttgcctcagcattgactgcccttaacgacatgggtaaagtgaggaaggatattcaacagtgggaaccgagtagaggctggaatgactggactcaagtaccattctgttcacaccacttccatgaattggtaatgaaggatgggagggtattggtggttccatgtcgtaatcaagacgaactgataggacgagctagaataagccaaggagccggatggtcacttaaagaaactgcttgtcttggcaaaagctacgctcagatgtggacattaatgtattttcatagaagagacttacgactagcagcgaatgcgatatgctcagctgttccttcacattgggtaccaacgtcacgaacgacctggagtatccatgcgaaacacgaatggatgacaacagaagacatgttagcagtttggaatcgtgtttggattcaagaaaacccttggatggaagataagactcctgttgaatcgtgggaggaagttccttatttaggtaaaagagaagatcaatggtgcggcagcctcattggtttaacatcgagagcaacgtgggccaagaacatacaaactgcaatcaatcaagtacgcagcttaataggaaatgaagaatacacagattatatgcctagtatgaaacgtttcaggagagaagaagaggaagctggagttctatggtga

SEQ ID NO: 22415 - RNA, 9876 nt, synthetic construct
  misc_feature 1..9876: note = derived and/or modified CDS sequence (opt6) from DENV-2__FJ906961__SS-prME
  source 1..9876: mol_type = other RNA
accgcgggcgttatagttatgctaatccccaccgctatggcatttcacctgacaacaagaaatggggaaccccacatgatagttggaagacaagaaaaaggaaagagcttattgtttaaaacagaagacggggttaatatgtgcacccttatggcgatcgatcttggagaactgtgtgaagatacgataacatataaatgtcctttactgagacaaaatgaacctgaagacattgactgctggtgcaacagcacatcaacgtgggtaacctatggtacttgtactacgacaggtgagcaccgcagagaaaagagaagcgtcgcgctagtaccacacgtcggaatgggcctagaaacaaggaccgaaacatggatgtcatccgaaggtgcatggaaacacgtacagcggatcgaaacgtggattttgagacaccctggattcacaataatggcagcgatactagcttatacgattggaacaacacattttcaacgtgcattgatatttatcctgcttacagcggtcgcgccctcaatgacaatgagatgtatcggaatatcgaaccgagattttgtagaaggcgtatcaggtggctcttgggtagatatagtactagaacatggcagttgcgttacaacaatggccaaaaataaacctacacttgatttcgaattaataaaaacagaagcaaaacaacctgcaactttacgtaaatattgtatcgaagctaaactaaccaacacaactacagagtcaagatgccctacacaaggggaaccatctttgaatgaggaacaggacaaaagattcatatgtaaacactcgatggtggaccggggatggggcaacggttgtggattatttgggaaaggaggaatcgtaacatgtgcaatgttcacttgtaagaaaaatatggaaggaaaagtcgttcaaccagagaaccttgaatacacaatcgttataacgccacactcaggtgaagaacacgcagtgggaaacgatacaggaaaacatggaaaagagataaaaataaccccacaaagcagcattaccgaagctgaattgactggttatgggactgtaaccatggaatgtagtccaagaaccggtctagattttaacgaaatggtgttactgcaaatggaagataaagcatggctagttcatcgacaatggtttttagacttgccgttaccgtggcttccaggcgccgatactcaaggatccaattggatacaaaaagaaacattagtaacatttaaaaatccgcatgcgaagaaacaagacgtggtagtcctcggcagtcaagaaggtgctatgcatactgcgttaacaggagcaactgaaatacaaatgagtagtggcaacttacttttcacagggcatctaaaatgtaggttaagaatggataaactccaactgaaagggatgtcctacagtatgtgtacaggcaagtttaagatagtcaaagaaatagcagaaactcagcacggaacgatagttattcgggttcagtacgagggagatggctcaccgtgtaaaataccattcgaaattactgatttagaaaaacgacatgttttgggtcgactaataaccgtcaatcctattgtgacagagaaagatagtccagtcaatattgaagcagagccacctttcggagattcgtatattatcattggtgttgaaccaggtcaattaaagttgaattggtttaagaaaggctcctccatcggacaaatgtttgagacaacaatgcggggtgctaaaagaatggcgatattaggtgatacagcatgggacttcggatcactaggaggtgtttttacctctattggcaaagcacttcatcaggtatttggagcaatatatggagcagcgtttagtggagtaagttggacgatgaaaatactaatcggcgtaataattacatggatagggatgaacagtagatctacgagcttaagcgttagtttagttttagtcggagtagtcaccctttacctgggtgcaatggtacaggcggattcaggatgtgttgtgagctggaaaaacaaggaacttaaatgtggatcaggcatttttattacggacaacgttcatacttggacagaacaatacaagtttcagccagaatcaccaagtaagttagcaagtgcaatccagaaagctcatgaagaaggaatttgtgggattagatctgttactagacttgaaaatctaatgtggaaacagataacacctgagctaaaccatatcctaagtgagaacgaagtaaaactgactataatgactggtgatattcgaggaattatgcaggcaggcaaacgatcattaagaccacaaccaaccgaacttaagtatagctggaaaacatggggaaaagccaaaatgttaagtacagaacctcataaccaaacatttttgatagatggtcccgagactgctgagtgcccaaacacaaatagggcatggaactctctggaagttgaagattatggattcggcgtcttcactacaaatatttggttaaaactgcgagaaaaacaagaagtattttgtgattcaaaattaatgagtgcagctattaaagacaatagagctgtacatgcggatatgggatactggatagaaagtgccctcaacgacacgtggaagatggagaaagctagctttattgaggtaaagagctgtcattggcccaagtcccacaccttatggagtaacggagtcttagaatctgaaatgatcattcctaaaaactttgcgggtccagtatcacaacacaactatcgacctggataccatacccagactgctggaccttggcacttaggaaagctcgagatggacttcgacttatgtgaagggacaactgttgtagtgaccgaagattgtggaaacagaggtccctcattaagaactactacagcaagcgggaagttaattaccgaatggtgttgtcgtagctgcacgttgcccccgttaagatatagaggtgaagacgggtgttggtacggcatggagatcagaccgctaaaggaaaaagaagaaaatttagtaaattctctagtaacggcaggtcacggacaaatcgataacttcagtctaggagttttagggatggcactttttctggaagaaatgctaagaacacggataggtacaaaacacgccatccttttagtagctgtgtcattcgtaacccttatcacaggaaatatgagtttcagagatctaggtagagtaatggtgatggtcggtgcaactatgacagacgatatcggaatgggtgttacatatttagcattactagctgctttcaaagttagaccgactttcgcggcgggactactacttagaaaattaacgtccaaagaattaatgatggcgacaataggaatagctttactaagccagtcgactatcccagaaacgatattagaattaacagatgcattggcacttgggatgatggtactaaagatagtgaggaatatggaaaaatatcaactcgctgttactataatggcgatctcctgtgtacctaacgcagtcatacttcagaatgcatggaaagtaagttgtactatacttgcagctgtatctgtatctcctcttttattgacatccagtcagcaaaaggctgactggataccattagcactaactattaaaggactaaatcccacagcgatcttcttaactacgctaagtagaacttcgaaaaagagatcctggccactaaatgaagcgataatggcagttggaatggtgtccatattagccagctccctattaaagaacgatatccctatgactggaccattggtggctggagggctattgactgtctgctacgttctaactggacgatcggcggacctagagttggaaagggctgcagatgtaaagtgggaagatcaagcagagatttcaggatcatcgccgattctatcaataacaatttcagaagacggctcaatgtccatcaaaaatgaagaagaagaacaaactttaacaattctaatcaggacaggtttactcgtcatctctggagtatttccagtgagtatacctattacagccgccgcgtggtacctatgggaagtcaagaaacagagagcaggggttctttgggacgttcctagtccaccacccgttgaaaaagcagaattagaagacggagcgtatcgtataaaacaacgaggaatactgggatactctcaaataggtgcaggagtatataaagaaggaacttttcatactatgtggcatgttacacggggcgcggttctaatgcacagaggcaaacgcatcgagccaagttgggctgatgtcaagaaggatctgatatcctatggtggtggatggaaactcgaaggtgagtggaaggaaggagaagaagtccaagtgcttgcattagagcctggtaagaaccctcgagccgtacagacaaaaccaggaatatttaaaaccaacactggcacaatcggagctgtatcattggatttctcacccggaacttctggaagtccaatagttgacagaaaggggaaagtagtgggactctacggcaacggtgtcgtaacaaggtctggggcatatgtaagtgcaatagcacaaacagaaaagtcgatcgaggataatccggagatagaagacgatatattcagaaagaaacgattaacaattatggatctacatcccggagctgggaaaacgaaaagatatctaccagcaatagtacgcgaagccataaaaaggggacttagaacattaatactggcaccaacacgagtagtcgccgccgaaatggaagaagcactaagaggattaccgatcagatatcaaacaactgcaataaaaacagaacataccggaagagaaattgttgatctaatgtgccacgcgacctttactatgaggttgttatcgccggtccgcgtgcctaattacaatttaataatcatggacgaggctcattttactgatccagcgtccatagccgccagaggatatatatcgacacgagtagagatgggagaagcggctgggatatttatgactgcaactccgcccggatcaagagacccatttccacaaagtaacgcaccgataatggacgaggaacgggaaatcccagagcgtagctggaatagcggacatgaatgggttacagattttaagggaaaaacagtttggtttgtgccgtcaattaaagcaggtaatgacatcgctgcatgtcttaggaaaaacggtaagaaagtgatacaactgtctagaaagacattcgattcggaatatgtcaaaaccagagcaaacgattgggactttgtagtaacaacagacatatcggaaatgggagcaaacttcaaagcggaaagggtgatagatccacgacgatgtatgaaacccgtgattcttacggacggggaagaaagggtaattttagcagggccaatgcctgtcacccattcaagtgcagcccaaagacgtggtaggattggtcgcaatccgaaaaacgaaaacgatcagtatatatatatgggagagcccttggaaaacgacgaagactgcgcgcattggaaagaagctaaaatgctgcttgataacatcaatactcctgaaggtataataccgtcgatgttcgaaccagaacgggaaaaagtcgatgctatagacggtgaatacagactgaggggcgaggcacgcaaaacgtttgttgacctcatgcgaagaggcgacttgcccgtatggctagcatataaagtagctgctgaagggattaattatgctgataggaaatggtgtttcgacgggatcaaaaacaatcaaattctcgaggaaaacatggaagtagaaatatggacaaaagagggtgagagaaagaaattaaaaccgcgctggctagatgctagaatatactccgacccactagccctcaaagaatttaaagagttcgcagcaggaagaaaatcgttaacattaaatctaataaccgaaatgggcagattacctacgtttatgacacaaaaagccagaaacgccttagataaccttgcagtgttacatactgcggaggctggtgggcgagcgtataaccatgcattatccgaattgccagaaactcttgaaacactactactattgactctcctcgctactgtgacaggaggaatttttctcttcttgatgagtgggaaaggaataggaaagatgacattgggaatgtgttgtatcataacagcatctatactgttgtggtacgcacagatccaaccccactggatagcggcgtctataatattagagttctttctaatagtattgctgataccggagccggaaaaacaaagaacacctcaagataatcagttaacatatgtagttatcgcaatcctaactgtggtagcagccacgatggcgaacgaaatgggatttttagagaaaacgaagaaagatctggggctaggatcaattaccacacaagaaagcgaatcaaacattcttgatatcgatctacgtccagcgagcgcgtggacactatacgcggtagcgactacatttgtaaccccaatgcttcgacatagtatagaaaattcgtcggtgaatgtctcgttaacagctattgcaaaccaagcaacagtcttaatgggattaggaaaaggatggcccctatccaaaatggatattggggtgcctttgctagccataggatgctattcccaagtcaatccaattacactgacagccgcactattgctattagttgcgcattacgcaataataggaccagggttacaagcgaaagcaacaagggaggcgcaaaagagagcagctgcaggtataatgaaaaatccaacagtagacggaataacggttatagacctagaacctattccatacgatccaaaatttgaaaaacaactcggacaagtaatgttgttgatattgtgtgtaacccaagtacttatgatgagaactacttgggctttatgcgaggctctcactcttgcgacaggacccatatctacgttatgggagggaaatcctggcaggttttggaatactacaatcgcagtttcaatggcaaacatcttcagaggctcatacttagccggtgctggtttgttattcagtataatgaaaaacacaactaatactcgtcgaggcactggcaatataggtgaaactctaggtgaaaaatggaagagtcggttaaacgctttaggaaagtcagagtttcaaatatacaagaaatcggggatacaggaggtagacagaacgctcgctaaagaggggattaagagaggtgaaacagaccatcatgcggttagtagaggatctgcaaagctaagatggtttgtcgaacgcaatatggtaacacccgaaggcaaagtggttgacctaggatgtggccgtggaggatggagttattattgcggaggactcaaaaatgtacgtgaagttaaggggttaacaaaagggggacccgggcatgaggagccgattccaatgagtacatatgggtggaatctagtacgtctccagtctggggtagatgtgttctttacaccacccgaaaagtgtgacacattattatgcgatataggagagtcaagtccaaacccgacgatcgaagctggtcgcaccctaagagtcctcaacttagtcgagaattggttaaataacaacacccaattctgtataaaagtcctcaacccatatatgccatcagtcattgaaaagatggaagcactccaaagaaagtacggtggagccctagtgcggaatcccttatcgaggaacagtacccacgaaatgtattgggtttcaaatgcaactgggaatattgtatcctctgttaatatgattagtagaatgttaattaaccgcttcaccatgaaacacaagaaagcaacgtatgaaccagacgtggacctaggatccggcacccgcaatataggtattgaaagtgaaataccaaatttagatataattggaaaacgaatcgagaagattaaacaggaacacgaaacatcctggcactatgatcaagatcatccgtacaaaacatgggcgtaccatggttcatatgaaacaaaacagacaggaagcgccagctccatggtgaatggagttgttcggcttttgactaaaccttgggacgtagtaccgatggttacacagatggccatgacagacaccacaccatttggccaacaaagggttttcaaggaaaaagtcgacactcgaacacaagagcctaaagaaggaaccaagaaattaatgaaaattactgcagaatggctctggaaagagttgggcaagaagaaaactcctagaatgtgtaccagagaagaatttactaggaaagtacgtagcaatgccgcgctcggcgcaatatttactgacgaaaataaatggaaatctgcacgagaagcagtagaggacggccgcttttgggagttagtagatcgggagcgcaatttgcatttggaagggaagtgtgaaacatgtgtatataacatgatgggaaaacgagagaagaaactgggagagttcgggaaagcgaaaggatctcgggcaatttggtatatgtggcttggggctcgttttcttgagttcgaagccttaggattccttaacgaagatcactggttctctaggggtaactcattaagtggcgtagaaggggagggacttcaccgcctaggttatattttgagagacgtaggcaagaaagaaggaggggcaatgtatgccgacgatactgcaggatgggatacaaggatcacgttggaggatctgaaaaatgaggaaatggttacaaaccacatgaaaggagaacataaaaagttggcagaggcaatttttaaactgacgtaccaaaataaagtggtacgagttcaacgacctactccacgtgggacagtcatggatatcataagccgcagggaccaaagaggatcagggcaagtcggaacgtacggactcaacaccttcaccaacatggaagcacaattgatccgtcaaatggaaggagaaggcattttcaaatcaatacaacatttaacggcgactgaagaaatcgctgtacaaaattggcttgcacgtgtaggtagagagagattgtcgagaatggctatatcaggggatgattgtgtagtcaaaccaattgacgaccgattcgcaagtgccttgaccgctctcaatgatatgggtaaagtaagaaaggatatccaacagtgggaaccttcgaggggttggaacgactggacgcaagtgccattttgctcacatcatttccacgagctagttatgaaagacggtcgcgtgcttgtggtcccgtgtagaaaccaagatgaacttatcggcagagcaagaatatcacaaggtgccgggtggtcgctaaaagaaactgcttgtctagggaagtcatacgcacaaatgtggactctaatgtattttcatcgtagagatttaaggttagcagcaaacgccatatgtagtgctgtgccaagccattgggtgccaacttcacgaactacttggtccattcatgcaaaacacgaatggatgacaacagaagatatgctcgccgtatggaatcgagtgtggattcaagaaaacccctggatggaagacaaaactcctgtagaatcatgggaagaagtaccttatctaggaaaaagagaagaccaatggtgtggatcactcataggtctaaccagtagagccacctgggccaaaaacattcaaaccgctataaatcaggtacgtagcctaattggaaacgaagaatataccgattatatgccatccatgaaaagatttaggagagaagaagaagaagccggtgtgctatggtaa

SEQ ID NO: 22416 - RNA, 9876 nt, synthetic construct
  misc_feature 1..9876: note = derived and/or modified CDS sequence (opt6) from DENV-2__FJ906962__SS-prME
  source 1..9876: mol_type = other RNA
accgctggcgttattgtaatgctaatacctacggctatggctttccatctgactacacgaaatggtgaaccacacatgatcgtgggccgtcaagaaaaaggaaaatctctcttattcaaaacagaagacggtgttaatatgtgcaccctgatggcaattgatttgggagaactgtgtgaagatacaatcacatataaatgccctttgttacgccagaatgaaccagaagacatcgattgttggtgtaacagtactagcacatgggtaacatatggtacttgtacgacaacaggggaacatagacgggaaaaacgatctgtggcgttagtaccacatgtcgggatgggactcgaaactcgaacggaaacttggatgagttcagaaggtgcatggaaacacgtgcaaaggatagaaacatggattttaagacatccaggattcaccataatggcagctattttggcatataccataggaactactcatttccagcgtgcactaatcttcatcttattaactgctgtggcacctagcatgacgatgagatgtataggtatatccaatcgtgactttgtggaaggagttagtggagggtcttgggtcgacattgtactagaacatggctcatgtgtaactactatggccaaaaacaaaccgactctggattttgaactgatcaaaacagaagcaaaacaaccagcaactttgcgaaaatattgtatagaagctaaattaactaatactacgacggaaagcagatgtccaacgcaaggcgaaccttcattaaatgaggaacaggataaaagattcatttgtaaacactcaatggtggacagagggtggggtaatggatgcggattgttcgggaaagggggaatcgttacctgtgctatgtttacatgtaagaaaaatatggaaggtaaagtagttcaaccggagaacctagaatatacaatcgtgataacaccacatagtggagaagaacatgcggtcggcaatgatacaggaaaacatggtaaagaaataaaaattacaccacaaagttcaattacagaggcagagctcactggatacggaaccgtaactatggagtgtagtccaagaactggattagatttcaatgaaatggtgctcctacagatggaagataaagcatggcttgtgcataggcaatggtttctagatctgcccttaccatggttgccaggtgctgatacccagggttccaattggatccagaaagaaacacttgtaaccttcaaaaaccctcatgcgaagaaacaagacgtagtagtactcggatctcaagaaggcgctatgcataccgcgttaactggggctactgagattcaaatgagctcaggaaatttactttttaccggacatctaaaatgtcgactgcgaatggataaattacagttaaaagggatgagttacagcatgtgcacaggaaaattcaaaatagttaaagagattgcggaaacacaacatggcacgatcgttatcagagtacaatatgagggtgacggaagtccctgtaaaataccctttgaaataacggacctagagaaacgacatgttttgggacgtctaataacggtcaatccaatcgttacagaaaaagattctcctgttaatatcgaggccgagcctccatttggtgatagctatataatcatcggagtggaaccaggacaactaaaattaaattggtttaagaaaggctcgtcaattggtcaaatgttcgagacgaccatgcgcggagccaaacgtatggcaatattaggggatacggcttgggatttcggatcgttaggaggtgtttttacatccattggtaaagctctacaccaagtattcggagcaatctatggtgcagccttctctggagtcagttggacaatgaaaatactgattggcgtcattatcacatggataggcatgaactcacgctcaacaagtctgagcgtctccttggtgttagttggcgtagtaaccttgtatctaggagctatggttcaagctgattcaggctgtgtggtatcatggaaaaacaaggaactcaagtgcggatcaggaatttttataacggataatgttcacacatggaccgaacaatataagtttcagcccgagtctccaagtaaattagcaagcgcaatccaaaaagcacatgaagaaggtatatgcgggataagatcggtgacacgacttgaaaatcttatgtggaaacaaattacaccagaattaaatcatatactcagtgaaaacgagattaagttgacgataatgactggagacattaggggaatcatgcaagccggcaaaagatctttgagaccacagccaacggaattaaaatacagctggaaaacctggggtaaagctaagatgttgagtacagaaagtcataaccaaacgtttcttatcgacggacctgaaactgcagaatgcccgaatacaaacagggcttggaatagtctagaggtagaggattatggatttggggtctttacaactaacatttggttaaagttacgagagaaacaagatgtattttgtgactccaaattaatgtctgcagcaatcaaagataacagagctgttcatgctgacatgggatattggatagaatcagctttaaacgacacatggaaaatggaaaaagcgagtttcatcgaagtaaaatcgtgccattggcccaaatctcatacactctggagcaacggcgtactcgagagtgaaatgatcattcccaaaaactttgctggcccagttagccaacacaattataggccgggataccacacacaaacagccggaccttggcatttgggcaagttagaaatggactttgatttgtgtgaggggacaacagtggtagtaacagaggactgcggtaacagaggtcctagtcttagaacaacgaccgcttctgggaaacttataaccgaatggtgttgtaggagttgtacccttcccccgctacgatatcgtggagaagatggatgctggtatgggatggaaattcggcccttaaaggaaaaagaagaaaatttggtaaatagtctggtcacagcaggccacgggcaaatagataacttctcattaggcgtactagggatggctctttttctggaggaaatgctaagaacgcgtatagggacgaaacatgccatactattagttgcagtatcctttgtcactctgatcacagggaacatgagctttcgagatttgggcagggtaatggtaatggttggtgctacaatgaccgatgatataggtatgggtgtaacttatttggcactgctcgccgcatttaaggtgcgcccaactttcgcagctggcctattgctgagaaagctaaccagtaaagaactcatgatggcaactatagggatagctttgctatcacagagtaccataccggagaatatattggagctaacggatgcattagcattgggtatgatggttttaaaaatagtacgaaacatggaaaaataccaattggcagtaacaattatggcaatttcttgcgttccaaatgcagtaattttgcaaaatgcatggaaagtatcatgtacaattttagcagcagtaagcgtttctccactattgcttacttcgagtcaacagaaggcagactggatacctctagcgctaacgataaaaggtctgaatccaacggcaatattcctaacgactctttccagaacgagcaagaaacgctcctggccactaaacgaagccattatggctgttggtatggtaagcattttagcatcctctctactaaagaatgatataccaatgaccggaccgttagtagcaggagggttattgactgtatgctatgtactaactggaagatctgccgacctagaactcgaaagagccgcggatgtaaagtgggaagatcaagcagagatatcgggatcttcgcccatactatcaataacaatatcggaagacggttccatgagcattaaaaatgaagaagaagaacaaacgctaactatccttatacgaacaggcttattagttatcagtggggtatttccggttagcattcccattacggcagctgcttggtatttatgggaagtcaagaaacagcgggcaggagtattatgggatgttccatctccaccaccagtggaaaaagcggaattagaagatggagcctataggataaaacaaagaggaatattgggctattcacagattggagcgggagtgtataaagaaggtacatttcacacaatgtggcacgtaactcgcggtgccgttttaatgcatcggggtaagcgaattgaaccctcgtgggctgatgtcaagaaagatttaataagctatgggggcggctggaaattagaaggagaatggaaagaaggtgaggaagtgcaggtcttggctctagaaccaggtaaaaatcctagggccgtccagacaaaaccaggaatttttaaaaccaacacgggcaccataggcgcagtaagcctagattttagtccaggaacttcagggtctcctatcgttgatcggaaggggaaggtggtaggtctatatgggaatggcgtagtgaccagaagtggagcctatgtaagcgcgattgcacaaactgaaaaatccatagaagacaatccagaaatagaagacgatatttttaggaaaaagcgacttacaataatggacctgcaccccggtgctggaaaaacgaaacgatatcttcctgctatcgtaagggaagctataaaacgaggactaaggacactgatacttgcacctacaagagtcgttgcggcagagatggaagaggctttacgtggattaccaatacgttaccagactactgctataaaaactgaacacaccgggagagaaatagtagacttaatgtgtcacgctacattcacaatgagacttttgtctcccgtaagagtccctaactataatcttatcataatggatgaagcccattttacagatcctgcctccatcgcggcaagaggctacattagtacccgtgtagagatgggcgaggctgccggcatattcatgacagccacacccccaggatcgcgtgacccatttccacaatcgaacgctccaataatggatgaagaaagagagataccagaaagatcatggaactctgggcatgaatgggtaaccgatttcaaaggtaaaactgtttggttcgtaccctccatcaaagcagggaatgatattgctgcatgtttacgcaaaaatggcaagaaagtcatccaattatcgagaaagacgtttgacagcgaatatgttaaaacgagggcgaatgattgggatttcgtagtgacaacagatataagtgaaatgggagcaaatttcaaagcagaaagagttatagatccaagaagatgtatgaagccagtaatcctaacagatggcgaagaaagagtaatattagcgggaccaatgcctgtgactcattccagtgctgctcagcgcagaggtagaataggccggaatcccaaaaatgaaaatgaccaatacatttacatgggcgagccattagaaaatgacgaagactgtgctcactggaaggaagctaaaatgctccttgataatatcaacacaccagaaggcatcatcccatctatgtttgagccagagagagagaaggttgacgcaatagacggagaatatcgactacgtggagaggctcgtaaaacattcgttgatctgatgagaagaggcgacctgcctgtatggctggcctacaaggttgccgcggaagggataaattacgcagatagaaaatggtgcttcgatggtatcaaaaataaccaaatactagaagaaaatatggaagttgaaatttggaccaaagaaggcgaacgtaaaaagttgaagcccagatggttggacgcaaggatctactcagacccacttgcgttaaaagaatttaaagaatttgctgcaggtaggaaatcattaacactaaatctcatcactgaaatgggaagattaccaaccttcatgacccagaaagctagaaatgctcttgataacctagcagtcttacacacagctgaagcaggcggaagggcctacaatcacgctttatctgaactaccagaaacactggaaactctacttctgttaacattgctagcgacagtcaccgggggaatcttcttatttctaatgagtggaaagggaattggaaaaatgacactcggcatgtgttgtattataacggcaagtatattattgtggtatgcacaaatacagcctcactggatagcagcttcgattatactcgagttctttttaattgtactcctaattcccgagccagagaagcaaagaacaccacaggacaatcaactaacatatgttgttattgcaattttaaccgttgtggcagccaccatggctaatgaaatgggatttttagagaaaaccaagaaagacttagggctaggtagtataaccacccaggaatctgaaagcaatatactggatatcgacttaagacccgcaagtgcttggacactgtatgcagtggcaacaacattcgtaacaccaatgttaaggcacagtatagaaaactcgagcgtcaatgttagcttgacagcaatagcaaaccaagctaccgtactaatgggattaggaaaagggtggcctcttagcaagatggatatcggcgtcccgttgctcgcgattgggtgttatagtcaggtgaatccaataacacttacagccgccttacttctgctcgttgcacattatgcaattattggaccagggctccaggctaaagcaacgcgagaagcccagaaaagagcggcagcaggcataatgaaaaatccaacagtagacggaatcacagttatcgacttagaaccaataccctacgacccaaaatttgagaaacaattgggacaagtcatgcttttaatactttgcgtaacacaggtgcttatgatgcgtacaacatgggcactatgcgaagctcttactctcgccacaggccccataagtactttgtgggaaggaaatccggggcgtttctggaatacaacgatagccgttagtatggccaacattttccgaggatcgtacctcgcgggtgcaggattgttattttcgattatgaagaatacaacgaacacacgacgaggtacaggaaatataggtgaaacacttggtgaaaaatggaaatcacgactgaacgctctgggtaaatcagaatttcaaatttacaagaaatcaggaatacaagaagtagaccgaacactagcgaaagaggggataaagcgtggagaaacagaccatcatgcggtttctagagggtctgcgaagctaaggtggtttgtagaacgaaatatggtcacacctgaaggaaaggtagtagatctgggctgtggcagaggtggatggtcatactattgcggtggcttaaagaacgtgagagaagtcaaaggtctaaccaaaggaggtccgggccacgaggaaccgatacctatgagcacatacggctggaacctcgtacggctgcaatcaggcgtggatgtcttctttacaccgccggaaaaatgcgacaccctcttatgcgatataggggaatcttcacctaatccaacaattgaggccggacgaacgttgagagtccttaatttggtagaaaattggctgaacaataacacacaattttgtatcaaagtactcaatccatatatgccgtcagtaatagaaaagatggaggcactacaacggaaatatgggggcgcactcgtgaggaacccgctgagcagaaatagtacgcacgagatgtattgggtctcaaatgctactggaaacatcgtatcttcggtaaacatgatatcaaggatgctgataaaccgattcactatgaaacataagaaagcaacatacgaacctgatgtcgatttaggtagtgggacgcgcaacatcgggattgagtcagaaattccgaatctagacataataggaaaacggatcgagaaaattaaacaagagcacgaaacaagttggcattatgatcaagatcatccatataaaacatgggcatatcatggttcctatgaaaccaaacaaacgggatctgcaagtagtatggtaaatggagttgtgcgccttttgactaaaccctgggatgtcgtaccaatggtaacgcaaatggcaatgacagataccacaccattcggccaacaaagggtatttaaagaaaaggttgacacacgcacacaagaacctaaagaagggaccaaaaagttaatgaagattacggccgagtggctatggaaagagctaggtaagaagaaaacacccaggatgtgtactagagaggaatttacaagaaaagttcgaagcaatgctgctttaggagcaatctttacagacgaaaataaatggaaaagtgcaagagaagcagtagaagatggtagattttgggaacttgtagacagggaaagaaatttacacttagaagggaaatgtgaaacttgtgtttacaacatgatgggtaaaagagagaagaaactgggtgagtttgggaaggcgaaaggttcgcgtgccatttggtacatgtggcttggtgctagatttctggagttcgaggcactaggatttctaaatgaagatcattggtttagtcgaggaaatagtctctcaggggttgagggcgaagggttacaccgtctaggatatatattaagagatgtagggaagaaagaaggcggagccatgtacgccgacgacacagccggttgggacacacgtatcactctcgaagacttgaaaaatgaagaaatggtaaccaaccacatgaaaggagaacataagaaattagccgaggcaattttcaaattaacttaccagaacaaggtcgttagagtgcaaaggcccacaccacgaggtaccgtaatggacataatctctagaagggaccaaagaggttcaggacaggttggtacctatggcctaaataccttcaccaatatagaagcacaattgatcaggcaaatggagggcgaaggtatattcaaaagcatacagcacctaacagcaacagaagaaatcgcggtccaaaactggctagcacgcgttggacgcgaacgcttatctagaatggcaattagtggtgatgactgtgttgtgaaaccgatagacgataggttcgcaagtgctttaactgctctcaatgacatgggaaaggttcgtaaagatatacagcaatgggaaccatcacgaggttggaacgattggactcaagttccattctgtagccaccattttcatgaacttgtgatgaaagacggaagggtattagttgtcccttgtaggaatcaagatgaattaataggtcgagctcgaatcagccaaggtgcaggatggtcacttaaagagactgcatgccttggaaaatcatatgcacaaatgtggacgctgatgtacttccacaggagagacttgcggttagcagcaaatgcaatatgttcagcagtccctagccattgggtaccgactagcaggacaacatggtcaatccatgcaaaacacgaatggatgacaaccgaagacatgttagcagtatggaacagagtctggatacaagaaaatccctggatggaggacaagactcccgttgagtcgtgggaagaagtaccatatcttggtaagcgagaagatcaatggtgtgggtctctaataggactaacatcgagggcgacgtgggccaaaaatatccaaacagctataaaccaggtccggtcacttattggaaatgaagaatatacggactatatgccaagtatgaaaagatttcgtagggaagaggaggaagccggcgttctatggtaa

SEQ ID NO: 22417 - RNA, 9876 nt, synthetic construct
  misc_feature 1..9876: note = derived and/or modified CDS sequence (opt6) from DENV-2__FJ850053__SS-prME
  source 1..9876: mol_type = other RNA
acagctggagttatagtaatgctgatacctacagctatggcgttccatttgacaacaagaaatggggaacctcatatgatagtgggaagacaagaaaaagggaaatcattattatttaaaactgaagacggggtaaacatgtgcactctgatggctatagatctgggagaattatgtgaagacacaattacatataaatgtccattactgagacaaaatgaaccagaagacatagactgctggtgtaactccacaagcacgtgggttacatacgggacatgcactaccactggagaacatagacgagaaaaacggagcgtagccctagttccgcacgttggaatgggattagaaacaagaactgaaacctggatgtcatcagaaggtgcatggaaacatgtacaaagaattgaaacatggatactaaggcatccagggtttacaattatggcagcaattttagcttataccataggaactacgcattttcaaagagctctgatatttatacttctaacggcagtcgcacctagcatgactatgcgatgcataggaataagtaatagggatttcgtcgaaggtgtaagtggagggtcgtgggttgacatagtgctcgaacatggcagttgtgtaacaacaatggccaaaaacaaaccgacactggactttgaattaataaaaactgaagctaaacagcctgcaacattaagaaaatactgtatagaagcaaaactaaccaacactaccacagagagccgttgcccgactcaaggcgaaccaagcctaaacgaagaacaggataaaaggtttatctgcaaacatagtatggtagacagaggctggggcaatggttgcggtctatttggcaaaggaggtattgtaacgtgtgctatgttcacctgtaagaaaaacatggaaggaaaagtcgtacaaccagaaaacctcgagtatacaattgtaataacaccgcattctggagaagaacatgctgtaggtaatgatacgggcaaacatggaaaagaaattaaaataacaccacaatccagtataactgaagcagaactaactggttacggtacagtgacaatggaatgctcaccacgaactggccttgactttaatgaaatggtactactacaaatggaagataaagcatggttggtgcatagacagtggtttttagacctccccctaccctggttaccaggggcagacacacaaggatcaaattggatacaaaaggaaacattggttacattcaagaatccccatgctaagaaacaagacgtagtagtacttggatcgcaagaaggagctatgcacacagcactgacaggtgcaacagagatacagatgagtagcggtaacctcctatttacaggacacctcaaatgtagacttagaatggacaaacttcagttaaaggggatgtcctattcaatgtgcactggaaaattcaaaatagtaaaggaaatcgctgagacccaacatgggactatagttattcgagtacaatacgaaggggatggatcaccttgtaaaataccttttgagatcacagacttagaaaaacggcatgtcttaggacgcctgattacagtcaacccaatcgtcaccgagaaggactctcccgtaaacattgaagcggagccacctttcggcgatagttacataatcataggggtagaacctggtcaactaaaacttaactggttcaagaaaggatcttctataggacaaatgtttgaaaccacaatgaggggcgcaaaaagaatggcaattttgggcgatactgcatgggattttggaagccttgggggagtcttcacatcgattgggaaagctctacaccaagtattcggcgcaatatacggggcagcattttcaggtgtttcttggacaatgaaaatcctaatcggagtcataattacgtggataggcatgaactctaggtcaacaagtttatcggtttcattagttctagtaggagttgtaacactatatctcggagcaatggtccaagcagatagtgggtgcgtcgtatcatggaaaaataaagaattgaaatgcgggagcggcatcttcataaccgataatgtacatacttggacagagcaatataaatttcagcctgaatctcccagcaaattagcatctgctatacaaaaagcccatgaagaaggaatttgtggcattcgatccgtgacccgactggaaaatttaatgtggaagcaaattacccctgaactaaatcatatactcagcgaaaatgaagtgaaattaactataatgacgggagacataagaggaataatgcaagctggtaaaagatcccttcgcccacagccaacagaacttaaatattcatggaaaacttggggaaaagcaaaaatgctttctacagaaccccacaatcagacctttttaatcgatggaccagagactgcagaatgtccaaatacgaatcgtgcatggaactcactagaggtggaagactatggttttggagtgttcaccacaaatatatggttaaagttacgagagaaacaagatgtgttttgtgatagtaaacttatgtcagccgcaataaaagataatcgtgcagtccatgctgacatggggtactggattgaatccgcgttgaatgatacatggaaaatggagaaagctagttttatcgaagttaagtcttgtcactggccaaaatcccacactttatggagtaatggagttttagaaagtgaaatgattatacccaaaaatttcgccggacccgtaagccaacataattaccgtcctggttaccacacgcagacggcaggtccctggcacttggggaaactcgaaatggactttgacttatgtgaaggaactactgtggtagtaactgaagattgtggtaacaggggacccagcttaagaactacaacggcatctggcaaactcatcacagaatggtgttgccgctcttgtacgctgcctcccctaagatataggggagaagacgggtgttggtatggaatggaaattcgacccctaaaagaaaaagaagagaacttagttaattccttagtaaccgctggccacggtcaaatagacaacttcagtcttggtgtattaggtatggcactattcttagaagaaatgttaagaacaagaattggaacaaaacacgcaatattattagtcgcggtttcgtttgttactctaataaccggtaacatgtcctttcgagatctaggacgggtaatggtaatggtaggtgcaactatgactgacgacatcggaatgggcgtaacttatctagcactactcgcagcgtttaaagtccggcccacgttcgccgcaggcctccttttgagaaaattgacatctaaggaactgatgatggctactattggaatagcattactgtcacagtcaacaattccagaaactattttagaattaactgatgcgttggcactaggaatgatggtattaaaaatagttcgaaacatggaaaaatatcaacttgctgttacaataatggcgatttcatgcgtacccaatgccgtgatcttacaaaacgcctggaaagtgagctgtacgatattggccgcagtaagtgtcagtcctttgttgctaacatctagccaacaaaaagcagactggattccgttagcgctaaccataaaaggactgaatccaacggcaatatttctcacgaccctaagccgaacaagtaagaaacggtcgtggcctctaaacgaggcaatcatggccgttggtatggtatcaatcctcgcaagctctttacttaaaaacgatatacctatgaccggaccacttgtcgccggtggactcctcaccgtatgttacgtattaacaggccgcagtgcagacttagaattggaaagagcagccgacgtaaaatgggaagatcaagcagaaataagtggctcgagtccgatattatcaataaccatttccgaagatggcagcatgagtatcaaaaacgaagaagaagaacagacattgacaattttaattagaacgggcctattagtgataagtggtgtttttcctgtatcaatacctatcacggcggcagcatggtatctgtgggaagtgaagaaacaacgtgcaggcgttctatgggatgtaccttcccctcctccagttgagaaagcagaactggaggacggggcttacagaataaaacagcgtggtatccttggctatagccaaataggagcaggcgtgtataaggaaggcacctttcacaccatgtggcacgtaactagaggtgcagtattaatgcatagaggaaaacgtatagaaccttcttgggcagatgtcaagaaagatttaatctcctacggtggagggtggaaacttgagggagaatggaaagaaggagaagaagttcaggtattagcattggaaccaggcaaaaatccacgcgcagtccaaactaaacctgggatatttaaaacgaataccggcacgataggagcagtaagcctcgatttctcgccgggcacttctggatcccctatagtggacagaaaaggaaaagtcgtaggattatacggaaatggggtggttactcgcagtggagcgtatgtttctgcgatagcacaaacagaaaagtccatagaagataatccagaaatcgaagacgatatatttagaaagaaacgtctcactatcatggacctccatccgggtgccggaaaaactaaacggtacttacctgctattgttagagaagcaataaaacgaggattacgaaccctcatattagcgcctactagggtagtggccgcagagatggaggaagccttacggggtttaccaataagatatcaaacgacagcaataaaaaccgaacatacggggagagagattgtcgaccttatgtgccatgcaactttcacaatgagactactaagtccagtgagggttccaaactataatttaattataatggatgaagctcattttacagatcccgcgtcaatagctgcacgaggatacatcagtacccgagttgaaatgggagaagcagctggcatatttatgactgctactccgccaggatcccgagatccctttcctcaatctaatgccccgatcatggatgaagaaagagagattccagaacgaagctggaactcagggcatgaatgggtgactgacttcaaaggaaaaactgtatggtttgtgccaagtattaaagcaggaaatgacattgccgcatgcctaaggaaaaatggcaagaaagtcattcagctcagtcgtaaaacatttgatagcgagtatgttaaaacacgagcaaatgactgggacttcgttgttactaccgatatttcggaaatgggagctaattttaaagcagagcgtgtcatagatcccagaagatgcatgaaacctgtaatattaaccgatggcgaggaaagagtcatcttggccggaccaatgcccgtcacccacagttcagcagctcaacggcgaggaagaataggtcgaaaccccaaaaatgaaaatgatcagtatatctacatgggagaacccctagaaaatgatgaagattgtgctcattggaaagaagcaaaaatgctattggataacataaacaccccagaaggtataattccctcaatgtttgaacctgagagggaaaaagtcgatgcaattgatggggagtacagactgagaggagaagcaagaaaaacattcgtcgatctaatgagacgaggtgatttaccagtatggttggcttataaagttgcggctgaaggcatcaattacgccgacaggaaatggtgctttgatggtatcaaaaacaaccaaatcttggaagaaaatatggaagtcgaaatctggacaaaagagggagaaaggaagaaacttaaacccaggtggttggatgctcggatatattcagatcctctagctcttaaagagttcaaagagtttgcagcaggtagaaaatcactcactttaaatctaataactgagatgggacgtttaccgacatttatgactcaaaaagccaggaatgctctagacaatcttgctgtattacatacagcggaggccggtgggcgagcctataatcatgctttatcagagctccctgagacactagaaacgctcctacttcttacattattagcgacagtcacaggcggcattttcctatttctaatgtcagggaaaggaataggaaagatgaccctcggaatgtgctgcatcatcaccgcatcaatactcttgtggtatgcacaaatacagcctcattggatagcagcaagtatcatattagagttctttttaattgtcctgctgatacccgaaccagaaaaacaacgcaccccgcaagataaccagcttacatacgtcgtcattgccattttaacagttgtggcagcgacaatggcaaatgaaatgggctttcttgaaaagaccaagaaagacctagggttagggtctataacaacccaggaatctgaatctaacatacttgatatagatcttaggccggccagtgcatggaccttgtacgcagtggcaacgacgttcgttaccccaatgttacgacactctattgagaacagcagcgtaaatgtgtccttgacagcaattgcaaatcaagctactgtattaatgggacttggaaaaggctggcctttgagtaaaatggatataggtgtaccactactagctataggatgctacagtcaagtgaaccccataacactcacagctgcgttgctgcttttagtggcccactacgcgattataggcccgggtcttcaagcgaaagcaaccagggaagcccaaaaacgtgccgccgctgggataatgaaaaacccaactgtcgatggtataactgtcatagaccttgaaccaataccatatgatcctaaatttgaaaagcaactgggtcaggttatgttactgattctatgtgtaacccaggtattaatgatgagaacgacatgggcattatgtgaggctttaaccttagctacaggaccaatatctacactatgggaaggaaatcccggaagattttggaacactacgattgctgtaagtatggcaaacatatttaggggcagctacttagcgggagcaggactgctgtttagtatcatgaagaacactactaacacacgaagagggaccggcaatattggagaaacactcggcgaaaagtggaagtctcgattaaacgccctcggaaagagtgaatttcaaatatacaaaaagtccggcattcaggaagtagatcgtacattggcaaaagaaggaataaagagaggagaaaccgaccatcatgcagtctccagaggatcagccaagttacgatggtttgtggaaaggaacatggtcactcccgaaggcaaagttgttgatctagggtgtggtaggggtgggtggagttactactgtggcggactcaaaaatgtaagggaggtcaaaggtctcactaagggtgggccaggccatgaagaaccgattccgatgtctacctacggttggaatctagtacggttacaaagcggagtagacgtattctttacgcctcccgaaaaatgtgacacattactatgcgatattggggaatcctcaccgaatccaactatagaagctggtaggacattacgcgtacttaatctggtcgaaaattggttaaataataacacgcaattttgtataaaagtgctgaatccatatatgccgtcggtaatagagaaaatggaagcattgcaacggaaatatgggggagcattagttcgtaacccattatctcgaaatagtacacatgaaatgtattgggttagtaacgcgacaggaaacattgtttccagtgtaaacatgataagcaggatgcttattaacagatttacaatgaaacacaagaaagcgacatatgaaccggatgttgacttggggtccggaacgagaaacataggaatagaaagcgaaataccaaatttagacatcatcggaaaacggatagagaaaattaagcaagaacatgaaacatcgtggcactatgaccaggatcatccctataaaacctgggcatatcatggatcgtatgaaaccaaacagacaggatctgctagtagcatggtcaacggggtcgtccggctactcaccaaaccatgggatgtggtacctatggtaacccaaatggccatgactgatacaactccatttggacaacagagggtgttcaaggaaaaagtggatacaagaacacaagagcctaaagagggcaccaagaaactaatgaaaataactgcggaatggctctggaaagaattgggtaagaaaaagacacctcgaatgtgtacgagagaagagtttacgagaaaagtcagatcaaacgcagctttaggggcaatatttacggacgaaaataagtggaagagtgctcgagaagctgtagaagatggacgtttctgggaacttgtagatagggaacgaaacctacatcttgaaggaaagtgtgagacgtgcgtatataacatgatgggcaagagagagaagaaactaggagaatttgggaaagcaaaaggttcaagggcaatatggtacatgtggctgggtgcacgatttcttgagtttgaggcactaggtttcttaaatgaagaccattggttttcacgtggaaattctcttagtggcgttgagggagaaggactacaccgcttgggatatatactgagggatgttgggaagaaagaaggtggggcaatgtatgctgacgataccgcaggatgggatacgcgtattaccttagaagatctcaaaaatgaagaaatggtaacaaatcatatgaaaggagagcataagaaattagctgaagctatttttaagttaacgtatcaaaataaagttgtcagagtacagcgtcctactcctcgcggtactgttatggatataatatctcggagagaccaacggggtagtggacaagtaggaacctatggattgaacacttttaccaatatggaggcgcaactaattcgccagatggagggagagggtatcttcaaatcaattcaacacttaacagctaccgaagaaatagctgttcagaattggttagcccgggtagggagagaacgtctcagtaggatggcaataagcggggatgattgtgttgttaaaccaatcgatgatcgatttgcgagcgctttaacagctttaaacgatatggggaaggtccgtaaagatatacaacaatgggaaccttctagaggatggaacgattggacacaagtacctttctgtagccaccattttcatgaacttgttatgaaagatggacgcgttctggtagttccttgtaggaatcaggatgaacttatcggcagagcaagaatatcacaaggtgctggctggtctctaaaagaaacagcgtgtttaggaaaatcgtacgcacaaatgtggacgttaatgtattttcatcggcgggacttgaggttagcagcaaatgcaatctgtagcgcggtaccatcacattgggttccaacaagcagaacaacgtggtcaatacacgcaaaacatgagtggatgacaaccgaagatatgctcgctgtctggaatcgagtctggatacaagaaaatccatggatggaagataaaacgcccgtcgaatcctgggaagaggtaccatatttgggaaaaagagaagatcaatggtgtggatccctgataggcttaacatccagagcgacatgggctaaaaatatacaaacagcgataaatcaagtacgaagcctcataggaaacgaagagtatacagactatatgccatctatgaaacgattccgaagggaagaagaggaagctggcgtgctttggtaa

SEQ ID NO: 22418 - RNA, 9876 nt, synthetic construct
  misc_feature 1..9876: note = derived and/or modified CDS sequence (opt6) from DENV-2__JN819420__SS-prME
  source 1..9876: mol_type = other RNA
acagcgggtgttatagttatgcttattcctacggcaatggcatttcacttaactacaagaaatggtgaaccccatatgattgttggtagacaagaaaaaggtaaatcactactcttcaaaaccgaagatggagttaatatgtgtacattgatggcaatagatctgggagaactctgcgaagatactattacatataagtgccccctattaagacaaaacgaacccgaagacatagactgttggtgcaatagtacctcaacttgggtaacatatggcacttgtacaacaacaggcgaacatagacgagagaaaagatcagtagcacttgttcctcacgtcggtatgggtttagaaactcgtaccgaaacctggatgagttcagagggggcgtggaaacacgtccaaagaatagaaacatggattctacggcaccccgggtttacaataatggcagcaatattagcttatactattggtacgactcattttcaaagagcacttatctttattctcctaacagcggtcgctccaagtatgacaatgaggtgtatcggaatatcgaatcgagatttcgttgaaggagtatccggtggatcgtgggtagatatagttctcgaacacggctcatgtgtaacaaccatggctaaaaataaaccaacgttggactttgagttaatcaaaaccgaagcgaagcaacctgcaaccttaagaaaatattgcatagaagcaaaattaactaacaccacaacagaatctagatgccctactcaaggagaacctagcttgaatgaagaacaagataaacgcttcatctgtaagcatagtatggtagacaggggatggggtaatggttgcggtctcttcggtaaaggcgggattgtgacttgtgcaatgtttacatgtaagaaaaatatggaaggcaaagttgtgcaacccgaaaatctagagtacacaatagtgataactccgcattcgggtgaggaacatgcagttggcaatgacacaggaaaacatgggaaagaaatcaaaatcacacctcaaagttctattaccgaagcagaacttaccgggtatggtacagtaacgatggaatgctcaccaaggacaggacttgattttaatgaaatggttttactacaaatggaggacaaagcgtggctggttcatcggcaatggtttctcgatctcccgctaccgtggctgcctggggcggatacccaaggttctaattggatacagaaagaaaccttggtaacatttaaaaacccacacgccaagaaacaagatgtcgtagtgcttggttcacaagagggcgcaatgcatactgcactcaccggcgctactgaaattcagatgtcttcagggaacttgctgtttaccggacatttgaaatgtagattgagaatggacaaactacaactaaaaggaatgtcatactcgatgtgcactggaaaatttaaaatagttaaggagatagctgaaacacaacatggaacaatagtaatacgggtccagtatgaaggagatggatccccatgcaagattccttttgaaataactgatcttgagaaaagacatgtactaggaagactaataactgtaaaccccatagtaacagaaaaagactcacctgtaaatatagaagcagaaccaccattcggagactcttacatcataataggggtagaacctggacaattaaaactaaactggtttaagaaaggaagcagcattggtcaaatgttcgagactactatgagaggagctaaaagaatggctatattaggagacacagcatgggattttggatcactaggaggtgtgtttacaagtataggtaaagctctccatcaagtcttcggtgcgatatacggtgcagcgttttcaggagtctcttggaccatgaaaatcttgattggcgttattattacctggataggcatgaatagcagatcaactagcctaagtgtgagtttagttttagtgggagtagtaactctatacttaggagcggtagttcaagctgattctggatgtgtagtatcatggaagaacaaagaattgaagtgcggaagtgggatttttattactgacaatgtacacacatggacagagcaatataaattccagcccgaaagtccatccaaacttgcaagtgcaatacaaaaagcacacgaagaaggaatatgcggaattagatccgtcacgaggttagaaaatttaatgtggaaacagataacacccgaactaaatcacatattaagcgaaaatgaagtgaaactaactatcatgacgggagatattaaaggtattatgcaggcaggaaaaagatcgctacgacctcaaccaactgaacttaaatactcatggaaaacctggggaaaagctaagatgctttcaacagaatcccacaaccaaacatttttaatcgatgggcccgaaactgccgaatgcccaaacactaacagagcttggaactccttagaagtcgaggattatggttttggagtcttcaccactaatatttggttaaagttgagagaaaagcaagatgtattttgcgacagtaagttaatgtccgcggcaataaaagataaccgagcagtgcacgccgacatggggtattggattgaaagcgccctaaatgacacttggaaaatggaaagagccagctttatagaagtgaaatcttgtcactggccgaaatctcacacactatggtcaaatggagttcttgaatctgaaatgatcattcccaaaaattttgcaggtcctgtttctcaacataattatcggcccggctatcatacgcaaacggctggaccgtggcatctggggaaattggagatggatttcgacttctgcgaaggtacgaccgttgtagtcacggaagactgtggtaacaggggaccttcattaagaaccacaacagcatcaggaaaattgataactgagtggtgttgtaggtcttgcaccttaccccctctccgttatcgtggagaagacggttgttggtacggaatggagattaggcctcttaaagaaaaagaagaaaatctagttaatagtttagttactgccggccatggacaaattgataattttagtttgggagttctggggatggcgttatttcttgaagaaatgctacgaactcgcataggaaccaaacatgcaatcctactcgttgcagtatcatttgttaccctaattaccggaaatatgtcttttcgtgacttgggaagagtcatggtaatggtaggagcgactatgactgatgacatagggatgggcgttacataccttgcgttgcttgcagctttcaaggtgaggcccacctttgcagctggattactgttacgtaaattaacctctaaagagttaatgatggcgacgattggtatagcactattaagtcaatcaacaatcccagaaaccattcttgaacttacagatgctttagctttgggaatgatggtattaaaaatagtaagaaatatggaaaaataccagttggctgttacgattatggccatctcgtgtgtgccaaacgcggtgatactacagaatgcatggaaagtgtcgtgtactattctagctgcagtaagcgtatcacccttactactcacttctagtcaacaaaaagctgactggatacccttagcactaacaataaaaggactcaacccaactgctatatttctaaccacattatcacgtacctccaagaaaagatcttggcccctgaacgaagcaataatggcagtcggtatggtgagcatattagcctcttctctgttaaagaatgatatacctatgacaggacccctagtagcgggtggccttcttaccgtatgttatgtgctaactggacgatctgcagatttagaattagagcgcgccgccgacgtaaaatgggaagatcaagctgagatcagtggtagcagcccaattttgagtatcacaatatcagaagacggctcaatgtccataaagaacgaagaagaggaacagactctcacaatacttataagaacaggtttgctcgtaatatccggagtctttcccgtctccataccaatcaccgccgcagcgtggtatctttgggaggtgaaaaagcaacgagccggtgttttatgggatgttcctagcccaccacccgttgaaaaagcagagcttgaagatggagcgtaccgtataaaacaaagagggatactgggatacagccagataggagccggtgtatacaaagaaggcacgttccatacgatgtggcacgtcacaagaggcgcagttttgatgcataggggaaaaagaatagaaccatcttgggcagacgtaaagaaagacttaatatcatacgggggcggatggaaacttgaaggggagtggaaagaaggtgaagaagttcaagtattagcactagaaccaggtaaaaatccaagggcagtacagacgaagcctgggatattcaagactaacacaggaactattggcgcggtaagtctcgacttttcacctggaacgagcggctctccaattgtggaccgaaaaggaaaagtagttggtttgtatggtaacggggttgtgactaggagtggggcgtacgtatccgccatagcccaaacagaaaaatccatcgaagataatcctgagatagaagacgacatatttaggaagaaacggcttacaattatggatttgcaccctggagcggggaaaaccaaaagatacttaccagctatcgtgagggaagcaataaaaagaggcttgcgcacattaatattagcacccactagagtagttgcggcagagatggaagaagcgttaagaggactaccaatacggtatcagacgccagcaattaagaccgaacataccggcagagaaatagttgatctcatgtgccacgcaacatttacaatgcgactattgtcaccggttcgtgtacctaattataatctgataataatggatgaagcgcactttaccgatccagcaagtattgcagcaaggggttacattagtacgagagtggagatgggagaggctgccggcatctttatgactgctaccccgcctggatctcgggacccttttcctcaaagcaatgccccaattatggacgaggaaagagagatcccagaacgttcatggaatagtggccacgaatgggtaactgattttaaaggaaaaacagtatggtttgttccttcaataaaagcaggcaatgacatagcagcttgcttacggaaaaatggcaagaaagttatacagttgtcacgaaaaacatttgattctgagtatgtaaaaacaagagcgaatgattgggatttcgttgtaacaacagatatatcagaaatgggagctaattttaaagccgaaagggttatcgatccaagaagatgtatgaaaccagtaatccttacggacagcgaggagcgagtaatactagccggtccaatgcccgtgacccactcttccgcagctcaacgtcgcgggcggattggacgaaaccctaaaaatgagaatgatcaatacatatatatgggtgaaccgcttgagaatgatgaggactgtgctcattggaaagaagcaaaaatgttattagataatatcaatacaccagaaggaatcataccaagcatgttcgagccagaacgtgaaaaagtagacgcgatagatggggagtatagattacggggcgaagcaaggaaaacctttgtagacctcatgcgccggggagatttgccggtatggctagcatacaaagtagcggcggaaggtattaattatgcagatagaaaatggtgctttgacgggatcaaaaataatcaaatactggaagaaaatatggaagtagaaatctggaccaaggaaggggaaaggaagaaactaaaacctagatggttggacgcacgtatatatagtgatcctctagcgctaaaagagttcaaggaatttgcagccggtcgcaagtcactcaccctaaacctcataacagaaatgggaagactaccaacttttatgacgcagaaagcaagaaacgcacttgacaatcttgcagttttacacaccgccgaagcgggcggtagggcgtacaaccatgcactttcagaactgccagaaacactagaaaccctattgctattaaccttattagcaactgtcacgggtgggatatttttatttctaatgtcgggaaagggaataggcaaaatgacactaggtatgtgttgcattatcacagcatcaatcctactctggtacgcacaaatacaaccgcactggatagcagcgagcataatcctcgaatttttcttaatagtattgcttatccccgaacctgaaaagcaacgaacaccacaggacaatcagttaacttatgtcgtcatagcaattttaacggttgtagcagccacaatggcaaacgagatggggttcttggaaaagacgaagaaagatttagggttaggaagtatcactacacaggaaagcgaaagtaatatactagatatcgatttaaggcctgcgtccgcatggacattatatgcagtggccacaacatttgtaaccccaatgctcagacatagcatagaaaactccagcgtaaatgtgtcactaactgcaattgcgaatcaagcaacagtattaatgggtctaggcaaaggatggccattatctaagatggatataggcgtacctctccttgctatgggatgctatagtcaatttaagccaataactcttacggcagctctcctactattagtggcacattatgcaattatcggccccggacttcaagccaaggccacgagagaagcacagaaaagagcagcagcgggcataatgaaaaatcctacagtggatggaataaccgtaatcgatctagaacccataccgtacgaccctaaatttgaaaaacaactcggacaggttatgctgttaattttgtgtgtaacgcaagtactaatgatgagaacaacgtgggctttatgtgaagcattaacattggcgacaggaccaatatcgacattgtgggaaggtaatcctggtcgcttctggaatacaaccatagcagtaagtatggccaatatcttccgggggtcttatttagctggggcgggattacttttctccatcatgaaaaacacaacaagtacaagaaggggtacaggcaatataggagagacattaggcgaaaaatggaagagtcgcctcaatgccctaggtaaatctgaatttcagatttacaagaaaagtggaatccaggaagtagacaggaccttagctaaagaaggtataaaacgaggtgaaacagatcaccacgccgtatcacgtggatccgcaaaacttcgatggtttgttgagagaaacatggtaaccccggaaggaaaagttgtagatcttgggtgtggacgtgggggatggtcatactattgtgggggtctcaaaaacgttcgcgaagtcaaaggcctaacaaagggcggtccgggtcatgaggagccaataccgatgtcaacttatggatggaatctcgtgaggttgcagagtggcgtagatgtctttttcacaccaccggaaaaatgtgatacgttgttgtgtgacataggagaatcctcccctaacccgacaatagaagcaggcagaaccttaagagtgcttaatctagttgaaaattggctcaacaataatactcaattctgcataaaggtgttaaacccctatatgccgtcagttatagaaaagatggaagcattacaacggcaatatggaggagccttagtaagaaatccgttaagtagaaacagcacccacgaaatgtattgggtcagtaacgcaacaggtaacatagtaagttcagttaatatgatttctcgcatgctaataaacagattcacgatgaaacataagaaagctacttacgaaccagacgttgacttaggatccggtactcgaaatataggaattgaaagcgaaatacctaaccttgacataataggaaaaagaattgaaaagatcaagcaggaacacgagatcagttggcattatgatcaagaccatccctacaaaacgtgggcatatcatggatcttatgaaactaagcagacaggaagcgcttcttccatggtgaatggagtagtgcgcttacttacaaaaccctgggatgtcgtgccgatggttactcaaatggctatgacggacacgacaccttttggtcaacaacgggtcttcaaagaaaaagtagatacccggacacaggaaccaaaagaaggaactaagaaactaatgaagattactgcggagtggctttggaaggaattagggaagaagaaaaccccaagaatgtgtactagagaagagttcactaagaaagttagaagcaatgcagctttaggggcaatctttacagatgaaaacaaatggaaaagtgcaagagaggcagtcgaagatggacgtttttgggaattggtcgaccgcgaacgcaatttacatcttgaaggaaagtgtgaaacatgcgtatataatatgatgggaaagagagagaagaaactgggagaatttggaaaggcaaaaggatcacgagcaatctggtatatgtggctaggcgcacgttttctagaatttgaagccctgggatttttgaatgaagaccactggttttctaggggaaactcactctcaggagtagaaggggaggggttgcacagactgggttacattttaagagacgtaggtaagaaagaaggaggggcgatgtatgctgatgacacagcaggatgggacacgaggataactttagaagatctaaagaatgaggagatggtcacgaaccacatgaaaggtgaacacaaaaagttagcagaagcaatcttcaaattgacataccagaataaagtagtcagagtacaacgacccactcccagagggacagttatggacataatcagtcgcagggatcaacgtggatcgggccaggtcggcacctacggacttaatacattcacaaacatggaagcgcaattgattcggcagatggagggcgaaggaatttttaaatcaattcaacatttaaccgcaactgaagaaattgcggttcagaattggcttgccagagtgggacgagagcgactcagccgaatggccattagcggtgatgattgcgtagtaaaacccatcgatgatcgattcgcctccgcccttactgctttgaacgacatggggaaagtgagaaaagacattcaacaatgggaaccatcaagagggtggaacgactggacacaagtgccgttttgcagccatcattttcacgagcttgtaatgaaagatggtagagtcttagtagtaccttgtcgaaaccaagatgaactaattggaagggcacgcatttcacaaggagcaggatggtctctaaaagaaacggcgtgtttaggtaaatcatatgctcaaatgtggacgcttatgtatttccatagaagagacttaagactagctgccaacgctatctgttctgctgttccgtcacattgggtgcctacttcgcgaacaacttggagtattcacgctaaacacgaatggatgaccacagaagacatgctagcggtatggaacagagtatggatacaagaaaatccctggatggaagataaaacccctgtagaatcgtgggaagaagtcccctatctaggtaagagggaagatcaatggtgcgggagcctcatcgggttaacaagtagggcaacgtgggcgaaaaacatacaaacagctataaatcaagtgagaagtcttataggaaatgaagaatacaccgactatatgccatctatgaaacgttttaggcgagaagaagaggaagccggtgtgttatggtaa

SEQ ID NO: 22419 - RNA, 9876 nt, synthetic construct
  misc_feature 1..9876: note = derived and/or modified CDS sequence (opt6) from DENV-2__FJ850118__SS-prME
  source 1..9876: mol_type = other RNA
acagcaggggtaatagtaatgctcataccaacagcaatggcattccaccttacaacgcgcaacggagaaccacacatgatagttggacggcaagaaaaaggtaaaagtttattattcaaaactgaagacggggtaaatatgtgtacactaatggctatagacctaggagaattatgcgaagacacaattacgtacaaatgcccactattacgacagaatgaaccagaagacatagattgctggtgtaattccaccagtacctgggtaacatacggtacttgcaccaccactggagaacatcgtcgagaaaaacgttccgtagcgttggtaccccacgtcgggatgggtcttgagacaagaactgagacctggatgagctcagaaggtgcttggaaacatgttcaaaggattgaaacttggatcttgcggcatcctggatttactattatggcggctattttggcttatacgatagggacaacccactttcagagggcgttgatattcatactactcaccgcagttgcacctagtatgacaatgagatgtattggaatatccaatcgcgatttcgtggaaggagtctcaggtggatcatgggtcgatattgtcttagaacacggaagttgtgtgaccactatggccaaaaataaaccaacactcgattttgaactaattaaaactgaagcaaaacagcccgctacactacgaaaatactgcattgaggcaaaactcacgaatacaacaacagagtcccgttgtccaactcaaggcgaaccatccttaaatgaggaacaagacaaacggttcatatgcaaacatagcatggttgatagaggctggggcaatgggtgcggactatttggaaaagggggcatagttacttgtgcaatgttcacttgcaagaaaaacatggagggaaaagtagtacagcccgaaaatttggaatacacaatagtaattacaccccacagcggtgaagaacatgcggtaggtaatgatacaggtaaacacgggaaagagattaaaatcaccccacaaagtagtattacagaggccgaattgacaggatatggaacggttactatggaatgcagtccaagaacgggtcttgactttaatgaaatggtgctactacaaatggaagacaaagcctggttagtgcaccgacagtggtttttggacttaccattaccatggctaccgggagcagacacacaaggaagtaactggatacaaaaagagaccttagttacatttaaaaaccctcatgcgaagaaacaagatgttgtagttttgggaagtcaagaaggcgcaatgcatactgctctcaccggagcaactgagatacaaatgagtagcggcaatttacttttcaccggtcatttaaaatgccgactacgcatggataaactgcaattaaaaggaatgagctatagtatgtgtacgggtaaattcaagatcgtaaaagaaatcgcagaaacacaacatggcactattgttatacgcgtgcaatatgagggcgacggatccccatgtaaaattcccttcgaaattactgatcttgagaagcgacacgtactaggacgactaattacagttaatcccattgtgacagagaaagatagcccagtcaacatagaggctgaacctccgttcggcgattcttacataatcataggtgtcgaacctgggcaacttaaacttaattggtttaagaaagggtcaagcatcggacaaatgttcgaaacaacgatgcgaggagctaaacgaatggcaatactaggtgatacggcatgggactttggatcattgggtggagtctttacctctataggcaaggctttacaccaagtattcggagctatctacggtgctgcattcagtggcgtcagctggacgatgaagatcttaataggagtgataattacctggataggtatgaactcccgctcaaccagtctctcagtgagtctggttctagtgggagtggtaacattatacctaggagcaatggttcaagctgattcaggctgtgtggtgtcatggaaaaataaagagttaaaatgtggatcaggaatatttataaccgataatgtgcatacttggacagagcaatacaagtttcaacctgaatcgcccagcaaattagcctccgcgatacaaaaagcacacgaagaaggaatatgcggaatccgtagcgtcacgagattagagaatctcatgtggaaacagataacccccgaattgaatcacatcctaagtgaaaatgaggtaaaactaacgataatgacaggcgacattagagggataatgcaggctggaaaaagatcccttcggccacaacccacggaattgaagtattcgtggaaaacttggggtaaagcgaaaatgttatccactgaaagtcataaccaaacctttttaatcgatggcccagaaacagcagagtgtcccaatactaacagagcgtggaactcgttagaggtggaggattatggttttggtgtatttacaactaatatatggttaaaactaagggagaaacaggatgtcttctgtgattcaaagttaatgtctgcagcgatcaaagataacagagcagttcatgctgacatgggatactggattgaatcagcactaaacgacacatggaaaatggagaaagcctcatttatagaagtcaaaagctgtcactggccaaaatctcacacactatggagcaacggggttctcgaatccgagatgataataccgaagaatttcgcagggccagtttcacagcacaactacagaccaggttatcacacacagacagcaggcccatggcatctaggaaaactagagatggactttgatctgtgtgaaggcacaacagtagttgtcaccgaagactgtggaaacagaggtccaagtctacgaacaacgacagcctctggtaagttaattacagaatggtgttgtcgaagttgcaccctaccccctttgcgctatcgaggggaagacggttgttggtatggaatggagatacgccccttaaaagaaaaggaagaaaacctagtgaactcattagtgacagccggatatggtcaaatagataactttagcctaggcgtactaggaatggctttattcttggaagaaatgctcagaacacgcatcggtaccaaacacgcaattttattagtcgcagtttcattcgtaacattgattacaggcaatatgtcgtttagagatctcggccgagtaatggtaatggtcggagcgacaatgaccgacgacattggtatgggtgtaacatatctagcactactggcagcgtttaaagttcggcccactttcgccgcaggattacttttgagaaaactaacatcaaaagagctaatgatggcgacaatagggattgcattactatcccaaagcacaataccagagacgatactagaattgaccgatgccttagcacttggcatgatggtattaaaaatagtgagaaatatggaaaaataccaactagcagtaactataatggctattagctgcgttcctaatgctgtcatactacagaatgcgtggaaagtcagttgcacgattttggcggccgtttcagtttctccgctattgctaaccagctcacaacaaaaagcagactggatcccattagctctaacaattaaaggactaaatcctaccgcaatctttttaacaactttgagcagaacaagtaagaaaagatcatggccattaaatgaagcgattatggcagttggaatggtttctatcctagcttcctctcttctcaaaaacgacataccaatgactggaccattggtggcgggcgggctcttaacagtatgctatgtacttacaggacgatctgcagacctagagttagaaagagcggctgacgttaaatgggaagatcaagcagaaatttccggatccagtcctatcctatccataaccatcagcgaggacggttcgatgtcaattaaaaatgaggaagaagaacaaacgctaactatactcattcgtacgggacttcttgtaatatcgggagtatttcctgtatcaataccaatcactgcggccgcgtggtacttatgggaggtgaaaaagcaaagagctggagttctatgggatgtgccttctccccctccggtagaaaaagccgagttagaagatggcgcctatcgcataaaacaaagaggaatcttaggttacagccaaataggagcgggagtttacaaagagggaactttccacactatgtggcacgtgacacggggtgctgtattaatgcatcgaggtaaacgtatcgagccatcatgggcggacgtcaagaaagacctaataagttatggtggagggtggaagttggaaggcgaatggaaagaaggagaagaagtacaagtactagcactggaaccaggcaaaaatccaagagctgtgcaaacgaaacccgggatttttaaaacaaatactggaacgatcggagccgtatcacttgacttttcaccaggtacctcaggaagtccgatagtcgatagaaaaggtaaagtggtggggctttatggaaatggagtagttacaaggagtggggcatatgtaagcgcgatagcacaaacggaaaaatctatagaggataaccctgaaatcgaggatgacatctttcgaaagaaaaggttaacaataatggaccttcatcccggtgctgggaaaacaaagaggtaccttcctgccatcgtaagagaagccattaagagaggtttacgaacattaattttagcaccaacacgcgttgtagcagcagaaatggaagaagcacttcgcggccttcccataaggtatcaaacgccagccataaagaccgaacacacaggaagagagatcgtcgatctaatgtgccatgcaacgtttactatgagactgttatcgccagtccgagttcccaattataacctaattataatggatgaggcacattttacggatccagccagtattgcagcgaggggatacattagcacacgagttgaaatgggagaagcagcggggatatttatgaccgcaacacccccaggaagcagggatccattcccacaatcaaacgcacctataatggatgaagagagagagataccagaacgatcgtggaactcgggtcacgaatgggttacggacttcaaagggaaaaccgtatggtttgttccgtctataaaagcaggaaatgatatcgcagcatgtcttaggaaaaacggtaagaaagtgattcagctctcaagaaaaacatttgacagcgaatatgtaaaaacccgtgccaacgattgggatttcgtggttaccacagatattagtgaaatgggtgcgaatttcaaagctgagagagtgatagacccaagaagatgtatgaaaccggtgattttgacagatggcgaagaacgtgtcatcttggcaggcccgatgccagttacgcacagcagtgcagctcagagaagaggtaggattgggaggaacccgaaaaatgaaaatgatcaatacatttacatgggtgaaccattagaaaacgacgaagattgtgctcattggaaggaagcaaaaatgcttttagacaacattaatacgcctgaaggtataattccgtcaatgtttgaaccggaaagagaaaaagttgatgctatagatggggaatataggctaagaggcgaggcgaggaaaacgtttgtagacttgatgcgtagaggggacttacccgtctggttagcgtacaaggtagctgctgagggaatcaattatgctgaccgaaagtggtgttttgatgggatcaaaaataaccagatattagaagaaaacatggaggttgagatatggaccaaagaaggagaacgtaaaaagttaaagccacgatggcttgatgcacgaatttattccgatccattagcattaaaagaatttaaagagttcgctgcaggtcgaaagagcttgaccctaaatctaataacagaaatgggtcggttgcccacgttcatgacgcaaaaagcaaggaacgcactagacaacctagccgtattgcatacagcagaagctggtgggcgagcttacaaccacgccctctcagagttgccggaaaccttagagactctactacttctgacgctcctcgcaacggtaactggaggtatattcctattcttgatgtcaggaaaaggtataggaaaaatgacacttggaatgtgttgtataataacggcatcaatactactttggtacgcacaaattcaaccacattggatagcagcaagcatcatcctagagttcttcttaatcgtattactaatacccgagccagagaaacaaagaacaccacaagacaatcaacttacatatgtagtaatagcaatacttacagtagttgccgctaccatggcaaacgagatgggattcctagagaaaaccaagaaagaccttggactaggaagcataacaacacaagaatcggagagcaacatacttgatatagacttaagacctgcatctgcatggaccttgtatgccgtggcgacgacgttcgtaactccaatgcttcgacatagtattgaaaattcgtcagttaatgtcagcttaaccgctatagcgaaccaggctactgtactaatgggtttagggaaaggctggccactatcaaaaatggacataggcgtccctttattggcaataggttgttattcccaagtgaatccgattactctaacagcagctctactattattagtagctcattatgcaattattggacctgggctgcaagccaaagcaaccagggaagcccaaaaacgtgcagcagctggaataatgaaaaatccaacagtagacggaattacagttatagaccttgaaccaatcccatacgacccaaaattcgaaaaacaactaggccaagtgatgttgctcatattatgtgtcacacaagtactaatgatgagaacaacatgggccctgtgcgaagctctgactctagcaacaggaccaatctcaaccttatgggaaggaaatcccggtcggttctggaatacaacaatcgctgtgagtatggcaaatatctttagaggtagttacttagcaggagctggattattatttagcattatgaaaaataccaccaacacccgaagaggaacgggcaacataggggaaactttaggcgaaaaatggaaatctagactaaacgcactaggtaaaagcgagttccaaatatacaagaaaagcggcattcaagaagttgacaggaccttggctaaagaaggaataaagcgtggagaaacggaccatcacgcggtatcaagaggaagtgcaaagctgcgttggttcgttgaaagaaacatggtcacacccgaaggtaaagttgtagatttgggttgcggaagaggcggatggagctactattgtggaggacttaaaaatgtaagagaagttaaaggactaactaaaggaggccctggtcatgaagaaccaatacctatgagtacatacggttggaatcttgttcggcttcaaagtggagtcgatgtcttctttacgcctccagagaaatgtgataccctgttatgtgacattggtgagagtagcccgaacccaacaatagaagcaggtagaactttaagagtcttgaatttagtagagaattggttgaataataatacgcagttctgcatcaaagttttaaacccatacatgccaagcgtaatagaaaagatggaagccttacaacgaaaatacgggggtgcattagtgaggaaccccctgagtaggaactccacacatgaaatgtactgggtatccaatgcaacgggaaacatagttagtagcgtcaatatgatatccagaatgctgataaaccgatttaccatgaaacacaagaaagctacctatgagcccgacgttgacttaggatcaggtactagaaatataggaatagaaagtgaaatccctaatcttgatattataggaaagagaatagagaaaataaaacaagaacacgaaacaagttggcattacgaccaggaccatccatataaaacatgggcataccatggatcatatgaaactaagcaaactggaagtgccagttccatggttaacggggtggtaaggctacttacaaaaccgtgggatgtagtcccgatggtgacgcaaatggcgatgacagataccactccttttggtcagcaaagagtgtttaaggaaaaagtggatacacgaactcaagaaccaaaagaaggaactaagaaacttatgaaaatcacagccgaatggttatggaaagaattaggcaagaagaaaacaccacgcatgtgcactcgagaagaatttactagaaaagttagaagtaatgcagccctaggagctatattcacagatgaaaataaatggaaatcagccagagaagcagtcgaagacggtagattttgggagctagttgacagggaacgcaaccttcacttggagggcaaatgtgagacatgtgtatacaatatgatgggcaaaagagagaagaaattgggtgaatttggtaaagcaaagggttctagggccatttggtatatgtggcttggggcaagattccttgaatttgaagcgctgggatttttaaatgaagaccattggttcagtagaggtaacagtttaagtggcgtcgaaggcgagggcttacatcgacttggatatattttaagagatgtgggcaagaaagagggtggggccatgtacgcagatgacaccgcagggtgggatactcgtattactttggaagacctaaagaacgaagaaatggttaccaaccacatgaaaggtgaacacaagaaactagcagaggcaatatttaaacttacataccaaaataaggtagtacgagttcagcggcctacccctagaggaacagttatggacattatatcaagaagagaccaaaggggatcaggtcaagttggtacttacggattaaacaccttcactaatatggaggcgcaactaatccgacaaatggaaggagagggaatctttaaatcaattcaacacctaacagccacggaagaaatagctgtccaaaattggttggcgagagtgggacgcgagagactatcaaggatggcaattagcggagacgattgcgttgtcaaaccaatagatgataggtttgcgtcagccttaacagcactcaacgatatgggtaaagtgagaaaggacattcaacaatgggaacctagcagaggatggaatgactggacacaagtccctttctgttcccaccatttccacgaattagtaatgaaagatgggagagtcctagtagtgccctgcagaaatcaagacgaactgataggacgcgcaagaatcagtcaaggggctggctggtcactaaaagaaacggcgtgtctgggaaaatcatacgctcagatgtggacactaatgtactttcatcgacgggatttacgattagcggcaaatgctatttgtagtgcagttcctccacattgggtacctacaagcaggacaacttggagtatacatgcaaagcatgaatggatgacaactgaggacatgttagccgtatggaatcgcgtatggatacaagaaaacccctggatggaagataagactccggtcgaatcctgggaagaggttccatacttaggcaaaagggaggaccaatggtgcggatcattaatcggacttacaagtagagccacatgggccaaaaacatacaaacagcgataaatcaagtaagatctttaataggcaatgaggaatatacagactatatgccgtcaatgaaaagattccgacgtgaagaagaggaggcaggagtactatggtaa

SEQ ID NO: 22420 - RNA, 9876 nt, synthetic construct
  misc_feature 1..9876: note = derived and/or modified CDS sequence (opt6) from DENV-2__JN819416__SS-prME
  source 1..9876: mol_type = other RNA
actgcaggagtaatagtgatgctgatcccaacggcaatggctttccatctaaccacaagaaatggtgaaccacatatgatagttggacgacaggaaaaaggtaaaagtctgttgttcaaaactgaagatggtgttaatatgtgtacactgatggctattgatctaggtgaattatgcgaagacactatcacgtataaatgcccactattacgacaaaatgaaccagaagatattgactgttggtgtaacagcacatcaacctgggttacttacggaacttgtactactaccggagaacacagaagagaaaaacggtcagtagccttagttcctcatgtgggtatggggttagaaacaaggaccgaaacatggatgagtagtgaaggcgcttggaaacatgtgcagcgcatcgaaacatggatccttagacatcccggttttacaatcatggcagctatcttagcatacacgataggcacaactcatttccaacgtgctttaatttttatcttattaacggcggtagcaccaagtatgacaatgcgatgtatcggcattagcaatagagactttgtagaaggggtaagcggtggttcatgggttgacatagttcttgaacatgggagctgtgtaacaacgatggctaaaaacaaacctacgctcgattttgaacttattaaaacggaagctaaacaacccgctacgttaagaaaatattgtatcgaagcaaaactcaccaacacaaccactgaatcaaggtgcccgacccaaggcgaaccctcactcaacgaagaacaagacaaaaggttcatttgtaaacattctatggttgacagaggatgggggaacggttgtggtttattcggtaaaggcggaattgtaacatgcgcaatgtttacatgtaagaaaaatatggaaggaaaagtagtccaaccagaaaatctcgaatacacgatagttataaccccacattcaggcgaagaacatgcggtaggcaatgatacgggaaaacacggcaaagaaataaaaataacaccccaaagctcaatcactgaagcagaactcacaggatatggcacggttactatggaatgctcgcctcgaacaggacttgacttcaatgaaatggtcctcctccaaatggaagataaagcatggttagtgcaccgtcaatggtttctagacctcccattaccctggctaccgggtgctgacactcaaggctcaaactggatacaaaaagaaacattagtaactttcaaaaatccacacgccaagaaacaagatgtagtagttcttggaagccaagaaggagctatgcatacagcgcttacaggggcaactgaaattcagatgtctagcggaaatcttttgtttactggacatctaaaatgcagactacgtatggacaaacttcaattaaagggtatgtcatacagtatgtgcaccggaaaatttaaaatagtaaaagagattgcagaaacacaacacggcacaatagtcatcagggttcagtacgaaggggacggttcaccatgcaaaattccatttgaaataactgatttggaaaagcgtcacgtcttaggtcggttgataacagtaaacccaattgttactgagaaagacagtccagtaaatatagaggcagaaccaccttttggagactcttacataatcatcggtgttgaacctgggcaacttaagttaaattggttcaagaaaggatcttccattgggcagatgtttgaaacgacgatgagaggcgccaaacgaatggcaattttaggggatactgcatgggattttggatctctaggtggggttttcacctcaattgggaaggcactgcaccaagtatttggtgctatatatggagccgccttcagtggcgtaagctggacaatgaaaatactcataggagtaattataacctggatagggatgaactctaggagtaccagtctaagcgtctctctcgtacttgttggggtcgtaacactttacctgggagcaatggttcaagccgattccggttgcgtggtcagttggaagaataaagaattaaaatgcggcagtggaatattcattactgataacgtccacacgtggacagagcagtacaaatttcaacccgaaagcccctcaaaactagcatcagcaatccaaaaagcgcatgaagagggcatttgtggaatccgatccgttacaaggctagaaaatctaatgtggaaacagatcactccggaattgaatcacatactatcggaaaatgaagtaaaattgaccattatgacaggagatataaaaggcataatgcaagctggcaaaaggtcattaaggccccagccaaccgaactgaaatatagttggaaaacatggggtaaagcgaagatgttatcaaccgaaagtcataatcaaacatttctaatagatggccctgagacggcagaatgtcctaatacaaatagagcatggaactccttagaggttgaagattacggcttcggagtattcacaacgaatatttggttgaaacttcgagaaaaacaagacgtgttctgtgatagcaaactaatgtctgctgctataaaagataatagggctgtacatgctgatatggggtattggatagaaagtgcgttaaatgatacttggaaaatggaaaaggcatcgtttatagaggtaaaatcatgccactggcctaagagccatacattatggtctaatggagtattagaatctgaaatgataatacccaaaaatttcgcgggacctgtaagtcagcacaactaccgtccgggctaccatacacaaacagcgggcccatggcatcttggtaagttagagatggattttgacctttgtgaaggaactacagttgttgtcactgaagattgcgggaataggggaccctccttgaggacaacaactgcgtcaggcaagctcatcactgaatggtgttgtcgcagttgcacacttccaccactacgttatcgaggcgaagatggttgctggtatggaatggagatcagaccactaaaggaaaaagaagaaaaccttgtaaactcgttggtcacagcaggacacgggcaaatagataacttttcgctaggagttctaggcatggcattatttttggaggaaatgttacgtacaaggattggtacgaaacatgcaattttacttgtggctgtgtcattcgttactttaataaccggaaacatgagtttccgtgatttgggtagggttatggtaatggtaggagcaactatgaccgatgacattggaatgggtgtaacctacttagcacttctagcagccttcaaagtgcgtccgactttcgcagcaggacttcttttaagaaaacttactagcaaagaacttatgatggcaactatcggaatagctttgctgagtcaaagtactattccagaaactatcttagaattaacagatgctttagcattaggcatgatggtgctaaaaatagtaagaaacatggaaaaataccaactagcagtaacgataatggcgatcagttgcgtacctaacgcagtaatattgcaaaacgcatggaaagtaagctgcactatcctagcagcagtgagtgtgtcgccactattgcttacctcgtcacaacagaaagcagactggatccctttagcattaacgataaaaggattaaaccctacagcaatatttttaacaacgctctcacgtacatcgaagaaacgctcgtggcccttaaatgaagcaataatggctgtgggaatggtttcaatacttgcaagttctctacttaaaaacgacattccgatgacaggacccttagtggcgggaggactattaacggtttgctacgtgctcactggaaggtccgcagatttagagttggaacgagccgcagacgtaaaatgggaagatcaggctgaaatatccgggtctagtccaatattatcaatcacgatctcagaggatggctctatgagtatcaaaaatgaagaagaggaacaaacactcacaattctcatacgcaccggtcttctagtgatatcgggggtattcccggtatctatacctattacagcagcagcttggtatctatgggaggtcaagaaacagagagcaggggtattatgggatgtacctagcccaccaccagttgaaaaagctgaactagaagacggtgcttatcggataaagcaaagaggaatcctcggctacagtcaaattggagctggagtttataaagagggaacatttcacacaatgtggcatgtcactcgaggagccgtattaatgcaccgaggcaaacgaatagaacctagctgggcagacgtcaagaaagatctaatcagctatggaggtggatggaaactcgaaggagaatggaaagaaggagaggaagtacaagtgttagcactagagcccggcaaaaatccaagagccgtacaaacaaagccaggtatttttaaaactaacacaggcacgatcggagccgttagtctagacttttcgccaggaaccagcggttcgcccatagtcgatagaaaagggaaggttgtcggtctatatggaaatggggttgtgacaaggagcggtgcatacgtaagtgctatagcacaaaccgagaaaagtatagaggacaaccctgaaatagaagatgatatttttagaaagaaacgacttacgataatggatctacatcctggtgctggtaaaactaaaaggtatctcccagcaatagtacgagaggccataaaacgaggcttacgaacactgatcctcgcacctacacgagtagttgcggcagaaatggaggaagcccttagaggtcttccaatcagataccaaaccccagccattaaaacggaacacacaggaagagaaatcgtagatctaatgtgtcatgcaacatttacaatgagattactttctcccgtacgtgttcctaactataacctaataattatggacgaagcccatttcacagaccccgcttcgatagcagcccggggatatatctccacacgagtagaaatgggagaggcagccggtatcttcatgacggcgacgccaccggggagtagagatccttttccacaatcaaatgctcccataatggacgaagaacgagagatcccagagaggagctggaactctgggcatgaatgggtaacggattttaagggcaaaacagtatggtttgttccaagcataaaggccggtaatgacatcgccgcctgtctaaggaaaaatggaaagaaagtaatacagttgtcgagaaaaacatttgactccgagtatgtcaaaactcgagctaatgattgggattttgttgtcacaaccgatattagtgaaatgggtgcaaattttaaagctgaaagagtaatagatccaagaagatgtatgaagcctgtaatactgactgatggagaagaacgagttattttagccgggcctatgccggtgacccatagttcagcggcacagagacgtggccggatcgggcgaaatccaaagaatgagaacgaccagtacatatacatgggggaacctcttgaaaatgatgaagattgcgcgcattggaaagaagccaagatgttgttagataatattaacactcctgagggaataattccgtctatgttcgagccagaaagagagaaagttgatgcaatagacggagaatacagattaaggggagaagcgcgaaaaacttttgtagacctcatgagaagaggagatttacctgtttggctagcatataaagtagctgccgaagggataaactatgcggacaggaaatggtgctttgatggaataaagaacaatcaaatactagaggagaacatggaagttgagatatggacgaaagaaggagagcggaagaagctaaagccaagatggttagacgcaaggatctacagcgacccactcgcacttaaagaatttaaagagttcgcggcaggtagaaaatcacttactttgaacttaattaccgaaatgggtagacttcccacctttatgacacagaaagcgagaaatgctctggacaacctcgcagttctccacactgcagaggctggaggtcgagcgtacaaccacgcactctctgaactaccggaaactttagaaactttacttttactaaccctgctggcaacagtaacgggtggaatcttcctatttttaatgtcaggtaaaggcattggcaaaatgacgctagggatgtgttgtattataacagctagcatcttactttggtatgcacaaatacaacctcactggatagctgcaagcataatattagagttcttcctcatagttttactaatccccgaacctgaaaaacagagaacaccacaggataaccaacttacgtatgtggtaatagctatattaactgtggtagcagcaacgatggcaaatgagatgggattcctagagaagactaagaaagaccttgggctaggaagtataaccacccaagaatcagaaagcaacatactcgatatagatctacggcctgcttccgcctggacattgtacgcagtcgcaactaccttcgttactcctatgttacgacacagcatagaaaattccagcgtaaatgtttcattaaccgctatagcaaatcaggcgacggtattgatgggattgggcaaaggctggccattatcgaaaatggatattggtgttccgctattagcaatcggttgctattcccaagtaaatcctatcacattaactgctgcattattattattagttgcccactatgcgattataggcccgggtctgcaggctaaagctacccgagaggcccagaaaagggctgcggcagggataatgaaaaacccaactgtggatggaataacagtcatcgacctagaaccaatcccgtacgacccaaaatttgaaaagcagctaggacaagttatgttacttattctatgtgtaacacaagtattaatgatgagaacgacatgggcattatgtgaggcactaacactggctacgggaccaatatctacgttatgggaaggaaatccgggacggttttggaatacaactatagcagtctcaatggcaaacatatttagagggtcatatttggctggggctgggctattgttcagtataatgaaaaacacgactaatactcgtcgagggactggcaatatcggagagaccctaggtgaaaaatggaaaagtcgcttaaatgcactaggcaaaagtgaatttcaaatatacaagaaatcggggattcaagaagtggaccgcacactggcgaaagaaggaattaaacgcggcgagacagatcatcatgcagtgagtcgcggatcagcgaaattaagatggttcgtggaacgtaatatggtgacgccggaaggaaaagtagtggatttgggttgcggtaggggtggctggtcctattactgtggtggattaaagaatgtccgagaagtcaagggactaacaaaaggtggaccgggtcatgaagaacccattccaatgagtacctacgggtggaacttagtcagattacaaagcggtgtagacgtgtttttcactccgccagaaaaatgcgacactctactatgtgatataggagagagctcacctaatccgactatagaggctggtagaactttaagggtgttgaaccttgtcgaaaattggttgaataataatacacaattctgcattaaagttttaaacccatacatgccgtcagtcatcgagaaaatggaggctttgcaaagaaaatacggaggagctttagttcgcaatccactaagtagaaatagtactcacgaaatgtattgggtaagtaatgcaacgggcaacattgtaagcagtgtaaatatgatatctcggatgttaataaatagatttaccatgaagcataagaaggcaacttacgaaccagatgtggacttgggatccggaactcgtaatataggtatcgaaagtgaaatacccaatctcgacatcataggaaaaagaatagagaaaatcaaacaagaacatgaaacaagctggcattatgatcaggaccacccttataagacatgggcctaccacggaagttacgagacgaaacaaactggatcagcaagctccatggtcaatggcgtagtcagacttttgactaaaccgtgggatgtagtcccgatggtcactcagatggctatgacagacaccacgccgtttggacaacaaagggttttcaaggaaaaggtcgataccagaactcaagaaccaaaagaaggtacaaagaaattaatgaaaataactgcggaatggttatggaaagaactggggaagaagaaaacccctagaatgtgcactcgggaagagttcactcgtaaagtccgttcgaacgcagcacttggagcaatatttacggatgaaaataaatggaaatccgccagagaggcagtagaggacagcaggttttgggagctagtcgaccgggaaaggaatttgcatctcgaaggtaaatgtgaaacctgtgtgtataacatgatgggaaagagagagaagaaattgggtgagttcggcaaggcgaagggatcaagagcaatttggtatatgtggttaggagcaagattccttgagtttgaagcactaggatttctaaatgaagaccactggttctcacgtgggaacagcttgagtggtgtagagggtgaaggtttacacagattgggatatatattaagagacgtggggaagaaagaaggaggcgccatgtatgcggatgatacagcgggttgggacactagaattacactagaagatcttaaaaatgaagaaatggttacaaaccacatgaagggagaacataagaaactagccgaagctatatttaagctgacatatcaaaacaaagtagtaagagtacaacgtccaacaccgcgaggaaccgtgatggatatcatatctcgcagagaccagagaggcagtgggcaagtaggaacttatggccttaatacgtttacgaacatggaagctcaactaatacggcaaatggaaggggaaggcatattcaagagtatacagcatttaacagctacagaagaaatagccgttcaaaactggctagcaagagtaggcagggagcgcctgagtcggatggccatcagcggagatgattgtgtagtaaaaccgattgatgatagatttgcaagcgcactcacagcgcttaatgatatggggaaagtgcggaaagatatccaacaatgggaaccctcccgtggatggaatgactggacacaggtacctttctgtagccatcattttcacgaattggtaatgaaagacggcagagtcttagtggttccttgtagaaatcaggatgagctaatcggtagagcaagaattagccaaggagccggttggagtctaaaagaaacagcgtgtctgggtaaaagttatgcgcaaatgtggacactaatgtacttccaccggagagacctgcggttggctgcaaatgccatttgttctgcagtaccgccacactgggtacccacttcacgaacgacgtggtcaatccatgcaaaacacgaatggatgacaactgaagacatgctagctgtctggaatcgagtatggatccaagaaaatccttggatggaagacaagacgcctgtagagtcatgggaggaagtaccatacctgggcaagcgagaggaccaatggtgtggttcgttaataggccttacatcacgcgcaacatgggccaaaaatatccagacagccataaatcaagtaagaagtttaattggaaatgaagaatacacagactacatgccttcgatgaaaaggttcagaagagaagaagaagaggcaggcgtactgtggtga

SEQ ID NO: 22421 - RNA, 9876 nt, synthetic construct
  misc_feature 1..9876: note = derived and/or modified CDS sequence (opt6) from DENV-2__FJ850119__SS-prME
  source 1..9876: mol_type = other RNA
acagctggtgtcatagttatgctcattccaaccgcaatggcatttcatttaactactaggaacggtgaaccacacatgatcgtcgggagacaagaaaaaggaaagtcactactgtttaaaactgaagatggaataaatatgtgtactctaatggcaatagatttgggagaattgtgtgaagacacaatcacatacaaatgtccattacttcgtcaaaatgaaccagaagacatagactgttggtgcaatagtacaagtacctgggtaacatatgggacttgtacaacgacgggagaacacagacgcgagaaaaggtctgtcgcacttgtaccacacgtgggtatgggtctagaaacgcgaactgaaacttggatgtctagcgaaggagcatggaaacatgtgcaaaggattgaaacttggatattaagacaccccggatttacaatcatggcagcaatactagcttacactataggtacgacacactttcaaagggcgctaatattcatattattaacagctgttgcgccatctatgactatgcgatgcattggaatatcaaatcgtgactttgtcgaaggtgtatcagggggctcgtgggtagacatcgtgttagaacacggttcttgcgtaacgacaatggcaaagaacaaaccgacactagacttcgaattgataaagacggaggcaaaacaaccagctacattaaggaagtattgtatagaagctaagctaactaatacaacgacagaatcaagatgcccaacacagggggaaccatcattaaatgaagaacaagataagagatttatttgcaagcacagtatggtcgaccgtggctggggaaatggctgcggtctatttggaaaaggaggcattgttacttgcgcaatgttcacctgtaaaaagaatatggagggaaaagtggtgcaaccggaaaatctagaatatactatcgtaataactccacatagtggagaggagcatgccgtaggcaacgataccggaaaacatgggaaagaaataaaaattacaccccagtcgtcaatcacggaggccgagctgactgggtatggaaccgtgacgatggaatgttctcctcggaccggattggattttaatgaaatggtcttacttcaaatggaagacaaagcgtggctagtacatagacaatggtttttagacttaccacttccatggctccccggcgccgacacgcaaggatctaattggatccaaaaagaaaccctagtgacctttaaaaatccacatgccaagaaacaagatgtggtggtgttagggagccaggaaggagcaatgcatacagctttaactggggcaacagaaatacaaatgagtagcggtaatttactgtttacaggacatctgaagtgtagactccgcatggataaattacagctgaaaggaatgtcatactcaatgtgtaccggtaagtttaagatagtaaaggaaatagcagaaacacaacatgggactatagtaattagggtacaatacgagggcgatggatcaccatgtaaaataccattcgaaattacagatttagaaaaacgtcacgtcttaggacgtctcatcactgttaacccaatcgtaacggagaaagatagcccggttaatatcgaagctgagccgccatttggcgattcatatataataataggtgtcgaaccgggacaactaaaactcaactggtttaagaaagggtccagtatcggacaaatgtttgaaacaaccatgagaggggcaaaaagaatggccatactgggcgataccgcatgggactttgggtccttagggggagtgtttacaagcattggtaaggcccttcatcaagtgtttggagcgatatatggagccgcattttcgggtgtatcctggaccatgaaaatcttaattggggtaattattacatggataggtatgaatagcagaagtacgtctctatcggtttcattagtcctagtaggagtagttaccttatatttaggagctatggtgcaagctgatagcggttgtgtagtatcatggaaaaacaaagaactaaaatgcgggagtggtatttttattacagacaacgttcatacgtggactgagcagtataaatttcaaccagagtctccaagtaaacttgcgtcagcaatacaaaaagcacacgaggagggaatctgcggaataagatcagtgacgagacttgaaaacttaatgtggaaacaaataacacccgagcttaatcatattttatcagaaaatgaagttaaactgacgatcatgacaggtgacattaaagggataatgcaagcgggtaaaaggtccttgagaccccaacctactgaattaaaatatagttggaaaacatggggtaaagcaaaaatgttaagtactgaatcacacaatcaaactttcttaatcgacggtcctgagacagcagaatgcccgaacacaaatagagcttggaactcattggaagtagaagactatggatttggtgttttcacaaccaacatttggcttaaacttcgagagaaacaagacgtattctgcgattcaaaacttatgagtgccgctattaaggacaatagagctgtgcatgcagacatgggatattggatcgaaagtgctcttaacgacacgtggaaaatggagaaggcgagcttcattgaagtcaaatcctgtcactggccaaaatcgcatactctatggtcaaacggcgttttagaaagtgaaatgataatacctaaaaattttgccggccccgtatcccaacacaactatcgacctggctaccacacccaaacagctggcccatggcatctaggtaaacttgagatggatttcgatctttgcgaaggaactactgttgtcgtaactgaagactgtggaaatcgcggtcccagcttaagaactacaacagctagtggaaagctaataacagaatggtgctgtaggagctgtactctcccaccgttaagatatagaggagaagatggttgctggtatggaatggaaataaggcctttaaaggaaaaagaagaaaatctagtgaacagcctagtgaccgcaggtcatggccagattgataattttagtttaggagtcttgggcatggctctctttttagaggaaatgctaagaacccggataggaacgaagcatgccatcttgttagtagcagtcagctttgtcacattaattactggcaatatgagtttccgcgatttaggcagagtcatggtcatggtaggagccacaatgactgatgacattggaatgggcgtcacatatttagcactcctagcagcattcaaagttaggcccacattcgcagctggccttttattaagaaaactcacatcgaaggagttgatgatggcaactataggaatagctctattgtcccagtcgactataccggaaacaatactagaattaaccgatgcactcgctctaggaatgatggtgctaaaaatagtcaggaatatggaaaaatatcaactcgcagtcacgatcatggcaatttcctgtgtacctaatgcagtaattttacaaaacgcttggaaagtctcatgtacaatcctagcggcagtcagtgtatcacctctactgctcacgtcgtcacaacaaaaagcggactggatccctttagcgctcacaataaaaggtttaaacccaaccgctatcttcttaacgaccctcagtaggacatctaaaaagcgatcctggcctttaaacgaagcaatcatggctgtaggcatggtatcgatattggcaagttcgttgttaaagaatgatatcccaatgacagggccactggttgcaggagggctattaactgtttgctacgtacttacgggaagaagcgcagacttggagttggaaagagcagcagatgtaaaatgggaggaccaagctgagatttcaggcagttcgccaatactaagtataacaatatcagaagacggatccatgagtataaagaatgaggaagaagaacaaactctaaccatactgatccgcacagggttgctcgtcatatcaggtgttttccccgtgtccatacccattacggcagcagcgtggtatctatgggaggttaagaaacaacgagctggtgtcttgtgggacgttccttcaccacctcccgtggaaaaggcggagctagaagatggtgcgtacagaataaaacaacgcggcatactaggctatagtcaaattggcgccggagtatataaagaagggacttttcacacaatgtggcatgttacgagaggagctgttttaatgcatagaggcaagaggatcgaacctagttgggcggatgttaagaaagatctaatatcgtatggaggaggctggaagctagagggtgagtggaaggaaggagaggaagtacaagtcctagcattagaaccaggcaaaaatccaagagccgtacaaactaaaccaggaatattcaaaaccaatacgggtactatcggcgcagtaagtcttgacttctcgccaggaacttcaggatccccgattgttgatcgcaagggaaaagttgttggattgtatggcaacggcgtagtaactagatctggcgcttatgtgtccgcaatagcgcagacagagaaatcaattgaggacaatcccgaaattgaggacgatatatttcgaaagaaacggttaacaatcatggatttacacccgggggcgggcaaaacaaaaagatatttaccagcaattgtccgcgaagcaataaagaggggcctcagaacacttatattagcccctacccgggtagtagcagctgaaatggaagaggcgctgagaggattaccgataaggtaccaaacgcctgcaatcaagactgagcatacaggccgagaaatagttgacctaatgtgccacgcaacgtttactatgcgtcttttatctcctgtccgagtccctaattacaatttgataatcatggacgaagctcatttcactgatccggccagtatagccgctcgtgggtacatatcaactagagtcgaaatgggagaagcagcaggaatttttatgactgcaacgccacctggtagtcgagatccattcccacaatctaatgctccaataatggatgaggaacgagagataccagagagaagctggaactcaggacatgagtgggtgacggatttcaaaggaaaaaccgtgtggtttgtaccatcaataaaggcgggtaacgatatagcagcatgtcttcgcaagaacgggaagaaagtaatacaactatccagaaagacatttgatagtgaatacgttaagacgcgagctaacgattgggattttgtggtaactaccgatattagcgaaatgggagctaactttaaagcagaaagagtaatcgatcctagacgatgtatgaaacccgttattctcactgatggagaagaaagggtaatattagcaggtcctatgcccgtaacacactcgagcgcggcgcagaggagagggagaataggaagaaatcccaaaaatgaaaacgaccagtacatatatatgggagaaccattagaaaacgacgaggattgtgcgcattggaaagaagcgaaaatgttattggacaatattaatacaccggaaggaataataccatcaatgtttgaacccgaacgagaaaaagtggacgccatagacggggaataccgactgcgaggtgaagctaggaagacattcgttgatctgatgcggagaggagatttaccggtgtggctggcgtacaaagtagctgcggaaggcataaattacgctgacagaaaatggtgtttcgatgggattaaaaataatcaaatattagaagagaatatggaagtcgaaatttggacgaaagaaggagaaagaaagaaattgaaaccgcggtggttagacgcacgcatatacagtgatcccctcgcattaaaagaatttaaggagtttgccgcgggaagaaaatcgcttacactgaatcttataacagaaatgggtcggttaccaacttttatgacacaaaaagcaagaaatgcgcttgacaatttagctgtgttacacaccgcagaggccggtggcagagcatataaccatgcactaagtgagttacctgagacgctggagactctcttgcttcttaccttactagcaaccgtcactgggggtattttcttatttctaatgagcggtaaagggattggaaagatgactttggggatgtgttgtattataacagcatctatattgctttggtacgcgcaaattcaaccgcattggatcgctgcttccataatactagagttctttttaattgttttgcttatacctgaacctgaaaaacaaagaaccccgcaagataaccagttaacttatgtggtcatagccatattaaccgttgtagcggcaacaatggcaaatgaaatgggttttctggagaaaacgaagaaagacctaggtctgggtagcattacaacacaagaatcagaatcaaacatattagatatagatttaagaccagctagtgcgtggacactctatgcagttgctacgacttttgtcaccccaatgttgagacatagcattgaaaactcgtcagtgaatgtttcattgacagcaatagcaaatcaagcgacagtactaatgggacttggcaaaggttggccattaagtaaaatggatataggagtcccactattagctattggatgctacagtcaggtcaacccaataacacttactgcagctttattacttttagtagcgcactacgcaattattgggccaggactacaagcaaaggcgaccagagaagctcagaaaagagccgcggcaggtattatgaaaaatccaacagtggatgggataacagttatagatttggaaccgatcccatatgatccaaaattcgaaaagcagctaggtcaggtaatgcttttaatactttgtgtaacccaagttttaatgatgaggaccacgtgggctctatgcgaagctctgactctggccactggcccaatctcgacactatgggaaggaaatcctggtcggttttggaatactacaatcgccgtctctatggcaaatatatttaggggttcatatctggcaggagcaggcttactcttcagcataatgaaaaacacgactaatactcgcaggggaacaggaaacattggtgagacacttggtgagaaatggaaatccaggttgaacgcattaggtaaaagtgaatttcagatatataaaaagagcgggatccaagaagtagacagaacactagctaaagaaggaataaaaaggggagaaactgatcatcacgcagtttcacgggggagtgcgaaactccgatggttcgttgaaagaaatatggtcacgcctgaaggtaaagtcgtagatctaggatgtggcagaggagggtggtcatactattgtggaggattaaagaacgtgcgagaggtcaaaggattaacaaaaggcggacctggacacgaggaacctatcccaatgtccacttacgggtggaacttggtaagactccaaagcggggttgatgtcttctttacgcctcccgaaaaatgcgatactctgttatgtgacataggggaatcgtcgccgaaccctactattgaagcgggtcgaacgcttcgagttttaaatttagtggagaactggcttaataataacactcaattttgtataaaagtattgaacccatacatgcctagcgtaattgagaaaatggaagctctacaaaggaaatatggtggcgcattggtgagaaaccccctaagccgaaattcaacacacgagatgtattgggtatctaatgccacaggaaatatcgtgagctcagtaaatatgatttccagaatgctaataaatagatttactatgaaacataagaaggcaacatatgaaccagatgtagacttaggatcggggactagaaacataggtattgaatcagagataccaaaccttgatataattggaaaacgaattgaaaagattaaacaagagcatgaaacttcatggcattatgatcaagatcacccctataaaacgtgggcataccatggatcttatgaaacaaagcaaacaggatccgcgtcttctatggtcaacggagtggtacgcttgttaactaaaccatgggatgtagtaccaatggttacccagatggctatgacagacacaacaccatttgggcaacagagagttttcaaagagaaagtggacactagaactcaagagccaaaagagggtaccaagaaacttatgaagattacagcggaatggctatggaaagaactgggtaagaaaaagacaccgagaatgtgtacaagggaagagttcacacgaaaggtaagatcaaacgcagcattaggtgccatctttaccgatgaaaacaaatggaaaagtgcaagagaagcagtagaagatggccgattttgggagctagtggatagggaacgaaatttgcacttggagggaaagtgtgaaacctgcgtttacaatatgatgggaaaacgagaaaagaaattaggtgagttcggcaaagccaaaggcagtagagcaatttggtatatgtggttaggcgcaagattcctagagttcgaggcattagggttcttaaatgaggaccattggttttcaagagggaatagtttatcaggagtagagggagaaggattgcatagattggggtatatacttagggacgtgggtaaaaaggaaggtggagcgatgtacgccgatgatacagcggggtgggatacacgaataaccttagaagatttgaaaaacgaggaaatggtaaccaatcacatgaagggcgaacataaaaagttggcggaagcaatcttcaaacttacataccaaaataaagtagtaagagtacaaagaccaacaccaaggggaactgttatggatattataagtagacgagatcagagagggtcaggacaggtggggacatatgggcttaatactttcacaaacatggaagcgcaattgattcgtcaaatggaaggggaaggtatttttaagtccatccaacatttaacagcaagcgaggagacggcagtacaaaattggttagcaagagtcggtcgggaaagattaagtagaatggcgatctcaggagatgattgcgtagtaaaaccaatagatgataggtttgcatccgctctcacagcgctaaatgacatgggcaaagtgcgtaaagacatacaacaatgggaaccatcacgcggctggaatgattggacgcaagtgcccttttgtagccaccattttcatgaacttgtaatgaaagacggacgtgttctcgtagttccttgtcgaaatcaagatgaattaatagggcgagctagaatatcacaaggcgcaggttggagcctaaaagagacagcatgcttgggtaaaagttatgctcagatgtggacacttatgtattttcaccggagagatttacggctagctgcgaacgcaatatgctcagcagtacctccacactgggtaccaacatcccgaacaacttggagcatacatgcaaaacacgaatggatgaccactgaagatatgttagcagtctggaatcgggtgtggatacaagaaaatccctggatggaagataaaacacccgttgaatcatgggaggaagtaccgtacctaggaaaacgcgaagaccaatggtgcggtagccttataggattgacttcacgagccacctgggccaaaaacatacagaccgcaattaatcaagtccgaagtcttatagggaacgaggagtacaccgattacatgccctcgatgaaaagatttcgccgcgaggaagaagaagcaggagttctatggtaa

SEQ ID NO: 22422 - RNA, 9876 nt, synthetic construct
  misc_feature 1..9876: note = derived and/or modified CDS sequence (opt6) from DENV-2__FJ850064__SS-prME
  source 1..9876: mol_type = other RNA
actgcaggagtaattgttatgttaattcctactgctatggcatttcacctaactacgcgtaatggagaaccacacatgatagtaggacggcaagaaaaaggaaagagcttgttatttaaaacagaagacggtgtaaatatgtgtaccttgatggcgatagaccttggtgaactctgcgaagacacaataacgtacaaatgcccgttgcttaggcaaaatgaacccgaagatatcgattgttggtgcaactcgacatcaacgtgggtaacatacggtacatgtacaacgactggagaacatagaagagaaaaacgaagtgttgcattagtaccacacgtgggaatgggtctggaaacgcgcaccgaaacgtggatgagctcagaaggggcatggaaacatgttcaacgtattgaaacatggattttaagacatccgggatttactattatggctgcgatccttgcatatactattgggacaactcatttccagcgagctctgatcttcatattattaacagcagtagctccatcaatgacgatgcgatgtattggtatcagtaaccgcgattttgtggaaggggtatccggtggaagttgggtggacatagtacttgaacatggatcctgcgtgaccactatggctaaaaataaacccacgttggatttcgaactaataaaaacagaagccaaacagccagcaacactgaggaaatattgcatcgaagcaaaattaactaacacaacaaccgaaagtagatgtccgacacaaggtgaaccatcattaaatgaagaacaagacaaacgatttatatgtaaacattctatggtagataggggatggggaaatggatgcggactgtttggcaaaggaggaatagtaacttgcgctatgttcacatgtaagaaaaatatggaaggaaaagtagtacagcccgaaaatcttgaatatacaattgttattacaccgcacagcggagaagaacatgcagtaggaaacgacacgggaaaacacggaaaagaaatcaaaataacacctcagtctagtataacagaagcagaactaacgggttatgggacggtaacgatggaatgctcgccaaggacaggtctagattttaatgagatggtactattgcaaatggaagacaaagcctggttagtccatagacagtggtttttagatttaccgctcccctggttgccaggagctgacacgcagggatcaaactggatccagaaagaaaccttagtaacattcaaaaatccccatgcaaagaaacaggatgtggtagttttaggctcacaggagggtgcaatgcacacagccttaacgggtgctacggaaatacaaatgtcatccggtaacctcttattcactggacatctaaaatgcagattaagaatggataaactacaactgaaaggtatgagttattcaatgtgtacgggaaaatttaaaattgttaaagaaattgcagaaactcaacacgggactatcgtgataagagtgcaatatgaaggtgatggatccccatgcaaaataccgttcgaaattactgacttagagaaaagacatgtgcttggcagactaataactgtaaaccccatagttactgaaaaagattctccagtcaatatagaagcggaacccccgttcggtgattcatacataatcattggagtagagccaggacaattgaaattaaactggttcaagaaagggtcttctataggacaaatgttcgccaccaccatgagaggagcaaaaaggatggcgatcttaggagacacagcctgggattttggcagtttaggtggcgtctttacgtcaataggcaaagcgcttcatcaagtttttggtgccatctacggggcagctttcagtggtgtatcttggaccatgaaaatactaattggtgtaatcataacatggatagggatgaatagtcgaagtacctcactcagtgtatctttagtgctggtaggtgtagtaaccctatacttgggagcaatggtacaagcggatagcggttgtgtagtatcatggaagaataaggaactcaagtgtggttcaggaattttcattacagataacgtccacacatggacagagcaatacaaatttcaaccagaatcacccagcaagttggctagcgcaatacagaaagcgcatgaagagggaatatgcggcataagatcagttacccgactcgaaaacttgatgtggaaacaaataacacccgaattgaatcacatcctatcagaaaacgaggtgaagctcaccatcatgactggtgatataaaaggtattatgcaagccggtaaacgttctcttaggccgcaacctaccgagctaaaatattcatggaaaacctggggcaaagcaaaaatgctgagcacagaaagtcataatcaaactttcttgatagacggaccagaaactgccgaatgtccaaatacgaaccgcgcttggaactcgctagaagtggaagactatggatttggtgtattcacaactaatatatggctaaaactccgagagaaacaagatgtgttttgtgatagtaaactaatgtctgcggctataaaagacaatcgggcagtccatgcagatatggggtattggatagaaagtgcgttaaacgacacgtggaaaatggagaaagccagctttattgaagtaaaatcatgccattggcccaaaagtcatacgctttggtctaacggcgtattggaaagtgaaatgataataccgaagaacttcgctggaccagtcagccaacataattatagaccaggctaccatacacaaactgcaggcccatggcacctcggtaaactggagatggatttcgacttatgtgaagggacaaccgtggtagttactgaagattgcggaaatcgaggtccaagtcttagaaccaccactgcctcggggaaattgattactgaatggtgttgcaggtcctgcacattaccgcctctcagatatcgtggagaggatggctgctggtatggtatggaaattcgacctttgaaagaaaaagaagagaatttagtgaactctttagtaacagcggggcatggacagattgataattttagtttgggcgtcctcggaatggcactatttttagaggaaatgctcagaacccgtataggcacaaagcacgcaatactgctagtagctgtaagttttgtaacgctcataacgggaaatatgtctttccgcgatctgggaagagttatggtcatggttggcgcaaccatgaccgatgatattggcatgggagtaacttatttggcactacttgcagcatttaaagtaagaccaacatttgcagcagggttgttactgcgaaaacttacttcaaaagaactaatgatggcaacaataggaattgcattattgtctcaaagcacgataccggaaaccattctcgaactaactgatgcgttagccttaggaatgatggttctgaaaatagtaagaaatatggaaaaatatcagcttgcagttaccataatggcaatttcatgtgtccccaatgctgtaatcctccaaaatgcatggaaagtgtcatgcacaatattggctgcagtgtccgtcagccctctattactaacatcatctcaacagaaggcagattggatacctctggccctgaccataaaaggtcttaatcctacagcaatatttctaacaacgctttctaggaccagcaagaaaaggtcctggcccttgaatgaagccataatggccgtgggaatggtcagcattctagcaagctcactattgaaaaatgatatacccatgacaggacccctcgtcgcaggagggctattaacagtatgttatgttttgactggtagatctgcggatttagaattagaaagagcagctgatgtaaaatgggaagaccaagcagaaatatccggttcgtcacctatattaagtataacgatatcagaggatgggtcaatgtctattaaaaatgaagaggaagaacaaaccttgactatcctaatacgcacgggattgcttgtaatttcaggggtctttcctgtatctatccccataacagctgccgcatggtatttgtgggaagtcaagaaacaacgcgctggtgtattatgggatgtacctagtccaccaccagtagagaaagcagaattggaagatggtgcatataggataaaacaacgagggattctaggttacagtcaaattggtgctggagtgtataaagaaggcacatttcatacaatgtggcatgtcacaagaggtgcagttcttatgcatagagggaaaagaattgaaccttcctgggccgacgtgaagaaagatttgatttcatacggaggcgggtggaagctggaaggagagtggaaggaaggggaggaggttcaagtattagcgctggaaccaggtaaaaatccacgggctgtacaaacaaaacctggaatttttaaaacaaacacaggtaccataggtgcagtaagtttagattttagccccggaacgagtgggtcccccattgttgaccggaaaggcaaagtcgtaggcttatacggtaatggagtagttacgagatcgggagcctatgtgtcagctattgctcagacggaaaaatcaattgaagataacccagaaatagaagacgacatatttcgtaagaaacgtttaaccataatggatctccatcccggagctggcaaaacgaaaaggtacctgcccgcaatagttagagaagcgatcaaaagaggattaaggacattaatccttgccccgacacgggtagttgctgctgaaatggaagaagcgcttagggggttacctatacgataccaaacaccagctattaaaacggaacacaccggaagagaaatcgtagatctaatgtgccacgcaacattcaccatgaggcttttatcaccagttcgagtaccgaattacaatctgatcataatggacgaagcacacttcacagaccctgcaagtatagccgctaggggctatatatcgacaagggtggaaatgggcgaagctgcaggtatatttatgacagccacccctcccgggagtcgtgatccattcccacaaagtaatgcaccgattatggacgaagaacgtgaaatacctgaaagatcatggaatagtggtcatgaatgggtaacggactttaaaggtaagacagtatggtttgtgccctctattaaggcaggtaatgacatagcagcttgcttacgcaaaaatggcaagaaagtaatacaattaagcagaaaaacattcgattcagaatacgtaaaaacgagagccaacgattgggatttcgtagtgacaacagacatttcggaaatgggagctaactttaaagcagagcgagtcatagaccccagaagatgcatgaaaccagtaatacttacagatggagaagaacgggttatactcgctgggccaatgcctgttacccatagcagtgctgcacaaagacggggacgtattggccgaaaccccaaaaacgaaaacgatcagtatatctatatgggggagcccctggagaacgacgaggactgtgctcattggaaagaagcaaaaatgcttctcgataatataaacactccagaaggtataataccatccatgtttgaaccggagcgtgaaaaagtagatgctattgacggggagtataggttgcgaggagaggcaagaaaaactttcgtagacttaatgaggaggggcgatttgccggtttggctagcgtataaagtagcggcagaaggtatcaattacgctgatagaaaatggtgctttgatggaatcaagaataatcaaatactagaagaaaacatggaggtagaaatatggactaaggaaggtgaaaggaagaaacttaagccaagatggcttgacgcaaggatctacagtgacccgcttgcactaaaagagttcaaagaatttgcggcaggaagaaaaagtttaacgttaaacttaatcactgaaatggggcgtttaccaacgttcatgacacagaaagcgaggaatgcactagataatctggcagttctacatacggcagaagcaggaggcagagcatataaccatgcgctgtccgaacttcctgaaacactagaaactctcttacttcttaccctgctagccacagttacaggtggcatatttctatttctaatgtctggcaaaggaattggtaaaatgacattaggaatgtgctgtataataacggcgagcatattactgtggtacgcccaaattcagcctcactggatcgcagcatcaatcatacttgagttctttcttattgttcttcttatcccggaaccagagaagcaacgaacaccacaagataaccaattgacatatgtagtgatagcaatattgacagtagtagccgccaccatggcgaatgaaatgggttttctcgagaaaactaagaaagacctaggtttaggttcaataacaacacaagaaagcgaatcaaacattctcgatatcgatttacgtccagcgtcggcgtggacactatacgcagtagcgacgacatttgtgacaccaatgctacgtcatagcatcgaaaattcatccgtaaatgtctcgcttactgccatagctaatcaagcaacggtattaatgggattgggaaagggatggcctctgtctaaaatggatatcggtgtgccgctattagccattggttgctattctcaagtcaatccaatcacgctaacagctgccctactgctgttagttgctcattatgcaatcataggacccggcctgcaagcgaaagcaaccagagaagcccagaaaagagctgcagcgggaatcatgaagaaccctactgtcgatggaatcactgtgatagatttggaacccattccttatgatccaaaatttgaaaagcaattgggacaagttatgcttctaatcttatgcgtaactcaagtcttgatgatgaggacaacatgggctttatgtgaagcactcacccttgcaacaggtccgatatcgactctatgggaaggtaatcccggacggttttggaatactacaatagctgtatcaatggcaaacatatttagaggatcatacttggcgggtgcaggattactatttagtataatgaagaacacaactaatactagaagaggtacgggtaacattggcgaaaccctcggggaaaagtggaaatctagattaaatgcacttggaaaaagtgagtttcaaatatacaagaaatcagggattcaggaagtagatcggactttagctaaagaagggataaagcggggagaaacagaccatcacgcagtaagtaggggttctgcaaaacttcgatggtttgtcgaacgtaacatggttacacccgagggcaaagtcgtagacctcggatgcggaaggggtggctggtcctattattgtggaggactgaaaaacgtcagagaagtcaaagggctaacaaagggaggccctggacatgaagaacctatacctatgagtacatatggctggaatctcgttcgcctacaatccggagtagacgtcttctttactccacctgagaaatgtgatacgttattatgcgatatcggagagtcgagcccaaaccctaccattgaagctgggcgcacactccgcgtattgaatctagttgaaaactggctaaataacaacacgcagttttgtattaaagttctaaatccgtatatgccctcagttattgaaaagatggaggctttacaaaggaaatacggcggtgcactggttaggaatccattatcgagaaactcgacccatgaaatgtattgggtatcaaacgctacaggaaatatagtgagttctgtcaatatgatttctaggatgttgataaatcgatttactatgaagcacaagaaagcaacatatgaaccagacgtagatttgggaagtggtacgcgcaatataggaatcgaaagtgaggtaccaaatttagacataataggaaaacgaattgagaaaataaaacaggagcatgagacaagttggcattatgaccaagaccatccatataaaacatgggcctaccacggttcatacgaaacaaaacaaacggggagtgcgtctagtatggtaaacggggtggtcagactgttaacaaaaccttgggacgtggtcccaatggtaacacaaatggcgatgacagatacaacgccgttcgggcagcaaagagtgtttaaagagaaggtggatacacgtacccaagaaccaaaggagggtacaaagaagctcatgaagataactgctgaatggctatggaaagagcttggcaagaagaaaacccctaggatgtgtacacgcgaggagttcactcggaaagtccgatcgaatgcggctctgggtgctatatttactgatgaaaataaatggaaatcagccagagaagcagtagaagatggaagattctgggaactcgttgacagagaaagaaatttgcatttggagggtaagtgcgagacctgtgtatataatatgatgggaaagcgcgagaagaaattaggagagttcggtaaagcaaagggatctcgggcaatttggtatatgtggcttggtgcacgcttcctagagttcgaagcgctagggtttcttaatgaagatcactggttctcaagagggaatagtttaagtggtgtggaaggtgaagggttgcatcgattgggatacatactcagagacgtgggcaagaaagaaggaggagcaatgtacgcagacgatacggcaggttgggatacgcgtatcacccttgaagatctgaaaaacgaagagatggtaacgaatcatatgaaaggagagcataagaaactagctgaggctatcttcaaattaacttatcaaaacaaggtagtaagggtacaaaggcctacaccgagaggtactgtaatggatatcatatcaaggcgtgaccagagaggaagtggccaggttgggacatatggcctcaatacatttacaaatatggaagctcaattgattagacagatggaaggggaaggtatcttcaaaagcattcaacacttaacggccactgaggagatcgcagtacaaaattggctcgcaagggttggaagggagaggctatcaagaatggcaatcagcggagacgattgcgttgttaagcctatagacgacaggtttgcatctgctttaactgcgctaaacgatatgggtaaggtcagaaaagatatacaacaatgggaaccatcaagggggtggaatgattggacacaagtccccttttgctctcaccatttccatgaactggtaatgaaagatggacgagtattagtggttccatgtagaaatcaagatgaattgatagggcgagccaggataagtcaaggagcaggatggagtctaaaagagactgcgtgcttgggcaaaagttatgcacaaatgtggacgttaatgtatttccatagacgagatctacgactagcagctaatgcaatttgtagtgccgtcccgccacattgggtaccaacctctaggacgacatggagtattcatgcaaagcatgaatggatgacaacagaagacatgctagcagtatggaatcgggtttggatccaagagaatccctggatggaagataaaacaccagtggagtcttgggaagaggtaccatacttgggaaaacgtgaggaccaatggtgtggatcattgatcggattgacgagcagggcaacatgggctaaaaatatacagaccgcaataaaccaagtacgttcattaatcggaaatgaagaatataccgattatatgccgagtatgaaaagattccgaagggaagaagaggaggcaggcgtgctttggtag

SEQ ID NO: 22423 - RNA, 9876 nt, synthetic construct
  misc_feature 1..9876: note = derived and/or modified CDS sequence (opt6) from DENV-2__FJ850065__SS-prME
  source 1..9876: mol_type = other RNA
acagccggtgtcatagtcatgttaattcctacagctatggcttttcacttaaccacgagaaacggggaaccacacatgatagttggacgacaagaaaaagggaaatcattacttttcaaaactgaagatggtgtgaatatgtgtacattaatggcaatagacttgggagaactgtgtgaagatacaataacgtacaaatgtcctttactacgtcagaatgaaccagaagatatagactgttggtgtaatagtacgagcacgtgggttacgtatggtacgtgtactacaacgggagaacaccgaagagaaaaacgctccgttgccttagtaccccatgtcggtatgggtctagaaacacgaactgaaacatggatgagttcagaaggggcgtggaaacacgtccaaagaatagaaacttggattttaagacacccagggtttacgataatggcagccatattggcatacacgattggaaccacgcatttccaacgagctcttattttcatattattgacagcagttgcacccagtatgacaatgcgttgcataggaatctcaaacagagactttgtagaaggcgtatcaggtggaagctgggttgatatagtattagaacacggcagttgcgtgacaacaatggctaaaaataaaccaaccttagattttgaacttataaaaacagaagcaaaacaaccagcaacgctacgtaaatattgcactgaagcaaaactaacaaatacaactacagaaagtcgatgcccgacacaaggggaaccaagtcttaacgaagaacaagataaaagatttatctgtaaacacagcatggtcgaccgagggtgggggaacggttgcggcctattcggaaaaggtggcatagtaacttgtgctatgtttacatgtaagaaaaacatggaagggaaagtagtacaacccgaaaatctagaatatactattgttataacaccacattcaggcgaagaacacgccgtgggcaacgatacaggtaaacacggaaaagaaattaaaattactccacaaagcagtataacggaagctgaattaacaggttatggaaccgtgacaatggaatgttcgccacgtacaggtctagatttcaatgaaatggtgctacttcaaatggaggacaaagcatggctagtacatagacaatggtttttggacttaccactgccttggctgcctggagctgatactcaagggagtaattggattcaaaaagaaacactcgtaacttttaaaaatccgcatgctaagaaacaagacgtggtggttctaggatcacaagaaggtgcaatgcataccgctttaacgggcgcaacggaaatccagatgtcaagtggaaacctgctattcactggtcatttaaaatgtagattgagaatggataaattacagctaaaaggaatgtcatattcaatgtgcacgggaaaattcaaaatcgttaaagagatcgcagaaacacaacatggcacaatagtcataagagtacaatatgaaggagatggcagtccatgcaaaataccattcgaaattacagacctagaaaaacgtcatgttttaggccgtttaattactgttaacccaattgtcaccgaaaaagatagcccggtaaacattgaagccgaacccccgtttggtgactcttatataataatcggtgttgaaccgggtcagttaaaacttaattggttcaagaaaggatcttctataggtcaaatgtttgaaacgaccatgaggggagcaaaacgaatggcgatcttaggtgatacggcttgggactttggaagtctaggaggagtattcacgagcatcggcaaagcattacaccaagtatttggagccatttatggtgccgcatttagtggtgtttcttggacgatgaaaatacttatcggtgttataataacttggataggtatgaactcgaggagtacttcacttagtgtctcattagtgctagttggggttgtaacactgtaccttggcgcaatggtacaagcagactctggctgtgtggtcagttggaaaaacaaagagttaaaatgtgggagtggaatatttattactgataacgtacatacatggacagagcaatataaatttcagccggaaagtccaagtaaattggcatcagcaatacaaaaagctcacgaagaggggatatgcggtatacggtcagtcacacgattagaaaatctcatgtggaaacagataactcccgaattgaatcatattttaagcgaaaacgaagtaaaattaactattatgactggagatataaagggaatcatgcaagcaggaaaacgatctttaagaccacagccaacagagttaaagtatagctggaaaacgtggggaaaggccaagatgttaagtactgagagccataatcaaactttcttgattgacggacccgagacagcagaatgtccaaacactaatcgagcctggaactctttagaagtggaagattacggttttggcgtcttcacaaccaatatatggttgaaacttcgtgaaaaacaagatgtattttgcgacagtaaattgatgagcgccgcaataaaggataatcgggccgtgcatgccgacatgggatactggatcgagtcggcgttaaatgatacctggaaaatggaaaaagcctcatttatagaagtgaaatcatgtcattggccaaaatctcacaccctatggagtaatggagttcttgaatctgagatgattatccccaaaaattttgcaggtccagtatcacaacataattatcgaccagggtatcacacccagacggcaggtccttggcatctaggtaaattagaaatggattttgatctgtgcgaggggaccaccgttgtagttacagaggactgtggtaaccgaggcccaagtttacgtacaacaacagcgtcgggcaaactcattaccgaatggtgctgtcggtcttgtacgctcccgccactaagataccgaggtgaagatggatgctggtatggcatggaaatacgaccacttaaggaaaaagaagaaaatttagtcaactcattagtcactgcaggacatggccaaatagataatttctcattaggagtgctgggtatggctttatttctggaagaaatgcttaggacccgaattggaacaaagcatgcaattctattagtagcagtgagctttgtaaccctgattactgggaatatgagctttagagacttaggtcgagtaatggtaatggtcggagcaactatgactgacgacatcggtatgggagtgacttatttagcattgctcgcggcttttaaggtgaggcctacgtttgctgcaggattgttattaagaaagttaacgtcaaaagaactcatgatggctactataggaatcgcacttctaagccaaagtactataccagagactattctggaattgacagatgcccttgctttagggatgatggtgctgaaaatagtcagaaatatggaaaaatatcagttagccgtaactattatggccatcagttgtgtccccaatgcagtaattcttcagaacgcatggaaggtgtcctgtacaatattagcagccgtaagcgtatcgccgttactcctaacaagttcacaacaaaaagcagattggataccactagcgttgacaattaaaggtttaaacccgacggccatcttcctcactacgcttagtcgcacaagtaagaaaagaagctggccactaaatgaagcgatcatggctgtgggcatggtatcgattctagcttcatcattactgaagaacgatataccaatgactggtccgttagtcgcaggcgggcttcttaccgtatgctatgtattaacaggaagatcggccgacttggaactcgaaagggctgcagacgtcaaatgggaagatcaagccgaaattagcggtagtagtccaatactatcgatcacgatctcagaagacggttccatgagtatcaaaaatgaagaagaggaacaaaccctaacaatactaattagaacaggattattggtaataagcggagtttttcccgtttccattcctattacggccgccgcgtggtatctatgggaagttaagaaacaaagagcaggcgttctgtgggacgtgccatcaccaccaccagttgaaaaagcggagctggaagatggagcgtacagaataaaacagagaggaatacttggatactctcaaatcggtgcaggagtttataaagaaggtactttccatacaatgtggcacgttacaaggggagctgtcctcatgcacagaggcaaacgtattgagccgtcatgggcggatgttaagaaagatttgatttcatacggaggaggatggaaattagaaggtgagtggaaagaaggtgaggaagttcaagttcttgcactggaacctggcaaaaacccacgtgcagtccagacaaaaccaggtatatttaaaaccaacacagggacaattggagcggtgtcattagatttctccccaggtacaagtggaagtcctatcgtagatagaaaaggtaaagtcgtgggtctatatggaaatggagtagtaacacgctcaggagcatatgtatccgcaatagcacaaacagaaaaatcaatcgaagataacccggagatcgaagaggacatctttaggaagaaaagactcaccataatggatttacacccaggggccggtaagactaaaagatacctcccagccatagtacgcgaagcaataaaacgcggattaaggacgctaatattggcacccacaagagttgtcgcagcagagatggaagaagctctaaggggacttcctataagatatcagacgccagcgattaaaacagaacatactggacgggagatcgtcgatttgatgtgtcatgccacttttacaatgcgtctcctatcacccgtgcgtgtgccaaattacaacttaattataatggacgaagctcattttactgatcccgcttccatagcggcgagagggtatatttccactcgagtcgaaatgggagaagcagcgggcatttttatgacagcgacacctcctggatcccgagacccgttcccccagagtaacgcacctataatggacgaggaaagagagatccctgaacggagttggaactcagggcatgagtgggtcacagatttcaaaggcaaaacagtgtggtttgttccatctataaaagcaggtaatgatattgcggcttgcttacgtaagaacgggaagaaagtgattcagttatcacgaaaaacatttgatagtgagtatgtaaaaacaagggcaaacgactgggactttgttgtgacgacagatattagtgaaatgggtgccaatttcaaagcagagagagttatagacccgagacgttgcatgaaaccagtaattcttactgacggagaagaaagggtaatactcgcagggcccatgcctgttactcacagtagtgcggcacaaagacgagggcgcattggtcgaaacccgaaaaacgagaacgatcaatatatctatatgggcgaacctctcgaaaatgatgaagattgtgcacactggaaagaagcaaaaatgctcctagacaacattaatacgcctgaggggattattccctcaatgtttgaaccggaacgtgaaaaagtcgatgctatcgatggtgaataccgactacgtggagaagctagaaaaacattcgttgatctaatgagaagaggggacctacctgtttggctggcctataaagtagctgcagaaggcatcaactacgcagacagaaaatggtgtttcgatggcattaaaaataaccagatcttagaagaaaatatggaagttgaaatctggactaaagagggggaaaggaagaaactaaaaccaagatggcttgacgcacgcatatattctgaccctctagcacttaaagaatttaaggaatttgccgctggtcgaaaatcactcacattaaatcttatcactgaaatgggaaggttaccaactttcatgacacaaaaagccagaaatgcattggataacttagcagttttacatacagctgaagccggagggagagcatataaccatgctctcagcgaacttccagaaactttggagacattgcttctgcttactttactcgctactgtaacgggaggaatatttctatttttaatgtctggaaaaggtataggaaaaatgactctaggtatgtgttgcattattacagccagtatccttttatggtacgcacaaatacaacctcattggatagctgctagcataatattagagttctttctaatcgttcttctaataccagaaccagaaaaacaaagaacgccccaggataaccaattgacttatgtagtgattgcaatacttactgttgtcgctgcaactatggcaaacgaaatgggctttttagaaaagactaagaaagacctaggactcggatcgataaccacccaagagagtgaatcaaatatactagatatagatctgaggccagcatccgcttggacactatatgccgttgcaaccactttcgtaaccccgatgcttagacatagtatcgagaatagttcagtcaatgtctctcttacagcaatagcaaatcaagctaccgttctaatgggtctgggaaaaggttggcccctctctaaaatggatatcggtgttcctctgctggccataggttgctattcacaggtaaaccccataacactcacagcggctctactattacttgtcgcacactatgctatcattggtcctgggttacaagcgaaagcgacccgtgaagcacaaaagagagctgccgctggaattatgaagaatccaacagtggacggaatcactgttattgatcttgaaccaattccatatgatcctaagtttgaaaagcagttaggacaagttatgctcctgatattatgcgtcacacaagttctaatgatgcgtactacctgggcgctgtgtgaagcactaaccttggcaacaggtcctatatcaacactatgggaagggaatccaggacggttttggaatactacaattgcagttagcatggcaaatatatttcgaggcagttacctagctggcgctggtctcttattttcaataatgaaaaacacaacaaatactcgccgcggcactggaaatatcggagaaacgctaggagaaaagtggaagtcaaggctaaatgcattggggaagtccgaatttcagatatataagaaaagtggtatacaagaagtagataggacattagcaaaagaggggatcaaaagaggggaaacagatcaccacgcagtctcgagggggtctgcaaagctaaggtggtttgtagaaagaaatatggtaacaccagaaggtaaggttgtcgacttagggtgtggaaggggtggttggagttattactgtggaggattgaaaaacgtcagagaggtaaagggattgactaaaggaggaccaggccatgaggaaccaatacccatgtctacatacggttggaacctggttcgtctccaaagtggcgtggatgtatttttcactcctccagaaaaatgcgatacgttactctgcgacataggagaatcaagtcctaacccaactattgaggctggacgtacattgcgtgtattgaatcttgtggaaaattggctgaataacaatacacaattttgcataaaagtactaaacccctatatgccaagcgttattgaaaagatggaggcacttcagcgaaaacatggtggcgcgctagttcggaatcctctaagccgaaactcaacgcatgaaatgtattgggtttctaatgcaacaggcaacatcgtatcatcggtaaatatgattagccgaatgcttataaatcgctttacaatgaaacataagaaagctacctatgaaccagacgtagatttaggcagtggaacacgaaatatagggatcgaatccgaaatacctaacttagatataattggaaaacgcatagagaaaattaagcaagaacatgaaacgtcatggcactacgatcaagaccacccatacaaaacttgggcatatcatggatcatacgaaaccaagcagacgggcagtgcttctagcatggtaaatggagtcgtacgcttgctaactaaaccctgggatgtagttccgatggtaacacaaatggctatgacagatacaacaccatttggacaacaacgagttttcaaagaaaaagtagacacacgaacacaagaacctaaagaaggaaccaagaaactaatgaaaataacagcagaatggctatggaaagaattaggcaaaaagaaaaccccaaggatgtgtacaagggaagaatttacccgaaaagtgagaagtaacgcagctctaggagcgatctttacagacgaaaacaaatggaaatccgcaagggaagcggttgaagatggaagattttgggagctagtcgatcgcgagagaaatcttcatctagaagggaagtgcgaaacatgtgtatataatatgatgggaaagcgcgagaagaaattaggggagttcggaaaggcaaaaggcagtagagccatatggtacatgtggttaggtgcaagatttctagagttcgaagcgttgggttttctgaacgaggatcactggttttcccggggaaattccttgtccggtgtggaaggcgagggcttgcaccgtttaggatacattctaagagacgtaggcaagaaagaaggcggcgcaatgtacgctgatgatactgcgggctgggatacccgtataactctagaggatctcaaaaatgaggaaatggttacaaaccacatgaaaggtgagcataaaaagctagccgaagccatttttaagttaacgtatcaaaacaaggtagtacgagtacaaagaccaaccccaagaggaacagtaatggacataatatcccggcgcgatcaacggggcagtggacaggtgggtacatacggacttaatacattcaccaacatggaggctcagttaattagacaaatggaaggggaagggatatttaaatctatacaacacctcactgctactgaagaaatagcagtacaaaattggttagcgagagtaggtcgcgaaagactctcacgaatggccatctctggggatgactgcgttgtaaaacctatcgacgatagatttgccagtgccctcactgcactaaacgatatgggaaaagtccgaaaagatatacaacaatgggaacctagtagaggatggaacgattggacccaagtaccgttttgttcacaccatttccacgaattggttatgaaggatgggagggttttagtagtgccatgcagaaatcaagatgaactcattggtagagcccgaatctctcaaggagctggttggtcactcaaagaaaccgcatgcctgggaaagtcgtacgcgcaaatgtggactttgatgtatttccaccgacgtgatctaagactagcagctaacgcgatatgctctgcggtaccgccacactgggtaccaacatcgagaacaacatggtcaatccatgctaagcacgaatggatgactaccgaggatatgctggctgtatggaatagagtctggatacaggaaaatccatggatggaagacaaaacgccagtggaatcctgggaagaagtaccctatttagggaaaagagaagatcaatggtgtggtagcctaatcggtcttacgtcgagggcaacttgggcgaaaaatattcaaacagcaataaatcaagtcagatctctcataggaaatgaggaatatacagattacatgccctcgatgaaaagattcaggagagaagaagaagaggctggggtcctttggtag

SEQ ID NO: 22424 - RNA, 9876 nt, synthetic construct
  misc_feature 1..9876: note = derived and/or modified CDS sequence (opt6) from DENV-2__FJ873808__SS-prME
  source 1..9876: mol_type = other RNA
acagctggggtgatagttatgctaattccgacagctatggcttttcacctgacaactagaaacggagaaccccacatgatagtaggaagacaggaaaaagggaaaagccttctatttaaaactgaagatggagtgaacatgtgtacgttaatggcaattgatttgggggaactatgcgaagatacgataacttacaaatgcccactgctgcgccagaatgaacccgaagatatagattgttggtgcaacagtacttcaacatgggttacttacggaacttgcacaacaaccggcgaacatagacgagagaaaaggagcgtggcactcgtaccccatgtaggcatgggtcttgaaacgagaacggaaacttggatgtcctcggaaggagcatggaaacatgtacaaaggatagaaacgtggattctaagacatccgggatttaccattatggcagctattctagcctatactatagggacaacacacttccaaagggcactgatattcattttattgactgctgtagcaccaagcatgacaatgaggtgtattgggatatctaaccgagactttgtagaaggtgtgtctggcgggtcctgggtagatatagtactagaacatggaagctgcgtaactactatggccaaaaataaaccaaccctggatttcgaacttataaaaaccgaagcaaaacagcctgcaacattaagaaaatactgcatagaggcaaaattaactaatacaactactgaaagccggtgcccaacgcagggtgagcccagcttaaacgaggaacaagataaacgattcatatgtaaacacagtatggtcgatcgtggatggggaaacggctgcggcctttttgggaaaggagggattgttacttgtgcaatgttcacatgtaaaaagaatatggaagggaaggtagttcaaccagaaaacttggaatatacaattgtcataacaccccactcaggtgaagaacacgcggttggtaatgacacaggcaaacacggcaaagagataaaaataacaccacagtcctccattacagaagctgaattaacaggatatggcacagtcactatggaatgctcaccaagaaccggactagatttcaatgaaatggttttgctgcaaatggaagataaagcgtggctagtgcacagacaatggtttttagacctaccactaccttggttgcccggtgcagatacacagggcagcaattggatccaaaaagaaacgttagtaacattcaaaaaccctcatgctaagaaacaagatgtggtcgtgctagggagtcaagaaggtgctatgcacacagcattaaccggggcgactgagattcagatgagctcaggaaacctattatttaccggacatttaaaatgtaggttaagaatggataaattgcagttaaaaggaatgtcatattctatgtgcacaggtaaatttaaaatagtcaaggaaattgccgaaacgcagcatggtacaatcgtcataagagttcaatatgaaggcgatggttctccttgcaagataccatttgaaataacagacttggaaaagcgccacgtattaggtcgcctaatcaccgtcaatcccatagttacagaaaaagattcacccgtaaacatagaggcagaaccccctttcggtgattcctacataattattggggtagaacctggccaacttaagttgaattggttcaagaaaggttcttccataggacagatgttcgaaaccacaatgcgaggggcgaaaaggatggcaatcttaggagacactgcatgggatttcgggagcttaggcggcgtctttacgtctatagggaaggcacttcaccaagtgttcggtgcaatatacggagcagctttttctggcgtttcttggacaatgaaaatacttattggcgtaatcataacttggattgggatgaacagtcggagcacaagtctatctgtatcgttggtcttggtcggagtagttacactatacctaggggcaatggtgcaggcagactcaggatgtgtagttagttggaaaaacaaagaattaaagtgcggaagtgggatatttataactgataacgtacacacctggacagaacagtataaattccagccggaatcacctagtaaattggcatcagccatacaaaaggcccatgaggagggtatttgtgggattaggtccgttacgcgcttagaaaaccttatgtggaaacagataacgcctgaacttaatcacatcttaagtgagaatgaagttaagctaacaataatgaccggtgatattaaaggtattatgcaagctggcaaaagatccttaagacctcaacccactgaactaaaatatagctggaagacgtgggggaaggcaaagatgctatctacagaatcacataaccagaccttcctaatagatggaccggaaactgcggaatgtcccaatactaaccgcgcatggaactctttagaagttgaagattatggtttcggagtcttcacaacaaacatctggctaaaacttagagaaaagcaagacgtattttgtgatagcaaattaatgtccgcagctattaaggataatagagcagtgcatgccgatatgggatattggatcgaaagtgccttaaacgacacgtggaaaatggaaaaagcatcctttatagaagtaaagtcgtgtcactggcccaaaagtcatactttatggtcaaatggcgtattagaatcggaaatgataatacccaagaatttcgctggacccgtttcacagcacaattatcgaccaggctatcatacgcagaccgcggggccttggcatttgggaaaattggaaatggatttcgatttgtgtgagggaacgaccgttgttgtcacagaagattgtggtaacaggggaccatcattacgtacaacaacggcgagcggtaagttaataacagaatggtgttgcagaagttgcaccctgccaccgcttcgctatcgcggtgaggacggatgttggtatggaatggaaataagaccactaaaagaaaaagaggaaaacttagtaaacagtctggtcacagccggacacggccagatcgataatttttcactaggagttttaggaatggcattatttctagaagaaatgttaagaacacgaattggaactaaacatgcaatactactggtggctgtcagctttgttacattaattactggtaatatgagttttcgagacctaggcagagtaatggtaatggtcggagcaacaatgaccgacgatataggtatgggtgtgacttacttagcgcttctagccgcattcaaaattaggccaacattcgctgccggtctattgctaagaaagttaacaagcaaagaactaatgatggcaaccataggaatagcgctgttgtcccaatcgacaatacctgagacaattcttgagctaacagatgcactggcattagggatgatggtgttaaaaattgtgcgaaatatggaaaaataccagctagctgtaaccatcatggcaataagctgtgtcccgaacgcggtcattctccaaaatgcatggaaagtctcttgcgcaattctcgcagcggtgagcgtctctccattactacttacttcatcaaaacaaaaagcagactggatacccctagcacttaccattaaaggtctaaatccaacggcaatatttttaactaccctctcgagaacctcaaagaaaagaagttggccactaaacgaagcagtaatggcagtaggtatggtttccattttggcctcttctctgctcaaaaatgacataccgatgacaggacctttagtagcaggaggactgttgacagtctgctacgtactaactggaagaagcgccgatctagaactagaaagagcggcagatgtaaaatgggaggatcaggcagaaattagcggatcatcaccgattcttagtataaccataagcgaagatggtagcatgtctatcaaaaacgaagaagaagaacagacactcacaatactcataagaactgggctcctagttatctcaggagtatttccagtatcaatcccaatcacagcagctgcatggtatctgtgggaggtcaagaaacagagagcaggagttttatgggatgtcccaagtccaccacccgtagaaaaagcagagttggaagatggagcatacagaataaaacagcgtgggatcttaggatactcgcaaattggtgccggtgtatacaaagaaggaacttttcacaccatgtggcacgtgactaggggcgcagtcttaatgcacaggggcaaaagaatagaaccgagttgggcagatgtcaagaaagatctgatttcatacggaggaggctggaaattggagggagaatggaaagaaggagaagaagtacaggtcttggctctggaaccgggtaaaaacccccgtgcggttcaaactaaaccgggaatattcaaaacaaacaccgggacaataggcgcagtatctcttgatttttctcccggaacgagtggttcaccaattgtggaccgtaaaggaaaagtagtaggcctatacggaaacggagtcgtcacgcgatctggcgcttatgtttcggcgatagcacaaactgaaaaatctatcgaagacaacccggagatagaagatgatatatttcgaaagaaaaggctcacgataatggatctacatccgggggccggtaaaacaaagcgttatctaccggctatcgtaagggaagcaataaagagagggttaagaacactcatactagcaccaacgagagttgttgcggccgaaatggaagaggcattacggggattgccaatcagataccagacaccagctataaagaccgagcacaccggaagggagattgtggatttaatgtgtcatgcgacattcactatgagacttctttctccagttagggtaccaaactacaatttgataatcatggatgaagcccatttcactgaccctgctagtatcgcagctagaggttacatctcaacgcgtgtagagatgggtgaagcggcaggaatctttatgaccgcaactcccccgggttcacgagatccgtttccacaatcgaatgctccaataatggatgaagaacgtgagattcccgaaagaagctggaatagcggccatgagtgggtcacagattttaaaggaaaaaccgtttggtttgtaccgtcaatcaaagcgggtaatgatatcgcagcttgtctaaggaaaaatggcaagaaagttattcaactaagccgaaaaacatttgatagtgaatatgtgaaaacccgtgcgaacgactgggatttcgttgtaactaccgatattagtgaaatgggtgcaaactttaaagccgaaagggtcatagatcctcgcagatgtatgaaaccagtcatactaactgatggtgaagaaagagtaattctagcaggacccatgccagtaacacatagttctgcagcgcaaagacgtggtaggatcgggcggaatcctaaaaatgagaatgatcagtatatatacatgggtgaacccctcgaaaacgatgaagactgtgcccattggaaagaagctaaaatgttgttggacaacatcaatacacccgaaggcattattccatcaatgtttgaaccagagcgagagaaagtcgatgctatagacggggagtacagattaaggggagaagccaggaaaacatttgttgacctaatgagacgaggtgacctacccgtctggctagcatataaagtggctgcagaaggcatcaactatgcggatcggaaatggtgctttgatggtataaggaataaccaaatcttagaagaaaacatggaagtagaaatttggaccaaagaaggagaaagaaagaaacttaagccccggtggcttgatgcaagaatctacagcgacccattggcccttaaagagtttaaggagttcgctgcgggcagaaagtcattaaccttgaatttaatcaccgaaatgggaaagctaccaacgtttatgacacaaaaagcaaggaacgcactggataacttggccgtactacatacggcggaggcaggagggagagcctacaatcatgcgctcagcgaattgccagaaacattagaaacgttattactattaactctactagcaacagtgacaggtggaatatttttgttccttatgtcgggaaaagggattggcaagatgactctgggcatgtgctgcattatcactgcttctatacttctttggtatgcacaaatacagccccactggattgctgccagcatcatactcgagttctttttgatagtcctattaatcccagaaccagaaaaacagagaaccccacaagataaccaactgacctatgtcgttatcgcaattcttacggtggttgctgcaacaatggcaaacgaaatgggcttcttagagaagaccaagaaagacctgggtcttggttcaatcactacccaagaatcagagtcaaacatactagatattgatctacgtcctgcatcggcttggacactttacgcagtagctacaacttttgtaacacctatgctcaggcacagtatagaaaatagcagcgtcaatgtcagtcttacggccattgccaatcaagcaacagtattaatgggtttaggaaaaggatggcccctaagcaaaatggacatcggtgtaccacttctagcgattggctgctactcccaagtgaatccaatcaccctcaccgcggccctcctattgttagttgcacattatgcaataataggcccaggcctacaagccaaagcaacaagagaagcacaaaaacgagctgcagcaggaataatgaagaatccaactgttgatggaattacggttattgatctcgaacctattccatacgatccgaaatttgaaaaacaattggggcaagtaatgctcctaattctctgcgttactcaagtgcttatgatgcgtacgacatgggcattatgcgaggctttaacgctcgcaactggacctatatctacattatgggagggaaatccaggacgattttggaacacaacaatcgcggtctcaatggccaacatattcagaggcagctatttagctggtgcaggattattgttttccataatgaaaaatactacaaataccagacgtggtacaggaaatatcggtgaaaccctgggcgaaaaatggaaatctcgcctgaatgccctgggaaaatcagaatttcaaatttacaagaaatccggcatccaagaagtagatcggacattagccaaagaaggtattaaaagaggagaaacagatcaccacgcagtaagtcgcggatcagctaaattacgatggttcgtggagaggaacatggtcacgcctgaaggtaaggtagtcgatttgggctgtgggagaggaggatggtcttattattgtggaggattaaagaacgtacgtgaggtaaagggtctaacgaaaggtggaccgggacatgaagaaccaatcccaatgtcaacatatgggtggaatctggtgagattacaatctggagtagatgttttctttacgcctccagagaagtgcgacacactattatgtgatataggagaatcctctcctaatccgactatcgaagctggccgcacactcagagttctaaatcttgtggaaaactggctaaataataacacccaattctgtattaaagttctaaatccttatatgccatcggtcatcgaaaagatggaggccctacaaaggaagtatggaggggcgctggttagaaatccactcagtagaaacagtacacacgagatgtattgggtctccaatgcaactggaaacatagtctcaagcgtaaacatgatatcccggatgctaataaatagatttaccatgaaacataagaaagcaacatacgaacctgatgtcgacctcggaagtggcacaagaaatataggcatcgaaagtgaaattccaaacttagatattataggaaaacgcatagagaaaattaaacaagaacatgagaccagttggcattatgatcaagatcatccctacaagacttgggcttatcatggatcttatgaaactaaacaaacgggtagcgcatcatcaatggtgaatggagtagtaaggcttttaactaaaccctgggacgtagttcctatggttacacaaatggccatgactgatacgacgccattcggtcagcaaagagtttttaaggaaaaagtagatacaaggacccaagaaccaaaagaaggtactaagaaactcatgaagataacagccgaatggctatggaaagaattgggaaagaaaaagacgccaagaatgtgtacaagagaagagttcacaagaaaggtcagaagtaatgcagctttgggcgcaatcttcacagatgaaaataaatggaaaagtgctagagaagcagtggaagacggaagattctgggaacttgtagatagagaacgcaaccttcacctagagggaaagtgcgagacttgcgtatacaacatgatgggaaaaagagagaaaaagctaggcgagttcggcaaagcaaagggatcacgtgctatatggtacatgtggttgggcgcaagatttttagaatttgaagcactgggtttcttgaacgaggaccactggttttcgaggggaaactcgctttctggagtagaaggagaaggacttcacagactgggttacatactgcgggatgttggtaagaaagaaggaggggccatgtatgctgacgatacggctggttgggacacacgcataacactagaggacctcaaaaacgaagagatggttaccaatcatatgaaaggagaacacaagaaattggccgaagcaatatttaaactaacatatcaaaacaaagtagtaagagtacaaagaccgacccctcggggtactgtaatggacataattagccgtcgagaccagcggggaagtggacaagtgggaacgtacggactaaatacatttacgaatatggaagctcaactaataaggcaaatggaaggggaaggtattttcaaatctattcaacacctcaccgctacagaagagatcgcagtgcaaaactggttggcaagggttggcagagaacgactcagccgaatggcaatttctggagatgattgcgtagtaaaacccatagatgaccgtttcgcgtccgcgctaacggcactcaatgacatgggaaaggtgagaaaagatatccagcaatgggaaccatcacggggatggaacgattggacacaggtcccgttttgttctcaccactttcacgagctagtgatgaaggacggacgcgtcctagtagtcccttgtcgaaatcaggatgaattaataggccgagcaagaatctcacaaggagcaggctggagccttaaagaaactgcttgcttaggaaaatcctacgcacagatgtggacattaatgtactttcataggcgagatttgcgcctagctgcaaatgcaatatgctctgcggtacccccgcattgggtaccaacctccagaactacatggagtatacatgcaaaacatgaatggatgacgactgaagatatgttggccgtatggaatagagtatggatacagggcaatccttggatggaagacaagacgcctgttgaatcttgggaagaagttccttatttagggaaaagagaagatcaatggtgtggtagtttaataggcctaacgtctagggcaacctgggccaagaatatacaaacagcgataaaccaggttcggtcactaataggtaatgaagagtatactgattacatgcctagtatgaaaagattccgacgtgaagaggaagaagcgggagttttatggtag

SEQ ID NO: 22425 - RNA, 9876 nt, synthetic construct
  misc_feature 1..9876: note = derived and/or modified CDS sequence (opt6) from DENV-2__FJ850120__SS-prME
  source 1..9876: mol_type = other RNA
acagctggggttattgtaatgctaatacctacggctatggcgttccatcttactacaagaaatggagaaccacatatgatcgttggtagacaagagaaagggaagtctttattgtttaaaactgaagatggagtgaatatgtgtacattgatggccatagatcttggtgaactgtgtgaagatacaataacttacaagtgccccttattaagacagaatgaaccagaagacattgattgctggtgtaatagtacctctacatgggtaacctatggcacctgtacaacaaccggagaacataggagagaaaagcgatcagtagccttagtaccacatgttggtatgggtttagagacccgcacagaaacatggatgagctccgaaggcgcatggaagcatgtgcaacgcatagaaacatggatactcagacaccctggtttcactataatggcagccattttagcttacacaataggaactactcactttcaaagagcactaatatttattctacttacggcagtagcgccttcgatgacgatgaggtgtataggaatctcaaacagagatttcgtcgaaggggtatccgggggttcatgggtcgatatagtgctagagcatggaagttgtgttacgacaatggcaaagaataaacctaccttggacttcgaactgattaaaacggaagcaaaacaaccagctacacttcgaaaatattgtatcgaggctaaattaacaaatacaaccacggaatccagatgtccaactcaaggagagccgtcattaaatgaagaacaggataagagatttatatgcaaacattccatggtagataggggctgggggaacggatgtggtctatttggaaaaggaggaatagttacatgcgctatgttcacttgtaaaaaaaacatggaaggcaaggttgttcaaccagaaaatcttgaatacacaattgtcataacacctcatagtggtgaagagcacgcggtagggaacgatacgggtaaacacggaaaagaaataaaaattactcctcaatcaagtgtaacggaagcggaattaacaggttacgggactgtaaccatggaatgtagtccacgaactggattagactttaacgaaatggtacttctacaaatggaagacaaagcatggctagtccaccgtcaatggttcttggacctaccactaccttggttaccgggtgcggacactcaaggaagtaattggatccaaaaagaaacgctagtaacatttaaaaatccccacgctaagaaacaagacgtggttgtgttaggtagccaagaaggagcgatgcataccgcactcacgggagcaactgaaatacagatgagctcgggaaatctactatttacgggccatttaaaatgtaggctaaggatggacaaattacagctgaaagggatgtcttacagcatgtgtaccgggaaattcaaaatcgtaaaagagatcgcagaaacgcagcatggaactattgttataagagtccagtatgaaggagatggaagcccttgcaagattccatttgaaattaccgacctggaaaaaagacacgttcttggtagactaatcacggttaatccgattgtaaccgaaaaagattcgccagtgaatatcgaagccgagccaccattcggggacagttatattattattggggtcgaacccggacaattaaaactgaactggttcaagaaaggttctagtataggtcaaatgttcgaaaccaccatgaggggggcaaaaagaatggcgattctaggtgatacagcatgggactttggctcgttaggtggagttttcacgtctatagggaaggcgcttcaccaggtattcggcgcaatttatggagctgctttctcaggagtcagctggacgatgaaaatattaataggagtaataattacttggattgggatgaacagcagaagcacatctctaagtgtcagcttagtcttagtcggagttgtaacactgtatttaggggctatggtacaagctgattcggggtgtgtagtcagctggaagaataaagagttgaagtgcggctccgggatatttataacagacaatgttcatacgtggaccgaacagtataagtttcagcctgaatcaccttcaaaactagcctcagcaatacaaaaagcccatgaggaaggaatatgtggaattagatccgtaacgagattagaaaatctaatgtggaaacaaataacaccggaattaaatcatatattaagtgaaaatgaagtgaaattaacgattatgacaggggacattcgaggcatcatgcaagcaggaaagagatcactcagaccacaaccaacagaactaaaatactcatggaaaacatggggcaaggctaagatgctgagcacagaaagtcataatcagacgtttctgatcgatggtccagaaacagctgagtgcccaaacacaaatagagcatggaactcactcgaggtagaagattatggattcggcgtcttcactacaaacatctggttaaaactaagagaaaaacaagacgtattctgtgacagtaagctaatgagcgctgcaattaaagacaacagggctgttcacgctgatatgggctactggatagaatcggcactaaacgatacatggaaaatggaaaaagcatcgttcatagaggttaaaagctgccattggccaaagtctcatacactctggtcaaatggcgtcctcgaaagtgaaatgataatcccaaaaaattttgctggaccggtatcccaacataactatcgtccaggctaccacacccaaactgcgggaccctggcatctaggtaaactagaaatggatttcgacttgtgcgaaggcactaccgtcgtagtaaccgaagattgtgggaataggggaccctctctacgtacaaccactgcgtcgggtaaactgataactgaatggtgttgtcgatcatgcacattaccaccactcagatacagaggtgaagatggctgttggtatggaatggaaattcggccactaaaagaaaaagaggaaaaccttgtcaattcgctagtaacggcaggacatggacaaattgacaactttagcctaggagtgcttggaatggcacttttcctagaggaaatgctaagaactaggattggcacgaagcatgcgatattgcttgtcgcggttagtttcgttacgctcataacaggaaatatgtcttttagagatttaggtcgggttatggttatggttggagctaccatgacagacgacataggaatgggggtaacctatcttgccttgttagcagcatttaaggttaggccaacatttgccgcaggtttactcttaagaaaattgacctccaaggaattgatgatggcgacgataggaattgcattattgagtcaatcaacaataccggaaacaatattagaactaactgacgcactagcattaggaatgatggttttaaagatagtacgaaacatggaaaaatatcaactagctgttactataatggcgatttcatgcgtaccaaacgcggttattctacaaaatgcttggaaggtaagctgtacgattctagcggccgtatcggtgagccctttactcctaacctctagccaacagaaagcggattggataccattagccttgacaataaaaggcctgaaccctacagcgatatttcttacaactcttagccgcacaagcaagaagcgatcatggccactaaatgaagcaattatggcagtagggatggtgagcatactagctagcagtttgttaaaaaatgacatacctatgactggtccattagtcgcaggagggttactaacggtttgctatgtactcacaggtagatcagcagatttagagcttgaaagggctgctgacgtaaaatgggaagaccaggccgaaatttcaggttcatctccaattctatctataacgatttcggaggatggctccatgtcaataaaaaatgaagaggaagaacaaacactcacaatactcatacgcactggacttctcgtaataagtggcgtttttcccgtaagcatcccaataaccgcggcagcctggtatctatgggaagtaaaaaagcaacgagcaggagtattatgggacgtaccatcgccaccacctgtagagaaggctaaacttgaagatggcgcttataggattaaacaaagaggaattttagggtactcacaaattggagctggcgtctataaagaaggaacatttcatacaatgtggcacgtaacaagaggggctgtattaatgcacagaggaaaaagaatagaaccatcatgggcagatgtaaaaaaagatctaatatcttacggagggggttggaagctagaaggagagtggaaggaaggagaagaagtccaagtcctcgcattagaaccgggaaagaatccgcgcgctgttcaaactaaacccggaatatttaagactaatacagggacaatcggcgcggtatcactcgacttctcacctgggacaagtggatcgccgatcgtcgaccgaaaaggtaaagtggtgggcttatacgggaacggtgttgtaacccgttctggggcatacgttagtgcaatagctcaaaccgaaaaaaacattgaagataacccggaaattgaggatgacatcttccgtaagaaaagactcacaataatggacttgcaccctggtgcaggaaaaacaaagcggtatctaccggcaatagtgcgagaagcgatcaagagaggtttacgaactctaatattagcccccacacgagtggtagctgcagaaatggaagaagccttgcgaggcttacccatccgctatcaaacacccgcaataaaaactgaacacacaggtcgggaaattgtggatttaatgtgccacgcgacattcacgatgcgactactatccccagtaagagtgcctaactataatttaataatcatggatgaagcacacttcaccgacccagcatcaatagcggccagaggatatatttcaacgagggtggagatgggtgaggccgcagggatttttatgacagctactccgccaggaagcagggaccccttccctcaatcaaacgctcctattatggatgaagaacgtgaaatccccgagagaagctggaatagtggtcatgaatgggtaaccgatttcaaaggtaaaaccgtgtggtttgtcccctcaataaaagctggtaacgatatagcggcctgtttgcgtaaaaacggcaaaaaggtcattcaattaagtcggaagacctttgacagcgaatacgttaaaactagggcaaatgattgggatttcgttgtgacaacagatatttctgaaatgggtgctaatttcaaggcggaaagagtcatagacccaagacggtgtatgaaaccagttatcttgaccgacggcgaagaaagagttatcctcgcgggaccaatgccggtaacgcactcgtcagcagctcaacgaagaggccgaattgggagaaaccccaaaaatgagaacgaccaatatatatatatgggagagcccctggaaaatgacgaagactgtgcacattggaaagaagctaaaatgttattagacaacattaatactcccgaagggataataccctcgatgttcgaacctgagcgagaaaaggtagatgcaatcgacggcgagtatagacttcgaggcgaagccaggaagacatttgtggacctaatgagaaggggagatttacctgtttggctcgcgtacaaagttgctgcggagggaataaactatgccgacagaaagtggtgttttgatggtataaagaataaccaaatactggaagaaaacatggaagtagagatctggactaaagaaggagagagaaaaaaactaaaacccagatggttagatgcaagaatttattcagatcccctggcattaaaggaatttaaggaatttgcagccggacgtaagtcattaaccttaaatttaatcacagaaatgggacgtctccctacgttcatgacccaaaaagccagaaatgcgctagacaatttagctgtcttacatacggctgaagccggaggaagagcctataaccatgcattgagcgaattacctgagacactagagaccctgctgcttttaaccttactagcaactgtgacaggaggtatctttttatttttaatgtctggaaagggaatcggaaaaatgactcttggaatgtgttgtattataacagccagcattctactatggtacgcccaaatacaaccacattggatagctgcaagtattatccttgaattctttttgatagttcttcttataccagaaccggaaaagcagcgaacgccacaggacaatcaactgacatacgtagttatcgcgatcttaaccgtagtcgcagcaacgatggccaacgaaatgggattcctggaaaaaacgaagaaggacctaggacttggctccattacgacacaagagtcagaatcgaatattttggatattgatttgagaccggcttcagcatggactctatatgctgtggcaaccacctttgttacccctatgttgagacacagtattgaaaactcatcagtaaatgttagccttacagccatcgcaaaccaagcaactgttctaatgggattgggaaaaggctggccacttagcaaaatggatattggtgtacctttactagctataggttgctacagccaagttaatccaataacactgacagcagctctgttactcctagtagcacactatgccataataggacccgggctccaagcaaaggcaacgagggaagctcaaaagagagcagctgcaggtataatgaaaaatccaacggtagacggaataacggtaattgacctcgaacctatcccatacgatccaaaattcgaaaaacaattaggacaagtgatgttactaattctatgcgtcacacaggtgttgatgatgcgaaccacatgggctttgtgtgaggcactcacacttgctacaggtcctataagtactctatgggaaggtaatccggggcgattctggaacaccacgatagcagtctcaatggcgaacatattcagaggttcgtatttagccggagcggggctgttattttcgattatgaaaaatacgacaaatacgaggagaggaacaggttctattggcgagacgcttggtgaaaaatggaagagcagattgaatgcgttgggaaaaagcgaattccaaatatacaagaaatcaggaatacaggaagtcgaccggactttggccaaagaaggtatcaaaaggggagagaccgatcatcacgcggtgtccaggggtagcgcaaagctaagatggtttgttgaacgaaatatggttacccctgaaggtaaggttgtagacttaggttgtggtaggggtgggtggtcatattactgcggtggattgaaaaacgtaagagaagttaaagggttaactaaggggggaccaggtcatgaagagccgatcccaatgagtacatatggatggaacttagttcgactccagagtggagtcgatgtattttttaccccacctgagaagtgtgacactttattatgtgacattggagaaagctcgccgaatcccacaatagaagccgggcgaaccttacgagtcctcaatttagttgaaaattggcttaataataacacacaattttgtatcaaagttctaaacccttatatgccatcagtaatagaaaagatggaagctctgcagagaaaatacgggggagcactagtaagaaatcctttaagtcgtaacagcacccacgaaatgtactgggtgtcgaacgcgacaggaaacatagtatcctccgtgaacatgattagtcgaatgctaataaacaggtttactatgaaacataaaaaagctacctatgaaccagacgtagacttaggttcaggaacacgaaatataggtatagaaaatgagatacctaacttagacattataggaaaaagaatagaaaaaattaaacaagaacacgagacctcttggcattacgaccaagatcatccctataaaacttgggcttaccacggtagttacgaaacaaaacaaaccggaagcgcaagctctatggtaaacggagttgtccgacttttaacaaaaccgtgggatgtagtgccaatggtaacacaaatggcaatgacggatacaaccccatttggtcagcagagagtcttcaaggagaaagtagatacacgtacccaagaaccaaaagagggtaccaaaaaattaatgaagataacagcagaatggctctggaaagagctaggcaagaaaaaaactccaagaatgtgtaccagagaagaattcactcgtaaggtcaggtcgaacgccgcacttggcgcaattttcactgatgaaaataaatggaaatctgcccgcgaggctgtggaggactcgagattttgggaactagtagatagggaacgtaatcttcacttagaaggcaaatgtgaaacgtgtgtttataatatgatgggtaaaagagaaaagaaattaggagaatttggtaaggccaaaggttcgcgtgccatatggtatatgtggttaggagctcgttttttggaatttgaggcattgggctttctaaatgaagatcattggttctcgcgtggaaatagtctttctggcgtcgaaggtgaaggattgcatcgacttggatacatactccgagacgtaggcaaaaaagaaggaggggcaatgtatgccgacgatacagcaggttgggacactcgcataactttggaggatttaaaaaatgaagaaatggtcaccaatcatatgaaaggagaacataagaaactagcagaggcgattttcaaattaacctatcaaaataaggtagtacgagtacaaagaccaacgcctagaggtaccgtaatggacataatctcgagacgtgatcaacgtggatcgggccaagtgggaacatacggattaaacacatttacgaacatggaagctcaacttatacggcaaatggaaggcgagggaatctttaaaagtattcagcatttaaccgcaactgaagaaatagcagtacaaaactggctagctcgtgtaggtcgagaaagactatctcgtatggctataagcggagacgactgtgtagtaaaaccaattgatgatcgatttgccagcgcgctaaccgcactaaatgatatggggaaagtcagaaaggacatacaacaatgggaaccttcgcgaggatggaacgactggactcaagttcctttttgtagtcatcatttccatgaactagtaatgaaagatgggcgggtgctcgtggtaccatgtcgaaatcaagatgaacttattgggagagcgcgaataagtcaaggagcaggatggtcattaaaagaaacggcgtgcttaggaaaaagctatgcgcaaatgtggacacttatgtactttcatagacgcgatttaagactagcagctaatgcgatatgttcggcagtaccgtcccattgggttcccacctccagaaccacctggagcatacacgccaagcatgaatggatgactacggaagacatgctggcagtatggaacagagtttggatacaagaaaacccatggatggaagataagacaccagtagaaagctgggaagaggtaccttatctcggtaaaagagaagatcaatggtgtggctccttgatcgggttaacatccagagctacatgggccaaaaacatacagacggctataaatcaggtaagatccctcatcggcaatgaagagtacactgattatatgccctctatgaagaggtttcgccgagaagaagaagaagcaggcgtactctggtaa

SEQ ID NO: 22426 - RNA, 9876 nt, synthetic construct
  misc_feature 1..9876: note = derived and/or modified CDS sequence (opt6) from DENV-2__FJ850121__SS-prME
  source 1..9876: mol_type = other RNA
acagcgggagttattgtaatgttgataccaaccgctatggcgtttcacctcaccacaagaaatggagaaccacatatgatagtaggaaggcaagaaaaaggaaaaagtcttctgttcaaaacagaagatggcgttaatatgtgcacactaatggcaatagatcttggtgaactatgcgaagataccataacttacaaatgtcctttgttacgccaaaacgaaccggaagacattgattgctggtgtaattcaacatctacctgggttacatatggaacatgtacaacaacaggcgaacataggagggaaaaacgtagtgttgccttagtacctcatgtgggtatgggacttgaaacaagaacagaaacatggatgagcagtgaaggagcttggaaacacgtacaacgaatagaaacatggatattgagacatccgggatttactatcatggcagctatactagcttatactattggaacaacacattttcaacgtgcattaatatttatactactaactgcagttgctccctcaatgaccatgcgttgtatcggaatttctaatagagatttcgtagaaggagtctctggtggatcctgggtagatatcgtactcgaacacggatcatgtgtaaccacaatggctaaaaacaaacccacgttagatttcgaattaatcaaaacagaagcgaaacaacccgcaacccttagaaaatattgtattgaagcgaaactaaccaacacgacgaccgaaagtagatgtccaacgcagggagaaccatctttgaatgaagaacaagacaaaagatttatatgtaaacacagtatggtcgatcgaggctggggaaatggatgtggactctttgggaaagggggtatcgtaacttgcgctatgtttacatgcaagaaaaatatggaaggaaaaatcgtgcagccagaaaacctagaatatacgatcgtcattaccccacacagcggggaggagcacgcagttggaaacgacactggtaaacatggcaaagaaataaaaataacacctcaatctagcataactgaagccgaattaacgggttacggaactgtaacaatggaatgttcgccaagaaccggactagattttaatgaaatggttctactccaaatggaagacaaggcttggctagtacaccgacaatggttcctagaccttcccctgccatggctgcctggggcagatacacaaggttctaattggatacaaaaagaaactttagtaacattcaaaaaccctcatgccaagaaacaggacgttgtagtactagggtcgcaagaaggagcaatgcatactgctctgactggagccacggaaatccagatgtcaagcgggaacctactatttacaggacatctaaaatgtcgactcaggatggataaacttcaacttaaaggtatgtcatactctatgtgtactggcaaattcaaaatcgtaaaagaaattgcggaaactcaacacggaacaattgtaattagagttcaatatgaaggcgatgggagtccgtgtaaaattccattcgaaataaccgacctagagaaaagacatgttttagggcgattaataacagtgaatccaatcgtaacagaaaaagattcacctgtaaacattgaagccgaaccacccttcggagatagttacataataatcggagtagaaccaggacaactaaaattaaactggtttaaaaagggttcaagcataggccaaatgtttgaaacgacgatgcgcggagcgaaacgtatggctatactaggagatactgcttgggattttggcagtttaggaggtgtatttacaagtatcgggaaggctttacaccaagtatttggagctatatatggggcggcatttagtggagtatcttggactatgaaaatactcattggagtgataattacatggattggaatgaacagtagatcgacatcattaagtgtgagcctagtcttagtgggcgtagttacactctatttaggagctatggtgcaagcagactcaggttgtgtagtaagctggaaaaataaagaacttaaatgcggatcagggatatttataacagataatgtacatacatggactgagcagtataaatttcaacctgagtcaccgagcaagctagcgtcagcgatacagaaagcccatgaggaaggaatttgtggtatcagaagcgtgacaagattagaaaatctgatgtggaaacagattacgcccgaattgaaccacattttatcagagaatgaagtaaaattaaccatcatgactggcgatatcaaaggtattatgcaggccggcaaacgttctctcagaccccaaccgacagaattaaaatattcatggaagacctggggaaaagccaagatgctcagcaccgaaagtcacaaccaaacattcctcatagatggaccagaaacggcagagtgtcccaacaccaatcgtgcatggaactcactagaggtagaggattatggattcggggtgtttactacgaacatatggcttaagttaagagaaaagcaagatgtcttctgtgattcaaaactaatgtcagctgccatcaaagataaccgagcagtgcatgcagatatggggtattggatagaatcagcccttaacgacacctggaaaatggagaaagcatcattcatagaagttaaatcctgtcattggccgaaaagtcacacactgtggtctaacggtgtattagagtcagagatgataattcctaaaaattttgcggggcccgtatcacaacacaactatagacccggataccatacacaaaccgcaggaccctggcacttaggtaaattagagatggatttcgacctctgcgaaggcacaacagtagttgtcactgaagactgcggtaacaggggcccaagcctcagaacgacaactgcaagtgggaaactaataacagaatggtgctgtagatcttgcacactaccaccactaagatatcggggagaagatggatgctggtatggtatggaaattcgcccactgaaagaaaaagaagaaaacttagtaaatagcctagttacggcgggtcacgggcagattgataatttctcattgggagtattagggatggcactatttttagaagaaatgttaaggacgcgtataggaacaaaacacgtgactctgttggtagcagtctcatttgtaacgttaataacaggtaacatgagttttcgggacctcgggagagtcatggttatggtcggggctacaatgaccgacgatataggaatgggagtaacatatttggcattattagccgcattcaaagtaagaccgacattcgcagcagggttgttattaagaaaactaacaagtaaagagctcatgatggcaactatcggtatagcattgctaagtcagtctacaatcccggagaccatccttgaattgaccgacgcattagccttaggtatgatggtattaaagatagtacgcaacatggagaaatatcaattggcagtaacaattatggcaataagttgtgtacctaatgccgttatattacaaaacgcctggaaagttagctgtacaatcctagcagccgtctcagtcagccctctattacttacaagcagccagcaaaaagcagattggattccacttgccttgactataaagggtctcaatcccaccgctatatttctaacaacgttgagtcgaaccagtaagaaaagaagctggcctctcaacgaagcaataatggcagtcggtatggtgagtatattagctagctcactactgaaaaatgatatacctatgactggcccgctagtagcgggaggtctactcacagtttgctacgtacttactgggagaagcgcagatctggagctagaaagagcagccgatgtcaaatgggaagatcaagcggagataagcggttcatcaccaatactatcaatcacgataagcgaagatggaagcatgtcaatcaaaaatgaggaagaggaacagaccctcactattttaatcagaacgggactcttagtcatcagtggggtctttccagtatcaatacctattactgccgctgcgtggtatctgtgggaggtaaagaaacaaagggctggtgtgttgtgggacgtaccaagtccccctccagtagaaaaagcagaactagaggatggtgcatatagaattaagcaaaggggcatactaggatactcccaaataggcgctggcgtctataaggaaggaacttttcatacaatgtggcatgtaacaagaggtgcagtcttgatgcacagaggaaaacgaatagaacctagttgggctgatgtcaagaaagacttaatatcatatggcggaggttggaaactagaaggagagtggaaagaaggcgaagaagttcaggtcctcgcattagaaccgggaaagaatcctagggctgtccaaactaaaccaggaattttcaaaacgaacacaggcactataggagctgtctcgctagatttttctccaggaacaagcggatctcctatagtggacagaaaaggaaaagtggtgggactttatggcaacggggttgtcacacgctccggagcgtacgtttccgcgattgcacaaacagaaaagtctatagaagataacccggaaatcgaggacgacattttcaggaaaaagagacttactatcatggacttacatccaggcgcaggaaagacgaaaagatacttgcccgcaatagtgagagaagcaattaaacgtggattacgcacacttatcctagcaccgaccagagtcgtagctgcggaaatggaagaggcgctaagggggcttccaattagatatcaaactccggcaataaagacagaacacaccggaagagaaattgtagatctaatgtgtcacgcaaccttcacaatgcgattattaagccctgtacgagtacccaattataaccttataattatggacgaagcgcacttcacagatcccgcttctatagcagcaaggggatacatctcaacccgcgtagaaatgggagaagccgcaggcatctttatgacagcaaccccacctggaagcagagatccatttccccaatcgaatgctcctatcatggacgaagaacgtgaaattccagaacgaagttggaactctggtcacgagtgggtaacggatttcaagggtaaaacagtatggtttgtaccatccattaaagccgggaatgacatagcagcgtgtctacgaaagaatggaaagaaagttatacaactatcgcgtaaaacctttgatagtgaatatgtgaaaactcgtgctaatgactgggacttcgtcgttacaaccgacataagtgaaatgggtgcaaactttaaagcagagcgtgttatagatcccagaagatgtatgaagcctgtgatacttaccgatggtgaagaacgtgttattctagccggacctatgccagtaacccatagtagtgctgcccagcgaagaggcaggattggacgtaaccctaaaaacgaaaatgaccaatatatctacatgggcgagcctttagaaaatgatgaagactgtgcacattggaaagaagcgaaaatgctgttagataatatcaatacgccagaaggaattatacccagtatgtttgaacctgagcgtgagaaagtagacgcaatcgacggtgaatatagattgaggggagaagctcgaaaaactttcgtggatttaatgcgtagaggggacctaccggtttggctcgcatataaagtggcagctgaaggaattaactatgccgatcgaaaatggtgtttcgatggaataaagaataatcaaatcctagaggagaatatggaagtggaaatatggaccaaagaaggcgaaaggaagaaattgaaacctagatggttagatgcaagaatctactcagacccattggcattaaaagaatttaaagaatttgcagcgggccggaaatctctgacactaaatttgatcacggaaatgggcaggctgccaacatttatgacacaaaaagcaagaaatgcattagacaaccttgcagtccttcacacagcagaagcagggggaagggcttataatcatgcactatcagaattacccgaaactcttgaaacgctacttctgctaactcttctagcaactgtcaccggcggtattttcttatttttaatgtcagggaaaggaataggtaaaatgactttgggcatgtgttgcattataacagcaagtatattgctttggtacgctcaaatacagccccattggatagccgctagtattatactcgaatttttcttaatagtattgctcatccccgaaccagaaaaacaaagaacaccgcaggataatcaattgacatatgttgtcatagcgatcttgactgtagtagcagctacaatggcaaacgaaatgggatttttagagaaaacaaagaaagatttgggcctaggtagcatcacgactcaagagtccgaatccaacatactagatatagaccttagaccagcgtcggcatggacgttatacgcagttgcgacgacctttgtaaccccgatgctccgacatagtattgaaaattcatctgtcaatgtctcattgacagcaatagcaaatcaggcaacggtgctaatggggctgggcaagggatggcctctgtctaaaatggatatcggagtcccactattagcaattggatgctattcccaggtcaatccaatcacattaacagcagcattattactgctcgtagcacactatgccattattggtcccggactccaagcgaaagccacacgagaagcacaaaaacgagcggcggctggtataatgaaaaatcccacagtggatggtataaccgtgatagacctagagcccattccttacgacccaaaatttgaaaagcaactagggcaagtaatgctgttaatcttatgcgtaactcaggttcttatgatgagaaccacatgggctttatgtgaagcgctaacccttgctacagggccgatttcaactttgtgggaaggaaacccaggacgattttggaacacaactatagcagtgtctatggctaacattttccgaggttcatacttagctggtgcaggcttattattcagtatcatgaaaaatacgacaaatacacgtagaggtacaggaaatataggtgagacactaggggaaaaatggaaaagtaggttaaacgcattaggcaaatcagaatttcaaatatataagaaatcaggcatccaggaagtagatagaacactagcaaaagaaggaatcaaaagaggcgagacagaccaccatgccgtaagtcgaggttcggcaaaattaagatggttcgtagaaaggaatatggtaacaccagaaggtaaagtcgtcgatttgggttgcggcaggggcggctggagttattactgtggtggactaaagaatgtccgggaggttaaaggacttacaaaaggtgggcccgggcacgaagaaccgattcctatgagtacatatggatggaacctcgtacgtctgcaatcgggagttgacgtgttctttacaccacccgagaaatgcgacacactcttgtgtgatattggcgagtctagtccaaatcctacgatcgaggccggtaggacattaagggtattaaacctagtagagaattggcttaacaacaacacacaattttgcatcaaggtactcaacccctatatgccatccgttatcgagaaaatggaagcattacagcgaaagtatggtggtgcactcgtaaggaatccattatccaggaatagtactcatgaaatgtattgggtttcaaatgctactggtaatattgtttcatcagtaaatatgatctcgagaatgctaattaacaggttcacaatgaaacacaagaaagcaacctacgaaccggatgtagatttgggttcaggaacgaggaatatcggtattgaaagtgaaataccaaatctagatataataggaaaaaggattgaaaagatcaagcaagaacacgaaacatcatggcactacgaccaggaccacccttacaagacttgggcttaccacggatcgtatgaaactaaacaaactggttcagcatcaagcatggtgaacggtgtagtgaggctcctcacgaaaccatgggacgtagtccccatggtaacacaaatggccatgacagacaccacaccatttggtcaacaacgtgtattcaaagaaaaagtagacactaggacacaagaaccaaaggaaggaaccaagaaattaatgaaaatcactgccgaatggctttggaaagagttgggaaagaagaaaactccgagaatgtgtacgcgcgaagaatttactagaaaagtaagatctaacgcggcactgggtgcgatcttcactgacgagaacaaatggaaaagtgcaagagaagccgtggaagacggcaggttttgggagctcgtggatagggaaaggaacctacatcttgagggtaagtgtgaaacatgtgtttacaatatgatgggaaaaagggaaaagaaacttggagagttcgggaaggccaaaggctcccgagcgatctggtatatgtggctaggtgctaggttcttagagtttgaagctcttggcttcttaaatgaagatcattggttcagtagaggtaatagcctcagcggggttgaaggagagggtctacaccggttagggtacatattgcgcgacgtcggcaagaaagagggtggggcgatgtacgctgacgatacggcaggatgggacactagaatcacactagaagacctgaaaaacgaagaaatggttaccaatcatatgaagggagaacataagaaattagccgaagcaatttttaaactcacatatcaaaacaaggtagtgcgtgtacagcgcccgaccccgcgaggtactgtaatggatataataagtagaagagaccaacggggaagcggacaagtcggaacatacgggttaaacacgttcaccaacatggaggcacaattaatcagacaaatggagggggaagggatttttaaatccattcaacacctaacagcgaccgaagagatagccgtacaaaactggttggcaagagtaggaagagaaaggttatcacgcatggcaattagcggagatgattgcgttgtaaaaccaatagacgaccgatttgcatcagctttaacagccttgaacgatatgggaaaggtaaggaaagacatacaacaatgggaaccatctaggggatggaatgactggacacaagtgcctttctgtagtcatcatttccacgaacttgtaatgaaagatggacgagtacttgtcgtgccttgtaggaatcaggatgaattaattgggagggcacggataagccagggagcaggctggtcattaaaagaaacagcgtgtttaggcaagtcgtatgcacaaatgtggacattaatgtactttcataggagggacctccgactagctgcaaatgccatatgctccgcagtaccaccccactgggtgccgacatcacggacaacttggtcgatccacgcaaaacatgaatggatgaccactgaagatatgcttgcagtttggaacagagtttggatccaagagaacccgtggatggaagacaaaacgcccgtggaatcttgggaagaagtaccatatttaggcaagagagaagatcagtggtgcggttcacttatcggattaacctcacgagcgacatgggctaaaaatatacagacggcaataaatcaggtcagatcattgatcgggaatgaggaatataccgattatatgccatctatgaaacggtttcgtcgagaggaggaggaagctggcgttttatggtag

SEQ ID NO: 22427 - RNA, 9876 nt, synthetic construct
  misc_feature 1..9876: note = derived and/or modified CDS sequence (opt6) from DENV-2__GQ199897__SS-prME
  source 1..9876: mol_type = other RNA
acagcaggagtaatagttatgcttattcccaccgctatggcttttcacttaacgacacgaaacggagaacctcatatgattgtggggcgccaagaaaaaggcaaaagtcttttgtttaaaacagaagacggagtaaacatgtgtactctaatggcaattgatctgggtgaattatgtgaagacactattacctacaaatgtccattgttaagacaaaacgaaccagaagacatagattgctggtgtaactctacatctacgtgggttacatatggtacttgtactaccacaggcgaacacagacgagaaaaacgatcagtagcgcttgtacctcatgtaggaatgggactcgaaacgcgcacagaaacgtggatgagtagtgaaggtgcatggaaacacgtacaacgcatagaaacatggatactaagacaccctgggttcactataatggcagcaatactggcgtatacaatagggaccacccacttccaaagagcattaatatttatactgttaacagctgtagcaccttccatgacaatgcggtgtattggaataagtaatcgagattttgtagaaggagtatctggaggaagttgggtagacattgtcttagaacatgggagttgtgtgacaacaatggccaaaaacaaacctacactcgattttgaacttataaaaactgaagctaaacaacctgcgactttgcgaaaatattgtattgaagcaaaacttacaaatactacgacggaatctcgttgtccaacacagggagaacctagtttaaacgaagaacaagataaacgattcatatgtaaacactcaatggtagaccgcggatggggcaatggatgcggattgtttggtaaaggaggtattgtaacctgcgcaatgtttacctgtaagaaaaacatggaagggaaagtcgtgcaaccagaaaatttggaatacacaattgtaataaccccgcactcaggtgaagaacatgcagttggaaacgacacaggaaaacacggaaaagaaatcaaaattaccccacaatcatcaataacagaagcagaactaaccggctacggaacagtaactatggaatgctcaccacgaactggactcgactttaacgaaatggtacttttacaaatggaagataaagcctggcttgtacaccgacaatggttcctcgaccttcctctcccgtggcttcccggagctgatacccaaggaagtaactggatacaaaaagaaactttagtaaccttcaaaaacccacacgcaaagaaacaggatgtagtagtactaggaagccaagaaggcgcaatgcatacggcacttacaggtgctacagaaattcaaatgtcatctggaaatttgttattcactggacatttaaaatgtaggctaagaatggacaaactacaactaaaaggaatgtcatattcaatgtgcacgggcaaattcaaaatagtgaaagaaatagctgaaacgcaacatggaaccatagtcataagggtacaatatgaaggagatgggtccccctgcaaaataccgtttgagataaccgacttagagaaaagacatgtgcttggaaggttaattacggtcaaccctatagtgaccgaaaaagattcaccagtgaacatcgaggcggaacctcccttcggagattcctatataatcattggggtagagcctggacagctaaaattaaattggtttaagaaaggtagctcaataggacagatgtttgaaactacaatgcgcggagcaaaacgaatggctatactcggcgatacggcttgggactttgggagtctaggcggtgttttcacttcaataggtaaggctttacaccaagtatttggtgcaatctatggggccgctttttcaggagtgtcttggactatgaaaatactaataggcgtaataataacatggattggaatgaatagtcgaagcacaagtctgtccgtttcgttggtactggtcggggtagtgacattatatttaggtgctatggtacaagccgattcaggatgtgttgtctcatggaaaaataaggaattgaaatgtggatctgggatatttataacagacaacgtccacacctggactgaacaatataaatttcaaccggaatctccctctaaattggcaagtgccatacaaaaagcgcacgaggaaggaatttgtggaataagaagcgtcactcgtctagaaaatctaatgtggaaacaaattacccctgaacttaatcacatactctcagagaacgaagtaaaactgacaattatgacgggagacataaaaggaatcatgcaggcaggaaagcgttctcttcggccacagcccacggagcttaaatacagttggaaaacgtgggggaaagcgaaaatgctaagcacagagtctcataaccagactttcttaatagatggcccggaaacagccgaatgccctaacacaaatcgtgcttggaactcactggaggttgaagactacggctttggcgtatttacgactaatatctggctaaaactaagggaaaaacaagatgtattttgtgatagtaaactaatgtctgccgccattaaggataatagggccgtacatgctgacatggggtactggattgagagtgcacttaacgatacctggaaaatggaaaaagcatcatttatagaagtaaaaagttgtcactggcccaaatctcacactctctggagcaacggcgttttggaatccgaaatgatcatccccaaaaactttgcaggtccggtgagccaacacaattataggcccgggtatcatactcaaacagcaggcccttggcatttagggaaacttgagatggacttcgatctctgtgaaggaaccaccgttgtggttacagaggattgcggcaaccgggggccttcgttaaggactacaactgcttcaggcaagctaatcactgaatggtgttgccgtagctgtacattacccccactcagatacagaggtgaagatggatgttggtatggtatggaaattcgaccattaaaagaaaaagaagaaaacctggtaaatagcttagtaactgctggacacggacagattgataatttttccttaggagttcttgggatggctttgtttttagaggaaatgttaagaacaaggatcggaacgaaacacgctatcttgctagtcgcggtcagttttgttactcttattacaggcaacatgtcattccgagatttaggcagagtaatggtaatggttggagcaacaatgacagacgatataggtatgggtgttacgtatcttgcccttctagcagcctttaaagtccgtccaacctttgcagccggattgcttctcagaaaactcactagcaaggagctaatgatggcgaccataggaatagcactactatctcaatcaactatacccgagacgatactggaattgactgatgcgctagcgctaggcatgatggtcttgaaaatcgtaaggaatatggaaaaataccaattagcagtaactataatggctattagttgcgtaccaaacgcagtcatcttacagaacgcttggaaggtgagttgtactatactggcagctgtttccgtgagtcccttattattaacttctagtcagcagaaagctgattggataccgctcgccttaactatcaaaggattaaacccgacagcaattttcttgacaacactctcaagaactagcaagaaaagaagttggcccttgaatgaagccattatggccgttggtatggtttcaatcttagcgtcgagcctgttgaaaaacgatatacccatgacgggacccctagtagcgggagggttactaaccgtatgttacgtattgacaggaagatcagcagatctggaattagagcgcgcagcggatgtaaaatgggaagaccaagcagagataagcggatcaagtcctatactatcaataactattagtgaagacggtagcatgagcatcaaaaatgaggaggaggaacaaaccctcactatattaattagaacaggcttgctggtggtatctggagtctttccagtgtccatacctataacggcagcggcttggtacttatgggaagtcaagaaacaaagagcaggagtactctgggatgtcccgagcccaccacctgttgaaaaagccgagttagaggacggtgcatacagaataaaacaaagaggaatcctaggatatagtcaaatcggtgctggagtttataaagagggtacttttcacacgatgtggcatgtaacacgaggagctgtcttaatgcatagaggcaagaggatagaaccttcatgggccgacgtaaagaaagatctgatttcatatggcggaggctggaaactagaaggcgaatggaaagaaggagaagaagtacaggtcttagcactagaaccaggcaaaaatcctagagctgtgcaaacgaaaccaggtatattcaaaacaaacacaggtacgatcggtgccgttagcttggactttagtcctggaacctccggatcaccgatagtggacaggaaaggtaaagttgttggattatatggaaatggtgttgttactagatccggagcgtacgtgagtgcaatcgcacaaaccgaaaaatcaatagaagacaatcccgaaatcgaagatgatatatttcggaagaagagattaacaataatggatcttcacccgggcgctgggaagacaaagaggtacctaccagcgatagtaagggaagctatcaaaaggggcctgagaacactgatattagcccccacacgtgtagttgcagcagaaatggaggaagcattacggggtttaccgatccgatatcagaccccagcaataaaaaccgaacacactggacgagagatcgtagacctaatgtgccacgctacatttacgatgcgtcttctgtctccagtaagagtacctaattacaatctcattataatggatgaagcacacttcacagatcccgctagtatagctgctcgagggtacatatcaacaagagtcgaaatgggggaggccgccggcatatttatgacagctactcctcctggcagcagagatccatttcctcaatcaaacgcccctatcatggatgaagaaagagaaattcctgaacgctcttggaactccggacacgaatgggtaactgactttaaaggaaaaaccgtgtggtttgtaccttcgatcaaagctggtaatgatattgcggcgtgtctaaggaaaaatggaaagaaagttatccaattgtctcgaaaaacatttgatagcgaatatgtcaaaactcgggccaacgattgggactttgttgtaacaacagatataagtgaaatgggagcaaatttcaaggctgaacgtgtaattgatccgagacgctgtatgaagccagtaattcttactgacggtgaggaaagggtgatattagctgggcccatgcccgtaacgcacagtagtgccgcccaaagaagaggaagaatcggacgtaatcctaaaaatgaaaatgaccagtatatatacatgggagaaccattggagaatgatgaggactgtgcacactggaaagaagcaaaaatgcttctcgataacataaatactccagaagggattataccatcaatgttcgaacctgaaagggaaaaagtcgatgctatagatggtgaatacagattaagaggagaagctcggaaaacatttgtcgatctaatgagaaggggagatctacctgtttggttggcgtataaagtcgctgcagaggggattaactacgccgatagaaagtggtgttttgatggtatcaaaaataatcaaatactagaagaaaatatggaagtagaaatatggaccaaagaaggggaaaggaagaaactaaaaccaagatggcttgatgccagaatttatagcgatccactagcgcttaaagaatttaaagagttcgcggcaggacgcaagtcgcttactctgaatcttatcacggaaatgggcagattaccaacattcatgacacaaaaagcacgaaacgcactggataacttagccgttctacatacagcggaagcaggaggacgagcatataatcatgccctttcagagctcccggaaacacttgagacactattactattgacactgctggcgacagtgacaggcggcatattcctatttctcatgagtggaaaaggaattggtaaaatgacacttggtatgtgttgcattataacggcatcgatattactttggtacgcgcaaatacaaccacattggatagctgcgtcaataattttagagttctttctaatagtactgctgattccggaaccagaaaaacaaaggacaccccaggacaaccaactcacttacgtagtcatagcaatactgacggtcgtagccgcaacgatggcaaacgaaatgggattcctggagaaaaccaagaaagatctaggcctaggaagtattaccacacaagaatctgaatcaaatatactcgatatcgatctacgaccggcgagtgcatggaccttgtatgcagtcgcgactacgtttgtcacaccgatgttgagacactcaattgaaaactcaagcgtaaacgttagtttaacagcgattgcaaaccaagctacagttttaatgggacttggcaagggctggcctctcagcaaaatggatattggtgtccccttactagcaatcggctgctatagtcaggtcaatccgattacgttaacagcggctttgctcttactggtcgcgcattacgcgataattggaccagggctccaagcaaaggctacgagagaagcgcagaaaagagctgccgccggaataatgaagaatccaacggtcgacggaattacggtaattgatttggaacctataccatacgatcctaaatttgagaaacaattaggtcaagttatgttattaatattatgtgtaactcaggtgttgatgatgcgtacaacatgggcattgtgtgaggctctaacacttgcaaccggacccattagtacactatgggaaggcaaccccggacgtttctggaatacaacgatcgccgtcagcatggctaacatttttagagggtcgtatctagctggcgcgggattactattttctataatgaaaaatacaactaacaccagaagaggtacaggcaacattggagaaacacttggagaaaaatggaaatcaaggttaaacgcattaggaaagtcagaatttcaaatatataagaaaagtggtattcaagaagtagatagaacacttgctaaggaaggtataaagagaggcgaaacagaccatcacgccgttagccgagggtcagctaaactaagatggtttgtagagagaaatatggtaacaccagaaggaaaagtggtagatttgggatgtggcaggggaggatggagttattattgcggtggtctaaagaacgtccgggaagttaaaggcctaacgaaagggggtccaggacacgaagaaccaataccaatgagcacctatggatggaatcttgtcagacttcagagcggggtagacgtgttcttcacaccaccagaaaaatgcgacacactgctctgtgacataggagaatccagccctaacccaactattgaagcggggagaaccctgagagtgttaaacctagtagagaattggctcaataataacacacaattctgtattaaagtacttaatccatatatgccgagtgtgatagagaaaatggaagcactacaacgtaaatatggcggagcacttgtacgaaacccactatcaaggaatagtactcacgaaatgtattgggtatctaacgctacaggaaatattgtaagtagtgtcaatatgataagtagaatgttaataaacagatttacaatgaaacataaaaaggcaacttacgaaccagacgtcgatctaggtagtggaactagaaacatcggcatagaatcagaaatacccaatctagatataattgggaaacgaatagagaaaataaaacaagagcatgaaacatcatggcactacgaccaagaccacccttacaaaacatgggcgtatcacggttcatatgaaacaaagcaaacggggtcagcttcctcgatggtaaatggcgtagtgcggttgctaacaaaaccatgggatgtagtaccaatggttacacaaatggctatgacagacactactcctttcggacaacagagggttttcaaagaaaaagtagacacacggactcaggaacctaaagaaggaacgaagaaactaatgaagattacagcagaatggctatggaaagaattaggtaagaagaaaacaccccggatgtgtacacgtgaggaatttacacgcaaagtgcgttccaatgctgcactcggtgcaatatttaccgacgagaacaaatggaaatcagctagagaagcagtagaagatggaaggttttgggaattagtagatagggaacggaatctacacctcgaagggaagtgcgaaacttgtgtttataacatgatgggcaaacgtgagaagaaattgggagagttcgggaaggcaaagggatcaagagcgatatggtacatgtggcttggggctcggtttttggagttcgaagcccttgggtttctaaacgaagaccactggtttagtcggggtaatagtttatcaggtgtagaaggcgaaggtcttcatagactaggatatatattgagagatgtaggtaaaaaggaaggaggtgctatgtatgcggatgatacagcaggatgggacactcgaattacactagaggacctcaaaaatgaagaaatggttacaaaccatatgaagggtgaacacaaaaagttagctgaagcaatcttcaaattaacctaccagaacaaagtcgttagagttcaacgaccgacacctcgtggtacagtcatggatattatatcaagacgagatcaaagaggcagtggacaggtaggtacgtatggtctaaatactttcacaaacatggaagctcagctcatcagacaaatggaaggtgagggaatttttaaatccattcaacatctaacggcgacagaagaaattgccgttcagaattggttggctagagtaggaagagaaagattaagtaggatggctatatctggagatgactgcgtggttaaacccattgacgatcgttttgcgtcagctttaaccgcacttaatgatatgggaaaggtgcgcaaagatatccagcagtgggaaccttccagaggatggaatgactggacccaagtgccattttgttctcaccatttccacgaattagtgatgaaggacggtagggttctagtagtcccttgtcgaaatcaagatgagctgattggtcgtgcacgaatttcacaaggggcaggatggtctttaaaagaaactgcctgtttaggaaaatcatatgctcaaatgtggacactaatgtactttcacagacgagatctacgcttggcagccaacgcaatttgttcggccgttcctccgcattgggttcccaccagtcggacaacttggagtatccacgctaaacatgagtggatgacgaccgaggatatgttagccgtttggaatcgcgtgtggatacaagagaacccatggatggaagataaaaccccagttgagtcttgggaagaagtaccatacctagggaagcgagaagatcaatggtgtggatctttgattggactcacaagtcgagccacatgggccaaaaatattcaaactgcaattaaccaagtaagaagtttaattggcaatgaagaatacacagattacatgccaagcatgaaacgatttcgacgcgaagaagaggaggcaggagttttgtggtga

SEQ ID NO: 22428 - RNA, 9876 nt, synthetic construct
  misc_feature 1..9876: note = derived and/or modified CDS sequence (opt6) from DENV-2__GQ199895__SS-prME
  source 1..9876: mol_type = other RNA
actgcgggagtaattgtgatgttaataccaacagcgatggctttccatctaaccaccaggaacggtgaacctcatatgattgtaggtcgacaagaaaaaggcaaatcgcttttattcaaaaccgaagacggagtgaatatgtgtactttaatggcaattgacctaggggaactttgtgaagatacgataacctataaatgtcccttactacgtcagaacgaaccagaagacatagattgttggtgtaattcaacatcaacatgggtgacttacggaacctgtacaacaacgggggaacaccgaagagaaaaacgcagcgtagcattagttcctcacgttggaatgggattagaaacgcgtacagaaacctggatgagttctgagggtgcatggaaacacgtgcaaagaattgagacatggatccttcgacatcctggtttcacaataatggcagccatattggcatatacaataggtacaacacactttcaacgagctctaatatttatcctgctaacagcggtagcccctagtatgacaatgcgttgtatcggcatttcaaatagggatttcgtagaaggagtttcgggcggaagttgggttgacatcgtcctagaacacgggtcttgcgtcacaacaatggctaaaaataaacctactttagattttgaattaataaaaacagaggccaaacaaccagcaacactccgaaaatattgtattgaagccaaactaacaaatacaacaacagaatcccgttgccctacccaaggcgaaccatctttgaacgaggagcaagataaacgattcatctgtaaacacagtatggtagaccgcggttggggaaatggatgtggtctatttggcaaaggtggtatcgtgacctgtgccatgtttacatgtaagaaaaatatggaagggaaagtagttcaaccagaaaatctcgagtatactatagttattactccccactctggcgaggaacatgcggttgggaatgatactggcaaacacggcaaagagataaaaattacaccgcaatcctcaatcacagaagcggagcttaccggatacggcacagtcactatggaatgttctccaagaacaggacttgacttcaacgaaatggtattactccagatggaagataaagcatggctcgttcatcgacaatggtttctcgatctaccactgccctggctcccaggtgctgatacgcaaggttcaaactggatccaaaaagaaactttagtaacttttaaaaatccgcacgctaagaaacaggatgttgtagtccttggatcacaggaaggagcaatgcacactgcattgacgggagctactgagatccagatgagttctggaaacttattatttacaggccatctaaaatgtagacttaggatggacaaacttcagcttaaaggtatgtcatatagtatgtgtaccggcaaattcaaaatagtaaaagagatagctgaaacacaacatgggacaattgttattagagttcaatacgagggagacggttcgccttgcaaaattccgtttgaaattactgacctagagaaaaggcatgtactaggacgattaataaccgttaaccctatagttaccgaaaaagacagtcctgtaaatatagaagctgagcccccttttggtgatagctatattattatcggagtggagccgggacagttaaaactaaattggtttaagaaaggtagttcaataggccaaatgtttgaaaccacgatgagaggggctaaaaggatggctatactcggtgatacagcatgggatttcggtagcttaggaggagttttcacgagcatcggcaaagcacttcaccaggtattcggagctatatacggcgctgcatttagcggcgtatcatggactatgaaaatactgataggtgtcattattacctggatcggcatgaactccagaagtacctcactctcagtatcgttagtcctagtaggagtcgttacattgtatttaggagcgatggtccaagctgattccggatgtgtcgtcagttggaaaaacaaagaattaaaatgcggatcagggattttcatcacagataacgttcatacatggacggagcaatacaaatttcaaccggaatccccttcaaaacttgcaagtgcgatccaaaaagcgcatgaagaaggaatatgcggaatacgctctgttaccaggcttgagaatctaatgtggaaacaaataacaccggaactgaaccacattttatctgagaatgaggtgaaactaactattatgactggtgatatcaaaggcattatgcaagcgggcaaaaggtctttgcgcccgcaacccacagaactaaagtactcctggaaaacctggggtaaggctaagatgctcagtactgaatctcacaatcaaaccttcttaatagatgggcccgaaactgcagaatgtccaaatacgaatagagcttggaactcactagaagtcgaagactacggtttcggggtgtttaccacgaacatttggttaaagctaagagaaaagcaagacgtcttttgtgattctaagctaatgagcgcggctattaaagataaccgagcagtccatgcagatatgggatattggatagagagtgcgctaaatgacacttggaaaatggaaaaagcctcttttatagaggttaaatcttgtcattggccaaagagtcataccctgtggagtaatggggttttggaatcagagatgattatacccaagaatttcgcagggcccgttagtcagcataattacagaccaggataccatacgcaaacagcgggaccgtggcacctgggaaaacttgaaatggacttcgatttatgtgaaggtacgacggtagttgtcacagaagattgcgggaaccgaggaccgagccttaggaccaccactgcatcaggtaaactgattaccgaatggtgctgcaggagctgcacacttccaccattgcgatatcgtggagaagatggttgctggtatggtatggaaattcgtcctttaaaagagaaggaggagaacttagttaatagcctagttacagcgggccatggacaaatagataacttcagcctaggggtgcttgggatggcgttatttctagaagagatgcttaggacacgaataggtacgaagcatgctattttgttagtagcggtttcttttgtaacactaattacaggtaacatgtcattccgtgatttagggagagttatggtcatggtcggtgcaacaatgacagatgatataggtatgggtgtaacctacttggctttgttagcggcctttaaggttcgcccaacgtttgccgctggacttctattacgtaaattaacaagtaaagaattgatgatggcgaccatcggaatagcattacttagtcaatcgacgatacctgaaacaattctggaattaacagacgcactagcactgggaatgatggtattaaaaatagtacgtaacatggaaaaatatcaactagcggtgactattatggcaatttcttgtgtaccaaacgccgtgatattacagaatgcgtggaaagtcagctgtactatcttagcagcggtatccgtatccccattgctactgacatcttctcaacaaaaggccgactggataccgttagcgttgacgataaaaggactaaatccaaccgcaatatttttaacaactttaagtagaacgtccaagaaacggtcgtggccgttaaatgaagcaatcatggctgtaggaatggtatccatactagcatcttcattattaaagaatgacatacctatgacaggtccattagtagcgggtgggctactaaccgtatgttacgtattgaccggtaggagtgcagatctagaattggaaagagcagcagacgtgaagtgggaggatcaagccgagatatcaggaagttctcctatattatccataacaattagtgaagatggaagtatgtctatcaaaaacgaagaagaggaacagactctaactatactcattagaactggactattagtaattagtggagtatttccagtctcaatacctataacggctgcagcatggtacctttgggaggtcaagaaacaaagggctggcgtcttatgggatgtgccctccccacctcccgttgaaaaggctgaattagaagatggagcatatcgtattaaacagcgaggcatactgggatatagtcagattggggctggtgtatataaagagggtacgttccacaccatgtggcacgtcacgcgcggtgccgtactaatgcacagaggaaaaagaatcgaaccatcatgggctgatgtcaagaaagatcttatttcatatggtggtggctggaaactagaaggtgaatggaaggaaggcgaagaggtacaagtgctagctctcgaaccaggcaaaaatccaagagcagtccaaaccaaaccgggtatattcaaaacaaacaccggaaccataggagctgtatcccttgatttctccccaggaacaagtggatcaccgattgtagaccgaaagggaaaagtagttggactatatggcaatggggtcgttacaagaagcggggcgtatgtatccgcaatcgcgcaaacagagaaaagtatagaggataaccctgagatagaagaggatatattccgtaagaaaagacttactatcatggacttacaccctggagctggaaagaccaagcgatacttgcctgctatagttcgtgaagccataaaaagagggttacggacgctcattctggcccctactcgggtagtagctgcagagatggaagaggcattacgagggttaccaatacgataccaaaccccagcgatcaaaacagagcacacaggacgcgagatcgtagatttaatgtgccacgcaactttcacgatgcgtctactaagtccagtaagggttcctaactataacctaatcataatggatgaagctcacttcacggatccagcatcaatagccgcgcgcggctatatcagtacgagggtcgagatgggagaagccgcaggaatattcatgacggcaacaccacctggttcgagagacccatttcctcagagtaatgcaccgataatggacgaagaaagagagataccagagcgatcgtggaacagcggacacgagtgggtcactgattttaaggggaaaacagtttggtttgtaccttcgataaaagccggaaacgatatagccgcttgtcttcgcaaaaatgggaagaaagtgatccaacttagcagaaaaactttcgactcagaatatgtgaaaacacgggcaaacgattgggactttgtagtaaccacggacatcagcgaaatgggagctaacttcaaagctgagagagtcattgacccaagacgctgcatgaaaccagtaattcttactgacggagaggaacgtgttattttagcagggccaatgccggtaacacattcaagtgcagcacaaaggagaggacgtattggccgaaaccctaaaaatgaaaacgaccaatatatttacatgggagaaccactagaaaacgatgaagattgtgctcattggaaagaagcgaaaatgctacttgacaatataaatactccagaaggcataataccgagcatgttcgaaccggaacgggaaaaggtagatgctatagacggtgaatatcgtctaaggggtgaagctaggaaaacgtttgtagacctaatgcgaagaggcgatcttccggtatggctagcatacaaggttgccgccgagggaattaattatgcagatagaaaatggtgtttcgatggaattaaaaacaatcagatacttgaagaaaatatggaagtagagatatggacaaaggaaggcgagaggaagaaactgaaacctaggtggctcgatgcacgcatttacagtgacccacttgcactgaaggagttcaaagaatttgctgctggcagaaaatctttaacgcttaatttgattacagaaatggggagattacctactttcatgactcagaaggcacgtaacgcactagataacttggctgtgcttcatacggcagaggcaggagggcgggcttacaatcacgcattgtcagaacttcctgaaacattagaaacattacttttacttacgcttcttgctactgttacaggaggaatatttttatttcttatgagtggcaaaggtattggaaaaatgactcttggaatgtgttgtataattacagcctcaatattactatggtatgcgcaaatccaacctcactggatcgccgcctccataatattggaatttttcctaattgtattattaataccggaaccggaaaaacaacgtacaccccaggataatcaattaacttacgttgtgatcgccatcttaaccgtcgtagcggcaactatggccaacgagatggggtttcttgaaaagaccaagaaagatctcgggcttggctcgataacaacccaagaaagcgagagtaatatactagacattgatttaaggcccgcgtccgcttggacattatacgccgtcgctacgacttttgtaacacctatgttaaggcacagcatagaaaattcctccgtaaacgtaagtcttactgcaatagcaaaccaagcaacagttttaatgggactaggaaaaggatggccgttatccaagatggacattggtgtgccactattagctataggttgttatagtcaggtgaacccgataacccttacggcagccttgttattacttgtcgcacattacgcaataatcggaccaggcctacaagctaaagcaacacgcgaagctcagaaacgtgcggcagctggaattatgaaaaaccccactgtagacggaataacagtaatagatcttgaaccgattccatatgatcctaaatttgagaaacagttagggcaagttatgctcctcatcctctgtgtcacgcaggtattaatgatgcgaacgacctgggcactttgtgaagcgctaactctagcaacaggaccaatttcaactttatgggaaggcaatccaggtcgattctggaatactaccatagcagtaagcatggcaaacatatttcgaggatcatacctagccggtgcaggcttactcttttccataatgaaaaacacaacaaacacgagaaggggaacaggaaacataggggaaaccttgggagagaaatggaaatcacgattaaatgcactaggaaagtccgaatttcaaatatataagaaaagtggtatccaggaggtggacagaacactagcaaaagaaggaataaaaagaggagagactgaccatcacgcagtaagcagaggtagtgcgaaattgaggtggtttgttgagaggaatatggtaacaccagaaggcaaagtagttgaccttggttgtggtcgaggtggctggagttattactgcggcgggctcaaaaacgtgcgagaagtaaagggtctgacaaaaggaggacctggacacgaggaacccataccaatgtcaacatatggatggaatttagttagactgcaatcaggtgtcgacgtattctttactccacccgagaagtgtgatacactactctgtgatataggtgaaagctccccgaatccaacaatagaagctggtaggacattacgagtattaaacttagtagaaaactggttgaataataatactcaattttgcattaaagtacttaatccctatatgccttcagtgatcgagaaaatggaggctttacaaagaaaatatggcggtgcattagtccgaaatcctttatccagaaattcaacacacgaaatgtactgggtgagtaacgcaactggaaatatcgtgtcaagtgtcaatatgatttcaaggatgctcattaatcgcttcacaatgaagcataaaaaggctacttatgagcccgacgtcgacctcggaagtggaactagaaatataggtatagaatcagaaattcccaacttagatataatagggaaaagaatagagaaaattaaacaagaacatgagacaagctggcactacgaccaagaccatccatataaaacctgggcatatcatggtagctacgaaactaaacagacaggcagtgctagcagtatggttaacggtgtagtgcgcctattaacaaaaccatgggatgttgtaccgatggtaacccaaatggcaatgacagatacaacacctttcggacaacaaagagtttttaaagagaaagtcgacaccagaacacaggaaccaaaagaaggaactaagaaattgatgaaaatcacggcggaatggctatggaaagaactgggaaagaagaaaactccccgaatgtgtacaagagaagagttcacccgtaaagtaagaagtaatgcggcgctaggggccatatttacagacgagaacaaatggaaatcagccagagaagctgtagaagatggaagattttgggaactcgttgatagggaaagaaaccttcatttagaaggaaagtgtgaaacctgtgtgtataatatgatgggcaaacgagagaagaaattaggtgaatttggaaaagccaaaggatctcgtgcgatctggtacatgtggctaggggcccgttttcttgaatttgaagcgctaggatttttaaatgaagatcattggttctctagaggaaattcactaagcggggttgaaggtgaaggcttacatagacttggttacatcctacgtgatgtcggaaagaaggaaggcggcgctatgtatgcggatgataccgctggttgggacacaagaataacattagaagacttgaaaaatgaagaaatggttactaatcacatgaagggagagcacaagaaattagcagaagcaatattcaagctgacataccaaaataaggtagtccgagttcaaagaccaacaccacgaggaacggtcatggatatcatatcaagacgggaccaacgaggcagcggccaggtcggaacatatggtttaaatacttttacgaacatggaagcccaacttataagacaaatggaaggcgaaggtatattcaaatcgatccaacacctaactgctactgaagaaatagctgtgcaaaactggctagcgagggtaggcagggaaaggttgtctaggatggcgatttcaggagacgactgcgttgtgaaacccatagatgatcgttttgcatctgcacttacagccctgaatgatatgggtaaagtgcggaaggatattcaacaatgggagccgagcagaggttggaacgattggacgcaagtcccattttgttcacatcactttcatgaacttgtaatgaaggacggtcgagtgttagttgttccttgtcgtaatcaagatgaattgataggcagagcccgaatttcacagggagcaggttggagcttaaaagagactgcatgtctggggaagtcatatgcacaaatgtggacattaatgtactttcaccgtcgtgatctcagacttgcagcgaacgccatatgtagtgcagtaccaccccattgggtaccaacgtcacgtacaacttggtcaatacacgcgaaacacgaatggatgacaactgaagatatgttggcagtctggaatagagtatggatacaggagaatccctggatggaagacaaaacgcccgtagagagctgggaagaagtaccatatttggggaaacgagaggatcaatggtgcggttctcttattggacttacgtcccgagctacatgggccaaaaacatacaaacagcaataaatcaagttcggtctttaatcgggaatgaagaatacaccgattatatgccaagcatgaagaggttcagacgcgaagaggaagaagcaggagtactatggtaa

SEQ ID NO: 22429 - RNA, 9876 nt, synthetic construct
  misc_feature 1..9876: note = derived and/or modified CDS sequence (opt6) from DENV-2__FJ898478__SS-prME
  source 1..9876: mol_type = other RNA
actgcaggggtgattgtaatgttaattccgactgcaatggccttccatttaaccacgaggaatggggaaccgcacatgatcgtgggaagacaagaaaaaggaaaatctcttctgttcaaaacagaagatggagtgaatatgtgtacacttatggctatcgaccttggcgaattgtgcgaagataccataacctacaaatgccctttacttcggcaaaatgaacccgaagacatagattgttggtgcaatagcacctcaacttgggtaacttatgggacttgtacaacaacaggagaacaccgaagggaaaaacgcagtgtagctttagtaccccatgtggggatgggattggaaacgcgtactgaaacttggatgtcgtctgaaggagcatggaaacacgtgcaaaggatcgaaacttggatactaaggcatccagggtttacgatcatggcagcaatcttagcatacacaattggcactacacactttcaacgagccttaatattcatactacttacagcagtagcgccatcaatgacaatgagatgtatcggtatatctaatagggacttcgttgaaggcgtgagtggaggaagttgggtagacatagtactcgaacatggtagttgtgtaacgactatggccaaaaataaacctacactagatttcgaattaataaaaactgaagcaaaacaaccagcaacgttacgaaaatattgcattgaagcaaaactgacaaacacaaccaccgaaagtaggtgtccgacccaaggagaaccatccttaaacgaagaacaagataaaaggtttatctgcaaacactcaatggttgacagaggatgggggaatggttgcggcctatttggtaaaggaggaatagtcacgtgtgctatgttcacatgtaagaaaaacatggaaggaaaagtagtccagccagagaatttagagtatacaattgtcatcaccccgcatagcggtgaagaacatgccgtagggaacgatactggaaaacacggaaaagaaataaaaataactccacaatcaagtataacagaagcagaactgactgggtatggaacagtgacgatggaatgtagtccaagaaccggattagactttaatgaaatggtactcctacagatggaggacaaagcctggcttgtgcatcgacaatggttcttggatttaccgttaccttggttgccaggtgcggatactcaaggaagcaattggatccaaaaagagacattagttacatttaaaaatcctcatgctaagaaacaggacgtagtagtgctaggatcacaagaaggagcaatgcacaccgccttaacgggcgctactgaaatacaaatgtcttctggtaatttattatttacgggacacttaaaatgcagactcagaatggataaactgcaattaaaaggcatgtcctactccatgtgtacaggtaaatttaaaatagtcaaagaaatagcagaaacgcaacacggaacaatagtgatacgtgtacaatacgaaggtgatggcagtccgtgtaaaataccctttgaaattactgacttagagaaaagacatgtattgggcagattgataacagtaaatccgattgtaactgagaaggactcacctgtcaacatagaggctgaacctccgtttggggatagttatataataattggagtagagccgggacaactaaaactaaattggtttaagaaaggtagctcgataggacagatgtttgaaacaacaatgagaggggctaagcgaatggctattttgggtgataccgcctgggatttcggctccctaggtggtgtgtttactagcataggaaaggccttacatcaagtatttggagccatttatggagcagcattttcaggcgtaagctggacaatgaaaatccttattggtgtaatcatcacgtggattggtatgaactcacgcagtacgagtctatctgtaagtttagttctagtaggtgtcgtgacgctatatctcggcgcgatggttcaagcggactcgggctgtgttgtgtcttggaagaataaggaattaaaatgtggcagcgggatttttattacggataacgtccacacttggaccgagcaatacaaattccaacctgagagcccatcaaagttagcatcagcaattcaaaaagcgcatgaagaaggaatatgcggtatacgatcggtgactagactagaaaatttaatgtggaagcaaataactcccgaattaaaccatatattaagtgaaaacgaagtaaaattaacgatcatgaccggtgatataaaaggcataatgcaagcgggcaagagatcactaagaccacaacctactgaattgaaatacagttggaaaacctgggggaaagcaaagatgttatccacggaaagccataaccagactttccttatcgacggacctgagacggccgaatgtccaaatactaacagagcttggaatagcctagaagtggaggattacggatttggagtattcacaacaaacatatggcttaaattaagagaaaaacaagacgtgttttgtgatagtaaacttatgagtgccgcaataaaagataatagagcggtgcatgccgatatgggttactggattgaaagtgctcttaatgatacctggaaaatggagaaagcctctttcatagaggtaaaaagttgtcactggccaaaaagtcatactctgtggtctaatggagttctagaatcagaaatgataatacccaaaaatttcgcgggacctgtttcacagcataattacagacccggataccacacccaaaccgctggtccttggcatttaggaaaacttgaaatggatttcgacttatgcgaaggaacaactgtcgttgttacagaggattgcggtaatagaggcccaagcctccgaactacaacagctagcggcaaacttataaccgaatggtgttgccggtcgtgcactctcccacccttaaggtatagaggagaggatggctgttggtacggaatggagatcagaccccttaaagaaaaggaagaaaacttagtaaattctttggttactgccggtcacggacaaatagataactttagtctcggagtactaggaatggccttattcctggaagagatgttgcgaacccgtataggtacaaaacacgcaatattgctggtggctgttagttttgtgacactaataacagggaatatgtcgtttagagatttaggtcgtgtaatggtgatggttggagcaaccatgactgacgatattggcatgggcgtaacctaccttgctttgttggccgcgtttaaagtgaggccaacgtttgcagctggtttattattgcgcaagttgaccagtaaggagcttatgatggcaacgataggtatagcactcctatctcaaagtactataccagaaactattctggaactaacagatgcccttgcattagggatgatggttttgaaaattgtaagaaatatggaaaaataccaattagcagtgaccattatggcaatatcatgtgtaccaaacgccgtcatactacaaaatgcctggaaggtgtcgtgtactattctagctgcagtgtccgtgtcaccattattactcacgtctagtcaacagaaggcggactggataccattagcccttacaatcaagggcttgaatcctacggcaatcttcttaactacattaagtagaacaagtaagaaaagaagctggccattgaatgaagccattatggcggtgggaatggtaagcatcctagccagctctttactaaagaatgacattccaatgacaggtccacttgtagctggagggttacttacagtttgttatgttctaacagggagatcagctgatttagaattagaaagagctgcagatgtaaaatgggaggatcaagctgagataagtggtagcagccctatacttagtataacaattagtgaagatggtagcatgagtatcaaaaacgaagaggaagaacagacactcaccatcctgatacgcacgggtctccttgtgattagcggagtatttccagtcagtattccgataacggcagcagcgtggtatttatgggaagtcaaaaagcaaagagcaggagtattatgggatgttcctagcccaccacctgtcgagaaagctgaattggaggacggggcatacagaataaaacaaagaggaatattgggttactcgcaaataggggctggggtgtataaggagggaacgtttcacacgatgtggcatgttacacggggagcagttctaatgcatagagggaaaaggatagaaccctcgtgggcggatgtcaagaaagatttaatatcttatggaggtggatggaaattagaaggtgaatggaaagaaggagaagaagttcaagtactggccttggagccgggtaaaaacccccgagcagtacaaaccaaaccaggaatatttaaaaccaacactggtacaataggagcagtttcgctagatttttctccaggaacaagcggatcaccaattgtagatcgaaaaggcaaagttgtcgggttatatggaaatggagtcgtaacacgcagcggagcatacgtgtccgcaatcgcgcaaacggaaaaatccattgaagataatcctgaaatcgaagacgatatatttaggaagaaaagactcaccattatggatctacatccaggtgcaggcaaaactaaaagatacctacctgccatagtgagagaagcgataaaaagaggattgcggactctaatcctagctcctacgagagtggttgctgcagaaatggaagaggcgttacggggactgccaatacgataccagactcccgctattaaaactgaacacaccggcagagaaattgttgatttaatgtgtcatgctacttttacaatgcggttgctttctcctgtaagagtaccgaactataatctcataatcatggatgaagctcattttactgaccctgcatccatagctgcccgagggtatatttctacaagggttgaaatgggagaagctgctggaattttcatgacagcgacacctccgggcagcagagatccattccctcagagtaatgcaccaataatggatgaggaacgagaaattccggagaggagttggaactctggtcatgaatgggttacagattttaagggaaaaactgtatggtttgtaccgtctatcaaagctgggaatgatatcgctgcttgtcttaggaagaatggaaagaaagtaatacaattgagtcgtaaaacttttgacagcgagtatgtcaaaacgagagcaaatgactgggactttgtagtaacaacagatattagtgaaatgggagcaaatttcaaggcggaaagagtaatagacccaagaagatgtatgaaaccagttatattaacagatggtgaagagagagtgatcctagcaggtcccatgccggttacccattcatctgcggcacaaaggcggggtaggattggacgaaatccgaaaaatgaaaacgaccaatatatatacatgggtgaaccattagaaaatgatgaagattgtgctcattggaaagaagctaagatgttattggataacataaacacacccgaaggaattattccatccatgttcgagcccgaaagggaaaaagttgatgctatcgatggggaatatagactccgtggagaagctaggaaaacctttgtagatttgatgagacgaggtgacttaccagtgtggctagcttataaagttgcagcagaaggaatcaattatgctgatagaaaatggtgctttgatggaattaaaaacaatcagatattggaagaaaatatggaagttgaaatatggacaaaagaaggtgaacgaaagaagctaaaaccacgatggttagatgcgaggatatactctgatccattagcgcttaaagaatttaaagaatttgcagctgggagaaaatctttgaccttaaacctcatcacagaaatggggcgcctcccaacatttatgacccaaaaagcacggaatgcgctagataacctggcagttctacataccgcggaagcagggggcagagcatataaccacgctctaagtgaattacctgaaacattggagactttactattactaacattattggctacggttaccggagggatattcctcttcctgatgtcgggaaagggcataggcaaaatgactttagggatgtgttgtattatcacggcaagcatattactgtggtatgcacagattcaacctcattggatcgctgctagcattatacttgagttcttcttaatagtactattaataccagagccggaaaaacagcgaaccccacaagataaccagcttacttatgtagttatcgccatattgactgtcgtagcagccactatggcgaatgaaatgggatttttagagaaaacgaagaaagacctagggctcggatcgataacaacacaggagtctgaaagcaatatattagacatagatctgcgccctgcgagtgcttggactttgtacgctgtagctactacttttgttactccaatgctcaggcattcaatcgaaaattcctcagtcaatgtgagtttgaccgcaattgcaaatcaagcaacagttctaatggggttaggtaaaggatggccattatcgaaaatggacattggtgtaccccttttagcgataggttgttatagccaggttaatccaataacacttacagctgcattactcctactggtagcacattatgcaatcataggaccaggtctacaagctaaagcaacaagggaggcacagaagcgggcagccgctggaataatgaaaaatccgactgtcgatggaatcaccgtaatagatcttgaacctataccatatgatcctaaattcgagaagcagttgggacaggtgatgcttttaattctctgcgtaacacaagtcttaatgatgcggaccacctgggcgttatgtgaagctctcacactcgctactggaccaataagcactttatgggaggggaacccagggagattctggaataccactattgccgtttcgatggcaaatattttccgaggaagttatctcgctggagcaggtctactcttcagcataatgaagaacacaacaagcacgagacgaggaacaggtaatataggagaaaccttaggcgaaaaatggaaatctaggttaaatgcacttggtaaatcagagttccaaatctataagaaaagtggaatacaagaagttgaccgtacattagccaaggaagggataaaaagaggagaaacagaccaccatgcggtatcgagaggttcagcaaaactcagatggtttgtggagcgaaacatggtaacaccagaaggtaaagtcgtagacttaggttgcggacggggaggatggagttactattgtgggggacttaaaaatgtaagagaagtgaaaggtctcacaaaaggtgggccaggccacgaggaaccaatcccaatgtcaacatacggttggaatcttgtaaggcttcaaagtggagtcgatgtgttctttactccacccgaaaaatgcgacacgctcttatgtgatattggtgaatcatctccgaatcctacaattgaagccggacgaacccttagagtactcaatcttgtcgagaactggcttaataataatacacaattctgcattaaagttttaaacccgtacatgccttctgtaatagagaaaatggaagcgttacaacgcaaatacggtggcgcactcgtacgaaatccgcttagcaggaactccacacacgagatgtactgggttagtaatgcgaccggaaatatcgtatcgtcggtaaatatgatatctcgaatgctaatcaatcgtttcactatgaaacataagaaagctacctacgaaccggatgttgatctcggttccggaaccagaaacataggaattgaaagtgaaattcctaacttagatatcatcggtaaaagaattgagaaaattaaacaagaacacgaaacaagctggcattacgaccaagatcatccttataagacatgggcatatcatggatcatatgaaactaagcaaacagggagtgccagttccatggtgaatggagtagtgcgattactaactaaaccctgggatgtagtacctatggttacgcagatggccatgaccgatacaaccccgttcggacaacaacgtgtatttaaagagaaagtagacacacgtacacaagagccaaaagagggtacgaagaaattaatgaaaatcactgcagagtggttatggaaagaactaggcaaaaagaaaacgccacgcatgtgtactagagaagagttcactagaaaagtcaggagtaatgcagcgcttggggcgattttcacagacgaaaacaaatggaaaagtgctcgagaagcggtagaagacggtcgtttttgggaattggtcgatagggaacgtaatctccatttagaagggaaatgcgagacttgcgtatacaatatgatgggaaaaagggagaagaaactaggagaatttggtaaagcaaaagggtcaagagcaatatggtacatgtggcttggcgctaggttcctagagttcgaagctctaggattcttaaacgaagatcactggttctcacgaggaaatagtttatcaggtgtagaaggagaaggactccaccggctgggttatatactccgcgacgtaggcaaaaaggaaggaggagctatgtatgcagatgatacagcaggatgggacacgcgaataacgctagaagatctaaagaatgaagaaatggtaacaaaccatatgaaaggtgaacataagaaattagcagaagccatctttaaacttacctatcaaaataaagtagtaagagttcaacgaccgacacccaggggaaccgtaatggatatcatatctagaagagaccagcgtggatccggccaagtcggaacatacggattaaatacttttacaaacatggaagcacagctgatacgacagatggaaggagaaggtatctttaaaagtatacaacacctaactgccacagaggaaatcgctgtccagaattggctagcacgagttggtagagaaaggttatctagaatggctatttcgggtgatgactgcgtagtgaaaccaattgatgaccgctttgctagtgcattgaccgcactcaacgatatgggaaaagtaagaaaggatattcaacaatgggaaccgagccgtggatggaatgactggacacaggtacccttctgctctcatcattttcacgaattggtcatgaaagatggaagagtcctagtagtaccctgcaggaatcaagacgaattaattggacgagccagaataagtcaaggagcaggatggtctctgaaggagacagcttgtctcggaaagtcttatgcccaaatgtggacattaatgtatttccacagaagggatctacggctggcggccaacgcaatttgctccgcggtaccatcgcattgggttcctacatctcgtacaacatggtccatacatgccaaacatgagtggatgacgacagaagatatgttagccgtatggaatcgagtatggatacaagaaaacccatggatggaagataagacaccagtcgagtcttgggaggaagtaccgtatctcggcaaaagggaggaccaatggtgtggaagtctcatcggtttaacaagccgggcaacttgggccaagaacatccaaacagcgattaatcaagtaagatcactaattggaaacgaagagtacactgactacatgccttcgatgaaacgattccgaagagaagaagaagaagctggcgtgttatggtag

SEQ ID NO: 22430 - RNA, 9876 nt, synthetic construct
  misc_feature 1..9876: note = derived and/or modified CDS sequence (opt6) from DENV-2__GQ199869__SS-prME
  source 1..9876: mol_type = other RNA
actgcaggggtgatagtaatgttaataccaactgcaatggcatttcacttaacgacaagaaatggtgaaccccacatgattgttggaagacaagaaaaaggaaaatcacttctatttaaaacagaagatggtgtcaacatgtgcacgctaatggcaatagacttaggagaattgtgtgaagatacgattacgtataaatgccctttgcttcgacaaaatgaacccgaagatatagattgttggtgtaattcaacaagtacctgggttacctatggtacctgtactacaaccggtgaacaccggagagagaaaaggtcagtggctctggtcccgcatgttggaatgggattagaaactaggacggaaacatggatgagttcagaaggcgcgtggaaacacgtgcaacgtattgaaacatggatactacgtcaccccgggtttacaataatggcagcaatactggcatacacaataggaacaacgcattttcaacgagcattaatttttatccttttaactgcagtagcgccgtctatgacaatgagatgcataggaatatcaaatagagatttcgtagaaggagtgtctggaggatcatgggtagacattgtattggaacatggttcatgcgttaccaccatggcgaaaaacaaaccgactttagattttgaattaattaaaacagaagccaaacagccggcaactttaagaaaatattgtatagaagccaaactgacaaatacaaccacagaaagccgatgccccacacaaggtgaaccgtcattaaacgaagaacaagataaaagatttatatgtaaacactcaatggtcgaccgcgggtggggtaatggatgtgggctgtttggtaaaggagggatagtaacgtgtgcaatgtttacatgtaagaaaaacatggaggggaaagtagtgcaacctgaaaatttggaatacactatagtcattacgcctcatagtggtgaagaacatgcagtcggtaacgatacaggaaaacacgggaaagagattaaaataacgccacagagttcaatcaccgaggcagagttgaccggatatggcacagtcacgatggaatgcagtccaagaacaggactagacttcaatgaaatggtattattacagatggaggataaggcgtggcttgtccatagacaatggtttttggatctgccactaccatggctaccaggcgctgatatccaaggatcaaattggatacaaaaagaaacattagtaacttttaaaaacccgcacgccaagaaacaggatgtagtagtactgggctcacaagaaggggcaatgcataccgcgttaacgggagctactgagatccaaatgtccagtggaaatctgttattcacaggccatttaaaatgtagactaagaatggataaattacaattgaaaggtatgtcctattcgatgtgtactggaaaatttaaaattgtcaaagagattgcagaaactcaacacggcactattgtaatacgcgtgcagtacgaaggtgacggaagcccatgtaagattccatttgaaataactgacctggagaaaagacacgtcctgggaagattgataactgttaaccctatagtaacagaaaaagatagtccagtcaacattgaagccgagcctcctttcggcgacagctatattatcataggagttgaacccggacaattgaaactaaattggtttaagaaagggtcatctataggacaaatgttcgagacaacaatgagaggagcgaagcgtatggcaatcctaggagatacagcttgggatttcggcagcttaggcggagtattcacaagcattggaaaagcacttcatcaagtatttggagctatctacggagctgcattttctggggtgtcatggaccatgaagattctgataggagtaataataacgtggattggtatgaactcgcgttctactagccttagtgtttcattagttttagtaggagtagttaccctttacttgggagcagtagttcaggcagactcaggatgcgtagtaagttggaaaaacaaagaacttaaatgtggtagcggtatatttattacggacaatgtacacacatggacagaacagtataaatttcaaccggaatcaccatcaaaacttgcaagtgcaatacaaaaagcgcatgaggagggaatatgcggaataaggagcgttactagattggaaaatctaatgtggaagcaaattaccccagaactaaaccacatattaagcgagaacgaggtcaagctgacaataatgacaggtgacattaaaggaataatgcaggccggtaaacggtcactaaggccccaaccaacagaattaaagtacagctggaagacctggggtaaggccaagatgctttcaactgaatcacacaaccaaacttttctcatcgacggaccggaaacagctgaatgtccaaatacgaatagggcctggaactctctggaagtcgaggactatggttttggtgtattcaccacgaacatctggctaaaactgagagaaaaacaagacgtcttttgtgacagtaaattaatgtcggccgctataaaggacaatcgagcagtccacgcggatatgggttattggattgagagcgcgttgaacgacacctggaagatggaaaaggccagctttatagaagtaaaaagttgtcattggcctaaaagtcatacgttatggtctaacggggttctagagagcgaaatgataataccaaagaatttcgccggtcctgtaagtcagcataactacagacctggataccatactcaaactgcaggcccatggcatttaggaaaattagaaatggattttgatttttgcgaagggacgactgttgtggtcacggaggattgtgggaacagaggacctagcctaaggacaacgacagcatctggaaagttaatcactgaatggtgttgccggagctgcactctaccaccactaaggtaccgaggcgaggatggatgctggtacggaatggaaataagaccactcaaggaaaaagaagaaaatctagttaacagtttagttaccgcaggacacggccaaatcgataattttagcctaggcgttttaggtatggcgttatttcttgaggaaatgctccgaacacgcataggaacaaaacatgcaatactattagtggctgtaagtttcgttacgttaattacggggaatatgtcatttagagacttgggacgggttatggtaatggtaggagccactatgaccgatgacattggtatgggtgtgacctaccttgctcttttagctgcttttaaagttcgaccaactttcgcagcaggattactcttacgtaaattaacaagtaaggagttaatgatggcgactataggaattgcattattgtcccagtcaacaattcccgagacaatcttagaattgacagacgcattagccctgggtatgatggtactaaagatcgtacgtaacatggagaaataccagttagctgtaacgatcatggccatctcgtgtgtaccaaatgcagtaatcctacagaatgcctggaaggtttcatgcacaatccttgcggccgtatcagtcagtccgctactattaacctcctcacaacaaaaggcagactggatacccctggcactcactatcaagggattaaacccaacagctattttcttaactacactttcaagaacgagtaagaaacgtagttggcctttaaatgaagctataatggcagttggcatggtgagcatccttgcttcttcactattgaaaaatgatattcctatgacagggcctctagtagcagggggactattaaccgtatgttatgttttgaccggacgttccgcggacttagaactcgaaagagctgcagacgtgaaatgggaagatcaagcagaaatcagtggttcaagcccaatactgtcaataacaatttcagaggacggttcaatgtccatcaaaaatgaagaggaagaacagacgttaaccattctcatacggacaggcctattagtaattagcggagtatttcctgtgtcgattcctataacggcagctgcgtggtatctttgggaagtcaagaaacagcgggctggtgtgctatgggatgtaccaagcccacctcccgtcgaaaaggcagaactagaagacggtgcgtaccgaatcaagcaaaggggtatacttggatattctcaaattggagccggggtctataaggaaggaaccttccatacaatgtggcatgtgaccagaggagcagtgcttatgcatcgtggaaagagaatcgagccatcctgggcagatgtcaaaaaggacttaataagttacggcggtgggtggaaacttgaaggagaatggaaagaaggggaagaagtccaagtcttagcactcgaaccagggaaaaaccctagagccgtacaaacaaagccaggcatattcaaaacaaacacggggactataggtgcagtaagtttagacttcagcccaggaacatcaggatcaccgatagtagatagaaaaggtaaagtggtaggactatatggaaatggcgtagtaactaggtcaggtgcatacgtatccgcaatagctcaaacggaaaagtctattgaggacaatccggaaattgaggacgatatattccgtaagaaacggctaacaataatggacctacacccaggtgcaggtaaaacgaagcgatatttgcccgctattgtaagagaagcaataaaacgaggacttagaacccttatactagctcccactcgagtagtagcagcggaaatggaagaagcactaagaggattacctataagataccaaacaccggccataaaaacagaacatactggtcgagaaatagtagatctaatgtgccatgctacctttacaatgaggctactatcccccgtaagagtaccgaactataatttaattataatggacgaggcacactttacggatccagccagtattgccgcaagaggctacataagcacgagggttgagatgggggaagctgcggggatttttatgactgcaactcccccaggatcaagggatccgtttcctcaatcgaatgcccctattatggatgaagaacgtgaaataccggaacgctcatggaactcaggacatgaatgggtgacggactttaaaggaaaaacagtgtggttcgttcctagtattaaagctggaaatgatatagcagcttgtttaaggaaaaatgggaagaaagtaatacagttaagtcgaaaaacattcgactctgagtacgttaagacaagagcaaatgattgggatttcgttgtaacaacagacatttcagaaatgggtgcaaattttaaagcagagagagtgattgatccccgtcgatgtatgaaaccagtaattctgaccgatggagaagaaagagtaattcttgctggtccaatgccagtaacacactcaagtgctgctcagcgaagaggacgaatcggcagaaaccctaaaaacgaaaacgaccaatatatatatatgggggaacctttagaaaacgacgaagattgtgcacactggaaagaagctaaaatgctattagataatatcaatacaccggaaggaattatcccctcaatgtttgaacctgaacgcgagaaagtcgatgcaattgacggagaatatcgcttaaggggtgaagcacgcaaaacgttcgtcgacttaatgcggaggggtgacttaccagtttggcttgcttataaagttgcggcagaaggcattaattacgcggataggaaatggtgcttcgacggtataaagaacaatcaaatcctggaggagaatatggaggtggaaatatggaccaaggagggagaaaggaagaaattaaaacctcgctggctagatgcccgtatatattctgatccattagcgttgaaagaatttaaagaatttgcagcaggacgaaaatcccttacgttaaatcttatcacggaaatgggaaggttaccgacttttatgacacaaaaggccagaaatgcgcttgataatttagcagttcttcatacagctgaagctggtggtcgtgcatacaatcatgcgttatccgaacttccagagacattagaaactttactgctactcactctgctagcgaccgttacaggtggtattttcctctttctcatgtctggaaaaggcataggcaaaatgactctaggcatgtgttgtatcataacggcctcgatacttctatggtacgcccaaatccaacctcactggatcgctgcctcaataatactagagtttttcctaatcgtattattaatacctgagccagagaaacagagaacaccccaagataatcaactcacatacgttgttattgctatactaactgttgttgcggctaccatggcaaacgaaatgggtttcttagagaaaacaaagaaagatttgggtttgggaagtataacgacacaggagagcgaaagtaacattctggatatcgatttaagaccagcgtcagcatggactttatatgcagtggctactacatttgttacaccaatgctacgacattcaatagagaactcatcggtaaatgtttcactaacagcaatagctaatcaagccacagttcttatgggactgggaaaagggtggcctctaagcaagatggacataggagtacctctattagccataggctgttatagccaggtcaatccaataactttaacagctgctttgctactactcgtggcccactatgcaatcataggaccggggttacaggctaaggcaactagagaagcccagaaaagagctgcggccggtatcatgaagaatcctaccgtagatgggataactgtaatagatctagaaccaataccgtacgatccaaaatttgaaaaacaacttggacaggtaatgttactaattctttgtgtaacgcaagtgttgatgatgaggacaacttgggcgctctgcgaggcactcactcttgcaactggtccgatctcgacactttgggagggtaatcctggaaggttttggaatactacgattgcagttagtatggctaacatatttagagggtcatatcttgctggggccggactactattttcgatcatgaaaaatacaacaagcacacgtagaggtaccggcaacatcggagaaactctaggcgaaaaatggaaatcaagattgaatgcattaggcaaaagcgaatttcaaatatacaagaaaagcggtatccaagaagtggacagaactcttgccaaagaaggaattaaaagaggggaaacagatcaccatgcagtatcaagaggaagtgcaaagttaagatggttcgtcgaacgtaatatggtaacaccagagggaaaagtcgtggatcttggttgcgggagaggcggatggagttactattgtggaggtctcaaaaatgttagagaagtaaagggtttgactaagggaggacccggacatgaagaaccaataccaatgtcaacctatgggtggaaccttgttagactacaatccggtgttgatgtattctttaccccacccgagaaatgtgatactttactctgcgacataggggaaagctcaccaaatcccaccatagaagcgggacgtactctacgagtactaaatctcgtagaaaactggttgaacaataatactcagttttgcatcaaagtgctaaacccttacatgccaagtgttatagagaagatggaagcacttcagagacaatatggcggagcactcgtgcgcaacccattaagtaggaactccacacatgaaatgtactgggtaagcaatgccactggcaatattgtatctagcgtcaatatgatcagccgcatgttaataaatagattcactatgaaacacaaaaaggctacatacgaaccagatgttgacttaggatcaggaacaagaaatataggcatagagtcagaaattcccaatcttgatatcataggcaaacgaatcgaaaagataaaacaagaacatgaaatttcctggcactatgaccaggatcatccatataaaacttgggcttatcacggttcttatgaaacgaagcaaactggctctgccagtagcatggtaaatggtgtcgtcaggttattgacaaaaccatgggacgtagtcccaatggtaacccaaatggctatgacagacaccaccccgttcggtcaacaaagagtcttcaaagaaaaagttgatacaaggacacaagagccgaaagaaggaacaaagaaattgatgaaaatcacggcggaatggttatggaaagaactcggtaagaagaaaactccccggatgtgtacaagagaggagttcactaagaaagttcgatcaaatgcggcactaggtgccattttcaccgacgaaaataaatggaaatcagctagagaagccgtcgaagatgggcggttctgggaactcgtggatagagaaagaaatctacatttggagggcaaatgcgaaacatgtgtatacaatatgatgggtaaacgcgagaagaaacttggcgaatttggcaaagcgaaaggatcccgtgctatatggtatatgtggcttggcgcaagatttttagagttcgaagcgttaggatttttaaatgaagatcattggttcagtagaggcaactcactctcaggcgttgaaggggaaggcttgcatagactaggctatattctccgcgatgtaggcaagaaagaaggtggagcaatgtatgctgatgacactgcaggatgggatacacgaattacgctagaggaccttaaaaatgaagagatggtaacaaatcatatgaagggcgaacacaagaaattagctgaagctatttttaagctcacctatcagaataaagtagttcgagtgcaacgacccacacctaggggcacagtaatggacataatttctaggagggatcaacgcggtagtggacaggtgggcacgtacgggttaaacacgttcactaacatggaagctcaactcattcgtcagatggagggggaaggaattttcaaatcgatacaacaccttacggccacagaagagattgcagttcaaaattggttggcgagggtaggtagagaaaggttatcaagaatggccatatctggagatgattgcgtagttaaacccattgatgaccgctttgccagcgcattaacagctctcaacgacatgggcaaagtccgcaaggatatacaacaatgggaaccaagtcgtggatggaacgactggacacaggtaccgttttgctcacaccatttccatgagttggtgatgaaagatggcagagtattggtagtaccatgtagaaaccaagatgaactaatagggcgagcacgcattagccaaggagcaggatggtcactaaaagaaacagcgtgccttggcaaatcatatgcacagatgtggacacttatgtattttcataggagagatttgagactagcagcaaacgccatttgtagtgcagtgccgtcccattgggttccgacttctagaactacctggagtattcatgcaaagcatgaatggatgaccaccgaggatatgttagctgtttggaacagagtttggatacaggaaaatccttggatggaggacaaaacaccagtagagtcatgggaagaagtgccttatctcggtaaacgagaagatcaatggtgcggcagtcttattggactaacgagccgggcgacctgggccaaaaacatccaaacagccataaaccaagtaagatcactcattggcaacgaagaatatactgactatatgccaagtatgaagagatttcgtagagaagaagaagaagcgggcgttctatggtaa

SEQ ID NO: 22431 - RNA, 9876 nt, synthetic construct
  misc_feature 1..9876: note = derived and/or modified CDS sequence (opt6) from DENV-2__JX079688__SS-prME
  source 1..9876: mol_type = other RNA
acagctggagtaatagtaatgttaataccaacagcaatggctttccacctgacaactaggaacggcgaacctcacatgatcgttggacgacaagaaaaaggtaaaagtctactatttaaaacagaagacggcgtaaacatgtgcacgttaatggcaattgacctcggagaactttgcgaagacacaatcacgtacaaatgcccgttactgcgccagaacgaaccagaagacattgactgttggtgcaactcgacaagtacctgggttacctacggtacgtgtacaactactggagagcacaggcgagagaaaagaagtgttgcattagtccctcatgtggggatggggctagaaaccagaacagaaacatggatgagctccgaaggtgcatggaaacatgtacaaagaatagaaacttggatattaagacacccaggttttacgatcatggcagcaatccttgcttacacaatcggtacaactcattttcagcgcgcgttgatatttatcttgttaacggcagttgcaccgtccatgacaatgagatgtatcggaataagcaacagagactttgtagaaggagtaagtgggggaagttgggttgacatcgtactcgagcacggatcatgtgttacaacaatggccaaaaataaaccaactttagactttgaattgataaaaacagaagcgaaacaaccagcaacactaagaaaatattgcatagaagcgaaattaactaacactacgacggagtcacgttgtccaactcagggtgaaccatcactgaacgaggaacaagacaaaaggttcatatgtaaacattcgatggttgaccgaggctggggaaatggatgcggtctattcggcaaaggtgggatagttacctgtgctatgtttacctgtaagaagaacatggaaggaaaagtagtgcaaccagaaaacctagaatacacaattgtaattaccccacactctggagaggaacatgcagtaggaaacgacacaggaaaacacggaaaagagataaaaataacgccgcaaagctcaattacagaggcagaattaacagggtatgggactgtgaccatggaatgtagtccgaggacagggttagacttcaatgaaatggttcttttacaaatggaagacaaggcatggctagtacaccgacaatggtttctggatttgccacttccgtggctaccaggagcggacactcaaggcagcaactggatccaaaaagaaactcttgtcacttttaaaaatccacacgcgaagaaacaggatgtcgtagtgctaggcagtcaagaaggcgctatgcatacggcacttaccggggccacagaaatccagatgagttcaggcaacctgcttttcacaggacatttaaagtgtcgtttacgtatggacaaacttcaattaaaaggaatgtcgtatagtatgtgcacaggaaaattcaagattgtcaaagaaattgccgaaactcagcatggtaccatagtcatacgcgtacaatatgaaggagacgggagtccatgtaaaatcccatttgaaattacagacctagaaaaacgacacgtattaggtcgacttattacagttaatccaattgtcacagagaaagactcaccagttaatatagaagcagaaccccctttcggagatagctacatcataatcggggttgaacccggacaactgaaactaaattggtttaagaaaggatcatcaattggtcagatgttcgaaacgacaatgcgtggagcgaaacgaatggcaatcttaggagacacagcatgggatttcgggtctttaggtggggtatttacatcaataggaaaggcactacatcaagtgtttggagccatatatggagcagcattttcgggcgtctcttggacaatgaagattctaataggagtgataatcacttggattggaatgaactcccgtagcaccagcctaagcgtttcgttggtattagtcggagtcgtgacattgtatttaggtgctgtagttcaagctgattctggatgcgtagtaagctggaaaaataaagagttaaaatgtggatctggaatttttataactgataatgttcacacttggactgaacaatacaaattccagccggaatctccatcgaaactagcaagcgctatacaaaaagcccacgaagagggcatatgtggtatacgatcagttacgagacttgaaaatctgatgtggaaacaaattacaccagagttaaatcatatattgagcgagaatgaagttaaactaacgattatgacgggagacattaaaggtattatgcaagccggcaaaagaagcctccgtccccaaccaactgaattaaagtattcttggaagacctggggcaaagcgaaaatgttaagtacagaaagtcataatcagacctttttaatagatggtccagagacagccgagtgcccgaacactaatagagcatggaatagcctagaagttgaagattatggttttggggtcttcaccaccaatatatggttaaaactaagggaaaaacaagacgtcttttgtgactctaagctgatgagtgcagccataaaggataatagagctgtccatgctgatatgggatactggatcgaatcagcgttgaacgatacctggaaaatggaaaaagcatctttcatcgaagtaaaatcttgtcattggccgaaaagccacacattatggagtaatggggtcttagagagtgaaatgataattcctaaaaatttcgctggaccggtaagtcaacacaattatagacctgggtatcacacacagaccgctggcccttggcaccttggaaaactagagatggatttcgatttctgcgaaggcacaactgtagtggtaacggaggattgcggaaaccgtggacctagtcttagaaccaccaccgcaagcggtaaacttatcacagaatggtgttgtagatcatgtaccttaccacccctgcgttatcggggtgaagatggctgttggtacggaatggagataaggcccctaaaagagaaggaagaaaaccttgtgaactctcttgtaaccgccggacacggtcaaattgataatttttcgttgggtgttctgggaatggccctgttcctggaagagatgctcagaacaaggataggtacaaaacatgcaatattactcgtagcagtaagttttgtaacacttataactggtaatatgtcatttcgggacttaggacgcgtcatggttatggtgggggcaaccatgacagacgatatcggtatgggagtaacatatttagctttgttggcagcattcaaggtacggccaacattcgctgcgggtttattactaagaaagttaaccagtaaagaattgatgatggcaactattggaattgccttattgagtcagagtacaattcctgaaaccatactcgaactaacagacgccttagcactaggaatgatggtgctaaaaatcgtcagaaacatggaaaagtatcaattagccgtgacgattatggctataagctgtgtacctaatgcagtaatattgcagaacgcatggaaagtcagttgtacgatactggcggcagtatccgtgtctccgttattactaacatcgtcccaacaaaaagcagactggataccccttgccttaaccataaaaggtctcaatcctacggcaatatttttaacgactttatcaagaacatctaagaaacgcagttggccattaaatgaagcaataatggcagtcggaatggtgtcgatattagcaagttcactactcaaaaacgacatacctatgacaggtcctctagtcgcaggaggactactcactgtatgctacgtattgaccggccgctcagcggatcttgaactcgagagagcagcagacgttaagtgggaggatcaagcagaaataagtggatcgagccccatattatcaataacaattagtgaggatggatccatgtccatcaaaaatgaagaagaagaacaaacactcactatacttataagaacaggtttattagtgattagcggcgtattcccggtatcgattcccataactgccgcagcgtggtacctatgggaagtaaagaaacaaagagccggtgtcctttgggacgtcccatctccccctcccgtggaaaaggcagagcttgaagacggcgcatatagaatcaaacaaagaggtatactgggttatagtcaaataggagcaggagtatacaaagaagggacgttccacacgatgtggcatgtaaccagaggcgcggttctgatgcatagaggaaaacggattgaaccttcatgggcggatgtgaagaaagatcttataagctacgggggtgggtggaagctagaaggagagtggaaggaaggcgaagaggttcaagtcttggctttagagcccggcaaaaatccgagagcggtacaaacaaaaccaggaattttcaaaactaataccggaactatcggtgctgtcagtttagacttttcccctggtacgagtgggagccctattgtagataggaaagggaaagtggttggtttgtatggtaatggagtcgtgacaagaagcggagcatacgtaagcgcgatagcccagactgagaagtctatagaagacaacccagaaatagaagatgatatattccgcaagaaaagacttacaattatggatttacatccaggggcaggtaaaactaagagatacttaccagctatcgtgcgagaagcaataaagagaggtttacgaactctaatactagcacctacccgcgttgtagcagcagagatggaagaggcgctaagaggattaccaataagatatcaaaccccagcaatcaaaactgaacataccggtcgggagatcgtagatcttatgtgccacgctaccttcacaatgagattgttaagtccagtacgagttccaaattacaacttaattataatggacgaagcccacttcaccgatcccgcttctatagcggctcgtggatacattagcacaagagtagaaatgggagaagcagcaggtatttttatgaccgccaccccaccagggtcaagagacccgttccctcaaagtaatgctccaattatggatgaagaaagagagataccagaacgatcatggaactccggtcatgagtgggtcaccgatttcaaaggaaaaacagtatggttcgtaccgagtatcaaggcaggcaatgatattgcagcatgcctaaggaaaaatgggaagaaagtgatacaactatctagaaaaacatttgattcggaatatgttaaaacgagagcaaatgattgggatttcgtagtaactacagacatatcagaaatgggagcgaattttaaggctgaacgcgttatagatccacgacgatgtatgaaaccagtaatattaacggatggtgaagaaagagtaatattagctggacctatgccagtaactcattcatccgcagcacaaagaagagggcgcataggaaggaatcccaaaaatgaaaatgaccagtacatttatatgggggaacccctagaaaatgatgaagattgtgctcattggaaagaagctaaaatgttactagacaacattaacacgccagaaggaattataccaagcatgtttgagcccgaaagagaaaaagttgatgcgatagatggagaatatagattaagaggagaagctagaaaaactttcgtagacctcatgcggcgaggagacttacctgtatggcttgcatataaagtagcagccgaaggaataaactacgcagaccgaaaatggtgcttcgatggaattaaaaataatcagatactagaagaaaatatggaagtcgaaatatggaccaaagaaggtgagaggaaaaagttaaagccaaggtggttagacgcacgcatatattccgatcctctggcccttaaagagttcaaagagttcgcagcaggtcggaaaagcctgacccttaatctgataactgaaatgggacgactaccaacatttatgacccaaaaagcaaggaatgctttagataatttagcggtcttgcatacagcggaagccgggggcagggcttacaatcacgcacttagtgagctaccggaaactcttgaaactcttctactactaacattgttagcgaccgtgactgggggaatatttttgttcttaatgtcagggaaagggataggaaaaatgacattagggatgtgttgtattattactgcaagtatattgctgtggcatgcacaaatacaaccacattggatagcagcttcaattattttagaatttttccttatagtgctgctaattccggaacccgaaaaacagagaacacctcaagataatcaattgacttatgttgtgatagcaatacttacagttgtcgcagcaacaatggcaaacgaaatgggatttttggagaaaactaagaaagacttaggcttgggatcaataacgactcaggaaagcgaatcgaatatattggatatcgatcttcgaccagcttctgcctggacattatatgcagtcgcaactacatttgttaccccgatgctcaggcatagtatagaaaattctagtgtcaatgtctctctgaccgctatagcaaaccaagcaacggtgttaatgggattgggcaaaggatggccattatctaaaatggatatcggagttccactattagctatcggatgctacagccaggttaatcctataacattgacggctgcattactcttacttgtagcccactatgccataataggaccaggattgcaagcaaaagctacacgagaagcacagaaacgggcagctgcaggtattatgaaaaacccaactgtagatggtataacagtaattgatttggaacctattccatatgatccgaaattcgagaaacaactagggcaagtcatgcttctcattttgtgcgttacacaagtcttgatgatgagaacgacctgggctctgtgcgaagccttaactttggctaccggtcccatcagtacactttgggaaggtaatccaggcagattctggaatacgacaatagcggttagcatggctaacatcttcagaggttcttacctggctggagcggggttactgttttcaattatgaaaaacaccacctcaacaagacggggcacagggaatataggagagactttaggagaaaaatggaaaagccgactgaacgccctagggaaaagcgaatttcaaatatataagaagagtggcatacaagaagtagatcggacacttgcgaaagaaggtataaagagaggagaaactgaccaccatgcagtgagtagagggtcagcaaaactccgatggtttgtagaacgaaatatggtgaccccagaaggaaaagtagtagatctcggatgcgggagaggagggtggagctattactgtggaggacttaaaaacgtaagagaggtaaaaggacttacaaaagggggacctggacacgaggaacccatacctatgtcgacctatggttggaatctagtacgactacagtcgggtgtagatgtattcttcacacctccggagaaatgtgatactttactgtgcgatataggagaatcatcaccaaacccaactatagaagcaggccgcacattaagagtacttaatcttgtggagaactggttaaataataatacgcaattttgcataaaagtcttaaatccatatatgcccagcgtaatagaaaagatggaagcactacaaagacaatatggaggcgccctagtcagaaatccattgagtcgaaattctactcatgaaatgtactgggtatctaatgcaaccggtaacatagtgtctagcgtaaacatgatctctaggatgttgataaatagattcactatgaaacataaaaaggcaacgtatgagccggacgtagatcttggatcaggaactaggaacataggcattgaaagtgaaatacccaaccttgatataataggaaagcgaattgagaaaatcaaacaagaacatgaaatctcatggcactacgatcaagaccatccttataaaacgtgggcgtaccatggatcatatgaaactaaacaaacaggcagcgcgagttcgatggttaatggggtagtacgcctcttaacaaaaccatgggacgtcgtcccaatggttacccaaatggcgatgacagatacaaccccgttcggtcaacagagagttttcaaggaaaaagtagatactcgcacacaggaaccgaaggaaggaactaagaaattgatgaaaattacagctgaatggctatggaaagaattgggcaagaagaaaacacccagaatgtgcactagggaagagttcactaagaaagttaggtcaaacgcagctttaggtgcaatctttactgatgaaaataaatggaagtctgcgagagaagccgttgaagatggtcgattttgggaactcgtcgatcgcgagagaaatttacacttagaaggaaagtgcgaaacgtgtgtatataatatgatgggtaaacgagagaagaaattaggggaatttggaaaagcgaaaggctcacgagcgatttggtatatgtggttaggtgcaaggtttttggaatttgaggctctaggtttccttaacgaagatcattggttttcacgcggtaatagtctaagtggagtagaaggagaaggactacatagactaggatatatccttagagacgtaggcaagaaagagggcggagcgatgtacgcagatgacactgccggatgggatacacgcataactctggaggaccttaaaaatgaggaaatggttaccaaccatatgaaaggagaacataagaaattagcggaagcaatattcaaattaacttaccaaaacaaagttgtaagagttcaacgaccaacccctagaggaacagttatggacattatctcgcggcgtgatcaacgaggtagcggacaagtagggacgtacggtctaaacacatttacgaatatggaagcccagctgataaggcaaatggagggagaaggaatcttcaaaagtattcaacatctaaccgctacggaggaaattgcagtacagaattggttagcaagggtgggaagagagcggttaagtcggatggcgatttcaggagatgactgcgtagtgaaaccgattgacgatcgcttcgcatcggcgctgactgccctcaatgatatgggcaaggttcgcaaggatattcaacaatgggagccgtcaagaggttggaacgactggacacaggtaccgttttgctcgcatcattttcacgagcttgttatgaaggatgggcgagtgctggttgttccatgtcgtaatcaagatgaactaatcgggagagccaggatatcacagggagccgggtggagcttgaaagaaacggcatgcctcggtaaatcctacgcacaaatgtggacactcatgtactttcatagacgagacctcagattagccgcaaatgcgatatgtagcgcagtcccatcgcattgggttcccactagccgcactacatggtcaattcatgcaaagcatgagtggatgaccactgaagatatgctcgctgtttggaatagggtatggatacaagaaaacccatggatggaagataagacacctgtcgaaagctgggaagaagtaccctatctgggaaagcgagaagatcaatggtgcggaagcctaattggattgacatcacgtgccacatgggccaaaaacattcagactgcaatcaatcaagtccggagtctcattggaatagaagagtacacggattacatgccatccatgaagcgatttcgtcgggaagaagaagaagcgggggtattatggtaa

SEQ ID NO: 22432 - RNA, 9876 nt, synthetic construct
  misc_feature 1..9876: note = derived and/or modified CDS sequence (opt6) from DENV-2__JF357906__SS-prME
  source 1..9876: mol_type = other RNA
acggcaggggtaatagttatgttgatacccacggcaatggcttttcacttgacgacaaggaacggagaaccgcacatgatagtgggaagacaagaaaaaggtaaatcattattattcaaaacagaagacggtgtgaatatgtgtacacttatggcaatagatctaggtgaattgtgtgaagacacaataacatataaatgccctcttttaaggcaaaacgaaccagaagacatagattgttggtgcaattctacatcgacgtgggtaacatatggaacgtgtacaacaacaggagaacaccgacgtgagaaaaggtcagtagccttagtacctcatgtagggatggggctagaaacgaggactgaaacatggatgtcatctgaaggcgcatggaaacacgtgcagagaatagaaacgtggatattacgtcatcccggatttacgatcatggcagccgttctagcctacacaattggaacaacgcatttccaaaaagccctaatattcatattattaacagccgttgctccgtctatgactatgcgctgtataggaatatcaaatcgtgatttcgttgaaggtgtatctggaggctcatgggtagatatagtcttagaacacggatcttgcgtaacaacaatggctaaaaataaaccgacgctagacttcgaattaataaaaacagaagcaaaacaaccggcaacactgagaaaatattgtatagaagcaaaactaactaatacgactacggaaagcagatgcccaacacagggcgaaccctctttaaacgaagaacaagacaaacgatttatttgtaaacactccatggtagacagaggttggggtaacggatgtggactgttcggcaaaggaggtatagttacatgtgcaatgtttacgtgtaagaaaaatatggagggaaaagtggtacaaccagagaatttagaatatacaatagtcattacacctcattccggtgaagaacatgcagtcggaaatgatactggtaaacatggcaaagagataaaaataacgccgcaatcgtccataacagaggcggaattaacgggttatggcactgttactatggagtgctcgcctcgaacgggattagacttcaatgaaatggttttactacaaatggaagataaggcttggctagtacatagacaatggtttttggatctaccactaccatggctacccggtgcagatacccaaggaagcaactggatacaaaaagagaccctagtgacttttaaaaacccacatgctaaaaagcaagatgttgtggtgttggggagtcaagaaggagcaatgcataccgcactaacaggagctacagagattcaaatgtcgtcagggaatctattattcacaggccacttaaaatgccgcttacgcatggataaattgcaacttaaaggtatgtcatatagtatgtgtacaggtaaatttaagatcgtaaaagaaatagcagagacacaacacggcacaatagtcataagagtccaatatgaaggagacggaagtccatgcaagatcccattcgaaatcaccgatttagaaaagcgccacgtcttgggaagattgattaccgtcaatccaatagttactgaaaaagatagcccagtcaatatagaagcggaaccaccatttggtgactcatacataataataggcgtggaacctggacaactaaaattgaactggtttaagaaaggatccagtatagggcaaatgtttgaaacaaccatgagaggcgctaaacgaatggctattctgggtgacactgcatgggattttggatcactgggcggtgtctttacttctattggaaaagcattacaccaagtatttggcgcgatctatggagccgctttttcaggcgtaagttggaccatgaaaattttaatcggtgttattataacttggattggcatgaatagccgatcaacctctctaagcgtgtcactcgtactcgtaggagtagttaccttatacttaggagcagtcgtacaagcagacagtggatgcgttgtgagttggaaaaataaagaacttaaatgcggctccggaatatttattacagacaatgtccatacttggacagaacaatacaaattccaacctgaatcgccgtcaaaattggcgtctgccatacagaaagctcatgaagaagggatctgtggtattagaagcgtcactaggttagagaacctaatgtggaaacagataacacccgagttaaaccacattttatcggaaaatgaagtcaaattaactatcatgaccggtgatattaaaggcataatgcaagctgggaaacgatcactgagacctcaacccaccgagctaaaatattcctggaaaacatggggcaaggctaaaatgttgagtacagaatcccacaatcaaacattcctgatcgatgggccagagacggcagagtgtcccaataccaacagagcatggaactcgttagaagtcgaagactatggttttggtgtctttacaacaaatatatggcttaagttgagagaaaaacaggatgtcttctgtgattctaaactcatgagcgcagcaataaaggataacagagcggtacacgcggatatgggatattggatagaaagtgccctaaatgatacctggaaaatggagaaagcatcatttatagaagtcaaatcatgccactggccgaaaagtcatacattgtggagtaatggtgtattagaaagtgaaatgataattcccaaaaattttgcaggtcccgtaagccaacataactatagaccgggctaccatacacaaacggctggtccctggcaccttggaaaacttgagatggattttgatttttgcgaaggcacgacagtagtagttacagaggactgtggaaatcgaggtccatcattacgtacaactacagcaagtggaaaactaataacggaatggtgctgcaggtcctgtacgttaccccctctccgttataggggcgaagacgggtgctggtacggaatggaaatcagacctttaaaagaaaaagaagaaaatctagtaaattcacttgtgaccgcaggtcatggtcaaatagacaatttctcactcggtgtattggggatggctctatttctagaagaaatgttaagaacacgaataggcacaaaacatgctatactattggtagctgtcagctttgtaacgttgatcacaggtaatatgagtttcagagatctcgggcgagttatggtcatggttggggcaacgatgacagatgatatcggaatgggagtcacgtaccttgctttactcgcggcgttcaaagtcagaccgactttcgcagcaggcttactcttaagaaagttgacatctaaagaactaatgatggctacgataggaattgctttactgtcccaaagcactataccagagacaatattagagttgacagacgcactagccttgggaatgatggtcttaaaaatcgtacgaaacatggaaaagtaccagttagctgtaaccattatggcaatttcctgtgtaccaaacgcagtaattctacaaaatgcatggaaagtgtcatgtacaatccttgcagctgtaagcgtatcgcctctactattaacgagtagccagcaaaaagccgattggataccattagcactgactatcaaaggcttaaaccccacggcgatttttctaacaacactatcgaggacatctaagaaacgttcatggccgctcaatgaagcaataatggcagttgggatggtaagcatattggctagttcactacttaaaaatgatattccaatgacaggccccctagtcgccggtggtctcttgactgtatgttacgtactaacaggacgatcagctgatctggagttagaacgagccgcggatgttaaatgggaagaccaggcagaaataagcggatcttcgccaattctttcaataaccataagcgaagatggatcaatgagtattaagaacgaagaagaagaacaaactctcacgatacttattcgcacaggtctattggtaatatccggcattttcccagtatcgataccaatcaccgcggcggcttggtatctttgggaagtgaagaaacagcgtgcgggagtgctttgggacgttccctctcctcccccagttgagaaagctgagttagaagatggggcctacaggataaagcaaagaggcattctcggatattcacaaatcggagccggcgtatataaggaaggaacgttccatacaatgtggcatgtaacacgtggagcagttctaatgcaccgaggtaaacggattgaaccttcgtgggcagacgtcaagaaagacttaatatcttacgggggcggatggaagttggaaggcgaatggaaagagggcgaagaagtacaagtattggcgttagaaccgggcaagaaccccagagcagttcagactaagcccggtatttttaagacgaacaccggtactatcggagctgtcagcttagacttttctccggggacctcgggatcgccaattgttgatcgaaaaggaaaagtcgttggtttgtatggtaacggtgtagtcacaagatcaggagcatatgtgtcagcaattgcacagacagagaaaagcatcgaagataatcctgaaatagaagacgacatattccgtaagaaaagactaaccattatggatctgcatccaggcgctggaaaaacaaagcggtatcttcctgctattgtacgtgaagcaattaagagaggccttcgaactttaatattagctccaaccagggtagtagcagcggaaatggaagaggctttacgtggactaccgattagatatcagacgcctgccatcaaaaccgaacatacagggagagaaatagtggacttaatgtgtcatgccaccttcacaatgagattgttgagcccagtcagggtacccaattacaaccttataataatggatgaagctcactttactgaccctgctagcatagcggcccgaggttatatttcaacaagggtagaaatgggagaggcagcgggcatctttatgacagcaacccctccaggatcaagagatccattcccgcaaagcaacgcaccaattatggatgaggaacgggaaattccagaaaggtcatggaactcaggacatgagtgggttaccgatttcaaaggtaaaactgtatggttcgtgcctagcataaaagctggcaatgatatagcggcgtgcctcaggaaaaatggtaagaaagtaatacaactatcacgtaaaacctttgatagtgaatacgttaaaacccgagctaatgattgggactttgtggtaacaacagacatttcagagatgggcgccaattttaaggccgaacgggtgattgaccctcgacgatgtatgaaacccgtgattctaaccgatggcgaagaaagggtcatactagctggtccgatgccagtgacacacagcagcgccgcgcagcgaagaggaaggataggacgtaaccccaaaaatgaaaacgaccagtacatttatatgggggaaccattagagaatgatgaagattgcgcacattggaaagaagccaaaatgcttctggacaatattaatacccctgaaggaatcataccctctatgtttgaacccgagagagagaaagtagacgccatcgacggagaataccggcttcgaggtgaggcaagaaaaacattcgtggatctgatgaggagaggcgacttgccagtctggcttgcttacaaggtagcagccgaagggatcaattatactgaccgaaaatggtgtttcgacggcatcaaaaacaaccaaatattggaagaaaatatggaggtcgaaatatggacgaaagaaggtgagagaaagaaattgaaaccgagatggctggatgcccgaatttattctgacccactagctttgaaagagtttaaagaatttgcggctgggagaaagagcctcaccttaaacttaattactgaaatggggagactacccacgtttatgacccaaaaagctcgaaacgctcttgataatttggcagtattgcacactgctgaagctggtggtcgagcctataatcatgcactgtcggaattaccagaaacactggaaaccttacttctcctcacgttacttgccaccgtaactggaggtatcttcctatttttaatgtcaggtaagggaatcggcaaaatgacattaggaatgtgttgcataataactgcatccatccttctatggtacgcccagatacaaccacattggatcgcagcttctataatacttgagttctttttaatagtactactgatacccgaacccgaaaaacaacgtacacctcaagacaatcaattgacgtacgtggtcatcgcgattctaacagtggtagcagcaacgatggctaatgaaatgggattcctagagaagaccaagaaagatctcgggttaggctctatcaccacgcaagaaagcgaatccaatatattagacatcgacttacggccagcaagcgcttggacattatatgcagtcgctacaacattcgtcacacctatgttgagacatagcatagaaaactcttctgttaatgtatcattaactgccatagctaatcaggccaccgttcttatgggactcggcaaagggtggccattatcaaaaatggatataggagtgcctctgttggcaataggctgttactcgcaggttaatccaataaccttgaccgcagcacttttactcctagtagctcactacgcaataataggtccaggtttacaagctaaagctacgcgcgaagctcagaaaagagctgcagcgggaattatgaaaaatccaacggttgatggtataacggttattgatcttgagcctatcccttacgatcccaaatttgaaaaacaattgggtcaagtgatgctcttaattctgtgtgtgacacaagttttgatgatgcgtacgacctgggccctgtgtgaagcccttactttagctactggccctatttctacactctgggaaggcaacccagggcgcttctggaatacaactatcgcagtatcaatggcaaatatatttcgtggaagttatctcgcgggtgcaggattattattcagtataatgaaaaacactacatccacaagacggggaaccgggaacataggagagacactgggcgaaaagtggaaatccagattaaatgctttgggaaaatcggaatttcaaatttataagaaatctgggattcaagaagtggatagaactttagctaaagaaggtataaaaagaggagagacggatcatcacgcggtatctagagggtccgctaaattaagatggtttgtagaacgaaacatggtaacgccagaaggtaaagttgtagacctaggctgtggaaggggtgggtggtcatattactgcggtggtctcaaaaatgttagggaagtcaaaggattaacaaaaggtggtccaggtcacgaggaacccataccaatgtcaacttatggttggaatctagttaggctgcaatccggagtagatgttttcttcacacctcccgagaagtgtgataccttattatgcgatataggggaatcctccccaaacccaaccattgaagccggtcgaacactacgggtcttaaatctggtcgaaaactggttgaataacaacacacaattctgcattaaagtactaaatccatacatgccctctgtaatagaaaagatggaagcacttcaaagacaatacggaggagcattagtcagaaatccactaagtagaaatagcacacatgaaatgtattgggtttcgaacgccacgggcaacatagttagtagtgtaaatatgataagtcgtatgctaattaataggtttaccatgaaacacaagaaagcaacgtatgagccagatgtcgatctaggatcaggaacaagaaacataggcatcgaatcggagataccaaacttagacataattggaaagagaatagagaaaataaaacaagaacatgaaatatcgtggcattacgatcaggatcacccgtataaaacttgggcgtaccatggtagctatgagacaaagcaaacaggatcagcatcgtcaatggttaacggagtagttcgactacttaccaaaccctgggacgttgtccctatggtgacgcaaatggcgatgacagacacaacaccatttggccaacagagagttttcaaagagaaagtggatacgagaactcaagaaccaaaagaagggacgaagaaattaatgaaaattacagcagaatggctttggaaagagctaggaagaaagaaaacaccaaggatgtgtacaagagaagaatttacccgaaaagtacgatctaacgccgcactcggagcaattttcacagacgagaataaatggaaaagtgctcgggaggcagtagaagatggaaggttttgggaactggtcgaccgtgagcgaaatctacatttagaaggcaaatgcgaaacctgtgtctacaatatgatgggaaaaagagaaaagaaacttggggaatttggaaaagcgaaaggctctagagctatttggtacatgtggttaggagcgcgattcttggaatttgaagcattaggatttttaaatgaagatcactggttcagtagggaaaattctttatcaggggtagaaggagaaggtttacatagacttggttatatactaagagatgtcggcaagaaagagggaggagcaatgtatgccgatgacactgctggttgggatacacggattacactagaagatttaaagaatgaggaaatggtaaccaatcacatgaaaggggagcataagaaactagctgaagcaatattcaagctgacctatcagaataaagtagtacgtgtgcaacgtcccactcctagaggcactgtaatggatataataagccgtagagaccaacggggttcaggtcaagtcggcacttacggattaaacacattcacaaatatggaagcacaacttattagacaaatggagggagaaggaatatttaaaagtatacaacatttaacagccacagaagagatagcagttcagaactggcttgcaagggtgggcagggaacggttaagccgcatggcaattagcggagatgactgtgtcgtaaagccaatcgatgatcgattcgcgagtgccttaacagcattaaacgacatgggtaaggtacgaaaagacatacaacagtgggaaccgtcacggggctggaacgattggacacaagtacccttctgcagccatcatttccacgaacttgttatgaaagatgggcgagttcttgttgttccatgcagaaatcaggatgaactcattgggagagcaaggatatcccagggtgcaggttggtctttaaaggaaactgcatgtctcgggaaatcttacgcccaaatgtggacactaatgtactttcatagacgggacctacgtctggcagccaatgctatatgttcggccgttcctagccattgggtaccaacttctagaactacatggtatattcatgcgaagcacgagtggatgactacagaggatatgctagcggtatggaatagagtttggatacaggaaaatccatggatggaggataagacaccagtagagtcgtgggaagaagtaccatatctagggaaaagggaagaccaatggtgcggaagccttattggattaacaagcagagctacatgggccaaaaacatccaaacagcaattaatcaagttagaagtctgatcggaaatgaagaatacacggattacatgccttcaatgaagcggttcagacgggaagaggaagaggctggtgtgctatggtaa

SEQ ID NO: 22433 - RNA, 9873 nt, synthetic construct
  misc_feature 1..9873: note = derived and/or modified CDS sequence (opt6) from DENV-2__HQ705624__SS-prME
  source 1..9873: mol_type = other RNA
actgctggtgtaattgttatgctaataccaacagcaatggcattccatctaacaacacggaatggggagccacatatgattgtaggacggcaggaaaaaggcaaatcacttctttttaaaacagaagacggagtaaatatgtgtacattaatggccatagatcttggagaactatgcgaagatacaataacatataaatgccctttgttaagacaaaatgaacctgaagatatcgactgctggtgcaattcaacatcaacctgggttacatacggaacttgtactactacaggcgagcaccgaagagagaaaagatcggtcgctttagtaccacatgtcggaatgggcctagaaacaaggactgaaacatggatgtcgagtgaaggtgcatggaaacacgttcaaagaatagagacgtggatattacgtcatcccggtttcacaataatggcagcaatcttagcgtacacaattggtaccacacattttcagagggctttaatatttatattattaacagctgtagcgccttcaatgactatgcgatgcataggcataagtaacagagatttcgtagaaggagtatctggtggaagttgggtcgacattgtattagaacacggaagttgtgtaacaacaatggcgaaaaacaaaccaactttggatttcgaattaatcaaaaccgaagcgaaacaaccggcaacattacgtaaatactgcatagaagcaaaattaactaatactacaacggaatcgagatgccctacacagggggaaccgtcattaaatgaagaacaagataagagatttatctgcaaacattctatggtagatcggggatggggaaacgggtgcggactatttggaaaaggtgggattgtaacatgcgctaagttcacttgtaagaagaacatggaagggaaagtcgtacagccagaaaacctagagtatactatagtgattacacctcactccggggaagaacacgcagttgggaacgataccggaaaacatggcaaagaaattaagattaccccacaatcttccattaccgaagccgagttaactggatatggtacggtaacaatggaatgttcaccacgaaccggtttggatttcaacgaaatggttttattacaaatggaggacaaggcgtggctagtacaccgacaatggtttctagacctacccttaccctggttgccgggagcagacacacaaggctcaaattggatacagaaagaaacattagtaactttcaaaaatccgcacgcaaagaaacaggatgtagtagtacttggtagtcaagaaggcgccatgcacacagcattgacaggtgcaactgaaatacaaatgagcagcggcaacctcttattcacgggacacctaaaatgtaggcttcgcatggacaaattacagctcaagggtatgagttactccatgtgcacaggtaaatttaagattgtgaaagagattgcagaaacacaacatggaactattgtaattcgtgtacaatacgagggcgacggatcaccatgtaaggtgccattcgaaataaccgatctagaaaaacggcacgtattaggtcgtttaatcacagtcaaccccattgtaacagaaaaagattcacctgttaacattgaagcagaaccaccatttggagattcatacatcatcattggtgtagaacctggacaattaaaactaaattggttcaagaagggatcatccataggtcaaatgtttgaaacaaccatgagaggtgcaaaacgcatggcaatactaggcgatacggcatgggattttgggagccttgggggcgtattcacctccatcggcaaggcacttcatcaagtattcggcgcaatatatggggcagcgttttccggagtgtcatggacaatgaaaatactcatcggagtaattataacgtggataggaatgaactcaaggtcgacctcactaagcgtctctttagtgcttgtaggtgtagtaacattatacttgggtgcgatggtacaagcagattcaggatgcgtcgtcagttggaaaaacaaggaactaaaatgtggtagtggcattttcatcactgacaacgtacatacatggactgaacaatacaaatttcagcccgaatcaccaagcaaactagcgtctgccatcaaaaaggcacatgaagagggcatatgcggtatccggagcgtaaccagacttgaaaatctaatgtggaaacagataacgccggagttaaaccatatactttctgaaaacgaggtgaaactaacaatcatgaccggggacataagaggcataatgcaagcaggtaaacgaagcctccgaccacaacctactgaactaaaatattcctggaagacttggggtaaagccaaaatgctatctacagaaagtcataatcagactttcttaatagacggaccagaaaccgctgaatgcccaaatacgaatagagcctggaatagcctagaagtagaagattatggatttggcgtatttaccactaatatctggttaaaattgagagacaagcaagacgtcttctgtgatagtaaactaatgtcagctgctatcaaggacaatagagcagtccatgctgatatgggttattggatagagtcagccttgaacgatacttggaaaatggaaaaagcatccttcatagaagtaaaaagttgtcattggccaaaaagccacacattatggtccaatggcgtcctggagtcagagatgattatacctaaaaatttcgcaggaccggtgtctcaacacaactatcgacctggttaccacacacagaccgcaggaccatggcacttaggaaaactcgaaatggatttcgatctgtgtgaaggtacaaccgtagtagttaccgaggactgcggaaatagaggaccatcacttcgcacgacaacagcttcagggaagctcattacagaatggtgttgtcgaagctgtacattacccccactacgatacagaggagaagatgggtgttggtacggcatggaaataaggccgttaaaagaaaaagaagaaaatctcgtaaacagcctagttacggcaggtcatggacaaatcgataatttctcactcggcgtcttgggtatggctttattacttgaggaaatgttacgtacaagaataggtacaaaacacgcgatcttacttgttgctgtcagcttcgtcaccttaattaccggaaacatgagtttcagagatttaggtagggtgatggttatggtaggagcgacaatgacagatgatattggaatgggagtaacttatttagctttgctagcagcgttcaaagttcgaccaacctttgcagccggtctactattaagaaaattaactagcaaggaacttatgatggctacaataggcattgcactactgtcacaatcaaccataccagagacaattttagaacttactgatgcgttagctttaggaatgatggtattgaaaatagtaagaaacatggaaaagtaccaactcgcagtcacggtgatggcaatctcttgcgtgcctaatgcggttatcttgcagaatgcctggaaagtctcatgtactatcctcgcggctgtttcagtttcgcctctgcttcttacttcgtcccaacagaaagccgactggatcccacttgcgttaacgataaaaggattgaaccctacagctattttcctaacaacactatcgagaacgagcaagaaacgttcctggccacttaatgaggctataatggcagtcgggatggtttcaattttggcaagtagtctactcaaaaacgatataccgatgaccggaccacttgtggccggtggtttactaactgtgtgctatgtgctaacaggaaggagcgcagacctggaattggaaagagctgccgatgttaaatgggaggatcaagcggaaatatcaggttcatcaccaatcctgagtataacaatcagtgaagacggcagtatgagtatcaaaaacgaagaggaggaacaaactctcactatattgataaggaccggtcttttagtaatatctggtgtattccccgtttcaataccaataaccgctgccgcttggtacttatgggaagtcaagaaacaaagagcaggcgtcctgtgggatgttccgtcacccccacccgttgaaaaggcggaattagaggatggcgcgtacaggatcaaacaaagaggcatcttgggatattctcaaatcggagcgggggtctacaaagaaggaaccttccacacaatgtggcacgtaactagaggtgccgtgttaatgcatagaggaaaacgtattgagccttcatgggcagacgtgaaaaaggatctgatatcttatggcggcggctggaagttggaaggtgaatggaaagagggtgaagaggtacaagttctggctttggaacccggtaaaaatccacgagcagttcagaccaagcctggaatatttaagaccaatacgggtacaataggggcagtatcattagactttcctggaacaagtgggagccctattgttgacaggaaaggaaaagtagtcgggctatacgggaatggcgtcgtaacacggtctggcgcttatgtaagcgctatagcacaaaccgagaaatcaatagaagataatccagaaatagaagatgatatttttcgcaagaaaagattgacgattatggacttacatccaggtgcgggaaaaactaagagatatctacctgccatcgtacgagaggctataaaacggggattaagaacgctaatcttagctccgacgcgtgtagtagccgctgaaatggaagaagcacttagaggcttacctatccggtaccaaacgactgcaattaaaacagagcatactggtcgtgagattgtggatcttatgtgtcatgctacgtttacaatgcgcctactaagcccggtgagagttccaaattataacttaataataatggatgaagctcattttactgatccagcctccatagcggccagaggttatatttcgacacgggtagagatgggagaagcggcagggatttttatgactgcaacaccgccaggatctagagatccttttccccaaagtaatgcacccataatggacgaagaaagagagatacccgagaggagttggaactcgggacacgaatgggtaaccgatttcaaggggaaaaccgtatggtttgtgccttcaattaaagctggaaacgacatagctgcgtgcctaaggaaaaatggcaagaaagttatacaactatcaaggaaaacctttgactcggaatatgtcaagacaagagcaaatgactgggacttcgtggtaacgaccgacatctcagagatgggggcaaatttcaaagctgagcgtgtcatagatcctaggcgctgtatgaaacctgtcatactaactgacggcgaagaaagagtaattctagctggccccatgccagttacacactcatctgctgcgcaacgtagagggagaattggacgaaaccccaaaaacgaaaatgaccaatacatttatatgggtgaacctctggaaaacgatgaagattgcgctcattggaaagaggctaaaatgttactagacaatataaatacaccggaggggataataccctcaatgtttgaaccggaacgagaaaaagttgatgcaatcgatggagaatataggcttcggggagaagctcgaaaaacatttgtagacttaatgaggagaggggacttacccgtttggttggcatacaaagttgcagccgaaggaataaactacgcagaccgtaaatggtgcttcgatggaattaagaataaccagatcttagaagagaatatggaagttgaaatatggactaaagaaggtgaaaggaagaaactaaaaccaagatggttagacgcaagaatatatagtgacccattagccttaaaagagttcaaagagtttgcagcaggacgaaaatcactcacactaaacctgataactgaaatgggacgcctacctacatttatgacgcaaaaagcccgtaacgcattagacaatttagcggttctccatactgccgaagcgggaggcagagcctacaaccatgctttgagcgaattgcccgagacgttggaaacattattattattgacgttattagcaacggtaacaggtggtatattcttgttccttatgagcggtaaaggaattggtaaaatgacactcgggatgtgctgcataattaccgccagtattctattatggtatgcccaaatacaaccacactggatagcggccagcattatacttgaatttttcttgatagtactgttgattccggaacctgaaaaacaaaggacaccacaggacaatcaacttacatatgttgtaatagcaatcctgacggttgttgcagcgactatggcaaatgaaatggggttcctcgagaaaactaagaaagatttaggtcttgggtcaatcactactcaagagtcagaatctaatatacttgatatagacttgagaccagccagtgcttggaccctctacgcagtagcaactacattcgtaacaccaatgctgagacacagcattgaaaattcaagtgtgaatgtgtcattgacagctatcgctaatcaagcaacagtactaatgggcctaggtaaagggtggccattatcaaaaatggatataggagtgcctcttctagctataggttgctacagtcaagtaaatcccatcacccttacagcagcactgctattacttgtcgcccactatgctataatagggcctgggctccaagctaaggctacaagagaagcacagaaacgtgccgcagcaggaataatgaaaaacccaacggtggatggtatcacagtaatcgatctcgaaccaataccttacgatccaaaatttgaaaaacaattaggacaagtaatgctattaatactttgtgtgacgcaagtattaatgatgaggacaacgtgggctctatgcgaggcattaacacttgctacaggcccaatttcaacattatgggagggcaatcctggcagattctggaataccacgatcgccgtaagtatggcaaatatatttcgagggagctatttagccggagctggacttctatttagtataatgaaaaacacaacgaatacaaggagagggactgggaatataggtgaaactttaggggaaaagtggaaatctagactcaacgctcttggtaaaagtgaatttcaaatttacaagaaatcgggtatacaggaggtagataggaccttagcgaaggaaggaattaaacgtggagaaacagatcaccacgcagtatcccgagggtctgctaaactcaggtggttcgtagaaaggaatatggtgacacctgaaggcaaagtggtggatttgggatgtggaagaggagggtggagttactactgtggtggactcaaaaatgtacgagaggtaaaagggttgacaaaaggaggtccaggacacgaggaacctatacccatgtctacgtatggttggaatcttgtgagactacaatcaggtgttgatgtatttttcacgccaccagaaaaatgtgacacactactatgtgatattggggaatcgtcgccaaatcccactattgaggcggggcgaactcttcgtgtacttaacctggtagaaaactggttaaataataatactcagttttgtattaaagtgcttaacccgtacatgccatcggtaattgagaaaatggaagccttgcaaagaaagtacggaggtgcactcgtcagaaaccccttaagcagaaatagtacgcacgagatgtattgggtatcaaatgcgacagggaatatagtaagtagcgttaatatgatatcaagaatgctaattaaccgattcactatgaaacacaaaaaggctacttacgaaccagacgtagaccttggcagtggcacaagaaacataggaattgaatctgagattccaaacttagatataatcggaaaaagaattgaaaagataaaacaggaacatgaaacatcctggcattatgatcaagatcatccttataaaacatgggcatatcatggatcttatgaaacaaaacagacaggaagcgcttcatcaatggtcaatggagtcgtccgattgctaactaaaccatgggacgtggtgccaatggttactcaaatggcgatgaccgatacaacaccctttggacaacaaagggtattcaaggaaaaagtcgatacacgtacccaagaaccaaaagaaggaaccaagaaacttatgaaaatcacagctgaatggctttggaaagagttagggaagaagaaaacaccaagaatgtgcacccgagaagagttcacgcggaaagtgagatccaatgcagccttaggcgctatcttcactgatgaaaataagtggaaaagcgcgagggaggccgttgaagatggaagattttgggaattggtggatagagagaggaacctccatttagagggaaaatgtgaaacctgcgtgtataacatgatggggaaaagagaaaagaaattaggggagttcggtaaggccaagggcagtagagcaatatggtatatgtggctaggtgcaaggttccttgaatttgaagcgttagggtttctaaacgaggatcattggttttctaggggaaacagtctatcgggcgtagaaggcgagggactacacagattaggatatattttgcgcgacgtgggtaagaaagaaggcggagctatgtatgctgacgacactgcgggatgggatacaaggataacacttgaagacctaaagaatgaagaaatggtgacaaaccacatgaaaggagaacataaaaagctggcagaagctatatttaaactaacctatcaaaataaggtcgttcgagtacaaagacctaccccgcgaggaacagtaatggatattatatcacgaagagaccaaaggggtagtggccaagtagggacatatgggttaaatacctttacgaacatggaggcccaactaattcgacagatggagggagaaggaatttttaaaagcattcaacatttaacagcaactgaggagatagctgtgcaaaattggttagctcgtgtaggcagagaacgactcagccgaatggcaataagtggagacgactgtgtggtaaaaccaattgatgacaggttcgccagtgccttgactgctttgaatgatatgggaaaagtaaggaaagatatccagcaatgggagccatcacgaggctggaatgattggacacaagtcccgttttgttcccaccactttcacgagctagtaatgaaagatggtcgcgtacttgtagtcccgtgtagaaatcaggatgagctaattggacgagcaagaatttcccaaggggcgggctggagtttaaaggaaacagcttgcctaggaaaatcatacgcgcaaatgtggactctaatgtattttcaccgaagagacctaagattagccgccaacgctatctgtagtgccgtcccaagtcactgggtcccaacatctcgaactacatggtcaattcatgcaaaacatgagtggatgacaactgaagacatgctagccgtctggaaccgcgtttggatacaggaaaacccgtggatggaggacaaaaccccagtagaatcctgggaggaagtcccatacttaggaaaacgcgaagaccagtggtgtgggagtctaattggcttaactagcagggccacctgggccaaaaacattcaaactgccataaaccaagtaagaagcctcataggcaatgaagaatatactgattatatgccgtcaatgaagaggttcagacgtgaagaggaagaagcgggggtcctttggtag

SEQ ID NO: 22434 - RNA, 9876 nt, synthetic construct
  misc_feature 1..9876: note = derived and/or modified CDS sequence (opt6) from DENV-2__HQ705625__SS-prME
  source 1..9876: mol_type = other RNA
acagctggagtcattgttatgttaatacctacagcaatggctttccatctgacgacgcggaacggggaaccacacatgattgtagggcgacaagaaaaaggaaaatcattattatttaaaactgaagacggtgtcaatatgtgcacattaatggcaatagaccttggcgaactttgtgaagatacgattacgtataaatgtccgttattgagacaaaatgaaccggaagatatagactgctggtgtaattcaacttcaacgtgggtaacttatgggacgtgcacaacaaccggtgaacatcgccgtgaaaaacgatcagtcgcactggtacctcatgtggggatggggctggaaactagaactgaaacatggatgagctcagaaggcgcatggaaacatgtccaacgaatcgagacctggatactacgtcatccgggattcaccataatggcagcaattttagcttatacaattggtacgacgcactttcagagagcactaatctttatcttattaacagcagtcgcacctagtatgacaatgcgctgcattggcatttctaatcgagacttcgttgaaggagtatcaggaggtagctgggtcgacatagtgcttgaacacggctcatgtgtaacgacgatggctaaaaacaaaccaactctagatttcgaattgatgaaaacagaggcaaaacagccggccactctaagaaaatactgcatagaagccaaactcacgaacaccaccactgagtcacgctgtccaacacaaggagagcctagccttaacgaagaacaggataaaaggtttatttgtaaacattctatggtggataggggatggggaaatggatgcggacttttcggtaaaggagggatagtaacttgtgcgatgttcacttgcaagaaaaatatggagggaaaagtggtacagcctgaaaatttggaatacactatcgtaattacgcctcactctggagaggaacatgcagtaggtaatgatacggggaaacacggaaaagaaataaaaataacaccgcaaagttcaataacggaagccgaactaacaggatacgggacggttactatggagtgttcgccccgaacgggactggatttcaacgagatggtattgcttcaaatggaagacaaagcgtggctggtgcacagacaatggttcctggatctacctttgccgtggctaccaggagcagatacacaaggaagcaactggatacaaaaagaaaccttagtgacatttaaaaatcctcacgccaagaaacaagatgtggtagtcttaggctcccaagaaggtgcgatgcacaccgcgcttaccggtgctactgagattcagatgtcgtctggcaaccttctcttcacaggtcatttgaaatgtcggctaaggatggataaattacagctgaaaggaatgtcatattccatgtgtacaggaaaattcaaaatagtaaaagaaatagcagaaactcaacacggtacaatagttatacgagtacaatacgagggagacggttcaccctgtaaaatcccgtttgagataactgatctcgagaaaaggcatgtcctaggaagattaatcaccgtgaatcccatcgtaaccgaaaaagattcaccggttaacatagaagcagaacctccatttggagattcatatatcattataggcgtagaaccgggacaactaaaactgaattggtttaagaaaggatcatctattggtcagatgttcgaaactacaatgaggggagctaaacgtatggccattctaggagacacagcctgggactttggatcactcgggggtgtcttcacctcaataggaaaagcacttcaccaagttttcggtgcgatttatggagcagctttctcaggtgtatcatggactatgaaaattctcattggagtaattattacatggattggtatgaactcacgaagtacgtcattatctgtttcattggtactggtcggcgtggttacgttatatttaggcgcggtagtacaagctgattctggttgcgttgtaagttggaaaaacaaagaactaaagtgtggatcaggaatattcatcacggataatgtgcatacatggaccgaacaatacaaattccaaccggaaagtcccagcaaattagcctccgcaattcaaaaagctcatgaagaaggtatttgtgggatacgatctgtaacaagactagaaaatttaatgtggaaacagataactcctgaattaaaccacatcctatcggaaaacgaagtcaaactaacaattatgacaggtgacattaaaggaatcatgcaagctgggaagaggagtctcagacctcaaccgactgaattaaaatattcatggaagacttggggaaaagcaaaaatgttaagcaccgaatcgcataatcaaacatttttaatagatggacccgaaactgctgaatgtccaaacacaaatagggcatggaactcacttgaagtcgaggattatggatttggggtgttcacgaccaatatttggctaaaattgcgagaaaagcaggatgtattttgcgactccaaacttatgtctgccgctattaaagacaacagagctgtgcatgcagacatgggttattggattgaaagcgctttgaacgatacgtggaagatggaaaaagctagctttatcgaggtaaaaagttgtcattggccaaagagtcatacactgtggagcaatggtgtattggaatcggaaatgatcattcctaaaaatttcgcaggcccggtttcacaacataactatagaccaggataccatactcaaactgcagggccctggcacttaggtaaacttgaaatggattttgacttttgtgaaggaacaacagtagtcgttactgaagattgtggaaacagaggtccatcattaaggacaacaacggctagcggtaaattaataaccgaatggtgttgtcgctcctgcactctgccacctttacgttatagaggggaagacggctgctggtatggaatggaaatacggccgctaaaagaaaaagaagagaatctggtaaattccttagtaacagccggacatgggcagattgacaatttctctcttggcgtattaggaatggcgttgttcctagaagaaatgttgaggacgcgcataggtaccaaacatgccatactattagtggccgttagttttgtaacattaattacaggcaatatgtcattccgcgacttaggtcgagtaatggtaatggtcggcgcaactatgaccgatgacataggtatgggagtaacctatttagcattgctcgctgcatttaaggtgagacctacctttgcagctgggcttctcttaaggaagttaacctcgaaggagttaatgatggcaaccataggaatagcacttctgtcacaatcaactataccggaaacaattttggaactaactgatgctcttgcgctaggaatgatggttctaaaaatagtaagaaacatggaaaaatatcaattagcagtaacaataatggcaatctcttgcgtaccaaatgccgtgattctgcaaaatgcctggaaagtatcatgcaccatccttgctgctgtgagtgtaagccctcttttactgaccagttcacaacaaaaagcagactggataccactagcgctcacaataaaaggcctgaatccaaccgcaatattcttgaccacattgagccgaacgagcaagaaacgctcgtggcctctaaatgaagcaattatggctgtgggaatggtcagtatcttagcgagctcactgctcaaaaacgatatacctatgacagggccattggtggcgggtggattacttacagtatgttatgttctaactggacgatccgccgatttagaattagaaagagccgcagacgtaaaatgggaagatcaggctgaaatctcaggcagcagtccaatactatcaatcacaatctcagaagatggaagcatgtctataaagaatgaagaagaagaacaaacattgacgattttaatacggacaggattgctagtcataagtggagtatttccagtaagtataccaatcacagctgcagcatggtatttatgggaagtgaagaaacaaagagcgggagttctatgggacgttccaagcccaccaccagtagaaaaggcggaattggaggacggagcgtacaggataaaacagcgcggtatcctaggttactcgcaaataggggctggcgtatacaaggaaggaacttttcatactatgtggcatgttaccagaggtgcagtactgatgcatagaggtaagagaatagaaccgtcatgggcagacgtgaagaaagacctaatttcctatggagggggctggaaattagaaggagaatggaaagaaggtgaagaagtacaagtcctagcactagaaccaggcaaaaatccccgcgcagtgcagactaaacccggaatattcaaaacaaatacgggaactatcggagcagtaagcctagattttagtccaggaacatctggaagccctatagtagacagaaaaggcaaagtagtaggcttatacggcaatggcgtcgtaacacgcagtggagcatatgtgtcagccatagcacaaacagaaaagtcaattgaagacaacccagaaatcgaagacgatatcttccgaaagaaacgcctaactataatggacttgcatccaggtgccggaaaaaccaaaagatacttaccggctatagtacgtgaagccataaaaaggggtttaagaactcttattttggccccgacaagagttgttgctgctgaaatggaagaggccctgaggggtttgccaattcgataccaaaccccggcgataaaaacagaacacacaggccgagaaatagtagacttaatgtgtcacgctacttttacgatgcggcttttatcgccagttagggtacctaattataacttaataatcatggatgaggcccattttaccgacccagcatcaatagccgcccgagggtatatttcaacacgtgtggaaatgggtgaagctgctggcatatttatgacagcaacacctccaggttccagagacccctttccccagtccaatgcgccaataatggacgaagaacgagagataccagaacgatcatggaacagcggacatgaatgggtcacagattttaagggaaaaactgtgtggtttgtcccatcaataaaagcggggaacgacattgcagcttgtctgaggaaaaatggcaagaaagtcatacagcttagcagaaaaacgtttgatagtgaatatgtaaaaactcgagctaatgactgggattttgtcgtaacgactgacatctcagaaatgggagcaaactttaaagccgaacgcgtaattgacccgcgcagatgcatgaaaccggttatattgacagacggtgaggaaagagtcattttggctggtccgatgcctgtaactcattcttctgcagcacaaagacgagggcgtatcggtagaaatccgaaaaacgaaaatgaccaatatatttatatgggggagcctctagaaaacgacgaagactgcgcacattggaaagaggccaaaatgcttttagataacataaacacacccgaaggaataatcccttccatgtttgaaccagaaagagaaaaagtagacgcaatagatggagaatatcgactacgcggagaagctagaaaaacgtttgtagacctgatgcgaagaggcgatttgcctgtgtggctagcctataaggtagcagctgagggcataaattatgcggataggaaatggtgtttcgacgggacgaagaataaccaaatattagaagagaatatggaagtagaaatctggactaaggaaggtgaacggaagaaacttaaacctcgctggttagacgcaaggatctattcggacccgttagcactcaaagaatttaaggagttcgcagctggtagaaaaagtctaactttaaatcttataacggaaatgggtagattgcctacattcatgacacaaaaagcaagaaacgcattagacaacttggccgttctacacacagccgaagctggcggtagagcatacaatcatgcactaagtgaattaccagaaactctagaaactttactgcttctcactttacttgcaactgtaacgggtggaatatttctattcctcatgtcgggaaaaggaatcggtaaaatgaccctgggaatgtgctgcatcataaccgctagtattctactctggtacgcacaaatacaaccacactggatcgcagccagtataattctagagttctttttaatagtactattaataccggaacctgaaaaacaaagaacaccccaagataaccaactcacctacgttgtcatagcgatcctaaccgtcgtggcagccacaatggcaaacgaaatgggatttttagagaaaacaaagaaagatcttggcttgggaagtattacgactcaagaaagtgaatctaacattctcgatattgatttaaggccagcatctgcatggacattgtacgcggtggcaactacgtttgtgacaccaatgcttagacactctatagaaaatagcagcgtcaacgtgtcattgaccgctatagctaatcaggcaaccgtcctaatgggcctgggaaagggatggccattaagcaaaatggatatcggagtacctctactagcaatcgggtgctattcccaggtgaatccaatcactctaactgcagcgctcctactattagtagctcactacgcaatcatagggccaggattacaagcaaaagctactagggaagcacagaaaagagccgccgcgggtataatgaagaatccaacagtggatggaattactgttatagatctagaaccaataccgtatgacccaaaatttgaaaaacaactcggtcaggttatgttgctaattctatgcgtaacacaggtattaatgatgagaacgacatgggcactctgcgaagcactgacgctagcaaccggcccgatatcaacattatgggaaggaaaccccggacggttttggaatacaaccatagcagttagcatggcaaatatattcagaggatcatacctagctggggccggattattattttcaataatgaaaaatacaacatcgacaagaagaggtacaggaaatataggtgaaacactaggagaaaagtggaaaagtcgattgaacgcactaggcaaatctgagttccagatttacaagaaaagtgggatacaagaggtcgatagaacccttgcaaaagaagggattaaacgaggtgagacagatcatcatgcagtatcaagaggttccgcaaaactaaggtggtttgtagagagaaatatggtaactccagaaggaaaggtagtggacctagggtgcggaagaggagggtggagttactactgcggaggactaaagaacgttagagaggtgaaagggctaactaagggtggacctggacacgaggagccgatacctatgtctacctatggatggaatttagttagactccaaagtggggtagatgtattctttactcctcccgaaaaatgcgatacacttctctgcgacatcggggaaagttcacccaatccaaccattgaggctggcagaacattgcgcgtactgaatctagtcgaaaattggcttaacaacaacacacaattctgtataaaagtcctaaacccatatatgccttctgtaattgaaaagatggaagcactacaacgacaatatggtggagccctagttagaaatccattgtctcgaaattccacccacgaaatgtattgggtatcaaatgctacaggcaacattgtatcatcagtaaatatgatctctagaatgttaatcaacagattcaccatgaaacacaagaaagctacttacgaacccgacgtggatttaggctccgggactcggaacattggaatagaatctgaaataccaaacttagacattataggaaagagaatagagaaaatcaagcaagaacatgaaattagctggcactacgaccaagaccatccatataaaacttgggcttatcatggcagttatgaaacaaaacagactggatcagcttctagtatggtcaatggagtcgtcagactcctaaccaaaccatgggatgtagttcctatggtcacgcagatggctatgacggatactaccccgttcggacagcaaagagtatttaaggaaaaggtggacacccgaactcaagaaccgaaagagggaaccaagaaattgatgaaaataacagcagagtggctttggaaagaattagggaagaagaaaactccacgtatgtgtacaagagaagagttcacgaagaaagtgcgatctaatgcagcacttggagctattttcacagacgaaaacaaatggaagagtgcaagggaagcagtggaggatggcagattctgggaattggtagatcgcgaaagaaaccttcatctagaaggaaagtgcgagacctgcgtatataacatgatgggcaaacgtgaaaagaaattgggagagttcggaaaggccaaaggcagccgagcaatatggtatatgtggttaggtgcgcgctttctcgaatttgaagcattgggatttttaaacgaagaccactggttctcaagaggtaattcacttagtggtgtggaaggcgaagggctacataggctagggtatattctaagagatgtaggcaagaaagaaggaggcgcaatgtatgcggacgacacagcaggatgggatacccgaattacgctggaagatctcaaaaatgaagaaatggtcactaaccacatgaaaggtgaacataaaaagctagctgaagctatctttaaactaacttatcaaaacaaagttgttagggttcaacgacctacaccgcgcggtacagtaatggacattataagcagaagggatcaacgagggagcggacaggttggtacatatggattaaacacgtttaccaatatggaagcacaacttataagacaaatggaaggcgaaggcatattcaagagcatacagcatctaacagccacagaagagatagcagttcaaaattggctagcgagggtggggagagaaagactaagtcgtatggcaatatccggagatgactgtgttgttaaacctatagacgaccggtttgctagcgcgttaactgcgttaaacgatatgggaaaagttcgaaaagatatccagcagtgggagccctcacgaggatggaacgactggactcaggtaccgttctgctctcatcattttcacgagctagtaatgaaagacggaagagtattagtagtaccctgcaggaaccaagacgaactaattggacgagcgcgaatttctcagggagctgggtggtcattgaaagaaacagcctgcctaggaaaatcctacgctcaaatgtggactttgatgtattttcatagacgcgacctaagacttgcagcaaatgcaatatgctctgcagttcctagtcattgggtcccgacaagccgaactacgtggagtatacacgcaaagcacgaatggatgaccacagaagatatgttagcagtatggaatagagtttggatacaagaaaatccttggatggaagacaaaactccagtggaatcttgggaagaagtaccttacctcggaaaaagagaggaccaatggtgtggttccttgattggattaacgagcagagcaacctgggcgaaaaacatacaaacggcgataaaccaagtgagatcattaataggaaatgaagaatacactgattatatgccatcaatgaaaagattcagacgcgaagaagaggaagctggagtgttatggtag

SEQ ID NO: 22435 - RNA, 9876 nt, synthetic construct
  misc_feature 1..9876: note = derived and/or modified CDS sequence (opt6) from DENV-2__JF730052__SS-prME
  source 1..9876: mol_type = other RNA
actgcaggagttatagttatgttgataccaacggctatggcattccatctaacaacgcggaacggggaaccacatatgatagtaggcagacaggaaaaaggtaaatcactattatttaaaaccgaagatggagtcaatatgtgtaccttgatggctattgacctcggtgaattatgtgaagatacaatcacatataaatgtcccctacttcggcagaacgagcctgaagacattgactgctggtgtaactcgacaagtacatgggttacatacggaacttgtacaacaacaggtgaacatagacgcgagaaacgatcagttgcccttgtaccccatgtcggaatgggtctggaaacaagaacagaaacttggatgagtagtgaaggcgcgtggaaacatgtgcaacgtatagaaacctggatcttaagacatcccggatttactataatggcagcaatcctggcatacacaataggcacaacccatttccaaagagcactaatattcatactattaacagcagtcgcaccttcgatgactatgcgatgtataggtatcagtaatagagacttcgtggaaggagtttcagggggatcctgggtagatattgtactggaacacggatcatgcgttactacaatggccaaaaacaaacccaccctggattttgaattaatgaaaaccgaggctaaacaaccagccaccctcaggaaatattgcattgaagcaaaactaactaacactactaccgaaagccgttgtccaacacaaggggagcccagtctcaatgaagaacaggacaaacgctttatatgtaaacattctatggtagaccgtggatggggaaatggttgtggactttttggaaaaggaggtattgtaacctgtgcgatgttcacttgtaagaaaaacatggaaggaaaagtggtacaaccagaaaatctcgagtatacgatagtaataacccctcacagcggagaagaacatgctgtcggtaatgatactggaaaacacgggaaagagattaaaataacgccacagagcagtattaccgaagctgagctaaccggatacggaactgtgacgatggagtgttctccgagaacaggcctcgacttcaatgaaatggtattgttacagatggaagataaagcgtggctagtacataggcaatggtttttagacttaccattaccttggttaccaggagctgatactcaaggatctaactggatacaaaaagaaacgttggtaacatttaaaaatccgcacgctaagaaacaagacgtggtagttctagggagccaagagggtgcgatgcatactgcacttaccggcgcaacagagatacagatgtccagtggaaatttattgttcacagggcatttaaaatgtcggctgagaatggataaacttcagctaaaaggaatgagttatagtatgtgtacaggaaaatttaaaatagtcaaagaaatagctgagactcaacacgggacaatagttataagagtacagtacgaaggggatggaagtccttgcaaaatacctttcgaaatcaccgatttggaaaaacgacatgttctcgggagactcattaccgtaaacccgatagtcacagaaaaagactcccctgtaaatatagaagccgagcccccgttcggggattcgtatattataataggagttgaaccgggccaactaaaactgaattggtttaagaagggaagctctattgggcaaatgtttgagactacaatgagaggagccaaaaggatggccatattgggtgacactgcttgggatttcggcagcctaggaggtgtcttcacatctatagggaaagcattacatcaggtctttggagccatctacggggctgcatttagcggagtatcgtggactatgaaaatcttaataggcgtcataattacatggatcggcatgaactctagaagtacttccctaagtgtgagcttagtattggtgggtgtagtcactttatatttgggtgccgttgtccaagcggactccggatgtgtcgtatcttggaaaaataaggaactaaaatgtgggtcaggtatatttataaccgataatgtacatacatggacggagcaatataaatttcaaccagaaagtccaagtaaattagcatccgcaatacaaaaggctcacgaggaagggatatgtggaatccgaagtgtcacgagactagagaacttaatgtggaaacagatcaccccggagttaaaccacattttaagtgaaaacgaagttaaattaaccataatgactggcgatatcaagggcataatgcaagctggtaaacgatcattgaggccacagcctacagaactgaagtactcctggaagacatggggaaaagccaaaatgctaagcactgagtcacataaccaaacattcctaatagacggtccagagactgcagaatgtccaaataccaatcgtgcctggaactcccttgaagttgaagactacggatttggcgttttcactacgaatatatggttaaaacttagagaaaaacaagatgtattctgtgactcgaaattaatgtctgccgcaataaaggacaatcgcgcagtacatgccgacatgggttattggatcgaatctgctctcaatgacacttggaaaatggaaaaagcatcatttatagaagtaaaaagttgtcattggcctaaatctcatacgctgtggtcaaatggtgtattggaatcagaaatgataattcctaaaaactttgcaggacccgtgtcacaacacaactaccgacccggataccatacccagacagctggaccttggcacctgggaaaactagaaatggattttgatttttgtgagggtaccacagttgtagttacagaagactgtggcaatagaggtccatcgttgcgaaccacaactgctagtggcaagttaatcaccgaatggtgctgtcgaagctgcaccctcccacccttgagatatagaggggaagatggttgctggtatggaatggaaattagaccattaaaagaaaaagaggaaaatctagtaaattcccttgttacagccggacacggccaaattgataacttctcactcggcgttctcggcatggcactatttttggaggaaatgttaagaactcggataggcacgaaacacgcgatcttacttgttgctgtctccttcgtgacacttactactggcaatatgtcgtttcgagatttaggtcgagtcatggtaatggttggcgccactatgacagatgacataggcatgggagttacctatttggcgttgctggcagcatttaaagttagaccaacatttgctgccggtttgttattgcgcaaattaacaagcaaggaactaatgatggctactataggtatagctttgctatctcaatctaccatacccgagactattcttgaattgacagacgcgctagcactcggcatgatggtactaaaaatcgtacgcaatatggagaagtaccaactagcagtgactattatggcaatctcatgtgtccctaacgcggttatcttacaaaatgcttggaaagttagttgtacgatactggcggccgtgtcggttagccctttactattaacatcttcacaacaaaaagccgactggattccgctcgccctaaccataaagggcttaaatccaaccgcaatctttctcacgaccctaagccgtaccagtaagaaacgatcgtggccattaaatgaagctattatggccgtcggaatggtgagcatacttgcctcgtcattacttaaaaatgatataccaatgacgggaccactggtagccgggggtttattgacagtttgctatgtattaacgggccgatcggcggatttggaactggaacgggcagcggacgttaagtgggaggatcaggctgaaatttcaggctcaagtccaattctatcaattaccatatccgaagacggttctatgagcataaagaatgaagaggaggagcaaacactaaccattttaataaggactggattattggtaatcagtggtgtattccccgtaagtataccaataacagcggcggcgtggtatctgtgggaagtgaagaaacagagagcaggagtgctctgggacgtcccaagtccaccaccagttgaaaaagcagaattagaagacggagcatatagaataaaacagagaggtattctaggatattcacaaataggtgccggagtatataaagaaggaacatttcatactatgtggcacgtcactaggggtgcagttcttatgcatcgcgggaaaagaattgaaccgagctgggcagacgtaaagaaagaccttatatcatatggtggaggctggaaactggaaggagaatggaaagaaggtgaggaggtacaggtattagccttagaaccaggcaaaaatcctcgtgcggtccaaacgaaaccaggaattttcaaaacaaatacaggaactatcggcgctgtgagcctagatttcagtcctggaacttcgggtagtcccatcgtagatagaaagggaaaagtcgtaggactttacggaaacggtgtcgtaacgagaagcggtgcatacgttagtgctattgctcaaacggagaaatccatagaagacaatccagagatagaagatgacatatttaggaagaaaagactaactattatggatttacaccccggagcaggaaaaacaaaacgctacttgccggcaatcgtacgtgaagcgatcaaacgaggtctaaggacattaattttggcacccaccagggtagtggccgccgaaatggaagaggccttaagaggactaccgattcgatatcaaacaccggcaataaaaacagaacatactggccgcgagatagttgatctcatgtgccacgcaacatttacaatgagactattatctcccgtccgagtacctaattataatttaattattatggatgaagctcattttacagaccccgccagcatagctgctcgaggttatataagcacaagggtagaaatgggcgaagcagcgggaatctttatgaccgccacaccaccaggatctagagacccatttccgcagtcaaatgcccccatcatggacgaggaaagagaaattcctgaaagatcatggaactcaggtcatgaatgggtgacagactttaaaggaaaaactgtttggtttgttccatcaataaaagcgggcaatgatatcgccgcgtgcttacgaaagaacggtaagaaagttatccaactaagccgtaagacatttgatagtgaatatgtcaaaactcgcgctaatgattgggactttgtagtcacgacagatataagtgaaatgggagctaactttaaggcagaacgagttatagaccccaggagatgcatgaaacctgtcattctaacagatggagaagaacgggtgatcctggcagggccaatgcccgttacacacagctctgcagcacagcgaagaggccgaataggaagaaatcccaaaaatgaaaatgaccaatacatatacatgggtgaaccccttgagaacgacgaagactgcgcacattggaaagaggcgaaaatgctattggataatatcaatacccctgaagggattatacctagcatgtttgaaccagaaagggaaaaggtcgatgcaatagatggggagtatcgcctgagaggtgaggctaggaagacatttgtggacttgatgagaagaggagacctgccagtgtggctagcttacaaagttgccgcagaagggattaactatgctgatcgaaaatggtgtttcgatggtactaaaaacaaccaaattttagaagagaatatggaagtagagatttggacaaaagagggagagaggaagaaactaaaaccgagatggctggacgcgaggatttattctgacccattagctttaaaagaatttaaagaatttgcagccggacgcaaaagcctaaccctaaacttaataacagaaatgggtagacttccaactttcatgacacaaaaagccagaaatgcgctcgataacttagcagtgttacatactgccgaggctggaggacgtgcatacaaccatgcgcttagcgaattaccggaaactttggaaacgttactgttgttaaccttactagcgacagtcactggaggaatatttttattccttatgtcaggcaaaggaattggaaaaatgacgctaggtatgtgttgtattataacagcatcaattctactatggtacgcacagatacaaccccattggatagctgcatcaatcatattggagttctttctaattgtacttttaatacctgaaccagaaaaacagaggactcctcaagataatcagctaacatatgttgttatagcaatactgacagtggtagcagccacaatggcaaatgaaatggggtttctggaaaagaccaagaaggatttaggcctaggttcaataacaacacaagagagtgaatcaaacatattagacatagatctcagacccgcttctgcttggaccctgtatgcagtcgctactacctttgttactccaatgttacggcattcgattgaaaactcaagcgttaatgtgtcgttaaccgctattgcaaatcaagcaacagtactcatgggattggggaaaggatggcccttgtccaagatggacattggagttcctctactggcaataggatgttactcacaggttaatcctataaccctcacggcagcactactattattagtagcgcactatgcaatcataggaccaggtttacaagcaaaagccacaagagaagctcagaaaagagcagcagcaggtataatgaaaaatccaactgtggatggaattacggttattgatctggaacccatcccttatgaccccaaatttgaaaaacaattaggacaagtaatgcttctgatactgtgcgttacacaagtgctcatgatgcggactacatgggcgctatgcgaagcgttaaccctagcgactggacctataagtacgctatgggagggtaaccctggaagattttggaacaccacaatagctgtaagtatggcaaacatttttagagggagttatctggctggtgcagggttgttattttctataatgaaaaacaccacctcaacacgtaggggcacagggaacattggcgaaacattaggcgagaaatggaagagtcgtttaaatgcattagggaagtcagaatttcaaatctataagaaaagcggaatccaggaggttgaccgaactttagccaaggagggcattaagagaggagaaacagatcatcatgcagtctcacgtgggtcagctaaactaagatggttcgtagaacgaaacatggtcacacccgaaggtaaagtcgtagatctcggttgtggaagaggaggctggtcttattattgtggtggactaaagaatgtacgagaagtcaaagggctaacaaaaggaggtccagggcatgaggagccaattccaatgtctacctacggttggaatctagtcagattacaatccggcgtagatgtctttttcacacctccagaaaaatgtgatacactactatgtgacataggagaatcatctcccaatccaacaatcgaagcaggacgaacgctccgtgtactgaacttagttgagaattggctaaacaataatacacaattttgtatcaaagttttaaacccatatatgccctctgtaattgagaaaatggaagcgttacaaaggcaatatggaggcgctttggtaaggaatccattatcacgaaatagcactcacgaaatgtattgggtttcaaatgcaacaggtaacatagtttcatcggtgaatatgatatccagaatgcttataaatcgatttacaatgaaacacaagaaagccacatacgaaccggacgttgatctaggttcaggtaccaggaatataggaatagaatcagaaataccaaacctagacatcataggtaaacgaatagaaaagataaagcaagagcacgagatatcatggcattacgaccaagaccatccttacaagacttgggcatatcatgggtcctacgagacgaaacaaaccgggtctgcaagttcgatggtcaacggagtagttcgattgttaacgaaaccctgggacgtagtaccaatggtaactcaaatggctatgaccgatactacaccctttggccagcagcgtgtatttaaagaaaaggtggacacgagaactcaggaaccgaaagaagggaccaagaaacttatgaagattacggccgaatggctatggaaggaattaggaaagaagaaaacaccccgtatgtgcacgagagaagagtttactaagaaagtccgatcaaatgcagctttaggagcgatatttacagacgagaacaaatggaaaagtgccagggaggccgtagaagatggtcgcttttgggaattagtagatcgagaaagaaacctacacctagagggaaaatgtgaaacatgtgtctataacatgatggggaaaagggagaagaaattaggagaatttggtaaagctaaagggtcgcgcgcgatatggtatatgtggcttggtgcccgtttcctggaatttgaagcattaggatttttaaacgaggatcattggttttcaagaggaaactcgttatcaggcgtagaaggagaaggattgcaccgacttggttatatacttagagatgtaggaaagaaagaaggtggcgctatgtatgctgatgatactgccggatgggataccagaataacattagaggaccttaaaaatgaagaaatggtaacgaatcatatgaaaggagaacacaagaaattggcagaagcaatatttaaacttacttatcagaataaagtagtgagggtgcaaagaccgactcctagaggtactgttatggatattattagtagaagagatcagagaggaagtggacaagttggtacatatggccttaatactttcacaaatatggaagcccaattaattagacaaatggaaggagagggaatcttcaagagtatccaacatctcacagccacggaagagatagccgtacaaaattggctagctagggtgggaagagaacgactaagccgaatggcaatatcaggcgacgattgtgtagtaaagcctatcgatgataggtttgcatctgctctgacggcacttaacgacatgggaaaggtcagaaaagatatacaacaatgggaaccctctaggggatggaatgattggacacaagtccccttctgttctcaccattttcatgaattggtaatgaaagacggtcgagtgctggtcgtaccatgtagaaatcaagacgagctgatagggagagctagaatatcacagggcgctggttggagtttaaaagaaactgcttgcttaggtaaatcatacgcacaaatgtggactctgatgtactttcacaggcgagatctccgactggcagcaaatgcaatttgttccgcagttccttcccattgggttcccacaagcagaacaacctggtccatacatgctaagcacgaatggatgaccaccgaggatatgctagccgtatggaatcgtgtgtggatacaagaaaatccgtggatggaggataaaactcctgtcgagagttgggaagaagtaccatacttaggtaaacgagaagatcaatggtgcgggtcattaataggcctgacatccagagctacatgggctaagaatatacagacagcgataaaccaagttaggtccctaatagggaatgaagagtacacagattacatgccatctatgaaacgctttcgtagggaggaagaagaagcaggagtactatggtga

SEQ ID NO: 22436 - RNA, 9876 nt, synthetic construct
  misc_feature 1..9876: note = derived and/or modified CDS sequence (opt6) from DENV-2__EU482748__SS-prME
  source 1..9876: mol_type = other RNA
acagcaggagttatcgtaatgttgataccgacagcaatggcgtttcacctgacaactcgtaatggggagcctcacatgatagttggaaggcaagaaaaagggaagtccttgctgtttaagaccgaagacggagttaatatgtgtacattaatggcaatcgaccttggagaactatgtgaggagaccattacgtataagtgtcccctactaagacaaaacgaacctgaagacatcgattgctggtgtaattcaaccagtacatgggtgacttacggcacatgtaccacaaccggagaacacagaagggaaaagagaagtgtcgccttggttccacacgttggaatgggtctagagacgagaaccgaaacgtggatgagttcagagggagcctggaaacatgtacaaagaatagaaacatggattcttcgacatcccggcttcacgattatggccgctatcctagcatacacaataggaactacacattttcaaagagcgctcattttcatattattaacagcggtagcaccttctatgaccatgagatgtatagggatatctaaccgtgactttgtagaaggtgtctcggggggttcatgggtcgatattgtcttggaacatggatcatgtgttactacgatggcaaaaaacaaacctacattagatttcgaactcattaagaccgaagctaaacaaccggccacactacgcaaatattgcatcgaagccaaattgacaaataccacgactgaaagcaggtgcccgacacaaggcgaaccttctttgaatgaagagcaagacaaacggttcatttgcaaacactccatggtagacagaggttggggtaacggctgtggacttttcggtaaaggaggaatcgttacatgcgctatgtttacctgcaagaaaaatatggaagggaaagttgtacagcctgaaaacctggaatacaccatagtaataaccccccactcgggagaagagcacgctgtgggaaatgacacaggaaaacatggtaaggagataaaaataacacctcagagttcaattacagaagcagagctgacaggatatggaactgtcacaatggaatgttcacctagaacgggattagactttaacgagatggtcctactacaaatggaggataaagcatggctagtgcaccgacagtggttcctagacttgcctcttccttggttaccgggggcggacacgcaaggatccaattggatacagaaggagacactggtaacattcaaaaatccacatgcaaaaaaacaagatgtagtggtattaggctctcaggaaggtgctatgcacacagcacttactggagccacggaaattcaaatgtcttcaggcaatctactattcactggccatttgaaatgcagattgcgaatggacaaactacaattaaagggtatgagttactcaatgtgcacaggcaaatttaaaatagttaaagaaatagcagagacacaacacggtacgatagtaattagggtccagtatgaaggagacggaagcccatgtaaaataccttttgaaataaccgacttagaaaagcgacatgttttaggaagattaatcactgtaaatcctatagtcacagaaaaagatagtccagtaaatattgaggctgaacctccgttcggggattcatacataataatcggtgtggaacctgggcaacttaagcttaactggtttaaaaaaggaagttcaataggccaaatgtttgaaaccacaatgcgaggagcaaagaggatggcgattctaggtgacactgcctgggacttcggatcactgggcggcgtgttcacgagcataggtaaagcattacaccaagtgtttggcgcgatctatggtgcagcattttcaggggtatcatggacgatgaaaatactcatcggagtgataattacctggataggaatgaattcacgctctacatcattgagtgtctcgttggtattagtcggtgtagtaactttatacctgggagctatggtccaagctgacagcggttgcgtcgtatcgtggaaaaataaagagctcaaatgtggaagtgggattttcataaccgataacgttcacacatggaccgaacagtacaagtttcaaccagagagtcctagtaaattagcatcagctattcaaaaagcacatgaagaaggaatatgcggtatacgtagcgtgactcgactagagaacttaatgtggaaacaaataacccctgaattaaaccacatattaagtgagaatgaagtgaaattaactataatgaccggagatataaagggtattatgcaggcaggcaaacgaagtctgaggccacaaccaaccgaattaaaatattcatggaagacctggggaaaagcgaaaatgttaagcacggaatctcataatcaaactttcctaatcgatgggcctgaaacagcagaatgtccaaacacaaatcgagcctggaacagcttggaagtcgaggattatggttttggtgtttttactacgaatatatggttaaaactaagagaaaaacaggacgttttttgcgattcaaagctcatgtcagctgccattaaagataatcgtgcggtacatgccgatatgggttactggatagaaagtgcattaaatgatacttggaaaatggagaaagcaagctttattgaagtgaagagttgccattggccaaagtctcataccttatggtcaaacggggttctagaaagtgaaatgataattcccaaaaattttgcaggaccagtatcgcagcataactacagaccagggtaccatactcaaacagctggaccttggcatttgggaaaattagagatggattttgatctatgcgaaggtacgacggttgttgtaactgaagattgcggaaacaggggtcccagtctacgtacgactacagcaagcggaaagctgataacagaatggtgctgtcgttcatgtacacttccgcccttacgatatcgcggagaagatggttgttggtatggaatggaaataagacctttaaaagaaaaagaggaaaacctagtcaactcactcgtaactgcgggtcacgggcaaatagacaatttctcattaggtgtcttaggaatggccttattcttagaagaaatgttacgaaccaggataggtactaaacatgccattttacttgtagccgtatcatttgttacactcataacgggaaatatgagcttcagggacctcgggagagtaatggttatggtaggggcaacgatgacggacgatattggtatgggcgtaacatatttagcgttattagcggcgtttaaagtgcgcccaacttttgcagcgggactactactgagaaaactcactagcaaagagctaatgatggcaactataggaatagcacttttatcacaaagtaccattcctgagacaatattagagctcactgatgccctagcacttggaatgatggttttaaagattgtaagaaatatggaaaaatatcaattagctgtaactatcatggctatttcttgcgtaccaaacgctgtcattttgcaaaatgcctggaaagtcagttgtacaattttagccgccgtttccgtcagcccacttctcctaacctcgagccaacaaaaggcggactggatacctctagcattaaccataaagggcttaaatccaaccgcaatatttttaacaactttgtctagaacctcaaaaaaaagatcctggcctctaaatgaagcaataatggccgtaggtatggtatcaattctagcgtcatcattattaaaaaacgatatcccaatgaccggaccgttagtggctggcggtctacttacggtgtgctatgttcttacaggacgctcggcagacctagagttagagcgtgccgctgatgtaaaatgggaagaccaggcagaaataagcggaagtagtcccatactatcaatcacaatatcagaagacgggtctatgtctataaaaaatgaagaagaggaacaaactctgacaattttaattagaacgggtttactagtaattagcggtgttttcccggtctctatcccaattacagcagcagcttggtatttatgggaggttaaaaagcaacgagcaggcgttctgtgggacgtgccaagtccgcccccagtggagaaagcagaactcgaggacggggcttataggataaaacaaagaggaatactaggctattcgcaaataggtgcaggtgtctataaagaggggacatttcacacgatgtggcatgtcacaagaggggctgtgttaatgcaccgcggaaaacgtatagaaccgtcctgggccgatgttaaaaaggacctaatcagttacggaggaggatggaaattagagggagaatggaaagaaggagaagaagttcaagttttggccttggaaccaggaaaaaacccgcgcgcagtccaaacgaagccgggaatttttaagacgaacactgggacaataggtgccgtatctttggacttctccccaggtacatctggatcgccgatcgttgaccgtaaaggtaaggttgttggattatatggcaatggggtggtaactcgaagtggagcttatgtctcggcgatagctcagacggagaaatcaatagaagataatccggaaatagaagacgacatatttagaaagaagcgtttaacaataatggatttacatccgggtgcaggaaaaacaaaacgttatttaccagctatagttagagaagctattaagcgtgggttgaggactttgattctagcaccaacaagggtagttgcagcggagatggaagaggcactgcgaggattacccatacgttatcagacgcctgcaataaagacagaacacacagggcgagaaatagtagatttaatgtgtcatgctacttttactatgcgacttctatcacctgttagagtgccaaattacaatctgataataatggatgaagcccattttactgatccggcatcaatagccgctagaggatacattagcactagagtcgaaatgggggaagcggctggaatatttatgaccgcaacaccccccggatctcgagatcccttcccccaaagcaatgctccgataatggacgaagagagagaaatacctgaacgctcctggaacagcggacatgaatgggtgacggatttcaaagggaaaactgtctggttcgtaccatcaatcaaggcgggaaacgacatagctgcgtgtctaagaaaaaatgggaaaaaagttattcaactatcaagaaaaacctttgactcagaatacgtaaaaacgagagcaaacgattgggattttgtagttacaacagatataagtgaaatgggcgccaactttaaagcagaaagagtcatagatccacgacgatgtatgaaacctgttatccttacagatggagaagaacgggtaatcttagcagggccgatgccggttacacactccagtgccgcacaaagacgcggacggataggaaggaatcccaagaatgaaaatgaccaatacatatacatgggtgagcccctagaaaatgacgaagattgcgctcactggaaagaggcgaaaatgctattagacaacattaataccccggaaggtattattccctcgatgtttgaacctgaacgagagaaagttgatgcgatagatggggaatatagacttagaggagaggctaggaagacattcgtagacctgatgagacgaggggatttaccagtctggctggcatataaagtcgctgcagaaggtataaattacgcagaccgaaagtggtgcttcgacggtataaaaaataatcaaatcttggaagaaaatatggaagtagaaatatggactaaagagggtgaacgaaaaaaactaaagccacgatggttagacgcaagaatctatagcgatcctttagcgttgaaggaatttaaagagtttgcggccggaaggaaatcattgacactaaacttaataactgaaatggggcgattaccgacattcatgacacaaaaagcaagaaatgcactagacaatctagcggttttacacaccgcagaggctggtggaagagcttataatcatgccttgagcgagttaccggagaccctagagacattactattactaacattactagccacagttacgggaggcatcttcttatttctgatgagcgggaagggcataggcaagatgactttagggatgtgctgtataattacggcctcaattctgctatggtacgcacaaatccagccacattggatagccgcttctataatattagaattttttcttattgtattgctaattcccgagcctgagaaacaaagaacgcctcaagacaaccaacttacctacgttgtaatcgcaatacttacagtggttgccgcaaccatggccaacgaaatgggttttttagaaaagacaaagaaggacctaggactaggtagtataacaacccaagaatccgaatcaaacatcttggatattgacctgcgaccagcaagcgcatggacattgtatgcagtcgcaacaaccttcgtaacgcctatgctccgccactcgatagaaaattcatcagtaaatgtctcgctgactgctatagcaaatcaagcaacggtattgatgggtctgggaaaaggatggcccctaagtaaaatggatatcggtgttcccctcttggcgataggctgctattcacaagtaaatccgattacactaacagccgctcttcttctactagtagctcattacgcaattattggtccgggcctacaggctaaagcgacccgcgaagcccaaaaaagagcagcggcaggaattatgaaaaacccaactgtagacgggataacagtaatagacctcgaacctataccatacgatcctaaatttgaaaaacagttagggcaagtcatgctattaatactatgtgtcacacaagttctaatgatgcgcaccacctgggctctatgcgaagcacttactctagctaccggccccatatctactctatgggagggaaatccgggccggttctggaacaccacaatagcagtatctatggcaaatatatttcgaggaagctacttggcaggagcaggtcttcttttttccataatgaagaacacaacatcgacaaggcgaggtactgggaacataggagaaacattgggagaaaagtggaagtctagactcaacgcattaggtaagtcagaatttcaaatttataaaaaatccggaatacaagaagtagatagaacacttgcaaaagagggcataaaaagaggggagactgaccatcatgcagtgagtcggggatcggcaaaactaagatggttcgtagaaaggaacatggttacacctgaaggtaaggtagtagatctcggatgtggtagaggagggtggtcatactattgtggtgggctgaaaaatgtgagagaagttaaaggcctcacaaaaggtggtccaggtcatgaagaacctatcccaatgtccacatacggttggaacctagtacgccttcagagcggtgtagacgtattcttcacgccaccggagaagtgtgacacgttattatgtgatataggcgaaagcagccctaaccccacaatagaagcgggaagaactctaagagtacttaatcttgtagaaaattggttaaacaacaacacgcagttctgtatcaaggtattaaacccgtatatgccatcagtcatcgagaaaatggaggcactgcaaagaaaatatggcggagctttagttcgaaatcccttatcaaggaattcaactcacgaaatgtattgggtttcaaatgcaacagggaatatagtcagctcagttaacatgattagtagaatgctaattaaccgatttacaatgaagcataaaaaaacaacttatgagccagacgtcgatttaggatcaggtacccgaaatatcggtatagaatcagaaatacccaatcttgacataatcggtaagagaattgaaaaaataaaacaagaacatgagacctcatggcattacgatcaggaccacccttacaaaacatgggcttaccacggttcttacgaaaccaaacaaactggatcagcatcttcaatggtgaatggagttgtgagacttttaacaaaaccctgggatgtggtgcctatggttacgcaaatggcaatgacagacacaaccccctttggccaacaaagggtcttcaaagaaaaggtagacaccagaacccaggaaccgaaagaaggaacgaaaaaactaatgaaaatcaccgcagagtggttatggaaagagctaggcaaaaagaaaacaccacgcatgtgtacccgagaagaatttacaaggaaagtacgtagtaatgctgctttaggagccatattcacggatgagaacaaatggaagagtgcaagagaagccgtcgaggatggtcgtttctgggagttagtggacagagagcgaaacttacacttagaagggaaatgcgaaacatgtgtttataatatgatgggtaaaagagaaaaaaaactaggagaatttggaaaggctaaaggcagtagagctatatggtatatgtggcttggggcacgttttcttgaatttgaagcactaggcttcctaaatgaagatcactggtttagtagaggaaactcattatcgggcgtagaaggggagggactacataggttaggctacattttacgagacgtttctaaaaaagagggaggtgcaatgtatgcggatgatacggccggttgggacacaaggataactttagaagatttaaaaaacgaagagatggttacgaaccacatgaaaggggaacacaagaagttagctgaggccatattcaagctgacttaccaaaataaggtcgtaagagtacaacgtccaacacccagaggaaccgtcatggatattatttctcggagagaccagagaggtagcggtcaggtgggaacgtacggattgaatacatttacaaatatggaagcacaactaatcaggcaaatggagggcgaaggcatttttaaatctatacaacaccttacggctactgaagagatcgtagtacaaaactggttagcacgtgttggtagagaacggctgtcgagaatggcaataagtggcgacgactgtgttgtcaaaccaatagatgatcgattcgcaagcgccctaacggcattgaatgatatgggcaaagtgaggaaggatatacaacaatgggagccatcacgaggttggaatgactggacacaagttcctttttgttcacaccactttcatgagcttgttatgaaggacggcagagttctagtagtcccgtgtagaaatcaagacgaattgatagggagagcgaggatatctcaaggagcaggttggtcactcaaagagacagcgtgcttaggcaaatcatatgcacaaatgtggactttaatgtactttcatagacgcgacttgaggcttgccgcaaacgcaatttgttcggccgttccctcacattgggtcccaacctcgagaaccacatggtccattcacgcaaaacatgaatggatgactacagaagacatgttagccgtatggaacagagtctggatccaagaaaatccatggatggaagataagactccggtagagtcatgggaagaagtaccctatttaggtaaacgagaagaccaatggtgtggatcgctcataggtttaactagtagagcaacatgggcaaaaaatattcaaacagcaatcaaccaagtgcgatcactaatcggaaacgaagaatatacggactatatgccgagtatgaaaagatttaggcgggaagaagaggaggcgggagtactttggtga

SEQ ID NO: 22437 - RNA, 9876 nt, synthetic construct
  misc_feature 1..9876: note = derived and/or modified CDS sequence (opt6) from DENV-2__EU482749__SS-prME
  source 1..9876: mol_type = other RNA
acagcaggggtcatagtcatgttaatacctactgcgatggcattccatcttacgacaaggaatggtgagccgcatatgatagtcggccgccaagaaaagggaaaaagtttgttatttaaaacagaggacggggtcaacatgtgcactcttatggcaattgacctcggtgagctatgcgaggatactatcacatacaaatgccctctattacgtcaaaatgagccagaggacatagattgctggtgtaattctacgagcacatgggttacatatggaacttgtacgactacaggagaacaccgaagggaaaaacggtcagtagcactcgtaccacatgttggtatgggcttagaaacaagaactgaaacatggatgagctcagagggggcatggaagcatgttcaaacaatagaaacctggatactacgacatcctgggtttactatcatggccgcaatattagcgtatacgatagggacgacccattttcaaagggctctcatattcatattattaaccgcagtggcgccaagcatgacaatgaggtgtataggaatcagtaacagggattttgtggaaggcgtttcggggggtagctgggtggacatagtactagaacatggcagctgtgttacaacgatggctaaaaataaaccaacattagactttgaattaataaaaacagaggcaaaacaaccagcaacgttgcgaaagtattgtattgaagccaagttaactaacactactacagaaagcaggtgtccaacacaaggagagcctagccttagtgaggaacaggataaaagatttatatgtaaacattcgatggtcgatcgaggatggggaaatgggtgcgggctgttcggaaagggtggtattgtaacatgcgcaatgttcacatgcaaaaaaaacatggaaggaaaggtcgtacaaccagagaaccttgagtacaccatcgtaataacgcctcactccggtgaggagcacgctgtaggtaacgacacaggaaaacatggaaaagaaataaaaattacaccgcaaagctcgattaccgaagcagaactcacaggttatggtactgtcaccatggagtgttcaccgagaactggattagacttcaatgagatggtattactccaaatggaggataaggcatggctcgtgcatcgccaatggttcttagacctgcctctgccatggctaccgggggctgacacacaagggtcaaattggattcaaaaagaaactctagtgacatttaaaaatccacatgctaaaaagcaagacgtagtggttctaggttcgcaggaaggagcaatgcacacagcactgaccggcgcaacagaaattcagatgagtagtggaaacctgctttttacaggtcatttaaaatgtcgattgcgaatggacaaacttcaattgaaaggaatgtcatattcaatgtgtaccggcaaatttaaaatcgtaaaggaaatcgcggaaacccagcacggtacgatagtgatacgtgtacagtacgaaggagacggaagtccatgcaaaatcccgttcgaaatcacagaccttgagaagaggcacgtattgggaaggcttataaccgtaaacccaattgtaacagaaaaagattctccggtaaacatagaggcagaacctccgtttggtgattcgtacataattatcggggtagaacctggacaattaaaactaaactggtttaaaaaaggctcgtctattggacaaatgttcgaaacaacgatgagaggggccaagcgaatggccattttgggagacacagcatgggattttggatctctaggcggagtattcacttcaatcggaaaggccttacaccaagttttcggagctatatacggagcagccttttcgggagtatcttggaccatgaaaatcctaataggagtgataattacttggataggaatgaatagccgttcaacttccttaagcgtgagtttggtactggtaggcgtcgtaacactttacctaggagctatggtacaagcagattccggttgcgtagttagctggaagaataaggagctaaagtgcggctcaggaatttttattaccgataatgtacatacatggacggaacaatataaatttcaaccggaaagcccatccaaactagcgagcgcaatacaaaaggcacacgaagaaggaatatgtggtattcgaagtgtaacacgtctcgaaaatttaatgtggaagcaaataacaccagaactgaatcatatacttagtgagaatgaagtaaaacttaccataatgacaggggacataagaggaataatgcaggcgggaaagagaagccttcgtccccaaccaactgagctaaaatattcttggaagacgtggggtaaagccaagatgctatccacggagtcccataatcagacttttctcatagacggtcctgaaacagcagagtgtccaaataccaaccgggcctggaattcattggaagtcgaagattacggctttggagtcttcacaacaaacatttggcttaaattaagagaaaaacaggacgttttttgtgactctaaactaatgtcagctgcgataaaagataacagagccgtgcatgctgatatgggctattggatagagtcagctctgaacgatacgtggaaaatggaaaaagcatcttttatagaggtaaagtcatgtcattggccaaaatcacacacgctgtggtctaacggggtactagaatcagaaatgattatcccaaagaactttgcaggcccagtttcacagcacaactatagacctggctaccacacacaaacagcaggcccctggcaccttggaaagctggaaatggatttcgatctatgtgaaggaaccacagtagttgttaccgaagattgcgggaatcgtggacccagcttacgaacaacaaccgcgtccggaaaattaattacggaatggtgttgcagaagctgcaccctgccacccttaagatacagaggagaggacggatgttggtacggcatggaaattcgacctttgaaagaaaaggaagaaaatctagttaacagcttagtaactgcaggccatggccaaatagacaacttttcactgggcgtgttgggtatggccctattccttgaagagatgttgcgtactcgtatcggaacgaagcatgctatattactagttgctgtatcattcgtaacgctaataaccggcaacatgagttttagggatttaggaagggtcatggtaatggtcggtgcaaccatgacggatgatattggtatgggagtaacataccttgcgctcttagccgcatttaaagtaaggcccacattcgctgcgggactattgttaaggaaattaacaagcaaagaactaatgatggcgacgattggaattgcactacttagtcagagtactatacctgaaacaatcctcgaattgacagacgcgttagcccttggaatgatggtacttaaaatagtacgaaatatggaaaaatatcaacttgcagtgacaataatggccatatcttgcgtgccaaacgcagtaatattacaaaacgcatggaaagtaagctgtactattttggcggctgtatcggtatcgccgttgctcttaactagcagtcagcaaaaggctgattggatcccgcttgcactcacgataaaaggcctgaatcccacggctatcttcttaaccactctttcgcgtactagcaaaaaaaggagctggcctttaaatgaggcaataatggcagtgggaatggtctcaattttagcctccagtctccttaagaatgacatccccatgacagggcccttagtagcaggaggtcttttaacagtgtgctacgttttaaccggcagatcagctgatcttgaactcgagagggcagccgatgttaaatgggaagaccaagcagaaattagcggatcaagtcccatcctttcaataacaatatctgaagacggttccatgtctattaagaacgaagaagaagaacaaactcttactatactcattagaactggactacttgttatctccggtgtttttccagtttccattccaataacggcagcagcgtggtatctttgggaagtaaaaaaacagagagccggtgtattgtgggacgttccttcaccacctccggtagaaaaagcagagttagaagacggagcgtatagaatcaaacaaagaggcatcttaggatattcacaaattggggcaggagtgtacaaagaaggaacctttcatacgatgtggcatgtaacaagaggtgcagtcttgatgcaccgaggtaaaagaattgagccaagctgggctgacgttaagaaagatctaattagctacggtgggggatggaaattagagggtgagtggaaggagggagaagaggtacaggtattggctttagagcctggcaaaaatcctagggccgtacagacaaaacctggaatatttaaaactaataccggcaccatcggagctgtctcactagatttttctccgggtacctctggaagtccaatcgtcgatagaaaaggaaaagttgtaggactatatggtaacggagtagtcacgaggagcggggcatacgtaagcgcaattgcgcaaacggaaaagagcatagaagacaacccagaaatcgaggatgatattttcagaaagaaaagattgactataatggaccttcatccaggagccggaaagaccaaaaggtatcttcctgcaatagtaagagaagcaataaaacgcggactacgtacactaatattagcaccaacacgtgttgttgccgcagagatggaagaagccctacgaggattgccaataagataccagaccacagctataaaaactgaacacacaggaagagaaatcgtcgacttaatgtgtcatgcgacatttacaatgcgactattatcaccagtaagagtaccgaattataatttgatcataatggatgaagcacatttcacggatcccgcatccatagcagccagaggctatatatctacaagagtggagatgggcgaagcagcaggcatttttatgacagcgacacctccaggatctagagaccccttcccacaaagcaatgctccgataatggatgaagagcgggagattcccgaaagatcttggaattcggggcacgagtgggtaacagacttcaaaggtaagacagtctggttcgtaccgtcaattaaagcaggaaatgatatcgctgcatgcttacggaaaaatggaaagaaagttattcaattatcacgaaaaacatttgacagcgagtacgtaaaaacaagagctaatgactgggattttgtagtaaccaccgatataagtgaaatgggggcaaactttaaagcagagagagtaattgatcctaggcggtgcatgaaacctgtcatcctcaccgacggagaggaacgggtaattctcgcaggtccaatgcccgtaacacatagttccgcagcgcaacgaaggggaagaattggccgtaatccaaaaaacgagaatgaccaatatatctacatgggagaaccattagaaaacgacgaagactgtgcacactggaaagaagcaaagatgctcttggataatataaatacaccagagggtatcattcctagtatgttcgagccagagcgagaaaaagtagacgcaatagatggagaatacagactaagaggagaagcacgcaaaaccttcgtggacctcatgaggcgaggtgatttaccagtatggctggcttataaagtagccgcagagggaattaactatgcagatcgcaaatggtgtttcgacggtataaaaaacaaccaaattcttgaggaaaacatggaagttgagatatggaccaaggagggagaaagaaaaaaactcaagcccaggtggttagacgcgagaatatatagtgacccattggcgttaaaagaattcaaagaatttgcggctgggagaaagagcctcacactaaacttgatcaccgaaatgggaagactaccaacatttatgacacaaaaggcacgaaacgcgctggacaacttggcggtgctgcatacagctgaagcaggaggaagggcatacaaccatgccttatccgaattacctgaaacactagaaacattattacttttaactttattagctactgttacgggaggaatattcttattcttaatgtccggaaaaggcattggaaaaatgacactgggaatgtgttgcataataacagcgtcaatactattatggtacgcgcaaattcaacctcactggattgcagcaagtataatattggaattttttttaattgtattgttaattccagaaccagaaaagcaacgcacacctcaggacaaccaactaacttacgtagttatagcaatattaaccgtagtagcggcaacgatggcaaatgagatgggattcttagaaaagacaaaaaaagatcttggactcggttcaataacaacacaagagtctgagtctaatattttagatattgatttgagaccggcaagtgcgtggactttatacgcagtcgccaccaccttcgtaactcccatgttacgtcattcgatagaaaattcatcggttaacgtcagtttaacagcgatagcaaatcaagcaacagtacttatgggtttaggaaaaggatggccactttccaaaatggacatcggcgtcccattgcttgccataggctgttattcacaggtaaacccaattacattaacagctgccttactactactggtcgcgcattatgcaataataggacccggcttgcaggcaaaagcaaccagggaagctcagaagagggctgctgcagggataatgaaaaacccaacagtagatggtataacggttatagacttagaaccgataccgtacgaccctaaatttgagaagcaattaggtcaagtcatgttgttaatcttatgtgtcacacaagtacttatgatgagaaccacgtgggctctatgtgaagcgttaacattagcaacgggtccaatatccaccctttgggaagggaacccggggcgcttttggaacacaacaatagcggtatccatggcaaatatatttaggggttcctatctcgccggggcaggactattgttctcaataatgaaaaacacaactaacaccagaaggggcacaggaaacatcggagaaaccctaggagaaaaatggaaaagccgtctcaacgcacttgggaaaagcgaatttcagatatataagaaatctggtatccaggaagtagatcggaccctcgcaaaagaagggataaagagaggagaaactgatcatcatgctgtttcaaggggatcagcaaaactgcgctggtttgtagagaggaacatggtgactcccgaggggaaagtagttgatttgggatgcggaagggggggatggtcatattattgtggaggtttaaaaaatgtgcgagaagtaaaaggattaacaaaagggggaccagggcatgaagagccaattccaatgtcgacgtacggatggaaccttgtacggcttcaaagtggagtggatgtattcttcacgccgccagaaaaatgcgacacactgctatgtgacataggtgagtcaagccctaacccaactatagaagcaggacgcactttacgtgttctgaacttagtcgaaaactggctaaacaacaacacccagttttgtataaaggtactgaatccctacatgccatcagttatagagaaaatggaggctctacaaagaaaatatggaggagcactagtaagaaaccccctatctaggaacagtacacacgaaatgtattgggtatccaatgctaccggcaatatcgtaagctccgttaatatgatctcccgcatgctgataaatagattcacaatgaaacataaaaaagcaacttacgaaccagatgtagatctgggatcgggaacgagaaacataggtattgaatcagaaataccaaatctagatataattggaaagcgaattgaaaaaataaaacaagagcatgaaacgtcatggcactatgaccaagaccatccgtacaaaacatgggcttatcatggatcgtatgagacgaaacagacgggatctgcttcttccatggtcaatggagtagtccgcctactaacaaagccctgggatgtagtgccaatggtgacccaaatggcaatgactgataccacgccgttcggacagcaaagagtttttaaagaaaaagttgatactaggacgcaagaaccaaaagaaggaacaaaaaagctaatgaaaataacagcggaatggctctggaaagaactcgggaagaaaaaaacacctcgtatgtgcacacgagaagaattcacgagaaaagtacgtagtaatgcagcacttggtgcaatctttacagatgaaaataaatggaaatcagcaagagaagcggtagaagatgggcggttttgggagctggtagatcgtgaaagaaacttacatttagaaggtaaatgtgaaacgtgcgtttacaatatgatgggaaaaagagaaaagaaactaggtgaatttggaaaggcaaaaggatcgagagccatttggtacatgtggttaggggcacgatttctagagtttgaagcactaggtttcttaaatgaagatcactggttctcaagaggaaacagcctaagcggcgtggagggagagggtttacataggctaggatacatcttgagagatgtcggtaagaaagaaggtggagccatgtacgctgacgacacagctggttgggatacaagaattacactagaggatttaaaaaatgaagaaatggttacaaaccatatgaaaggagaacataagaaactagctgaggcaatttttaagttaacataccagaacaaagtagtaagagtacaaagaccaacacccagaggcaccgtgatggatataatttcgaggcgagatcaacgaggatcagggcaggtgggtacatatggactaaatacatttacgaatatggaggcgcagttaattagacagatggaaggggagggaattttcaagtcaatacaacatcttactgcgacagaagaaatagctgtacaaaattggcttgccagagtcggtagagaaagattatcgagaatggcaatatctggtgatgattgcgtagtaaaaccaatagatgacaggttcgcaagtgctttgactgcattgaatgatatgggtaagataagaaaagatattcagcagtgggaaccaagccgaggatggaatgactggactcaagtaccattttgttcccaccattttcacgaattggtaatgaaggacggcagagttctcgtcgtaccctgtagaaaccaggatgaattaatcgggcgagccaggattagccaaggggcggggtggtctctcaaggaaacggcatgtttaggcaagagttatgcacaaatgtggacccttatgtatttccaccgtagagacttaagattagcagccaatgcaatatgttcagcggtcccatcccactgggtccctactagtaggacgacttggtcaatccacgcgaagcacgaatggatgactacggaagacatgttggcagtctggaatagagtttggattcaagaaaatccatggatggaagataaaacaccagtcgaatcttgggaggaagttccctacctgggcaaacgagaggaccaatggtgtggttcattaatcgggttaacaagtagagcaacatgggcaaagaacatacaaactgcaattaaccaggtaagaagcctaatcggcaacgaggagtacacggattacatgccttctatgaagagattccgaagagaggaagaagaagctggagtactttggtag

SEQ ID NO: 22438 - RNA, 9876 nt, synthetic construct
  misc_feature 1..9876: note = derived and/or modified CDS sequence (opt6) from DENV-2__EU482751__SS-prME
  source 1..9876: mol_type = other RNA
actgctggggtgattgtaatgcttatacctaccgcaatggcatttcacctaactactagaaatggggaaccacatatgatagttggccgacaagaaaaagggaaatcattactctttaaaactgaagacggcgtgaatatgtgtacccttatggcaatagatctgggagaattgtgtgaagatacaatcacctataaatgtccattacttagacaaaatgaaccagaggacatagactgttggtgtaactcaacgtcgacctgggtaacttatggaacatgtactactacaggggaacatcgaagagaaaagcgttcagtcgccctagtcccccatgtaggaatgggactagaaacaagaacagagacctggatgtctagtgaaggggcgtggaaacatgttcaacgaattgaaacctggattctgcgccatcccggattcacgattatggctgcaatactggcatatactattggaactacgcatttccaaagagcactaatttttatattgctaacagctgtagcaccaagcatgactatgcgatgcattggaatctctaacagagatttcgtagaaggcgtctcaggtggaagttgggttgatattgttttagaacacgggagctgtgtaacaacaatggccaaaaacaaacctacacttgattttgaattgataaaaacagaagccaaacagccagcaacgttgcgaaaatattgcatagaggctaaacttactaatacgaccaccgaatcaagatgtccgacacaaggagaaccatcgctgaatgaggaacaagataaacgctttatatgtaaacacagtatggtggacagaggctggggaaacggttgtggcctctttgggaaaggaggcattgtaacgtgcgcgatgtttacgtgtaaaaagaacatggaagggaaggttgtgcagcccgaaaatttggagtatacaattgtaatcacccctcattcaggagaggagcacgctgtaggcaatgacacaggaaaacacggtaaagaaataaagataacacctcaaagttctataaccgaggccgagttgacgggatatggaacagtcacgatggaatgtagtcctagaacgggtcttgacttcaacgaaatggtcctgttacaaatggaggataaagcctggttggtacacagacagtggttcctagatttacctcttccatggctccctggtgcagatactcaggggtcaaactggatacaaaaggaaaccctagtcacttttaagaacccacacgccaagaaacaagatgtagttgttctaggatcccaagaaggtgcgatgcatacagcgttaaccggagcaactgagatacaaatgtcaagtggtaaccttttatttacgggccacttgaaatgtcgcctccgaatggacaaattgcaactcaaaggcatgtcctattcaatgtgtactggaaaatttaaaattgtaaaggaaatagccgaaacccaacacgggactatagtaatccgagtacagtatgaaggtgatggatcaccatgtaaaatacctttcgagataacagatttagagaagagacatgtactaggaagattgataactgtaaaccctatagtgacagaaaaagatagccccgtaaacatagaagcggaaccacctttcggagattcttatattatcataggcgtggaaccaggacaactaaagttaaattggtttaagaaagggagttcaattggacagatgtttgaaacaactatgcgtggcgcaaaacggatggcaattttaggagatactgcatgggattttggcagtctgggaggcgtatttacgagtataggtaaagcactccatcaggtattcggagctatttacggtgccgctttttcaggagtatcttggacaatgaaaatactaataggcgtcataataacgtggataggaatgaactcaaggtcaacaagccttagcgtaagtctagtcctagttggcgtcgttactctttatctgggcgcagtggtgcaagctgactccggctgtgtcgtttcatggaaaaataaagagcttaagtgtggcagcggcattttcattaccgacaatgtacatacttggaccgaacaatataagtttcaaccagaaagtccatcgaaacttgcatcagcgatacaaaaagcacacgaagaaggaatatgtggaataagatctgtcacaagacttgaaaatctgatgtggaaacagatcacgcccgaattaaaccatatcctatctgaaaatgaggtaaaactaaccataatgacaggagatatcaagggcataatgcaagctggcaaaaggagcttaagaccccaaccgaccgaattaaaatacagttggaaaacatgggggaaagcaaagatgttgtctacagaatcgcacaaccaaactttcctgattgatggccccgaaaccgccgaatgtccaaacacaaatagagcatggaacagtttggaagtggaagattatggttttggagtttttacaacaaacatatggttaaaattgcgagaaaaacaagatgtattttgtgactcaaagttaatgagcgccgcaattaaggataaccgagcagtacatgctgatatgggatattggattgaatctgccttgaatgatacatggaaaatggagaaagcgtccttcattgaagtgaaatcgtgtcattggccgaaaagtcacacactatggtcaaatggagtcttagaaagcgaaatgataatccctaagaactttgctggaccggtaagccaacataattacagaccagggtaccacacacaaactgcgggaccatggcatttaggtaaattagaaatggattttgacttttgtgaaggaacgaccgtcgtcgtaacagaagattgtggcaatcgtggtccaagtctcaggaccacaaccgcgagtggcaaactaataacagaatggtgctgtagatcatgcacgttaccaccgttgagatatcgtggagaagacggctgctggtatggaatggaaatacgccctttaaaagagaaagaagaaaatttggtaaacagcctagttaccgcgggtcatggacagatcgacaactttagccttggtgttcttgggatggctctttttctcgaagaaatgctcagaactagaattgggaccaaacatgcaatattactggtagcagtaagttttgttacattaataaccggtaacatgtcgttcagagatttagggagagttatggtaatggttggcgctactatgacagatgatataggtatgggagtaacttacttggctttgctggccgccttcaaagtacgaccaacattcgccgctggactcctactgcgtaagttaacaagtaaagagttaatgatggcgacaatcggtatagctttgttatcccaatcaactatacccgaaacaatattggaactaacagatgcactcgcactcgggatgatggtacttaaaatagtcagaaatatggagaaatatcagctagccgttactatcatggccataagctgtgtacccaatgcagtaatattgcaaaatgcctggaaagtttcctgtactattctcgcagcagtttccgtttcaccactgttgcttacatcatcacaacaaaaagctgactggatccccttggcgctgactatcaaagggctaaatccgacagcgatctttctaacaactttgagtcggaccagcaagaagagatcttggccattaaatgaagcaatcatggctgttgggatggtttccatacttgcttcaagtttactgaaaaatgatatacctatgactggaccacttgtagcgggaggccttttaacagtatgttatgtactaacaggacgaagtgctgacttagagttggaacgtgcggcagatgtcaagtgggaagatcaagcagaaatttcaggttcatcgcctatattaagcattacaatatcagaggatggatctatgagcatcaaaaatgaagaagaagaacaaactttaacaatactaataagaacaggattattggtaataagcggagtatttccagtgtccatccccatcacagcagcagcatggtacttatgggaagtcaagaaacagcgagcaggggttctatgggatgtaccaagtccacctccggtagaaaaagcagagcttgaagatggagcatacaggataaaacagcgaggaatactcggatatagccaaataggtgctggtgtctacaaagaaggaactttccataccatgtggcacgttacaagaggggcagtccttatgcacaggggtaagcgtatcgaaccgtcatgggctgatgtcaaaaaggatctaatttcttatggtggcggttggaagttagaaggagagtggaaagaaggagaagaagtccaggtgttagctctagagccaggcaaaaatccacgtgcagtccaaacaaaaccaggaatattcaaaactaataccggcacaataggtgctgtttctctggacttttccccaggaacctctggctctcctatagttgatagaaaaggcaaagtagtaggcctatacggaaatggcgttgtaactcgctcgggcgcatacgtttcagcaattgcacaaactgaaaagtcgattgaggacaatccagaaatagaagacgacatttttaggaagaagcgacttacgataatggatttacatccgggagcgggaaagacgaaacgatatcttccagcgattgtaagagaagcaataaaaagaggcttgagaaccttaatactggcaccaacacgggtagtagcagcagaaatggaggaggcattgcgcggactacccataaggtaccaaacgccagcaataaaaacagaacatactggacgtgagatcgtagatcttatgtgccatgccacgtttacaatgagactactaagcccagttagggtacctaactataacctaatcatcatggatgaagcacatttcacggacccagctagtatcgctgcaagaggttatatatcaacgcgtgtggaaatgggtgaagcagcagggatcttcatgaccgcaacaccaccggggtctcgtgacccattccctcagagtaacgctcctatcatggatgaggaacgcgagatacccgaaagatcctggaactcaggtcacgagtgggttacagatttcaaaggtaaaactgtgtggtttgtaccctcgataaaagcaggtaatgatattgctgcatgtttgaggaaaaatggcaagaaagttatacaactctcaaggaaaactttcgactctgaatatgtcaaaacccgtgctaacgactgggatttcgtagtaacaacagacatatctgaaatgggtgcgaatttcaaagcagaacgagttattgacccccggagatgtatgaagcctgtaatactaacggatggggaagagagagtaatccttgcaggccccatgccagtgacacatagcagcgctgctcaaaggaggggtaggattggacgtaaccccaaaaacgaaaatgatcaatatatatatatgggtgaaccattagagaatgacgaagactgcgcacattggaaagaagcaaaaatgttattagacaacataaacacaccagaaggtataattccttcaatgtttgaaccagaacgagaaaaagtagacgcaatagacggagaatataggctacgcggagaagccagaaagacatttgtagacttaatgagaagaggtgacttacctgtgtggctagcatataaagttgcagcagagggtataaattacgcagatagaaaatggtgtttcgatggaatcaaaaacaatcagatactagaagaaaatatggaagtggaaatctggacaaaagaaggtgaaagaaagaaacttaaaccaaggtggctcgacgcaagaatttactcagacccattagcattaaaagaatttaaggagttcgccgcaggtaggaaatccttaacgctaaatctaataacggaaatgggtcgattaccaacgttcatgactcaaaaagcacgtaacgcactagacaatctagccgtactacatactgctgaagcaggagggcgtgcatataatcatgcactaagcgaactcccagagacgcttgaaaccttactacttcttacgttattagctaccgttacagggggtattttcttgtttttgatgtcagggaaaggtataggtaaaatgacgttgggtatgtgttgtataataacagccagcatattattatggtatgcacaaattcaaccgcactggatagcagccagtattatactagagttctttcttatcgttttacttatccccgagccggaaaaacagcgtactcctcaagataatcaattaacctatgttgtaatagccattttgaccgtcgtcgcggcgaccatggcaaacgagatggggtttttagaaaagaccaagaaagatcttgggctcgggtctatcactacgcaagaatcggaatcaaacatcttggacatcgacttgagaccagcatctgcctggacactctatgcggttgctaccacgttcgtaacaccaatgttaagacatagtattgagaactcgagcgtaaatgtttctttaacagccatagcgaaccaagcgacggtactgatggggctagggaaaggttggcccctatcgaaaatggatattggtgtaccgttactcgccataggatgttacagccaagtcaacccaatcacattgacagcagctttgttactattagtcgcacattacgcgataatcggtccaggcctacaagcaaaggcaacccgcgaagctcagaaaagagctgcagcaggtataatgaaaaatccaacggtcgatgggattacggttatagatctagaaccgatcccatatgacccaaagttcgagaaacaattgggtcaagttatgcttcttatattgtgcgtgacacaagtactgatgatgagaacaacgtgggccttgtgtgaagctcttacgctggcgacaggccccatatcaacgctatgggaaggaaacccaggaaggttttggaatactaccatcgccgtatcaatggctaacatttttcgaggtagctatttagcaggggcagggcttctgttttcaataatgaaaaacactacaagcacaaggagaggcaccggtaatataggagaaacactcggagaaaaatggaaatcgcgactaaacgccctcggaaaaagtgaatttcaaatatacaaaaagagtggaatacaagaggtggatagaactctggccaaggaagggataaagagaggagaaacagatcaccatgcggtcagtcgtggatcagccaagctaaggtggtttgtcgaacggaacatggtaacgccagaaggaaaggtcgtcgatttgggttgtgggaggggtggatggagttattattgtggtggcttgaagaacgtacgtgaggtaaaaggtctaaccaagggaggcccggggcatgaagaaccaatccctatgagcacatatggttggaatctggtaaggctccaatcaggggttgacgttttctttacaccgccagagaaatgtgacacacttttatgtgacataggtgagagtagcccaaatcctactattgaagcaggacgaacactcagggtcttaaacttagtagagaattggttaaacaataacacacaattttgtataaaagtactaaacccatatatgccttcggtgatagagaaaatggaagctctacaacgtcaatacggaggtgccctagtgagaaaccccttatcacggaacagtactcacgaaatgtactgggtcagcaacgcaacagggaatattgtgagcagtgtaaacatgattagccgaatgcttatcaacaggttcacaatgaagcacaagaaagcgacttatgagccagacgtggatttaggatcaggcacaaggaatataggaatagaaagtgaaatacctaacctagacataattgggaagaggatcgagaaaattaagcaagagcatgagatatcatggcattatgaccaagaccacccatataaaacttgggcatatcatggaagctacgagaccaaacaaactggaagcgcctcctcgatggtcaatggggtggttcgattgttgactaaaccctgggatgttgtacctatggtaacccaaatggccatgaccgacaccacaccatttggtcaacaacgtgtattcaaagaaaaagtcgatactcggacacaagagccaaaagaagggaccaagaaactaatgaagataacagctgaatggctctggaaagaacttggaaagaagaaaacaccaaggatgtgtactcgagaagaatttacaagaaaagtaagatcaaatgctgcactcggagccatatttacggatgagaataaatggaaatccgcgagggaagccgtagaagacggcagattctgggagttagtggacagagaaagaaatttacatctggaagggaaatgcgaaacctgcgtatataacatgatgggcaaaagagaaaagaaattgggcgaatttggtaaagcgaaaggttcacgagctatttggtacatgtggcttggagctcgcttcttggagttcgaagcactgggctttttaaacgaagatcattggtttagtagaggaaatagcttatcaggagttgagggagaaggattacataggctgggatatatactacgagacgtaggaaagaaagaaggaggtgcaatgtatgccgatgatacagcaggatgggacacaagaattacactcgaagacttaaagaacgaggagatggtaacaaaccacatgaaaggagaacataagaagctagccgaagctatattcaaattaacttatcaaaacaaagttgtgcgagtacaacgacccaccccgagaggcaccgtcatggatataatttctcgacgggatcagcgaggatcagggcaagtaggaacttatggattaaatactttcacaaacatggaagcacaactaatcagacaaatggagggcgaaggcatatttaaatctattcaacatctaacagcaaccgaagaaattgccgtccaaaattggttagcaagggttggaagagaacgattatcaagaatggcaatatcaggcgacgattgtgtagtaaaaccaatcgatgataggtttgcatcagcattaactgcactaaatgacatgggaaaagtacgaaaggatatccagcaatgggaaccgtcaagaggctggaatgactggacccaagttccattctgttctcaccatttccacgaactcgtcatgaaagatggacgagtcctagtagtaccatgtcggaatcaagacgaattgataggtagagctcgaatctcacaaggcgctggttggtcacttaaggaaactgcatgcctaggaaaatcgtatgctcagatgtggaccctaatgtattttcataggagggatctacggttagctgccaacgcaatatgctcggcagtaccgagccactgggtaccaacatcgagaacaacatggagtatacatgcgaaacatgaatggatgactaccgaagacatgttagccgtttggaatcgagtgtggatccaagagaatccctggatggaagataaaacaccggtagaatcttgggaagaagttccatatctaggtaagagagaagatcagtggtgtggatcgctcataggtcttaccagcagagccacttgggctaaaaacatccaagcagctataaatcaggtacggtcattaataggtaacgaagaatatactgattatatgccatccatgaaaagattccgcagagaagaggaagaggcaggagttctatggtaa

SEQ ID NO: 22439 - RNA, 9876 nt, synthetic construct
  misc_feature 1..9876: note = derived and/or modified CDS sequence (opt6) from DENV-2__GQ868604__SS-prME
  source 1..9876: mol_type = other RNA
acagcgggagtgatagtaatgcttataccaacagcaatggcatttcaccttacaactagaaatggagagccccacatgatagttggaagacaagaaaaaggaaagagcttactttttaaaacagaagacggtgttaacatgtgcacactaatggctatagatctaggtgaattatgcgaagatacaatcacatataaatgcccattattaagacaaaatgaacctgaagatatagattgctggtgtaattcaacgtcgacatgggtgacttatggtacttgcactactactggggaacatcgacgagagaaacggtcagtcgccctagtacctcacgtaggcatgggtctggagacgcgaacagagacgtggatgagttccgaaggtgcatggaaacacgtacaacgaatagaaacttggattttacgacatcctggctttaccataatggccgcaatattggcgtatacaatcgggacgacacatttccaacgagctttaatattcattcttctaacagctgtagcgccaagcatgactatgcgttgcataggcatctctaaccgagatttcgtagaaggtgtgtcagggggcagttgggtagatatagtattggagcatggtagttgcgtaacaacaatggcgaaaaacaaaccaaccttggacttcgagttaataaaaacagaagcaaaacaaccggcgacgctaagaaaatactgtatcgaagctaaactaacaaatactacgaccgaatccagatgccccacgcaaggggagccttcattaaatgaagaacaagataaaagatttatttgtaaacatagtatggtagatcggggatgggggaatggatgcggcctgtttggaaaaggaggtattgtaacctgcgcaatgtttacatgtaagaaaaatatggaagggaaagtggtacagccggaaaatctagaatatacaattgtaatcacgcctcattccggcgaagaacacgcagtaggtaatgatacgggaaaacacggaaaagaaattaaaataacaccgcaatccagcataacagaagctgaattaactggctatggcactgtaaccatggaatgctccccaagaacgggattggactttaatgaaatggtgttattacaaatggaggataaagcatggctagtacataggcaatggttcctagacttaccactaccatggcttcctggtgctgacacgcaggggtccaattggatacagaaagagaccctagttactttcaaaaatccacatgcgaagaaacaagatgtagtggtgctaggcagccaagagggtgctatgcacacagcacttaccggagcaaccgagatccaaatgagttccggaaatctactcttcacgggacatctgaaatgtaggttaagaatggacaaactccagctgaaaggaatgtcttatagcatgtgtaccggaaaattcaaaatcgtcaaagaaatcgcagaaactcaacacggaacaatagtgataagagtgcaatacgaaggcgatggatctccatgtaaaattccttttgaaataacggacttagagaaaagacacgtattaggcaggctgattactgtaaatccgatagttactgaaaaagattcacccgtgaatatagaagctgagccaccattcggggatagctatataataataggcgttgagcccggccaactcaaactgaactggttcaagaaaggatcaagcataggacaaatgtttgagactacaatgcgcggtgcaaaacgaatggcaattttgggtgacactgcatgggatttcgggagtttaggcggagtgtttacgagcataggcaaagcactgcaccaggtattcggagccatatacggggccgcatttagcggcgtatcatggacaatgaaaattttaatcggtgtaataattacatggataggaatgaactcgcgctcaaccagcttaagtgtctcgttggtgttagttggtgtagtaacactatatttaggagctgttgtacaggcagacagtggatgcgttgtgtcatggaaaaacaaagagcttaaatgcggcagcggcatatttatcacggacaacgtacacacctggacagaacaatataaatttcaaccagaatcgccctcgaaattagcctcggctattcaaaaagcacacgaggaaggaatctgcggcattaggagtgtaactcgcctggaaaaccttatgtggaaacaaattaccccagaactcaaccacatactgtcagaaaacgaggtaaaattaacgataatgactggagatataaaaggaatcatgcaagcaggaaaaaggagcttacgaccgcagccaaccgaactgaaatactcatggaaaacttggggaaaggcgaaaatgttatctactgaatctcataatcagactttcttgatcgatggaccagaaacagccgaatgtcctaacaccaacagagcctggaacagtcttgaggtagaggactatggatttggcgtctttacaaccaatatatggttgaagctaagagagaaacaggacgttttctgtgactcaaaattaatgagcgcagcaataaaagataacagagcagtccacgcagacatgggctattggatagagtctgctctcaatgatacatggaagatggaaaaagccagcttcatagaagtcaagtcctgtcattggcccaaatctcatacactctggtcaaacggcgtacttgaaagcgaaatgataatacccaaaaattttgcaggacccgtgtcccagcataactataggccaggctaccatacgcagactgctggtccttggcatctaggtaaacttgaaatggattttgacttatgtgaaggtacaacagtggtcgtgacagaagattgtggtaaccgaggtccaagtctgcgaactaccacagcctctggcaaactaatcacggaatggtgttgtcgtagttgcacactaccaccgttaagataccggggagaagacggttgctggtacgggatggaaataagaccactcaaagagaaagaagagaatttagttaattctctagtgactgcaggccgaggtcagatcgacaatttctcgctaggggtactcggaatggctctcttccttgaagaaatgttaagaaccaggattggaacgaaacacgcgatattactcgtagctgtttcattcgtaaccttaattactggaaacatgtccttccgtgacttgggcagggtaatggttatggtcggggcaacaatgacggatgacatagggatgggagtcacatatctcgctctacttgctgccttcaaagtgcgcccgacatttgcggctggattgttgttacgcaaacttacaagtaaagaattaatgatggccaccattggtatcgcattattatcccagtcaactataccagaaaacatattagaactaactgacgctttagctctgggaatgatggtactgaaaatagtccgtaacatggaaaaatatcaactagcagtaactataatggctatatcatgtgtacctaacgctgtgattttacaaaatgcatggaaggtatcgtgcacaatactagcagccgtcagtgtaagtccattactactgacgtccagtcaacagaaagcagattggattcctttggctttgaccattaaaggactgaacccaacggcaatttttcttaccaccttatcgagaacaagcaagaaaagatcatggcctttgaacgaagctataatggccgttggtatggtttctatcttagcctcttccttactgaaaaacgacattccaatgacgggcccgctcgtagctggcggacttctaacagtatgttacgtcttaacaggaaggtcagcagatcttgaattagaaagggcagcagacgttaaatgggaagatcaagcagaaatatctggaagtagccccatattatccataacaatatcagaagacggatcgatgtcaattaaaaatgaagaagaagaacaaacgttaaccatattgataagaacagggctccttgtcatctcgggagttttccccgtgagtattcctataactgcagcagcgtggtacttatgggaagtcaagaaacaaagagccggggtgctatgggacgtaccatcaccacctccagtagaaaaagcagaattagaggacggagcttatcgtattaaacagagaggaatcctgggttactcacaaatcggtgcaggcgtttataaagaaggtactttccacacgatgtggcatgtaaccagaggagcagtactaatgcataggggcaaaagaattgagccaagttgggctgacgtaaagaaggatctgattagctatgggggtggttggaaattagaaggagaatggaaagaaggggaagaggtacaagtcctggcactagaacctgggaaaaatcctcgggcagtccaaacaaaaccaggaatatttaagaccaataccggaacaatcggagctgtcagcttagacttctctcctgggacatctggatcacccatcgtagatcgtaaagggaaagtagtaggtctttacggtaatggcgtcgttacacgctcaggggcttacgtaagtgctattgcccaaactgaaaaatcaatagaggacaatcctgaaatcgaagacgatatctttagaaagaaaagacttaccattatggatctacatcctggggcaggtaaaacaaagagatacctaccagcgatcgtacgtgaagcaataaaaagaggactgaggacgttaatcctcgcacctacacgagttgtcgcagccgaaatggaggaggcattacgaggactccccatcagatatcaaacgccagctatcaagacagaacacacggggcgagaaattgtagatttaatgtgccatgctactttcactatgcggttactttctccggttagagtaccaaattacaatttaatcataatggatgaagcacactttacagaccctgccagcattgcagcgagaggatacatatcaaccagggtagaaatgggggaagcagcaggtatattcatgaccgccactccaccgggatcaagagacccctttccgcaatctaacgcacctataatggacgaggaacgggaaattcccgagagatcgtggaactcaggacacgaatgggtaactgattttaagggtaagaccgtgtggttcgtcccctcaataaaagcagggaatgatatcgcagcgtgtttacgaaagaatgggaagaaagtgattcaattgtccagaaaaacttttgacagtgagtatgttaaaacgcgcgctaatgattgggactttgttgtaacaacagacatctctgagatgggcgctaatttcaaagccgaacgggttatagatccacgacgctgtatgaaacccgtaatattaacggatggagaagagagggtaatattagccggaccaatgccagtgacacattcttcagccgctcaaaggagggggcggataggcagaaaccccaaaaatgaaaatgaccaatatatatatatgggtgaaccactcgagaacgatgaagattgtgcccattggaaggaagctaaaatgcttctagacaacattaatactcccgaaggcatcatcccttcaatgttcgaaccagaacgagagaaggtagacgcaatagatggagaataccgtctaagaggcgaagcacgaaaaacatttgtagacctgatgagacgtggtgatctgccagtctggctagcgtacaaagtcgcagcagagggcatcaactacgcagatagaaaatggtgtttcgatggaattaaaaacaatcaaatattggaagaaaatatggaagttgaaatatggacaaaagaaggtgaaagaaagaaactgaaaccgagatggcttgacgctaggatttacagtgacccgttggcattaaaagagtttaaagagttcgccgcaggtagaaaaagccttactcttaacttaattaccgaaatggggagactgccaactttcatgacacagaaagctagaaacgcgcttgacaacttggccgtgctgcacacagcagaagctggtgggcgagcctacaatcatgcactaagcgaactaccagaaacattagaaacattattattgctgacacttctcgcaacagtaaccggtggaattttcctctttctcatgtcaggcaagggaataggaaagatgacgctaggtatgtgctgtataataactgcttcgatattactgtggtatgcccaaattcaacctcactggatagcagcaagtataatcctagaatttttcctgatagttttacttattccagaaccagaaaaacaacgaacaccacaagataatcaacttacatacgtcgttattgcaatactaaccgtagttgcagcaactatggctaatgagatgggttttctggagaaaaccaagaaagatttagggctcggctcaataacgactcaggaatcggaaagcaatatactagacatagatttgcgcccggcaagtgcttggactctttatgccgttgcaaccacgtttgtaactccaatgttacgtcattcgatagaaaactcgagtgtaaatgtgagtttaacggctatagcaaatcaagcaacagtactaatgggattgggtaaaggatggccgctatcaaaaatggacataggtgtcccactattagctataggatgctacagtcaagtcaatccgattactttaactgctgcgttgttactcctagttgcacactatgccattatcggcccaggactacaagctaaagcgacaagagaagcacagaaaagagctgctgcgggaataatgaagaatccaaccgtagatggaattacagtcatcgatctagaaccaatcccatacgatccaaagttcgaaaaacaattagggcaggtcatgttgttaatattgtgtgtaactcaagtattaatgatgaggacaacctgggccctatgtgaggctttgacactagcaacgggaccgatatctacactgtgggaaggtaatcctggccggttttggaacactacaatcgctgtaagcatggcaaatatattccggggatcatatttggcaggagccggattattattttccataatgaagaatacaacttccacacgccgtggtacgggtaacataggagaaactctaggcgaaaaatggaagtcgcgtctgaatgccctaggtaaatctgaatttcaaatttacaagaaatctggtatacaagaagtcgatagaaccttagccaaagaagggataaaaagaggggaaacagatcaccatgcagtaagcagaggatcagctaagttaaggtggtttgtcgaacgtaatatggtaaccccagaaggaaaagtagtagatcttgggtgcggaagaggagggtggtcatattactgcggcggactcaaaaatgtacgtgaagtcaaagggctcaccaaagggggtcctggacacgaagaaccaattccaatgtcgacatacggttggaatcttgtgcgcctccaatccggagttgatgtgttcttcactcccccagagaaatgtgatacactactctgtgacattggtgaaagttctccgaatccaaccatagaagccggtcgaacattaagagttctaaacttagttgaaaattggctaaacaacaatacccaattctgtataaaagttcttaatccttacatgccaagcgtcatcgagaaaatggaagcccttcaacgacagtacggaggagcattggttagaaacccattatccagaaattctacgcacgaaatgtactgggtttctaacgctacagggaatatagtctctagcgtaaacatgatttcacgaatgcttataaaccgattcacaatgaaacacaagaaagccacatatgaacccgatgtagatcttggatccggaacacggaatataggaatcgagagtgaaattccaaatctggatatcatcggaaaaagaatagagaaaataaagcaggaacacgagatatcatggcactacgaccaagaccatccctacaaaacatgggcataccacggtagttacgagacaaaacagacaggatcggcatcatcgatggttaacggggttgtacgtcttctcaccaaaccctgggatgtggttcccatggttacacaaatggctatgacggatacaacgccgtttggccaacaacgtgtattcaaagagaaagttgacacacgaacgcaagaaccaaaagaaggtaccaagaaattgatgaaaattacagctgagtggctatggaaagagttaggcaagaagaaaacacctaggatgtgcacaagggaagagtttaccaagaaagtgaggtctaacgctgcattaggagcaatattcaccgacgaaaacaaatggaagtccgctagagaggcagtagaagatggacgtttctgggagttagtggatagagaacgaaatcttcacttagagggtaagtgcgagacatgcgtttacaatatgatgggtaagagagagaagaaattaggcgagtttggaaaggcgaagggatctcgggcgatatggtacatgtggctaggagctaggtttctcgaatttgaggcccttggcttcttgaacgaagatcactggttcagccgaggtaacagcttgtcaggcgttgaaggcgaaggtcttcataggctaggttacatccttagggatgtcggtaagaaagagggcggcgcaatgtatgctgacgatacggcaggttgggatacacgcataacgcttgaagatctgaaaaatgaagagatggttacaaaccatatgaagggagaacataagaaacttgccgaagctatatttaaacttacgtatcaaaacaaagtcgttcgagtacaaagaccaacaccgagagggacggtcatggatataatttctagaagagatcaacgcggatctggacaagtcggtacgtatggattaaatacatttaccaatatggaagctcaacttattcgacaaatggaaggtgaaggaatattcaaatcgattcagcatctaactgcgacagaagaaatagcagttcaaaactggctagcccgggttgggcgtgaacgactttcccgaatggctattagtggtgacgattgtgtagtcaaaccgatagatgatagatttgcatcagcattaacagctttaaacgatatgggtaaagtgaggaaggatattcaacaatgggaaccatcaaggggatggaatgattggacccaagtacctttttgtagtcatcatttccacgaactcgtaatgaaagatggaagagtgttggtagtaccttgccgtaatcaagatgaactaattgggcgagctaggatttctcaaggagctggctggtcattaaaggaaactgcatgtctcggcaaaagttacgcacaaatgtggacactaatgtatttccacagaagagatctcagactggcggcaaacgcgatatgttccgcggtcccatctcattgggtacccacctcgcgtactacatggagtattcatgccaagcacgaatggatgactaccgaagacatgctagcagtgtggaatagggtatggatacaagagaacccctggatggaagataagactccggtagagtcatgggaagaagtgccttatctcggcaaacgagaagatcaatggtgtggtagcttaatcggactaacatcaagagcaacctgggcaaagaatatacagactgccattaatcaggttaggagtttaataggtaatgaggaatataccgactacatgccaagtatgaaacgatttcgtagagaagaagaagaagcgggggtactgtggtaa

SEQ ID NO: 22440 - RNA, 9876 nt, synthetic construct
  misc_feature 1..9876: note = derived and/or modified CDS sequence (opt6) from DENV-2__EU482752__SS-prME
  source 1..9876: mol_type = other RNA
actgctggggtaattgtcatgctaataccaaccgctatggcatttcatctaactacaagaaatggtgaaccgcatatgatcgtaggacgtcaggaaaaaggaaaatcattattatttaaaaccgaagacggtgtaaacatgtgtactttaatggctatagatctaggagaattatgcgaagacacgataacttacaaatgtccattattaaggcaaaacgaaccagaagacatagattgttggtgcaatagtacaagcacttgggtaacttatggcacatgcacaacaacaggtgaacacagaagggagaaaagatctgtcgcgttagtcccacacgtaggcatgggactggaaacaagaacagaaacttggatgtcaagtgaaggtgcatggaaacatgtacaaagaattgaaacatggatattaagacatcctggatttactataatggcagcgatattagcatacacgatcggtacgacacactttcaacgagcattaattttcatattactgactgcagttgcgccctctatgacgatgagatgcataggaatttctaatagagattttgtcgaaggggtgtctggcggctcgtgggtagatattgtactagaacatggttcgtgtgtaactaccatggccaaaaataaaccgactttagattttgaattaattaaaacagaagcaaaacagcccgcaacccttcggaaatactgtatagaagcaaaactaacaaatactactaccgaatcacgttgccctacacaaggagaaccatctttgaatgaggaacaagataaaagattcatctgcaaacatagcatggtggataggggttggggtaatggatgcggattgttcggtaaaggaggaatcgttacttgcgcaatgtttacctgcaagaaaaatatggaaggcaaagttgtacaaccagaaaacttagaatatacaattgtaataactccgcactcaggcgaagaacacgcagtaggcaatgacactgggaaacatggtaaagagatcaaaataactccacaatctagtataactgaagcagaacttacaggttacggaaccgttactatggagtgtagcccacgtactggtcttgactttaacgaaatggttttattgcagatggaagataaagcatggttagtacatagacagtggtttttggatcttccgttaccatggctacccggagcagacacccaaggctcaaattggatacaaaaagagacgttggtcaccttcaaaaacccccatgccaagaaacaagatgttgtagtattgggaagtcaggaaggtgcaatgcatacagcactaacgggcgccactgaaatccaaatgagttctggtaacttactattcactggacacttaaaatgtcggctcagaatggataaattacaactaaaaggaatgagttattccatgtgcaccggtaaatttaaaatagtaaaggaaatagctgaaactcaacatggaacgatagtgattagagtacagtatgaaggagacggatcgccgtgtaagataccgttcgagataacggaccttgaaaagcgacacgtactaggaagattaataacagtaaatcctatagttactgagaaagatagcccggtaaacatagaagcggaacctccatttggagattcatatataataataggagtagaaccaggtcagctaaagttaaattggtttaagaaaggaagtagtatcggacagatgttcgaaactacaatgagaggagccaaaaggatggctatcctgggagataccgcttgggattttgggagtttaggtggagtcttcacaagtataggaaaagcgctccatcaggtattcggtgcaatttatggagccgcatttagcggagtaagctggacaatgaaaatactaataggtgtaataataacgtggataggaatgaactcacgatctacctcactctcagttagcttagtcctagtaggcgttgtaacgttatacttaggagctatggtacaggcagattcgggctgtgtcgtaagttggaaaaataaagaactaaagtgtgggtctggaattttcatcactgataacgtacacacctggaccgagcaatacaagtttcaaccagaaagtccgagcaagttagcctccgccatacaaaaggcgcatgaggaaggaatatgcggaatcagaagtgtcaccagactagaaaacttaatgtggaaacagataacacctgaattaaatcatatactatccgaaaacgaagttaaactcactatcatgaccggcgatatacgcggcattatgcaagctggaaaaagatcattaagaccacaacctaccgaattaaaatattcttggaaaacctggggaaaagcgaagatgcttagcacagagtctcataatcaaacatttcttattgacggtcccgagactgccgaatgtccaaacaccaacagagcatggaacagccttgaagtagaggactatggatttggagttttcacaacaaacatttggctaaaacttcgcgaaaaacaagacgtattttgcgattccaaacttatgtcagccgcaataaaagataatagagctgtacacgcggacatggggtattggattgaatctgcacttaacgatacatggaaaatggaaaaagcgtcgtttattgaagtaaagagctgtcattggccaaaatctcacaccttatggtcaaatggggtactagagagtgaaatgatcattccaaagaatttcgcgggccctgtatctcaacataattaccgaccgggatatcatacgcaaactgcaggaccatggcaccttggtaaactggaaatggacttcgatttatgcgagggcactactgtggtagtgaccgaagactgcggaaatagaggaccatctttacgcactacgaccgctagtggaaaactaataacagaatggtgttgtcgatcatgcactttaccaccgttgagatatcgaggcgaagacggttgttggtacggtatggaaatcaggccactgaaggaaaaggaggaaaacttagttaatagtctcgttactgcgggacacggacaaatcgataactttagtttaggcgtattaggaatggccttattcttagaggaaatgctaagaacacgaatcgggacaaaacatgcaatactactggtcgcagtatcatttgtcaccttaatcaccggaaatatgtctttcagggacctagggagggttatggttatggtaggagcaacaatgactgatgacattggtatgggcgtgacctacttagctttgttagccgcattcaaagtcagacctaccttcgctgctggattactgctaagaaagttaacctcgaaagaattaatgatggcgacaattgggattgcactattgagtcaatcaaccatccccgagaacattttggagctaactgatgcgctagctttaggtatgatggtacttaaaatagtacgaaacatggaaaaataccaattggctgtcacgattatggccatctcatgtgtaccgaatgcagtcatactacaaaatgcgtggaaagtgtcttgtaccattctagcggcggtcagcgtctcacctctgttattaacatcatctcaacaaaaagcagattggattcccttggcacttaccataaaggggctaaatccgacggcaatatttttaactacattaagcagaacaagcaagaaaagaagttggccgttaaatgaagcaatcatggctgtcggaatggtctcaatactagcttcatctcttctcaagaatgatattccaatgacgggaccccttgtagccggtggattactaacagtatgttatgtgttaaccggacgatccgccgacctagaacttgagcgggctgcagatgtgaaatgggaagaccaagcagaaataagcggatcaagtcccatactatcaatcactattagcgaagacggatccatgagtattaaaaatgaggaagaggagcagacactgactatcctcattcgaacaggattactggttattagcggggtctttcccgtatcgattccgatcacagctgcagcctggtacctttgggaagtcaagaaacaacgagcaggagtcctgtgggacgtaccatctccaccgccagtcgaaaaagctgaattagaagatggggcatataggatcaaacaaagaggtattctgggttattcgcaaatcggagctggtgtttacaaagaaggaacttttcacacaatgtggcatgtcacgcgaggagctgtattaatgcatagaggcaaacgtatcgaacccagctgggctgacgttaaaaaggacctaattagttatggtggaggatggaaattggaaggagaatggaaagagggggaagaagtgcaagtattggcattggaaccaggtaaaaatccgagagctgtccaaacaaaaccaggcatttttaaaacaaacactggtacaatcggggccgttagtttggacttctcaccaggaacaagtgggtctccaattgtggatagaaaggggaaggtcgtaggcttatatggaaatggcgtagttacaaggtccggtgcgtacgttagcgcaatagcgcagacagagaaaagtattgaggataaccctgagatagaagatgacatattcagaaagaaaagattaacaataatggacctacatcccggtgcaggaaagactaaacgatatctgcctgcgatagtaagagaagcgattaagcgtggacttagaacattgattctagctccgacaagagtagttgcggctgaaatggaagaggcacttagaggtcttccaattagatatcagacaaccgcgataaaaacggagcacacaggtagagaaatagtagatctaatgtgtcacgcgactttcacaatgaggttactatcgccagtgagagtaccgaattataatttgataattatggatgaagcacactttacagatcctgccagcatagcagctcgaggttatatcagcacacgagtagaaatgggagaggccgctggtatttttatgacagcaactcctccaggttccagggacccatttccgcaatcaaatgcacccataatggatgaagaaagagagatccccgaaagatcatggaatagtggacacgaatgggtcactgacttcaaaggcaaaactgtctggtttgtaccgtcaattaaagccggaaatgacatagcagcttgtctccggaagaatggtaagaaagttattcaactttcaaggaaaacttttgattcagagtatgtaaaaactcgggctaatgattgggactttgtagtgactacagatatcagtgaaatgggtgctaactttaaagcagaaagagttatagacccaaggagatgtatgaaacccgtaatcttaactgatggagaggaacgcgtaatcttagctgggcccatgccggttacacacagtagtgctgcccagcgacgcggtcggataggcagaaatccgaaaaacgaaaatgatcagtacatatacatgggagaacctttagagaatgacgaggattgcgcgcattggaaagaagctaagatgttactggacaatataaacactcccgagggaatcattcctagcatgttcgagccagaacgcgaaaaggtggatgcaattgatggagaatatcggctgagaggagaagcgagaaaaacattcgtagatttaatgcgaagaggagatcttccagtatggcttgcttataaagttgccgccgaaggtattaactatgcagatcggaaatggtgttttgatggtatcaaaaacaatcaaatcctggaagaaaatatggaagttgaaatttggacaaaagaaggtgaacgcaagaaacttaaaccgagatggttagacgctcgaatttattccgacccattagcattgaaagaatttaaagaatttgcggcaggacgaaaatctttaacacttaacctgataacagaaatgggaagactacccacgttcatgacgcaaaaagctcgaaacgccctagataatttagccgtactccacacagcggaagcgggtggtcgggcatacaatcacgcattgagcgaactgcctgaaaccctagaaactcttctactcttgacgttgttagccacggtaactggcggcatatttttatttttaatgagtggtaagggaatagggaaaatgactctcggaatgtgttgtatcataacagctagtatattactctggtacgcccagatacaaccacattggatagcagccagtataattttagagttctttttaatcgttctattaattcccgaaccggaaaagcagagaacaccacaagataatcaactaacttatgtagtaatcgcaatcttgacagttgtagcggcaaccatggctaacgaaatgggatttttagaaaagactaagaaagatcttggattaggctctataacaactcaagagtcagaatcgaacatactagacatcgacctacgcccagcttccgcgtggacgctgtatgcggtggcgactactttcgtaacacccatgctgcgtcacagcatagaaaacagctccgttaatgtcagtcttactgcaattgccaaccaagcaaccgtcttaatgggactcggaaagggatggccgctatctaagatggacataggcgtaccgcttctggccattggctgctactcacaagtaaatccaattactctaacggctgccttattacttttggttgctcattatgcaatcatcggccctggacttcaagcaaaagctacacgagaggctcagaaaagagcagcggctggtataatgaaaaacccaacggtggacggcattaccgtaatagacctagaaccaataccatacgatccgaaatttgaaaaacaattaggacaggtgatgttactaatcttatgcgtaactcaagttctaatgatgcgcacgacatgggctctatgtgaagccttgactcttgctaccgggccaatcagcactttatgggagggcaaccctggtcggttctggaatacgactatcgcagtatctatggctaacatctttaggggtagttatctagctggagcgggactgttgttcagtattatgaaaaacacaactaatactcgtaggggaaccggtaacatcggagaaacgctaggggaaaaatggaaaagccggctcaatgcattaggcaagtcagaatttcagatttacaaaaagagcggtatacaagaagttgatcggacattggctaaggaaggtatcaaacgaggtgaaacagaccatcatgcagtaagcagaggctccgcaaaacttcgttggttcgttgagagaaatatggtaacacccgaaggcaaagtggttgatctaggttgtggtagaggcggctggtcttattattgcggtggactcaaaaatgtaagggaagtcaaagggctaacgaaaggaggacctggtcatgaggaaccgatccccatgtcaacctacggatggaatttagtaaggctacaaagcggtgtagatgtattctttactcctccagaaaagtgcgatacactgctatgcgatataggtgaatcaagccctaacccaacaattgaagctggtagaactttaagggttttaaacctagtagaaaactggttaaataataatacacaattctgcataaaagtactaaacccatatatgcccagcgtaatagagaaaatggaagccttacaaagaaaatatggcggtgccctagtaaggaacccactaagtagaaatagcacccacgaaatgtattgggtgtcaaatgccacggggaatattgtatcatctgtgaacatgatcagccgaatgttgataaaccgtttcacgatgaagcataagaaagcaacctacgaaccagacgttgaccttggtagcggcacaagaaatataggaatcgaaagtgagattcctaacttagacataataggaaaaagaatagagaaaattaaacaggagcatgagacatcctggcattatgaccaagaccatccgtataaaacatgggcataccatgggagttacgagacgaaacagacaggatcagcttcctcaatggtaaacggagtcgtcagacttttaaccaaaccctgggatgtagtcccgatggtaacacaaatggctatgaccgacacgacgcctttcggccagcaacgagtgttcaaggaaaaagtcgatacaagaacacaagaacccaaggaaggaactaagaaactaatgaaaataacggcggagtggctatggaaggaactgggcaagaagaaaactccgaggatgtgtacacgcgaagagttcacaaggaaggttcgcagcaacgcagcactaggggctatattcaccgacgaaaataaatggaaatcagctcgagaggcagtagaggatggtcgattttgggagctagtggacagagaacgtaacctgcatttagaaggcaaatgtgaaacttgcgtttataatatgatgggaaagagagaaaagaaactgggtgaatttggtaaggcaaaaggttcaagagctatatggtacatgtggctgggtgcacgatttctggaatttgaagcactcggatttttaaatgaggatcattggtttagtaggggaaactcactatctggcgtcgagggagagggcttacatcgattaggttatattttgcgtgatgttggtaagaaagaaggtggtgctatgtacgctgatgatacagccggctgggacacacgaataaccttagaggatttgaaaaatgaagagatggttacaaatcatatgaaaggagagcataagaaactagcagaggccatctttaaattaacgtaccagaataaagtcgtacgggtacaaagaccaaccccgcggggaacagtaatggatattatatcacgaagagatcaaagaggctctggacaagtaggaacatatggtcttaacacatttaccaatatggaagcacagctcattcgacagatggaaggagaaggaatttttaaatccatccaacatttaactgcaacggaagagatagccgtacaaaactggctagcaagagtcggaagggaaagactgagccgtatggcaatctcaggcgatgattgcgttgtgaaaccgatagatgaccgctttgcaagtgctcttacagcactgaacgacatgggcaaagtaagaaaagacatccaacaatgggaaccgtcaaggggttggaacgattggactcaagtacccttctgcagtcatcattttcatgaattagtaatgaaagatgggagagtattggtggttccatgcagaaatcaggacgagctgattggcagagctagaatctctcaaggtgctggttggtccctcaaagaaactgcgtgtctgggcaaaagctacgcacaaatgtggacattgatgtatttccatcgaagagatctcagattggcagcaaatgctatttgcagcgcagtgccatcacactgggtcccaacaagtcgtacgacttggtccatacatgcaaaacacgaatggatgactaccgaggatatgctggcagtttggaatcgcgtatggatacaagaaaatccctggatggaggacaagacaccggtagaaagctgggaagaagtgccatacttgggtaaaagggaagatcagtggtgcggctcactaatcggattaacatctagggctacctgggctaaaaacatccaaacagcaattaatcaagtaagaagtttaataggaaatgaagaatatactgattatatgccttccatgaaaagatttagaagggaagaagaggaagccggagtactctggtaa

SEQ ID NO: 22441 - RNA, 9876 nt, synthetic construct
  misc_feature 1..9876: note = derived and/or modified CDS sequence (opt6) from DENV-2__EU482753__SS-prME
  source 1..9876: mol_type = other RNA
actgctggagtaatagtaatgcttataccaacggctatggcatttcatcttaccactagaaacggggaaccacacatgatagtaggaagacaagaaaaaggcaaatccctactgtttaaaaccgaagatggtgtcaatatgtgtactttgatggcaatagatttaggagaattatgtgaagatacaattacatacaaatgtcctctactcagacaaaatgaaccagaagacattgattgttggtgtaatagtacgtccacctgggttacatatggtacgtgcacaacaaccggcgaacaccgtagggaaaaacgctccgtggctctagtaccacacgttggaatgggattagaaactaggactgaaacgtggatgagtagtgaaggagcttggaaacatgtacaacggattgaaacatggatcctaagacatccgggatttacaataatggcggcaatactagcatacaccataggtacaactcattttcaacgcgcattgatcttcattctattgacggctgtggctccatcaatgaccatgaggtgtattgggataagtaacagagactttgttgaaggtgtatcaggaggtagctgggtggacattgtactggagcacggatcctgtgtcactactatggccaaaaataaaccaactctagactttgaattaataaaaacagaagcaaaacaaccagcaacactacgtaaatactgtatagaagcaaaactgacaaacacaacaactgaatcaagatgtcccacacaaggagaaccgagcctaaatgaagaacaggataaaagatttatttgtaaacattctatggtcgacaggggttgggggaatggatgcggcttgtttggcaaaggtggtatcgtgacgtgtgcgatgttcacatgtaagaaaaatatggagggtaaagtggtccagcctgaaaatctagaatacacaatagtaatcactccacatagcggcgaggaacacgcagtaggtaatgataccggtaaacatggcaaagaaattaaaataacaccacaatcatcaatcaccgaagcagaattaactggatacggtactgtaactatggagtgttcaccaagaacggggctcgactttaacgaaatggtcctattgcaaatggaagacaaagcgtggttggtccatcgtcaatggtttttggatctaccgctaccttggttacccggcgctgatacccaaggatcaaattggatacaaaaagagacgttagtgacattcaaaaatccacacgcgaagaaacaagacgttgtagtccttggatctcaagagggagctatgcatacagcactcacgggggccacagaaattcagatgtcaagtggtaatttgcttttcacaggtcatttaaaatgcaggctacgtatggataaactacagctgaaagggatgagctatagcatgtgcacaggaaaatttaaaattgtgaaagaaattgctgagacacaacatgggacaattgtaataagggtccaatatgaaggggacggcagcccttgtaaaatcccgtttgaaattactgacctagagaaaaggcatgtacttggcagacttattacagtcaatcctatagtaacagaaaaagattccccagttaacatagaagccgaacctccattcggggacagctatattataataggtgtagaaccgggacaattgaaacttaattggttcaagaaaggaagctctatcggtcaaatgttcgagacaacaatgcgtggagcaaaaagaatggcaattttgggcgataccgcctgggacttcggatcattaggaggcgtttttacttcaatcggtaaagcgctacatcaagtatttggggctatctatggtgcagctttctcgggtgtgagttggacaatgaaaatccttataggcgttattataacatggataggaatgaactcgcgctcaacgtccttgtctgtttctctggtcctagtcggagtagtgactttatatctcggagcaatggtgcaagcagatagcggctgtgtcgtcagttggaaaaataaggagctcaagtgcggaagcggtattttcattacagacaatgtacatacatggacggaacaatataaattccaacctgagagccctagtaaattagcttcagctatacaaaaagcacatgaagagggaatatgtggtatacgatcagttactcgcctggaaaatctaatgtggaagcaaatcacacctgaattaaatcatatcttatcagaaaacgaagtcaagctgacgatcatgacgggtgatatacgaggaattatgcaggcgggtaaacgaagtctcagacctcaacctacagaactaaaatactcgtggaagacttggggaaaggctaagatgctctctacagaatcacataatcaaacttttctgatagatggaccagaaacggcggagtgtcctaacacaaatcgagcatggaatagtctagaagtagaagattacggctttggcgtattcacaacaaacatttggctaaaactacgagaaaagcaagacgttttctgcgattcgaaactgatgtccgcagcaataaaagacaatagggcagtccacgcagacatgggttattggatagaaagtgcgctaaatgatacttggaaaatggaaaaagcaagttttattgaagtgaaatcgtgtcattggccaaaaagtcacacattatggtcaaacggtgttcttgagtccgagatgataatacccaaaaattttgcaggacctgtatctcaacacaattatcgccctggttatcatactcagacagcaggcccctggcacttaggaaagttagaaatggattttgacctatgcgaaggtactacggttgtagtgacggaagactgtggtaatagaggcccctcactaagaaccacaactgcaagtggaaagttaatcacggaatggtgttgtcgtagctgcacgctcccgccgttaagatatagaggagaagatggctgttggtacggaatggaaataagacctctaaaagaaaaggaggaaaatttagtaaattctctagtaacagcaggacatggtcaaattgacaatttttctttgggtgtgcttggaatggcgcttttcctagaggagatgctaagaaccaggataggaacaaaacatgcgatcctcctagtagccgtgtcatttgtcacactcatcacgggaaatatgagctttagagatttaggtcgtgtcatggtcatggtcggcgccactatgacggatgacatcggaatgggcgttacgtatctagcattgctagctgcattcaaagtgagaccaaccttcgcagcaggtctattattaagaaagctaacatcaaaagaactaatgatggcaaccataggcatagcattactctctcaaagtaccatcccagaaacaatactagaattaaccgatgcactcgctttggggatgatggtattaaaaatagtacggaatatggaaaaatatcagttagcagtaacaataatggcgataagctgcgtacctaatgcagtaatactgcagaatgcgtggaaagtaagttgtacaatactagctgctgtatccgtatcgccactattgctcacatccagccaacaaaaagccgattggattcctctggctctaaccataaagggcctaaatcctacagcaatatttcttacaactctctctcgaacaagtaagaaaagatcctggccactaaatgaagccatcatggctgttgggatggtctcaatattggcatcatctttattgaaaaatgatataccgatgactggtcccttagttgccgggggactattgactgtctgctacgtacttacaggaagaagcgcggacctagaattggaacgagctgccgacgtgaaatgggaagaccaagcagaaattagtggctcgagtccgattctatctatcacaatttcagaggatggtagtatgtctataaagaacgaagaagaagaacaaacgttgactattttaatacgcactgggttattggttatatcaggggtgtttcctgtaagtatacccataacagcagccgcttggtatctctgggaggtcaagaaacaaagagccggagttctttgggacgtcccaagcccaccgcctgttgaaaaagccgaactagaggacggagcttatcggattaaacaaagaggaatattgggttattctcagataggggccggcgtctacaaagaaggtacattccataccatgtggcatgtaactagaggagcagtactaatgcatagagggaaaagaatagaaccatcctgggcagatgttaagaaagacctaatatcttacggtggcggttggaaacttgaaggagaatggaaagaaggagaagaagttcaggtattggcgcttgaacctggcaaaaatcctagagctgtacaaaccaagccgggtatatttaagacaaatacaggaacaataggagcagtatcattggactttagccctggaacatcaggctcaccaattgtagatagaaaaggaaaggtagttggattgtatggcaatggagtggttaccagaagtggagcttatgtatcggctatcgcccagacagagaaaagtattgaggataatcctgagatagaagatgatatctttaggaagaaacgtttaactataatggatctccatccgggcgccggcaagacaaaacgctatctaccagcgatcgtacgtgaagcaattaaaagaggtttacgaacactaatactagctccaactcgggttgtagctgccgaaatggaagaggctttaagagggttgccaatacggtatcaaacaacagcgattaaaacggaacatacaggaagagaaatcgttgatctaatgtgccacgctacgttcacaatgcgactccttagccctgttcgggtaccaaattataatctaataattatggatgaggcccactttacagatcctgcttcaatagccgcccgtgggtatatatcaacgcgcgttgaaatgggtgaagccgcgggtattttcatgactgctacacccccgggtagcagagatccatttccccaatcaaacgcccctattatggatgaagaacgggaaataccagagcgctcgtggaatagtggacatgaatgggtaacagatttcaaaggcaagaccgtctggttcgtaccttcgatcaaagctggtaatgatatagcagcatgcctgcgtaaaaatggtaagaaagtaatccaactctcaagaaaaacctttgactcggaatatgttaaaactcgagcaaacgattgggatttcgttgtgactaccgatatatccgagatgggggcaaatttcaaagcggaacgtgtgattgatccaagaaggtgcatgaaacccgtaattctcacagacggggaagaacgagtaatactagcaggtcccatgccagtaacccatagttcagccgctcaaaggaggggtaggattggacgaaatccgaaaaatgagaacgatcagtatatatatatgggcgagccactagaaaacgatgaagactgtgcccattggaaagaggctaaaatgctgctcgacaatatcaatacaccagaaggaataattcccagtatgttcgaacctgaacgcgagaaagttgatgctatagatggagaatatagattgaggggcgaagctcgaaagactttcgtagacctgatgagacgcggggatcttccagtatggttggcatataaggtagcagcagaggggattaattacgctgacaggaaatggtgttttgacggaattaagaacaatcaaatactggaagaaaatatggaagtggaaatatggacgaaggaaggcgaacggaagaaattaaaaccccgatggctagatgctcggatctattctgatcctttggctttgaaggaatttaaagaatttgcagccggaaggaagtccttaactcttaatttaatcaccgagatggggagactccctacctttatgacacaaaaggcaaggaacgcactagataatctggcggtgctccataccgcagaagccggtggtagagcatataaccatgcattatcagaattgccagaaacattagaaaccctactcctgctaactctattggctacagttaccggaggtatatttctatttttaatgagtggtaagggcattggaaagatgacccttggtatgtgctgcatcataacagcaagcattctcctgtggtatgcccaaatccaaccccattggatcgcggctagtatcatacttgagttctttctgattgtcctgttaattccagaacccgaaaaacagcgtacaccacaagataatcaactcacatatgtagtaattgcaatattaactgtggtggctgcaacgatggcaaacgaaatgggatttcttgagaaaactaagaaagatttagggttaggttcaattacaacacaagaatctgaatccaatatcctagatatagatctgagaccggcatcagcatggacactttatgctgtagctactacgtttgtaacaccaatgttaaggcactcaatagagaacagttcagtgaatgtgagcctaacagcaatagctaaccaagctacagtgctaatgggccttggcaaggggtggccattgtcaaaaatggatatcggagttcctctattagcgatagggtgctactcacaggttaacccgatcacactaacggcggctcttttactattagtggcgcattatgctataatagggcctggcctgcaagctaaggcgactagagaggcgcagaaaagggcagcggcaggaataatgaaaaaccctacggtagacggtataacagtaatcgatctagaaccaatcccctacgatccaaagttcgaaaagcaactcggccaagtgatgcttctaattctatgtgtaacccaagtactcatgatgagaacaacatgggcgctttgtgaagcactaacgctcgccacggggccgataagcactctgtgggaggggaacccagggcgattttggaatacaacaatagctgtatcgatggcgaacatattcaggggtagttatttagccggtgcaggcctgctatttagtatcatgaaaaacactacaaatactcgacgtggaacggggaatattggcgaaacgttaggcgaaaagtggaaatccagactaaacgcattaggtaaaagtgaatttcagatttataagaaaagcggcattcaagaagttgatcgaacattggctaaagaaggaataaagagaggagaaacggaccaccatgcagtctcaaggggctcagcaaaattacgttggtttgtagaaagaaatatggtaacgcccgaaggcaaggttgtcgacttaggttgtggaagagggggttggagctattattgtggaggcctaaagaacgtgcgagaagttaaaggcttgacaaaagggggcccgggacatgaagaacctatacccatgtccacgtatggttggaacctagtaagactgcaaagtggagtagacgtattctttactccgccggaaaaatgcgataccctactttgtgatataggtgaaagctctcccaatcctacaatagaggccggccgaactctaagagtacttaacctagtagagaattggttaaataataacacacagttctgtataaaagtacttaatccatacatgcctagcgtaatagagaaaatggaagcactacaacgcaaatacggaggcgccctagtacgaaatcctctatcaagaaattcgacacatgaaatgtactgggtaagcaatgcaacaggaaatattgtcagcagcgtgaatatgatttctcgcatgctgattaatcgtttcaccatgaaacacaagaaagcaacttatgaacctgatgtcgatttggggagtggaactcgcaatattggaatcgagagcgaaattccgaatctcgatataattggtaaaagaatcgagaaaataaaacaagaacatgagacaagttggcattacgaccaggatcacccgtataagacatgggcatatcatggatcatacgaaaccaaacaaacaggcagtgctagttcgatggttaacggggtagttagactattaacaaaaccatgggatgttgttccaatggttacacagatggcgatgacagataccacgccttttgggcaacaacgtgtatttaaagaaaaagtcgacacaagaacacaggagccgaaggaaggtacgaagaaactaatgaaaatcaccgcggaatggttatggaaagaattaggcaaaaagaaaacgcctcgaatgtgcactagagaagaatttacaagaaaagtacggagtaatgccgcactaggagcgatattcacagacgaaaataaatggaaaagtgccagagaggcggtagaggatggacggttttgggagctcgttgatagagaacgtaacttacatttagaaggaaaatgcgaaacctgtgtgtacaacatgatgggaaagcgggagaagaaattaggtgaatttggaaaagctaagggatctagagcaatctggtacatgtggctgggagctaggtttttggaatttgaagcattaggttttctaaacgaagaccattggttctcaagaggaaacagcctctcgggtgtagaaggtgaaggattacatagactaggatatatactaagggatgttgggaagaaagaaggaggcgcgatgtacgcagacgataccgcaggctgggataccaggattacgctcgaagatctgaaaaacgaggaaatggtaactaaccatatgaagggtgagcataaaaagctagcagaagcaattttcaaacttacataccaaaataaggtagtgagggtacaacgacccacgccccgaggcactgtcatggatataatttcgcgaagggaccaaagaggaagcggtcaagtgggaacctatggattaaatacgtttacaaacatggaagcccagttgatacggcaaatggaaggagaaggcatttttaaaagcatacaacaccttacggccaccgaagaaatagcggtacagaactggttggctcgtgtcgggagggaaagacttagccgtatggcaataagcggagacgattgtgtggtaaaaccgatagacgaccgtttcgcatccgcattaactgcacttaatgacatgggaaaagtcagaaaggatattcaacaatgggaacctagtcgcggatggaatgactggacacaagttcccttctgctcacatcattttcatgaattggtaatgaaagatggacgagttctagtagtaccatgtcgaaaccaagatgaattaattggtcgagccagaattagtcaaggtgctggatggtctcttaaagaaactgcttgtttaggtaaaagctatgcacaaatgtggacactaatgtacttccacagacgcgaccttagacttgccgccaacgctatctgtagcgcagtcccatcgcattgggtgcccacatcaagaacaacgtggtcaatacacgctaaacacgaatggatgacaacggaagatatgttagcagtgtggaatcgtgtctggatacaagaaaacccgtggatggaagacaagaccccagtcgaatcatgggaagaagtaccttacctaggtaaaagagaggatcaatggtgcggtagcatgataggattgacgtctagagcgacttgggctaaaaacatacaaactgcaataaaccaggtccgatccctaatagggaatgaagaatataccgactacatgccaagtatgaagcgatttagacgcgaagaggaggaagcaggggtactttggtag

SEQ ID NO: 22442 - RNA, 9876 nt, synthetic construct
  misc_feature 1..9876: note = derived and/or modified CDS sequence (opt6) from DENV-2__EU482680__SS-prME
  source 1..9876: mol_type = other RNA
acagccggagtcatcgtcatgctaatcccaaccgccatggcatttcacttaacaacacgtaacggggagccacatatgattgtaggacgtcaagaaaaagggaaaagtctcctattcaaaacagaggacggggtgaacatgtgcaccttgatggccatagacttgggggagctttgtgaagacacaattacctacaagtgcccactattaagacaaaatgaacctgaagacatagattgctggtgcaactcaacatccacatgggtaacatacggaacatgcaccacgacaggcgaacatagaagagaaaaaagaagtgtagctttggtcccccatgtaggaatgggtttagaaacaagaacggaaacatggatgtcttctgagggagcatggaaacatgtgcaaagaatcgaaacatggatactgcggcatccgggatttaccataatggccgcgattttagcatatacaattggaacgactcatttccaacgagcgctaatatttatattattaacagcagttgctccatcaatgacgatgagatgtataggaatatctaaccgagacttcgttgagggtgtaagcgggggaagttgggtggatatagtgcttgaacacggctcatgtgtgacaacaatggcgaaaaataaaccaactttagatttcgaactaatcaaaactgaagcgaaacaaccagccactctccgaaagtactgtattgaagccaaattaacgaataccactacagaatccagatgtccgactcaaggtgagccaagtttgaacgaagagcaagacaaaagattcatatgtaaacactccatggtagaccggggttggggtaacgggtgtggtttgtttggaaaaggaggtatcgtaacctgcgctatgtttacttgtaagaaaaatatggaaggtaaaattgtccaacctgagaaccttgagtacactatagttataacaccacactctggagaagaacacgctgttggaaacgacacggggaaacacgggaaagaaattaaaataacacctcaatcaagtataacagaagccgaactaacaggatatggtacagtaaccatggaatgtagtcctaggacaggactagattttaatgaaatggttctactacaaatggaagacaaggcatggctagtccaccgacaatggttcctagacttaccactaccctggttgccgggtgcggatacgcagggttccaattggatacagaaagaaacccttgtaacatttaagaatccgcatgctaaaaagcaagacgtagtagtactggggagccaagaaggtgcgatgcatacggccttaactggcgcgactgaaatacaaatgtccagcgggaacctcttatttacaggtcacttaaaatgtagattgagaatggataaactacaattaaaagggatgagttactcaatgtgtacaggtaaattcaagatagtaaaagaaatcgccgaaactcaacatggtactattgtaataagagtacaatatgaaggggatggtagcccttgtaaaatcccatttgaaataactgacctagagaaaaggcacgttttagggagactcatcacagtaaacccaatagttaccgagaaagatagccctgtcaatatagaagcagagcctccttttggagactcttatataatcattggagttgaacccggccaactaaaattgaactggttcaaaaaaggttcgtctatcgggcaaatgtttgagacaacaatgcgaggagccaaacgcatggcgatccttggggacacagcttgggattttggtagtttaggcggagtgttcacatctattggcaaggcactccatcaagtatttggcgccatatacggtgccgcattttcaggtgtatcgtggaccatgaagatattaattggcgtaattattacatggatcgggatgaacagtagatcaactagtttaagtgtatcacttgtactagttggtgtagtcacactctatctcggagcgatggtacaggcggactcaggatgtgtagtatcctggaaaaataaagaactcaaatgtgggtcaggcatcttcattaccgataatgtgcacacttggacagaacagtataaatttcaaccagagagccccagtaaattagcatcagcgatacagaaagcacacgaagaaggtatatgcggaataagatcagtaacgcgccttgaaaacttgatgtggaagcaaatcacacccgaattaaaccatattttaagtgaaaacgaagttaaactgacgataatgacgggggacatcagaggtataatgcaggctggaaagaggtcgctaagaccacagccaacagaacttaaatattcctggaagacctgggggaaagctaagatgttatccacagaatcacataatcaaacgttcctaattgacggaccggaaactgctgaatgcccaaatacaaacagagcatggaactcactggaggtagaagattacggtttcggggttttcacaactaacatatggcttaaactgcgggaaaagcaagatgttttttgtgattctaaattgatgagtgcagcgattaaagacaacagggcagtccatgcagatatgggatattggatagaaagcgctctcaatgacacttggaagatggaaaaagcatcatttattgaagtcaaaagctgtcactggcctaaatctcatacattatggtctaatggagtgttagaatcagaaatgatcataccaaagaactttgccggtccagtaagtcaacataactataggccaggttatcatactcaaacggcgggaccatggcatctaggcaaattagagatggatttcgatttatgtgaaggcacaactgtagtagtaactgaagactgcgggaatagaggaccctcacttcgaacgactacagcatcaggaaaactaataaccgaatggtgttgtagatcctgtactttaccaccgttaagatacagaggagaagacggctgctggtacggaatggaaatcaggcctttaaaagagaaagaagaaaatctagtaaattcgttagtgacagccggacatggccagattgataactttagtttaggagtactaggaatggcactattccttgaagaaatgctaaggacaagaataggtacaaaacatgcaattctactggttgctgtctctttcgttacattaataactggaaatatgagttttagagatctaggtcgtgtgatggttatggtcggcgcgacaatgacagatgatataggaactggagtaacatacctggccctattggcggcgtttaaagtaaggcccacgttcgcagctggacttctgttacgtaaactaacctccaaggaacttatgatggcaactataggcatagctttactgagccagtcaacaataccggaaacaatcctagagctcacggacgccttagcactgggtatgatggtattaaagattgtccgtaatatggaaaaataccagttggccgtaacaattatggcaataagttgtgtgccaaatgctgtaatattacagaatgcttggaaagttagttgcacaatactagcagccgtatctgtatcacctctcttattaacgtcttcgcaacaaaaagcggactggattccattagctctaactataaaaggcttgaaccctactgcaatttttctgactacattatcccggacatctaaaaagagaagctggcctctaaacgaagctataatggccgtaggcatggtgagtatattagcgtcatcccttctaaagaacgacataccgatgacagggcctttagtggcagggggtcttctaacggtatgttacgttctaacagggcgttcagcagatctagaactggaaagagcggctgatgtaaagtgggaagaccaagctgagatatcagggtcatcaccgattttatctatcactatatctgaagatgggtcaatgtccattaaaaatgaagaggaagaacagacactaacgatactaattaggaccggcttactggttataagtggtgtcttccctgtcagcattccaataacagcggcggcgtggtatctatgggaagtaaaaaagcaacgcgcaggagttctatgggacgttccatcaccacctccagtagaaaaagcagagctagaagatggagcatatagaataaaacagaggggcatcttgggttacagccaaattggggccggcgtatataaagagggcacttttcatactatgtggcatgtgactaggggagccgttcttatgcaccgagggaaacggattgaacccagttgggcggacgtaaaaaaggatcttataagttacgggggagggtggaagttggaaggtgaatggaaggaaggggaagaagtgcaagttttagcactcgaacccggtaagaacccgagggcagtacaaaccaagccgggcatatttaaaacaaatactggcacgattggcgcagtctcacttgatttcagtccaggcacctcaggaagtcccatagtcgacagaaagggcaaagtggtaggactctatggtaacggagtagtgactcgaagtggtgcttatgtatcagccattgcccaaacagaaaaatcaattgaagataatcctgaaatagaggatgacatttttagaaaaaaacgactgacaattatggacttacaccctggcgcaggaaaaacaaaacgttacctacccgcaattgtgagagaagcaataaaaaggggattacggacactaattttggcgcctacgcgagtcgtcgcggccgagatggaggaagcgctacgaggcctaccaatacgatatcaaacaacagctataaaaactgaacatacaggaagagaaatcgtagacttaatgtgtcatgcaacgtttacaatgaggttgctgagtccagttcgggtaccaaattacaatcttataataatggacgaagcccattttaccgaccctgcttcaatagcggcgcgtggttatataagtactagagtcgaaatgggtgaagctgcagggatttttatgaccgcaactcctccggggtctcgagatccgttcccacaaagcaatgcgccgataatggatgaagaaagagaaatacccgaaagatcatggaacagtggacatgagtgggtaacagattttaaaggaaaaactgtatggttcgttcctagcataaaagcagggaacgacattgccgcttgtctacgaaaaaatggaaaaaaagtcatacaactaagtcgaaaaacctttgattcagaatacgtcaaaactagagcaaatgactgggactttgttgtgactactgatataagcgagatgggtgctaactttaaagcagaaagagtgatagacccaaggcgatgcatgaaacctgtgattttaactgatggcgaagaaagggtgatactcgcaggtccaatgccagtcacacactcgtctgccgcacaacgtagagggagaataggcaggaatcccaaaaacgagaatgatcaatacatctacatgggagaaccattagaaaatgacgaagattgcgcgcactggaaagaagctaaaatgctcttagataacatcaacactccagagggaataatcccaagtatgtttgaacccgagcgagaaaaggttgatgccatagatggagaatacaggttacgaggtgaagcacgaaaaacctttgtagatctgatgcgtagaggcgacttaccagtatggttggcatataaggtggcagcagagggaattaattatgcagataggaaatggtgtttcgatggcattaaaaacaatcaaattctcgaagagaacatggaagtagaaatttggacgaaagagggtgaaagaaaaaagttaaaacctaggtggttagacgcacgtatatactccgatcctcttgcactcaaagaatttaaggaatttgcggcaggtcgcaaatcgctcacgttaaatcttattacagagatgggacggttgccaactttcatgactcaaaaagcaagaaatgctcttgataatcttgcagtactccacacagctgaagctgggggccgagcatataatcacgcattatcagaactgcctgaaaccctagagactttgttacttctaactttgttagcaacagtgactggcggcattttcttatttctcatgtcaggcaaaggcataggcaaaatgacattgggaatgtgttgcattataacagcttctatattgctatggtatgcacaaatacaaccacactggatagcagctagcataatcctagagtttttccttatcgtcctcttaattcctgaacctgagaaacaaagaacaccacaagacaatcagcttacttacgtagtaatagcgatactaactgtagtagcagcaacgatggcaaatgaaatgggttttttagagaaaacgaaaaaagatttagggttaggatccattacgacgcaggaatccgagtcaaatatattagatatagatcttcgaccggcctccgcatggacattgtatgcagttgcgacaacattcgtcacaccaatgctaaggcattcaatcgagaattcgtccgtaaacgtttcacttacagcgattgcaaaccaagcaacagtactaatgggcctaggtaaaggctggccattatcgaaaatggatataggagtaccattactggcaatcggatgttatagtcaggtaaacccaataacactaacggcagcgcttctcctcttggttgcccattacgccataataggcccgggactgcaagctaaagcgactcgagaagcccaaaaaagagcggccgcaggcattatgaaaaaccctactgttgatggaattacagtaatcgatctggaacccattccttacgatcctaagtttgagaaacaactagggcaggtaatgctacttattctctgtgttacgcaagtacttatgatgaggactacttgggcattatgtgaagcattaactttagctacggggcctataagcactctctgggagggtaatcccgggcgcttttggaatactaccatcgctgttagtatggcgaacatcttcagagggagttatctagcaggggcagggctcctatttagtattatgaagaatactacaaatacaagacgcggcactggtaatatcggagaaactcttggagaaaaatggaagagccgactgaatgcattaggaaaatccgagttccaaatctacaagaaatctggcatacaagaggtggacagaacccttgccaaagaaggaataaagcgaggagagacggatcatcacgcagtctcccgaggttccgctaagctccgctggtttgtagaaagaaatatggtaacaccagaaggaaaagtcgttgatctggggtgtgggcgaggcggatggtcttattactgtggtgggttaaagaacgtacgcgaggtgaagggacttactaaaggaggaccaggtcacgaggaacccattccgatgtcaacatacggctggaatttggttagactacagagtggtgtagatgtattcttcactccgccggagaagtgcgacacattactgtgtgacattggcgaaagctcgcccaaccccactatagaagcaggacgaacactaagagtattaaacctagtagagaattggttaaacaataatacacaattctgtataaaagtattgaacccttatatgccgagtgtgatagaaaagatggaagcattacaaaggaaatacggaggtgcacttgtacgcaatcctctcagccgtaacagcactcatgaaatgtattgggtaagtaacgcaactgggaatattgtatcaagtgtgaacatgatatctcgaatgctgattaaccgttttactatgaaacacaaaaaagccacgtacgaacctgacgtagacctagggagcggtacaagaaacatcggaatagagagtgaaaaaccaaacttagatatcataggaaagaggatcgagaaaataaagcaagaacatgagacaagttggcactatgatcaagatcacccatacaaaacatgggcataccatgggtcttatgagacaaagcaaacaggaagcgcatcatctatggtaaatggagtcgttcgattactaactaaaccttgggacgtagtaccgatggttactcaaatggcaatgacggatacaactccatttggccagcaacgagtatttaaagaaaaggttgacaccaggacacaggaaccaaaagaagggacaaaaaaattaatgaaaataactgcggagtggctgtggaaagaactgggaaaaaaaaaaacaccacgaatgtgtactcgcgaagagttcacgaggaaggtacgaagtaatgctgcattaggcgccatattcactgatgagaataagtggaaatcagcacgtgaggcagtagaagatggaagattttgggagttagttgatagagaacgaaatttacatctagagggaaagtgcgaaacatgtgtctacaatatgatgggcaaacgagagaaaaaattgggagaatttgggaaagccaaaggaagccgggccatttggtatatgtggcttggggcaagatttcttgagtttgaggcattaggttttttaaatgaagaccattggttttcaaggggaaatagtttaagcggggtagaaggagagggattacataggttgggatacatactaagggacgtaggaaaaaaagaagggggagcaatgtacgcggatgatacggccggatgggatactcgaataacattagaggatctaaagaatgaagaaatggtaacgaaccatatgaagggggaacataaaaaactggccgaagcaatctttaaactcacttatcagaacaaagtagtaagagttcaaaggccaacgcctagaggcaccgtgatggatataattagccgacgtgatcaaagaggatcgggccaagttggaacctatgggttaaatacatttacaaacatggaagcacaactgataagacaaatggaaggtgagggcatctttaaatcaatacagcatttaactgcaacagaggaaattgcggtccaaaattggttagctcgggtaggccgtgagcgactgagccgtatggcaatctctggcgacgattgcgtagtcaagccaatcgatgaccgatttgcgtccgcgctgacagcgctaaacgatatgggaaaagtgcgaaaagacatacagcaatgggaaccttccagggggtggaatgactggactcaggtccccttttgtagtcatcactttcatgagctagtgatgaaagatggtagagtactcgtcgttccttgtcggaaccaggatgaacttattggacgggcaaggataagtcaaggagcaggttggtccttaaaagaaacagcgtgtttaggtaaatcttacgctcaaatgtggacactgatgtattttcatcgaagagaccttcgtttagctgctaacgctatatgttcagccgtgccctcacattgggtaccaacatcacgaacaacgtggtcaattcatgcaaaacatgagtggatgacgactgaagatatgttagcagtctggaacagagtatggatccaagagaacccgtggatggaagacaaaacaccggtagagagctgggaggaagtcccttatttagggaaaagagaagaccaatggtgcggaagtttaatcgggctaacctcccgtgccacttgggcaaaaaatatccaaacagcaataaatcaggttaggtctttaataggtaacgaggaatacacagactatatgccaagtatgaaacgttttcggagggaagaggaagaagcaggagtgctttggtaa

SEQ ID NO: 22443 - RNA, 9876 nt, synthetic construct
  misc_feature 1..9876: note = derived and/or modified CDS sequence (opt6) from DENV-2__EU482754__SS-prME
  source 1..9876: mol_type = other RNA
acagcgggggtgattgtcatgctaattcccacagctatggcatttcacctaacaacaagaaatggagaaccacatatgattgtaggacgtcaagaaaaaggtaaaagtctgttgttcaaaacagaagacggcgtaaacatgtgcacactaatggcaatggacttaggtgaactttgtgaagatacaattacatataaatgccctcttcttcgccaaaacgaacccgaagacattgattgttggtgtaacagcaccagtacatgggtgacatatggaacttgtacaacaacaggtgaacaccgacgagaaaaacgtagcgttgctttggtgccgcacgtcggcatgggattagaaacacgaacggaaacatggatgtcaagcgaaggtgcttggaaacatgttcaaaggatcgaaacttggatactacgccatcctggatttacgattatggcagcaattttagcatatacgatagggacgacgcactttcaacgagcattaatatttatccttttgacagcagtagctcctagtatgaccatgaggtgcataggaatttcaaatagggacttcgtggaaggtgtttccggaggttcttgggtggatatagtactagagcatggaagctgtgtgaccacaatggccaaaaataaacccactttagacttcgaattgataaaaacagaagcgaaacaacccgctactttaagaaaatactgcattgaggcaaagctcaccaacacaacgactgaatcaagatgtcccacacaaggggagccctctcttaatgaggaacaggataagaggttcatatgcaagcacagtatggtagacagagggtggggaaatgggtgcggtctgtttggaaagggaggaattgtaacatgcgccatgttcacctgtaagaaaaatatggagggaaaagttgtacaaccagaaaaccttgaatacacaatagtgatcacgccgcacagtggtgaggaacatgcagtaggtaatgacactggaaagcatggtaaagagatcaagataacaccccaatcatcaatcacggaagctgaactaactggatatggaaccgttacaatggaatgctcgcccagaactggacttgacttcaatgagatggtccttctgcaaatggaagataaagcgtggctagttcatcgccaatggtttttggatttaccattgccatggctaccgggagcagatactcaagggtcgaactggatccaaaaagaaaccttagttacgtttaaaaatccacacgccaagaaacaagacgtagttgtattaggaagtcaagaaggagcaatgcacacggctttaacaggtgctacagaaattcaaatgtcgtctggcaatttactattcacaggacatctaaaatgccgattaagaatggacaaattacagttaaaaggtatgtcctattcgatgtgcacgggtaaatttaaaattgtaaaagaaatagccgaaacccagcatggtactattgttattagagtacagtacgaaggagatggctcaccgtgtaagataccctttgagattactgatctcgaaaaacgtcatgtgttgggcaggcttataacagtaaacccgatagttacagaaaaagacagtccagtgaatatagaggcagagcctccatttggagactcttatatcataattggagttgaaccaggacaattgaaattaaattggttcaagaagggatcatctattggacagatgttcgaaactacaatgcgaggagcaaagagaatggccatacttggagacacagcatgggattttgggtccctaggaggggtatttactagcataggcaaggcactgcatcaagtatttggagcgatctacggggctgcttttagtggagtatcgtggaccatgaaaatcctaataggcgtaataataacatggattgggatgaacagtagatcaacttcgctctcggttagtctcgtcttagttggagtcgtcactttgtatttgggtgccatggttcaagcggatagtggatgtgtggtctcctggaaaaataaagagctcaaatgtggttccggaatatttataaccgacaacatacatacatggacagagcaatacaaatttcagcctgaatcaccatcgaagctagcatctgctatacaaaaagcacacgaagaaggtatttgtgggataagatcagtaacacgcctagaaaatctaatgtggaagcaaattacgcctgagttaaaccatatactctctgagaacgaagtaaaactaactatcatgacaggtgatattagaggtataatgcaagcaggaaaaagatccctgcgacctcagcccacagagcttaaatacagctggaagacgtggggcaaagcaaaaatgctttccactgaatctcacaatcagaccttcttaatagatggaccggaaaccgcagaatgtccaaacacaaaccgtgcatggaatagccttgaagtagaagactatggtttcggagtatttacgactaatatatggttaaaacttcgagaaaaacaagatgtcttttgtgatagtaaacttatgagtgcagcaattaaagataatcgggcagtacatgctgatatggggtactggatagaaagcgccttaaacgatacgtggaagatggaaaaagcatcattcattgaggtaaagagttgtcactggcccaaaagccatacattgtggtcaaatggtgtacttgaatctgaaatgataatacctaaaaactttgcagggcccgtgtctcaacacaattacaggcccggatatcatactcagactgcagggccatggcatttaggaaaattagaaatggattttgacctttgtgagggtacaaccgtcgtggttacagaggattgtggaaacagaggacccagccttcgaacaactactgcgtcaggaaaacttattacagaatggtgctgccggagctgtaccttacctcccctacgttatagaggtgaagatggatgttggtacggaatggaaattcgaccactaaaagaaaaagaagaaaacctagtaaattctctagtcaccgctggacatggacaaatagataattttagcttaggggttttaggaatggcgttatttttagaagagatgctgcggacaagaatcggaactaagcacgcaatactgttggttgcagtaagttttgtgacattgatcacgggaaacatgtcatttcgtgatctaggacgtgtaatggtaatggttggcgcgactatgacggatgacatcggtatgggggtaacatatctcgccttattagcagcattcaaagtacgacctactttcgccgccggtctacttctacggaagctgacctcaaaggaacttatgatggcgaccatcggtatagcgctactatcacaaagtacaatcccagaaaccattttagaacttacggatgcgttagcgctcggcatgatggtgttgaaaatagtaaggaacatggagaagtatcaattggcagtcacgataatggcaataagctgcgtgccaaacgctgtaatattacagaatgcttggaaagtatcatgtacaatattggcggcagtgagcgtaagcccattattgctgacgagcagccagcagaaggcagattggataccgctggctctaacaataaaaggtctaaatcctacagcaatatttttaacaactttgtcacgtacttcgaagaaaagaagttggccattaaatgaagcaattatggcagtaggtatggtttcaattcttgctagctcattgctaaagaacgatattccaatgacagggccattagttgcgggtggtttactaacagtatgttacgttctgaccgggcgatctgccgatttggaattggagagagcggcagatgtcaaatgggaggaccaagcagagataagtgggagttcgccgatattatctattaccataagtgaggatggttctatgagcattaaaaacgaagaagaagaacaaacactaacaattttaattcgaaccggactcctggtaattagtggagtatttccagtatcgatacctattaccgctgccgcatggtatttatgggaagtgaagaaacaaagagccggtgttctatgggatgtgccaagtccaccacccgtggaaaaagccgaactcgaggacggcgcttaccgaattaaacagagaggaatattgggttacagtcaaattggtgccggtgtgtataaagaaggaacatttcatactatgtggcatgtaacgagaggtgcagtattaatgcatcgtggtaaacgaatagaaccgtcatgggcagacgtaaagaaagatttaataagctacggcggaggttggaaactcgaaggagaatggaaagaaggtgaagaggttcaagtactagccttagagcccggcaaaaatcccagggcggtgcaaactaaacctggaatctttaaaactaatacaggaacaattggggcagtatctcttgattttagcccaggcacttctgggagccctatagtagacaggaaaggaaaagtagttggattatatggaaatggggtcgttacacgatctggcgcttatgtttccgccatcgcccaaacagagaaaagtatcgaggacaaccccgaaatagaggacgacattttcagaaagaaaagactcacaattatggacctacatcctggagctgggaagactaaaagatatttaccggccatagtaagagaggccattaaacgtggtttgcggacacttatcttagcacctacacgcgtcgtggcagcagagatggaagaggctttacgggggctaccgatcagataccaaacaaccgctattaaaacagaacatacagggcgtgaaatagtagacttaatgtgtcacgcaacttttacaatgagacttctaagtccagtacgagttccaaattataatctaataataatggatgaggcacattttaccgatcctgcttctatagcagctcgaggatacatatcgacgcgtgtagaaatgggtgaagcagcgggcattttcatgacagccacaccaccgggctcacgagacccctttccccaatcaaacgcgcctataatggatgaagaacgtgagatccctgagcgatcatggaactctgggcacgaatgggtaacagactttaaaggaaaaacagtatggtttgttccttcaataaaggcaggcaacgatatagctgcatgtcttcgtaaaaacggaaagaaagtaattcaattatcgaggaaaacttttgattccgaatatgtcaaaacgagagcaaatgactgggatttcgtcgtaacaacggatatatcagagatgggcgctaattttaaagctgagagagtcatcgatcctaggcgatgtatgaaacctgtcatactaacagacggtgaagaacgagtaattctggcagggccaatgccagtaacacactcatctgccgctcaacgacgcggacgcattggccgtaatcccaaaaatgagaacgaccaatacatctatatgggagaacctctagaaaacgatgaagattgcgctcattggaaagaagcgaaaatgcttctagataatattaacacaccagagggaattattccatccatgttcgagcctgaacgagaaaaagtagatgcgatcgacggtgaatacagattaagaggagaagcaagaaagacctttgtcgacctgatgagacgaggggatcttcccgtgtggcttgcttacaaagtagctgctgagggaatcaattatgcagatcggaaatggtgtttcgacgggatcaagaacaaccaaatactggaagaaaatatggaagtcgagatttggacaaaggagggcgagaggaagaaattaaaacctagatggctcgatgctcgaatatactcagacccattagcattgaaagagttcaaagagttcgctgcaggtaggaaatccctcacgcttaatctcattacagaaatgggaagacttcctacttttatgactcaaaaagcgcgaaatgcactagataatttagctgttctacatactgccgaagcaggaggacgagcatataatcacgccctctcagaactccctgagacattagaaactcttcttctgctcacactattagcaacagtaactggaggaattttcttgtttctcatgtccggtaaaggaataggtaaaatgacactgggcatgtgttgcataataacagctagcatattactgtggtatgcgcaaatccagccacactggatagccgcaagtataatattagaatttttcttgatagtattgttaattccggaaccagaaaaacaaagaaccccacaggacaatcaactaacctatgtagtaattgctattttgacagtagtagcggctactatggcaaatgagatgggtttccttgaaaagaccaagaaagaccttggtctaggctcaataactacccaagaatcggaatctaacattctagatatagatttgcgacccgcatccgcttggacactatatgcagtcgcaacgacattcgttacgccaatgctgcgacactccatagaaaatagttcagttaacgtctcgctcacagcaatagcgaatcaggctactgttttgatgggtctaggcaaaggctggccgttgtcaaaaatggatattggtgtacctttgttggcgataggatgttattcgcaagtaaatccaattaccctaacggctgcactgctactattggtagcgcattatgccataatcggtccaggtcttcaggcgaaagcgaccagggaagcacagaaaagagctgctgcaggtatcatgaaaaacccgactgtcgacggaatcactgtaatagacttagaaccgataccgtatgatccaaaatttgagaaacaacttggacaagtcatgttactcatcttatgtgtaacacaagtattaatgatgagaactacttgggccctttgcgaagcattgacactagcaacgggtcctatatcaacactatgggaaggaaacccaggacggttttggaatacaaccatagctgtgtcgatggccaacatatttcgagggtcctaccttgccggagcaggactattattttctataatgaaaaatactaccaatacgagaagaggtaccggtaatatcggcgaaacattaggtgaaaaatggaaaagcaggcttaacgcactaggcaaatcagaatttcaaatatataagaaaagcgggattcaagaggttgacagaacattagctaaagaagggatcaaacgcggagaaacagaccaccatgctgtatcacgtggctcagcaaaactacgttggttcgtagagcggaacatggttacaccagaaggaaaagtggttgatcttggatgcggtagaggcggttggagttattattgcggtggactcaagaatgtaagagaagtaaaaggtctgacaaaaggcggcccaggtcacgaggagcctattcctatgagcacatacggatggaacttggtcaggctccaaagtggagttgacgtattctttactccacccgaaaaatgcgacactttactgtgcgatataggcgagtcgagtccaaatcccacaattgaggcaggaagaacactccgtgtattgaacctggtcgaaaattggttaaataacaacacccaattttgtataaaagttttaaatccatacatgccttcagtaattgagaaaatggaagccctccaaagaaaatacgggggagccttagtacgaaatccattatccaggaatagcacgcacgaaatgtactgggtaagtaatgcaacaggaaacatagtcagctctgtaaacatgatatctagaatgttgattaatagatttaccatgaaacataagaaagcaacctatgaacccgacgtcgatctcggaagcggtacgagaaatatcggcatagaatcagaaataccgaatctcgatataatcggaaaaagaattgagaaaattaaacaagaacacgagacatcatggcactacgatcaggatcatccatataaaacatgggcctaccatggatcgtacgaaacaaaacagacaggttcagcatcgtccatggttaacggagtcgtaagactattaacaaagccctgggatgtcgtacccatggtaactcaaatggcaatgaccgatacaactccattcggtcagcaaagggtgtttaaagaaaaagtagatacacgtacgcaggaacctaaagaaggcactaaaaagctaatgaaaataaccgctgaatggctgtggaaagaattgggcaagaagaaaactcccagaatgtgtaccagagaagaatttacaagaaaagtccgttcaaatgccgctcttggagcaatatttacagacgaaaataaatggaaatcagcgagagaagcggttgaggatggacgcttctgggagctagttgatcgagagaggaacttacacctagagggaaagtgtgaaacgtgtgtctataacatgatgggtaaacgagagaagaaattaggtgagttcggtaaagccaagggtagtagagcaatatggtatatgtggcttggtgccaggttcctagagttcgaggcgttaggcttcctgaatgaggatcactggttttcacggggtaattctcttagtggagtcgaaggagaggggttacatcggttaggatatatcctccgtgacgttggcaagaaagaaggtggagctatgtacgcggacgatactgcagggtgggacacaagaataacacttgaagatttgaaaaacgaggaaatggtgaccaaccatatgaagggggaacacaagaaactagcggaagcaatatttaaattgacctaccagaacaaagtagttagagtacaacgacccactccgcgaggcacagtcatggatattataagtcgccgtgatcaacgcgggtctgggcaagttggaacatatgggttgaacacatttaccaacatggaagcacagcttataaggcagatggaaggggaaggaatatttaaaagcattcagcatttaacagcgacagaagaaatagcagttcaaaattggcttgcaagagttggcagagaaagattaagtcgaatggcaatctcgggggacgattgcgttgtgaaaccaatcgatgatagatttgcttctgcacttactgcacttaatgatatgggcaaagtgaggaaagacatacaacaatgggagccgagtagaggctggaacgactggacgcaggtaccattctgttctcatcattttcacgaactcgttatgaaggatggtagggtcctagtagtaccgtgccgaaaccaagatgaattaattggacgagcaaggattagccaaggcgcaggatggagcctaaaggagaccgcttgcttggggaaatcatacgcacaaatgtggacgttaatgtatttccatcgtcgtgatttgcgtttagcggcaaatgctatttgtagcgctgtaccgagccattgggtcccaactagccgaactacttggtcaatacacgctaaacacgaatggatgacaaccgaggatatgctagcagtatggaatcgtgtctggatacaggaaaatccctggatggaagataaaacaccagtagaatcatgggaagaggtgccttatctaggaaaaagggaggaccaatggtgtggttcgttaattggtttaaccagtcgcgcaacatgggcaaagaatatacaaacagcaataaatcaagtaagaagtttaataggaaatgaagaatacactgattatatgcctagcatgaaacgatttagacgcgaagaagaagaagcaggagttttgtggtag

SEQ ID NO: 22444 - RNA, 9876 nt, synthetic construct
  misc_feature 1..9876: note = derived and/or modified CDS sequence (opt6) from DENV-2__FJ478455__SS-prME
  source 1..9876: mol_type = other RNA
acagctggagtgattgtaatgctgattccgaccgcgatggcgttccacttaacaacacggaatggtgaacctcatatgatcgtagggagacaagaaaaaggtaaatctctactattcaaaaccgaagatggggtaaatatgtgcactctgatggcaatagacctaggagaactttgtgaagacacaattacatataaatgcccattgttacgccaaaacgaacctgaagatatagattgctggtgcaattcaacttcaacatgggttacttatggaacttgtaccacgactggtgaacatagaagagaaaaacgatcagttgccttagtaccacacgttggaatgggtctagaaacgcgaacagaaacttggatgagtagtgaaggagcatggaaacacgtgcagaggatcgaaacttggatattacgccatccaggattcaccataatggctgctatactggcttacacaataggaaccactcattttcaacgagcacttatctttatattattaacagcagttgcgccgagtatgacgatgcgatgcataggtatcagcaatagagatttcgttgaaggagtaagcggaggttcgtgggttgatatagtccttgaacatggatcgtgtgtcacgacaatggcgaaaaacaaaccaacgctggatttcgaattaataaaaaccgaagcgaaacaacccgcaactctccgaaaatattgcatagaagcaaaacttacaaacaccacgactgaatcaagatgcccaactcaaggcgaaccgagcttaaatgaggaacaagataaacggtttatttgtaaacattcaatggtagatcggggttggggaaatggttgtgggctgttcgggaaaggaggaattgtcacatgtgcgatgttcacgtgtaagaaaaatatggaaggaaaagtagttcaacctgagaacttagaatatacaatagtgataacaccccattcaggtgaggaacacgctgtcggtaatgacacaggtaaacacggtaaagaaataaaaatcacccctcagagctcaattactgaagcagagctgacggggtacggaaccgtcacaatggagtgctcgcctcggacgggtttggacttcaacgaaatggtactattacaaatggaggataaagcatggttagtgcatcgacaatggttccttgacctcccattgccctggttgcccggagcagatactcaaggatcaaattggatacaaaaagagaccctcgtgacttttaaaaacccccacgcaaagaaacaggatgtagtagttttaggcagccaagagggcgcaatgcacactgcactaacaggggcaacagagatccaaatgtcatctggcaatttgttgtttacgggtcacttaaaatgtcgattaaggatggataaactacaacttaaagggatgtcatactcaatgtgcacgggtaaatttaaaatagtgaaagaaatagccgaaactcagcatggtacgattgtaattagggtccagtatgaaggtgacggaagtccctgtaaaatcccatttgaaatcacagatctagagaaaagacacgtattaggtcgattaataacagttaatcctatagtcacagagaaagatagtccagtaaatatcgaagcagagccaccatttggtgactcatatattattatcggtgtcgaacctgggcaattaaaactaaattggttcaagaaagggtcgtcaattggtcagatgtttgaaaccacgatgagaggagcgaaacgtatggcaatcttgggcgacacagcttgggatttcggatcgttaggcggtgtcttcaccagcattggtaaggctttgcatcaggtatttggtgctatttacggagcagctttttcaggagtgtcatggactatgaaaatacttatcggagtaataataacttggattggaatgaactcacgttcaacatcactatcagtatccttagttttagtgggagttgtaacactatatttaggtgctgttgttcaggcagacagcggttgcgttgtatcatggaaaaataaagaattaaaatgtgggagcggaattttcatcacagataatgtccacacctggacagaacagtacaaattccagcctgaaagcccatcaaaactagcatcggcaattcaaaaagctcatgaagaaggaatttgcggtattaggtcagtgacacgtttagaaaatctcatgtggaaacaaatcacaccagaattaaaccatatactgagtgaaaatgaggttaaacttacgatcatgacaggtgacataaaagggataatgcaagctggaaaacgaagtttaagaccacaacctaccgagctaaaatattcttggaaaacatggggtaaagccaaaatgctttcgacggaatcccacaatcaaacgtttttaattgatggacctgaaactgtagaatgcccaaatactaatagagcatggaacagtttagaagtagaagactacggattcggcgtattcactacgaatatatggttgaaattacgagagaaacaggacgtattctgtgactcaaaactcatgtcagccgcaatcaaggataatagagcagtacacgcagatatgggctattggattgaaagtgctttaaatgatacatggaaaatggaaaaggcctcattcattgaagtcaaatcttgtcattggccgaaatcgcacacgttgtggtctaatggagttttggagagtgaaatgataatccccaaaaatttcgcggggccggtgagtcaacataattaccgacctggctaccatactcaaacagccggaccctggcacttaggtaaattggaaatggatttcgatttttgcgaaggcacaacagtagtagtaactgaagattgtggtaatcgtgggccgagcctcagaactacaacggcttcaggcaaattaataacagaatggtgttgtcgttcatgtacattgcctccgttacgttatcggggcgaagatggttgttggtatggtatggaaatcaggccgctcaaagaaaaagaagaaaatttggtaaattctctcgtaacagccggacacggccaaatagataatttttctcttggggtgttaggtatggctttatttcttgaagaaatgttacgtacacgtataggtaccaagcatgcaattttattggtagccgtatcttttgtaaccctgatcaccggaaatatgagttttagggatctcggacgagttatggtcatggttggagctacgatgacggacgacataggtatgggagtaacttacttagcacttttggcagcattcaaagtcagaccaacctttgcggcgggtttattgcttcgaaagctaacttcaaaagaattaatgatggcaactattggaatagccttactatcacaaagcactatacctgagacaattctagaactaacagatgccctcgcgcttggaatgatggtactgaagattgtacgtaatatggaaaaatatcagctggctgtgacaatcatggccatctcatgtgtacctaacgcggtaatactgcaaaatgcttggaaggtatcttgtactatcctagccgcagtatctgtatccccgttattattaacttcatctcaacaaaaagcagactggattcctttggcactaacaatcaaaggcctcaatccaaccgctatctttttaacaacattatctcgcaccagtaagaaacgatcttggcctctaaatgaagcgattatggccgtaggtatggtcagtatattggcttcaagtctcctcaaaaacgacatccctatgactggaccattagtcgcaggcgggttactaacagtttgttatgttcttacaggacgctcagcggacctagaactagaacgcgctgctgatgtaaaatgggaagaccaagctgaaatcagtggcagttcgccaattctatccataaccatcagcgaggacggcagtatgtctattaaaaatgaagaagaagaacagactttaacgatattaataaggacaggactgctagtaatatcgggcgtattcccggtctccatacctattactgcagcagcgtggtacttatgggaagtcaagaaacaacgagccggagtactctgggatgtaccaagtccacctccggttgaaaaagcagaattagaagatggtgcttacaggataaaacaacgagggattctaggatattcacaaataggcgctggtgtttacaaagaaggaacatttcataccatgtggcatgtaactagaggagcagtattgatgcatagaggaaaaagaatagaaccctcgtgggcagatgtcaagaaagatctgatttcatacggcggagggtggaaattagaaggagaatggaaagaaggtgaagaggttcaagtactagctttagaacccgggaaaaacccacgtgcagtacagacaaagcccggcatatttaagactaatactggcactataggcgcagtgtctttagacttctctccagggacgagtggcagccccattgtagatagaaagggaaaggttgtaggattgtatggtaacggcgtagtcacacgatcaggtgcatacgttagtgcgatagcacaaactgagaaaagcatagaagataacccagagattgaggatgatatcttccggaagaaacgactaacaataatggatctccaccctggggcaggaaaaacgaaaagatacttacccgccatagttcgagaagcaattaaacgcggtctcagaacgctaatattggcacctacaagggtcgtggctgctgaaatggaggaagcgttaaggggattgccaatacggtatcaaacaccagcgataaaaactgagcacacggggcgtgaaatagttgatcttatgtgtcacgctacatttactatgcgccttctgagtccagtaagagttcctaactataacttgataataatggatgaagcccactttactgatcctgcatcaattgctgcgagaggatatatatcgacgcgagtagaaatgggtgaagctgcaggaatattcatgacagcaactcccccagggtcacgggaccctttcccccaatcaaatgctccaatcatggacgaagaaagagaaatacctgaaagaagttggaatagcggtcatgaatgggtaacagatttcaaaggaaaaacagtatggtttgtaccttccatcaaagcagggaatgacattgctgcatgcctcaggaaaaacggcaagaaagtaattcaattgagtagaaaaacgtttgatagcgagtatgtcaaaacgagggctaatgattgggactttgtcgtaacgacagatatttcagaaatgggagcgaatttcaaagcagaacgcgtaatagacccacgccgatgcatgaagcctgtaatattaaccgatggggaagaaagagtaattctagctggaccaatgccagttacccactcatcagcagcacaaagacgtggacggataggaaggaacccgaagaatgaaaacgatcaatacatatacatgggggagccacttgagaacgacgaagattgtgcgcattggaaagaagcaaaaatgctattggataatataaatacaccggaaggaatcattccgtcaatgtttgaacctgagagggagaaagtagatgcaatcgatggggaatacagacttagaggagaagctcgtaagacctttgtagatcttatgagacgaggagaccttcccgtatggctcgcttataaagtcgcagcagaagggatcaactacgcagacagaaagtggtgttttgatgggattaaaaataatcaaatactagaagagaatatggaggttgaaatttggacaaaagaaggtgaaaggaagaaattaaaacctcggtggctggatgctagaatatattccgaccctctagcgctcaaagaatttaaggaatttgcagccggtcgaaaaagtcttacacttaatttgataacggaaatggggcgactcccaacttttatgactcagaaagcgaggaacgcgttagacaatttagcggtactccataccgctgaagcaggcggacgtgcctataaccacgccctttcagaactcccagagactctagagacactgttattacttacactacttgccacagtaactggaggtattttcttatttctgatgagtgggaaaggtattggaaaaatgacattaggcatgtgttgcataattacagcgtcaattctactctggtatgcgcaaatacaaccacattggatagcagcctctatcatattagaatttttcttaattgtattattgattcctgagccagaaaaacaaaggacacctcaagataatcagctcacgtacgtagtgattgcaatactaaccgtagtggcagcgactatggcaaacgaaatgggttttcttgagaaaaccaaaaaggacttaggactgggaagcattactacgcaggaatctgaatcgaatatcttagacattgacttaagaccagctagtgcctggactctatatgcggtagctactacattcgttactcctatgctacggcactcgattgagaactcatccgtaaatgtgagtttaacagcgatcgcaaatcaagctaccgtattaatgggtctaggcaaaggctggcccttgagtaagatggacattggtgttcccttgttagcaataggttgctattctcaagtaaatccaatcaccttaaccgctgccttattgttgctagtggcccactacgccatcatcggcccgggtctacaggccaaagctactagagaagcacagaaacgtgccgcagcaggaataatgaaaaatccaacagtagatggaataactgttatagacctagaaccaataccttatgacccaaagtttgaaaaacaacttggtcaagtaatgctactaattctctgtgtaacacaagttctaatgatgaggacaacatgggccttatgcgaagcactgactcttgcaacaggccccatatcaaccctatgggaaggaaacccgggaaggttttggaacacaacgatagcagtcagcatggcaaatatctttcgtgggagctacttggccggagcaggcttattgttctcaataatgaaaaatacaacatcgacccggagaggcacaggtaacattggagaaacactaggggaaaaatggaaatctcggctaaatgcgcttggcaaatcagaatttcagatatataagaaatcaggcattcaagaagtagatagaacactggcaaaagaaggaataaaaagaggagaaactgatcatcacgcagtatcacgcggtagcgcgaaattaagatggtttgttgaaagaaacatggttacaccagagggaaaagtggtagacctaggatgtggtaggggcgggtggtcatattattgtggtggacttaaaaacgtcagagaagtcaaaggtctaactaaagggggaccgggccacgaagaaccaatacctatgagtacctatggatggaatctagtacgtctccagtctggagttgatgttttctttaccccaccagaaaagtgcgacacactactctgcgacattggtgaaagttctccgaatccaaccatagaggccggcagaacgctcagagtactaaacttagtagagaactggcttaacaacaatacccagttttgcatcaaagtattgaatccgtacatgccctcggttattgagaaaatggaggctttacaaaggcaatatggcggtgctttagtacgaaacccgttatcaagaaactcgacacatgaaatgtattgggtatcaaacgccacaggcaatattgtcagtagtgtaaatatgatttcgcgaatgttgataaaccgattcacgatgaaacataaaaaggcaacctacgaacctgacgtagatctgggttcgggcacaagaaacatagggattgaatctgagattccaaatctcgacattataggtaaacgaatagagaaaattaaacaagagcacgagataagttggcactatgaccaagatcacccctataaaacatgggcttatcacggatcttatgaaacaaagcaaacaggatctgccagtagtatggtcaatggagtagtacgcttattaaccaaaccctgggacgtggtgccaatggtgacccagatggcaatgacagatactacccccttcggacaacaaagagtatttaaggagaaggtagataccaggacacaggaacccaaagaaggaactaaaaagttaatgaagatcacagcagaatggctatggaaagaattaggtaaaaagaaaactcctcgaatgtgtaccagagaagagttcacaagaaaagtgagaagtaatgcggccttgggagctatatttacggatgagaataaatggaaatcggcccgagaagcagtagaagatggacgtttttgggaattagtagatagagagcgtaatttacaccttgaggggaaatgtgaaacgtgtgtatacaacatgatgggtaaacgtgagaagaaattaggcgagttcggaaaagcaaaaggcagtcgggcaatctggtacatgtggttgggagctagattcctcgaatttgaagcactcggcttcctcaatgaagaccattggttctcaagaggaaacagtctttcaggcgtagaaggtgagggattacacagattgggatacatactaagagatgttggcaagaaagaagggggagctatgtatgcggatgacacggctggttgggacacacgaataacgttagaagatttaaagaatgaagagatggtaacaaatcatatgaaaggagaacacaagaaactggctgaggctatcttcaaattaacctatcagaacaaagtagtccgggtgcagagacctacacctagggggacggttatggacatcattagcagaagggatcaacgaggatccggccaagttgggacctacggattaaatacatttactaatatggaggcacaattgataagacaaatggaaggagaaggtattttcaaaagcatacaacaccttacagctactgaggaaatcgccgtgcaaaactggttggcgcgagtgggaagagaaagacttagcaggatggcaattagcggagatgactgtgtagtgaagccaattgacgacagatttgcgagcgcattgacggctttaaacgatatgggcaaagtaaggaaagatattcaacaatgggaaccttctagaggttggaacgattggacacaggtccctttctgtagtcatcatttccatgaacttgtaatgaaagacggaagagtactcgttgtaccatgtaggaatcaagacgagctaataggtagagcacgtatatctcaaggagcggggtggtcactaaaagaaactgcttgtctcggcaagagctacgcacagatgtggaccctaatgtactttcacagaagggacttaagactagctgcaaacgctatatgctcggctgtaccttctcactgggttcccacatcccgaacaacctggagtatacacgctaaacatgaatggatgacgaccgaggatatgttagctgtttggaacagagtatggatacaggaaaacccttggatggaagacaagacacctgtagaatcgtgggaggaagttccatatttaggcaagcgcgaggaccaatggtgtggatcacttatcggtcttacaagcagagccacatgggccaaaaacattcaggccgccataaatcaagtgagaagtctaataggcaatgaagaatatacggactatatgccttcgatgaaacgcttccgacgtgaagaggaagaagccggtgtactatggtga

SEQ ID NO: 22445 - RNA, 9876 nt, synthetic construct
  misc_feature 1..9876: note = derived and/or modified CDS sequence (opt6) from DENV-2__EU482756__SS-prME
  source 1..9876: mol_type = other RNA
acagcaggagtaatagttatgctaataccaactgcaatggcgttccacttaacaacaagaaatggcgagcctcatatgatagtggggcgtcaagagaaaggcaaatcattactttttaaaactgaagacggtgttaatatgtgtacccttatggctatagatttaggtgaactatgcgaagataccataacatataaatgcccattactacgccagaatgaaccagaagatatagactgttggtgtaatagcacgtcgacatgggtaacttatggaacatgcacgacgacgggagaacaccgtagggagaaaagatcagttgctctcgttcctcatgtaggaatggggttggaaacgaggactgaaacgtggatgagctcggaaggagcttggaaacatgtccaaagaatagaaacgtggatcttgcgtcatccaggtttcacgatcatggcagccattttggcttacacgatcgggacgacacacttccagagagccctaatctttatcctactaacagcagttgcgccgtcaatgacgatgagatgcataggtatatcgaacagagatttcgtcgagggagtctctggcggatcttgggtcgatatagttctggaacatggttcatgtgttactacaatggccaaaaataaaccaacgctagattttgagttaatcaaaaccgaagcaaaacaacctgcaacactccgcaaatattgtattgaagctaaattaacaaatacaacaactgaatcaagatgccctactcaaggagaaccatcgctgaacgaggaacaggataaacggttcatatgtaaacattcaatggtagatcgagggtggggtaatgggtgcggattgttcggtaaaggaggtatagtaacatgtgcaatgttcacatgcaagaaaaacatggaagggaaagttgtacagccagaaaacttagaatataccatagttataactcctcatagcggggaggagcatgcggttggcaatgacacgggaaaacacgggaaagaaataaaaataacacctcaaagcagcatcactgaagctgaacttaccggatatgggacagtaacaatggaatgctcaccacgtactggtttagattttaatgaaatggtcctccttcagatggaagataaagcatggctagtacacaggcagtggtttttagatttgccactaccttggttacctggagctgacacccagggatctaattggatccaaaaagaaaccttggtaacatttaaaaacccccatgccaagaaacaagacgttgtggttttaggatcacaagaaggagcaatgcatacagccttaacaggtgccaccgagatacaaatgagtagcggaaaccttcttttcactggacatttaaaatgtagactaaggatggataaactacagttaaaaggaatgtcatactcgatgtgtacaggcaaatttaaaatagttaaagaaatagctgaaacacaacatggaacaatagtcattcgagtgcaatacgaaggtgacggaagcccatgtaagattccatttgaaataacagatttagagaagcgtcatgttcttggacgccttataaccgttaatccaattgtaacggaaaaggactcacccgtaaacattgaagcagagcctccattcggtgactcctatataataataggagtcgaaccaggtcagttaaaactgaattggttcaagaaaggctcaagtataggtcaaatgttcgaaacaacgatgagaggggcaaagaggatggcgatattaggtgatacggcttgggatttcggttcgttaggtggtgtttttaccagtataggtaaagccttacaccaagtatttggcgctatatatggagccgcattcagcggcgtcagctggacgatgaaaatactgattggagtaattattacatggataggaatgaactctcgatcaactagcttatcagtgagtctagtacttgtaggcgtagtaacattatatttaggagcgatggttcaagccgactcaggttgtgttgtatcatggaagaacaaagagcttaaatgtgggtccggcatttttataacggataacgttcacacgtggacagaacaatataaatttcagccagaaagtccatctaagttagcaagcgccatacagaaggcacacgaagaaggaatctgtggaataagaagtgtgacgcggctagaaaatttaatgtggaaacaaatcactcctgaactgaatcatattctaagcgagaatgaagtgaagttaactataatgacaggtgatataaggggcataatgcaagctggtaaaagaagtttaagacctcaacctaccgagttgaaatatagctggaaaacgtggggcaaagccaaaatgttgagtacggaatcgcacaatcaaacatttttgattgatggaccagaaaccgccgaatgtcctaacactaacagagcatggaatagcttagaggtagaagattacggctttggtgtatttacgacgaatatatggttgaaactgagggagaagcaagatgtgttttgtgattcaaaattaatgagtgctgccataaaagacaatagagccgtccatgctgatatgggctattggatcgaaagtgcattaaatgatacgtggaaaatggaaaaagccagctttatcgaggtaaaaagttgtcactggccaaaaagccacactctctggtcaaatggagttctagaatcggaaatgataattcccaaaaatttcgcaggaccagtaagtcagcataattaccgtcctggatatcatacgcaaacagcaggaccatggcatttaggcaaacttgagatggattttgatctatgtgaagggactacagtcgtagtaactgaagactgtggcaacagaggcccctcactaagaactaccactgcttcgggcaaattaataactgaatggtgttgtaggagctgtacactacctcctctacgatatagaggtgaggacggttgctggtatggtatggagatccgaccccttaaagaaaaagaagaaaacctagttaatagtcttgtaactgcgggtcacgggcaaattgataattttagtttaggagtactaggcatggcactatttttagaggaaatgttaagaacacgaataggtacaaagtacgcaatattgttggtcgctgtatcgtttgttacgctaataacaggcaatatgtcttttagagatttaggcagagttatggtaatggtaggagcaacaatgacagatgatattggaatgggggtcacctacttagctctgctcgctgcgtttaaagtacggccaacttttgctgcaggacttttattgaggaaactaacttctaaagagctaatgatggcaacaatcggaatagcactactttcacaatcaacgatccctgagacaatcctagaactaacagacgctttagctctaggtatgatggtacttaagatcgtacggaacatggaaaagtatcaactggctgtaactataatggctatttcgtgcgtccctaatgcagttatattgcaaaacgcatggaaagtctcatgtacgatcctagccgccgtatctgtatccccactacttctaacatcatcgcaacagaaggccgactggataccacttgcgcttactataaaaggattaaatcctacagccatattcttaaccacactgagtagaacatcgaagaagagatcgtggccgctaaacgaggccattatggctgtcggaatggtaagcatacttgctagttcccttttaaagaatgacataccgatgacagggcctctagttgctggaggtttattaactgtttgctacgtcttaacaggacgaagcgctgacttagaattggaacgggcagcagacgtaaaatgggaagaccaagcagaaatttcaggtagttcccctatactctcaatcacaatttcggaagacggtagtatgagtatcaaaaatgaagaagaagaacaaacattaacaatcttaatccgtacaggtctactggtcatttcaggagtattccccgtaagcatacctataacagcggcagcatggtacttatgggaagtcaagaaacagagggcgggcgtgctatgggatgtaccctcgccaccacctgttgaaaaagcagaattggaagacggggcgtatcgtattaagcaaagaggcatcttgggatattcacaaatcggggcaggagtatataaagaaggaacttttcatactatgtggcatgtaacaaggggtgcagtgcttatgcatcgcggaaagcgcatagaacccagttgggcagacgtcaagaaagatctcattagctatggtggaggttggaaattagaaggagagtggaaggagggagaagaggtccaggttttagctttagaacctggtaaaaatccgagagcagttcaaaccaagcctggcatttttaaaacaaacacaggaactatcggcgctgtcagtttagattttagcccaggaaccagcggatcacccatagttgataggaaaggaaaggtcgtcgggctttacggtaatggtgttgtaacgagatcaggggcttatgtcagcgccatcgcacagacagagaaatctatagaagataatccagaaatagaagacgatatatttagaaagaaacggctaactatcatggatctccatccaggagccggtaaaaccaaaagatatttaccagctatagtaagagaagccatcaaaagaggattaaggactcttattcttgccccaacgagagttgtagcggcggaaatggaagaagctctcagaggattgccaatacgataccaaactacagcaatcaaaaccgaacacactggacgagaaatcgttgatttgatgtgtcatgctacatttacaatgagattactaagcccagtaagagttccgaattacaacttaataataatggacgaggcgcactttactgatccagcgtccattgcagcgagaggatatatcagcactagagtggaaatgggcgaagctgcagggatctttatgactgcaacccctccgggtagcagagatccctttccccaatcaaatgcaccaataatggacgaggaacgtgaaatacccgaacgaagctggaacagtggtcatgagtgggttactgactttaaaggtaaaacagtatggtttgtacctagcataaaagcgggaaatgatatagcagcttgtctaaggaagaatgggaagaaagtcattcaactttctaggaagacgtttgattcagaatacgttaagacacgagcaaatgattgggatttcgtggtgactaccgatatttcggaaatgggtgcaaattttaaggcagaacgagtaatagatcctagacgctgcatgaagccagtaatattaaccgacggagaagaacgggtaattttagcaggccctatgcccgtaactcattcatcggccgctcaaagacgtggacgtatcgggagaaaccctaagaatgaaaacgatcaatatatttatatgggagaaccattggaaaacgacgaagactgtgctcactggaaagaagctaaaatgctcttggataacatcaacacacctgaaggaattatcccctccatgtttgagcctgaaagggaaaaagtggacgcgatagatggagagtataggttacgcggggaagctagaaaaacatttgttgacctcatgaggcggggtgatttacctgtatggctagcgtacaaggtggctgcagagggcataaattatgcagatagaaaatggtgcttcgatggtattaaaaacaatcaaatattagaagaaaatatggaggtagaaatttggactaaggaaggagaaagaaagaaactaaaaccaagatggttagatgcacgtatatattcagatcccttggctctaaaagaatttaaggagttcgccgcaggaagaaagagcttaacgttaaatctgattactgagatgggacgtttaccaacattcatgacacaaaaagcgagaaacgcactggataatctagcagtgctccacactgcagaagctggaggacgggcatacaaccacgccttgtctgaactccctgaaaccttagagactttattattgctcaccttactagcaacagtaactggaggtatatttcttttcctaatgagtggtaagggaataggtaagatgaccctaggaatgtgctgcataataactgccagcatactcctatggtatgcccaaatccaaccccactggattgccgctagcattatcttggaatttttccttatcgttcttttaataccagagccagaaaaacaaagaacaccacaagataatcaattgacttacgtagtgattgccatcctcacagtagttgctgcaacaatggctaatgaaatggggtttctagaaaagaccaagaaagatttaggattagggtcaataacgacccaggaaagtgagagtaacattcttgatatagatctcagaccagcgtctgcttggacgttatatgcagttgctactaccttcgtaacacctatgttacgtcacagtattgaaaactcttcagtcaacgtttcattaacagctattgccaaccaagcaaccgtacttatgggattggggaaaggttggcctttaagtaagatggatataggagtgccactgcttgccataggttgttactcgcaagtgaatccaataacacttacagcggctttattgcttctcgtggctcattatgctattattggaccaggtctacaagccaaagcaacccgagaagcacaaaagcgggcagctgcgggtattatgaaaaatccgacggtagatgggattacagtcatcgatttagaacccataccctatgacccgaagtttgaaaaacagcttggacaagtaatgttattaatattatgcgtgacgcaggtactgatgatgagaacgacttgggctctttgcgaggcattgacattagccacaggacccataagcacgttgtgggaaggcaatccaggtcgattttggaatacgactatagcagtaagtatggcaaatatattcagaggaagttatctagccggagctgggttattattcagtataatgaaaaacacgacaaatactaggcggggaacagggaatatcggagagactctcggggagaagtggaaaagccgcttaaacgcactaggaaaatcagaatttcaaatatacaagaaaagtgggatacaagaagtcgaccgaaccttagcaaaagagggcataaaacgaggtgagaccgatcatcacgctgtaagccgcggctccgcaaaattgagatggtttgtggaacgaaacatggttacacctgaaggaaaggtggtagacttagggtgcggtcgtggagggtggtcctattactgtggaggcctgaaaaatgtaagggaagtcaagggtctaacgaaagggggccctggccatgaagaaccaattccgatgtcaacttatggttggaatctagtaagactacaatccggagtagacgtgttctttactccacccgaaaaatgtgacacgttgttatgtgatatcggagaaagctcaccaaatccgaccatagaggcagggcggactctacgtgttctgaatttggtggaaaactggctcaacaataatactcagttttgtataaaagttctgaacccctacatgccctctgtaatagaaaagatggaggcactccaacgtaaatatgggggcgcattagtaagaaacccactaagtaggaacagtactcatgaaatgtattgggtatcaaatgcgacggggaatatagttagcagtgtcaacatgatatcacggatgctcattaatagatttactatgaaacataagaaagcgacatacgagccggacgtagatttaggttcggggacccgaaatataggtatagaatcagagattcctaatctagatattatcggcaagcggattgagaaaattaagcaagaacatgaaacatcgtggcattatgatcaagatcatccatataaaacatgggcttaccatggatcttatgaaacgaaacaaaccgggtcggcatcatccatggtcaatggtgtggtgcgtcttttaactaaaccatgggatgtagttcctatggttactcaaatggcaatgactgatacgaccccatttggacagcaaagagttttcaaagaaaaggtcgatactcgcactcaggaacccaaagaaggaacaaagaaactaatgaaaataactgcagaatggttatggaaagaattaggtaaaaagaaaacaccaagaatgtgtactagggaagagtttacaaggaaagtaagatccaatgctgcgttaggagcgatatttacagatgaaaataaatggaaaagtgcacgagaggctgtcgaggatggacgcttctgggagttagtagatagggaaagaaatctacatctcgaaggaaaatgtgaaacctgtgtatataatatgatggggaaacgagaaaagaaactaggagaatttggtaaagctaagggttcacgagcaatatggtatatgtggcttggtgctagatttctagagtttgaagccttaggctttttaaatgaggatcactggttcagccgtggtaattccttaagtggtgtcgaaggcgagggcttacaccgacttggatatatattaagagatgtgggaaagaaagaaggcggcgcgatgtatgcagatgacaccgccgggtgggatactcgaattacactagaggacttgaaaaatgaagagatggttacgaatcatatgaaaggtgaacataaaaagttagcagaagcgatcttcaaactaacataccaaaacaaagtggttcgagtccaacgaccaactcctcgaggtaccgtgatggatattatctcaagaagggaccagagaggctctggacaggttggcacttatggtttgaacacatttactaatatggaagcacagctaatacggcaaatggaaggcgaaggaattttcaaatcgattcaacatttgacagccacggaggagattgcagtccaaaactggttagcaagagtcggacgggagagattatcaagaatggcaatttcgggagatgattgtgtagtaaaacccatagacgacagatttgcatcggcgctcacagctctaaatgatatgggtaaagtacgaaaagacatacagcagtgggaaccatcacggggatggaatgactggacgcaagttcctttctgtagtcatcacttccatgaattggtgatgaaagatggcagagtgttggtggttccatgccgaaaccaggatgaattaataggtcgggcaaggatatctcagggggcaggttggagccttaaagaaacagcttgtttaggcaaaagctatgcgcaaatgtggacactgatgtactttcaccgtcgcgatttacgactagctgcgaacgctatatgctctgccgtaccttcccattgggtcccaacatcgcggacaacctggagtattcacgccaagcatgaatggatgactactgaagatatgttggcagtttggaaccgcgtttggatacaagaaaacccttggatggaggataagaccccagtggagtcatgggaagaggtaccttatcttgggaaacgagaggatcaatggtgtggaagtttaattggattaactagccgagctacatgggctaaaaatattcaaacagcgataaatcaggtccgatctctgatcggaaatgaggaatatacagattatatgccttcaatgaagagattcaggagagaggaggaagaggctggtgtgctttggtag

SEQ ID NO: 22446 - RNA, 9876 nt, synthetic construct
  misc_feature 1..9876: note = derived and/or modified CDS sequence (opt6) from DENV-2__EU482757__SS-prME
  source 1..9876: mol_type = other RNA
acagcgggtgtaattgtgatgctgatacccactgcaatggcatttcatcttactactaggaatggagaaccccatatgatagtagggagacaagaaaaaggaaaatcactactctttaaaaccgaagatggtgttaacatgtgtaccttaatggcgatagacctaggagaattatgtgaagacacgataacatacaaatgtcccttattaaggcaaaacgaacccgaagacatcgactgctggtgcaatagcacatcaacttgggtgacatacgggacatgtactacaactggagaacatcgacgagagaaaagaagtgtggcattagtaccgcatgtaggaatgggattggaaacgagaactgaaacatggatgtcgagcgaaggagcatggaaacatgtgcagaggattgaaacttggatcctgcgtcaccctggatttacaatcatggcggcgatactggcatataccataggaactactcactttcaacgcgctcttatatttatacttttgactgctgtagcgccctcgatgacgatgagatgcataggcatctcgaatagagactttgtagaaggggtgtcaggaggatcttgggttgatatagtgcttgaacatggatcatgtgtaaccactatggccaaaaataaaccaacgttagactttgaattaataaaaacagaagcaaaacaacccgctacattgagaaaatattgtattgaagctaaattgactaacacaaccacagaatccaggtgtcctacacaaggagaacctagcctgaatgaagaacaagataaaagattcatttgcaagcactcaatggtagacaggggttggggtaacggttgtggattattcggcaaaggaggtatagtaacctgtgctatgtttacttgcaagaaaaatatggaaggtaaagtggtgcaaccagagaacctagaatatacaatagttataaccccacattctggtgaagaacatgctgttggtaacgacaccgggaaacatggaaaagaaataaaaatcactccacagtcttcaataactgaagctgaactcaccggatatggaacggtaacaatggagtgtagtccgaggactggattagatttcaatgagatggtgctgctgcaaatggaagacaaagcgtggctagttcatcgccaatggtttctagatctccccttaccatggttgcccggtgcggacacgcaaggatcaaattggatccaaaaagaaaccctagtaacatttaagaatccacacgccaagaaacaagacgtagtagtgttagggagccaagagggtgcaatgcataccgcattgactggtgcaacagaaatccaaatgagttcagggaatcttctgttcacaggtcacctgaaatgtcgtctaagaatggataaattacagctaaaaggaatgagctactccatgtgtacaggaaaatttaaaatagttaaagagattgccgaaacacaacacggcacaatagtaattagagtacagtacgagggagacggatcaccttgcaagattccctttgaaatcactgatttggagaaaagacacgtgctaggaagattaataacagtaaaccctatagtgactgaaaaagattctcccgttaatatcgaagcagaaccacctttcggggattcatacattattattggtgtagagccggggcaactaaagttaaactggttcaagaaagggagttcaattggacaaatgttcgaaactaccatgagaggggcaaaacggatggccattctcggagataccgcttgggattttggaagtcttggaggagtgtttacaagtattggaaaagcacttcatcaggtatttggagccatatatggtgccgcctttagcggggtttcatggaccatgaaaatattaatcggcgtgataataacttggataggaatgaactcaagatcgacttctctttccgtgtccctagtcctagtaggtgtagttacactctatctaggtgcaatggtacaagctgattcaggttgtgtcgtgtcttggaagaacaaggaacttaaatgcggctctggcatatttataactgataatgtgcatacatggaccgaacaatataaatttcaaccagaatctccttccaaactagcatcagctatccaaaaagcacatgaagaaggcatatgcggaatccgaagcgtaactagattagaaaacctaatgtggaaacaaatcactccagagctaaatcatattctttcggagaatgaggtaaagttaacgatcatgactggtgatatcaaaggaatcatgcaagcaggcaaaagatcactacgaccacaaccaaccgaacttaaatactcgtggaagacatggggtaaggctaaaatgttaagcacagaatctcataaccaaacgtttttaattgatggcccggaaaccgcagaatgtcccaatacaaaccgcgcgtggaatagcttggaggtagaagactacggttttggtgtcttcaccaccaatatctggcttaaactcagagaaaaacaagacgttttctgtgactctaagctgatgtcagccgcaataaaggataaccgcgccgtacatgcagacatgggttactggatcgaatccgcacttaatgacacgtggaaaatggaaaaagcaagtttcatagaggtaaaatcctgccactggccaaaaagtcatacactatggtcaaatggagtccttgaatcagaaatgattataccaaagaacttcgcgggacctgtgtcacagcataattatcgcccaggatatcatacacaaacagccggaccatggcatcttggaaaacttgaaatggattttgacttgtgtgaagggactacagtggttgttacggaggattgcggcaatagaggtccctcattacggacgacaacagcatcgggaaagttaatcacagaatggtgctgcaggagttgtacgttgccaccccttagatacaggggcgaagatggatgctggtatggaatggaaatacgaccccttaaagaaaaggaagaaaacctcgtgaacagcttagtgacggcaggacatggacagatagataatttctcactcggcgttctaggcatggctttattccttgaagagatgttacgtactaggattgggacaaaacacgcaatcctcttagttgcagtttcttttgtaactctcatcactggtaacatgagcttccgagacctaggtagagtgatggttatggtgggtgccacaatgacggatgatatcggaatgggagtaacatacctagcattacttgctgctttcaaggtcagaccgacctttgccgctggtcttctcttacggaaattgaccagtaaagagcttatgatggcaacaatcggtattgcattgctgtcacaaagtacaattccagaaacaatactcgaactaacagatgccctagccttaggaatgatggtactgaaaatagttcgaaacatggaaaaataccaacttgctgttacaattatggctatatcgtgtgtacctaatgctgtaatcctacaaaacgcatggaaagtatcttgtaccattttagccgcagtgtcagtatctccacttctactaacctctagccaacaaaaagctgattggataccattggcacttacgataaaaggattaaatccaaccgcgatattcctgacgactttgtctcgcaccagtaaaaagaggagctggcctcttaacgaagcgatcatggccgtaggaatggtcagcatcctagcgagttcactactaaagaacgatattccaatgacaggacccctagtagctgggggattactaacagtttgctacgtacttactggtaggtccgcagatttggagctagaaagagcagccgacgtaaaatgggaagatcaagcagaaatttccgggtcatccccaatcttaagcataacaataagcgaagacggatcaatgagtataaagaatgaggaagaagaacaaacgttgacaatactaattagaacaggactattagttattagtggcgtatttccagtatcaataccaatcacggccgcagcgtggtacctgtgggaagtaaagaaacaaagagcaggcgtactctgggatgttccaagtccaccccctgtagaaaaagctgagctagaagatggcgcatatagaataaaacaaaggggaatcctaggctactcccaaatcggggccggtgtatataaagaaggaacctttcatacgatgtggcatgttacaagaggcgcggtgctaatgcatagagggaaacgtatcgagccgtcttgggcagatgtcaagaaagacctcatttcctacggtggaggttggaagctagaaggagaatggaaggaaggagaagaagttcaagttctagctttagagccaggcaaaaacccgcgtgctgtgcaaacaaaaccagggatcttcaaaaccaacacaggaactataggtgccgtatcccttgacttctcccctggtaccagcggcagtccaatcgttgacagaaaaggaaaagttgtagggctatacggaaatggcgtagtcacacgaagtggggcttacgtatccgccatagcacagacagaaaagtcgatagaagataaccccgagatagaggacgatatatttaggaagaaacgtttaacgatcatggatctacatccaggagccggaaaaacaaaacggtatttaccggctatagtacgggaggcgataaaacgtggtctgaggaccttaattctcgcacctacgagagtggtagccgctgagatggaagaagcgttaagaggtctgcctatacggtatcagacaccagccatcaaaactgagcacacggggagggaaatagtggatctcatgtgtcatgccacatttaccatgagactgttgagtcccgttcgtgtaccaaactacaatttaattatcatggatgaagcccattttacagacccggcgtcgatcgccgcgaggggatacataagcacgcgagttgagatgggagaagccgcgggaatatttatgacggctactcctcctggaagtagagaccctttcccgcaatcgaatgcgcctattatggacgaagaaagagaaatacctgaacgttcctggaactcagggcacgaatgggttacagattttaaaggaaaaacagtttggttcgtcccgagtatcaaagcaggcaacgatatagccgcatgcttaaggaaaaatggcaagaaagttatacaacttagtcgaaaaacttttgattcagaatatgtcaaaacaagagcgaatgactgggattttgttgtaacaacggatatttcagaaatgggagcaaacttcaaagcggaacgagtgatcgatccacgccgatgcatgaaacccgtaatattaaccgatggagaggaaagagtaattctagccggtcctatgcctgtgacacacagcagtgctgctcaaaggagaggtcgaattgggcgtaatcctaaaaatgaaaacgaccaatatatttatatgggtgaaccacttgaaaatgatgaagactgtgctcactggaaagaggctaaaatgttactagataacatcaacacacctgaaggaattataccatcaatgtttgagccggagagggagaaagttgacgcaattgacggcgaatacagattacgaggggaggcgcggaaaactttcgttgatctaatgaggcgcggtgaccttccagtctggctagcatataaagtagcagccgagggaataaactatgcagaccgaaaatggtgtttcgatggtattaaaaataaccaaatacttgaggaaaatatggaagttgagatttggaccaaggagggagaacgcaagaaattaaaaccaaggtggttggatgctcgaatttatagtgacccgttagcactgaaagagttcaaagaatttgctgcaggtagaaaatcgctaaccttaaacctcataacagaaatgggaagactgcccacttttatgactcagaaagctcgtaacgctctcgataaccttgcagtgctacacacagctgaagccggtggccgcgcttataatcacgcactaagcgaactcccagaaactctagagacgctacttttactaacattgctcgcaacagtaaccggtggcatatttctttttctcatgtctgggaaaggcatagggaaaatgacacttggaatgtgttgcataataactgctagcatacttttatggtatgctcaaatacaaccccattggattgccgctagtataatcctcgagttctttttaatagtactattaataccggagcccgaaaaacagcgaacgcctcaagataatcaattaacatacgtagtcatagcaatattaaccgtagtcgcggcaactatggcaaacgagatgggatttctggaaaagacgaagaaagatttgggcctaggttccatcactacacaggaaagtgagtctaacatactagatatagacttacgacccgcatcagcatggactctgtatgctgtggcaacaacatttgtaaccccgatgttgagacactccattgaaaacagcagtgtgaatgtaagccttacggctatagcaaaccaggctacggtcctcatgggactgggaaaaggctggccactaagtaaaatggacataggagtcccacttctggcaattggatgctatagtcaagtgaaccctatcacacttacggctgcgttattactattggttgcacattatgcaataataggaccggggctgcaagctaaagcaacacgagaggcgcaaaaacgagcggcggcaggaataatgaaaaatccaactgtagatggaataacggtcatcgacctagaaccgataccatatgaccccaagtttgaaaaacaacttggccaagtgatgctgctgatcctatgcgtaacacaagtattaatgatgagaacaacatgggcgttatgcgaagcgttaactctagcgacaggtccaatcagtacattatgggaaggaaatccaggacgtttctggaatactacaattgcggtgtcaatggctaatatcttcagaggaagctatcttgcgggggccggcctattattttctattatgaaaaatacgacaagtactagaagaggtactggcaacataggtgaaacactcggtgaaaagtggaaatccagactaaacgctcttgggaaatctgaatttcaaatttataagaaaagtggtatacaagaagttgataggacacttgccaaagaaggcattaagagaggggaaacagaccatcatgctgtatctagaggatcagccaaacttcgatggtttgtagaacgaaatatggtcactcccgagggtaaagtagtcgacttagggtgcggtagaggaggttggagctattactgtggaggactgaaaaacgtaagagaagttaaaggattaacaaaaggagggccagggcatgaggaaccaattccaatgagtacatatggatggaatcttgtcaggttacaatccggagtagacgtcttctttaccccaccggaaaaatgcgatactcttctatgcgatatcggagaatcgtcacccaatcccactatagaagcaggtcgcaccctccgggtcctgaacttagtggagaactggctaaataacaatacacaattttgcataaaggttttgaatccttatatgccctcagttatagagaaaatggaagcattacaacgcaaatatgggggcgcgcttgtgaggaatcccctctcaaggaatagcactcatgagatgtattgggtatccaacgccactggcaatattgtttcttcagtaaatatgataagtcgaatgctgatcaataggttcacaatgaaacataaaaaggctacctatgagccagatgtagacctaggatctggcactagaaacattgggattgagtctgaaatccctaatctagatattatagggaagcgtatcgagaaaatcaaacaggagcatgaaacaagttggcattatgatcaagatcatccctataaaacctgggcttatcatggttcctacgaaacaaaacaaacgggctcagcatccagcatggttaatggtgtggtaagattgttaacaaagccttgggatgtagtacctatggttacacagatggctatgacagacactacaccatttggacagcaaagagtatttaaagaaaaagtcgacacaagaactcaagaacccaaagaaggcactaagaaactaatgaaaataacagcagaatggctatggaaagaattgggtaagaagaaaacccctaggatgtgcaccagagaagaatttactaggaaggtacggtcaaatgccgcgctaggggcaattttcacggatgaaaataaatggaagtctgcacgtgaagcagtagaggatggaaggttctgggagctggtagacagagagagaaatttacatctagaaggtaagtgcgaaacatgcgtatataatatgatgggaaaacgtgaaaagaagttaggagaatttggtaaagctaaaggttctcgggcaatttggtatatgtggcttggagcaaggtttttagaatttgaagctcttggcttcctaaatgaagaccattggtttagtaggggaaactcactaagcggagtggaaggagaagggcttcaccggttgggatacatattaagggacgtttccaagaaagaaggtggagcaatgtacgctgacgacactgcaggttgggacactagaataaccttagaggacctcaaaaatgaagaaatggttaccaatcacatgaaaggcgaacataagaaactagcagaagccattttcaaactgacttatcagaataaggtcgtaagggtacagcgacctactccacgtggaacggtgatggacataatttcaagacgagaccaaaggggttcaggtcaagtaggtacttatggccttaatactttcacaaatatggaagcgcagttgataagacagatggaaggtgaaggtatttttaagtctatacaacatttgacagcaaccgaagagatagtagtacaaaattggctagcaagagttggacgcgaaagactatctcgaatggcaatctcgggtgacgactgcgtcgtcaaaccaatagacgatcgtttcgcgtcagcattaacagctctgaatgatatgggaaaggtgcgcaaagatatacaacaatgggagccgagtagaggatggaacgattggactcaggttcctttctgttcacaccatttccacgaactggtcatgaaagacggacgagttctcgtagtcccctgtaggaaccaagacgaattaataggcagagctcgaatatcacagggtgccggttggtctttgaaagaaactgcgtgtcttggaaaatcatatgcccagatgtggacactaatgtacttccatagacgagatttgaggctagcagctaatgcaatttgcagtgcagtgccaagtcattgggtcccaacaagtagaacaacttggtcaattcatgcaaaacacgagtggatgacaactgaagatatgcttgccgtctggaatcgagtctggatacaagagaatccctggatggaagacaaaacacctgtagaatcctgggaggaagttccttatctaggaaaacgagaagaccaatggtgcggaagtcttataggactaacaagtcgggcgacttgggctaaaaatatccaaacagccattaatcaagttaggtcattaatagggaatgaagaatatacagattatatgccgtctatgaaaaggtttcggagagaggaagaggaagccggagtcctatggtga

SEQ ID NO: 22447 - RNA, 9876 nt, synthetic construct
  misc_feature 1..9876: note = derived and/or modified CDS sequence (opt6) from DENV-2__FJ906956__SS-prME
  source 1..9876: mol_type = other RNA
acggctggggtaatagtgatgttgattcctactgctatggcatttcacttaaccaccagaaatggtgaaccacacatgattgtaggtaaacaagaaaaagggaaatcactattatttaaaacagaagatggtgtcaatatgtgtacgctaatggcaattgacttgggggaactatgtgaagacacaataacgtacaaatgtccacttctcagacaaaatgaaccagaagacattgattgttggtgtaactccacttcaacatgggtaacttatggaacctgtacaacaacgggagaacacagacgtgagaaaagaagtgtggcgttagtcccgcacgtcggtatgggtttagagacacgaactgaaacttggatgagttcagaaggagcatggaaacatgtgcagaggatcgaaacatggattttacggcatccgggttttacgataatggcagctattttagcctatacgatcggaaccactcattttcaaagagcactaatctttatcctactgacggcagttgcgccatccatgacaatgcgttgtataggcatatcaaatagagactttgtcgaaggcgtaagcggagggtcttgggtggatatagtactagaacacggttcgtgcgtaactacaatggctaaaaacaaacccaccttggatttcgaacttataaaaactgaagcgaaacagccagcaactctacgtaaatactgcatcgaagccaaactaactaacacaactaccgaatctcgatgtcctacccaaggagaaccttctttaaatgaagaacaagataaacgttttatatgcaaacacagtatggtggatcgtggatggggaaatggttgtggactatttggcaaagggggtattgtgacttgtgcgatgtttacgtgtaagaaaaatatggagggaaaagttgtgcagccagaaaacttagaatataccattgtcattaccccacattcaggggaagaacatgccgtcggtaatgataccggaaaacatgggaaagaaattaaaatcacacctcaatctagcataaccgaagcggaattaacaggatatggtacggtcacaatggaatgttcaccccgcactggtttggactttaacgaaatggtattattgcaaatggaagataaagcgtggttagttcatcggcaatggtttttggatctgccactcccatggctcccgggtgccgatacccaaggcagtaattggattcaaaaagagaccttagtaacattcaaaaacccccacgcgaagaaacaggacgttgtagttttgggcagtcaagaaggagcgatgcatactgcattaactggagccaccgaaatacaaatgagcagcggaaacctcttattcacaggtcacctaaaatgtcggttgaggatggacaaactccaactaaaaggaatgtcatacagtatgtgcacgggcaaatttaaaattgtgaaagaaattgcagaaactcaacatggtacaattgtgatacgagtacaatatgagggggacggcagcccatgtaaaatacccttcgaaataaccgacttggaaaagaggcatgtcttaggacgtttaattacagtcaacccgatagtaacagggaaagactcaccagtaaatattgaagcagaaccgccatttggggattcatatataatcattggagttgaaccaggtcagctgaaacttaattggtttaagaaaggatcaagcattggacaaatgtttgaaacaactatgagaggtgcaaaaaggatggctattctcggagatacagcctgggactttggatcccttggtggtgtattcacgagcattgggaaggcattgcatcaagtatttggtgccatatatggggctgcttttagtggggttagttggacaatgaagatactcataggtgtgataattacttggataggcatgaactcaagatcgacaagcctatcggtatcactggtattagtgggagtagtgactctgtatttaggtgcaatggtgcaagctgactcggggtgtgtggtgtcctggaagaataaagaattaaaatgtggttcaggaatatttatcactgataatgtgcatacatggaccgaacaatataaattccaaccagagagccctagcaaattagcatcggctatacaaaaggcacatgaagaaggaatttgtgggatacgttcagtaacaagactagaaaatctcatgtggaaacagatcacgccagaattgaatcatatactctctgaaaacgaagtcaaacttactataatgacaggtgatataagaggaataatgcaggccggaaaacgaagcctaagaccccagcctaccgaacttaagtattcgtggaaaacatggggaaaagccaaaatgctgtcaacagaatcacacaaccaaacatttttaatagacggacctgaaacagcggagtgtccaaacacgaatagagcttggaacagccttgaggtagaggattacggcttcggagtgtttacgacaaatatatggcttaaactcagagagaaacaagacgttttctgtgatagtaaactaatgtcagcagctattaaagataatagagctgtgcatgcagacatgggatattggatcgaaagcgcacttaatgatacttggaagatggaaaaagcaagttttatagaggtaaaatcatgtcattggccaaaaagccacaccctctggagtaatggagttttggaatccgaaatggtaataccgaaaaactttgctggacctgtgtctcagcacaattatcggccagggtaccacactcaaactgcagggccatggcatctaggaaaattggaaatggatttcgacttatgcgagggtacgaccgtagtagttaccgaagattgcggtaataggggaccatctctgcgcacgactacggcaagtggcaaactcataacagagtggtgctgcaggtcatgtacgctaccaccactgaggtatagaggtgaagacggatgttggtacgggatggaaataagaccattaaaagagaaagaagaaaatctggtaaactcacttgtaactgcaggtcatggtcaaatagacaacttttcattaggagtcctaggaatggcattgttcctagaagaaatgctaagaaccagaattgggacaaaacatgcaatactcctagttgcagtttcctttgtcactttaataacaggcaatatgagctttcgcgatttaggaagagtaatggtaatggtaggggcaacgatgacggatgacattggtatgggtgtcacttatttggcacttctagctgcatttaaggtcagacctacatttgcagcgggtttacttctaaggaaactgacatccaaggaactcatgatggcgaccatcggtatagcccttttgagccaaagtacaattcctgaaactatactggaacttacagacgcccttgcactaggcatgatggtgcttaaaatagtaaggaacatggaaaaataccagctcgcagtaaccattatggcaatctcttgtgtccccaatgctgttatattacaaaacgcctggaaggtgagttgcactattctagcagcggtcagcgttagtccacttctactaacatcatctcaacagaaagctgattggatacctctggctttaactataaaaggtttaaatcctacggcaatattcctgacaacgctgagtagaacaagtaagaaaagatcatggccacttaatgaagcaataatggcggtaggaatggtttcaatacttgcgagttcgctactcaaaaatgacattccaatgaccggacctctagttgccggtggtttgttaaccgtatgttacgttttaactggacgatccgccgatcttgaattggaacgagctgcagatgtaaaatgggaagatcaggccgaaatatctggcagctcacctatattgagtataacaatatcagaggatggatccatgtccatcaaaaatgaagaagaagaacaaactctcacaatacttattcgcaccggtctcttagtgataagcggcgtttttccagtctcaatcccaataacagcagcagcttggtatctttgggaagtgaagaaacaacgggccggagtactttgggatgtcccaagcccaccacctgtggagaaagcagaacttgaagatggagcttaccggataaaacaacgcgggatcctgggttacagtcaaataggagctggagtctataaggagggtacattccatactatgtggcatgtaacacgcggagctgtccttatgcatagaggaaaaagaattgagccaagctgggcggacgttaagaaggatctgataagttatggtgggggatggaagttggaaggtgaatggaaagagggagaagaagtgcaagttttagcacttgaacctggcaaaaatccgcgcgcagtacaaacgaaaccaggtatattcaaaaccaacaccggcacaataggtgctgtatcgctcgacttttctccaggtacatccggatcccctattgtagatagaaaaggtaaggtagtcggtctgtacggcaacggagttgtaacaagatcaggggcttacgtctccgcgatagcccagacagagaagagtatcgaagacaacccagaaatagaagatgacatattcaggaagaaaagacttacaatcatggatctacatccgggtgccgggaaaactaaaagatatctaccagcaatagttcgagaagctattaaaagaggtcttcgaactctaatattagcaccgacaagggtagtagctgccgaaatggaggaagcgttaaggggcctacctatacgataccaaacaacagctataaaaactgagcacaccggtagagaaatagttgatttaatgtgtcacgcaacctttaccatgcgattactaagtcctgttcgagtcccaaactacaatctaattattatggatgaagcgcattttacggatcctgcttcaattgccgcacgaggttatatttctacaagagtcgaaatgggtgaagcagcaggcatattcatgacggctacaccacctgggtccagggacccatttccgcaatcaaatgcccctattatggatgaagagagagaaatccctgagagaagttggaactcaggacacgagtgggtaactgatttcaaaggaaaaactgtatggttcgttccatctataaaagcaggaaatgatatagcagcatgcttaaggaaaaatggaaaaagagtaattcaactatctcgaaaaacctttgacagcgaatatgtaaaaacacgagctaatgattgggattttgtagtgactacagatatatcagaaatgggtgcgaatttcaaagcggagcgagtaatagaccccagaaggtgtatgaagcccgtcatactgacagatggcgaagaaagagtaatattggcaggccccatgcctgtcacccacagctctgcagctcaaaggcgtggtcgcattggtagaaaccccaaaaacgaaaatgaccagtacatatatatgggtgagcccttagagaacgatgaagactgtgcccattggaaagaagcaaaaatgttattagacaacataaacacacctgaagggattataccatctatgttcgaacccgaaagagaaaaagtagacgcaatcgatggggaatacagattaagaggtgaagcgcgaaaaacatttgtagacctaatgcgacgaggtgacttgccagtatggctggcttacaaggtagcagcggagggcataaattacgcggaccgaaagtggtgttttgatggcattaaaaataatcaaatattagaagaaaacatggaagttgaaatctggaccaaggaaggcgaacggaagaaattgaaaccaagatggctagatgcacgtatctactccgatcctctagcattaaaagagttcaaggagttcgcagccggaagaaaatcacttacactaaatttaatcacggaaatgggacggctgcccactttcatgacacaaaaagctcgcaatgcattagacaacctagctgtattacacactgcagaggccggagggagagcatacaaccatgctttatcggaattacccgaaacgctagagactcttttactattaactctattagcaaccgtcactggtggcatattcctatttttaatgagcggcaaaggaatcggcaaaatgacgttaggtatgtgttgtatcataaccgcatcgattctcctttggtatgcacagatacaaccccactggatcgctgcaagtataatattagagttcttcttgatagtgctgctcatacctgagcccgaaaaacaacgtactccacaagataatcaattgacctatgttgttatcgcaatcttaacagtcgtagcagccacgatggcgaatgaaatgggattcctagaaaagactaagaaagatctaggtctcggatcaataacaacacaggaatcagaaagtaacatattggatatcgacctaagaccagcaagtgcatggaccttgtacgctgtcgcaacgacatttgttacgcctatgctgagacattccatagaaaactctagtgtaaatgtatcgttaacggcaatcgctaatcaagctaccgtattaatggggctaggtaaaggttggccgttatcaaagatggatataggagtaccattgttagccataggatgctatagtcaggtgaatccgatcacgcttactgctgccttactattattggtagcacactatgcaataataggccctggcttacaagccaaagcaaccagagaagcacagaaaagagcggctgcaggcattatgaagaaccctacggtggatggaataacggtgatcgaccttgaaccgattccctatgatcccaagttcgaaaaacaactaggacaagtcatgttactcatactatgtgtgacacaggtgctaatgatgcgaacaacgtgggcgttatgcgaggcgcttactctggctacaggtccgatttctaccttatgggagggcaaccccggaaggttttggaatacaacaatagcggtatcaatggccaatattttccgaggttcttatctagctggcgcagggttgctcttttcaatcatgaaaaacactacaaacacaagacgaggtactggtaacatcggcgaaacgcttggcgaaaaatggaaatcccgattaaatgcgttagggaaaagcgaatttcaaatctataagaaatctggcatacaggaagtagatagaacacttgcgaaagaaggaataaaaagaggagaaacggatcaccatgctgtctctagaggtagcgcaaagttacggtggttcgtagagaggaatatggtaacaccagagggtaaggtggtagatctaggttgcggaagaggaggatggagttactattgcggaggacttaaaaatgtgcgcgaagtaaaagggttgacgaaaggtggcccgggtcatgaagaacctatcccaatgtcaacttatggatggaacttagtgcgcttacaatcaggggtagacgtatttttcacacccccagagaagtgtgatactttattatgtgatattggagaaagttcacctaatccaacaatagaggcaggtcgtacattgagggtactcaatttagtagaaaactggttaaacaacaatacacaattctgtataaaagtattaaatccttatatgccttcagtcatagagaaaatggaggccctccagagaaaatacggaggggcattggtcagaaatcctctgagtcgaaattcaacccacgaaatgtactgggtatcgaatgcaacagggaatatagtaagcagtgttaatatgatcagtagaatgctaattaacaggtttacaatgaaacataagaaagcaacatatgaacctgatgtcgacctgggatccggtacacgtaatattggcatagaaagtgaaataccaaacttggacatcataggaaaaagaatcgagaaaataaaacaagaacatgaaacatcatggcattatgaccaggaccatccttacaagacgtgggcatatcacgggagttatgagactaagcaaaccggttccgcatcaagtatggtaaatggtgtcgtacgactgctaacaaaaccctgggatgtggtcccaatggtcactcaaatggcaatgacagataccacaccatttggccaacaacgagtcttcaaagaaaaagtggacacgagaacacaagaacctaaagaaggtaccaagaaattaatgaagataactgcagaatggctttggaaagaattggggaagaagaaaacgcccagaatgtgcactagggaagagtttacgcgtaaagtacgaagtaatgcagcacttggtgcaatattcacagatgaaaataaatggaaatcagccagggaagcggtggaagatgggcgattttgggagctagtagatagagaaagaaatttgcatttggagggcaagtgtgaaacttgtgtatataacatgatggggaaacgagagaagaaattaggtgaatttggcaaggccaaaggctcccgcgcgatatggtacatgtggctcggcgcgaggtttcttgagtttgaggcgttaggttttctaaatgaggatcactggttctctaggggtaatagcttatctggagttgagggtgaagggttgcatcgattaggttacatacttagggatgtaggcaagaaagagggaggagctatgtatgctgacgacactgcgggttgggataccaggatcacattagaggacttgaaaaatgaagaaatggtgactaaccatatgaaaggcgaacacaagaaactagctgaagctatattcaagctaacgtatcaaaataaagtagttagagtccaaagaccgacaccacgaggaacagtcatggatataatttctcgtagagatcaacgcggatcaggtcaagtaggtacatatggattaaatactttcactaacatggaagcccaactaatcaggcaaatggagggtgagggcattttcaaatccatacagcacttgacagcaacggaggaaatagcagttcaaaactggctcgccagagttggccgcgaacgactttcaaggatggcaatatccggggatgattgcgtcgtaaaaccaatcgatgacaggtttgcatcagcactgactgctttaaatgatatgggaaaagtacgaaaagatattcagcaatgggaaccatctagaggatggaatgattggacgcaagtcccgttctgctcccatcactttcatgaacttgtcatgaaagacggtagagttttagtggttccgtgtagaaaccaggacgaattaattggtagggcaaggatcagtcaaggtgcgggctggagtctcaaagaaactgcttgcttgggaaagtcctacgctcagatgtggaccttaatgtactttcatagacgagatttgcgactggctgcaaatgcaatatgcagtgcagtgccctcacattgggtaccaacttcaagaacaacatggtcaattcacgcaaaccacgaatggatgacaacagaagatatgttagccgtatggaacagagtttggattcaagagaatccctggatggaagataaaacgcccgtcgagagttgggaagaagtcccatatctaggaaagcgagaggaccagtggtgtggatcattgatcggattgacttcacgggcaacatgggcgaaaaacattcagacagcgattaatcaagtacgatcattaatcggcaacgaagaatacactgactatatgccatcaatgaagagattccgtcgtgaggaggaggaagcgggagtgttatggtaa

SEQ ID NO: 22448 - RNA, 9876 nt, synthetic construct
  misc_feature 1..9876: note = derived and/or modified CDS sequence (opt6) from DENV-2__EU482759__SS-prME
  source 1..9876: mol_type = other RNA
acagcaggggttatagtaatgttgatacctacagctatggcttttcacttaactactcgaaatggggaaccccatatgatagttggacgacaagaaaaaggtaaaagtcttctattcaaaacagaagacggagttaacatgtgtacattaatggcaatagatctaggggaattatgcgaagatactatcacatacaaatgtccattactccggcaaaacgaaccagaagatatagactgctggtgcaactcaacaagcacatgggttacatatggaacatgcacaactaccggtgaacataggagagagaaaaggtcagttgcgctagttcctcacgtaggaatgggtctagaaacaagaacagaaacctggatgagttcggagggagcgtggaaacatgtccaaagaatcgaaacgtggatattacgacatcccggatttacaataatggctgcaattttggcctataccataggaacaacccattttcaaagagcactaatctttatactgctaaccgcagtagccccgtccatgacaatgcgatgcatcgggatttccaatagagactttgtggaaggcgtttcaggcgggtcctgggtagatattgtgctagaacacggcagttgtgtgactaccatggctaaaaacaaacccaccttagattttgagcttataaaaacagaggcgaaacagcccgcaacgttacggaaatactgtattgaagcaaaattaacgaatacaacaacagaatcacgttgtcccactcagggtgagccgtctttaaatgaagaacaggacaaaagatttatatgcaaacactctatggtggacagaggatggggcaacgggtgcggactattcggtaaaggaggaattgtcacttgtgcgatgttcacctgtaagaaaaatatggaaggaaaagttgtacaacctgaaaacttagaatacactattgtgattacaccgcacagtggggaggagcatgctgtaggtaatgataccgggaaacacggaaaagaaattaaaatcactccacagagctcaataacagaagcagaactaactggatatggaaccgttactatggaatgtagtccccgaacggggctagactttaacgaaatggtactgcttcaaatggaggataaagcatggcttgttcataggcagtggtttttagatctgccattgccatggttaccaggggcggatacacaggggtcaaattggattcaaaaagagactttagtaacattcaaaaacccacacgccaagaaacaagatgtcgtggtattaggttctcaagaaggcgcgatgcacacggctttaacaggtgccactgaaatacagatgagttctggcaatctactattcaccggacatcttaaatgccggttgcgaatggataaactacaacttaaaggcatgtcatattcaatgtgcaccggtaaattcaaaatcgttaaagagatagcagaaacgcaacatggtacaattgtgataagggttcagtatgaaggcgatggaagcccctgcaaaatcccatttgagattaccgacttagagaaacgacacgtactaggaagactgataacggttaaccctattgtaacagaaaaagactccccagttaatatcgaagctgaaccgccctttggagatagctatattattattggcgtagaacccgggcaacttaaattaaattggttcaagaaaggatcctcaataggacaaatgttcgaaaccacaatgagaggtgccaaaagaatggcaatacttggagataccgcttgggactttggcagcttaggcggtgtttttaccagcatcggaaaagcacttcaccaagttttcggagcaatttacggggcagccttcagtggcgtctcctggaccatgaaaattttaattggggtcatcattacatggattggaatgaactcgagatctacgagcctttcggtcagccttgtattggtaggagtggtaacattatacttgggtgcaatggtccaagcagattctggatgtgttgtttcatggaaaaacaaagaattaaaatgcggaagtggtatctttattactgataacgtgcacacctggacggagcaatacaaattccagccagaatccccatcaaaactagcttcggcgattcaaaaagcacatgaagaaggtatctgcggtatacggtcagtaacgcgcctcgagaacctcatgtggaaacagataactcccgagttaaatcacatattaagtgaaaatgaggtcaaattaacaataatgaccggtgatattcggggtataatgcaagcgggaaaaagatcattacgtccgcagcccacagaactgaaatatagttggaagacttgggggaaggcaaaaatgttgagcacagaatcacataatcaaactttccttatagatggcccggagacggcagaatgcccaaacacaaaccgtgcttggaactcacttgaggtcgaagattatggctttggcgttttcacaacgaatatttggttgaagctacgtgaaaaacaagatgtattttgtgatagcaagttaatgtccgcagctataaaagacaatcgagctgtccatgcagacatgggatactggatagaaagcgcgctaaatgatacatggaaaatggagaaggctagctttattgaggtaaagtcatgccattggcctaaatcccacacactctggtctaacggggtgttagaatctgaaatgattatccctaagaactttgcaggaccggttagtcaacacaattatagaccgggttaccatacacaaacggcaggtccgtggcatttaggtaaacttgaaatggatttcgacttatgcgagggaacgaccgttgtcgtaactgaagattgtggaaatcgaggtccgagtttacgtaccacaacagctagcggtaaattgataacggaatggtgctgcagatcgtgcactttgcctcctcttagatatagaggagaagatggttgttggtatggtatggaaatcagacctcttaaggaaaaggaagagaacttagttaacagcctagttacagcaggacatggacaaattgacaacttcagtctaggggtgctgggcatggcactgttcttggaggagatgttacgaacaagaattgggacaaaacacgcaatactcctagttgccgtgtcattcgtaacacttataacagggaacatgtcatttcgcgacttaggaagagtaatggtaatggtaggcgctacaatgaccgatgacataggaatgggtgtaacatacctagcgcttctggcagcctttaaggttagacctaccttcgcagcaggcttactattgagaaaattgactagcaaagagctaatgatggcaaccataggtatagctttactttcacaatcaactataccggagactatactagaattaacagatgcgttagcactaggaatgatggtacttaaaatagtccgaaatatggaaaaatatcaattagctgttacgataatggcgattagttgcgtcccgaatgcagttattctacaaaatgcttggaaagtgagctgtacaatattggccgcggtatcagtctcccctcttctactgacttcatcacaacagaaagcggactggatacctctagcattaacaatcaaaggacttaatccaacagctatcttcttgacgactttaagtagaacgtcaaagaaaagatcatggccccttaacgaagctataatggctgttggcatggtctctatattggctagttctctattaaagaatgatattccaatgactggtccattggtagcaggaggactgctgacagtctgctatgtattaactggccgcagcgcggatcttgagctagaaagagctgctgatgtcaaatgggaagatcaagcagagatttctggaagttcaccaatactatcaattactatatccgaggatggctctatgagtataaagaatgaggaagaggaacaaactttaactatacttattcgtaccggactattagttatctctggagtatttccagtttccatcccgattacagctgctgcctggtacttatgggaagtgaagaaacaaagggctggtgtactgtgggatgtaccgtcccctcctccagtagaaaaagctgagctggaggatggtgcatacaggataaaacaacgaggtatattaggatattcgcaaattggagccggagtatataaggaaggaacatttcacacaatgtggcatgtgacaagaggagccgtactaatgcacagaggtaaaagaatagaaccgtcatgggccgacgtcaagaaagatttaatttcttacggagggggatggaagctagaaggtgaatggaaggaaggagaagaggtccaagtattagctttagaaccaggcaaaaaccctcgtgcagtacaaaccaagccaggtatttttaaaacaaacacagggactataggagctgtttcattagacttttcccccgggacgagcggttcccccatagttgatcgtaaaggcaaagtcgttggactatatggtaatggcgtggtaacaaggtcaggtgcatatgtttctgctatagcccaaacagaaaaatcaatagaggataatccagagatagaggacgatatattcagaaagaaacgacttacaattatggatcttcatccaggcgcgggcaaaacaaagcggtatctacccgctattgtacgtggagctataaaacgaggtctaagaacattaatactcgctcctacacgagtcgtcgcagctgaaatggaagaagcattaagagggcttccaattcgataccaaactacagcaataaaaacagaacacactggacgagaaatcgtggacctcatgtgccatgcaacatttacaatgagactgttatcaccagttagggttcctaattataatttaataataatggacgaagcgcattttacagatccagcatcaatagcagcccggggttatatcagcaccagagttgaaatgggcgaggcagcagggatttttatgactgcgacgccaccgggttcacgagacccgtttcctcagagcaatgcacctattatggatgaagaacgagaaattccggaaagatcttggaactctgggcatgaatgggtaacagattttaagggaaagacagtatggttcgttccaagtataaaagcaggaaatgatattgctgcgtgtttacgtaaaaatggcaagaaggtgatccaactgtctcgaaaaacgtttgatagtgaatacgtaaaaacccgagcaaatgactgggattttgtagttacaacagatatttctgagatgggagctaatttcaaggccgagagggttatcgatcccagaagatgcatgaaaccagtaatcctcaccgatggagaagaaagagtaatactcgctggaccaatgccggtaacgcatagtagtgcagcacaacgaagaggcagaataggaagaaacccaaagaacgaaaatgatcaatacatatacatgggagaaccgttagagaacgatgaggattgtgcacattggaaggaggctaaaatgcttttagacaatattaatactccagagggtattataccatcgatgttcgaaccagaaagagaaaaagttgatgcgatagatggagagtataggttacgcggcgaagcaagaaaaacatttgtagacctaatgaggagaggagatttaccggtgtggctcgcttataaagtagcagcagaaggaattaattatgcggaccgaaagtggtgctttgatgggatcaaaaacaatcaaatcctggaagaaaacatggaagtagaaatatggactaaagaaggtgagcgaaagaaattaaaaccaagatggttggatgcgcgaatctatagtgatcctttagcactcaaagaatttaaagagttcgcagccggacgtaaatctctaacgctaaatttaataacggagatgggacgactccccacatttatgacgcaaaaagctagaaatgctttggacaatctagctgtcctacatacagccgaagcaggaggacgtgcctacaaccatgccctctcggaattaccagaaacattagaaaccctacttctattaacactattagcaacagtcacgggaggtatattcttgtttctaatgtcagggaaaggcatagggaagatgactttaggaatgtgttgcataataacggcctccatattactatggtatgctcaaatacaacctcattggatcgctgcatcaataatcttagagttctttctgatagttcttctaatcccagagccagaaaaacaaagaacaccgcaagataatcaactaacttacgtcgtaatcgctatacttacagtagtggctgccacgatggccaacgaaatgggatttttagagaaaacaaagaaggatctcggcttaggatcaataacgacgcaggaaagcgagtctaacattcttgatatcgatttacgaccagcaagcgcatggactctatacgcagttgcaactacattcgtaacaccaatgttaagacatagtatcgagaactcttcagtgaacgtaagtttaactgccatagccaatcaagcaacagtcctcatgggattaggcaagggatggcctttatctaagatggacattggagtacctctactagcaattggttgttactcacaagttaaccccattacattgacagcagcattattgttgctcgtagcacactatgccataattggacccgggcttcaagccaaagccaccagagaagcacagaagcgagctgcagcaggaatcatgaaaaatcccacagtagacggtataactgttatagaccttgagcccattccatatgatccaaaattcgagaaacaactgggtcaagttatgctgctaatcctttgtgtcacgcaagtattaatgatgagaacaacttgggcgctttgtgaagcactgacactagcaactgggccaattagcacgttgtgggaaggtaaccctgggcgattttggaacaccacaattgccgtatctatggctaacatatttcgtggttcctatttagcaggagcaggattattgttttcaatcatgaaaaatactaccaataccagaagaggcactgggaacataggcgaaactttgggggaaaagtggaagagtcgtttaaatgccctaggcaagagtgagtttcaaatctataagaaatcgggaatccaggaagttgatagaactctggcaaaagaagggataaaaagaggagaaacagatcaccatgctgtaagccgtggaagcgcaaagttaaggtggttcgtagaacgaaatatggtaacccctgaaggaaaagttgtagatttaggctgtggtagaggaggatggtcatattattgtggcggactcaaaaatgtaagagaagttaaaggtctaactaaagggggtcctggtcacgaagaacccatcccaatgtcgacgtatggatggaaccttgtgaggttacaaagtggagtcgacgtattctttaccccgccagagaagtgcgatacattgctctgtgacatcggtgagagttccccgaaccctactatagaagccggacgaactctaagagttcttaacttagtcgaaaattggttaaacaacaacacacaattttgtatcaaagtcctgaacccttacatgccttctgtaattgagaaaatggaggccttgcaacgaaaatacgggggagctcttgtaaggaatccgttatccagaaattcaactcatgagatgtattgggtcagcaatgccacaggaaatattgttagctctgtaaacatgatatcaaggatgttgataaatcgctttaccatgaaacataaaaaggctacgtatgaacctgacgtagacctcggatcgggaactcgcaatattggaatagagtcagaaattcctaatctcgacataatagggaaaagaatcgagaaaataaagcaagaacatgaaaccagttggcactatgatcaggatcatccttataagacgtgggcataccacggatcatacgaaactaaacagaccggtagtgcttcaagcatggttaatggtgtagtacggttgctaacaaaaccttgggatgtcgtgccaatggtaacccaaatggcaatgacagatactacaccttttgggcagcagcgagtgttcaaagaaaaggttgatacaagaacgcaagaacccaaggaaggaacaaagaaattaatgaaaataacggcagaatggttatggaaagagcttggcaagaagaaaactccacgtatgtgtactagagaagagtttaccagaaaagttcgtagtaatgcggccttaggagcaatctttactgacgaaaacaaatggaaaagtgctagggaagccgtagaggacggaaggttttgggaactggtggaccgagaaaggaacttgcatttagaaggaaaatgtgaaacttgtgtctacaacatgatgggaaaaagagagaagaaactcggtgaatttggtaaggccaaaggaagccgggcgatatggtatatgtggctcggagctaggtttttagaatttgaagcgctgggctttctaaacgaagaccattggttcagtagaggaaatagcttatccggcgtagagggtgaaggtcttcacaggctaggatatattttgcgcgatgtgggcaagaaagagggaggcgccatgtatgctgatgatactgcaggttgggacaccagaataacccttgaagatctgaaaaatgaagaaatggtcacgaaccatatgaaaggtgaacataagaaactcgcggaagctatatttaaactaacttaccaaaataaggttgtcagagttcaacgaccgactccacgcggtacagttatggatatcataagtagaagggaccaacgaggctccgggcaagtaggaacatatgggttgaatacttttactaacatggaagcacaactaatacgccaaatggaaggagaaggaatttttaagagtatacaacatcttactgcaactgaagaaatagctgtgcagaactggctcgcaagagtaggtcgagaaaggttgagccgaatggcaataagtggggatgattgtgttgttaagccaatagatgatcgattcgcgagcgcattgacagcactaaatgatatgggaaaggttagaaaagatatacagcaatgggaaccgtcaaggggctggaacgactggacccaagttccattttgcagccatcactttcatgaattagtgatgaaagatggaagagtcctagtagtaccttgtcgaaatcaagatgaattaataggtagggcgcgtatatcacaaggagcaggctggagcttaaaagaaacagcatgcctgggtaagtcgtatgcgcaaatgtggacattgatgtattttcacagaagagatctaagattggccgcaaatgcaatttgcagtgctgtcccttcacattgggtcccaacgtctagaaccacatggagtatacatgcaaagcatgagtggatgacaacggaagatatgctagcggtgtggaatcgagtatggatacaagagaatccgtggatggaagataagacccctgtagagagctgggaggaggtaccctatttaggcaaacgtgaggaccaatggtgcggatcacttatcggactcacatctcgtgcaacctgggcaaagaatatccaaaccgccataaaccaagtcagaagccttatcggaaatgaggagtacacggattacatgcctagtatgaaaaggtttcgaagagaagaagaagaagcaggagtcctctggtga

SEQ ID NO: 22449 - RNA, 9876 nt, synthetic construct
  misc_feature 1..9876: note = derived and/or modified CDS sequence (opt6) from DENV-2__EU482760__SS-prME
  source 1..9876: mol_type = other RNA
accgcaggagtaattgtaatgctgatcccaacggccatggcgttccaccttactactcgaaatggagaacctcatatgatcgttggccgtcaggaaaaaggaaaatcattactattcaaaacagaagacggagtgaatatgtgtactttgatggccattgatttgggagaactttgcgaagataccataacatataaatgcccgctattacgacagaatgaaccagaagatatcgactgctggtgcaatagcacttctacttgggtcacatatggaacatgcgccacgacaggagaacatagacgtgagaaaagatcagtcgcattggtcccacacgtaggtatgggtttagaaacgagaaccgaaacttggatgagtagtgaaggggcttggaaacatgttcaaagaatcgaaacatggatattaagacaccctggatttacaataatggctgccatacttgcttacactataggtactacacactttcagagagcattgatttttatcctattaacggccgtcgcaccatctatgaccatgagatgcataggaatcagtaatagagacttcgtggaaggcgtgagcggaggatcctgggtagacattgtcctggagcatggatcatgcgtaaccacgatggcaaagaataagcctacgttagatttcgagctaataaagactgaagctaaacaaccggccacgctaagaaagtattgtatagaagctaagttgacaaacacgacgacagaatcaagatgccctacccaaggcgagccttctttgaatgaggaacaagataaacgtttcatatgtaaacactcgatggtcgatagaggttggggtaatgggtgtggattgtttgggaagggaggaatagtcacgtgcgcgatgtttacttgcaagaaaaatatggaaggtaaagtagtccagccagaaaaccttgaatacacaatagtaattaccccacattccggagaggaacatgcagtcggaaatgatacaggtaaacatggcaaagagataaaaataacacctcagagctcaattactgaggccgaattaacgggttacggaacggtaactatggagtgtagcccacggacgggtctagatttcaacgagatggtgctactccagatggaagacaaggcgtggctagtccatcgccaatggtttctagatcttccactaccatggttgcctggagcagatacacaaggatccaattggattcaaaaagaaactctggtgacatttaaaaatcctcatgcaaagaaacaggatgtcgtcgtcttaggatcacaggaaggtgctatgcatacagcattgacaggggcaacggaaatacagatgtcttctggaaacctacttttcacaggacacctgaaatgtagactacgtatggacaaactacaactaaaaggcatgagctactccatgtgcactggaaaattcaaaattgttaaagaaattgccgaaactcaacatggtacgatcgtaataagagtacaatatgaaggcgatggatcaccctgcaaaattccatttgaaataacagacctcgagaaaagacacgttttgggtcgactaattactgtgaacccaatcgtgacggagaaagacagtcctgttaacatcgaagcagaaccaccatttggcgattcatacattatcataggcgttgaacccgggcaattaaaactcaactggtttaaaaagggctcatcgataggccaaatgtttgaaactaccatgcgaggagcaaaaagaatggcaattttaggagatacagcctgggactttggctctctcggcggagttttcactagcatcggcaaagcactgcatcaagtattcggagcaatatacggtgcagcattctcaggggttagctggaccatgaaaattttaataggagtaatcataacatggattggtatgaactcgaggtctacgagtttatctgtgagtctagtattagttggtgttgttacattatatttgggtgcaatggtccaagctgacagcggatgtgttgtttcgtggaagaacaaggaacttaaatgcggctcaggaatattcatcacagataatgtacacacttggacggaacagtataaatttcagccagagagtccctcaaaactagcatcggcaatacaaaaagcccatgaagaaggaatatgtggaattaggtcagtaacaaggctggaaaatctcatgtggaaacaaatcacaccagaattaaaccacattctaagcgagaacgaagtaaaacttactataatgacaggagacatcaggggaataatgcaggcaggtaagagatcgctaagaccacaaccaactgaattaaaatatagctggaagacgtggggaaaagctaaaatgttaagtactgaatcgcataatcaaacattcttaatagatggaccagaaacagcagagtgtcccaacactaatagagcttggaactctttagaagttgaagattatgggttcggcgtttttactacaaatatatggctaaaacttcgagaaaaacaagatgtattttgtgatagcaaactcatgtctgcggcgataaaagataatagggcagttcatgctgatatgggatattggatagaatcggcactgaacgatacatggaaaatggaaaaggcttcctttatcgaagtaaaaagctgtcattggccaaaatcacatacattgtggtctaacggcgtccttgaatcagagatgataatacccaaaaattttgcgggaccagtaagccaacacaattacagaccaggatatcatacacagacagcaggaccttggcatttagggaagttggagatggacttcgatctctgtgaaggaacgacagtcgtggtaactgaagattgcggtaaccgaggcccctctctgcgcactacaacagcgagcggtaaactcattacagaatggtgttgtaggtcttgcacgctacccccgttacgatatagaggagaggacgggtgttggtacggaatggaaattcgaccattaaaagaaaaagaagaaaacttagtgaactctttggtgacggccggccacggacagatagacaatttctcactaggagtattagggatggcgcttttcttagaggaaatgctgcgtacaagaataggcaccaagcatgcaattttgttagtagccgtttcgtttgtaacacttataaccggaaacatgagctttcgagatttaggaagggttatggtaatggtaggtgcgacaatgacagacgacataggcatgggtgtcacctatttagcgttactcgccgcgtttaaagttagacctacattcgcagcaggactgctattaagaaagttgacttcgaaagaattaatgatggcgacaattggaattgctttgctatcacaatcaactattccagagactatacttgaacttaccgacgcattagcgctgggaatgatggtcttaaagattgtacgaaatatggaaaaatatcagttagccgtaacgataatggcaattagttgtgtccccaacgccgtgatactccaaaacgcctggaaggttagttgtacaatactcgcagcagtttcagtatccccactcctactgacatccagccaacagaaggcagattggatcccgcttgctttgactattaagggactcaacccaaccgccatttttctaaccactttatctaggacaagcaagaaaagatcctggccacttaacgaagcgataatggcagtgggtatggtatctattcttgcaagttccctgctcaaaaatgacatcccaatgacagggccccttgtggcagggggtctattgacagtttgctatgttttaacgggaagatcagcagatctggagttagaaagggcggctgatgtgaaatgggaagatcaggcagaaatctccggatcctcaccgatactttctataaccatatctgaagacggtagcatgagtatcaaaaatgaagaagaggaacaaacgctcactattttgatccgtaccggtttgctcgtaatatcaggagttttcccagtctctataccaataaccgctgcggcatggtatttatgggaagttaagaaacaaagggcgggtgtattatgggatgtgccttccccacccccggtcgaaaaagcagaacttgaggacggagcgtaccggataaaacaaagaggaatattaggatacagccaaataggcgcaggcgtatataaggaagggacattccacacgatgtggcacgttacacggggagcggtccttatgcatcgtggaaagcggattgaaccctcttgggccgatgtaaagaaagacctaatttcatatggagggggatggaaattggagggcgaatggaaagaaggagaagaagtacaggtgctagcacttgaaccagggaaaaatccacgtgcggtacaaactaaaccgggaatttttaaaaccaacactggtacgataggagctgtgagtctagacttctctccaggcacctcaggcagtccgatcgttgataggaagggaaaggtagttggattatatggaaatggagtagttacgcggagtggagcatatgtatccgctatcgctcagacggaaaagtccatagaagataatccagaaattgaagatgatatcttcaggaagaaaagacttacaataatggatttgcaccccggtgccggtaaaacaaaaaggtatttaccagcaattgttagggaagcaattaaaagaggcctaaggactcttattctcgccccaaccagagttgtagccgcggagatggaggaagccctacgggggctacccattagataccaaacgacagccattaagactgaacataccggtcgtgaaatcgtggacctcatgtgtcacgccacttttactatgagacttttaagtccagtccgagttccgaactacaacttaataattatggacgaagctcactttactgatccagcaagcatcgctgcccgaggttatatctccacaagggtagaaatgggagaagcagctggtattttcatgacagctacaccgcctggatcacgtgatccctttccacagagtaacgctccaatcatggatgaagaaagggaaatcccagagagatcgtggaatagcggccacgagtgggtaactgattttaaaggcaaaacagtttggttcgtaccttcgataaaagcaggaaacgacatcgcggcatgcctcaggaaaaatgggaagaaagtaatccaattaagcagaaaaacttttgattcagaatatgttaaaactcgagccaatgattgggattttgtcgtaacgacggacatttcagagatgggtgcaaattttaaagctgaacgggtaatagatcctcgtcgttgtatgaaaccagtgatactaacggatggagaagagagagtgatccttgcagggcccatgccagttacacactccagcgcagcgcaaagacgtggtagaattggaagaaaccctaaaaatgagaatgatcagtacatatatatgggagaaccgctggagaatgatgaggattgcgcgcattggaaagaggcaaaaatgttacttgacaacattaacacacctgaaggtataatcccgagtatgttcgagccggaacgcgaaaaagtggatgcaatagatggtgagtatagattgcgtggggaggctagaaaaacatttgtggacttgatgaggcgaggagacctaccagtatggctcgcctacaaagttgccgcagagggaataaattatgctgatcggaaatggtgtttcgatggtattaaaaataaccaaatattagaagaaaacatggaagtcgagatctggacaaaagaaggagaaaggaagaaacttaaaccccgatggctggacgctcgtatttatagtgatccactagccctcaaagaatttaaggaatttgcagcgggaagaaaatctttaacgctaaatttaataacagaaatgggtagattacctacgttcatgactcagaaagcaagaaatgccctcgacaatttagcggtactgcatacagccgaggctggaggtagagcgtataaccatgcattaagtgaattaccagaaacactagaaactttgctgcttttaaccttactagcaactgtgacaggaggaatcttcttattcttaatgtctgggaaaggtataggcaaaatgacgttgggaatgtgttgtataatcacagcaagtatattattatggtacgcacaaatccagcctcactggatagctgccagtataatattagagttctttttgatagttttacttatcccagaacccgaaaaacaacgaacaccacaggataatcaattgacttatgtcgtaattgcaattctaacagtagtagctgcaaccatggcaaatgaaatgggttttctcgagaaaacaaagaaggatttaggattaggatccattacaacacaagagtccgaaagcaatatattagatattgatctccgacccgcaagtgcctggacgttatacgcagttgcaactacatttgtaactcctatgctccgccattcgattgaaaactcatcagtaaacgtaagcctaactgctatagcaaaccaagcgacagtattaatgggtttaggtaaaggatggcctttaagtaaaatggatataggtgttcccttattagcgataggatgttatagccaagtgaatccgattactttaacagcggccttgctattattagtagcacactatgccattattggacccggattacaagcaaaagcaacaagagaagcacaaaagagagctgctgcgggcataatgaagaaccctaccgttgacggcattacagtgatagatctagagcctataccatatgatcccaaattcgaaaaacaactcggacaagtcatgctactcattctatgtgtgacgcaagtcctgatgatgcgaactacgtgggcattatgtgaagcactgactctcgcgacaggtcctataagtacgttatgggaaggtaatccaggtaggttttggaatacaacgattgccgtttccatggctaacatatttaggggatcatatttggccggcgctggacttctattttcaataatgaaaaacacgactaacactcgaagaggaacaggcaatataggggagacgcttggggaaaaatggaaatcacgtttgaacgccttaggtaaatccgagttccaaatttataagaagtcggggatacaggaagtggacaggacactagccaaagaaggtattaaaagaggcgaaacagatcatcatgctgtttccagaggcagtgcaaaattaagatggttcgtcgaaaggaatatggtaacaccagaaggaaaagtagtggatctaggatgcggaaggggtgggtggtcgtattattgtgggggactaaagaatgtcagggaagttaagggattgactaaaggaggaccaggacacgaagaaccaataccaatgtctacatatggatggaacctagtgcgtcttcaaagcggcgttgatgtatttttcacacctccagaaaaatgtgatacacttctctgtgatatcggagaatcatcacctaaccccactatcgaggcaggacgtaccctacgagttctaaatctcgttgagaactggctaaataataatactcaattttgcataaaagtattgaatccttacatgccttccgtaattgaaaagatggaggcgcttcaacgtaaatatggaggagccctagtaagaaatccactaagtcgcaattcaacccatgaaatgtactgggtatcaaatgccaccggcaatattgtatcatccgtgaatatgattagtagaatgctgataaatcgctttaccatgaaacataagaaagccacgtatgaacctgatgttgatttaggtagcggtacgcgaaatatcggaatagaatccgagataccaaatttagatatcattggcaaaagaatcgaaaagattaaacaagagcatgaaacaagttggcattatgatcaagaccacccttacaaaacctgggcatatcatggatcatatgagacgaaacaaacagggtcagcatctagcatggtaaacggagtagttaggttacttacaaaaccatgggatgtagttccaatggttacccagatggcaatgactgacacgacaccgtttggtcaacagagggtatttaaagaaaaagtagatacaaggacgcaagagccaaaggagggtactaagaaattgatgaaaataacagcagaatggctatggaaagaacttggcaaaaagaaaacaccaagaatgtgcacacgagaggaatttacgcggaaagtacgttccaacgcagccttgggagcaatctttacggacgaaaataaatggaaatccgcgcgtgaagcagtagaggacggtcgcttctgggaactggtcgatcgagaacgaaacctgcatttagaaggaaagtgcgagacatgtgtatataatatgatgggtaaaagggagaagaaactcggagagttcgggaaagctaaaggatcaagagcaatctggtatatgtggttaggcgcaagattcctagagttcgaagcacttggatttctcaatgaagaccattggttctccagaggtaattcactgtcgggagtcgaaggtgagggactacatcgacttggatacatactccgggacgttggaaagaaagaagggggagcgatgtatgctgatgataccgcaggttgggatacacgtataacgttagaagacctcaaaaatgaagaaatggtaactaatcacatgaaaggcgagcacaagaaactggccgaagctatattcaagttaacgtatcaaaataaagtagtgagggttcaaagaccaaccccgagaggcacggttatggatatcatatcaagacgagaccaaagaggttcgggtcaagtaggaacatatggactaaatactttcacaaacatggaggcacaactgattcggcagatggaaggagaaggaatttttaaatcaattcaacacctaaccgcaaccgaggaaatagcagtccaaaactggctggcaagagttggtcgtgaaagattgagcagaatggctatttctggggatgactgtgttgtaaaacccatagacgacagattcgcatctgctcttacagcattaaatgatatgggaaaaatcagaaaagatatccagcaatgggaaccaagtaggggctggaatgattggactcaagtaccgttttgtagccaccattttcatgagcttgttatgaaggatgggagagtattggttgtaccttgtagaaaccaggatgagctcataggacgcgctagaatctcacaaggcgccggatggagtctgaaagagacagcatgcttaggcaaatcttacgctcaaatgtggacgctaatgtattttcacagaagagacttaagacttgccgctaatgcgatttgttcggctgttccgagtcattgggtaccgacttcaagaacaacttggtccattcatgccaaacatgaatggatgactaccgaagatatgctagcagtttggaatcgcgtttggatacaggaaaacccttggatggaagacaagacgccagtggagtcatgggaagaagttccttatttagggaaacgtgaagatcaatggtgcggctcactgataggacttacaagtagagccacttgggctaaaaatattcaaacagcaataaatcaagtgcggtcactaatcggaaatgaagaatacacagattatatgcccagtatgaaaaggtttagacgagaggaggaagaagcgggtgtactatggtag

SEQ ID NO: 22450 - RNA, 9876 nt, synthetic construct
  misc_feature 1..9876: note = derived and/or modified CDS sequence (opt6) from DENV-2__EU482762__SS-prME
  source 1..9876: mol_type = other RNA
acagcaggagtgattgtaatgcttataccaacagcaatggcatttcatttaacaactcgtaacggagaaccccatatgattgttggacgacaagaaaaaggtaaaagtttgctattcaaaactgaagatggagtaaatatgtgtaccctaatggctatagacttaggtgaactgtgcgaagatacaataacgtacaaatgcccactcctcagacaaaatgaaccagaagacatagattgctggtgtaattctacaagcacatgggtgacgtatggtacatgtaccacaaccggcgaacacaggagggagaaaagaagtgtggcgttagtaccccatgttggaatggggttagaaacacgaacagaaacatggatgagctctgaaggagcttggaaacacgttcagcgaatagaaacatggatattacgtcaccctggttttacaattatggctgcaatattggcttacactataggaacgacacattttcagagagcattgatatttattctgcttacagcggtcgcaccatcaatgacaatgagatgtattggtatctcgaatagggatttcgtcgaaggagtctcgggaggatcatgggttgatatagtattggaacatgggagttgtgtaactacaatggccaaaaataaacctacattggactttgaactaataaaaacggaagcaaaacaaccagcaactttgaggaaatactgcattgaagcaaaattaacaaacactacaaccgaatcacgatgtccaactcaaggtgaacccagcttaaacgaagaacaggataaaaggttcatctgtaaacattctatggtcgatagggggtggggcaatggatgtggacttttcggaaaaggtggtattgtgacatgtgctatgtttacatgtaagaaaaatatggaaggaaaagttgtgcaacctgaaaacttagaatacacaatagtaattactccacacagcggagaagaacatgctgttggaaatgatactggcaaacacgggaaagaaataaaaatcacacctcaatcgtctataaccgaagcggaactaaccggatatggaacagtcaccatggaatgctctcctagaactggtttagacttcaacgaaatggtactactacaaatggaagacaaagcatggttggtccatcgacaatggttccttgatcttccattaccatggctaccgggggccgatacgcaaggttcgaattggatacaaaaagaaacgcttgtaacgtttaaaaaccctcatgcaaagaaacaagatgtagttgtattgggcagccaagaaggggccatgcatacggctttaacgggggcaacggaaatccaaatgtcatcaggaaacctgcttttcactggacacctaaaatgccgtctacgtatggacaagttacaactcaaaggaatgtcctatagtatgtgtacaggtaaatttaaaatagtgaaagaaattgctgaaacacagcacggtacaatagtaattcgagtacaatatgagggagacggatccccatgtaaaatacctttcgaaataacagacctagagaaaagacatgtcttagggagattaattactgttaatcctatagtcactgaaaaagattccccggtaaatattgaggcggaacctccatttggagattcgtacattatcataggagtagaaccaggacagctgaaattgaattggtttaagaaaggaagctcgattgggcaaatgtttgaaacgacaatgaggggcgccaaaagaatggcaattttaggggatacagcctgggactttggctcccttgggggagttttcactagcataggaaaagcactccatcaggtattcggagccatttacggggctgcatttagtggcgtatcatggacaatgaagattctgataggagtgattattacatggattgggatgaactctaggtctacttctttaagcgtaagtctagttctagtaggagtagtaaccctatatcttggcgcaatggttcaagctgacagtggttgtgtcgttagctggaaaaataaagaactaaagtgtggatcgggaatatttattacggataatgttcacacctggacagaacaatataaattccagccagagtcaccatcaaagctggcctctgccatccaaaaagcacatgaagaaggtatatgtggcataagatctgtgactcgattagaaaatttaatgtggaaacaaattaccccagaacttaatcatattctcagcgagaatgaagttaaactaacaatcatgacaggagatatacgcgggattatgcaagcaggaaagcgaagcctaagaccccaaccaactgaattaaaatatagttggaagacatggggtaaggctaagatgttgtcgactgaatcccataatcaaacatttcttatagacgggccagaaacagcagaatgcccaaacacgaatcgcgcatggaacagtctagaagtcgaagactatggctttggagtattcacaacaaacatttggttaaaattaagagaaaagcaagacgttttctgcgattctaagctaatgtcggccgcaataaaagataacagagcagtccacgccgatatgggatattggattgagagtgctttaaatgatacttggaaaatggaaaaagcctcctttatagaagtaaaatcctgttattggcccaaatctcatacactgtggagcaacggagtattggaaagtgaaatgattatacctaaaaatttcgccggacccgtatcacaacacaactacagaccagggtaccacactcaaacagcgggaccatggcatctaggtaaattagagatggacttcgacttatgtgaaggaaccacagttgttgtcacagaggactgtggtaacagagggccgtcactacggactacgacagccagtggaaagttgattacagagtggtgttgtcgaagttgtacactgccacctctgcgttaccgaggggaggacggatgctggtatggaatggaaatacgaccgctaaaagagaaagaagagaatttagtcaactcgttagtaactgcggggcatggccagatagacaatttttcattaggagttctgggtatggcgctatttcttgaagagatgcttaggacaaggattggaaccaaacatgcaatacttttggtagccgtttcctttgtaacactgataacaggaaacatgtccttcagggatctaggtcgcgttatggtaatggttggtgcaacgatgacagatgatataggaatgggagtgacatatttagctttactagctgcgtttaaagtgagaccaactttcgcagctgggttattactgcgtaaactgactagcaaagagctgatgatggctactatcggaatcgctctattgagtcaatccacaataccagagactatacttgaactaaccgatgcactcgcactaggtatgatggttttgaagatcgttagaaacatggaaaagtaccagttagcagttacgataatggcaatatcgtgtgtgcctaatgcagtaattctacaaaatgcgtggaaagtaagctgtacaattttagcagctgttagtgtgtcaccattacttcttacaagttcacaacaaaaagcagattggatacctttagcactaaccataaaaggacttaaccccacagctatattcctgacaacgttgagcagaacaagcaagaaaagatcatggccactaaatgaagcaattatggctgtaggtatggtcagtatattagcatctagcttacttaagaatgatataccgatgactggaccacttgttgcagggggcttacttacagtatgctatgttttaacgggtaggtcagcggatctagaacttgaacgagctgcagatgttaaatgggaggatcaggcggaaatatcagggtcaagccctattctatcaattacaattagtgaagacggttccatgtcgatcaaaaatgaagaggaagaacagactttaacaatccttataagaactggcttattagtaatttccggggtttttccggtaagtattcctataacggcagctgcttggtacttatgggaagtcaaaaagcaaagagcgggggtgttatgggacgtaccgtctcccccgccagttgagaaagcagaactagaagacggggcgtatagaataaaacaaagaggcatactaggttatagccagataggagcaggagtatataaagaaggcacgtttcatactatgtggcacgtgactcgcggtgccgtactgatgcacagaggcaagcgcattgagccgtcttgggctgacgtcaagaaagacttgatctcttatggaggtggatggaagttagaaggtgaatggaaagaaggcgaggaggttcaagtgctcgcattagaacctgggaaaaatcccagggccgtacaaacgaaaccaggtatattcaagactaacacaggtaccatcggagcggtaagtctagattttagcccaggaacaagtggttctccaatagtagatagaaaaggcaaagtcgtaggtctttacggaaatggagtcgttactcgctcaggagcatatgtatcagcaattgcccaaactgaaaaatccattgaggataatccagaaatagaagatgatatatttcgaaagaaaaggttaaccatcatggatttacatcctggggcaggaaagaccaaaagatatttaccggcgatcgtcagagaagcgatcaaacgcggtcttagaacattaatattagcacccactagagtagtagctgcggaaatggaggaggctttgaggggtctacccatcagatatcagactacagcaatcaaaacagagcatacaggaagagaaattgttgacttgatgtgtcacgccacgtttactatgagattgctatcaccggtgagggtgccaaactacaacctgattataatggatgaagctcatttcacagatcctgcaagtatagcagctagaggctatatatccacgcgagtagaaatgggcgaagccgccggaatcttcatgactgctacccctccaggctccagagacccctttccccaatccaatgcacccataatggatgaagaaagagaaataccagagcgttcttggaactccggacatgaatgggttacagattttaaaggtaaaactgtctggtttgttcctagcatcaaagcagggaacgacatagctgcatgcttgaggaaaaacggcaagaaagtaatccaactttcacgtaaaacgtttgatagtgaatacgttaagacgagagctaacgactgggacttcgtggtaacaaccgacataagtgaaatgggagcgaacttcaaggcagagagagttatagacccccgaaggtgcatgaagccagtcattcttacagatggagaggaacgtgttatcttagcggggcctatgcccgttacccattcttccgctgctcaacggagagggagaatcggtcgcaaccccaaaaatgagaatgaccagtatatatatatgggagaaccccttgaaaacgatgaggactgcgcacattggaaagaggcgaaaatgttgctagataacattaatacccctgaggggattattccttccatgtttgaaccggaaagggagaaggtggatgcaatagacggggaatataggttgagaggcgaagcacgtaaaacatttgtagatttgatgcgaaggggagaccttcctgtctggcttgcctacaaagttgccgcagagggtataaactacgctgatcgaaaatggtgttttgacggaatcaagaataatcagatcttagaagagaatatggaagtagaaatttggactaaagaaggtgaaaggaagaaactcaaaccaaggtggttagatgctcgcatatattctgatcctctagctttaaaagagttcaaggagttcgccgccgggagaaaatccttgactctaaatttaattaccgaaatgggtaggctgcctacatttatgacacaaaaagccagaaatgcacttgacaatcttgctgtcttacataccgctgaagccggtggacgagcgtataatcacgctttaagcgaattacctgaaactttggagaccttgttactacttacattactagctactgtaacgggcggaatattcttattcttgatgtcaggaaaaggaataggaaagatgacattaggtatgtgctgtatcattacagcctctatattactatggtatgctcaaatacaaccacattggatcgcagcgtctattattctagagttctttctaattgttctcttaataccagaaccagaaaaacaaagaacccctcaagataatcagttaacttatgtagtcatagcaatattgaccgtggtcgcagcaacaatggcgaacgaaatgggattcttagagaaaactaagaaagacttagggttaggaagtataaccacacaggaatctgagagtaatatcttagacatagaccttcgaccggcatcagcgtggacgttatacgctgtagcgacaacattcgtcaccccgatgttacgacattcaatagaaaattcttctgtaaacgttagtctaaccgcaatcgcaaatcaagccaccgttttaatggggctaggaaagggttggcctctctctaaaatggacataggagtgcctctcctcgctataggttgctattctcaagttaatccgataacactaacggcagcattgctactacttgtcgcacattacgcaattataggtccgggcctccaggctaaagccactcgggaggcacaaaagcgtgcagcggcgggcattatgaaaaatccgacagtcgatggaatcacagtaattgatttggaacccataccatatgacccgaaatttgaaaagcagcttggtcaggtcatgctgctaatcttatgtgttacacaagtgctgatgatgcgcaccacatgggcactctgtgaagcgttaactcttgctactggtcctataagtaccttatgggaaggaaacccaggacgcttttggaacactaccatagcagttagtatggcaaatatctttagaggcagttacctagcaggagctggattattatttagcataatgaaaaacacaacaaatacaagacgcggaacggggaacatcggagaaactttaggagagaaatggaaaagcaggttgaatgctttgggtaaaagcgagttccagatttacaaaaagtcaggcattcaagaagttgacagaacgttagctaaggagggcataaaaagaggagaaacagatcatcatgcagtatcgagggggagcgcaaaattgagatggttcgtagagaggaatatggttacaccagaaggaaaagttgtagatctaggatgcggtaggggagggtggagctattactgcggtggactgaagaacgtccgtgaagtcaaaggtctaacgaaaggcggcccgggccatgaagaaccgattccaatgtcaacttatggatggaatttggttagactacagtctggagtggatgtatttttcacacctccagaaaaatgcgatactttactttgtgatattggagagtcatctcccaatccgacaatagaagcgggaaggacacttagagtattaaacttagtagaaaactggttaaacaataatacacagttttgcataaaagtactcaatccatatatgccatctgttatagagaaaatggaagcattgcaaagaaagtacggtggagcactcgttagaaatccgttaagccgaaacagcacccacgagatgtattgggtaagtaatgctacaggaaatatagtctcctcggtaaacatgatatctaggatgttaattaatagattcaccatgaaacacaaaaaggccacatacgaacctgacgtagatttgggctccggaacaaggaacatcgggattgagtccgagataccgaatttagatattatcgggaaaagaattgagaaaataaagcaagaacatgaaacgtcatggcactatgaccaagaccatccatataagacatgggcttatcacgggtcatatgagacgaagcaaactgggtcagcgtcgagcatggttaacggagttgtccgactgcttaccaaaccatgggacgtggttccgatggttacacaaatggcaatgacggatactacccctttcggacaacaacgggtgttcaaagaaaaagtagatacaaggacacaagagccaaaagaaggaaccaagaaattaatgaagattacagcagaatggttatggaaagaactagggaagaagaaaactccccgtatgtgtactcgtgaagagttcacgaggaaagtcaggagtaatgctgctctaggcgccatatttacagatgagaacaaatggaaatcagccagagaagctgtggaagacggaagattctgggaactggttgatcgtgaacgcaaccttcacttggaaggaaaatgtgaaacgtgtgtatataacatgatgggaaaacgagaaaagaaattgggagagttcggcaaggctaaaggaagtagagccatatggtatatgtggctcggcgcgagattcctcgagttcgaggctcttggattcctaaacgaagatcactggttttcccggggcaattctctatcaggcgtagaaggcgaaggtcttcaccgacttggatatatactcagggatgtaggaaagaaggagggaggagcaatgtatgctgatgatacagcgggttgggatactcggattaccttagaagacctcaagaatgaagaaatggtcaccaaccatatgaaaggagaacacaagaaactggcagaagccatttttaaacttacatatcaaaataaggtagttcgtgtacagagacccacgcccagaggcactgtgatggatataataagccgcagggatcaaagaggatcaggacaagtaggtacatatggcttgaacacgtttacgaatatggaggctcaactaataaggcaaatggaaggtgagggtatattcaaaagtatacagcatctaacagcgacagaagaaatcgctgtacaaaactggttagcacgagtgggcagggaaaggctgtcaaggatggcaataagcggtgatgactgtgtggtgaaaccaatagatgatcgattcgcttcggcactaactgcactcaatgacatgggtaaagtaagaaaggacatccaacagtgggaaccttcacgaggttggaatgattggacacaggtaccattctgctcgcatcattttcatgaattagtcatgaaagatgggcgcgttttagtagtgccatgtagaaaccaagacgaactcataggtagggcccgaatctctcaaggggcaggctggtctcttaaagaaactgcatgcttagggaaaagttatgcacaaatgtggactttaatgtactttcacagaagagatttaagattggcagcaaacgcaatatgcagcgcagtacccagccattgggttcctacatcacgtacgacatggtcgatacacgcaaaacatgaatggatgaccacagaagacatgctcgcagtatggaatagggtgtggatacaagaaaatccatggatggaagataaaactcctgtagaatcatgggaagaagttccctatctaggaaaacgcgaagatcaatggtgcggaagcctaattggactcacgtctcgagccacatgggccaagaatattcagacagcgataaatcaggtaagaagtcttattggcaatgaagaatatactgattatatgccctctatgaaacgattcaggcgcgaggaggaggaggctggggtattgtggtaa

SEQ ID NO: 22451 - RNA, 9876 nt, synthetic construct
  misc_feature 1..9876: note = derived and/or modified CDS sequence (opt6) from DENV-2__EU482763__SS-prME
  source 1..9876: mol_type = other RNA
actgcgggagtcatagtcatgctaatacctactgcaatggcgttccatcttacaactcggaatggtgaaccccacatgattgtcggaagacaagaaaaaggaaagagcttactatttaaaacagaagatggagttaatatgtgtacgttaatggcaatggacctaggagaattatgtgaagacacaataacttacaaatgtccacttctaagacaaaacgaacctgaagatatcgattgttggtgcaattcaacgtctacatgggtaacatatggtacttgtaccactactggggaacatagacgagagaaaaggtcagtcgcattagtacctcacgttggtatggggcttgaaactaggacagaaacctggatgtcaagcgaaggtgcgtggaaacatgtgcagagaatagaaacttggatacttagacatccaggattcactataatggccgcaatattggcctatacaataggaacgacacacttccagagagcattaatttttatactccttacggcagtagcgccaagcatgaccatgagatgcattggaataagtaatagggatttcgtagaaggtgtcagtggtggctcgtgggtagacatagtactagaacacggttcttgcgttactacaatggcaaagaacaaacctaccctggactttgaattaatcaaaacagaagcgaaacaacccgccactttaagaaagtattgtattgaagcgaaattgacaaatactacaacagaaagtaggtgccccacacaaggagaaccaagtcttaatgaagaacaagataaaagatttatttgtaaacactcaatggttgacagaggttggggcaatggctgtggtttatttggtaaaggagggatagttacctgtgcaatgtttacttgtaagaaaaacatggagggcaaagtagtccaacccgaaaatttagaatacacaattgtcattacaccccattccggtgaagaacatgcagtgggtaatgatacgggaaagcacggaaaagaaataaaaataacacctcaaagcagcataacggaagcagaactgaccgggtacgggactgtaactatggaatgttcgcctcgaaccggattggactttaacgaaatggtcctgttgcaaatggaagataaggcttggctagtacatagacaatggtttctcgacctccctcttccgtggctacctggtgcagacacacaaggatcgaattggatacaaaaggaaacacttgtaacttttaaaaatccacacgcgaagaaacaagatgtagttgtactaggttcgcaagaaggagcaatgcatacggcattaacaggcgcaacggaaattcaaatgtcatctggaaacttactatttacggggcatcttaaatgcagattaagaatggataagttgcaactaaaaggaatgtcttacagtatgtgtaccggcaaattcaaaatagtgaaagaaattgcagaaacacaacatggtaccatagtaattcgtgtccagtatgaaggtgatggaagtccctgtaagataccatttgaaatcacagatcttgagaaaaggcatgtactaggtagactaataacggttaaccccatagtgacagaaaaagacagtccagtgaatatcgaagccgaaccaccgttcggggacagttatattataataggagttgaaccaggtcaacttaaattaaactggttcaagaaaggttctagtatcggtcaaatgtttgaaactaccatgcggggtgcgaaacgtatggcaatactcggcgataccgcttgggactttggatccctgggtggtgtatttacatcaataggcaaggctttacaccaagtcttcggagctatatatggtgcagcgttttcaggcgtgagctggaccatgaaaatactaattggtgttatcataacttggataggtatgaacagccgatctacctctttatccgttagtcttgtattggtgggggttgtgacattatacctgggtgcaatggtacaagcagatagcggttgtgtggtatcatggaaaaacaaagaattaaaatgtgggtctggtatatttataacagataatgtacatacatggaccgaacaatataaatttcaaccagagtcgccatcaaaattggcaagcgccattcaaaaagcacatgaagaaggaatatgtggaattagatcagtaactagactagaaaacttaatgtggaaacaaattacacctgaattaaatcacatattaagtgaaaacgaggtgaaattaacgataatgacaggagatattaggggcataatgcaagccgggaaaagaagcctaagaccacaacctaccgaacttaaatatagttggaagacgtggggaaaagccaaaatgctatcaaccgaaagccataaccaaacgtttttaatcgacggacccgaaactgccgaatgtccaaatacaaatagagcttggaactcattggaagtagaggactatggattcggggtatttacaactaatatatggttgaaacttagggaaaaacaagatgtattttgcgactctaagttaatgtctgcagctattaaagacaaccgggcagtacatgctgatatgggatactggattgaaagcgcgttaaatgatacatggaaaatggagaaagctagctttatagaagtaaaatcttgtcattggcccaaatcacatactctatggagcaatggagtgctagaaagtgaaatgatcataccgaaaaatttcgctgggccagtgtcgcaacacaattatagaccgggatatcacactcagactgctggtccctggcacctagggaaactggagatggattttgatttatgcgaaggaactacggtcgtcgtcactgaagactgcggcaaccgaggtccctcactcagaacaactacggcaagtggaaaattaataactgagtggtgctgtagaagttgcactctaccacctctgcgataccgaggtgaagacggatgctggtacggtatggaaattagaccattaaaagaaaaagaagaaaacttagtcaattcacttgtcacagcaggtcacggccaaattgacaatttttctctaggcgttttgggaatggctctcttccttgaagaaatgctaaggacacgcataggcactaaacatgccatcctcttagttgcggtgtcattcgttaccttaataaccggtaatatgagttttcgtgatctaggccgagtgatggtaatggttggggcaaccatgacagatgacatcggaatgggagttacgtacttagccctgctagccgcatttaaggttagacccacatttgctgccgggctactcttgaggaaattgacatcaaaggaattgatgatggcaacgatcggcatcgcattgctgagtcagagcacaatccccgaaacaatactggaactaaccgatgctttagcattaggcatgatggtgcttaagatagtaagaaacatggaaaaataccaactagcagtcactatcatggccatctcctgtgtgcccaatgcagttatactacaaaatgcctggaaagtatcctgtactattctggcagccgtcagtgtatcccctcttcttctaacctcgtcccaacaaaaggctgattggatacccctcgcactcacaatcaaaggacttaatccgacagccatctttctaacgaccctctcccgaacatccaagaaaagaagctggccgttgaatgaagcgataatggcagtaggcatggtttcaattttagcatcgtctctgctcaaaaacgacatccccatgacaggtcctctagtggcgggaggtctgttaacagtttgctatgtcttaacaggtcgaagtgctgacttagagttagaacgggccgctgacgtaaaatgggaagaccaggctgaaataagcgggtcttcacccattctttcaataacaatttctgaagatgggagtatgtctatcaaaaatgaggaagaggagcaaacattaactatattaataagaacaggacttctagtaatatctggcgtattccccgtgtcaatccccataactgcggccgcgtggtacctatgggaggtcaagaaacaacgagctggcgtactgtgggacgttccaagtccacccccggtagaaaaagctgagttagaagatggagcgtatcgaataaaacaaagaggtatattaggttacagtcaaattggcgcaggggtctataaagaaggcacatttcatacaatgtggcacgtgaccagaggtgcggtcttgatgcatcggggaaagcggatagaaccctcatgggcagatgtgaaaaaggacttaataagttacggaggtggatggaagctagaaggggaatggaaagaaggagaagaagtacaggtattggcactagaaccaggcaaaaatccgagagcggtacaaacaaaaccaggaattttcaagaccaatacaggcacaataggagcagtttcattagacttctcaccaggtacatctggtagtccaattgtagatagaaagggtaaagtagtaggtctatatggaaacggcgttgtcactagaagcggagcttacgtaagcgctatcgcacaaaccgaaaagtcgatcgaagataatccagaaatcgaagacgatatcttcagaaagaaacgtttaacaataatggatctacatccgggtgcgggaaaaacaaaaaggtatcttcctgcaattgtacgagaagccatcaaacgaggattaagaacactcatacttgcgccaactcgggtcgtagccgcagagatggaagaagctctacgcggtcttccaatacgttatcagacgactgctattaagaccgaacatacagggcgtgagatagtagatctcatgtgtcacgcaacctttacaatgcgactgctttccccagtacgcgtcccgaactacaatttaataataatggacgaagcacacttcacagaccctgcaagtatagcggcaaggggatacataagtacacgagttgaaatgggagaggcagctggtatttttatgactgcgacaccaccaggaagccgtgacccatttcctcaatctaatgcaccgataatggatgaagagagggaaatcccagagagatcctggaacagtgggcatgagtgggtaacagatttcaaagggaaaacagtctggttcgtcccatcgattaaagctggcaatgacatagccgcatgtctacgtaagaacggaaagaaggtgatccaactctccagaaaaacatttgatagcgaatatgtcaaaactagggcaaatgattgggattttgttgttacaactgacatatccgagatgggtgcaaattttaaagctgaaagagttatcgatccacgacgttgcatgaagccggttatacttactgatggtgaagaaagggtcatcttggcaggaccgatgccggtgacgcattcttcagcagcccaacgacgcggtaggataggtcgcaatcctaaaaatgaaaatgatcaatacatttatatgggcgaaccgctagagaatgacgaggactgtgctcactggaaagaggcaaaaatgctgctagataatattaatacacctgaaggaataataccgagtatgttcgagccggagagggaaaaagttgacgctattgatggcgaatataggctcagaggggaggctcgaaaaacgtttgtggaccttatgcgccgaggagacttacctgtatggttggcgtacaaagtagcagcagaaggaattaactacacggaccgaaaatggtgctttgatggtattaagaataatcaaattctggaagaaaatatggaagtagaaatatggacgaaagagggtgaacgaaagaaattaaaaccgaggtggttagacgccagaatatattctgatcccctcgcattaaaggagttcaaagaatttgctgccgggaggaagtctttaacactcaacctaataacagaaatgggccgattaccaactttcatgacgcaaaaagcgcgaaatgccttagataatttggctgtactgcacacagcagaagctggaggtcgtgcttacaatcatgccttatctgaactaccagagactcttgaaacgctgttattattaactcttctagccaccgttacaggaggaatttttctgttcctaatgtcaggtaaaggaatagggaaaatgaccctaggaatgtgttgtataataaccgcaagtatattactatggtacgctcaaattcaaccacattggatagcagctagcattattttagagttcttcctaatcgtccttttaattccagaaccagaaaaacaaagaacaccgcaagataatcagttgacatatgtagtaattgctattttaactgtggtcgcggcaacaatggcaaatgaaatgggcttcttagaaaagaccaagaaagatctaggacttggatcaataacaacccaagagagcgaatccaacattctggatatagacctaaggcctgcgagtgcttggactctttacgcggtagctacaacttttgtaacaccaatgctcaggcattctatcgagaatagctctgtaaatgtatctttaacagctatcgcgaatcaagctaccgttttaatgggcttaggtaagggttggccactatcgaaaatggatattggagtcccactattagccataggttgttactcgcaagtaaatcccattacactaacggcagccttgttactattagtcgcacattacgctattataggtcctggtcttcaggcaaaagcgacacgagaggcacaaaaacgggcagccgctggcataatgaaaaatccaacagtagacggaataactgtaatagacttagagccaattccctatgatccgaaatttgaaaaacaactagggcaggtaatgctattaatactctgcgtgactcaggtcctgatgatgagaactacctgggcattgtgtgaagcgttgacgttagctacaggcccaataagtacattatgggaaggaaacccgggtcgattctggaatacaacgattgccgtcagtatggcaaacatattcagggggagctatctcgcaggggccggattattattctccattatgaaaaataccactaatacacgtagaggtacggggaatattggagaaacacttggagagaaatggaaatctagactgaatgccttaggaaaatcagaatttcaaatctacaaaaagtctggaatacaagaagtggacagaactttggcaaaagaaggaatcaaacgaggggaaacagaccatcatgcggttagcagaggaagcgcgaaattgaggtggtttgtagaacgaaacatggtaacccccgagggtaaggtagtagacttaggttgtgggcgaggcgggtggtcatattactgtggtggtctaaagaacgtccgtgaagtaaagggtctaaccaagggagggcctggccatgaggaacccattcctatgagcacatacggatggaacttagtgaggctccaatccggcgtcgatgtgttcttcactccccctgaaaaatgcgatacacttctatgcgatattggagaatcatccccaaacccaactatagaagcgggaagaaccctaagggtattaaacttggtagagaattggttaaacaacaacacacaattctgtataaaggtattaaatccatatatgccctcagttatagagaaaatggaggctttacagagaaaatacggtggtgcattagtgaggaacccgttatcaaggaactcaacccatgaaatgtactgggtcagtaatgcgacagggaatatagtcagcagcgttaatatgatatctcgtatgctgattaataggttcactatgaaacataagaaggcgacctatgagccggatgtcgacttagggtctggaacaagaaatataggaatagaatcagagattcccaacctagatataattggaaaaagaatagagaaaatcaaacaagagcatgaaacaagctggcactatgatcaggaccatccctataaaacctgggcatatcatggatcttatgaaaccaaacaaacaggaagtgcctcgagcatggttaatggggttgttagactgctcacaaaaccttgggatgtagtccctatggtaacacaaatggcaatgactgacacaacgccgttcggacaacaacgcgtattcaaagagaaagttgatacaaggacacaagaaccaaaagaaggtaccaagaaattaatgaaaattacagccgaatggttgtggaaagaattaggcaaaaagaaaactccacgcatgtgtaccagagaagagtttactagaaaagtccgatccaatgcagcattgggagccatatttacagatgaaaacaaatggaaatctgctagagaagccgttgaagacggacggttctgggaattagtggatagggaacgtaatctacatctggaaggtaaatgtgaaacctgcgtttacaatatgatgggaaaacgtgagaagaaattaggagagtttgggaaagcaaaaggttcacgtgccatttggtatatgtggcttggagcacgatttctcgagttcgaagcacttggttttctgaacgaagaccattggttttcacggggaaattcattgtcaggggtagagggggaaggtttacacagacttgggtatatattacgggacgtaggcaagaaagaaggaggagccatgtatgctgatgatacagctggatgggacacgcgaattacgctggaggacctgaaaaacgaggaaatggtgacaaatcatatgaaaggagaacataagaaactagcagaggcaatttttaaattaacgtaccaaaataaagtcgtcagggtccagcgaccaactccaagaggaacggtcatggacataatctcgcgcagagatcagcggggttctgggcaggtagggacatatggccttaatacgtttacgaatatggaggcgcaattaattagacagatggaaggagagggtatcttcaagtcaatacaacaccttacagcaactgaagagattgctgttcagaactggctagcaagagtaggaagagagcgcctatcaagaatggccatcagcggagatgattgtgttgtaaagccaattgatgacagatttgcaagcgcactgacagccttgaatgatatgggtaaagtccgtaaggatatacaacaatgggagccgtcaagaggatggaatgattggacgcaagtgccattttgctctcatcattttcatgagctagtaatgaaagatggaagggtgttagtggttccatgtagaaaccaagatgaactaatcggacgggcaaggatatcccaaggagccggttggagtttgaaggaaaccgcttgcctagggaaatcttacgctcaaatgtggacattaatgtatttccacagaagggacctgaggcttgctgcaaacgctatatgcagtgctgtgccctcacattgggtccccacatcgcgcacaacttggtcaatacatgcgaaacacgaatggatgacaactgaggatatgttggcggtttggaatagagtttggatacaagagaacccgtggatggaagacaagacaccagtcgaatcttgggaagaagttccatacttagggaaaagagaagatcaatggtgcggttcgttaatcggacttacgagcagagccacatgggctaagaatatccagaccgcaattaatcaagtaaggagtctaattggaaacgaagaatatacagactacatgccaagcatgaaaagatttcgtcgagaggaggaggaggccggtgttttatggtaa

SEQ ID NO: 22452 - RNA, 9876 nt, synthetic construct
  misc_feature 1..9876: note = derived and/or modified CDS sequence (opt6) from DENV-2__EU482444__SS-prME
  source 1..9876: mol_type = other RNA
acagcaggagtaattgttatgttaatacccacagcaatggcatttcacttgacgacacgaaatggcgaaccgcacatgattgttggccgacaagagaaagggaaatcattattatttaaaacagaagacggcgtcaacatgtgcacgctaatggccatggacctaggtgaattatgcgaagatacaataacttataaatgtccacttttaagacagaatgaaccagaagatatcgattgttggtgtaactccacatcaacgtgggttacctacgggacatgtacgactactggggaacataggagagagaagcgatcagtagcattggtaccacatgtaggaatgggactagaaacacgaacagaaacctggatgtctagtgagggagcctggaagcatgtgcaaagaatcgaaacctggatcctcagacatccaggcttcactataatggctgctatattagcttatacaattggtaccacccacttccaaagagcactcatctttatactactcacagccgtagcaccatcaatgactatgcgttgtattggtatttcaaacagggactttgtagaaggcgtcagtggtgggtcttgggtagatatagttttggaacatggcagttgtgtaacaactatggcgaaaaataaaccaacgctagactttgaattaataaaaacagaagcaaaacagccggcaaccctccgaaagtattgtattgaggcaaagcttaccaatacaaccacggaatcaagatgccccactcaaggtgagccgtctctaaatgaggaacaagataaaagattcatatgtaaacattcaatggtagacagaggatggggaaacggatgtggcctattcggaaaaggaggaattgtaacgtgcgcaatgtttacgtgtaagaagaatatggaaggtaaagtagtacaaccggagaaccttgaatatactatagttatcaccccgcactctggagaagagcacgctgtgggtaacgatactggaaaacacggcaaggagatcaaaattacaccccaaagctcaataacagaagctgaactaactgggtacggcactgtaactatggaatgttcgccgaggacaggattggacttcaatgaaatggtgcttttgcaaatggaagacaaggcatggttagtgcaccgacagtggtttttggacttaccccttccctggctacctggagctgatacgcagggatcgaattggatacagaaagaaacgttagtcacatttaagaatccacatgcgaagaaacaagacgtagtagtattgggaagtcaagaaggagcaatgcatacagcattgaccggagctaccgagattcaaatgtccagcgggaacttactgttcaccggacatctgaaatgccgactgcgaatggataaattacagcttaaaggtatgtcatactccatgtgtacaggaaaattcaaaatcgtaaaagagatagccgaaacacaacacggaacaattgtaattagagtgcaatatgaaggagacggatcaccttgcaaaattccatttgaaatcacagatttagaaaaaagacatgttctgggcagactaatcacggttaacccaatagttacggaaaaagacagtccagtaaacatcgaagctgaaccacctttcggcgatagttatataataattggagtcgaacccggacaattgaaactaaattggttcaaaaaaggctcaagcataggacaaatgttcgaaacaactatgagaggagcaaagaggatggcgatcctaggagatacagcttgggatttcggatcattaggaggggtcttcacctcaattggaaaagctctccaccaggtattcggagcaatttacggggcggcattttccggagtgagttggacaatgaaaatactaataggtgtgataatcacatggattggaatgaactcccgaagcacaagcttgagtgtaagcctggtcttagtcggggttgtaactctataccttggggctatggtacaagcagatagtggatgcgttgtctcttggaaaaacaaggagttgaaatgcggaagtggaatttttataactgacaatgtacacacctggacagaacaatacaaattccaaccagagtctccaagtaaactcgcgagtgcgatacaaaaggcacatgaagaaggaatttgtggaatacggagtgtcactagattagaaaatttaatgtggaaacaaatcacaccagaactaaatcatatactatccgaaaatgaagtaaagcttacgataatgacaggagatatcagaggaatcatgcaggccggtaaacgatcattacggccacaacctacagagctaaagtatagttggaaaacttggggcaaagcaaagatgttatcgaccgaatcgcataatcaaacattcctgattgacggcccagaaaccgctgaatgccctaacaccaatagagcctggaattcattagaagtggaagattatggatttggagtatttaccactaacatttggcttaaattgcgggaaaaacaagatgtgttctgtgacagcaaattgatgagtgcggcaattaaagataatagggcagttcatgcagacatggggtactggattgaatcagccctaaatgatacctggaaaatggaaaaggctagttttatagaggtcaaatcgtgccactggccgaaaagtcataccttatggtcaaacggcgtactcgaatcggaaatgattattccaaagaatttcgcgggtccagttagtcaacataactatcgcccaggatatcatacacaaacagccggtccctggcatttgggtaagctagagatggatttcgacctatgcgaaggcaccacagttgtagtaacagaggattgtgggaacagaggaccatccttgcgcacaacaaccgccagtggtaaactcattacagagtggtgttgtcgttcttgcactttacctccattaagatacaggggtgaggacggctgttggtatggcatggaaatacgtccattaaaagaaaaggaagaaaatttggtaaactcacttgttactgctggacacggacagatagacaatttctcattaggcgtactgggaatggcgctgttcctcgaagaaatgcttaggacgcgcataggcaccaaacatgcgattcttttagtcgcagttagcttcgtcactcttataacgggaaacatgagctttcgcgatctagggagggtgatggttatggtcggagcaaccatgacagatgacattggcatgggagttacatatctcgcactactagccgcatttaaagtccgacctacattcgcagcaggcctcctactcaggaaactcactagtaaagaattaatgatggctacaatagggatagctctactaagtcaatcaacgataccggaaacaatattagaacttacagatgcactcgcgttaggtatgatggtattaaaaatcgttaggaacatggaaaaatatcaattggccgttactataatggcgataagttgtgtgcctaacgccgtgatattgcagaacgcatggaaagtatcatgtactatattagcagctgtttcagtatcaccacttttgttaacttcttctcagcaaaaagcagattggattcctctggctctcacgataaaaggtttgaatccgactgcaatatttcttacaacactctccagaacaagtaaaaaacgtagttggcctctaaacgaagctattatggctgtaggaatggtttcgatactcgcttcgagcctattaaaaaacgatatcccaatgacaggacccctcgtggccggagggttgttgacggtatgttatgtgttaaccggaagatctgctgatttagaacttgagagggccgctgacgtcaaatgggaggaccaagcggaaatatcaggaagttcgcctattttatctataacaatatcagaagatggatcaatgagcattaagaatgaggaggaggaacaaactttaactatattgatacgaaccggccttttagttatttcaggcgtatttcccgtaagcatacccattactgcggcagcatggtatttgtgggaagtaaagaaacagcgagctggcgtactatgggacgtaccaagtccccctcccgtagaaaaggcagaattagaggacggagcataccgtatcaaacaacgaggtatactgggttatagtcagatcggggcaggcgtgtacaaggaagggacatttcacactatgtggcacgtgactagaggtgctgtattaatgcataggggcaagagaatcgaaccgtcttgggcggacgtaaagaaagacttgatatcttacgggggtggttggaaattggaaggagaatggaaagagggagaagaagtccaagtcctggcattagaaccaggaaaaaacccgagggctgttcaaacgaagccaggaattttcaagacgaatactggcaccatcggagccgtatccttagacttctccccgggcacatcaggaagtccaatagtagaccgaaaagggaaggtggtagggctgtacggaaacggtgtagtgacgcgttctggagcatatgtatctgcaatagcacaaacagaaaaaagcatagaagataacccagaaatagaagatgatatattcaggaagaagagattaacgattatggatttacaccctggagcgggcaaaacaaaaagatacttaccggcgatagttagagaggcaataaaaaggggtctaagaacactaattttagcgccaacaagggtggtagctgctgaaatggaagaggcactcagaggattacctatcagataccaaacaacagccattaaaacagaacacacaggtcgagaaatagtagatttaatgtgccatgcaacattcacaatgcgtttactttctccagttcgtgtgccaaattacaacttaataattatggatgaggcgcatttcaccgatccagcaagcattgcagcccgaggatacattagtacacgcgtagaaatgggagaggctgcagggatattcatgacagctacacctcctggctctagagatcctttcccacaaagtaatgcaccgataatggacgaagaaagagagatcccagaaagaagctggaactctggccatgaatgggttactgattttaaaggaaagacggtttggttcgtaccatctataaaagcaggaaacgatatcgccgcctgcctaagaaagaatggcaaaaaagtcattcaactttcgagaaaaacttttgactcggaatacgtaaagactagagctaatgactgggattttgttgtgacaactgatatatcggaaatgggggccaattttaaagcagaaagagttatagaccctcgaagatgtatgaaacctgttattttaaccgacggagaggaaagagttatattggcaggtccaatgcccgtaacccattcttcagccgcacaaaggagaggacgcataggaaggaatccaaaaaatgaaaatgatcagtatatttatatgggggaaccgttggaaaatgacgaagactgtgcccattggaaagaggctaaaatgttactggacaatattaatacacctgaaggtatcattccttcaatgttcgaaccggagcgggaaaaagtagatgctatcgacggagagtaccgcctccggggagaggcaagaaaaacgtttgtggaccttatgaggcggggagatctccccgtgtggttagcatataaagtggcagcagaaggcataaattacgcagaccgcaagtggtgttttgatgggattaaaaacaaccaaatcttagaagagaacatggaagttgaaatatggacgaaagaaggggagaggaaaaaattaaaaccacgctggctagatgcaagaatttatagtgaccctctagctttaaaggagtttaaggaattcgcagcggggcggaaaagtttaacactcaacttaatcacagagatgggacgactacctacgtttatgacacagaaggctcgtaacgcactagataatttagccgtattacatactgcagaagccggggggcgtgcatacaaccatgcgctaagtgaactccccgaaaccttggaaacgctgttattattaacactacttgctacagtgacaggcgggatattcctgttccttatgagcggcaaaggaattgggaagatgacactaggaatgtgttgtatcataacggctagtatattgttgtggtacgcacagatacagccacattggatcgctgcatcgatcatacttgaattctttttgattgttttactcataccagaacccgaaaaacaacgaactccccaagacaatcaacttacatatgtagtaatagcaatactaactgtagtagcggcaacaatggctaatgaaatgggatttctcgagaagactaaaaaagatttaggattaggatcgatcaccatccaagaaagtgaaagtaacattctcgatattgatttaagacctgcaagcgcctggacgttatacgcagtcgccacaacattcgtcacccccatgctaagacatagtatagaaaactcttccgttaacgtatcattaacagcaattgcaaatcaagctacggtattgatgggtctcggaaaaggctggccactgagcaagatggatatcggtgtccctttacttgcaattggttgttattcgcaagtgaaccctataaccttaactgcagctctgctcctgttagtagcgcattacgcaattataggtcctggtttgcaagcaaaggcaactagagaagcccaaaaaagggcagcagcaggcataatgaagaatccaacagttgatgggataactgtaatcgatttagagccgataccatatgatcctaaatttgaaaaacaattgggacaggtgatgcttctaattttatgtgtaacacaggtgctcatgatgcgaacgacatgggcgttatgcgaagcactaacactggccaccggcccaatttctaccttatgggagggcaatcccggtcgattttggaataccactattgcagttagcatggccaatatcttcagaggaagctatttggccggcgctggtttacttttttccatcatgaaaaatacgacaaatacaaggcgtggaacaggcaatataggggagacattaggtgaaaaatggaaatcgcggttaaacgcccttggaaaaagcgaattccaaatatacaagaaaagtggaattcaggaagtagatagaactttagccaaagaagggataaaaagaggtgagactgatcatcatgctgtctcccgaggaagcgcgaaactaagatggttcgtagaacgaaatatggtcactcctgagggtaaagtagttgatctaggctgcggtagaggtggatggtcatactattgcggtggattaaaaaacgtacgcgaagtaaaaggcttaaccaaggggggccccggccacgaagaacccataccgatgagcacgtatggatggaacctagtaagattacagtctggtgtagatgtctttttcaccccacctgaaaaatgtgacacactactctgtgacattggagaatcttcaccaaatccgacaatagaggctggacggactcttcgagttttaaatctcgtcgaaaactggctgaataataacacgcagttttgtataaaagtccttaacccttatatgccgagtgtgatagaaaaaatggaggcattacaacgtaaatatggaggagccctagtaaggaatccattaagtagaaattcaacgcatgaaatgtactgggtaagcaacgctacgggaaatattgtaagctcagtaaacatgataagcagaatgttaatcaatcgtttcacgatgaaacacaaaaaagccacgtacgagccggacgtagacttgggtagcggaactaggaatattggaatagaaagcgagattccgaatcttgatataataggaaaacgaatagaaaagattaaacaggaacatgagacttcatggcattatgatcaagatcacccgtataaaacatgggcataccatggaagctatgaaaccaaacaaactggatccgcatcgagtatggtcaatggcgttgtacgtctactaacaaaaccatgggatgtagtaccgatggtgacacagatggcaatgactgacaccaccccattcggacaacaaagggtttttaaggaaaaggttgatacacgaacacaagaaccaaaagaggggacaaaaaaattaatgaaaatcactgccgaatggctctggaaagaactcggcaagaaaaaaacgccacgcatgtgtacccgagaggaatttacccgaaaagtacgcagcaatgcagcattgggcgcgattttcacagacgaaaataaatggaaaagcgcgcgtgaagcggtagaagatggaaggttttgggaattagtagaccgggagaggaatctccacttggagggtaagtgtgagacatgtgtttataacatgatgggaaaacgagaaaaaaagctaggtgagtttggaaaagcaaaagggagcagggctatttggtacatgtggttgggtgcaagatttttagagtttgaagcactcggtttcttaaatgaagatcattggtttagtaggggaaattcgctcagcggcgtcgaaggcgagggacttcacagattaggatatattctcagggacgtgggtaagaaagaagggggtgtaatgtatgccgatgacacagcaggttgggatacacggataactttagaggatctaaagaacgaagagctagtaacaaaccatatgaagggggaacacaagaaacttgctgaagccatcttcaaactaacctaccaaaacaaggtcgtaagagttcaacgtcctacacctaggggtacggtaatggatataatctcgcgccgtgatcaacggggtagtggtcaagtcggtacgtacggcctaaatacatttactaacatggaagcacaactgataagacaaatggagggagagggaattttcaaaagtatacaacacttgactgcaaccgaagaaattgcagtacaaaactggctcgcgcgtgtcggaagggaaagattaagcaggatggctatctcgggggacgattgtgtagttaagcccatagatgaccgatttgcatcggcattaacagcacttaacgatatgggaaaggtccgcaaagatatccaacaatgggaaccttccagaggatggaatgactggacacaagtacctttttgcagtcatcattttcacgaactagttatgaaagatggaagggtcctagttgttccgtgcagaaatcaagatgaattaatcgggcgagccaggatatcacagggtgctggttggtcactaaaagaaacggcctgcttaggcaaaagctacgcacaaatgtggacactaatgtattttcatagacgagatctaaggttagcggcaaacgctatatgtagcgctgtcccgtcccactgggtacccacctccagaacaacctggagtatacatgcaaagcatgagtggatgacaacagaagacatgcttgcagtatggaacagagtgtggattcaagaaaatccatggatggaggataaaactccagtggaaagttgggaggaggttccatatctgggtaaaagggaagaccaatggtgtggttcactcataggtttaacttccagagctacttgggcaaaaaacatacaaacagcaataaaccaggtccgatccctaataggaaacgaagaatacacagactatatgccgtctatgaagcgattcagaagggaagaagaagaagcaggagtattgtggtga

SEQ ID NO: 22453 - RNA, 9876 nt, synthetic construct
  misc_feature 1..9876: note = derived and/or modified CDS sequence (opt6) from DENV-2__EU482684__SS-prME
  source 1..9876: mol_type = other RNA
actgctggagtaatagtaatgttaataccaactgcgatggcatttcatttaacaactcgcaacggagaaccccatatgattgtaggacgacaggaaaaaggaaaatccttgttatttaaaacagaagatggagtaaatatgtgtacgctaatggcaatcgaccttggagaattgtgtgaagacacgatcacctacaaatgtccattgctaagacaaaacgaaccggaagatatagactgttggtgcaactcaacttccacctgggtaacatatggtacatgtacaaccacaggggaacatagacgtgaaaaacggtcagttgctttagtccctcacgttggtatgggtctagagactagaactgaaacatggatgtcgagtgaaggagcatggaaacatgtgcaaagaattgaaacgtggatcttaagacacccaggattcactataatggctacgattctagcttatacaattggaaccacgcattttcaaagggcgctgatatttatcctactaacagctgtagctccctctatgacaatgagatgcatagggatatctaaccgtgactttgtagagggagtaagtggaggatcatgggtcgatattgtattggagcacggtagctgtgttacaacaatggctaaaaacaaacctaccctagactttgagttaataaaaacagaagctaaacaaccggctacacttagaaaatactgtatagaggctaaactgactaatacgactaccgaaagccgatgccccacacagggagaaccaagtctcaatgaagaacaagataaaagattcatatgtaaacattcaatggtagacaggggatggggcaatgggtgcggattgtttgggaaagggggtatagttacatgcgctatgtttacttgtaagaaaaatatggaaggaaaagtagtgcaaccagagaaccttgaatacacaatagtaataacacctcatagtggtgaagaacacgcagtgggaaacgatacgggaaaacatggtaaagaaattaaaataacccctcagtcttccattacagaagcggaactcacaggatatggaacagtcaccatggaatgctcacctcgcacaggtttggattttaacgaaatggtattgctgcagatggaagataaagcatggttagttcacagacagtggtttttggatttgcccttgccatggttaccaggagcggatacacaaggcagcaattggatacaaaaagaaacattagtgacattcaaaaacccacatgcgaagaaacaagatgtagtagtattggggtcacaagaaggtgcaatgcacactgcattaacaggggcaaccgaaatacaaatgagtagtggcaacctactatttacaggacacctgaaatgccgattacggatggataaactacaattgaaaggaatgagctacagcatgtgcactggtaaatttaaaatagtcaaagaaatagcggagactcaacatggcactatagttataagagttcagtatgagggagatggttcaccctgtaaaatccccttcgaaataacagatctagaaaaacgccacgtactagggagactaataactgtgaatccaatcgtgacggaaaaagatagtccagtaaacattgaggctgagccaccctttggagactcctacatcataattggtgttgaaccaggacaacttaaacttaattggttcaagaaaggttcttccatcggacaaatgttcgaaaccactatgcgaggtgcaaaaagaatggctattctgggagacacagcatgggactttggctccttgggtggagtgttcacgtcgataggcaaagcacttcaccaagtttttggtgcaatttatggagctgcattctcaggtgtatcatggacaatgaagatattaatcggagtaattataacgtggataggtatgaactcaaggagcaccagtttaagcgtgagcttagtgttggtaggtgttgtaacattatacttaggcgcagtggtccaagctgattccggatgtgttgtgagttggaaaaataaggaattgaaatgcggcagtggtatatttattaccgataatgtgcatacctggacagaacaatacaaatttcaaccagagagtccatctaaactggcatcagctatacaaaaggcccatgaggaaggaatatgtggcattagaagcgttacgaggttggaaaacttaatgtggaaacaaattacaccggaactaaatcatattctaagcgaaaacgaggtaaaattaactataatgacaggagatataaaaggcataatgcaagcagggaaaagaagtttgcgtccccaacccactgaattaaagtatagttggaagacctggggcaaggcaaaaatgttatcgacggagtcacacaatcaaacgttcttaatagatggaccagaaacggcagaatgccctaatacaaatcgagcctggaatagtctagaggttgaagattatggattcggtgtatttaccacaaacatatggcttaagttgcgtgaaaaacaggatgtgttttgcgactctaaattaatgagcgcagctatcaaagacaacagggcagtacacgcagatatgggatattggatagagtctgccctcaatgatacatggaaaatggagaaagcatcctttatcgaggtaaaatcctgccattggccaaaatcacatacgctatggagcaatggtgtactggaatccgagatgattatcccgaaaaactttgcgggaccagtgtctcaacataattatagaccaggatatcacacccaaaccgcgggaccgtggcaccttggtaaactagaaatggattttgatttctgtgaaggaacgacggtagtagtaactgaggattgtggaaataggggcccatcacttaggacgaccaccgcatctgggaaacttattactgaatggtgttgcagaagttgcacattgcctcccttgcggtaccgcggggaggatggctgttggtatggaatggagattcgtccattaaaagagaaagaagagaatcttgttaattcactggtaacagcaggacacggacaaatcgacaatttttcactcggtgtcttaggtatggcgctatttctggaagagatgctacgtacgagaattggtacaaaacacgcgatattattagtagctgtatcattcgttacactaataacgggaaatatgagcttcagagacttgggtagagttatggtcatggtgggagcaactatgacagatgatattggcatgggggttacatatctcgcattactggcggcatttaaggtaagaccaacttttgcagcaggattgttattgaggaaattaaccagtaaagaattaatgatggcgaccattggaattgcattgttaagccaaagtacgattcctgagacgatactagaattaacagatgctcttgctctaggaatgatggttctaaaaatcgtcagaaacatggagaagtaccaactggctgttacaataatggcgatatcatgcgtacctaacgctgtcatcttgcaaaatgcgtggaaagttagttgtaccatattagctgctgtaagcgtatcaccactcctgctcacgagctcgcaacaaaaggcggactggatccctcttgcattgacaataaaaggtcttaatccaacagcgatatttttaactaccctatctagaacgtccaagaaaagaagttggccattgaacgaggctattatggcagtaggtatggtatctattctcgcttcttctctactcaaaaacgacatacctatgacaggcccgctagtagccgggggactattaacggtgtgttacgtactaacaggtaggagcgccgatctcgaactcgaaagagcagccgacgttaaatgggaagaccaagctgaaatatcaggcagtagcccaattctgtctatcacaatatcagaggacggttcaatgagtattaaaaatgaggaggaagaacaaacgttaaccatcttaatacgaacaggactcttagtaatatcaggcgtgttcccagttagtataccaataactgccgctgcttggtacttatgggaagtaaagaaacaaagagcaggggtactctgggacgtcccaagtccaccaccagtcgagaaggctgaattagaagatggagcgtatcgcataaagcagagagggattcttggttactctcaaataggggctggggtctataaagaggggacattccatacgatgtggcatgtcacacgtggcgcagtgttaatgcacaggggcaaaagaatcgaacccagttgggcagacgttaagaaagacttaatctcttacggaggagggtggaagttagaaggtgagtggaaagagggagaggaagtacaagtactggctttagagccagggaaaaatccgcgagccgtacaaaccaaacctggaatcttcaaaactaatactggtactataggagctgtatccttggatttcagtcccggaacgtccggaagcccgatagttgaccgtaagggtaaagtagtcggactctacgggaacggggttgtaacgagatctggtgcgtatgtgtctgcaattgcacagactgaaaaatcaatagaggacaatcccgagattgaagacgacatatttagaaagaaaaggttaacaataatggatttacatccgggtgccggtaaaaccaaaagatatttaccggctatcgtacgcgaagcaataaaacgaggacttagaaccttaatattagcgcctacaagggtggtggctgcagaaatggaagaagcactacgagggcttccaataagatatcaaactccagctataaaaacagagcatacagggagggaaatagtggacctcatgtgtcacgcaacttttaccatgcgcctcctctcacccgtcagggtaccaaattataaccttataataatggacgaagcacatttcactgatcccgcatccatcgcagcgagaggatatataagtacaagagtcgaaatgggagaagcggcaggtatctttatgactgcaacgccgccaggttcaagagaccccttcccacaatcaaatgcacccataatggacgaggagcgggaaatccctgagaggagctggaactctggacatgaatgggtaacagatttcaaaggcaaaacagtatggtttgtaccaagtattaaagcaggtaatgacatcgccgcatgccttaggaaaaatggcaagaaagtgatacagctttctagaaagacttttgatagtgaatatgttaaaacgagagcaaatgattgggattttgtagttacaacagacatttcagaaatgggggccaattttaaggctgaacgcgtaatcgacccaagacggtgtatgaaaccagtaatacttactgatggtgaggaaagggttattctcgcgggtcctatgccagtaactcactctagtgcagcacaaagaaggggaagaatcggtaggaacccaaagaacgaaaatgatcaatatatttacatgggagaaccactggaaaacgatgaagattgcgcccactggaaagaagcaaaaatgcttttagacaatataaataccccagagggaataattccgagtatgtttgagcctgaaagagaaaaagttgacgccatagatggagaatataggttacgaggagaggccagaaaaacatttgtagacttaatgagacgtggtgatctacccgtgtggctagcatataaggtagctgcagaaggaatcaactatgctgatcgcaagtggtgcttcgatgggattaaaaataaccaaatattagaggaaaacatggaggtagaaatttggacaaaagaaggcgagaggaagaagttgaaaccgcgatggttagatgcacgaatctacagcgatcccttggcgcttaaggaatttaaagaatttgctgcaggccggaaaagcctcacactgaacttaatcacagaaatgggtagactgccgaccttcatgacccaaaaagcaaggaacgcgctcgataacctggccgtcttacataccgctgaagccggtgggcgagcttataaccacgcgttaagcgaattaccagaaactttagaaacactattattgttgacattactagcgactgtcacgggtggtatatttctctttctcatgtcaggaaagggtatcggaaaaatgaccctaggaatgtgttgtataataacagctagcatactgttatggtatgcacaaattcagcctcactggatagcggcaagtataatactagagttctttctaattgttttgctaatcccggaaccagaaaagcaaagaactccgcaagataatcagctaacctatgtcgtaatcgctattttaaccgtcgtagcggctactatggccaacgaaatgggatttttggaaaagacgaagaaagacttaggcttagggtctataacaactcaggaaagtgaatcgaatattttagacatagatctaaggccagcgtcagcatggactctttatgctgtagccaccacgtttgttacacctatgctacgacattccatagaaaattcgtccgtgaatgtttccctaactgcaattgcaaatcaagccactgtactgatgggcttgggtaaaggttggccactttcaaagatggatatcggtgtcccattgttagcgattgggtgctacagtcaggtcaaccctatcactctaaccgctgcgttactacttctagtggcacactatgctattatagggcccgggctacaagcaaaggcgacccgagaagctcagaaacgagcagcggcgggcataatgaaaaacccaacggtagatggaataaccgtaatcgatcttgagccaataccgtatgatcctaaatttgagaagcaactaggccaagtaatgttactaattctgtgcgtcacacaggtattaatgatgcgaacgacgtgggccctttgtgaagccttgactttggccaccggcccaatctcaactctatgggaagggaatcctggcagattttggaatactacaatagcggtatctatggcaaatatattccgcggaagctatctagctggagccggactgttgttctcaataatgaaaaataccacatccacacgaagagggacgggcaacattggggaaacattgggagaaaaatggaaatccagacttaatgcattaggtaagtcagagtttcaaatttataagaaatctggcattcaggaagtcgacagaactctcgctaaagagggaataaaaaggggagagacggatcatcacgctgtttccaggggaagcgcaaaattacgctggtttgtcgagaggaatatggttacaccggaagggaaagtcgtagatctaggttgcggtcgaggaggttggtcgtactactgcggaggacttaaaaatgtacgtgaagtgaaaggactaaccaaaggaggcccaggacatgaagaaccaataccaatgtccacatatggatggaatttagtacgcttacaatccggtgtagatgtgttctttacgccacccgaaaagtgtgatacactgttatgtgacataggtgaatcttcacctaatcctacaattgaagcaggaaggactttacgagtattaaacttagtagaaaattggttaaataacaacactcaattttgtattaaagttttaaatccctacatgccgtctgttatagagaagatggaagccctccaaagacaatatggtggagccctagttcggaacccactaagtagaaatagtacccacgagatgtattgggtatcaaacgccacaggcaatatagtatcatctgttaatatgatatcgagaatgctaatcaatcgatttaccatgaaacataagaaagccacctacgagcccgacgtagatctaggatcaggcaccagaaatattggaatagaatcagagatacctaatctggacataatagggaaacgcattgaaaagatcaaacaggagcacgaaattagttggcattacgaccaggatcatccatataaaacatgggcatatcatggttcctacgagacgaaacagactggttcagcaagttcgatggtgaatggagttgttaggctactaaccaaaccctgggatgtagtcccaatggtgacgcaaatggcgatgacggacactactcccttcggacaacagagagtgttcaaggaaaaagttgacactagaactcaggaacccaaagaaggaactaagaaattaatgaaaattacggctgagtggctatggaaggagttaggtaagaagaaaacgccacgtatgtgtacaagggaagaatttacgaaaaaggttagatctaacgccgctttaggcgcgatatttacagatgagaacaaatggaaatcagcaagggaagcagtagaagatggccgattttgggaacttgtcgaccgtgaaaggaaccttcacctggaaggaaaatgtgaaacgtgtgtatacaatatgatgggaaaaagggagaagaaactgggtgagtttggaaaagcaaaaggttccagggctatatggtacatgtggctgggagcaaggtttttagagttcgaagcgcttgggttccttaacgaagatcattggttttcaaggggtaactccttaagcggcgtagaaggagaagggttgcacaggttaggttatatcttaagagatgttggtaagaaagaaggcggggcaatgtacgctgacgacacggcgggatgggatactagaataaccctagaggatttgaaaaacgaagaaatggtaaccaatcatatgaaaggggaacataagaaactagcagaagccatttttaagctaacctatcaaaataaggtagttagggtacaaagaccaacacctaggggaaccgtaatggatataataagccgacgcgatcaaagggggtctggacaagtaggcacctatggattgaatacgtttaccaacatggaggcccagttgatcagacaaatggagggtgaggggatatttaaatcgatacaacatttaacggctaccgaggagatagcagtgcagaattggctcgcaagggtaggtagagaaaggttatcacgcatggccatatctggtgacgattgtgtggttaagcctattgatgacagatttgcaagtgctttaacagcgttgaacgacatgggtaaggtccggaaagatatccaacagtgggaacctagccgaggttggaatgattggacgcaggtaccgttttgctcgcatcacttccatgaactcgtaatgaaagacggtagagttctagttgtaccatgtcgaaatcaagacgaactaattggccgcgcacgtatatctcaaggagccggttggtcgttaaaagaaactgcctgccttgggaaatcgtatgctcaaatgtggacattaatgtatttccatcggcgagaccttaggcttgctgctaatgcaatctgcagtgccgtaccatcgcactgggtcccaacttcaagaacaacatggagtatacacgcaaaacatgagtggatgactaccgaagatatgctggccgtatggaatagggtctggatacaagaaaatccgtggatggaagataaaacaccagtagaaagttgggaagaagttccgtacctcggcaaaagagaggaccaatggtgcggaagtttgatagggttaacatctagagcaacatgggccaaaaatatacaaacagccatcaaccaagttagaagtctaataggcaacgaagagtatacggattatatgccaagtatgaaaagatttcgacgtgaggaagaagaagccggtgttttatggtaa

SEQ ID NO: 22454 - RNA, 9876 nt, synthetic construct
  misc_feature 1..9876: note = derived and/or modified CDS sequence (opt6) from DENV-2__EU482685__SS-prME
  source 1..9876: mol_type = other RNA
accgctggagtaatagtgatgcttataccgacagctatggcattccatttaactactcgaaacggagaaccacatatgattgtcggacgtcaggaaaaaggaaagtcactgttgttcaaaacggaagacggagtaaacatgtgtacactaatggcaatagacctgggcgaactttgcgaggacacaataacctataaatgtccactacttcgacagaatgagccagaggatatcgattgttggtgtaattctacaagtacttgggtcacctatggaacctgcacaaccacgggagaacacagaagagaaaagagatcagtagccttagttccacatgtaggaatgggtctagaaacgagaacagaaacttggatgagcagtgagggtgcatggaaacacgttcaacgcattgaaacttggatactaagacacccgggatttacaatcatggctgcaatactggcctacaccatcggcacgacgcattttcaacgtgcacttatttttattctattaacagctgtagcaccgtcaatgaccatgagatgcataggaatctcaaatcgcgatttcgtagaaggagtttcaggcggttcatgggtggatattgtattagaacatggatcatgtgtaacaactatggcgaaaaacaaaccaacattagactttgagttaatcaaaactgaggctaaacaacccgccaccttgagaaagtattgtattgaagcaaagttgacaaacacaacaacagagtcaaggtgtccaacacagggggaaccatctttaaacgaagaacaggacaaaagatttatttgtaaacactctatggtagatcgagggtgggggaatggttgcggtttgttcggcaaaggagggatagtcacatgcgcaatgtttacatgcaaaaaaaacatggaaggaaaagtagtgcaaccggaaaatcttgaatatactatagtcataacaccccacagcggagaagaacatgccgtcgggaatgacaccggaaaacatggaaaagaaattaaaataactccacaaagttctattacagaagcggagcttactggatacggcaccgtgaccatggagtgcagcccacgaacaggtttagatttcaacgaaatggtattgttacaaatggaggataaagcctggttagtacatcgacagtggttcttagacttaccactcccttggttaccaggggctgatacacaaggctcaaattggattcaaaaagaaacactggtgacatttaaaaatccacatgctaaaaaacaagatgtagtagtgctaggaagccaagaaggggcaatgcatacagccctcaccggcgcaacagagatacaaatgtctagcggcaacttattgtttacagggcatcttaaatgtagactgagaatggacaaactgcaactaaaaggcatgtcatattctatgtgcacgggtaagtttaaaattgtaaaagaaatagccgaaacccaacacggaactattgtaatacgtgtccagtacgaaggggatggtagtccgtgtaaaattccgtttgaaattacggatctggagaaacgacacgtgttaggacgactcattacagtcaatccaatcgttacggagaaagattcacccgtcaatatcgaagcggagcctccatttggggatagttacattataataggtgttgaaccgggtcagctgaaattgaattggttcaaaaaaggttcatccattggccagatgttcgaaacaacaatgcgtggagccaagaggatggctatactaggggatacggcatgggactttggatcccttggaggggttttcacgtccattggcaaagcattacatcaagtatttggtgcaatatatggagcagcattttctggcgtgtcatggacgatgaagatattaataggggtcatcataacatggattggaatgaattctcgctcaactagcttgtcggtgagtttagttctagtaggagtcgttaccctgtatctaggggctgtagtacaggctgattcagggtgcgtagtatcctggaagaataaagaactcaagtgtggatcagggatttttataacggataacgtacatacatggacagaacagtataaatttcaaccagaatcacctagcaaactagcatctgcaattcagaaggctcatgaagaaggaatttgtggaatacgcagcgtaactagattagaaaaccttatgtggaaacaaataacacctgaactaaaccatatattaagtgaaaacgaagtaaaactcacaataatgacgggggatataaaaggaataatgcaggctggcaagcgttcgctacgaccacaaccaactgaactgaagtactcgtggaaaacttggggaaaggcaaaaatgctgagtactgagtcacacaatcaaacttttttaatagacggcccagaaacggcggaatgcccgaatacaaatagagcatggaatagtttagaagttgaagattatggcttcggcgttttcacaaccaacatctggctaaaattacgcgagaagcaagatgttttttgtgattcaaaattaatgtctgcggctattaaagacaacagagcagttcacgcagatatgggatattggatcgaatccgcactcaatgatacatggaagatggaaaaagcaagcttcatagaagtcaagtcatgccattggcccaaatctcacacactgtggtcgaacggagtattagaaagtgagatgataataccgaaaaacttcgcaggacctgttagccaacataactatcgtcccgggtaccacacacaaactgcgggtccttggcatttaggcaagctagaaatggactttgacttctgcgaaggcacaactgtcgtcgtaactgaagattgcggcaatcgcgggccaagtttaaggacgactaccgcatccgggaaattaataacagaatggtgttgcaggtcgtgtacactcccaccgttaaggtatagaggcgaggatggctgttggtacggtatggaaattcgtcctttaaaagagaaagaagaaaatctggtaaacagtctagtcacagccggcaatgggcaaattgataacttcagtctgggggtactcggaatggccttattcttagaagaaatgctaagaactaggataggtacaaaacatgcgatacttttagtagctgtatcgtttgtcaccttaataacaggaaatatgtctttccgagaccttggtagggttatggttatggtaggggcaactatgactgacgatataggaatgggagtgacttacttagcattacttgctgcattcaaggtaaggcccacgtttgcagctggtctattattgagaaaattaacaagtaaagaattaatgatggcaaccataggtatagcactattatctcaatccacgatacctgagaccatactagaacttacagacgcattagcattgggtatgatggtattaaaaattgttcgtaacatggagaaatatcaattagcagtgacaattatggctatctcgtgtgtcccaaacgcagtcatcttacaaaacgcatggaaagtgtcctgtacgatattagcagcggtctcggtctccccactactattaacgtcctcacagcaaaaagccgattggattcctctagctttgacaattaagggtctaaatccaacggccatatttctcactacattaagtcgaacgtccaaaaaaagatcgtggccgcttaatgaagcgattatggctgttggaatggtaagcatattagcaagcagtctattaaaaaatgatataccaatgacaggacctttagtagcaggaggtttgctaacagtgtgttatgtacttaccggacgatccgccgacttggaattagaacgggccgccgacgtgaaatgggaagatcaagccgaaatcagcggaagcagccccatactttctatcacaatctcagaggatggatcaatgtccataaaaaatgaagaagaggaacaaactctaacaatcctaattaggacaggtcttctagttatttcaggcgtttttcccgtaagtattcctataacagcagcggcatggtatttatgggaggtaaagaagcaaagagccggagtgctatgggatgttccgtctccgccaccggtagagaaggcggaattggaagacggtgcgtatcgaattaaacagagaggtatactaggatattcccaaataggagcaggagtatacaaagagggtacatttcatactatgtggcacgtaacgcgaggagcggtattaatgcatagaggaaaacgaattgaaccaagctgggcggatgtcaaaaaggatctaatcagttatggaggcggatggaaattagaaggtgaatggaaagaaggggaggaagtacaggtactagcactagaaccaggaaagaatccaagggctgtacaaacgaaaccgggtatctttaaaaccaacactggaacgataggtgcggtcagcttagatttctctccgggaacaagcggatcccccatagttgacaggaaaggaaaagtagtggggctttacgggaacggggttgttacaaggagtggagcgtatgtatcggcaatcgcacaaacagaaaagtccatagaagataatcctgaaattgaagatgatatatttcgaaagaaacggttaactatcatggatctgcaccctggtgccggaaaaacaaaaagataccttcctgcgatagtccgtgaagcaattaaacgagggttaaggacactaatactggccccaacacgtgttgtagcagccgaaatggaagaagcgttacgaggtctaccaataaggtaccaaactccagcgatcaaaacagaacacacaggacgagagatagtagatttgatgtgccatgcaaccttcacaatgaggcttttgtcaccggtacgtgtaccgaattataatctgataataatggatgaggcccattttacagatcccgcctcaattgcagcacgtggatacatctctacgagagtagaaatgggcgaagcagcagggatatttatgactgcaacacctcctggaagtcgggacccctttccacaatcaaacgccccaatcatggacgaggaaagagagataccagaacgatcatggaacagcggccatgagtgggtcactgacttcaaaggaaaaaccgtatggtttgttccttcaatcaaagcaggaaatgacattgctgcttgccttcgaaaaaatggaaaaaaagtaatacagctgtctagaaagacattcgacagcgaatatgtaaagacacgagctaatgactgggacttcgtagtcacaactgatatctctgaaatgggagctaacttcaaagcagagagggtaattgatccgagaagatgcatgaaacccgtaatcttaacagatggagaagaaagagtaattttggcaggtccaatgcctgttactcattcatctgctgcacagagaaggggtagaattggaagaaatccaaaaaatgaaaacgatcagtatatatatatgggggagccgttagaaaacgatgaggactgcgcacactggaaagaggcgaaaatgttattagataatattaacacccctgaaggcataataccaagcatgttcgaacctgagagagaaaaggtagatgcaattgatggagaataccgattaagaggggaagcaagaaagacatttgtagatttaatgagacgaggcgatctaccagtatggttggcgtacaaagtcgctgctgaaggaataaactatgcagaccgaaaatggtgtttcgacggtataaaaaataatcaaattctagaagagaacatggaggtcgaaatttggacgaaagagggagaacgaaagaagctaaagccacgatggcttgacgcacgtatatattcagatcccctagcactaaaggaattcaaggaattcgccgcaggtagaaaatccctcactttaaaccttattaccgaaatgggcaggttaccaacattcatgacacagaaagctcgtaatgcattagataatttagccgtcctgcatactgcggaagcgggaggcagagcttataaccacgcattgtctgagctgcccgaaaccctagaaaccttattattactgactttacttgcaaccgttacaggaggtatatttctttttttaatgtctggaaaaggcataggaaaaatgacactggggatgtgttgtataattacagcatcaatactactgtggtatgcacagattcagccacactggatagcggcctcaataatcctggagttcttcttaatagtactactaataccagaaccagagaaacagcgtactccccaagacaaccaacttacctatgtagtaatcgcaattttaacagtcgttgctgcaacaatggcaaacgaaatgggttttctcgaaaaaactaagaaggatctaggattgggcagtataacgacgcaagaaagcgagtcaaatattcttgatatagacttgcgtccggcatcagcgtggacgctgtatgcagtagcaaccactttcgtcacaccgatgctaagacattcaatagaaaatagtagtgtaaatgtatcactgacggccattgcaaatcaagctaccgtgctaatgggactaggcaaagggtggccactatccaaaatggacattggagtaccgctattggcaataggatgctattcgcaagtaaatcccataacactgaccgcggctctgttgttgcttgttgctcattacgcaataataggtccaggcctacaagcaaaggcgacacgtgaagctcaaaaacgagcggcagcaggaattatgaagaatccgactgtagatggaatcactgttatagatctggaaccaatcccatacgatccaaaatttgaaaagcaattgggacaagtaatgttgctcatactgtgtgtaactcaagtattgatgatgcgaacgacctgggcactgtgtgaagcattaaccctggcaacgggaccaatatcaactttatgggaaggcaacccaggacgcttttggaacactacaattgcggtgagcatggcaaacatattcagaggaagttatctagccggtgcgggtttacttttctctatcatgaagaacaccacatctacaaggagaggaacaggaaatattggtgaaactttaggagagaaatggaaaagtcggcttaacgcacttggaaaatcagaatttcaaatctataaaaagtcgggaatacaagaagttgatcggactcttgccaaagaggggattaaaagaggagaaaccgatcatcacgccgtgagtagaggatcagccaagttaagatggtttgtcgaaaggaatatggtgacaccagaaggtaaagtagttgacctgggatgcggaagaggaggctggtcatactactgcggtggtttaaaaaacgtacgtcaagtaaaagggctaacgaaaggggggcctggacatgaagagcccatccccatgtcaacgtacggatggaatcttgtacgattacaatcaggtgttgatgttttctttacaccacccgagaaatgtgatacgctattatgtgatataggagaaagtagtcccaaccctacaattgaagcaggtcgtactctaagagtcctaaaccttgtagagaattggctcaataacaacacgcaattttgtatcaaagtattaaacccctacatgccttctgtaattgaaaaaatggaggccttgcaacgtcaatatgggggcgcacttgttcggaaccctctttctcgtaatagcacacatgaaatgtactgggtcagcaacgctacagggaatattgtttcaagtgttaatatgatttcacgtatgctaattaataggtttacgatgaaacataaaaaagcaacttatgaaccagacgttgacctaggaagcggaactcgaaacatcggcattgaaagtgagataccgaacttagatatcataggtaagcgtatcgaaaaaataaaacaagaacacgaaatatcatggcattatgatcaagatcatccatacaaaacatgggcctatcacggatcatatgaaacaaaacaaacagggtcggcaagttcaatggtaaatggagtcgtacgactattaactaaaccatgggacgtggtaccaatggtaacgcaaatggctatgacggataccacaccttttggacaacaaagagtttttaaggagaaggtagacacacggacccaggaaccaaaagaaggtacgaaaaaattgatgaagataacagccgaatggttatggaaagaactgggaaaaaagaaaactccgcgaatgtgtacgagggaagaatttactaaaaaggtgcgatcgaatgcagctctaggggcgatatttaccgacgagaataaatggaaatcagccagggaagcggtagaggatggacgattctgggagctggtagatagggaaagaaatcttcatctcgaagggaaatgtgaaacatgcgtatataatatgatgggaaaaagagaaaagaaattaggagagttcggaaaagccaaaggttctagagcaatttggtatatgtggttaggagcacgtttcctggaattcgaagctttgggttttctaaacgaagaccattggtttagtcgaggcaattctttgagtggagttgaaggagaagggctccataggttgggatacatactcagagatgtaggaaaaaaagaaggaggcgccatgtacgctgatgatacagcaggatgggatactagaatcaccttagaagacctgaaaaatgaagaaatggtcacaaatcatatgaaaggtgaacataaaaaacttgcagaagcaattttcaaattaacgtaccaaaacaaagtggtaagggtgcagaggcccacaccgcgcggtacagttatggacattatttctcgaagagaccaacgcggtagcggacaagtcggtacgtatggcctcaatacatttacaaatatggaagcgcaactaatacggcaaatggaaggagaaggtattttcaaatctatccaacatttaactgcgacagaagaaatagctgtgcaaaactggctagcccgcgtgggacgcgaaagattgtcaagaatggcaattagtggtgacgattgtgtagtcaaaccgatcgatgatcgctttgcaagtgcgctgacagctctaaatgacatgggaaaggtgcgaaaagatatccaacagtgggaacctagtcggggatggaacgactggactcaagtaccattttgttcgcatcattttcacgagttggtaatgaaagacggaagagttctcgtagttccctgccgtaatcaagatgagctcatcgggagagcgcggatttcacaaggggcgggatggtcattgaaggagactgcatgtttaggcaaatcttatgcccaaatgtggacattaatgtattttcataggagggacttgagattggcagcaaatgcaatatgcagtgcagtaccatctcactgggtacctacaagccgtacaacgtggtctattcacgcaaaacacgaatggatgaccacagaagacatgttagcggtttggaaccgcgtctggatacaagaaaacccgtggatggaagataaaaccccagtagagtcatgggaagaagtaccgtacctgggaaaacgagaagatcaatggtgcgggtcgctcatcgggttgacttcgcgagcaacatgggctaaaaatatacaaactgctattaatcaagtgagaagtctaattggaaatgaggagtacacagactatatgcctagtatgaaaagattcagacgggaggaagaagaagcgggagtgttatggtag

SEQ ID NO: 22455 - RNA, 9876 nt, synthetic construct
  misc_feature 1..9876: note = derived and/or modified CDS sequence (opt6) from DENV-2__EU482687__SS-prME
  source 1..9876: mol_type = other RNA
accgcaggagtaatagttatgttaataccgacagctatggcttttcatctaacgacccgtaacggggaaccgcatatgatagtaggtagacaagaaaaaggaaaatcactgcttttcaaaacagaagatggagtgaacatgtgcactctaatggcgatagatcttggagaattatgcgaagatacaattacatataaatgtccactattacgtcaaaatgaaccagaagacatagactgctggtgtaattctacatcaacatgggtaacatacggcacatgtacaacaacaggagaacatcgcagagaaaaacggtctgtggctttagttcctcatgtgggaatgggattagagacaagaacagagacatggatgtcatcagagggagcttggaaacatgttcaacgaattgaaacatggattctaagacaccctggattcactataatggcagcagttttagcatacaccattggtacaacacacttccaaagagcgcttatttttgtccttcttacagcagtagcacccagcatgaccatgcgatgcataggcatctctaacagagacttcgttgaaggagtaagcgggggtagttgggtagatattgtccttgagcatgggtcctgtgtaacgactatggccaaaaataaacccacgcttgactttgagttaataaaaactgaagctaaacaacccgctacattaagaaaatactgcatcgaggcgaaattgaccaataccacaactgagagtagatgcccaacacaaggggagccttcactcaatgaggaacaagataaacgctttatttgtaaacactctatggtagatagaggctgggggaacggatgcggactgtttggaaaaggaggtatcgtgacttgtgctatgtttacttgcaagaaaaatatggagggcaaagttgtccaaccagaaaacttagagtacaccatagtcataactccccactcgggcgaagaacacgcagtaggcaacgatacgggaaaacacggaaaagaaataaaaattacaccgcaatcgagtataactgaagcagaactcacgggatacggaacagtaaccatggaatgcagtccgcgcacgggactggattttaatgaaatggtcctcttacaaatggaagataaagcatggttggtacacagacaatggttcctcgacttaccgcttccctggctacctggagctgatacccaaggctcaaattggatacaaaaagaaactcttgttacttttaaaaatcctcacgctaagaaacaagatgtggttgtgttaggaagccaagagggggccatgcatacggcccttacaggtgcaacagaaatacaaatgtcctcaggaaatctactgttcacaggtcacctcaaatgtagactcaggatggacaaattgcaactgaaaggaatgtcatatagtatgtgtacaggcaaattcaaaatagttaaagaaatagcggaaactcaacacggtacgattgtcattagagtccaatacgaaggtgatggttccccctgtaaaattccatttgaaattaccgacctcgagaaaagacacgttctcggtcgactcataaccgtaaatccgatcgttacagaaaaagactctcccgtaaatatagaagcagaaccccctttcggagactcctacatcattataggggtagagcctggccaactcaaattaaactggtttaagaaagggtcaagcattggacaaatgtttgagactacaatgagaggtgctaaaagaatggcgatattaggggatacagcatgggactttggatcgttaggaggggtatttacaagtattggaaaagcacttcatcaagtattcggagccatatacggggctgctttttccggagtttcgtggacaatgaaaatattaatcggagtaataataacttggatcggtatgaacagtagaagtacaagtctatctgtaagtctcgtattagtcggtgtagtaacgttataccttggagcagtcgtccaagcggattcaggatgtgtagtatcatggaaaaacaaagaactgaaatgcggaagtggtatatttataacagataacgtccatacctggacggagcaatacaaattccaacctgaatcgccaagtaaattagcctccgcaatacaaaaagcacacgaagaaggcatatgtggcatcagatctgttacgcgcttggaaaacctgatgtggaaacaaataactcctgaattaaatcacatactaagtgaaaacgaagtcaaattaacaataatgacaggtgacattaaaggcattatgcaagccggaaaaagatccttaagacctcaacccactgaattgaaatattcgtggaaaacctggggtaaagctaaaatgttgtccactgaaagccataatcaaaccttcttgatagacgggccagagacagcagaatgtccaaacaccaacagggcatggaactcattggaagtagaggactacggtttcggtgtttttactacgaacatttggctgaaactgagggaaaaacaagatgtattttgtgacagcaaactaatgagcgccgcaataaaagataatagggctgtacacgctgatatgggatattggatcgaaagtgctctaaatgatacatggaaaatggaaaaagctagttttatagaagtaaaatcatgtcattggccaaaatcacatacactatggagtaacggagtattggaatcagaaatgataatacctaaaaacttcgccggacctgtaagtcaacacaattatcgcccagggtatcacacacaaacagcgggtccttggcatcttggaaaactggaaatggattttgacttctgtgaggggactactgttgtggtcactgaggattgtggcaatagaggaccaagtttaaggactactacagcatcgggcaaactaattactgaatggtgttgtaggtcgtgtacgttgccacctctacggtatcgaggggaggatggatgttggtacggaatggaaatccgtccacttaaagaaaaagaggagaaccttgtaaatagcttagtaacagcaggacacgggcaaatagataattttagccttggtgtgctgggcatggcgctattcttagaagaaatgttaagaacgagaatcggaaccaaacatgcaatactcctcgtagcagtttcgtttgtaacgttaataacagggaatatgagttttagggacctggggagagtaatggttatggtcggagcaacgatgacagacgatattggcatgggggtaacgtatcttgccttgttagcggcatttaaggttcgtccaacattcgccgctggtcttttattaagaaaattaacttcaaaagaattaatgatggcaactattggaatagctttactatcacaaagtacgattccggagacaatcttagaactgacagatgcacttgctttaggtatgatggtattaaaaatagttaggaacatggaaaaatatcaactagcagtcacaatcatggctatctcgtgcgttcccaacgctgtcatattacaaaatgcctggaaagtgagctgtacaatactggcagcagtgagcgttagcccactgttattaacaagtagtcaacagaaagcagattggattccacttgcacttactataaaaggtcttaatcctaccgcgatatttttaactacactctcaagaactagcaagaaaagatcttggcccttaaacgaagcaataatggctgttggtatggtatcgattctagcttcgtcccttttaaagaatgacatacccatgactggccctttagttgcgggaggtcttttaactgtttgctatgtactaaccggcaggtcggcagatcttgagttggaaagagccgccgatgtcaaatgggaagaccaagctgaaatcagtggttcatccccaatcttatcaattaccattagcgaagatggatctatgagtattaaaaacgaggaagaagaacaaactttgactatactcatccgtaccggactcctggtaatatcaggtgtttttcctgtgtctatccccataacagctgcagcttggtatttgtgggaagttaaaaagcaaagagccggtgtgttatgggatgtaccaagtccgcctccagttgaaaaagcggaattggaagatggcgcttaccggattaaacaaagggggattctcggttattcacagatcggcgctggtgtatacaaggaagggacatttcacacaatgtggcatgtaacccgaggtgcagttctaatgcatcgaggcaaaaggatagaaccatcatgggcggatgtcaagaaagatctaataagttatggaggaggttggaaattagagggagagtggaaggagggagaagaggtgcaagttttagcactggagccagggaaaaatccaagggcagtgcaaaccaaaccgggaattttcaaaaccaacacgggaacaataggagcagtatctctagatttctcaccaggaacctcgggtagccctatagttgaccgtaaagggaaggtagttggtctgtacggcaatggcgtagttacaagatcaggagcgtatgtctcagcaatagcacaaactgaaaagtcaattgaagataatccagaaatagaggacgacatcttcaggaagaaaagattgacaattatggacctacaccctggagccggaaaaactaaacgttatctaccggcaatagttcgcgaagcgatcaaaagaggcctgcgtaccctcatattagcaccgacacgcgtcgtcgcagcggagatggaggaagcgttacgcggtttaccgatacgctatcaaactcctgcaattaaaacagaacatacaggtcgagaaattgttgatttgatgtgtcacgcaacgttcacaatgcgtctcctgagccccgttagagtaccgaattacaacttgataataatggatgaagcgcattttactgatcctgcctcaatcgcagcgaggggatacatatcgactcgagtggaaatgggtgaagcagcgggtatatttatgaccgctacgccaccaggaagccgtgacccatttccacagtcgaacgccccaatcatggatgaagagagggaaatccccgaaaggagctggaactctggccatgagtgggttacagatttcaaagggaaaaccgtctggtttgtcccttctataaaggcaggcaacgatatagcggcatgtctcaggaaaaatggcaagaaagttatacaacttagtcgtaaaacctttgattccgaatacgtcaaaacccgtgctaacgactgggattttgtagttacgaccgacatttccgaaatgggagcaaacttcaaagcagagagagttatagacccaagaagatgtatgaaaccagtcatattaacagacggtgaagagagagttattttggcaggtcctatgcctgtcactcattcgtcagctgcccagagaagaggtagaataggtcgaaaccctaaaaatgaaaacgaccagtatatttatatgggagagccactggaaaatgatgaggattgtgcacactggaaagaagcgaaaatgttgctcgacaatataaatacaccagagggaattatcccttcgatgttcgagccagagagagagaaggttgacgcaatagatggagaatatcgactgcgaggagaagcacggaagactttcgttgatctgatgcgtagaggagacttacccgtgtggttggcgtataaagttgcagctgaaggaataaattacgctgaccgaaaatggtgcttcgatggcatcaaaaacaaccaaatccttgaagaaaatatggaagtagaaatatggaccaaagaaggcgagagaaagaaactaaagccaagatggcttgacgcccgtatatactctgacccactagcgctaaaagaatttaaagaatttgcagcaggtcgtaaatcgttaactctcaacctcataacggagatgggacgattacctacctttatgacacaaaaggcccgaaacgccttggacaatctcgcggtcttacatacggcagaagccggcggtcgcgcttataaccatgcattaagtgagctaccagagactttagaaacgttattattgttaacactcctggccacagtaaccggcggtatattcctcttcttaatgagcggtaagggtatagggaaaatgacgcttggtatgtgctgtataataacagctagtatattattatggtacgcacaaattcaaccccactggatcgcagcgagtataattctagagttcttccttatagtcttactcatacccgaacccgaaaaacaacggacaccgcaagacaatcaattaacttacgtggttatagccattttaacagtagttgcagcaaccatggcaaatgaaatgggcttcctggaaaagaccaagaaggatctaggactaggctcgatcacaacacaagagtcagaaagtaatatacttgacatagatctgagaccagcatctgcatggacgctctatgcggtggcaacaacttttgtaactcccatgctaagacattcaattgaaaactcatcagtaaacgtatctttaactgccatagctaatcaagcaacagtactcatgggattaggaaaagggtggcctctgtcgaaaatggacattggagtaccactactagcaataggttgttacagccaggttaatccaataacactcacagcagcactcctgctcctagtggcccattatgcaattataggccctggtcttcaagccaaagcaacacgagaagcacagaaaagagctgctgcaggaataatgaaaaacccaactgtagacggaataacggtcatcgatctagagccaataccatatgatccaaaatttgaaaagcaattgggacaagttatgctactcatactttgcgtaactcaggtattaatgatgcgcacgacatgggctttgtgtgaagccctaacactggcgacaggcccaatctccacattatgggaaggcaaccctggacgattttggaacacaacgattgcggtctccatggcgaacatatttcgaggtagttatcttgctggcgcaggcttactttttagcattatgaaaaatacgactagcacccgaaggggaacaggcaatataggtgagacactaggtgaaaaatggaaaagtcgactaaatgcacttggtaagtctgagtttcagatatataagaaatctggcatacaggaggtagaccgtactctagcgaaagaaggcataaaaagaggcgaaacggaccatcacgccgtatcacgaggaagtgcaaaactcaggtggtttgtggaacgaaatatggttacgcctgaagggaaggtagtcgatctaggctgcggacgtgggggatggtcatattattgtggtggtctcaaaaacgtacgggaggttaaaggccttaccaaaggaggcccaggccatgaagaacctatacccatgagcacatacggatggaacttagtaagattacaatcaggagttgatgtctttttcacaccacctgaaaaatgtgatactctgttatgtgacataggtgaatcatctccgaatcctacaattgaagccggcagaaccctgcgtgtattgaacttagtggaaaattggttaaataacaatacacaattttgcattaaggttcttaatccatatatgccatcagtaatagagaaaatggaggcactccaacggcagtatggaggggcacttgttcgtaatcctctatcacgaaattcaactcatgagatgtactgggtatcaaacgcaaccggcaatatcgtaagttctgtcaatatgatatcgcgaatgctcataaatagatttacgatgaaacataagaaagcgacttacgaaccagacgtggacttgggaagcggaacgcggaatatagggatagaaagcgagataccaaacttagatataattggcaagcgtatcgaaaagatgaaacaagaacacgaaatctcctggcattacgaccaagatcatccctataaaacttgggcatatcacggatcgtatgagactaaacaaactggtagcgcatcgtcgatggtaaatggggttgttagattacttactaagccctgggatgtcgtacctatggtcacacaaatggcgatgactgatacaacccccttcggacaacaaagagtcttcaaagaaaaagtagacacaaggacacaagaacccaaagagggaacaaagaagttaatgaagattactgccgaatggctctggaaagaattaggcaagaagaaaaccccacgtatgtgcacaagggaagaatttactaggaaagttagaagtaacgcggccctaggagctatttttactgatgagaataaatggaaatcagccagggaagcagtggaggatggacgtttttgggaactcgtggacagggaacggaatttgcatctagaaggcaaatgcgaaacatgtgtttacaatatgatgggcaaaagggagaagaaattgggcgaatttgggaaagcaaagggctcaagggcgatatggtacatgtggttgggagcgagattcctagagttcgaggctctcggttttctgaatgaagaccattggttttccaggggaaattccctatcaggtgttgagggcgagggactacatcgcttaggctatatattgcgcgacgtgggaaagaaagaagggggagctatgtacgctgatgacaccgcaggatgggacactcgaattaccctagaggatctgaaaaatgaagaaatggtcactaatcatatgaagggcgaacacaagaaactagcagaagccatcttcaaattgacttatcaaaataaagttgttcgagttcaacgtcccacgccaaggggaacagtaatggatattatctccagacgcgaccagcgagggagcggtcaggttggaacgtatggattgaatactttcacaaacatggaggctcaattaatcagacaaatggaaggtgagggtatattcaaatccatacaacatctaacagcaaccgaagaaatagctgtacaaaactggcttgcaagagtaggacgtgaaagattaagtcgcatggcgatatctggagatgattgcgttgtaaaaccaatcgacgatagattcgcttctgcactgacggccctaaacgacatgggaaaagtaaggaaagatatacagcaatgggaaccatcgcgtggctggaatgattggacgcaggtccctttttgcagtcaccattttcacgaattagtcatgaaagacggaagagtattagttgttccatgtaggaaccaagatgaattaatagggagagcgagaatatctcaaggggccggatggtctctcaaagaaacagcctgtctgggcaaaagctacgcacaaatgtggaccctgatgtattttcataggagagatttgaggcttgcggcaaatgcaatatgttcagcagttccatcacactgggtaccaacaagtcgaactacatggtcaattcacgcaaaacatgaatggatgactaccgaagacatgttggcggtatggaatagagtttggatccaggaaaacccatggatggaagacaagacaccagtagagtcttgggaggaagtgccatacttaggaaaaagagaagatcaatggtgcggatcattaataggtttaacatcaagagcaacatgggccaagaacatacaggccgctattaatcaggttaggtccttaatcggtaatgaagaatatacagactatatgccaagtatgaaaaggtttcggcgggaagaagaggaggcaggcgtattatggtaa

SEQ ID NO: 22456 - RNA, 9876 nt, synthetic construct
  misc_feature 1..9876: note = derived and/or modified CDS sequence (opt6) from DENV-2__EU482688__SS-prME
  source 1..9876: mol_type = other RNA
actgcgggagttatagtcatgctgatacctacagcaatggcttttcacctcactacaagaaatggggaaccacatatgattgtaggccgacaggaaaaaggcaaaagcttgttatttaagacagaagatggggtaaatatgtgcactttaatggctatagacttgggagagttatgtgaagatacaatcacttataaatgccctctacttcgacaaaatgaacctgaagatattgattgctggtgtaatagtacatctacttgggttacttatggaacgtgcaccactacaggagaacatagaagagaaaaaagatccgtagcgttagtaccccacgtcggaatgggattagaaacacgtacagaaacctggatgtcatcggaaggtgcgtggaaacatgtgcaacgaatagagacatggatactaagacaccctggcttcacaattatggccgctatacttgcgtatacaatcgggactacccacttccaaagagcattaatttttatcctattaaccgcggtagctccatcaatgacaatgaggtgtattggcattagtaatagggacttcgtagaaggagtatcaggggggtcctgggtggacatagtattagagcatgggtcttgcgtaacaactatggccaaaaataaacccacattagactttgaattgataaaaacagaggctaagcaaccagcaacactcaggaaatattgtatagaggcgaaactaactaataccactaccgaatctcgctgtccgactcaaggagaaccgagtttaaatgaggaacaagataaacgattcatttgtaaacattcgatggttgataggggttggggcaacgggtgcggtttattcggaaagggagggattgtcacctgtgcaatgtttacgtgtaaaaaaaacatggaaggtaaggtagttcaaccagaaaacctagaatatacaatagtaataacaccccactcgggggaagagcatgcggtaggaaacgacactgggaaacacggtaaagaaataaaaatcacgccacaatcatctatcacagaagcagagttaaccggctacggcaccgtcaccatggaatgctctccaagaaccggcctagacttcaatgagatggttctgttgcaaatggaagataaagcatggttagtacacaggcagtggttcttagatttgcccttaccatggttaccgggagctgacactcaaggcagcaactggatacaaaaagaaacgttagtaacatttaaaaatccacacgctaaaaagcaggatgttgtagtattgggatctcaagaaggggcgatgcatacagccctaactggggcaacagagatacagatgtcgtctggaaatttgttatttaccggtcacttaaaatgtcgattgagaatggataaacttcaattaaagggaatgtcgtattcaatgtgtacggggaagtttaagattgtaaaagaaatagccgaaacccagcatggtacaatagtcatccgcgtacaatatgagggggatggttcaccttgtaaaatacccttcgaaataacggatttagaaaaaaggcatgtactgggccgtttgattacggttaacccaatcgtgattgaaaaagatagcccagtcaatatagaagctgaacctcctttcggagactcatatataattatcggggtagagcctggacagttaaaattaaactggtttaagaaaggatccagtattggccaaatgttcgagaccactatgagaggtgctaaaagaatggcaatactcggtgacactgcatgggattttggcagtctaggtggagtgtttacaagcataggaaaagcattacatcaagtctttggcgctatttacggtgcggcgttctctggtgtatcttggacaatgaaaatcttaattggagttatcattacgtggattggcatgaactcccgaagcacatcactaagcgtctccctagttctggtcggcgttgttacactatatcttggagccatggtacaggcagatagtggatgcgtagtcagttggaagaacaaagaattaaagtgtggttctggaatctttataacagataatgtacatacctggacagagcaatataagtttcagcctgaatcaccgagcaaattagcttctgcaatacaaaaagcacatgaggaagggatctgcggtataaggagcgtgacaagattagaaaatctaatgtggaagcaaataactcccgaattaaatcatatattatcagagaacgaagtgaaattgacaataatgactggcgacataaggggaataatgcaagctggaaaaagatcactccgccctcaaccaaccgaacttaagtattcctggaaaacctggggcaaagcaaagatgctgtcgacagagtcgcacaaccagacctttttaatagacggtccagagacagcagaatgtcctaatacaaatagagcatggaattctcttgaagtggaagattacggcttcggagtatttactaccaatatttggctgaaattaagagaaaaacaggatgtcttttgtgatagtaagttaatgagtgctgctataaaggacaacagggcggtccatgcagatatggggtattggatagagagtgcacttaatgacacttggaaaatggaaaaggccagtttcatcgaagtcaagtcttgccattggccaaaaagtcacacactctggagtaacggggtccttgaaagtgagatgattataccaaaaaatttcgcaggacctgtcagccaacacaattatagacctggctatcatactcaaaccgctggtccatggcatcttgggaaactcgaaatggactttgacttgtgtgagggtacaactgtggtagtcactgaggattgtggaaatcggggtccctctttgagaaccactacagcatcgggcaaacttataacagaatggtgttgccgctcgtgcaccttaccaccgctacgttatcgtggcgaagacggatgctggtatggaatggaaataaggcctctaaaagaaaaagaagagaacttggtgaatagtttggtcacggcaggacatggccaaatagataatttttcacttggcgttctcggtatggcactattcctcgaagagatgctacgaacaagaatcggaactaagcacgcaatactcttagtagcggtatcactggtcacactaattacagggaatatgagttttagagatttaggaagagtaatggttatggtgggagctaccatgactgatgacataggaatgggagtaacatatctagcactattagctgcctttaaagtgagaccaaccttcgccgctggtctactattaagaaagctaacatcgaaagaactaatgatggcaacaatagggattgcattattatctcaaagtaccataccggagactatacttgaactcacggatgcacttgccttaggaatgatggttctgaaaatagttagaaacatggaaaaataccaactggcagttacgataatggcaatatcctgcgtaccaaacgcggtaatattacagaacgcctggaaagtctcctgtactatcttagcagcagtttccgttagtccattactcttaacttccagccaacaaaaggcggattggattcccctagctttaacgataaaggggctaaatccaaccgcgatttttttgacaactctatcacgcacatcgaaaaagcgatcgtggccgttaaatgaagctataatggcagtaggaatggtaagtatattagcttcaagtcttttaaaaaatgacatcccaatgactggtcctttagtagctggtggattactaaccgtctgttacgtactcaccggaaggtcagccgacctagagttagagagggccgcagatgtaaaatgggaagaccaagcagaaattagtggctctagccccatactatcaataacaatttcagaggacggctcaatgtcaattaaaaatgaagaagaagaacaaactctaactatcctaataagaacaggattattagttatctcaggtgtatttccggtgagtattccaattaccgcggcagcctggtacttatgggaggtaaagaaacaacgagccggagtactctgggatgtcccttccccacctcctgttgaaaaggctgaattagaagatggcgcttacaggatcaaacaaagagggattctaggttattctcaaataggcgctggagtatacaaagaaggaacattccacacgatgtggcacgtaacacgaggagcagtactgatgcatagaggaaagcggatcgaaccctcatgggccgacgttaaaaaggacctaataagttatggaggaggctggaaattagaaggagaatggaaagaaggagaagaagtgcaggtcttagctctagagcccggaaaaaaccctcgggctgtacaaacaaaaccaggaattttcaagacaaatacaggtacaataggggccgtaagtttagatttttcccctggaacttcaggtagccccatagtcgacagaaagggtaaagtagttggcctatatgggaatggggttgttacaagatcaggcgcatacgttagtgcaatcgcacaaacggaaaagtccatagaggataaccccgaaatcgaagatgacatctttagaaagaaaagattgacaatcatggatcttcatcctggtgcagggaaaactaagagatatttacctgcaattgtacgagaggcgataaagcgaggactgcgtaccttaatattagcacctacaagggtcgtagctgctgaaatggaagaagctctacgaggattgccgatcaggtaccaaaccacagcgattaagactgaacataccggacgcgaaatcgtggatttaatgtgtcatgctactttcactatgcgattattaagccctgtaagagtgccaaattacaatcttattattatggacgaggcacacttcacagatcctgcttctatcgcagctcgaggctacatatcaactagggtcgaaatgggtgaagctgcgggaatttttatgactgccactccgcctggtagtagagaccccttccctcaatccaatgcgcctataatggatgaagagcgcgaaattcccgaacgaagctggaattcaggacatgaatgggtaacagatttcaaaggaaaaaccgtgtggtttgtaccgtctataaaggcgggcaacgatattgcggcttgtctcaggaaaaatggaaagaaagtaattcaacttagccgaaaaacattcgatagtgaatatgtgaagacgcgagcaaatgattgggactttgtagtaacaactgacatttcagagatgggagcaaactttaaggcagaaagagtgattgatcctagaaggtgcatgaagccagtaatacttactgatggcgaagaaagggtaatattagctggccccatgccagttacacactcatccgctgcgcaacgacgtggtagaataggaagaaaccctaaaaacgagaatgatcaatatatatacatgggtgagccccttgaaaacgatgaagactgcgctcactggaaagaagcaaaaatgttacttgacaacataaatactcccgaaggaattataccaagcatgtttgagccagagagagaaaaagttgatgcaatcgacggggaatatcgattaagaggcgaagctaggaaaacatttgttgacttaatgcgacgaggagatctcccagtatggctcgcgtacaaagttgcagcggagggcataaactatgcagaccgaaaatggtgttttgacggtataaaaaataatcaaatattggaagaaaacatggaggtcgagatctggacaaaggaaggcgagaggaaaaaacttaaaccaagatggctggatgcacgtatttattcagacccgctagccttaaaagagtttaaagaattcgccgctgggcgtaaaagtttaaccttgaacttgattaccgaaatgggaagactaccaaccttcatgacacaaaaggcccggaatgcattagacaatttagcagttctgcatactgcagaagcgggagggcgtgcttacaaccacgcattgtccgaattgccggagacattagaaacgcttctattactcaccttgctggcgactgtaaccggaggtatttttctattcctaatgtcaggaaagggaattggcaaaatgactctcggaatgtgttgtattatcaccgcttcaatactattgtggtacgcgcagatacaacctcattggatagcagcctcaattattttagaatttttcctcatcgtgctgcttattccagaaccggaaaagcaacgaacacctcaggataatcagctcacctatgttgtaatagctatactgacggttgttgcagcaaccatggccaatgaaatggggttccttgagaaaacaaaaaaagatctcggattggggtccataacaacgcaggaatccgaaagtaatatactggacatagatctaagacccgccagtgcgtggacactctacgctgtagccacaacatttgtaacgcctatgctacgccattcaattgagaactcctcagttaatgtatcattaacagctatagcaaaccaagccactgtgttaatgggtctgggtaaaggctggccgttgtcaaagatggacattggtgtaccattattagcaattgggtgttactctcaggtaaacccaattacactcacagcggccctactccttctcgtggcacattatgcaattataggcccaggacttcaagcaaaagcgacgagagaagcacaaaagagagcggcagcgggaatcatgaagaatccaacggttgatggtatcacagttatcgatctagaaccaattccctacgacccgaagtttgagaaacaattaggtcaagttatgcttttaatattatgtgtcactcaagtactgatgatgagaactacatgggcactatgtgaagctctaacactagcgaccggaccgattagtaccctctgggaagggaatccaggccggttctggaacacaactatagccgtatcgatggcaaatattttcagaggttcctacctggctggcgctggactacttttttcaatcatgaaaaatacaactaatacaagacgcgggaccggaaacatcggtgaaacactgggagaaaaatggaaatctagactgaacgccctgggaaaaagcgaattccaaatatataagaagagtggcattcaggaagtagatcgtaccctagctaaagaaggaattaaacgaggggaaactgatcaccacgcggtctcaagaggctcagcgaaactacgctggtttgtagaaaggaacatggtaactcccgaggggaaggtcgtagatctgggttgtggaaggggcggctggtcatattactgtggaggactgaagaatgtgagagaagtgaaagggttaaccaaagggggacctggccatgaggaacccatccctatgagtacatatggttggaacctggttagattgcaaagtggtatagatgtattttttacgccccctgaaaaatgcgacacactgctctgtgatattggggagagcagccccaatccaacgatagaagcgggtaggacgctaagagtgctaaatttagtcgagaactggttaaataacaacacacaattctgtatcaaagttttgaatccttacatgccatcagtgatcgagaaaatggaagctctacaacgaaaatatggtggggcacttgttcgaaatccgctaagtcgaaattcaacccatgaaatgtactgggtctcgaacgcaactggtaatatagtctcgagcgtgaatatgatttcaaggatgctgattaacagattcacaatgaaacacaagaaagctacatatgagcctgatgtcgatttgggtagcggaacaagaaacatcgggatagaatctgaaattcccaatttagacatcatagggaaacgcattgaaaaaatcaaacaagaacatgaaacgtcctggcattacgaccaagatcatccatataagacatgggcatatcatggatcgtacgaaacaaaacaaacaggatccgccagttccatggtcaatggtgtagtgcgacttcttacaaaaccttgggacgttgtccctatggtgacacagatggcgatgactgacacaacaccatttggacaacaacgagtcttcaaagaaaaagtagatacaaggacacaggagccaaaggagggaactaaaaaattgatgaaaataacagcggagtggctctggaaagaactagggaagaaaaaaacacccagaatgtgcactagagaggaatttaccagaaaggtaagatccaacgccgctttgggtgcaatcttcactgatgaaaataagtggaagtcagctcgggaggcagtagaagatggacgattctgggaattggtagacagagagagaaacctacacttagagggaaagtgcgagacctgtgtatataatatgatgggcaaacgtgaaaaaaagctcggagaatttggaaaggcaaaagggagtagagcaatatggtacatgtggctcggagcgagatttctcgaatttgaggccctagggtttttaaacgaagatcactggttttcaagaggaaacagcttaagcggggttgaaggagaagggttacaccgtctggggtacatcttaagagacgtaggaaaaaaagaaggaggtgctatgtacgctgacgatacagctggctgggacacgcgtattacattggaagacttaaaaaatgaagaaatggtcactaatcacatgaagggcgagcacaaaaaacttgcagaagccatcttcaaattaacctatcaaaataaggttgtccgagttcaaagacccaccccacgcggcacggttatggatattatttcgcgcagagaccaaagaggctcaggacaagttggtacctacgggctaaatacttttacaaatatggaagcccaattaataagacagatggaaggagaaggcatttttaagtcaatccaacacttaacagcgactgaggaaattgccgtacaaaattggctcgcacgggtcggaagagaaaggttaagtagaatggcaatttcaggagatgactgcgtcgtgaaacccatagatgatagatttgcaagcgctttaactgcactcaatgatatgggcaaggtacgtaaagacatacagcagtgggaaccctctagaggatggaacgattggacacaagttcctttttgctcacatcattttcacgagttagtaatgaaagacggtagagtactagttgtgccttgccgcaatcaagacgaactaataggaagagcaagaatatcacaaggcgcaggatggtctttaaaagagaccgcctgtttagggaagagctatgcgcaaatgtggacactgatgtacttccacagaagggatctaagacttgcagcgaacgccatatgtagtgctgttccctctcactgggtgccaacgtcaaggacaacctggtctatacacgcaaaacatgaatggatgaccactgaagacatgttggcagtctggaacagagtctggatacaagaaaatccatggatggaagataaaacccccgttgaaagctgggaagaagtgccgtacctaggaaagcgggaagatcagtggtgtggttctatgatcggtctaactagcagggcaacttgggcaaagaacatccaaactgcaataaaccaagttcgatctcttataggaaatgaagagtatactgactacatgccgtctatgaaacgatttcgtagggaggaagaagaagccggcgtgctttggtga

SEQ ID NO: 22457 - RNA, 9876 nt, synthetic construct
  misc_feature 1..9876: note = derived and/or modified CDS sequence (opt6) from DENV-2__EU482691__SS-prME
  source 1..9876: mol_type = other RNA
accgcaggagtgatagtcatgctgattcctacagcaatggcattccatctaacaacacgaaacggagaaccacatatgatagtaggaaggcaagaaaaaggtaaatcattgttattcaaaacagaagacggtgtcaatatgtgtactttaatggcgatagatcttggagaattgtgcgaagatacaattacatataaatgcccattattaagacagaatgaaccagaagatattgattgttggtgtaatagtacctctacatgggtgacttacggaacatgcacgacaactggggaacatagacgagagaaaagatcagtagcattagtcccgcatgtcggaatgggattagaaactcgaacggaaacctggatgtcatccgaaggagcgtggaaacatgtccaacgtattgaaacttggatactaaggcaccctggtttcactataatggctgcgatattagcctatactataggcacaacccatttccaacgcgcattaatatttatcctgctaactgcagtagcaccaagcatgactatgagatgcataggcatttctaaccgcgatttcgtggaaggggtttcaggaggttcatgggttgatatcgtcttagaacatggcagctgtgtaaccacaatggccaaaaataaaccaacgcttgatttcgaactaattaaaactgaggctaaacaaccagcgaccctacgaaaatattgcatagaagcgaaattaacgaacaccacaacagaaagtagatgtccaactcaaggagaacccagcctaaatgaggagcaggataaaagatttatttgtaaacacagcatggtcgacagagggtggggaaacggctgtggattgtttggtaaaggagggattgttacttgcgctatgtttacatgtaagaaaaatatggagggcaaagtagtccaaccagaaaacctagaatacacgatagtaataacaccgcattccggagaggaacacgcagtcggtaatgataccggaaaacatgggaaagaaataaaaataactccgcagtccagtattacagaagcagaattgactggatacggcactgtaacaatggaatgctcaccccgaacaggactcgattttaacgaaatggttttattgcagatggaagataaggcttggttagtgcataggcaatggttcctggatttgccattaccttggctacccggggcggacacacagggatctaattggatacaaaaagaaactcttgtaacctttaaaaatcctcatgcgaagaaacaagatgtagttgttctcggatctcaggaaggtgcaatgcatacggcgctcacaggagcgaccgaaattcaaatgtcttcaggaaatcttctattcacaggtcacttaaaatgccgattacgaatggataaattacagctaaaaggtatgtcttattcaatgtgtacaggaaaattcaaaatcgttaaagagatagctgaaacacaacacggcaccatagtaattcgagttcaatatgagggtgacggaagtccctgtaaaattccattcgagattacggatctagaaaaacgccatgtcctagggcgactaattacagttaatcctattgtaacagaaaaagactcaccagtaaacattgaggctgagccacctttcggagattcatatataataataggagttgaacctggacaattgaaactaaactggttcaagaaagggtcatctattggacagatgttcgagaccaccatgaggggtgcaaaaagaatggctatactcggcgacacagcttgggactttggatcgttaggcggtgtgtttacatcaattggtaaagccttacatcaagtgttcggtgctatttatggagcagcttttagtggagtgtcatggacaatgaaaatattaataggggtgataattacctggattggaatgaatagtcggagtacaagcctaagcgtatcactcgtgttagtgggtgtagtcactttataccttggagcagtggtccaggcggactcgggttgcgtagtgagctggaaaaataaagaattaaaatgcggaagcgggatttttataacagataacgttcatacatggacagaacaatataaattccaacccgaatcccccagtaaactagcctcagctatacaaaaagctcatgaagagggaatatgtggaataagatcagtaacaagattagagaacctaatgtggaaacagataactccagaattaaatcatatactaagtgaaaatgaagtaaaactgacgataatgaccggggatataaaaggcataatgcaggcaggaaaacgaagtctgcgtccacaacccacggaattaaaatacagctggaaaacgtggggaaaagcaaaaatgttatcaacggaaagccataatcaaactttcttgatcgatggtcctgagactgcagaatgcccaaacattaatcgagcttggaacagcctagaagtagaagattatggatttggcgtattcactaccaatatatggttaaaattgcgagaaaaacaggatgtattttgtgatagtaaattaatgagtgcagcaatcaaagataatcgtgctgtacatgccgatatgggatattggatagaatccgcccttaacgacacatggaaaatggagaaagctagctttatagaagtaaaatcgtgtcactggccaaaatctcatactctctggtccaatggggtactggaatccgagatgataatacccaaaaatttcgcgggaccagtttcccaacacaactatcggcccggataccacactcaaactgcaggaccctggcatctggggaaactggaaatggactttgacttctgtgaaggtactactgtggtagtcacggaagactgtggcaaccgaggtccttcactaagaaccactactgcgtctgggaaactgatcacggaatggtgttgccgaagctgtacactaccaccgctcagatatagaggtgaagatggctgctggtacggaatggaaatacgacccctaaaagaaaaagaagaaaacttagttaacagcctggtcactgcaggtcatggccaaatcgacaatttctcattaggagttctaggaatggccctatttcttgaagaaatgttaagaacaaggataggaacaaaacacgcaattttgttagtcgctgtcagtttcgttactttaataacaggaaatatgtcgtttagggacctcggtagagtgatggtaatggtcggggctacaatgacggacgatataggtatgggtgtgacttatcttgcccttctcgcagctttcaaagttcggccaacatttgctgccgggctattactcagaaaattgacttccaaagaattaatgatggcaacgattggcattgctctactcagccagtcgacaataccagaaacaattctagagctaactgacgctttagcactgggtatgatggtccttaaaatagtgaggaatatggagaagtaccagctggcagtaacaataatggcaatttcttgtgtcccgaacgctgtgatactacagaacgcatggaaagtcagttgtacaatactggcagccgtaagcgtatcaccattgctcttaacaagcagccaacaaaaagccgactggatacctctagccctaacaattaaaggactcaacccaacggctatatttttgacaactcttagtcggacaagtaagaaacgaagttggccactgaatgaggccattatggcagtaggaatggtaagcatactagcatcctccctgctcaaaaatgatatcccaatgacaggacccctggttgcaggcggcctgttaaccgtatgctatgtgcttaccgggcgctcagccgacttggagttggaacgtgccgcagacgtgagatgggaggatcaagctgaaatatccggaagctcacccatactatcaataactatttcggaagatggatcaatgtcaattaaaaatgaagaagaggaacaaactctaaccattcttattcgtacaggtttattggtaattagcggggtattccccgtttcgatccctatcacagcagcagcgtggtacttatgggaagttaagaaacagcgagccggagtcctgtgggatgtgccatcccctccgccggtagaaaaggcagaactagaggacggagcctacagaattaaacaacgcggtattttgggttacagccagataggagcaggagtctacaaggaaggtacctttcatactatgtggcatgtcacaaggggagctgttttaatgcacagagggaagagaattgaaccatcgtgggccgatgtcaagaaagacctgattagttatggaggaggatggaaattagaaggcgagtggaaggagggggaagaagtccaagtcctagcacttgaacctggcaaaaatcccagagcagtacaaacaaagcctggaatttttaaaacgaataccggaacaattggcgcagttagtctagatttttcaccagggacctccggttcacctatagtggacaggaagggtaaagtagtgggactttacggaaatggcgttgtcactagaagtggggcctacgtatctgccatagcacaaacagaaaaatcaattgaagacaacccagaaatcgaagatgatatttttagaaagaaacgacttactataatggatctccatcctggtgcagggaaaactaaaaggtatttaccggcgatcgttagggaagcgattaaaagaggactgcggacattaatcttggcaccaacacgggtagtagctgcagaaatggaggaagcactaaggggattacctatccgctaccagacaccagcgataaaaacagaacatacaggacgggaaattgtagacttaatgtgtcatgcaactttcacaatgagactactaagtccggttagggtgccaaactataatctgataattatggacgaggctcattttacagatcccgccagcatagcagcgcggggttatatatctacacgcgtagaaatgggtgaagctgcaggaatctttatgactgcaacaccaccaggttccagagatccgtttccacaaagtaatgctcctataatggacgaagaaagggaaattcctgaaagatcatggaactctgggcacgaatgggtaactgatttcaaaggaaagacagtatggtttgtgccgtcaataaaagcaggaaacgacatagctgcttgtctgcgcaaaaatggaaagaaagtaatacaattatctcgaaaaacattcgatagtgaatacgttaaaacaagagccaatgattgggatttcgtcgtgaccaccgatatttcagaaatgggggcgaatttcaaagcggaacgagtcattgatccccgaaggtgtatgaaaccagtcatactaactgatggagaagaaagagttatcctggctggacctatgcccgtaacacacagtagtgctgcccaaaggaggggtagaatcggacggaatcccaaaaatgaaaacgatcaatatatatatatgggagaacccctggaaaacgatgaagattgtgcacattggaaagaagcaaagatgttactggacaatattaatacgcccgagggtataattccgagcatgtttgaacctgaacgagaaaaagtagatgcgattgatggagaatatagactacgaggagaagctaggaaaacatttgttgacttgatgagaagaggagacctacccgtctggctggcctataaagtagctgcagaaggaatcaattatacggaccggaaatggtgctttgacggaatcaaaaataaccagatattggaagaaaacatggaagtggaaatttggaccaaagagggagaacgtaagaaactaaagccacgatggttagacgcgagaatatattcggaccccctagcactaaaagaatttaaggaatttgcagctgggagaaaatcattaacactcaatttgataaccgaaatgggacgcctccctacgttcatgacacagaaagcccgaaatgcgttagacaacttagctgttttacatactgctgaagcagggggacgagcttataaccatgcgttatccgaattaccagaaactctagaaacactactcctccttacgttactagcgaccgtaactggtggaatattcctatttttaatgtcgggtaaaggaataggaaaaatgacgttaggaatgtgttgtatcataactgccagcattctcttatggtacgctcaaatacaacctcattggatcgcagcttctataatattagagttctttctaatagtgctgctaattcctgaacctgaaaagcagcgaacacctcaagataatcaacttacttacgtagtcatagccattttaacagtagtagctgccaccatggccaatgagatgggatttctagagaaaaccaaaaaggacttaggattaggttctattacaacgcaggaatcagagagtaatatattggatattgatttaagaccggcgtcggcgtggacactttacgccgtagctaccacttttgttactccaatgttgagacattctatcgaaaattcatcggtgaatgtatcactcacagcaattgccaaccaagcaacagttttaatgggattaggaaaagggtggccgttatcaaaaatggacattggcgtaccactgcttgcaattggatgctactctcaggttaacccaataacactcacagctgcacttctgctattagtagcgcattatgccattattggtccaggactccaagcgaaagcgacaagagaagcccaaaagagggctgctgcaggaataatgaaaaacccgacagttgacggtataacagtgattgatttagaaccaattccctatgatcctaaatttgaaaaacagttaggacaagtaatgctattaattttatgcgtaacgcaggttcttatgatgagaacaacatgggcattatgcgaagcgttaacactagcgacaggaccaatatcaacattatgggaggggaaccctggaagattttggaacacaactatagctgtatccatggccaatatatttagaggttcttacctggcaggagcaggtctgctgttctcgattatgaaaaatacaacctctacaaggagaggcacagggaatatcggggaaacgctaggagaaaagtggaaatctagactaaatgctttgggtaaaagcgaatttcaaatatataagaaatcaggtatccaggaagtcgatagaacactggcgaaggaaggcataaaaaggggagagacagatcaccacgcggtatcaagggggtcagccaaattacgatggtttgttgaaaggaatatggtcacacctgaaggaaaggtagttgatctgggttgtggcagaggaggttggtcttattattgcggcggcctcaaaaatgtccgcgaggtgaaaggattgacgaaaggtgggcccggacacgaagaacccatacctatgagcacttacggatggaacctcgttagacttcaatcaggagttgacgttttctttacgcctccagaaaaatgcgatactttactttgtgatattggggaaagttccccaaaccccactatagaagccggaagaacgttacgtgtattaaacctcgttgagaactggctcaacaacaatacacaattttgcgttaaggtactgaacccatatatgcccagtgttattgagaaaatggaagcgctacaacgacagtatggcggcgccttggtacgaaacccgttgagcagaaactcaactcatgaaatgtattgggtaagtaatgctaccggtaatatagtatcctctgttaatatgataagtcgcatgttgattaatcggttcaccatgaaacataagaaagctacttatgagccggacgtagacctaggatcaggtacaagaaatatcggcatagaatctgaaataccaaacttagatataataggtaaaagaattgagaaaataaagcaagaacatgaaatatcatggcactacgatcaggatcacccctataaaacatgggcgtatcacggttcttatgaaacaaaacaaacgggttcagcgagctctatggtcaatggtgtagtacgtttgctgaccaaaccatgggacgttgtacctatggtaactcagatggccatgacagatactactcccttcggacaacagagggtatttaaagaaaaagtagatacccgtacccaagagccaaaagaaggaaccaagaaattaatgaaaataacagccgagtggctatggaaagaattaggtaagaagaaaacacctcgaatgtgcaccagggaagagttcacaagaaaagtgcgatcaaacgcggcgttaggggcaatatttacggatgaaaataaatggaagtccgccagggaagcagtcgaagatggccgattttgggagctcgtagatagggagagaaacttacatctggaaggaaagtgtgaaacatgcgtttataacatgatgggaaaacgtgagaagaaactcggggaatttggaaaagccaagggctcccgagctatttggtatatgtggttaggagcaaggtttcttgaatttgaggcattagggtttttaaatgaagaccattggttctcaagaggtaacagtctttcaggtgtagaaggggaaggactccataggttaggatatatacttcgcgatgtaggtaaaaaggaaggtggtgctatgtacgctgatgacacagctggatgggataccaggataacattggaagatcttaaaaacgaggagatggtcacaaatcacatgaaaggcgaacacaaaaagttagccgaagccatcttcaagctcacatatcaaaacaaagtggtaagagtacaaagacctactccaagaggcacagttatggatattatttcgaggagggatcagcgaggatcaggtcaagttggcacctacgggctaaatacatttaccaacatggaagcccaattaataagacaaatggaaggtgaaggaatattcaagagcattcaacatttaacagctactgaagagatcgcagttcaaaattggctagctcgtgtaggaagggaacgactatctagaatggcgatatcaggagacgactgtgtcgtgaaaccaatagatgatcgattcgcatctgccctcaccgctctgaatgatatgggaaaagttcgcaaagatattcagcaatgggaaccatcgcgagggtggaatgactggacacaagtaccgttctgttcgcaccactttcacgagctagttatgaaagatggtcgtgtattggtagtcccatgtaggaatcaagacgaattgattggacgtgctcgaatatcacaaggagcaggatggagcctaaaggaaacggcttgccttggaaaatcatacgcgcagatgtggacactgatgtatttccatagacgggatcttcgactagctgcaaatgcaatctgtagtgctgtgccgagccattgggtacccacttctagaactacctggtcgattcacgcgaaacacgaatggatgacgacagaagacatgcttgcagtctggaatcgggtgtggattcaagagaatccatggatggaggataaaacccccgtagaaagctgggaagaagtaccctacttaggaaaaagagaagatcaatggtgcggctcactaataggattaacctcgagggcaacttgggcgaagaatattcaaactgcaataaatcaagtacgctcattaattggcaatgaagagtataccgactatatgccatcaatgaaacgatttagacgagaagaggaggaggccggtgttctctggtaa

SEQ ID NO: 22458 - RNA, 9876 nt, synthetic construct
  misc_feature 1..9876: note = derived and/or modified CDS sequence (opt6) from DENV-2__EU482693__SS-prME
  source 1..9876: mol_type = other RNA
acagcgggagtcattgtcatgttgataccaacagcaatggcattccacctcaccacacggaatggtgaacctcatatgatcgtaggaagacaagaaaagggaaagtcgttgttatttaaaacggaagacggagtaaatatgtgtacattgatggcaatagacttaggcgaactatgtgaggataccatcacatataaatgtccattattgcggcaaaacgagcccgaagacattgattgttggtgcaactcgacgagtacatgggtaacatatggtacatgtaccactacgggggaacatcgacgggaaaagcgtagtgtggcattagtcccacatgtggggatgggcttagaaactagaactgaaacctggatgtcatcagagggtgcctggaaacatgttcaaagaattgagacttggatattacgacaccctggctttacaataatggccgcgattctagcgtacacgattggcacaacacactttcaaagagcattgatatttatcttactgacagctgtcgctccttcaatgaccatgagatgtataggcataagcaaccgggatttcgttgaaggtgtcagtggcggtagctgggttgacatcgtgttggaacatgggtcatgtgtcacaactatggccaagaataagcctacccttgactttgaactcataaagacagaggctaaacagccagctactctcaggaaatattgtatcgaagcaaaactaacaaacacaaccaccgaatcacggtgcccaactcaaggtgaaccaagtcttaacgaagaacaagacaaacgattcatttgtaagcatagtatggtagatagaggatgggggaatggatgcggattattcggcaaaggtggtatagttacatgtgctatgtttacgtgcaaaaagaatatggagggaaaagttgtacagccagaaaacttagaatataccattgtcattaccccccattcgggagaggaacatgccgtcggcaatgacacaggtaaacatggcaaagagataaaaatcacgccgcaaagtagtatcacagaagcagagttaacaggctacggaaccgtaactatggaatgttctcctagaacaggattagattttaatgaaatggtgcttctacaaatggaggataaagcttggttggtgcatcggcaatggttccttgatcttcctttgccctggttaccaggcgcggatacacaagggagcaattggattcaaaaagagactctagtaacttttaaaaatccccatgctaagaaacaagatgtagtagtcttgggatctcaagagggggcaatgcacacggcgttgaccggcgcaactgaaatacagatgtcttcaggcaatctgcttttcactggacacctaaaatgcagacttaggatggataaactacaattaaaggggatgagttatagcatgtgtactggtaaattcaaaatagtgaaagaaatcgccgaaacacaacatggcacaattgtgataagggtacaatatgaaggtgatgggtcgccgtgtaaaatcccatttgagataacggatctggaaaaaagacatgttctaggacggttaataaccgtaaacccaattgtcaccgaaaaagacagcccagtcaacatagaggcggaacctccttttggtgatagctatataatcattggtgtagagccaggacaacttaaattaaactggttcaaaaagggatcatcaataggacaaatgtttgagacgacaatgagaggtgcaaagagaatggcaatattaggtgatacagcatgggatttcggctcattaggtggagtatttactagcattggcaaagcattacaccaagtattcggcgcaatatacggagcggctttttcaggcgtaagctggacaatgaagattcttatcggtgtgattattacttggattggaatgaattctaggagtacgtctctttctgtgagtcttgtacttgtcggtgttgttacattatatctgggagctgttgtgcaagcagatagcggatgtgtagtaagttggaaaaataaagagctcaagtgcggtagcggaatcttcatcacagataatgtgcatacatggacggaacaatataagtttcaaccagaaagtccatcaaaactcgcatcagcaatacaaaaggcccatgaagaaggtatttgcggaataagatctgttactaggttagagaatttgatgtggaaacaaataacccccgaattaaatcacattctcagtgaaaatgaggtcaaattaacaattatgacaggcgacatcaaaggtattatgcaagcaggaaagagatctttaagaccacaacccacggagctaaagtatagctggaaaacttggggaaaagcaaaaatgttatccactgagtcgcacaatcaaaccttcttaattgacggacctgaaacagctgaatgtccgaatacaaatcgcgcgtggaattcactagaagtggaagactatggctttggagtattcaccaccaatatatggctaaaacttagggaaaaacaagacgtattttgcgatagtaaactaatgtcagcagccattaaagataacagagcagtacatgcagacatgggctactggatagagagcgctctgaatgatacttggaaaatggagaaagcgagttttattgaagtcaagtcgtgtcattggccaaaaagtcatacgttgtggtctaacggcgtcttagagtcagagatgatcatcccgaaaaacttcgctggcccagtatcgcagcataactatcgccccggttatcatacacaaactgccggaccatggcatctcggaaaattagaaatggattttgatttatgtgaagggacaacggtggtagtcactgaggactgcggtaacagaggtcctagtctgcgtacgacaacagcaagcgggaaacttataaccgaatggtgctgcaggtcatgtacgcttccaccgctgcggtacagaggtgaagacggatgttggtacggcatggaaattagacccttgaaagaaaaagaagaaaacctggtgaattcactggtgacggcgggccatggtcagatagacaatttttcattgggcgtacttggaatggcactatttcttgaagaaatgcttagaacacggatcggaacaaaacacgccactctgttggtagctgtttcctttgtcacactgataacagggaatatgtcgtttagggatctcggtagggttatggtaatggttggagcaactatgacggatgacattggaatgggcgtaacatatttagcactactagccgcatttaaagtgaggcccacttttgcagccgggttactcttaagaaaactgacttcgaaagaactgatgatggctacaatcggtatagcattgttaagtcagtcaaccatccctgaaactatactagagctaactgacgcactagcattaggaatgatggttttaaagattgtacgaaatatggaaaagtatcaactggcagtaaccataatggctatatcatgtgtgccaaatgcagtaatcttacaaaacgcgtggaaagtaagttgtactattttagctgctgtttcagtatcgcccctgcttttgactagttcacaacaaaaagccgactggatcccattagcgttgacaattaagggactaaatccaacagcaatattcttaacgactttatctcgaacttcaaagaaaaggtcatggccacttaatgaagcgattatggcagttgggatggtgagcatactagctagttctttactaaagaatgatattccaatgacaggaccattggtagcggggggtttgctaacagtgtgctatgtgttgaccggaaggagtgcagatctggaactagaaagagcggctgacgtcaaatgggaggaccaagcagaaatctccggaagttctccaatactttcaatcacaatttccgaagatggatcaatgagtataaagaacgaagaagaggagcagacattaacaattctgatacgaaccggcttactagtgattagcggggtatttcctgtaagtattccaataacggcggcggcttggtacctatgggaagtgaaaaagcaacgcgcaggggtattgtgggatgtaccaagtccccctcctgtcgaaaaagcggaacttgaagacggggcctatcgcataaaacaacgcggtattctcggctactcccaaatcggtgctggggtctacaaagagggtacatttcacacaatgtggcatgttacaagaggagccgttttaatgcacagaggtaaaagaatagaaccatcgtgggctgacgtcaagaaagaccttatatcatatgggggaggatggaagcttgaaggggagtggaaagagggtgaagaagttcaggtattggcattggaaccaggaaaaaatccacgagccgttcaaaccaaacccgggatatttaaaactaatacgggtacgataggagcagtatcactggatttttcaccgggtacaagcggtagtccgatagtggataggaagggaaaagtagttggcctatacgggaacggagtagtgacacgcagcggagcatatgtttcagctatagcgcaaacagagaagagtatcgaggataatcctgaaattgaagacgatatcttcagaaagaaaagattgacaatcatggacctgcatccaggtgctggaaaaacaaaacgatacttaccagcgattgtacgcgaagccataaagcgaggcctcagaaccttaattttggcgccaacgagagtcgtcgcagcggaaatggaggaagcgcttcgaggattgccaatacgatatcagacaccggcaataaaaactgaacatactggcagagagatagtagacttaatgtgtcatgcaacctttacaatgcgtctattgagtccggtaagggtaccgaattacaatttaatcataatggatgaggcacactttacagacccagctagcatagcagcgagagggtatattagcactcgggtggagatgggagaagcagcaggaatcttcatgaccgcgaccccacccggatcaagagacccctttccacaaagtaacgctcctataatggatgaagaaagggaaattccggaacgatcatggaactctggccatgaatgggtaacagactttaagggtaaaacagtatggtttgttccatctattaaagctggtaacgacatagcagcttgtctacgaaagaatggaaaaaaagtaattcagctctcaaggaaaacatttgactctgaatacgtaaaaacgagagctaatgattgggactttgtggtcaccaccgatataagcgaaatgggcgcaaactttaaagctgagcgcgtaatagaccccagaagatgtatgaaaccagttatcttaacggatggagaagaacgagttattctagctggccccatgcctgttactcattcttcagctgctcaacgacgaggtcgtattggcagaaatcccaaaaatgaaaacgaccagtatatttatatgggtgaaccattagagaatgacgaggattgtgcgcattggaaagaagcaaaaatgttgctagacaatattaatactcccgaaggaataatcccgagtatgtttgagccggagcgcgagaaagttgacgcaatcgatggtgaatatagactccgaggagaggcaagaaaaacatttgtagatttgatgaggaggggagatctaccggtatggctagcatataaagtagctgcagaggggatcaattatgcggatagaaagtggtgtttcgatggaatcaaaaacaaccaaatacttgaggagaacatggaagttgaaatatggaccaaagaaggcgaaaggaagaaactgaaaccaagatggctcgatgcccgtatatatagtgatccactagcattaaaagagtttaaagaatttgcagccggacgtaaatcactcacactaaacttaattacagaaatgggaagactaccaacatttatgacacaaaaggcccgtaacgctttggacaacttagctgtgctgcacacagcggaagcggggggaagagcttacaaccatgcattatccgaacttcctgaaacattagaaacattgttacttttaacactactagcaacagtaaccggaggaatatttctattcctaatgagcggtaagggaattggcaaaatgacgctaggcatgtgttgcataatcacggcatcaatcttgttatggtatgctcagattcaacctcactggatagccgcttcaattatactagagttttttcttattgtactacttattccagaaccagaaaaacaaagaacacctcaagataatcagctgacctacgtagtcatagcaatactgacagtagtagccgcaaccatggccaacgaaatgggtttccttgagaaaacgaagaaagatctgggactaggtagcataaccacacaagaatctgagtcgaatatattagacatagatttgcgcccagcatcagcctggacactttatgcagtagcgaccacatttgttaccccaatgttaagacatagtatcgagaacagttccgtgaacgtctcacttacagcgattgcgaaccaagccaccgttctgatggggctgggaaaagggtggccattgtcaaagatggatataggggtacctttgttggcaatagggtgttattcacaagttaatccaataacgttaacagccgcattattgctgttggtagcacactacgcgattatcggtccaggattgcaggccaaagcaacgagagaagcacagaagagagcagcggctggtataatgaaaaatccgacagtagatgggataactgtaatagacctagaacccataccttacgatccgaagtttgaaaaacaattaggacaggttatgctcttgatactctgtgtgactcaagtactgatgatgagaactacttgggcactctgcgaagcgttaacactagcaaccggtccaataagcacgttatgggaagggaatccaggcagattctggaatacaacaatcgcagtgtcgatggctaacatatttagaggcagctacctagcaggagctgggttgttatttagtataatgaaaaatacgacatcaactcgcagaggaacaggtaacataggggaaacattaggggaaaagtggaaatcaaggctgaatgcactaggtaaatcagaatttcaaatatataaaaaatctggaatacaagaagtagatagaactctggcaaaagagggaataaaacgaggagaaactgaccatcatgcagttagtcgtggtagcgcgaagttacggtggtttgtagaacgaaatatggtaactccagagggtaaggtagtagacctgggttgtggacgaggcgggtggtcatattattgtggtggactcaaaaatgtacgagaagtgaaagggcttacaaaaggaggtccgggtcatgaagagcctatcccaatgagcacttatggatggaacttagtcagattgcaatcgggagtagatgttttttttacaccgccggaaaaatgcgacacactactctgtgatataggagagagtagtccaaacccaacaattgaagcaggacgaacccttagagtcctaaatttagtggaaaattggttaaataataatactcaattttgcatcaaggtcctcaatccttatatgcccagcgtaatcgaaaaaatggaagccctgcagagaaagtatgggggagcattagtcaggaatcctttgagtcgcaatagtacacacgaaatgtactgggtttcaaatgcgacagggaatattgtatcaagcgtaaatatgataagcaggatgctgataaatcgtttcaccatgaaacataaaaaagcgacttatgagcctgatgtagacttaggaagtggaacccgtaacattggaattgaatccgaaatcccaaatttggacatcattgggaagagaatcgagaagataaagcaagaacacgagaccagctggcactacgatcaagatcatccatataaaacatgggcgtatcacggttcatacgaaacaaaacaaactggatcggctagtagcatggtaaatggtgtcgtacgactgctcacaaaaccatgggatgttgttcctatggttacacaaatggcaatgacagacacaacgccttttggacagcaaagagtctttaaggaaaaagtagacacccgcacccaagagccaaaagagggaactaagaagttgatgaaaatcacggcagagtggctctggaaggaactaggcaagaaaaaaactccaaggatgtgcacaagagaagagtttaccagaaaagttcgaagtaatgcagcgcttggagcaatatttacagacgaaaataaatggaaatcagccagagaagcagtagaagatggacggttctgggaactggttgacagagaacgaaatctacatttggagggaaaatgtgaaacatgtgtctacaacatgatgggtaaaagagagaaaaagctaggcgaatttggaaaagcaaaaggctccagggctatctggtatatgtggctaggtgcaagatttctggagttcgaggcattagggtttctcaatgaagaccattggttctctcgaggaaatagtctatcaggtgttgagggagaaggactacacagacttggatacatactacgtgatgtgtcaaaaaaagagggcggagcaatgtatgcagatgatacagccggatgggacacccgtataacactagaagacttaaaaaacgaagaaatggtcacaaatcacatgaaaggagagcacaaaaaattagctgaagcgatctttaaacttacatatcaaaataaggtagtgcgagtacaacgacccaccccgcgagggactgtaatggatataatcagtcgccgagaccaaagaggatctgggcaagttggaacatatggcttaaatacttttactaacatggaagcgcagctaataaggcaaatggaaggggaaggaatcttcaaaagtattcaacacttgacagcagccgaggagaacgttgtgcaaaattggttagctcgggtggggagggagagactttcaagaatggcaatatccggtgatgactgtgtagttaagccgatagatgatagatttgcctctgcactaacagcgttgaatgacatgggaaaagtaaggaaggatatacaacaatgggaaccatctagaggttggaacgattggacccaagtaccattttgctctcaccactttcatgagctagtaatgaaggatggcagggtgcttgtagtgccatgcagaaatcaagatgaacttataggtagagccagaataagtcagggtgctggatggagcctaaaggagacagcatgcctaggaaaatcctatgctcagatgtggaccttaatgtacttccatcgaagagatctgcgtttggcagcgaatgcaatttgtagcgcagtcccatcacactgggtgccaacttcaaggactacatggagtatacatgcaaaacacgagtggatgaccacggaagatatgttggcagtttggaatagggtctggatccaagaaaatccttggatggaagacaagacaccagtagagtcctgggaagaagtgccgtatcttggaaaaagagaagatcaatggtgcggttcactaattgggttaacgagtcgagctacctgggctaaaaacattcagactgctatcaatcaagtaagatctctcatagggaacgaggagtacaccgattacatgccatccatgaaacggtttcgcagggaagaagaggaagccggcgtcctctggtga

SEQ ID NO: 22459 - RNA, 9876 nt, synthetic construct
  misc_feature 1..9876: note = derived and/or modified CDS sequence (opt6) from DENV-2__EU596483__SS-prME
  source 1..9876: mol_type = other RNA
acagctggtgttattgtgatgttaataccaacagcaatggcttttcatcttacgacaagaaacggggaacctcacatgatagttggtcggcaagaaaaaggtaaatcgttattattcaaaactgaagatggagtcaatatgtgtacacttatggcaatagatctaggtgaattatgcgaagataccataacatataaatgccccctattaagacaaaatgaacctgaagacatagattgttggtgcaattccacatctacctgggtcacatacggaacatgtacaactacaggtgaacatcgtcgtgaaaaacgaagcgtagcccttgttcctcacgtcggaatgggactcgaaacgcgaactgaaacttggatgtcatctgaaggggcttggaaacacgtccaaagaatcgaaacctggatcttacggcaccctggattcacaataatggcagcgatattagcatacacgatagggactacacatttccaacgagcattgatatttatacttttgaccgctgtagcaccaagcatgaccatgcgttgtataggaattagtaatcgcgactttgttgaaggcgtgtccggtggtagctgggtagacattgtattggaacatggtagctgtgttacaactatggcgaaaaacaaaccaacgttagattttgaacttatcaaaacagaagctaaacaacccgcaacattaagaaagtactgtattgaagccaaattaacaaatacaacgacagaaagtagatgcccaacacagggagagccttccctcaacgaggaacaagataaaagatttatatgcaaacacagtatggtagaccgaggttggggaaatggttgtggcttatttgggaaaggtggcattgtaacgtgtgcaatgttcacatgtaagaagaacatggaaggtaaagttgtacaacctgaaaacttagaatatacaattgtaataaccccacattccggagaggagcatgcagtaggaaacgacacaggaaaacacggcaaagaaatcaagatcacaccgcaatcgtcaataacagaggccgaactaacgggttatggaacagtaactatggaatgctcaccgcgaaccggactcgacttcaatgaaatggtgttattacaaatggaggataaagcgtggttggtacatcgacaatggtttctagacctgcccctgccgtggttacctggcgcagacacacagggcagcaactggatccagaaggaaaccctagttaccttcaaaaatccgcatgccaagaaacaggatgttgtggtgttgggctcacaggaaggagccatgcacaccgcactaactggggctacggagattcaaatgagcagtggaaatctattatttacaggccatttaaagtgtcgattacgtatggataagctacaactgaaagggatgtcctacagcatgtgtacgggaaaattcaagatcgtcaaggaaatcgccgaaacacaacacggcacaattgtaataagagtccaatacgaaggtgacggatctccatgcaagataccttttgaaataactgacctggagaaaagacacgttctagggcggttaataactgttaatcctatcgtaaccgagaaggactcgccagtaaacattgaggcagaaccacctttcggagactcctatattataattggggtagaaccaggacagctaaaattgaattggtttaagaaaggatcatcaatcgggcagatgttcgaaaccacaatgagaggtgccaagcgaatggcaattcttggtgacaccgcgtgggactttgggagcctcggaggcgtattcacgagtattggaaaagcattgcatcaagtgtttggagcaatatacggtgcggcttttagtggggtcagttggacgatgaaaattcttattggagtaattataacatggattggaatgaactctcgcagcacttcattatcagtatctctagtgttagttggagttgtgactttatatttaggagccgttgtccaagcagattctggttgtgtggtttcctggaaaaacaaagaattgaagtgtggatcaggaattttcatcacagacaatgttcatacttggacggaacaatataagttccaaccagaatcaccttcaaagttggcatcagctatacagaaagcacatgaagaaggtatttgtggcatacgtagcgtcacaagactggaaaatctcatgtggaaacagataacgcccgaacttaaccatatattatcagagaatgaggtaaaacttacaataatgacgggggatataaaaggcataatgcaagcgggaaagagatcgctaagacctcaaccaactgaattaaagtattcatggaaaacgtgggggaaggcaaaaatgttatctacagaaagtcataatcagacctttctaattgatggaccagaaaccgcagaatgccccaacactaatagagcgtggaatagcttagaagtagaagactacggatttggtgtctttactacaaacatatggctaaagctacgcgaaaagcaagacgtattttgcgactccaaattgatgtcagcggcgataaaggataatagggcggtacatgcagatatgggatattggatggagtccgcgttgaacgacacctggaaaatggaaaaggctagctttatagaagtaaaatcgtgccactggcctaaaagtcacacgttatggtcaaatggggtattagaatccgaaatgataataccgaagaatttcgcaggtccagtttcacaacacaattaccgtcctggatatcatactcagactgcaggaccatggcatttaggaaaactcgaaatggatttcgacttctgtgaaggaacaacagttgttgtaacagaagactgtggtaacagaggcccgtcactaaggactactacggcctcaggaaaactcataacagaatggtgttgtagaagttgtaccctccctccgcttcgttacagaggagaagacggttgttggtatggcatggaaattaggcctttaaaggaaaaagaagaaaatctagtaaacagcttagtaacagcagggcacggacagattgacaacttttccttaggagttcttgggatggccctctttctcgaagaaatgctaaggacacgcataggtacaaaacacgcaatcctgttagttgctgttagttttgtaactttgataacgggtaatatgagcttcagggatctgggaagggtaatggttatggtaggagccactatgacggatgatattggaatgggtgtcacttatcttgcattgctagcagccttcaaagtaagacccactttcgcggcaggacttctacttcggaaattgacttctaaagaattaatgatggctaccataggtatagctcttttaagccaaagtactataccagagacaatattagagttaacagatgcacttgccttaggaatgatggtgctgaagatcgtaagaaacatggaaaagtatcagctagcggtgaccataatggccataagttgcgtcccaaatgcagtaatattacagaacgcttggaaagtctcatgcacgatcctcgcagcggtttcagtatcaccgctgctccttacatcaagccaacagaaggcagattggataccactagcactaacgatcaaaggacttaatccaacagcaatatttctaacgacgctttcgagaaccagtaagaaacgtagttggcccttgaacgaagctataatggccgtaggaatggtatctattttagccagtagcttgctgaaaaatgatatacctatgactggcccgttagtggcgggtggcctcttaactgtatgttatgtgttaactggacgatcggcagatttagagttagaaagagcagcagacgttaaatgggaggaccaagccgaaatctcgggaagttcaccgattttatcgattacaatatcagaagatggatcaatgagtatcaaaaatgaagaagaagaacagacattgacaattctaatcagaactggtctcctagtgatcagtggcgtatttccagtctctataccaataactgcagcagcgtggtacctatgggaagtaaagaaacaacgtgcgggcgtcttatgggatgtaccaagtccacctccagtagaaaaagcagaattagaagatggtgcgtatagaataaaacaaagaggtatattaggatatagtcaaattggtgcgggggtgtataaagagggcacttttcataccatgtggcatgtaactcgtggtgcagtattaatgcatagagggaaaaggatcgagcctagttgggcagatgtcaagaaggatttaatttcttatggaggcggatggaaactggaaggagaatggaaagaaggcgaagaagtacaggtattagcgttagaacctggaaagaatccaagagcagtacaaaccaaacctggaatatttaaaactaacacgggaacaataggggctgttagtcttgacttttccccggggacatcaggaagtcccatcgtagatagaaaaggcaaagttgtaggactttatggaaacggagtggttacccgaagcggagcgtacgtgtcagctatagcacagacagagaaaagcatagaagacaacccagaaattgaagacgatatctttaggaagaaaaggctaaccatcatggatctccatccgggtgctgggaaaacaaaacgttacctaccggcaattgttagagaggccataaaacgcggtctaagaactttaattttggcaccaacaagggtagttgcagcggaaatggaagaggcactacgaggcctacccattcggtatcaaacaccagcaattaaaactgaacacactggtcgagaaattgtggatcttatgtgccatgcgacttttacaatgagacttttatcccccgtaagagtacctaattacaaccttataataatggatgaagcacatttcaccgatcccgccagtattgccgcaagaggatatataagtacacgtgtcgaaatgggagaagctgcaggaatctttatgactgcgactccaccaggttcaagagacccctttccacaatcaaatgcccccataatggatgaagaaagagaaattccggaacgttcttggaactcaggccacgaatgggtaactgacttcaagggaaaaacggtatggttcgtaccttcaattaaagccgggaatgatattgcagcgtgtttaaggaaaaatggcaagaaagttatacaactctcacgaaaaacttttgactctgaatatgtaaaaacccgtgcaaacgattgggacttcgtagttacaacggacatctcagaaatgggagctaattttaaagcagagcgcgtaatcgatcctagaaggtgtatgaaacccgtcattttgaccgatggagaggaaagagttattcttgcaggcccaatgccagttacacattcaagcgcagctcaaagaagagggagaatcggtcgaaaccccaagaacgaaaacgatcaatacatctacatgggggaaccactagaaaatgatgaagactgcgcgcattggaaagaagcaaagatgcttctcgataacataaatacccctgagggaataattccaagtatgtttgaaccagaacgggagaaggtagacgcaattgacggagaataccgacttcgaggagaagcgcgaaaaacattcgtcgatttaatgagaagaggagatctaccagtttggttagcgtacaaggtagcggccgaaggcattaattataccgatagaaagtggtgttttgatggtataaagaataaccaaatcttagaggaaaatatggaagttgaaatatggacgaaagagggagagcgaaagaaattaaagcccaggtggcttgacgctagaatctattcggacccattggcactaaaggagttcaaagaatttgctgctggccgtaaatcactaacattaaacttaataacggaaatgggcagactaccaacatttatgactcaaaaagcacgtaacgcactagacaaccttgcagtcctgcatacagcggaggccggtgggagggcgtataaccacgcgcttagtgaactaccagaaacgctagaaacattattattattaactctattagcaactgtcaccggcggaatatttttgtttttgatgtccggaaagggaataggaaagatgacattaggtatgtgctgcataatcactgcctctatactactttggtatgcgcagattcaaccccattggatagcagcaagtataattctcgaatttttcctaatagtactacttatacctgaaccggaaaaacaaagaacaccacaggacaatcaactaacttatgtagtgatcgcgatactgactgttgtggcagcgacaatggcgaacgaaatgggttttctcgagaaaacaaagaaagacctcgggttaggcagtataaccacacaagagtcagaatctaatatccttgatatagatttaaggccggcgagtgcttggacattgtatgctgttgcaacaactttcgttactccaatgttacgacattcaattgaaaattcgtctgtcaatgtttctttaacagcaattgcaaaccaagcaacagtactaatggggttaggaaaaggttggccacttagtaagatggatattggtgtgccacttctggctataggttgctatagccaagtcaatccgataactctaacggcggctttgcttttattagtagcccactatgcaataattggaccgggattacaagctaaagcaaccagagaagcccaaaagagagctgcagcgggaattatgaaaaatccgactgtagatggaattacagtaatagatttagagccaataccttacgacccgaaatttgagaaacaacttgggcaagttatgttattaatactatgtgtaacccaagtattaatgatgaggactacttgggccctgtgtgaagccctaacattagcaactggacccatttcaacgctctgggagggaaatcctggtcgcttttggaacacgacgatcgcggtaagcatggcaaatatttttagaggctcctatctggcaggcgcaggattactattttcaatcatgaaaaacactacctcgacaagacgagggacaggaaatatcggagaaacactaggagaaaagtggaagtctaggcttaacgccttaggaaaaagtgagtttcaaatctacaagaaaagcggcatacaggaagtagatcgaacattagcaaaggaaggtataaagagaggagaaactgatcaccatgcagtctcaagaggcagtgcaaagttgagatggttcgtagaaaggaatatggtaactccagaaggcaaggtagtcgatttgggatgtgggagaggaggatggtcttattactgtggtgggctcaaaaatgtcagggaagttaaaggactgactaaaggaggccccggtcacgaggaaccgataccaatgtcgacatatggatggaacttggttaggctccaaagtggggttgacgtatttttcactccacctgaaaagtgcgataccctattatgtgatataggagagtcgagtccaaatccaaccatagaggcaggtagaactctgcgagtgctaaacctggtagagaactggctaaataataatacccagttctgcatcaaagtgcttaatccttacatgcctagtgttattgagaagatggaagcccttcaacgccaatacggaggtgcgctggtcagaaatcctctaagccgtaactcaacacatgaaatgtattgggtatcaaacgctacaggaaatatcgttagcagtgtaaatatgataagcaggatgctaataaacaggttcaccatgaaacataagaaagctacctacgagccagatgtagacttggggtcaggaactcgtaatatcggcatagaaagcgaaatcccaaacttagacattattgggaaaagaatagaaaagataaaacaggaacacgaaattagctggcactacgatcaggaccacccctacaaaacctgggcctaccacggcagttatgagaccaaacaaaccggaagtgcatcatcaatggttaatggcgtggttagattattaacaaagccgtgggatgtagttcctatggtcacacaaatggcaatgacagacaccacaccttttggacaacaaagagtttttaaagaaaaagtggatacaaggacacaggagccaaaagaaggtactaagaaactaatgaaaataacggcggaatggctatggaaagaattaggtaagaagaaaactccacgaatgtgtactcgagaagaatttacaaggaaagtacggagtaatgcagcactgggcgcaatatttacagatgaaaataaatggaaaagtgcaagggaagcggttgaggatggtagattttgggagttggtagatcgtgaacgaaaccttcacctggagggcaaatgcgaaacgtgcgtatataatatgatggggaaaagagagaagaaactaggagagttcgggaaagccaaaggtagtagggccatctggtatatgtggcttggtgcccgcttcttggaatttgaagcattggggtttctaaacgaagatcattggttctctcgcgggaacagcctatccggggttgaaggagaagggttgcatcgacttggctacatactacgggacgtcggcaagaaagaaggaggcgcgatgtatgctgatgatacggcaggttgggacacacgtataacgctcgaagatttgaaaaatgaagagatggtcacaaatcatatgaaaggagaacataaaaagctggctgaggcgatatttaaacttacgtatcagaataaagttgttcgcgtccagcggcctacgcctagaggcactgttatggatatcataagtcgtcgtgatcaacgcggtagtggacaagtaggaacctacggattaaatacattcacaaatatggaagcgcaattaatacgccaaatggaaggtgaagggatatttaaaagtatacaacatcttaccgctaccgaagagattgctgttcaaaactggttggccagggtcggtcgcgaaagattaagcagaatggcaataagcggcgacgattgtgttgtaaaaccaattgacgacagatttgcaagtgctttaaccgcactaaatgacatgggaaaagtgagaaaagacattcaacaatgggaaccctctaggggttggaacgactggacccaagtccccttttgtagtcatcacttccatgagcttgtaatgaaagacggtcgtgtactggtagtaccctgcagaaatcaagacgaactaataggcagagcaagaatatctcagggcgcaggttggagtttaaaagagacggcatgtttgggaaaatcttatgcacaaatgtggacactaatgtactttcatcgacgagatcttcgacttgccgcgaatgcaatctgcagtgctgtaccttcccattgggttccaacatcaagaactacatggagcatccatgccaaacatgaatggatgaccactgaagacatgttagcagtgtggaatcgagtttggatacaagagaatccctggatggaagacaagacccctgtcgaatcatgggaagaagtcccatacctaggaaagagggaagatcagtggtgtggatcacttatcggattaacatctcgggcaacatgggcgaaaaacattcagactgctatcaatcaagttaggagcttaatcgggaatgaagaatatacagattacatgccatcgatgaaacggtttcgaagagaggaggaggagactggggtactttggtaa

SEQ ID NO: 22460 - RNA, 9876 nt, synthetic construct
  misc_feature 1..9876: note = derived and/or modified CDS sequence (opt6) from DENV-2__EU482597__SS-prME
  source 1..9876: mol_type = other RNA
accgctggtgttatagtcatgctaataccgactgcaatggcatttcacttgactactcgtaacggagaacctcatatgatagttggtcggcaagaaaaaggaaaatcgctactatttaaaactgaagacggtgtcaatatgtgcacactaatggctatagacctcggggaattatgcgaagataccataacgtacaaatgtccactattgcgacaaaatgaaccggaggacattgactgctggtgtaactcaacaagtacttgggtaacatatggaacatgtaccacaacaggagaacatagaagagagaaaagaagcgtagccctagtgccgcacgtaggaatgggtttggaaacgagaacagaaacatggatgtcttcagaaggagcatggaaacacgtgcaaagaattgaaacatggatcttgcgccaccctggattcacaattatggctgctattttggcatataccattggaactactcattttcaaagagcactgatatttatattgctaacagcagtggcaccgtcaatgactatgcgatgtatcggtatttccaatagagactttgtggaaggggtatcagggggatcctgggtggacatagtattagaacatggatcttgcgtaacaaccatggccaaaaataaaccaacgttggatttcgaattgattaaaacggaggcaaaacaaccagcaactttaagaaaatattgcatagaagcaaaattaacaaatactacgacagaatcccgctgcccgactcaaggcgagccttcgttatcagaagaacaagacaaaagatttatatgtaaacactccatggttgacagagggtggggtaatggatgcgggttgtttggaaaaggcggaattgtcacatgtgcaatgttcacatgcaagaagaacatggaggggaaagtagttcagccagaaaatttagaatatacaatagtaatcacgccgcactcgggagaagaacacgcggtgggaaatgacacaggtaaacacggaaaagagataaaaataactccacaaagtagcatcacagaagcagaacttacgggttatggcacagttactatggagtgctccccaaggacggggctagattttaacgaaatggtactgttacagatggaagacaaagcctggcttgtgcatagacagtggtttttggatctccccttgccgtggcttccaggcgcggacacacaaggatcaaattggattcaaaaagagactctagttacctttaaaaatccacatgctaagaaacaagatgtagtagtattaggatcacaagaaggtgcaatgcacacggcattaacaggagcaactgaaattcaaatgtcaagtggcaatctattatttacaggacatcttaagtgccgcttgcgaatggataaattacaactaaagggtatgtcctattccatgtgtactgggaaatttaagatagttaaggaaatcgcggaaactcagcacggcactatcgtcataagagtgcaatatgaaggcgatggatcaccctgcaaaattcctttcgaaataacagatttagagaaacgacacgtattaggaaggttaataacagttaaccccattgttacagaaaaagatagtccggtaaacatagaggcagaaccgcctttcggcgatagttatataatcataggagttgaacctggtcaacttaagctcaattggtttaagaaaggctcaagcataggtcaaatgtttgaaacaactatgaggggtgctaaacgaatggcaatattaggcgacacagcgtgggattttggatcacttggcggtgtatttacttcgattgggaaagccctacaccaagtctttggggctatatatggagcagcattctcaggagtgtcttggacgatgaagatactaatcggtgtgattattacctggataggcatgaatagccgaagtacttcattgagtgtaagtcttgttctagtaggtgttgttacgttatatttaggagcaatggtccaagcggactcgggctgtgtggtgtcatggaaaaacaaagaattaaaatgcggttctggaatatttataacagataacgtacatacatggaccgaacaatataaatttcaaccagagagtccatctaaattggcgtcagcgatccagaaggcgcacgaggaaggaatatgtggtattcggagcgtgacccggttagaaaacctcatgtggaaacagataacacctgaactaaatcatatcctatcggaaaatgaagtgaagttaacaataatgacaggtgacataaggggtataatgcaagcgggaaaaagaagtttaagaccacaacctactgagctcaaatacagttggaaaacatggggtaaagctaaaatgttatcgacagaaagtcacaaccaaacatttctaatagacgggccagaaactgcagaatgccccaatacaaaccgagcttggaactcccttgaagtagaagattatggatttggggtgtttaccacaaacatttggctaaagttaagggagaagcaagatgtattttgcgatagtaaactaatgagtgctgctattaaggacaacagagcggttcatgccgacatgggctattggatagaaagtgcactaaacgacacgtggaagatggaaaaggcatctttcatagaggtgaaatcatgtcactggccaaagtctcataccctgtggtcaaatggcgtcttagaaagcgaaatgattataccaaagaatttcgctggacctgtaagccaacataattaccgaccaggataccatactcaaacggcaggaccgtggcatttagggaagttagaaatggactttgatctatgtgaagggaccaccgtcgtagttactgaagattgcggaaatcgcggtcctagtcttagaacgacgacagccagtgggaaactcatcactgaatggtgttgtaggagctgcacgcttccaccattaagatatagaggggaagacggatgttggtacggcatggaaatacgacccttgaaggaaaaagaagaaaatttggttaatagcttagtgacggctggtcacggacaaattgataatttctctttgggcgtattgggtatggcgctatttttggaagaaatgctaagaacaagaattggaacaaaacacgctatacttctagttgcagtctctttcgtaacattaataacaggtaacatgtcttttcgagatttaggtagagtaatggtcatggtgggagccacgatgacggatgatatcggtatgggcgtaacttatcttgcactgttagctgcattcaaggtacgaccaaccttcgcagctggtctacttttaagaaaattaacgagtaaggaactaatgatggcaacaataggcatagcgttattgtcgcagtcgacaataccagaaacaattcttgaactcaccgatgctttagcacttgggatgatggtgctcaaaatcgttcgtaatatggaaaaatatcaactagcagtaacaatcatggcaatatcctgcgttccaaacgctgttatattgcaaaacgcatggaaagtgtcatgtacaattttggcggcggtgagtgtcagccctttactattaacaagtagtcaacagaaggctgactggatcccgttagccttaacaatcaaaggattaaatccgacggctatattcttaacaacattgtcaaggactagcaagaaacgaagctggcctctgaacgaggccataatggctgtaggaatggtttccatcttagcgagctcactgcttaaaaatgatatcccaatgactggaccattagtcgctggtgggttactcacagtgtgttacgtcctgacgggaagatctgccgacctagagcttgagcgagcggccgatgtgaaatgggaagaccaggcggaaatctcgggcagcagccccatattatcaattactataagcgaagacggttcgatgtctatcaaaaatgaagaggaagaacagaccttaacaatccttatacgtacaggtttgttagtgattagtggtgtatttccagtgagcatcccgataaccgcagctgcctggtatttatgggaagtgaaaaagcaaagagccggtgttttatgggacgtaccatcaccgccaccagtggaaaaagccgaactagaggatggggcctatcgaatcaaacaacggggcatattaggttacagtcaaataggtgctggcgtatacaaagaaggcaccttccacactatgtggcatgttacccgcggtgcagtattgatgcataggggtaaacgtatagaaccttcttgggccgatgtcaagaaagaccttataagttacggtggaggctggaagctagaaggagagtggaaggaaggagaggaggtccaagttttggcattggaaccaggtaaaaatcccagagctgtacagacaaaaccaggaatctttaaaactaatacaggaacgattggagcagtgtcacttgattttagtccaggcacaagcgggagtcccatagtagataggaaaggaaaagtcgtgggcctgtatggaaatggggtagtaacgagatcgggagcttatgttagcgcaatcgcacaaacagaaaaatctatagaagacaacccagaaatagaggatgatatatttaggaagaaaagattgacgataatggacctgcatcccggagcaggaaaaacaaaaagatatttacctgcgatagtgagagaggccatcaagcgaggattgagaaccctaatacttgcaccaacaagggtcgtagcagctgaaatggaagaagccctacgtggtcttccgatcagatatcaaacgactgcaataaaaacagagcacacaggacgtgaaatagtagatctcatgtgtcatgcaacattcacaatgagattactaagtcccgtacgtgttccaaactataacctaataataatggatgaggcgcactttactgatccagcaagcattgcggcacgcggatatatatcaacgagagtggaaatgggggaagcagcaggaatctttatgaccgctacccctccaggtagcagagatccattcccgcaaagtaacgcgcctatcatggatgaagaacgtgaaattccggaaagatcttggaactcaggtcatgagtgggttacagatttcaaaggaaagaccgtttggtttgtcccaagcataaaggcaggaaacgacatcgctgcgtgcctcaggaaaaatggtaagaaagtgatccaacttagcagaaaaactttcgattctgaatatgtcaaaactcgtgctaatgactgggacttcgtagtcacgaccgatatatcagaaatgggagccaattttaaggctgaaagagtcatcgatcctaggcgatgtatgaaaccagtcattctaactgatggagaagaaagagttatactagctggtccaatgccggttacccacagtagtgctgcccaaaggagaggacggatcggacgcaatcctaaaaacgaaaacgaccagtatatttatatgggtgaacctctagaaaatgacgaagattgtgcccattggaaggaagcaaaaatgttacttgataatattaatacccctgaagggatcataccaagtatgttcgaaccagagcgggagaaggtagatgcaatagatggtgaatacagattaagaggtgaggcaagaaaaacttttgtagacttaatgaggcgaggagacttacccgtatggttagcttataaagtcgcagccgaaggcataaattatgccgatagaaaatggtgcttcgatgggatcaaaaataaccaaattctggaagaaaatatggaggtagaaatatggaccaaggaaggagagaggaagaaattaaaaccacggtggctcgacgcaagaatatacagtgatccattagcgttgaaagaatttaaagaatttgctgcaggtagaaaatctctgaccttaaacctaataacagagatgggaaggttgccgacatttatgacacaaaaagcaagaaacgccttagataatctagcggtgttacacaccgccgaagccggcggacgagcttacaaccacgcgctgagtgaactacccgaaactctcgaaacattactactgctcacgttactcgcaacagtgacaggagggatatttttgttcctgatgagcgggaaaggcataggtaaaatgacactaggaatgtgctgtattattacagccagcattttactatggtatgcgcagatacagccacactggatagcggcatcaatcatactggagttctttcttattgtattattgattccagagccagaaaaacaacgcacgccccaagataatcagttaacgtatgtagtgatagcaatattaactgttgttgcagctactatggcaaatgagatggggttcctagagaaaacgaagaaagacctcgggttaggctcaattacaacgcaagagagcgaatccaatatattagacatagacctacgtccagcatcggcgtggacactttatgccgtcgctacaactttcgtaacaccaatgcttagacactcaatagagaactcatcagtgaatgtttcactaactgcaatagcaaatcaagcaacggtgttaatgggattaggtaagggatggcctctaagcaagatggacattggtgtaccattgcttgcaatagggtgttattcccaagtgaatccaataacgttaacagcagcgttgcttctcctagtcgctcactatgccataataggccccggcctacaagcaaaagctactagagaggcacagaaaagagcggcagctggaattatgaaaaaccctacagtggatggtataaccgtcattgacctagagcctataccgtacgacccaaaatttgaaaaacaactcggccaagtaatgctattaatactatgcgttacacaagtgctaatgatgcggacaacgtgggcattgtgcgaagcgttaacgctagctacaggtccgatatctactctctgggaggggaatccaggtagattttggaatacaactatagcagtatcgatggctaatattttcaggggttcataccttgccggcgctggacttttattctctataatgaaaaatacgactaatacaaggagaggtacaggtaacataggtgaaacacttggagaaaaatggaaatcacgcctgaatgcacttggcaagtcggagtttcagatctataagaaatccggtattcaggaggtcgatcgcacgctagcaaaagagggaataaaaagaggagaaactgatcaccacgcagtatcgcgtgggtctgcaaaacttagatggtttgtagagagaaatatggtcacaccagaaggaaaggtagttgaccttggatgtggtaggggcggttggtcgtattattgtggcggtcttaagaatgtaagagaagtaaaaggccttacaaaaggaggtcctggacacgaagaacccattcctatgtcaacctacggatggaatctagttcgtcttcaaagtggtgtagacgtgttctttacacccccagaaaaatgtgacacgctactctgtgatattggtgaaagttcaccaaatcctacgatcgaagctggtagaacactacgtgtactaaatttagtagaaaattggctgaataacaatacacaattttgtattaaagtgctaaacccgtacatgccaagtgttatcgagaagatggaagcacttcagaggaaatatggaggggcgttagtacgaaatccactatccaggaacagtacacatgagatgtattgggtatcaaatgccacagggaatatcgtatcatccgtaaacatgatatcacgaatgttaatcaaccgttttactatgaagcacaagaaagcgacgtatgaaccagatgttgatctggggagtggaactcgaaatatagggatagagtcagaaatcccaaatctcgacattattggcaaaaggattgaaaagatcaaacaggaacacgaaacatcttggcactacgaccaagatcatccatacaaaacttgggcatatcatggatcatacgaaactaagcagacgggatcagcatcttcaatggtcaatggagttgtcagactccttacgaaaccctgggatgttgtcccgatggtaactcagatggctatgacggataccaccccattcggccaacagcgtgtctttaaagaaaaagttgacacgagaacacaggaaccgaaagagggtacgaagaaattgatgaagattaccgcagagtggctatggaaggaactagggaaaaagaaaacgcctagaatgtgtactcgtgaagaatttactagaaaggtacgctcaaatgctgcactcggtgctatctttacagatgaaaataaatggaagtcagctcgcgaggctgtggaggatggaagattttgggagctcgttgatcgtgaaagaaacctacacctggaaggcaagtgtgaaacctgcgtttacaatatgatgggtaaacgcgagaagaaactgggcgaatttggtaaagcaaaaggatcaagggcaatatggtacatgtggctaggagcacgcttcttagagttcgaggctttgggattcttgaatgaggatcattggtttagcagaggtaattcgctttcaggagttgaaggtgaaggattacacaggttaggttacatattaagggacgtcgggaagaaagaaggcggggcgatgtacgcagatgacaccgccggatgggacactagaataaccttggaagaccttaaaaatgaggaaatggtaacaaaccatatgaaaggagaacataagaaattagcggaggccatcttcaagttaacatatcaaaacaaagttgttagagtgcagcgaccgactccacgaggtacagtaatggatattatatcacgacgagaccaacgtgggtctggacaagtcggaacatatggcctaaacacgtttacaaatatggaagcccaactaatccgacaaatggaaggtgaaggaatttttaaaagtatccaacatctaacggcgacagaggagattgctgttcaaaactggctcgcacgagttggccgtgaaagattatcgagaatggccatttcaggagacgactgtgtcgtcaaacctattgatgatagattcgcgtcagcacttaccgcccttaacgatatgggaaaaatacggaaggatatacaacaatgggaaccatcaagaggatggaatgattggactcaagtaccgttttgctcccaccattttcacgaacttgttatgaaagacggcagagtgctcgtagtgccttgtcgaaatcaagatgaactaataggtagagcccgcatatcacagggcgcaggctggtcattaaaagaaactgcttgcttaggcaaatcttacgcgcaaatgtggacactaatgtactttcacagacgagacttgcgacttgccgccaatgcgatatgctctgcggtaccaagtcattgggttccgacatcaaggacgacttggtcaattcatgctaaacacgaatggatgacaacagaggatatgttggcagtatggaatagagtttggattcaagagaatccgtggatggaagataaaactccagttgaaagttgggaagaagtaccctatcttggaaaacgagaagaccaatggtgcggatctttaatcggtcttacctcaagagcaacgtgggccaaaaatattcaaactgctataaatcaagtgaggagtctaatagggaatgaggaatacaccgattacatgccaagcatgaaacgattccgtagagaggaagaagaagctggagtgttatggtaa

SEQ ID NO: 22461 - RNA, 9876 nt, synthetic construct
  misc_feature 1..9876: note = derived and/or modified CDS sequence (opt6) from DENV-2__EU482598__SS-prME
  source 1..9876: mol_type = other RNA
actgcaggggttattgtaatgttaataccaacagcaatggcatttcatctaactacaaggaacggagaaccccatatgattgtggggcgccaggaaaaagggaaaagccttttattcaaaactgaagatggagttaatatgtgtacactaatggcaatagatctaggagaattgtgtgaagacacaataacctataaatgcccattattaagacaaaacgaaccagaagacatagactgctggtgtaatagcacaagtacatgggtgacttatgggacgtgcactacaactggagaacatagacgggagaaacgaagtgtggcactggtgccccatgtcggaatgggacttgaaacccgtacagaaacatggatgagttcagaaggagcatggaaacacgttcagcgaatcgaaacttggatactgaggcatcctggatttacgattatggcggcaatattagcgtacacaattggaaccactcattttcaacgagcattgattttcatccttcttacggcagtggcaccaagtatgacgatgagatgtattggaatttctaatcgagatttcgtcgaaggagtttctggaggaagttgggtggacatcgtacttgaacatggtagctgtgtaacaacaatggcgaaaaataaaccaaccctcgacttcgaattaataaaaacagaagcgaaacaacctgcaactttacgcaaatactgcatcgaagcgaaactcactaatacaacaacagaaagcagatgcccaacacagggtgaaccgagtctaaacgaagaacaagacaagcgattcatttgcaaacacagtatggttgatagaggatggggaaatggatgcggtctatttggaaaaggcggaatagtaacttgcgcaatgttcacctgtaagaaaaatatggaaggcaaaatagtgcagcccgagaacttagaatatactatagtaatcacaccgcatagcggagaagaacacgcagtaggaaacgatacagggaaacatggtaaagaaattaaaataactccccaaagttcaattacagaagcggaactaactggctatggcaccgtgacaatggaatgttcaccgcgtactggattggacttcaatgaaatggtcttattacaaatggaagataaggcatggttagtacaccgacaatggtttctagatctacccttgccatggctgcctggagctgatacacaaggatcaaattggattcagaaagaaaccttagtcacgttcaaaaacccacacgccaagaaacaagacgttgtagtactagggagtcaggaaggtgctatgcatacggctctaacgggtgcaactgaaatacaaatgtcgagcggtaatcttttgttcactgggcatctaaaatgccgactacgcatggacaaactacagcttaaaggaatgtcttattccatgtgcacggggaaatttaaaatagtaaaagaaattgctgaaacacagcacgggactattgtcatacgcgtacaatatgaaggggacggatccccctgcaaaatacccttcgaaataacggaccttgagaaaaggcatgtcctgggcagactgataacagtgaatcccatagtcacagaaaaagatagtccagtaaatatagaagccgaaccgccttttggtgattcgtatataattatcggtgtggaaccaggtcaattaaaattgaattggttcaagaaaggcagcagcataggacagatgtttgaaacaaccatgagaggggctaaaagaatggccatactgggagacacagcatgggactttggtagcttaggaggagtattcaccagtattggaaaagccctgcatcaagtctttggagcgatctacggcgcagcattcagtggtgtgtcgtggactatgaaaatcctaataggtgtaattattacatggataggcatgaactcgaggtctacatctctgtcagtgtcattagtacttgtcggagttgtaacattgtatcttggtgctatggtacaagctgattctggttgcgttgtttcatggaaaaataaggaactaaaatgcgggagcggaatattcattacagataacgtccatacctggaccgaacaatataaatttcaaccggagagtccgagcaaacttgcatctgcaatacagaaagctcacgaggagggaatatgcgggatcagatcagtgacgaggctagaaaatcttatgtggaaacaaattacaccagaactaaatcatatcctaagtgagaacgaagtaaaattaacgataatgactggggacataagaggaataatgcaagctggtaagcgaagtttgcgacctcaaccaactgaattgaagtattcctggaaaacatggggaaaagcaaagatgctatcaaccgaatctcacaaccagacgtttctaatagatggccctgaaactgctgaatgtcctaacacaaatcgagcatggaacagtttagaggttgaggattacggttttggggtgttcaccacaaacatatggctgaaattaagggaaaaacaagacgtattttgtgatagtaaattaatgtcggcggccattaaagataatagagcggtacacgcagacatgggatattggatagaatcagcattaaatgacacgtggaaaatggaaaaagcctcattcatagaagttaagtcttgtcactggcccaaaagtcatactctatggtcaaatggtgtgttggagtcggaaatgattatccccaaaaattttgcaggtcctgtttcccaacataactataggcccggttatcacacacagaccgctggaccatggcacttaggtaaattagaaatggactttgatctctgtgaaggaactacagtagtggtaacagaagactgtggaaatagagggcctagcttaagaactacgacggcttctggcaaactgataacagaatggtgctgccgaagttgtacactacctccattaagatatagaggtgaggatggttgttggtatggaatggaaatacgcccgttaaaagaaaaagaagagaaccttgtaaattccttagttacagcagggcatggacaaatcgacaatttctccctaggtgtattgggaatggcattattcctagaggaaatgttaagaactagaattgggacaaagcatgccatactacttgtcgcggtcagctttgtaacgctgataacgggtaatatgtcttttcgagacttgggacgcgtaatggttatggtcggagctacgatgacagatgatatcggaatgggcgttacttatttagcactgctagctgcatttaaagttagaccgactttcgcagccggcctattgttacgaaaattaacgagcaaagaattaatgatggcgactattggtattgcactactatctcaatccactattcccgaaactatcctagaattgactgacgccctggctttaggaatgatggtattgaagatcgtacggaatatggaaaaatatcaacttgcagtcactattatggccatatcctgcgttccgaatgcggttattctacaaaacgcttggaaagtttcctgcacaatacttgcagcagtatcagtgtcacccctccttttaacatcatcacagcaaaaagcagactggatcccactggcgttgacaataaaaggtctcaatcccacagctatattcttaactacattaagtcgaacaagtaaaaagagatcttggccgctaaacgaagctataatggctgtcgggatggtttcaatactcgcttcctccctattaaagaacgatatacctatgacaggaccactggtggcagggggtttacttactgtgtgttatgttcttaccggaagatctgctgacttggaactagagagagcagctgacgtaaagtgggaagatcaagcagaaataagtggatcatcacctatactcagtataacaatctcagaagacggtagtatgtcaatcaaaaatgaggaagaggaacagacccttacaatattaatacgcactgggcttctagtaatttcgggagttttcccagtgtcaatacctatcacagcggctgcttggtatttgtgggaagttaaaaagcaaagggcaggggtcctgtgggatgtaccaagcccaccgccggtagaaaaggcggaactagaagatggagcatatcgtataaaacaaagagggatcctagggtatagccaaattggagctggggtgtataaagaaggaacgtttcataccatgtggcatgtcactaggggagccgtacttatgcatcgcggcaaacgaatagagccctcttgggctgatgtgaaaaaggacctaatatcatacggcggtggatggaagctagaaggagaatggaaggagggagaagaagtacaggttttagccttagaaccgggcaaaaaccccagagcagtccaaaccaaaccaggaatattcaaaacaaatactggaaccataggggccgtcagtttagacttttccccaggtactagcgggtcacccatcgttgatagaaaagggaaagtagtgggattatacggaaatggagtagtaacccgctctggagcatacgttagcgccattgcgcaaacagagaaaagtattgaggataaccctgaaatagaggacgatattttccggaagaaaagactgaccataatggacttacacccaggggcagggaaaaccaaaagatatctcccagccatagtaagagaagcgataaaacgtggtctgcggacactgatactggcccctacaagagttgttgccgccgagatggaggaggctttacgaggcttacccataagatatcaaacaacagcaatcaagacagaacatactggtcgtgagatagtagatctaatgtgtcatgctacatttactatgcgcttgctcagccctgtacgagtgccaaactataatttaattataatggatgaagctcattttactgaccctgcatctatcgcagcacgaggctacatatccactcgggtcgagatgggagaagccgccggtattttcatgactgctacaccgccagggtcgagagaccccttcccacagtcgaatgcccctatcatggacgaagaaagagagattcctgagcgatcttggaactcaggtcatgaatgggtaacagatttcaaaggcaaaactgtatggtttgttccatcaataaaagcaggtaatgatattgctgcttgtttacgtaagaatgggaaaaaggttatccaactctctagaaagacttttgatagcgaatatgtaaaaacaagagcaaatgattgggattttgtagtcacaacagacatatcagaaatgggagcaaattttaaggcagaaagagtcattgatcccaggcgatgtatgaaacccgtaatcctcacagatggggaagaacgtgtaattcttgctgggccaatgccggtaacgcattccagcgcggcacagagaagaggacgaatcggtcgcaatcccaaaaatgagaacgatcaatacatatatatgggagaacctctagaaaatgatgaggattgcgctcactggaaagaagcgaaaatgctgctggacaatattaatacacctgaaggaattatcccttctatgttcgaacccgaaagagagaaggtagatgcaatcgatggtgaatatagactacgaggagaagcaaggaaaacctttgtggaccttatgagaagaggggacttaccggtttggttagcctataaggtagcggccgaaggaattaactacgccgaccgaaaatggtgcttcgatgggatcaaaaacaatcaaattttagaagaaaatatggaagttgaaatttggacgaaagaaggagaaagaaagaaattgaaaccacgatggctagatgctaggatttatagcgatcctcttgctctcaaagagtttaaagagttcgctgctggaagaaaatccttaacgttaaatttaattacagagatgggcagactaccaacattcatgactcaaaaagccaggaacgctcttgacaacttagcagtcctccacactgccgaagcaggaggtagagcttacaatcatgcactatccgaactacccgaaacgttagaaaccttactattactaacattactggctaccgtaaccggtggcatatttttgtttttaatgagtggcaaaggaattggtaaaatgaccctaggaatgtgctgtataattactgcatccatactcctatggtatgcccagatacaacctcactggatagctgcaagcataatattagaatttttcctaatagtcttacttataccagaaccagaaaagcagagaacgcctcaagataatcaactcacatatgtcgtaatcgccattttgacagtcgtagccgccacgatggcaaatgagatgggctttctcgaaaagacgaagaaggaccttggcctagggagtattacaacgcaagagtctgaaagtaacattttagatatagacctacgaccagcctcggcatggaccctttatgcagttgcaaccacttttgttacacccatgcttagacattcgatagaaaattctagcgtcaatgtctctttaacagccatcgcaaaccaggcaaccgttctaatgggactaggaaaaggatggccactaagtaaaatggatataggagtaccacttttggcaataggatgctattcacaagtgaatccaattacattgacggcagccttattacttttggtcgcgcactacgcaataattggtcctggattacaggccaaagctacaagagaggctcagaaaagggccgccgcaggaattatgaagaaccctactgtagatggaataacagtaatagatctagaaccaatcccctatgatccgaaattcgagaaacagttaggtcaagtaatgttattaattctttgcgtcacacaggttctaatgatgagaacgacatgggcactgtgtgaggctttaacactagcaacgggtcccatatctacactctgggaaggaaatcctgggcgattctggaacaccacgatagcagttagtatggctaatatcttcagaggatcttatttagcaggagcagggttgcttttcagtattatgaaaaatactactaatactaggagagggactggaaatatcggtgaaactctcggcgaaaaatggaaaagtaggctgaatgcactggggaaatcagagtttcaaatctacaagaaatctggaatacaggaagtggaccgaacattagctaaagaaggcatcaaaagaggagagacggaccatcacgcggtctcacggggatctgctaaattacgatggtttgtcgagaggaacatggtaactccggagggaaaagtagttgacctcggctgtggacgaggaggctggtcctattattgcggaggtctcaaaaacgtgcgtgaggtaaaaggtctaactaaaggaggacccggtcacgaagaaccgattccaatgagtacctatggttggaacctcgtaagattacaatcaggagtggatgtcttctttactcccccagaaaaatgtgatacattactttgtgacataggtgagtcaagcccaaatcctacaatagaagcggggagaactttaagagtactaaatttagtggagaattggttaaataacaacactcagttctgtattaaggttctaaacccatatatgcctagcgtaatagagaaaatggaagcccttcaaagaaagtatggaggggcactggttcgaaaccctctatcaagaaattctacacatgagatgtattgggtatccaatgcaacagggaatatagtttcatcagtaaacatgatatctagaatgctgattaaccgatttacgatgaaacataagaaagcaacatatgaacctgacgtggacctcggtagtggaacccgaaacataggaatcgagtccgagatccctaacttggatataatcggcaagcgaatagaaaagataaaacaagagcacgaaacctcttggcactatgatcaggaccatccatacaaaacatgggcatatcatggttcgtatgagacaaagcagactggttcagcatctagcatggtaaatggagtcgtccgcctcttaacaaaaccttgggatgtggtcccaatggtcacccaaatggcgatgactgatacaaccccatttggacaacaacgtgtttttaaagaaaaagtagatacacggacccaagaaccaaaagaaggtacgaagaaattaatgaagataacggcagaatggctatggaaagaattaggcaagaagaaaacccccagaatgtgtactagagaggagtttaccaggaaggtcagaagtaatgctgcccttggtgccatctttacagatgaaaataaatggaaatctgctagggaagctgtggaggatgggaggttctgggaactcgttgatagggagaggaacttacatctagaaggtaaatgcgaaacctgcgtgtataatatgatgggaaaacgagagaagaaattaggagagttcggtaaagcaaaaggtagccgcgcaatatggtatatgtggcttggtgcaagattcttagagtttgaggctttaggatttttaaatgaagatcattggttcagcaggggaaacagcctttccggagtagaaggtgagggattgcacagactaggttacatcttgcgtgacgttggtaagaaagaaggaggagcgatgtacgccgacgatacggctggatgggatacccgcataactttagaggacttaaagaatgaagaaatggtaaccaaccacatgaaaggcgagcataagaaattagcggaagcgatattcaaactaacctatcaaaacaaagtcgtgagagtacaaaggccaacccctagaggaacagtcatggatatcattagtcgacgtgaccaaagaggaagtggtcaggtcggaacatatggacttaatacttttaccaacatggaggcacagctcatcagacaaatggaaggggaaggtatatttaaaagcatccagcatttaacagcaactgaagaaatagctgttcagaattggctagcgagagtgggaagggaacgactctccagaatggcaatatcaggagatgactgcgtggtaaaacctatagacgacagatttgcctcggctttaaccgcgctgaacgatatgggtaaagtacgaaaagatatacaacaatgggaacccagtagaggatggaacgattggacccaagttccgttttgttcacatcacttccacgagctagtgatgaaggatggtcgagtattagttgtgccatgcagaaatcaagatgagttaataggaagggcgaggatctcacaaggagctggatggtctttaaaggaaacagcctgtctaggaaaatcatatgcacaaatgtggaccttaatgtattttcatcgcagagatttacgtcttgccgcaaacgcgatatgtagtgcagtacctagtcattgggtcccgacatcgagaacaacgtggtcaatccacgcaaaacatgaatggatgacgacagaagacatgcttgcagtgtggaatcgtgtatggattcaagagaacccatggatggaggacaaaactccagttgagtcttgggaagaggtaccgtatttaggcaaaagagaggatcagtggtgtgggtcacttataggcctaacaagtcgagcgacatgggccaaaaatattcagacagctatcaatcaagttaggagcttgatcggaaacgaagaatacacagattatatgcccagtatgaaaagattccgaagagaggaggaagaagcgggagtattgtggtaa

SEQ ID NO: 22462 - RNA, 9876 nt, synthetic construct
  misc_feature 1..9876: note = derived and/or modified CDS sequence (opt6) from DENV-2__EU482603__SS-prME
  source 1..9876: mol_type = other RNA
acagcgggtgtaatagtcatgcttattcccaccgcaatggctttccatttgaccactcgtaatggtgaacctcatatgattgttggaagacaggaaaagggaaaaagcttattgtttaaaactgaagacggagtaaacatgtgcactctaatggcaatcgatttaggagaattatgtgaagacactataacatataaatgtcctttattacgccaaaatgagccagaggatatagattgctggtgcaattcaactagtacttgggtaacgtatggtacctgcaccacaacgggagagcacagaagggaaaaacgatcagtggctttagttccccacgtaggcatgggtctggagacaagaacagaaacatggatgagcagtgaaggcgcttggaaacacgtccaaagaatagaaacgtggatattgagacacccagggtttaccatcatggcagcaattttagcgtatactatagggacaactcattttcaaagagcactgatattcatcctgttaacagcggtagcgccctccatgactatgcgatgcattggaatatcaaaccgggatttcgttgaaggtgtatcaggtggatcatgggtggatatagttcttgagcacgggagctgcgtaactaccatggcaaagaataaacctacactagacttcgaattgattaaaacagaggcaaaacaacctgccacacttcgaaagtactgtattgaagctaaattaacaaatactacaacggaatctaggtgtcctacgcaaggggaaccatctttaaacgaagaacaagataaacggtttatatgcaaacacagtatggtagacagaggatggggtaatggctgtggcttatttggaaaaggaggtattgtaacatgcgcaatgtttacatgcaagaaaaacatggaaggtaaagtagtacaaccagaaaacctggagtacacaatagtaataacaccacactcgggagaagaacatgcagtgggaaatgacacgggcaaacacgggaaagagataaagattactccacaaagcagcattaccgaagctgaattaacaggatatggcactgtaaccatggaatgctcgcctcgaactggactcgattttaacgaaatggtgcttttacaaatggaagacaaggcctggctagtacacagacaatggttccttgatcttccattgccatggttgcctggggccgacacccagggatcaaattggattcagaaggagaccctagtaactttcaaaaacccgcatgctaaaaagcaggatgtagtagtcttggggtctcaggagggagctatgcacacggctcttacgggggcgacggaaattcaaatgtcaagtggaaatctacttttcacaggccacctgaaatgtagattgagaatggacaagctacaactcaagggcatgtcatatagcatgtgtactggaaaatttaaaattgtaaaagagatcgcggaaacacaacatggaacaatagttatccgggttcagtatgagggggacggctctccttgtaaaataccctttgaaattacagatctagaaaaacgccatgtattggggcgtcttattacagtcaacccaatagtcacagaaaaagattcacccgtaaacatagaggcagaaccgccattcggagattcatatataataatcggagtagagcctggacaattaaaattgaactggttcaaaaagggatcctcaattggtcaaatgtttgaaacaactatgcgtggtgcaaaaagaatggcaatcctgggtgatacagcgtgggactttggatcactgggaggggtctttacttcaatagggaaagcgctgcaccaagtgttcggcgcaatctatggggcagcattctcaggagtctcttggacgatgaagatccttataggagttatcatcacgtggataggtatgaatagtcgttcgaccagcctcagcgtttcgctcgtgctagtgggtgtcgtcacactttacttaggggccatggtacaagcagattccgggtgcgtagtaagttggaaaaacaaagaattaaagtgtggatctggtatattcattaccgataatgtccatacatggactgaacaatacaagtttcaacccgaatctccgtcgaaattggcgtcagctatacaaaaggcccatgctgaaggaatttgtgggattagaagcgttacccgactagaaaacttaatgtggaagcaaataacacccgaactaaatcatatactgtcagaaaatgaagtcaagttaacaattatgactggagacataaaagggataatgcaggcagggaagaggagtcttcgtccacagccaacggaactcaaatatagctggaagacatggggaaaggcaaaaatgttaagtactgaatcacataatcaaacgtttcttattgatggtccagaaactgccgaatgtccgaacactaaccgagcttggaacagcctagaagtagaagattatggtttcggtgtctttactactaatatttggttaaagttaagagaaaaacaggacgttttttgcgattctaaactaatgagtgcagcaataaaggacaatcgcgccgttcacgctgatatgggatactggatagaatcagcattaaacgacacatggaaaatggaaaaagcgtcatttatcgaagtaaaatcatgccactggcctaaaagtcataccttatggagcaatggagtgttggagtcggaaatgattatcccgaaaaattttgcgggacccgttagtcaacataattatagaccgggatatcatactcagaccgctggaccttggcacctgggaaagttagaaatggattttgatctatgtgagggtacaactgttgtggtaactgaagattgcggcaatagaggaccatcactccgaactacaactgcatccgggaaacttataaccgagtggtgttgcagatcgtgtactttaccgccattaagatatagaggagaagacggttgttggtatgggatggagattcggcctttaaaagaaaaagaagaaaacttagtcaatagtttagtgacagcaggtcacggtcaaatcgataatttctcactaggagtgcttggaatggcactgtttttagaagaaatgctaagaacccgtattggtactaaacatgcgatacttttagtagcagtcagttttgtaacattaattacaggaaacatgtcttttcgagatctaggacgagtaatggtaatggttggcgcaactatgaccgacgacataggcatgggagtcacatatttagcgcttttagcagcgtttaaagttcgaccaacattcgcggccggactattactgagaaagttgaccagtaaagaactgatgatggctactattggaatagcactactgtctcagagcacgattccagaaacaatacttgaattgacagatgcactagcattgggcatgatggtattaaagatagtccgggacatggaaaaatatcagcttgctgtaaccataatggctattagttgtgtaccgaatgctgtcatcctacaaaatgcttggaaagtatcatgcactatactggctgcagttagtgtaagccctttattgctaaccagttcacaacaaaaagcagactggatccctctggccttgacgatcaagggacttaacccaactgccatctttctcacgacattaagtcgaacatctaaaaaacgcagttggcctttaaacgaagcgataatggcagtaggaatggtgagtatactcgcttctagcttactaaaaaacgatatccccatgaccggcccactagtagcaggtggacttctaactgtttgttacgtattaactggaagaagcgcagatttagaactagaaagagccgctgatgtaaaatgggaggatcaggcggaaatttcaggtagcagtccaatactctccataactataagcgaagatggaagcatgtcaataaaaaatgaggaggaggaacagacattaaccattctgataaggaccggattactagtaataagtggagtattcccagttagtatacctataactgcggcagcatggtatttatgggaagtcaaaaaacaaagggcaggagttttatgggatgtcccttctccgccaccagtggaaaaggccgaattagaagacggagcttacagaatcaagcagaggggaattcttggttactcacaaatcggagcaggagtatacaaagagggaacattccacacgatgtggcatgttactcgtggtgccgtactaatgcatcgtggaaaaagaatagagccttcgtgggctgatgtaaaaaaagacttaatttcatacggaggtggttggaaactagagggagaatggaaggaaggggaggaagttcaagtcctggccttggaacccgggaaaaacccaagggcggtacagacgaagcctggcatcttcaaaaccaatactggaacgataggggctgtatcactcgactttagtccaggaacaagcggatctcccatcgtagatagaaaaggaaaagtagtaggactttatggcaatggcgtagtaacacgttcaggagcgtacgtatcagctatagcacaaacagaaaaaagtatagaagataaccctgaaatcgaagatgatatctttcgaaaaaaacgtctgacaataatggacctacatcctggagccggtaaaaccaaacgatatttacctgccatagtacgagaggccataaaacgcgggttaagaacactaatactcgcgccaactagggtggtagcggcagaaatggaagaagcattacgcggcttaccaatacggtatcaaactccagcaattaaaacagagcacacagggcgcgaaatcgtggatctgatgtgccatgccacttttacaatgaggttgttaagcccagtcagggtaccaaattacaatttaataataatggatgaagctcatttcactgacccagcaagtattgcagcgaggggttatatatcaactagagtggaaatgggtgaagcggccggcatattcatgactgccaccccgccaggttcccgtgatcctttcccacaaagcaatgctcccataatggatgaagagagagagatcccagaacgatcatggaatagcggacatgaatgggtaacagattttaaaggaaaaactgtgtggttcgttccatccataaaggccggtaacgatatcgcggcgtgcttaagaaaaaacggaaaaaaagtcatacaactaagtcgaaaaacattcgacagtgagtacgttaaaaccagagctaatgactgggatttcgttgtgactacagacatatcagaaatgggagctaactttaaggctgagcgtgtgatagacccacgacgatgcatgaaaccagtaatcctaactgatggtgaagaacgggtaattttagcaggacccatgccagtaacacactcatccgcagctcagaggcggggtagaattggaagaaaccccaaaaatgaaaatgaccagtatatatatatgggggaacccttggaaaacgacgaagactgcgcgcactggaaagaagctaaaatgctgttagacaatattaatacaccggagggaatcatacccagtatgtttgaaccggaaagggaaaaagttgatgctattgacggtgagtatcgattaaggggtgaagctaggaaaacctttgtagatttgatgagaagaggagacttaccggtgtggttagcatataaggtggccgcagagggaatcaactatgcagaccgtaaatggtgttttgacggaattaaaaataatcaaatactggaagaaaatatggaagtggaaatttggaccaaagaaggcgaaagaaagaaattaaagccgcgatggctagatgctaggatttatagcgatcctctagctttaaaagagtttaaagaatttgcagccggaagaaaaagtctaactctaaacctaataacggagatgggaagactgcctacctttatgactcaaaaagcccgaaatgctcttgataatcttgcagttttacacactgcggaagcaggtggtcgtgcatataatcatgcgttatcagaattaccggaaacactagagacgctgttattattaactttgttagcaacagtcacggggggaattttcttattcctaatgagcggcaaggggataggaaaaatgacgctgggaatgtgttgtatcatcacagcaagcattttactatggtacgcccaaatacaaccacattggatagcggcaagcatcatattggaattttttttaatcgtattgttaataccagaacccgaaaaacagaggacgcctcaagataatcaactcacgtatgtagtaatcgcaatcttgaccgtggtagcagcgacaatggcgaatgaaatggggtttcttgaaaagacaaaaaaagacttgggtttaggaagtatcaccacacaagaatcagagagtaacattttggacatcgacctccgacccgcatcagcttggactctttacgcagtggccacgacattcgttacgccgatgctcaggcattcaatcgagaattcttcagtaaatgtctcccttacagccatcgctaatcaagctacagtcttgatgggcctagggaaagggtggccattaagtaaaatggacataggagtacccttactggctattggttgctattcacaagtcaatccaataactttaaccgcagcgttgcttcttttagtagcacactatgcgattataggcccaggcttacaagctaaagcaacgagggaagctcaaaagagggcagctgcaggcatcatgaaaaacccaacagtagatggtattacagtgatagaccttgaaccgattccatacgacccgaaatttgaaaaacagttaggccaagttatgctacttatattatgtgtcactcaagtattaatgatgcgcacaacgtgggcattatgtgaggccctcactctggcaaccggaccgatatcgacactatgggaaggaaacccaggacgcttttggaatactacgatagccgtaagcatggccaatatcttccggggatcttatcttgcgggggcaggtttactcttcagcatcatgaagaatacaacgagcacacgccgcggaactggtaacataggagaaaccttgggagaaaagtggaaatctaggttaaatgcgctcggaaaaagcgaatttcaaatatataagaaatctggaatacaagaggtggatcgtacgctagctaaagaaggaataaaaagaggagagacagatcaccatgcagtatcacgcggatcagcaaaactaagatggttcgttgaaagaaatatggtcacccctgagggtaaagtcgtagacctcggttgtggaaggggcggctggagctattactgcggtggtttgaagaacgttcgggaagttaaaggtttgacaaaaggcggtccaggacacgaagaacctatacccatgtccacatatggatggaacttagtaagactacaatctggtgtagacgtattttttactccaccagaaaaatgtgacacattactatgcgatataggcgagagctctccgaatcccaccattgaagctggacgaacattacgtgtacttaacttggtagaaaattggctgaataataatacgcaattttgtattaaagtacttaacccttatatgcctagcgttatagaaaaaatggaagcactacaaagaaaatacggcggggcactggttagaaaccccctctcgaggaatagcacccacgagatgtattgggtctctaatgcaactggaaatatcgtcagttcggtaaacatgataagtcgaatgctcataaataggttcacaatgaaacataaaaaaactacatatgaaccagacgtcgacctaggaagcggcacgagaaacatagggattgaaagtgaaatcccaaatcttgacattataggtaaaaggatagaaaaaattaaacaagaacatgaaacttcatggcattacgaccaggatcacccctacaaaacgtgggcctatcatgggtcatacgaaacaaaacaaacagggtcagcgagttctatggtaaacggtgtagttcgcttgttaacgaagccatgggacgtagttccaatggtaacccagatggcaatgacggataccacaccattcggccaacaaagagtattcaaagagaaggttgacaccaggacacaagagccgaaagagggtacgaaaaaactaatgaagataacagctgagtggctatggaaggagctaggcaaaaaaaaaacgccaagaatgtgtacacgggaggaatttactaggaaagtaaggagcaacgccgcactaggtgccatatttacagatgaaaataaatggaagtcagcaagggaggccgtagaagatggaagattctgggagctagtagatagagaaaggaacctacacttagaaggtaaatgcgagacctgcgtgtataatatgatgggaaaacgcgaaaagaaactgggagaattcggcaaagctaaaggctcgcgagccatttggtacatgtggctaggagcgagattcttggaatttgaggctctcggctttttaaacgaagaccattggtttagtcgtggaaattctctcagtggtgtggaaggagagggcctacatagattgggatatattcttagggatgtttcaaaaaaggaaggaggagctatgtacgcagatgataccgccggatgggatacgaggataactttagaagatctcaaaaacgaagagatggttactaaccatatgaaaggagaacacaaaaaattggctgaggccatatttaagctaacttatcaaaacaaagtagtacgtgttcaaaggccgactccacgtggcacagtaatggatatcatatcgaggagagaccagagaggttcggggcaagttggaacgtacggtctcaacacatttacaaatatggaagctcaactcatacgacagatggagggggagggaatatttaaatcaatacagcacctaaccgcaacggaagaaatagtagtgcaaaattggcttgcacgagtgggcagagaaagactttcccgcatggcgatatccggtgatgattgtgttgttaaacctatcgatgatcgtttcgcgtctgctctgacagctctgaatgatatgggtaaggtaagaaaggatatccagcaatgggaaccaagtcgaggatggaacgattggacacaagtaccattttgctcgcatcattttcatgagctcgtaatgaaggatggccgtgtcctagttgtgccgtgccgaaatcaggatgaactgattggacgtgcaagaatctcccaaggtgcggggtggtccctaaaagaaactgcctgccttggtaaaagttatgcacaaatgtggacattgatgtactttcataggagagatcttcgattagcggcaaatgcaatttgtagcgcggtaccgagtcactgggtaccgacctcacgtaccacatggtctatacacgctaaacacgaatggatgacaactgaagacatgctcgcagtttggaatagagtctggatccaagaaaacccatggatggaggataaaactcccgttgaatcgtgggaggaagtaccttatttgggaaaaagagaagaccaatggtgcggatcacttatcggactcacatcacgggcaacctgggctaaaaacatacaaactgctataaatcaggtccgatctttaataggtaatgaagaatacacagattatatgcccagtatgaagagatttcgaagagaggaagaggaggccggagttctgtggtag

SEQ ID NO: 22463 - RNA, 9876 nt, synthetic construct
  misc_feature 1..9876: note = derived and/or modified CDS sequence (opt6) from DENV-2__EU482599__SS-prME
  source 1..9876: mol_type = other RNA
actgccggagttatagtaatgttaatacccacagccatggctttccaccttacaacaaggaatggtgaaccgcacatgatagtggggcgccaagaaaaaggaaaatcattacttttcaaaactgaagatggtgtaaatatgtgtactttaatggccatagacttaggagaactctgcgaagacacgataacttacaaatgtccattattaaggcaaaacgaaccggaagatatagactgctggtgtaatagtacatccacttgggtcacttatggaacgtgcacaacgacgggtgaacatagaagagagaaaaggtcagtggcgctcgtaccacatgtcgggatgggactagaaactagaactgagacgtggatgtcatcagaaggagcatggaaacatgtacagcgaatagaaacgtggatattacgacatcctggcttcacaataatggctgccatactcgcatatacaatcggcaccactcattttcaaagggccctaatatttatccttttaacagctgtagcgccatctatgacgatgcggtgcataggaatatctaatagagacttcgtcgaaggagtatcaggcggtagttgggtagacatagtgctagaacacgggtcatgtgttacgactatggcgaaaaacaaaccaacattagatttcgaattaataaaaacagaggccaaacaaccagcaacattgcgaaaatattgtattgaagcaaaactaacaaatacgaccacagaaagtagatgtcctactcaaggcgaaccgtctctaaatgaagaacaagacaaacgctttatatgtaaacacagtatggtagatagaggctggggtaacggttgtggattatttggcaaaggaggtatcgttacatgtgcaatgtttacatgcaagaaaaatatggaaggaaaagtagtacaacctgaaaatctagaatatacaatcgtaattacaccacattcaggagaagaacatgcagttgggaacgataccggaaaacatggtaaagaaattaaaataactccacaatcatcaataacggaagcagagctaactggttacggtacagtcaccatggaatgttcaccgcgaacagggttagattttaatgaaatggtactacttcagatggaggataaagcatggttagtccacaggcaatggttcctagatctaccgttgccctggctaccgggggctgacacacaaggctctaactggatacaaaaagaaacgctggtcacattcaaaaacccacatgccaagaaacaagatgtagttgtactaggatctcaagaaggagctatgcacacggctttaacaggagccacagagattcaaatgtcttcaggaaatctccttttcaccggacatctcaaatgtcgcctgagaatggacaaacttcaactaaaaggaatgtcttactcaatgtgcacggggaaatttaaaattgtaaaagagatagcagaaacccaacatggcactattgtaataagagttcagtacgaaggtgatggttctccatgtaaaataccatttgaaataacagacttagagaaaaggcatgtattaggacgattaataactgtaaacccaatagtaaccgaaaaagattctccggtcaatatagaggctgaaccaccatttggcgattcctatatcattataggggtggagcctggccaattaaaactgaactggttcaagaaaggaagttctataggccagatgtttgagacaacaatgagaggcgcaaaaagaatggcaatactcggcgacacagcctgggattttggctcactcggaggcgtttttacctctataggaaaggctttacatcaagtatttggcgcaatttacggggcagcgttttcaggtgtaagctggacgatgaaaattttaattggagtcataataacttggataggaatgaacagccgctcgacatcactttcagtatcattagtactggtaggtgtagtcaccctatacctaggagcaatggttcaagcagattcggggtgtgttgtatcatggaaaaataaagaattaaaatgcggttcaggaatttttataacagacaatgtgcacacgtggacagaacaatataaatttcaaccagaaagcccatctaaattggcgagtgcaatacaaaaagcccatgaagaaggtatatgcggtatcagaagtgttacaagactagaaaatctaatgtggaagcaaataacaccggagctcaatcatatactttcagaaaatgaggtgaaacttacaattatgacaggcgatattagggggataatgcaagcaggaaagagatcactccgtcctcaacctacagaactaaagtactcatggaaaacgtggggaaaagcgaagatgttaagtacggagagtcataaccaaacttttctaatagacggaccagaaacagctgaatgtcctaacacaaatcgagcatggaatagtcttgaagtggaagattacggtttcggagtctttaccacaaacatatggttaaagctcagggaaaaacaagatgtattttgtgatagtaaactaatgtcagcagcaatcaaggacaatagagcagtgcatgcggacatgggatattggattgaatcagcactcaatgacacatggaagatggaaaaagcctcatttatagaagtcaaatcatgccattggccaaagtcccatacactttggagcaatggagtgcttgaatcagagatgatcattcccaaaaactttgccgggcccgtttcgcaacacaattacaggccaggataccatacacagactgcaggaccgtggcatttagggaagctcgaaatggatttcgatttatgtgaaggtactacagtcgtagtaaccgaagattgcggtaatagaggaccttctttaagaactacaacggcttctggtaagttaattactgaatggtgctgtcgtagctgtactttacccccattacgatatcgtggggaagatggctgctggtacggtatggaaattaggcccctaaaagaaaaggaagaaaatttagtcaattcattagtaactgctggccatggtcaaatcgacaactttagtctaggggtgctggggatggcactctttctcgaggaaatgctaagaacaagaatcgggacaaagcatgcgattttgttagttgcagtttcatttgtgaccctgataacaggtaacatgtcatttagagatctaggacgcgtaatggtaatggtaggtgctacaatgacagacgacatcggaatgggtgttacatatttagcattactcgcggcctttaaagtccgtcccacattcgcagcgggtctacttctgcggaaacttacatcaaaagaattgatgatggcaaccattggtattgctctgttaagtcagagtaccatacccgaaacgatattagaactaactgacgcgttggcattaggaatgatggttctgaaaattgtacgaaacatggaaaaatatcaactagcagtgactataatggtgatatcatgtgtgcccaacgcagtcatcttacagaatgcgtggaaagtgagttgtaccatattagcagcagtgtcagtaagtccactactattaacgtcttctcaacaaaaagctgattggatacccttggcattaacgataaaaggtctgaatccgacggcgatatttttgactacactgagtagaacgagcaagaaacggtcgtggccgctcaatgaggcgattatggccgtgggtatggtgagtatccttgcctcaagtcttctaaagaacgacattcccatgacaggcccactcgttgcaggaggccttttaactgtatgctatgttctaacgggacggtctgcagacttagaactagagagggcagcagatgttaaatgggaagaccaggcggagatatcaggatcttcaccaatattgtccataacgataagtgaggatggttcaatgtcaatcaagaatgaggaagaggaacagactttaacaatactaatacgaacaggtctcctagttatcagcggagtatttccagttagcatcccgataaccgctgcggcttggtacttatgggaggtcaagaaacaaagagcgggcgtgctatgggacgttccttcaccacccccggtagaaaaggcagagcttgaggatggtgcctataggataaagcaaagagggattttaggatattcccaaataggagcaggcgtttataaggaaggcacattccacacgatgtggcatgttacacggggagcggttctaatgcatcgaggaaaaagaatagaaccaagttgggcagatgtcaagaaagatctgatatcttacggaggagggtggaaattggaaggggaatggaaagaaggagaggaagtacaagtactagcattagagccaggtaaaaacccgcgagcagtacaaactaagcctgggattttcaagacgaatactggaacgatcggggcggtaagtctagatttctcaccgggaacaagcgggtcgccaatagtggacagaaaaggcaaagtagtggggctatatggtaatggggtagtgacacgctctggtgcttacgtttcagcaattgcacagacagaaaaatcgatcgaagataatccagaaatcgaagatgatatttttagaaagaaacgtttaacaattatggacctacatccaggtgccggaaaaacaaaaagatacttaccagcaatcgtgagggaagctataaagcgcggactcagaacgttaattttggcacctacacgagtagtcgccgcagaaatggaagaagcactgcgaggacttcccataagatatcagacaacagccataaaaacggaacatacaggaagagaaatagttgatcttatgtgccatgcaacttttactatgaggttactgtcacccgtacgcgtaccgaactataacttaataataatggacgaggcacactttaccgacccggcctcaatagcagctagaggatatatcagtactcgagtagagatgggagaagccgccggcatattcatgactgcaaccccgcctggaagtcgcgacccctttccacaaagtaatgcacctatcatggatgaggaacgagaaataccagaacgatcatggaatagtggccatgaatgggttaccgacttcaaaggcaagacagtgtggttcgtgccatctattaaagcaggaaatgacatagccgcctgcctaagaaagaatggcaagaaagtaattcaattatccagaaagaccttcgattcggagtacgtcaaaacaagagccaatgattgggattttgtcgtgacaacagacatttctgaaatgggcgcgaacttcaaagccgagcgcgttatagatcctcgaaggtgtatgaaaccagtgattttaacagatggagaagaaagagtaatactagccggtcctatgccagtaacacactcaagcgctgcacagcggcgtggaagaattggaagaaatcctaaaaacgaaaacgaccaatatatatatatgggcgaaccactggaaaatgacgaagattgtgcacattggaaagaggcaaaaatgctcttagacaacataaatacccctgaaggaattatccctagcatgtttgaaccagaaagagagaaagtggacgcaatagatggggaataccgattaaggggtgaagcgaggaagacgttcgtcgatttgatgaggagaggggatctacccgtttggttagcatataaagtagccgctgaaggtataaactacgcagatcgaaaatggtgtttcgatgggatcaaaaacaaccaaatcctagaggaaaatatggaagtcgaaatatggactaaagaaggggagcgaaagaaattgaaaccaaggtggctcgatgctcgaatatattctgaccccctcgcattaaaggagtttaaagagttcgcagctggaagaaaatcgctaactctaaatttaattaccgagatgggccgtcttccaacatttatgacgcagaaagcaagaaatgctctagataatttagccgtattacacacggcggaagctggtgggagagcatataaccacgctttaagtgaattaccggaaacactggagaccttactgctgttaacattattagctacagttacgggagggattttcttgtttctaatgagcggcaaaggaataggaaagatgaccctgggcatgtgctgtataatcactgcctcgattcttctatggtacgcacaaatacagccacattggatagcagccagtataattctggaatttttcctgatcgttttattaataccggaaccggagaaacaaagaactccacaagacaaccaattgacctatgtcgtgattgcaatcttaacggtcgttgccgcgacaatggcaaatgaaatgggatttctcgagaaaacaaagaaggatcttgggttaggaagcataacaactcaagaatcagaatccaatatattagacatagacctcagaccagcctcggcctggacactgtatgctgttgcaaccacctttgtgacccccatgcttcggcactcaatagaaaattcctcggtcaacgtaagccttaccgcaatagcaaaccaagcaacagtattaatgggtttaggaaaaggatggcctctctcaaaaatggacattggtgtaccgctattagcgatcggatgctattcgcaggtaaatccgataacactaacagcggcactacttctattggtggcgcactatgctattataggccccggtttacaagccaaagctacaagagaagctcaaaagcgagctgcggcaggaataatgaaaaatccgacagtagatggaattacagtcatagacctagaaccaataccatatgatccaaaattcgaaaagcaactaggacaggttatgttacttatactgtgcgtaacccaagtcttaatgatgcgaactacttgggcgttatgtgaagctctcacacttgccacaggaccaattagtacgctatgggaaggcaatcccggtcggttttggaatactacaatagcagtatccatggcgaacatattcagaggaagctatttagctggagctggcttattattctctatcatgaaaaacacaacaaacacccgtcgaggaacaggtaacattggagaaacgctcggagaaaaatggaagtcccggcttaatgctctaggaaaatcagaatttcagatatacaagaaaagcgggattcaagaggtcgacaggacattagctaaagaaggaataaaaagaggagagacagatcatcacgcagtatcaaggggatctgctaagttaagatggtttgtggaaaggaacatggtaacgcctgaaggaaaggtagtagaccttggatgtggacgtggtggctggagttactactgtggtggcctaaagaacgtacgggaggtaaaaggcctcacaaaaggaggtccaggtcacgaggaacctataccaatgtccacgtatgggtggaatcttgttagattgcaatcaggagtcgacgtattctttacaccaccagagaagtgtgatacactactttgtgatataggcgaatcttctcctaatcccaccattgaagcagggcgaacgctacgtgtactaaacttggtagagaattggctgaataataatactcaattttgtattaaagtacttaacccttacatgccatccgtcatagagaaaatggaagcactccaaaggaagtacggaggggcattagtccgcaacccattatctagaaacagcacacacgaaatgtactgggtctcaaatgcaacaggcaacatcgtaagttctgttaatatgataagcagaatgttgataaaccgatttacgatgaaacataaaaaggcaacatatgaacccgatgtagatcttggaagtgggactaggaatatcgggattgaaagtgaaattcctaacttggatataataggtaagagaattgagaaaattaaacaagagcatgagacgtcatggcattatgaccaggatcatccatacaagacatgggcatatcatggatcctacgaaactaagcaaacgggttcagcaagcagcatggtaaacggagtagtacgcttactaacaaaaccatgggatgtggttcctatggtaacccaaatggctatgactgacactaccccattcggccagcaacgcgtattcaaagaaaaagtcgataccagaacacaagaaccaaaagaaggtaccaagaaattaatgaaaatcactgcagaatggttatggaaagaattaggcaagaagaaaacaccgaggatgtgtacccgcgaagagttcaccaggaaagtccgatcaaacgccgcactcggagctatatttactgatgagaacaagtggaaatctgctagagaagcggttgaagatggacgcttttgggaactggtcgatcgggagcgcaacctacatttagaaggcaaatgtgagacatgtgtatataatatgatgggtaaaagggagaagaaattaggagaatttggtaaagcaaaaggatctcgtgccatctggtacatgtggcttggcgctaggttcctggagttcgaggcactcggatttctaaatgaagaccactggttttccagagggaatagtttaagcggagtcgaaggcgagggtttacatcgcttaggatacatattacgtgacgtgggcaagaaagagggaggagctatgtacgcagacgatacagcaggatgggataccagaataacactcgaagatcttaaaaatgaggaaatggttacaaatcacatgaaaggagaacacaagaaactagcggaagctatatttaaactaacatatcaaaataaagtggtaagagtgcaaaggccaacaccaagaggtacggttatggacatcatttcccgccgtgatcaacgaggttcaggtcaagtcggaacatatggcctaaacacatttacaaacatggaggcccagttaatccgacagatggaaggagaaggaattttcaaatcaatccaacatttaaccgctacagaagaaattgccgtacaaaattggctagcacgagtgggacgtgagcgcctatcccgtatggctatcagtggggacgattgtgtcgttaagccaatagatgatcgattcgcatcggcactaacagccctaaacgatatgggaaaagttagaaaagatattcaacagtgggaaccttctagaggttggaatgactggacacaagtaccattttgttcccatcattttcacgaattagttatgaaagacgggagagtcctcgtagtaccatgcaggaaccaagatgaactgattggtagagcacggatatctcaaggcgcaggatggtcccttaaggaaacagcatgtttaggcaaaagctacgctcagatgtggactttaatgtactttcacagacgcgatctacgactagcggccaatgctatttgtagcgctgtgccaagtcactgggtaccgaccagccgcaccacatggtccatacatgctaaacacgaatggatgaccacagaggacatgttagctgtctggaatcgagtatggatccaagaaaacccgtggatggaagataaaacacctgtagaatcctgggaggaagttccatacctaggcaaacgcgaagaccaatggtgtggatcgctaataggcttaacatcacgagcgacatgggccaaaaacattcaaacggccataaatcaagttcggagtctaatcgggaacgaagaatacactgattacatgcccagcatgaaacgtttccggagggaagaagaagaagcaggagtactatggtaa

SEQ ID NO: 22464 - RNA, 9876 nt, synthetic construct
  misc_feature 1..9876: note = derived and/or modified CDS sequence (opt6) from DENV-2__FJ898436__SS-prME
  source 1..9876: mol_type = other RNA
actgcgggagttattgtgatgttaatacctaccgctatggcatttcacttaactacacgaaatggtgaacctcatatgatagtaggacgacaagaaaaagggaaatcccttctatttaaaaccgaagatggtgtaaatatgtgcactctgatggctattgaccttggcgaactttgtgaagatacgataacctataaatgtccgttattaagacaaaatgaaccagaagacatagactgttggtgtaattcgacctcaacatgggtaacctacggtacatgcacaaccactggggaacatagaagagagaaaagatcagtagctctggtaccgcacgtagggatgggactcgaaacccgtacagaaacatggatgtcttcagaaggagcatggaaacacgtccaacgaatagaaacttggatcctaagacaccctggatttaccatcatggcagcaattcttgcatatacaataggaacaacgcactttcaacgagctctgatattcatactgcttaccgctgtggcaccttcaatgacaatgaggtgcattggaataagtaatcgagattttgtagaaggcgtaagcggaggaagttgggttgatattgttctagaacacggatcttgcgtaacaacgatggccaaaaataaaccaaccctcgatttcgaactaattaaaactgaagcaaaacaaccagctaccctaagaaaatactgtattgaagcaaaactcactaatactactacggaatccagatgtccaacccagggtgagccttcattaaatgaagaacaagataaaagatttatctgcaaacattcaatggtagatagaggatggggaaatggctgtggtttgtttggtaaaggtggtatcgttacgtgcgcaatgttcacttgcaagaaaaatatggaaggtaaagtagtccagcctgagaatctagaatatacaatagtaattaccccgcatagcggtgaggaacatgcagtcggcaacgacactggaaaacatggaaaggaaattaaaatcacaccacaaagtagtatcacagaagctgaattaaccggatatggaacagtgaccatggaatgttcaccaagaactggactagacttcaacgaaatggtacttctacaaatggaagacaaagcatggttagtccatcgacagtggttcctcgacttacctttgccttggcttccaggcgctgatacacaaggctcaaactggattcaaaaggagacattagtgacatttaagaacccacacgccaagaaacaagatgtagtcgtactcgggtcacaagaaggtgctatgcacacggccttaacaggagcgaccgaaattcagatgtcctcaggaaacttacttttcaccggtcacctcaaatgtagattacgaatggataagctgcagctaaaaggtatgtcttactcgatgtgcactggcaaatttaaaatagttaaagagattgctgaaactcagcacggcactattgtcataagggtccagtacgaaggagatggaagcccatgcaagatacctttcgaaataacagacctagagaaaaggcacgtcctaggaagattaatcacagtaaatccaatagttactgagaaagactcgcctgtcaacatagaagcggaacccccattcggagattcatacattattattggggtagaacctggacagttaaagctaaattggttcaagaagggatcgagtatagggcaaatgtttgaaactaccatgcgcggagccaagagaatggccatattaggggacacagcatgggacttcggcagcttaggtggagttttcaccagtataggaaaagcacttcaccaagtctttggtgcaatatacggggcagctttctcgggcgttagctggacaatgaaaatcctaatcggcgtaattataacatggattggaatgaatagtagaagtacaagtctaagtgtatccttagttttagtgggcgttgttacattatacctaggagccatggtacaagctgattctggctgtgtagtaagttggaagaataaggagttgaagtgtggtagcggtatctttattacagataacgttcatacatggacagaacaatacaaattccagcctgaaagtccatcaaaactcgctagcgccatccaaaaagcccacgaagagggtatttgtggcatcagatcggtaacgcgattagagaatctgatgtggaaacaaattactcccgaattaaatcacattctatctgagaatgaagtaaaacttacaatcatgacaggagatattcgaggaatcatgcaagcgggtaaaagatcacttcgacctcaacctacagaattgaagtattcttggaaaacatggggaaaagctaaaatgctttcaacagaatcacataatcagacctttttaatagatggacctgaaacagctgaatgccccaacactaacagagcatggaactcattagaagtagaagattatgggtttggggtcttcacgactaatatttggctgaaactacgcgaaaaacaagacgtattctgtgattcaaaactaatgtccgcagctatcaaagataatagagcggtgcatgctgatatgggatattggattgaatcagcattaaatgatacatggaagatggaaaaggcttcattcattgaagtaaagagttgccattggccgaaatcacacacgctatggtctaacggcgtactagaaagtgagatgattatccccaaaaatttcgctggccctgtttcccaacataattacagaccaggctatcacacccaaacagcaggtccgtggcatctcggaaaactcgaaatggactttgatctctgcgaaggtactacagtcgtagtaacggaagattgcggaaacagaggaccctcactaagaacaacaacagccagtggaaaactaataacggaatggtgttgcaggtcatgcacacttccacctctgcgttaccgcggtgaagatggatgctggtacggaatggaaattcgaccattaaaagagaaagaagaaaatttggtaaacagcttagtaacagcaggccatggtcaaattgataactttagcttaggcgtcctgggaatggccttattcctagaagaaatgctacgcaccagaatcggaactaagcatgccatcctgctcgtcgcagtaagttttgtaaccctgattacggggaacatgagtttccgtgatttgggcagagtaatggtaatggtgggagctacgatgactgatgatattggaatgggggttacttacctggccttactagcagctttcaaagttagaccaacatttgcagcaggtctattattgaggaaattaacaagtaaggagctaatgatggctacaataggaatagcccttctgtcccaatccacaatacccgaaactatacttgaactcacagatgctcttgcattaggaatgatggttttgaagattgtaagaaatatggaaaaatatcagctcgctgtaaccattatggccatctcctgcgtaccaaacgcagtaatcttacaaaatgcatggaaagtctcatgtaccattctagcggcagtttcagtaagcccattgctacttacaagcagccaacaaaaagcagactggattcctttagcgctgacgataaagggacttaatccaacagctattttcttaactactctaagcagaaccagcaagaaaagatcttggcctttaaacgaggctataatggcggtaggaatggtttctatactagctagctcactcctgaagaacgatataccaatgaccggtccgctagtcgcgggaggactactcacagtctgttacgtactcacaggccgttcggcagatctagaactagaaagagcagctgatgtgaaatgggaggaccaagctgaaatatccggcagctcaccgatactgagtattacaatatctgaagatggctccatgtcaatcaaaaatgaagaagaggaacagacgcttacgatccttataagaactggtttgcttgttataagtggtgtgttccctgtttcaatacctattacagcagccgcttggtacttatgggaggttaagaaacaacgggctggagtattatgggatgttccaagtccccctcctgttgaaaaagcagaactagaagatggtgcgtatagaatcaaacaaaggggcattctaggatatagtcaaattggtgcaggagtctacaaagagggtaccttccatacaatgtggcatgtgactagaggcgcagttcttatgcacagaggaaaaagaatagaaccgtcgtgggctgacgtcaagaaagatttaatatcctatgggggaggatggaaacttgaaggagagtggaaagaaggcgaagaggtacaggtcctagcactagagccgggtaagaacccgagagcggtgcagactaaacctggcatttttaaaacaaatacgggcacaataggtgcagtcagcttggacttctcaccgggaacatcgggttcacccattgtagatcgtaaaggaaaagtagtcggtctttatggtaatggggtagtaacccgatcgggcgcatatgtcagtgcgatcgctcaaactgagaaaagcatcgaagataatccagaaatcgaagatgacatatttaggaagaaacggctaactattatggacctgcacccaggggcgggaaagactaaaagatacttgcccgctatagtgagagaagctataaagagaggactacgcaccctaatcttagcacccactagggttgttgcagcagaaatggaagaggctttaagagggttaccgataagatatcaaacaacagcgataaaaacggaacacacaggtagagagattgttgatttaatgtgccatgccacgtttacaatgaggctcctatcgcctgtaagagtgccaaactataatttgattataatggatgaagcccactttacagacccggcatccattgccgcaagaggatacatctccacacgggttgaaatgggagaagcagctggtatatttatgacagcgacaccgccagggagccgggaccctttccctcagtcaaatgctccgattatggatgaagaaagagaaatacccgaaaggagttggaactcgggccacgaatgggtaaccgattttaagggaaagacggtttggtttgttccaagcataaaggctggcaacgacatagccgcatgcctaaggaaaaacgggaaaaaggtcatccaactttcaagaaaaacgtttgactcagagtatgtcaaaacaagggccaatgattgggatttcgtggtaacgaccgatatcagcgagatgggagcgaactttaaagcagagcgagtaatcgatcccagaaggtgcatgaaacctgttatattaacagatggcgaggaaagggtaattttagcaggtcccatgccagtcacacattcctccgcggcacagagacggggaagaattggaagaaatcccaaaaacgagaacgatcaatacatttacatgggtgaaccactagaaaatgatgaagactgtgcccactggaaggaagcaaaaatgcttctcgataacataaatacaccagaaggaataataccaagcatgttcgagcctgaacgcgaaaaggtcgacgcgatagacggtgaataccgacttagaggggaagctagaaaaacatttgtagatcttatgcgcaggggagatttgccagtgtggttggcatacaaagttgcagctgaagggattaattatgcggataggaaatggtgctttgacggtataaagaacaatcaaatactcgaagaaaacatggaagtagaaatatggacaaaagaaggtgaacgaaagaagctaaagccaagatggcttgacgcacggatatactcggatccacttgcactaaaagagttcaaagagtttgcagccggacgaaagagtctgaccctgaatctaataacagaaatgggacgtctaccaacattcatgacgcaaaaagcgaggaacgcacttgataatctagccgttttgcatactgctgaagcgggagggcgggcctacaaccatgcactatcggaattgcctgagacgttagaaacacttttgttattgaccttactagcaacggtaacaggaggcatattcctctttttaatgagtggaaaaggaatcggtaagatgacacttggaatgtgctgcatcataacagcaagcatattactatggtatgcccaaatacagcctcactggattgcagcttccataatccttgagttcttccttatagtcctccttatacccgaaccagagaaacaacgaacaccacaagataatcagctcacctacgtagtaatagctattctaacagttgtagccgcaacgatggcaaatgagatgggtttccttgagaagactaagaaagacttgggcttaggttccattactactcaagagagtgagagtaatatcctagatatagatctacggccagcttcggcctggactctgtacgctgtggcgacaacatttgtgaccccgatgcttcgacattcaatagaaaattcaagcgtaaacgtttctcttaccgcaatcgctaaccaagcaaccgtactgatgggactagggaaaggatggcccctctcgaaaatggatattggtgtacctctactcgcgattggatgctattcacaggttaacccaattactctgacagcagctctactactcctagtagctcattacgctattataggacccggcctgcaagccaaagcgacacgcgaagctcagaaaagagccgcagctggtataatgaaaaatccgaccgtagacggtataaccgtaattgatcttgaacctataccttatgatcccaagttcgaaaaacaactaggtcaagtaatgttattaatattatgcgttacccaagttttaatgatgagaacgacttgggcactctgtgaagcattgacactagcaacagggcccatttcgacactttgggaagggaacccaggacgattctggaacacaacaattgcagtcagtatggccaatatttttagaggatcatatttagcgggtgcaggactgttattctcgatcatgaaaaatacaaccaacactaggagaggtacagggaacatcggtgaaactctgggagaaaaatggaaatcacgtctgaatgcattaggaaagtcggagttccaaatatacaagaaatcggggatccaagaggtagatagaaccttagcgaaagagggaataaaaagaggagaaacggatcatcacgcggttagtcgtggtagcgctaaactaagatggttcgtagagagaaacatggtaaccccagaaggaaaagtagtggatttaggctgtggtaggggtggatggtcatattattgcggaggcttgaaaaatgtacgagaagttaaaggattaactaaaggaggtccaggtcacgaggaaccgataccaatgtcaacctatggttggaacctggtaagattgcaatcaggtgtagacgtatttttcacacctccagagaaatgcgatacattactttgtgatataggagaatcatcaccaaatccaaccatcgaagcaggtagaactctacgtgtactgaaccttgtagaaaattggctaaataataatacacaattctgtataaaagtactcaatccttatatgccgagtgtcatcgagaaaatggaagcgttacaacgcaagtacggaggcgcattggtaagaaatcctttgtcaagaaacagcacgcacgaaatgtactgggtatcaaatgctacagggaacattgtaagttcagtaaacatgataagtagaatgttaattaataggtttaccatgaaacacaaaaaggctacatatgaacctgatgttgacctcggatcaggtacaagaaatattggaattgaatcagaaattccaaatctggatataatcggcaaacgcatagaaaagataaaacaagaacacgaaacctcgtggcattatgatcaagatcacccctataaaacttgggcttaccatggctcttacgagaccaaacaaaccggatctgcatcatctatggtaaatggagtagtacgactactaacaaagccatgggatgtagtaccaatggtgacccaaatggctatgaccgataccactccatttggacaacagagggtcttcaaagaaaaggttgatacacggactcaagaacctaaggaaggaacaaagaaattaatgaaaattacagctgcatggctttggaaagaattgggtaagaagaagacccccagaatgtgtactagagaagagttcacccgcaaagtaaggagtaacgcggccttaggtgcaatctttactgacgaaaataagtggaagagtgcccgagaagctgttgaagatggtaggttctgggaattagttgatagagaaagaaacctgcacttagaggggaagtgtgaaacgtgtgtatataatatgatggggaaacgagagaagaaattgggagaatttggaaaagctaaaggtagccgagcaatttggtacatgtggttaggggcacgatttctagaatttgaagcactcggttttctcaatgaagaccattggtttagtaggggcaattcattatctggagtcgaaggagagggcctccataggcttggttatatactgagggatgtcggaaagaaagaaggaggggcgatgtatgcagacgatactgcaggatgggacactcggatcacgctagaagacctgaaaaatgaagaaatggtaaccaaccacatgaaaggagaacataagaaattagctgaggctatatttaaattgacgtatcaaaataaggtcgtaagagtacaacgcccaacgccgagaggaacggtaatggatatcatctctcgtagggaccaaagaggatccggacaagtcggtacatacggattaaatacgtttactaatatggaagcacagcttattagacaaatggaaggggaagggatatttaaaagtatacaacatctaacagcaaccgaagaaatagcggtacaaaattggctcgctagagttggtcgagagagactctctcgaatggccataagcggggacgattgtgttgtaaagcctatagatgatagatttgcatcggcattaaccgcactaaatgatatgggtaaagtacgtaaggacatccaacagtgggaaccgtctcgtggatggaatgattggacacaagtgccattttgttcacaccattttcacgaactggtaatgaaagatggaagagtcttggtcgtaccttgccggaaccaagatgaattaataggtcgagcaaggataagccagggagccggttggagtctaaaagaaactgcttgtcttgggaagtcgtatgcacaaatgtggacactgatgtatttccatcgccgtgacctgagattagcggctaatgcgatctgctctgcagtgccctcgcactgggtacctacatctagaacaacttggtcgatacacgctaagcacgaatggatgacaacggaagacatgttagcagtatggaatcgtgtatggatacaagagaatccatggatggaggataaaacaccggtggagtcctgggaggaagtaccatatctgggaaaaagggaagaccagtggtgtggcagtctgataggacttacgagccgagctacttgggccaaaaatatacagacggcaattaaccaagttcgatcactaataggtaacgaggaatatacagattacatgccgtcgatgaaaagatttcgtagggaagaggaagaagccggtgtactatggtaa

SEQ ID NO: 22465 - RNA, 9876 nt, synthetic construct
  misc_feature 1..9876: note = derived and/or modified CDS sequence (opt6) from DENV-2__EU482634__SS-prME
  source 1..9876: mol_type = other RNA
acagcgggagttatcgtaatgctgattcccacagctatggcatttcatctgacaacaagaaatggtgaaccccatatgattgtcgggagacaagaaaaaggaaaatcattacttttcaaaactgaagacggagttaacatgtgcacattaatggctatagatttgggagaactatgtgaagatacaatcacctataaatgtccgctactaaggcaaaatgaacccgaagatattgattgctggtgtaattctaccagcacatgggtaacatatggaacgtgtactacaaccggtgaacatagacgagagaaaaggagcgtggcgttagttcctcatgtgggaatgggattggaaactcgaactgaaacttggatgtctagcgaaggagcctggaaacatgttcaacgaattgaaacgtggatattgagacatccaggttttactataatggcggcaattttagcatatacaatagggacaacccatttccagcgagctttaatctttattctactaacggctgtagcaccaagtatgacgatgcgttgtataggaataagcaatcgagatttcgttgaaggagtctccggtggatcatgggttgatattgttcttgaacacggatcttgtgttacaactatggcgaaaaacaaacccacattagacttcgaattaataaaaacagaagctaaacaacccgcaacactacggaaatattgcatagaagcaaaattaacaaacactacaacagaaagtagatgcccgactcagggggagcccagtctgaacgaagaacaagacaaaaggtttatatgcaaacactcaatggtcgaccgaggatgggggaacgggtgtggtttgtttggaaaaggtggaattgtaacatgcgctatgttcacttgtaagaaaaatatggaaggaaaagtagtccaacctgaaaatctggaatacacaattgtcattacgccacacagtggagaagaacatgcagtaggcaatgacactgggaagcatggcaaggaaatcaagatcacgccccagagtagtatcacagaagcggaattgacgggatatgggacggtgacaatggagtgtagcccacgtactggccttgacttcaatgaaatggttttactacaaatggaagacaaggcttggttagtacatcgtcaatggtttctagatttgcccttgccatggctaccaggtgctgatactcagggtagtaattggatacaaaaggaaacgcttgtgacattcaagaacccccatgctaagaaacaagacgtagttgtattggggtcgcaggaaggcgcaatgcatactgcactaaccggcgctactgaaattcagatgtcaagcggtaatctcctctttactggtcatcttaaatgtcgactaaggatggataaattacaattaaagggaatgtcttactccatgtgcacaggcaaatttaaaatcgtcaaagaaattgcagaaacccaacacggcactatagtgataagagttcagtacgagggcgatggaagcccatgtaagatcccgtttgaaatcacagatttagaaaaacgccacgtattaggtagactaataacagttaatccaattgtcacagaaaaagatagtccggtaaatatagaagcagagcctccatttggtgattcgtatataataattggcgtcgagcccgggcagttaaaactaaattggtttaagaaaggtagttctatcgggcagatgttcgagacaacgatgcggggagctaaacgaatggcaattttgggcgatacggcttgggatttcgggtcactaggcggtgtttttactagcataggcaaagccctacatcaagtatttggcgcaatatacggagcagccttctctggtgtatcatggacaatgaaaattctcataggagtaataataacctggataggtatgaatagtcgttctacgtcgctatctgtctcactcgtgctcgtgggagttgtgaccctataccttggtgcgatggtacaagctgattcagggtgtgtagtatcatggaaaaataaagaacttaaatgtggttcagggatattcataacggataacgttcatacatggacagagcagtacaaatttcaaccggagagtccaagtaaactagcgtctgcaatacagaaagctcacgaagaaggaatatgtggtataagatcggtgaccaggttggagaatttaatgtggaaacaaataacgccggagctaaatcatatcctagcagagaatgaagtcaagttaactataatgactggtgatattaaaggcataatgcaagccggtaaaaggtcgttgagacctcaacccactgagctaaagtatagctggaaaacctggggaaaagccaagatgttgtctacagaaagtcacaaccaaacgtttctaatagatgggccagaaacagctgaatgcccaaatacaaatagagcttggaactccctagaagttgaagactatggatttggagtttttaccacgaatatctggttaaagttgagggaaaaacaagatgtattctgtgattcaaaactaatgtctgccgccataaaagacaacagagctgtacacgcggacatgggatattggattgaatctgctctaaacgacacatggaaaatggagaaagcgtcatttattgaagttaagagctgccattggccaaagtcacatacactctggtcaaatggtgttctagaatctgaaatgataatcccaaagaatttcgctggaccagtctcacaacataactatcgaccggggtaccatacacaaacggctggtccatggcacttaggaaagctcgaaatggactttgatttatgtgaaggcacaactgttgtcgtaacggaagattgtggtaacagaggtccctcactacgtacaactaccgcctcaggtaaactaatcactgaatggtgttgtaggtcatgtacactcccgcccttaagatatagaggggaagacgggtgctggtacggaatggaaataagaccgctgaaagaaaaagaagaaaacctagtcaattcgctggtaacagctggtcatggccaaatagacaatttttctctaggtgtgcttggaatggctctgtttttagaagaaatgttaaggacacgaattggaacaaagcatgcgattttgttagtagctgtaagttttgtaactctcattactggtaatatgagcttccgcgatctaggtcgcgtaatggtcatggtaggagctacaatgactgatgacataggaatgggagtgacttatctagccttactggcagcatttaaagtgcgcccgactttcgctgcaggccttcttctcagaaaactaacaagtaaagagcttatgatggcaactataggaatagcattactaagtcaaagcacaattccagaaactatattagaactaacagacgcgctagcccttggtatgatggttttaaagatagtgcgcaacatggagaaataccagctcgctgtaacaataatggccataagctgtgtcccgaatgctgtcatacttcaaaatgcatggaaggtttcgtgtactattctggcagccgtttcagtatcaccgctacttctaacttcaagtcaacagaaagctgactggataccattagctttaacaataaaaggcttaaatccaactgcaatttttcttactactttgtccagaacgaacaagaaacgttcatggcccttaaacgaagctataatggcagtaggaatggtgagtatactagcttcatctttactgaaaaatgatattcctatgacgggaccattagttgcaggcggactcctaacagtttgctatgttcttacaggtaggagcgccgaccttgagctggagcgtgctgcagatgtcaaatgggaggatcaagctgaaatctccggttcatctccaatactatcgataactataagtgaagacggtagcatgtcaatcaagaacgaagaagaagaacagactcttacaatactgatacgcacagggttgctagtaataagcggggtcttcccagtgagcattcccattaccgccgcagcatggtacttgtgggaagtcaagaaacaacgagctggagtgctatgggatgtaccctcaccaccaccagtagagaaagcggaattagaagatggagcttataggataaagcaaaggggaattttggggtattcacaaattggagctggtgtttataaagaaggcaccttccatacaatgtggcatgtaaccagaggagcggtattgatgcatcgcgggaaacggatcgagccctcatgggccgacgtaaagaaagatttaatttcatatggaggaggatggaaattagaaggagagtggaaagaaggtgaggaagtgcaggttctagcacttgagccaggcaaaaatccccgcgcagtgcagacaaaaccaggaattttcaagacgaacacaggaaccattggagctgtgagccttgatttctcaccaggtacaagtggcagcccaatcgtggatcgcaaaggaaaagtggtcggtttatacggtaatggtgtagtaactcgatccggtgcgtatgtatctgcaatagcacagactgagaaatccatagaggataatccagaaatagaggatgacatcttcaggaagaaacgattaacaataatggatttacatccaggagcagggaaaaccaagaggtacctcccggccatcgtaagagaagcaataaaaaggggattaaggaccctaatattagctcctacgagagtggtagcggccgagatggaagaagcacttcggggattacctataagataccaaacacccgcgatcaaaacggaacatacagggagagaaatagttgacttaatgtgccacgccacatttacaatgagactcctgtcaccagtaagagtaccgaattacaatttgattatcatggacgaagcacacttcaccgatccagcatctatagcggcaagaggctacataagcaccagggtagagatgggtgaggcagctggtattttcatgactgctacaccccctgggtccagggatccgtttccacaaagcaatgcacccattatggatgaggaacgagaaatacctgaaaggagttggaatagtggacacgaatgggtaacggacttcaagggaaaaactgtatggttcgtcccgtcaatcaaagctggaaacgacatagcggcgtgtttgcggaagaatggtaagaaagttatacaacttagcagaaaaacatttgatagtgagtatgtaaaaactcgcgccaatgattgggatttcgtagtaacaaccgatatatcagaaatgggtgcaaattttaaagctgagagagttatcgatccgagaaggtgtatgaagcccgttatacttactgatggggaagaacgggtcatattagctggaccaatgccagtcacgcatagctccgcagcacaacgaagagggaggataggaagaaaccctaaaaatgagaatgatcaatatatctacatgggcgagcccctagaaaatgacgaagattgtgcgcattggaaagaggcgaagatgttattagataacataaatacaccagaaggtataattccttctatgttcgaaccagaacgagaaaaagtagacgctatagatggcgaataccgtttaagaggagaagcccgtaaaactttcgttgatttaatgaggcgtggggaccttccagtttggcttgcttacaaggtagcggcagaaggtataaactacgcggatcgaaaatggtgttttgatgggatcaaaaataaccagatcctcgaagaaaacatggaagtagaaatttggaccaaggagggagaacgaaagaaacttaaaccgagatggcttgacgcaagaatatactccgatcctttagcactcaaggagttcaaagagttcgcagcaggcagaaaatcattaactctaaatctgataacagaaatgggccgactccccacgttcatgacacaaaaagctagaaacgcactcgataatctagccgtgctccatacagccgaagctggcggtcgtgcttacaaccacgcactatcggaattacccgaaaccttagaaacactactactcttgactttgttggctacagttacagggggtattttcttatttttgatgtcaggaaaagggatcggaaaaatgaccttaggaatgtgctgtataattaccgcctctatcctcctgtggtacgcgcaaattcaaccacactggatagccgcgtctatcattctcgagttctttctaatagtattattgatccccgagccagaaaagcagcgaactcctcaagacaatcaactaacttacgtcgtcatcgccatcttaactgtagtagctgcaacaatggccaatgaaatgggatttctagaaaagaccaagaaagatcttggactaggatcaattacaacacaggaatcagaaagtaatattcttgatattgaccttagaccggctagtgcatggactttatacgcagtcgcaactacattcgtaacacccatgcttagacactcaatagaaaatagctctgtaaatgttagtctaaccgctattgctaatcaggcaacagtcttgatgggacttggtaaaggctggcctttatccaaaatggatataggggtaccactattagccatcggttgctactcacaagttaatccgataacactgacagcagcattactattacttgtagctcactacgctattatcggaccggggctacaagccaaagcaaccagggaagcacaaaagcgggcagcggctggaattatgaaaaaccctacagtcgacggaataacagtaatcgatttagaacctataccatacgaccctaaattcgaaaaacaattggggcaggtaatgctactaatattatgtgttacacaagtacttatgatgagaacaacttgggctttatgtgaagcacttaccttggccaccggacctatatcaacgctatgggaaggtaacccgggaagattttggaatacgacaattgcagtatcgatggcaaacatttttcgggggtcgtacttagctggagcaggattattgttttcaataatgaaaaacaccacatcaacaaggagaggtacgggaaatattggtgaaactctaggggaaaaatggaaatctagacttaatgcattaggaaaatctgagtttcaaatctataagaaatctgggatccaagaagtggaccgaactctagctaaagaaggaataaaacgaggagagactgaccatcatgcggtatcaagaggctccgcaaaacttagatggtttgtagagagaaacatggtcacacccgaaggtaaagtagtcgaccttggatgcggcagaggaggatggtcatactactgtggtggtcttaagaatgttcgtgaagtaaaaggacttacaaaaggtggtccaggacacgaagaaccaatcccgatgtcaacgtatggatggaatttagtacgcctacagagcggcgtagacgtctttttcacaccaccagaaaagtgcgatacactgctttgcgatataggagaatcgtcacccaatccaactattgaagcaggacgtacactgagagtattgaatttagttgaaaattggctaaataacaacactaaattttgcattaaagttcttaatccgtatatgccctccgtcattgagaaaatggaggctttacagaggaaatatgggggcgctcttgtaagaaatccgttaagccggaactcaacacatgagatgtactgggtgtcaaatgcgaccgggaacatagtatcgtccgtaaatatgatatcgagaatgctaattaacagatttacaatgaaacataagaaagcaacctacgaaccagatgtggatttaggaagcggaaccagaaatatcggtatcgaatccgagataccaaacttagatatcatagggaaacgtatagagaaaataaagcaagaacatgaaacatcttggcactatgaccaagaccacccttacaaaacgtgggcataccacgggagctacgaaacaaaacaaactgggtccgcaagttcaatggtcaatggggtggttcgccttttaactaaaccatgggatgtagtacccatggttacgcaaatggcgatgacagacaccactccctttggccagcaacgcgtctttaaagaaaaagtagataccagaacgcaagaaccgaaagaaggtacaaagaaactaatgaaaataactgccgaatggctatggaaagaattaggtaaaaagaaaactcccaggatgtgtactagagaagaatttactagaaaagtcagatcgaacgccgcattaggagccatatttacagacgaaaataaatggaaaagcgctagagaggcagttgaagatggaagattttgggaacttgttgatcgtgaaaggaatttacacctagaaggaaaatgcgagacgtgtgtatacaatatgatgggcaaaagagaaaagaaattgggggaatttgggaaagctaaagggtctcgtgcaatatggtatatgtggctaggagccaggtttcttgaatttgaagcactgggatttcttaatgaagaccattggttttcaagaggtaattcattatcaggtgttgaaggagaaggattgcataggttaggatatattctaagagatgtaagcaagaaggaaggaggagcgatgtacgctgatgacacagcaggctgggatacaagaatcactctggaagacctcaaaaatgaagaaatggttactaatcacatgaagggggaacacaagaaactggctgaagcaattttcaagttaacatatcagaacaaggtagtacgtgtacaaagaccgactccgcgcggaacggtaatggatataatatcacgcagagatcagcgaggctctggtcaagttggtacctacggtttgaatacattcacaaacatggaagctcaattaataaggcaaatggagggagaaggtatatttaaaagcatacaacacttaactgcaaccgaagaaatcgtagtacaaaactggttagcaagagtggggcgtgaacgcctttcgcgaatggcaatatcaggcgatgattgtgtcgtaaaacccatagatgatagattcgcaagcgccctcacggcattaaacgatatggggaaagtacgtaaagatatacaacaatgggagccttcgcgggggtggaacgactggacccaagtccctttttgtagccatcactttcacgaattggtcatgaaagatggacgcgttctggtagtgccttgtagaaatcaggacgaattaataggccgcgcccgcatttcacaaggtgcaggctggagccttaaagagactgcatgtctaggcaaaagttatgcacaaatgtggactttaatgtactttcatcggagagatctacgcttagcagctaatgccatttgctccgcagtgccatctcattgggttccgacaagcagaacaacttggagtattcatgcaaaacatgaatggatgacaacagaggatatgctagccgtgtggaatagagtctggatacaagaaaatccatggatggaggataaaactcctgtagaatcttgggaagaggtgccttatttaggaaaacgtgaagatcagtggtgtggaagccttatcggattaacgtcaagagcaacctgggcgaaaaatatacagactgccataaatcaggtccgatctctaattggaaacgaggaatacacagattatatgcctagtatgaaaaggtttagaagggaggaagaggaagctggagttctttggtaa

SEQ ID NO: 22466 - RNA, 9876 nt, synthetic construct
  misc_feature 1..9876: note = derived and/or modified CDS sequence (opt6) from DENV-2__EU482635__SS-prME
  source 1..9876: mol_type = other RNA
acagcaggcgtaatagtcatgttgatccccacagcaatggcattccatcttacaacgaggaatggggaaccccacatgattgtggggcgtcaagaaaaagggaaaagtttgttatttaaaactgaagacggggtaaatatgtgcacactcatggctattgatttgggggaactctgcgaagatactataacttataaatgtccccttcttcgtcaaaacgaacctgaagacattgactgttggtgtaattcaacgagcacatgggtaacttatggtacttgtacaaccactggcgaacaccgaagagagaaacgaagtgtggcgttggtacctcatgtgggaatgggcctcgaaactcgaaccgaaacatggatgtcgtccgaaggtgcatggaaacacgtgcaacggatagaaacatggatactacgacatccaggatttactatcatggcagcaatattagcgtataccatagggacgactcattttcaaagagcactcatttttatattattaacagcggtcgcaccgagcatgaccatgcgatgcatcggtatatcgaatcgggatttcgtggaaggagtttccggagggtcgtgggtagacattgtactcgaacacggcagttgtgtcacaacgatggccaaaaacaaacccactctagattttgaattaataaaaacggaagcaaaacaaccagcaacactccgtaaatattgcattgaagctaaacttactaatactacgacggaaagcagatgtccgacacaaggtgaaccgtcattatcggaagaacaagacaaaagattcatctgcaaacactcaatggttgatagagggtggggaaatggatgtggactcttcgggaaaggcggaatagttacatgtgctatgtttacatgcaagaaaaacatggagggaaaagtagttcaaccagaaaacctagaatacacgatagtgattacacctcattccggagaagaacacgcagtaggaaacgacactggtaaacatgggaaagaaataaaaatcactccacaatcatcgattactgaggcagaacttacaggatacgggacggtgactatggagtgctcacctcgaaccggcctagacttcaatgaaatggttttacttcaaatggaggataaagcatggctggttcatcgacaatggttcttagacttgccgctaccttggctcccaggagctgacacacaaggatctaattggatacaaaaagaaacattagttacctttaaaaatccacatgccaagaaacaggacgttgtagtgctaggatctcaagaaggggctatgcataccgcattgacaggagcaactgaaattcagatgtccagcggaaatctcttatttacaggacacctaaaatgtagacttagaatggacaaattacaactcaaaggaatgtcctacagcatgtgtacaggaaaattcaaaatagttaaagaaattgcagaaactcaacatggtactatagttatacgcgtacaatatgagggcgatgggtcgccttgtaaaatcccattcgaaataaccgatctcgagaaaagacatgttttagggagattaattacggtcaatccaattgtaaccgaaaaagactcgccagtaaacatagaagcagaacctccctttggagatagctacattataataggagttgaaccaggtcaacttaaactcaattggtttaagaaaggatcttccatcggccaaatgttcgagacaacgatgaggggcgcaaaacgaatggctatactcggggatacagcgtgggattttggaagcctgggaggtgtctttacgtccatcggaaaagcgctccatcaggtttttggagcaatatacggtgctgcgttttcaggtgtttcctggactatgaaaatcttaatcggggttattataacatggataggaatgaactccagatcaacatcactcagtgtgtcgctagtcctagtgggagtggtgacattgtatttaggcgctatggtgcaagctgactccgggtgtgtcgtaagttggaaaaacaaagaactaaaatgcggatcaggcatctttattactgacaatgttcatacttggacagaacaatataaattccaacctgaatcgccttcgaaactcgcgagcgcaatacagaaagcacatgaagaaggaatctgtggtattaggagtgtaacgcggcttgagaacctaatgtggaaacaaattacaccagaactaaatcatattttgtcagagaatgaagtaaaactgacgataatgacgggagatattaggggtatcatgcaagccggcaaacggtcacttcgaccgcaacccacagaactaaaatacagctggaaaacatggggcaaagctaaaatgctctctacagaatcccacaatcaaacatttctaattgacgggccagaaaccgctgagtgtccaaacactaatcgagcatggaactcacttgaagtcgaagattatggctttggcgtatttaccacaaacatatggctaaaactccgcgagaaacaagatgttttctgcgatagtaaattgatgagcgctgccattaaagacaatagagctgttcacgctgatatgggttattggatagaatcggctctcaatgatacatggaaaatggaaaaggcttccttcattgaggtaaaaagttgtcattggcctaaatcgcacacactctggtcaaatggggttttagaatcagaaatgatcatacctaaaaattttgccggtcctgtatcacagcataactacagacctggatatcacacacaaacagcaggaccttggcacctaggaaaactagaaatggacttcgatttatgcgaaggtacgactgttgtagtcactgaggactgtggaaatcggggaccctcacttcgtacaacgaccgcttcaggcaaattaataaccgaatggtgctgtcgaagctgtacactacccccattaagatataggggagaggatggttgttggtatggtatggaaatacgaccattgaaagagaaagaagagaacctagtaaattctctagtaacagcaggacatggacaaattgataattttagtcttggcgtgctcggaatggcattgtttctcgaggaaatgctcagaaccagaattggaacaaaacacgcaatcttgctcgttgctgtgagttttgtcaccttaattaccgggaatatgagctttcgtgacctagggagggtaatggttatggttggtgctacaatgactgacgacataggaatgggagtaacttaccttgccttacttgcagcttttaaagtgcgtcccacattcgcagcaggtctgcttctacgaaagttaacttcaaaagaattgatgatggctactatcggaattgctctgttgagccagtcaactatacctgaaacaatcctcgaacttactgacgcgctagctctaggaatgatggttttaaaaatagtacggaatatggaaaaataccaacttgccgtaacaattatggccatatcatgcgttccaaatgcggtaatcttgcaaaatgcttggaaagtgtcttgcacaatactagcagctgtttcagtgagtccccttctgctaacatcaagtcaacaaaaggcagactggatccctttggcattgacaataaaaggtcttaatccaacagcaattttcctcactacgttgagcagaacgagcaagaaacgatcatggccactcaacgaagcgattatggccgttggtatggtcagcatacttgcttcttctttacttaaaaatgatatacccatgacaggaccattggtagctggcggcttactaacggtatgttatgtattaactggccggtcggctgacctggaactggagcgagctgctgatgtgaaatgggaagatcaagcagaaatatcaggctcctctcctattcttagtataaccataagtgaagatgggagcatgtcaataaagaacgaggaagaagaacaaaccctgactatactgattaggacaggactccttgttatatccggcgttttcccggtgtcgatacccataactgcagctgcttggtatttatgggaggtaaagaaacagcgtgctggagttttatgggatgtgccatcaccaccgcctgttgaaaaagcagaattggaagatggagcataccggatcaaacaacgaggtatattaggatatagtcaaataggcgcgggcgtatataaagaaggaactttccacacgatgtggcacgtgacaagaggtgccgttctaatgcaccgaggcaagagaatagaaccatcctgggcagatgtaaagaaagatttaatctcatatgggggaggatggaaattggaaggagaatggaaagagggtgaagaggtccaagtcttggcattggaacctggcaaaaatccccgtgcagtccagacaaaacctggcatttttaaaaccaacacaggtactattggtgcagtatcattggatttttcgccaggaacctctggtagtcccatagtcgatagaaagggcaaggtcgtaggcttatacggaaacggtgttgtaactcgtagcggagcttatgtttctgcgatagcacaaacagagaaaagcatagaagacaatccggaaattgaagacgatatatttaggaagaaacgcctcacgataatggatcttcatccgggagctggtaaaacgaaaagatatctaccagcaatcgttagggaagcgataaaacgaggcctaagaacactgatattagctcccactagagtcgttgccgccgaaatggaagaagcattacgtggcctaccaatacgataccaaacaacagccataaagacagaacacactggtagggaaattgttgatcttatgtgccatgcaacatttactatgcgtttactatcacctgtgagagtacctaattacaacttgataataatggacgaagctcattttacggatccagcatctattgctgcgcggggatacatctccacaagagtagaaatgggcgaggctgcaggtatttttatgacagctacgccaccagggtcgcgtgacccgtttccacaatcaaacgcaccaattatggatgaagagagagaaataccagaacgaagttggaactcaggtcatgaatgggtaaccgattttaaaggtaagacagtctggttcgtcccatctatcaaagcagggaatgatatagcggcatgtttgcgtaagaatggtaagaaagtaatccaacttagcagaaaaacatttgatagcgaatatgtaaaaacgagagcaaatgattgggattttgtagttacgacggacataagtgaaatgggtgccaatttcaaggctgaaagagtaatagatccaagacgatgtatgaagccagtaatcctaacagatggggaagagagggttatattagccggacccatgcctgtaacacattcttcagccgctcagagacgggggagaataggacgaaatcctaaaaatgaaaacgatcaatacatatatatgggcgagccactcgaaaacgatgaagattgcgctcattggaaagaagcaaaaatgttattagataacattaacacaccggagggcattataccaagcatgtttgaaccggaaagggaaaaggtcgacgcgatcgacggagaatatcgtctgaggggcgaggcgagaaaaacatttgtcgatttgatgagaagaggagacctacctgtatggctggcgtataaagtcgcggcagaaggcatcaattacgcagatcgcaaatggtgctttgacggaatcaaaaataaccaaattctagaggaaaacatggaagtcgaaatatggactaaagaaggggaaagaaagaaactaaagcctaggtggcttgacgcccgaatttactctgatcctctcgcactaaaagagtttaaggaatttgcagcaggtcgaaaatccttgaccttaaacttgattacagaaatgggaagacttcctactttcatgactcaaaaagctaggaatgctcttgataacttagctgtactacacacggcagaggccggtggacgtgcatacaaccacgctctgtcagaacttccagaaacattagagacccttttgttattaacacttttggctaccgttacaggaggaatatttttattcttaatgtcagggaaaggaataggaaaaatgactttaggaatgtgctgcattatcactgcgtccatacttctttggtatgcccagatacaaccacactggatcgcagcaagtataatcctagagttctttttaatcgtactattaataccagagccggaaaaacaaagaactccacaagacaatcaattgacgtatgtagtaattgcaatacttacagttgtagccgccacaatggcaaacgaaatggggtttctcgagaaaactaagaaagatcttggactcggaagcattacaactcaagagtcagaaagtaatattttggacatagatctacgacccgcatctgcatggacactatatgcagtcgcaacaactttcgtaacaccgatgttacggcatagtatagaaaattctagtgtgaatgttagcctaacagctatagcaaatcaggctacagttctaatggggttaggaaagggatggcctctatccaaaatggatattggtgtacctcttcttgcaatagggtgttacagccaagtaaaccctattacactcacggccgccttgctactattggtagctcattatgcaattataggtccaggattacaagcgaaagcaaccagagaggcccagaaaagagcagcggcaggcattatgaaaaaccctactgtagatggaattactgtaatagatctagaacccataccatatgatccaaagtttgaaaaacaactcggccaagtaatgttattaatattgtgcgtgacacaagttttgatgatgagaactacctgggcgttatgcgaggctttaacccttgctaccggacctataagtaccttatgggaaggcaatccaggaaggttctggaataccaccatagcggtttccatggcaaatatatttcgcggatcttatctcgcaggagctgggttattattttctataatgaagaacacaaccagcacacgcagagggactggaaacatcggagagacccttggagaaaaatggaaaagcagactaaacgctcttggaaaatcagagttccagatatacaagaaatctggcatacaagaagttgatcgaaccctggcaaaagaaggaattaaaagaggagagacggaccaccatgcagtgagccgcggatcagcaaagctacgctggtttgttgaaagaaatatggttacacccgaagggaaagtagttgacttgggctgtggcagaggtggatggagctactattgcggagggctgaagaatgttcgggaagtcaaaggactgacaaagggcggtcctgggcacgaagaaccaatacccatgtccacgtacggctggaacctggtccgtctacaaagtggggtagatgtgttctttacccctcctgaaaagtgtgacacgctcctctgtgacataggtgaaagctcgccaaaccccacaattgaagcaggtcgtacactgagagtgttgaaccttgtcgagaactggttaaacaataatacccaattttgtataaaggttttaaacccatatatgccaagtgtgatagaaaagatggaagccttacaacgtaagtacggtggagccctagttaggaatccactgagtagaaattccacacatgaaatgtactgggtctcaaatgctacaggaaatattgtatcctcagtcaatatgataagccgcatgttaatcaacagatttacaatgaagcataagaaagcgacttatgagccagacgtagacctcggctctggtaccagaaatatcggaattgaatccgaaatacctaacctcgatatcatcgggaaaagaatagagaaaattaaacaagagcatgagacatcatggcactatgaccaagatcatccatataaaacatgggcctatcatggaagttatgaaactaaacagactggatccgctagctcaatggtaaacggagtggtgagattattgactaaaccatgggatgtggtccccatggtaacgcaaatggccatgactgacactacaccgtttggtcaacaacgagtatttaaggaaaaagtggacactagaacacaagaacctaaagaaggcaccaagaaattaatgaaaatcacagctgaatggctatggaaggaacttgggaagaagaaaactccacgtatgtgcactcgtgaagagtttactaggaaggtaagaagtaatgcggccttaggagcaatatttactgatgagaataaatggaaatcagcaagagaggcggtggaagatggaagattttgggaattagtcgatagagaaagaaacttacacttggaagggaagtgtgagacgtgcgtatacaacatgatgggaaaaagagagaagaaattaggagagttcggaaaagcaaaaggatcacgtgccatttggtacatgtggctcggggctagattcttagagttcgaagctctcggtttcctaaacgaagaccattggtttagcagaggaaactcattgtccggagtggaaggtgaggggctacacagactcgggtatatccttcgagatgtgtcgaagaaagagggcggcgcaatgtacgctgacgacacagctggatgggatactcgaataaccctagaagatttgaagaacgaggagatggttacgaatcatatgaaaggggagcataagaaacttgccgaagcaatatttaaattaacatatcaaaacaaagttgtgagagtacaaagacctacgcctagaggaacagttatggacataatatcgcgccgtgatcagagaggatctggtcaagtagggacctacggtctgaatacttttacaaatatggaagcacagctaatcagacagatggaaggagaaggaatatttaaaagtatccaacatctcactgcaacagaagagatagcagtgcaaaattggttagctagagtaggcagagaacgtttatcaaggatggcaatatcaggggatgattgtgttgtgaagccgatagatgaccgattcgccagcgccctaactgcacttaacgatatgggaaaggtacgtaaggatatacaacaatgggagccctcccgaggatggaatgactggacacaagtcccattttgctcacatcacttccatgagctagtcatgaaagacggacgggttttagttgtgccatgcagaaaccaagacgaactgatagggagagctcgtataagccaaggtgcgggatggtcattaaaggaaaccgcatgtctgggaaaaagttatgcgcaaatgtggaccctgatgtactttcaccggagagacctcagacttgcagctaacgcaatctgcagtgcagtcccctcacattgggtgccaacgtcacgaacaacctggtctatacacgccaaacatgaatggatgacaacagaagacatgctggctgtatggaatagagtctggatacaagaaaatccctggatggaggacaagacaccggtagaaagctgggaagaggtgccctatcttggaaaacgtgaagatcaatggtgcggtagtttgattggattaacatccagagcaacatgggccaaaaacatacaaacggcaattaatcaggtaaggtcattgataggaaacgaagagtacaccgactatatgccatcaatgaaaagatttagaagagaagaagaagaagcgggagtactctggtga

SEQ ID NO: 22467 - RNA, 9876 nt, synthetic construct
  misc_feature 1..9876: note = derived and/or modified CDS sequence (opt6) from DENV-2__GQ199874__SS-prME
  source 1..9876: mol_type = other RNA
actgcaggagtaattgttatgcttataccaacggccatggcattccatctaacgaccagaaatggagaaccacacatgatcgttggacgacaagaaaaaggaaaatctcttcttttcaaaactgaagatggagttaacatgtgcacgctcatggcgatggatttgggtgaactttgtgaagatactataacttataaatgccctctcttgagacagaatgaacctgaagacattgattgttggtgcaacagtacttccacgtgggtgacatatggaacctgtacgacaactggtgaacataggcgtgagaaaagatcagtagctctagtgccgcatgttggcatggggttagaaacacgtacagaaacatggatgtctagcgaaggggcatggaaacacgtacaaagaattgaaacatggatcctaaggcatccaggatttactataatggcagctatccttgcatatactataggcacgactcatttccaacgagcattaatctttatattactaaccgcagtagcccccagtatgacaatgcgatgtatcgggattagtaacagagattttgtagaaggagtaagcggaggcagttgggtagatatcgtgttagaacatgggagttgtgtaacgacgatggctaaaaataaacctaccttagattttgaactgataaaaacagaagcaaaacagccagcaacacttagaaaatattgcatcgaagctaaattaacgaatacaacaaccgaaagccggtgtcctacccaaggcgaaccatcactaaatgaagaacaagacaaaagattcatatgtaaacatagtatggtagacagaggatggggtaatggctgcgggctatttggaaaaggaggtatagttacctgtgcgatgtttacttgcaagaaaaacatggaaggcaaagtggttcagcctgaaaatctagaatacaccatcgtaattactccccacagtggtgaagaacatgcagtaggtaatgataccggtaaacacggcaaagaaattaaaataaccccacagtcttctattactgaagcagaactcacgggatatggcacagtgacgatggaatgttctcctcgtacaggactagattttaacgagatggtactccttcaaatggaggacaaagcctggctagtgcatagacaatggtttttggatctcccattaccgtggttaccaggggccgacactcaaggaagtaattggatacaaaaagaaacgctggtgacatttaaaaatccgcacgctaagaaacaagacgtagtagtattagggtctcaagagggcgcaatgcatacagccttaactggcgctacagaaattcaaatgtcatccggaaacttgttatttaccggtcatcttaaatgtcgacttagaatggataaactccagcttaaaggaatgtcatattcaatgtgcaccggcaagtttaaaatcgtaaaagaaatagctgagacacaacacggcaccatagttattagagtccagtatgaaggcgatggatcaccatgtaaaatcccatttgaaattaccgacttggaaaagagacatgtactcgggcgactgatcaccgttaacccaatagtaactgaaaaagatagtccggttaacatagaggccgaaccaccttttggtgactcgtacataataataggagtagagcccggacagctgaaattgaattggtttaagaaagggtcaagcattggtcagatgtttgaaacaactatgagaggtgcgaaaaggatggctatcctaggggacactgcatgggactttggcagtctgggcggagtgtttacaagtataggaaaagcgttgcaccaagtttttggagcaatatatggtgcagcgttctccggtgtgtcctggacgatgaaaatattaatcggagttatcataacttggattggtatgaatagtagaagtacaagtctgagtgtctcactggttcttgtgggagtggttactctgtatttaggggcgatggttcaagcagacagtggttgtgtagtatcatggaagaacaaagaattaaagtgcggatcaggtattttcatcacggataacgttcatacttggaccgaacagtacaagtttcaaccggagagtccgagtaaattagcaagtgcgatacaaaaggcacacgaagaagggatatgtggaattagaagtgttacacgattagagaatttaatgtggaaacaaataacaccagaactgaatcatatcttatccgaaaacgaagtcaaattaacaattatgaccggcgatattagaggcatcatgcaagctggaaaaagatcgctacgtccacaaccaacagagctaaaatatagctggaaaacatggggtaaggcaaaaatgttatccactgaaagtcataatcagacatttttgattgatggcccagaaactgcagaatgcccgaacactaaccgcgcatggaatagcctagaagtagaagactatggatttggtgttttcactactaacatctggttgaaacttagggaaaaacaagatgtcttttgcgactcaaaactgatgtctgcagcaataaaagacaaccgagctgtgcatgctgacatgggatattggattgagtcagccctaaacgatacgtggaagatggaaaaagcatcctttatcgaagtgaaaagctgccattggccaaaatcgcataccctatggtcaaacggcgtcttagaatctgaaatgataattcctaaaaactttgcaggcccggtatctcaacataattacagaccaggataccatacacagaccgcaggtccatggcaccttggcaaattagaaatggattttgatctgtgcgaaggcacaacagtagtagtgactgaagattgcggaaataggggaccatctctgcgtactacgacagcaagcggaaaacttattaccgaatggtgttgtcgctcttgcaccttgccaccactacgctatcggggtgaagatggttgttggtatggaatggaaattagacctttgaaagaaaaagaagagaacctggtaaatagtctagtaacagctggacatggacaaatcgacaatttcagtttaggtgtgctgggaatggccttatttcttgaagaaatgctaagaaccagaataggaacaaagcatgcaatcctattagttgctgtaagttttgtcaccctaataacgggtaatatgagtttccgtgatctagggagagttatggtaatggtaggcgcaaccatgacagatgatattggcatgggagtcacctatctagcacttctggcggcatttaaagtgaggccaacattcgcagcgggactattattacgtaaacttacaagtaaagaacttatgatggcaacgataggcatagcactattatcacagagtaccattccagaaacaatattggaattaaccgatgcacttgcgcttggtatgatggtccttaagatcgtaagaaacatggagaaatatcaactagctgttactataatggcaatcagctgcgttccaaatgcagtaatactccagaacgcctggaaggtatcctgtactatacttgcagctgtgagcgtaagcccattactactaacatcaagtcaacaaaaagctgactggatacctttggctttaacgataaagggtttaaatccgacagcaatctttttaacaactctaagccgcaccagcaagaagagatcatggcccctcaatgaagcaatcatggcagtcggcatggttagtattcttgctagttcacttttgaaaaacgatattccaatgactggccctctagtagcaggagggctcctgacggtgtgctacgtactaacaggtagatcagcggaccttgaattagagagagccgcagatgttaaatgggaagatcaagctgagatcagcggttcctcacccatattatcaataacaatttctgaagatggtagtatgtcgatcaaaaacgaagaagaagaacaaaccttaacgatactgataagaacaggattattggtaattagtggagtatttcctgtatcaataccaatcacagcagccgcgtggtatctttgggaggtcaagaaacaaagggccggcgttctatgggacgtaccatcaccaccgccagtagaaaaagctgaacttgaggacggtgcttaccgtatcaaacaaagaggcatattaggttattcacaaataggagctggtgtatacaaagaaggtacgtttcacacaatgtggcatgtcacaagaggagctgtactcatgcaccgaggtaaacgtatcgaaccaagctgggcagatgtcaagaaagaccttatttcgtatggagggggatggaagttagaaggcgaatggaaggaaggagaagaagtacaggtgttagcgttagaaccgggaaagaatccaagagcagtacagacgaagcctggtatatttaaaacaaacacgggaacaataggagcagtttccttggattttagccctgggacgagtggtagtcctatcgtggaccgtaaaggtaaagtcgtcggactatacgggaacggggtggtaacgcgtagtggcgcttatgttagtgctatcgcccagacagagaaatcaatagaggataatccggaaatagaagacgacatttttaggaaaaagagacttacaataatggacttacacccgggggctggcaaaacaaaacggtacttacccgctattgttagggaagctataaaaagaggattaaggacacttatattggctccaactagggtagttgctgcagagatggaagaggctttacgaggtctaccaatcagataccagacaactgcaataaaaactgaacacaccggcagggagatagtagatttaatgtgccatgccaccttcacaatgagattactaagcccagtacgcgtgccaaactataatctaattataatggacgaagcgcattttactgatccagccagcatagcggccagaggctacatctctacaagggtagagatgggtgaagcagcaggtatattcatgacagccacaccccctggctcccgagatccatttccacaatcaaatgcaccaatcatggatgaagaaagagaaatacctgaaagatcctggaactcaggccacgagtgggtcacggactttaaaggcaaaacagtttggttcgtaccttctatcaaggcgggaaatgacatcgctgcctgtttaaggaaaaacggcaagaaagtaattcaattgtcaagaaaaacatttgactcggaatacgtcaagactcgggcaaatgattgggacttcgtagtcactactgatatcagtgagatgggcgcaaacttcaaagcagagagagtaatagatcctagacgttgtatgaaacctgtaatattaacagacggagaagaaagagtgattctcgctggcccaatgcctgtaacacacagttccgccgcccagagacgtggaagaattgggaggaatccaaagaacgagaatgatcagtatatttatatgggagaacctcttgagaatgatgaagattgcgcacactggaaagaggctaaaatgcttctggacaatataaacacgccagaaggaattattcctagcatgttcgaaccagaaagagagaaagtagatgccatagatggtgaatatagactacggggagaggctcgtaaaacattcgtggatctaatgagaagaggagatctacccgtgtggcttgcgtacaaagtggcagccgaaggcataaactacgcagatcggaagtggtgtttcgatggaatcaaaaataatcaaatccttgaagaaaatatggaagtagaaatatggacaaaagaaggtgagcgaaagaagttaaaacctagatggttagatgctcgaatctatagcgatcctttagcactaaaggaatttaaagaatttgccgcaggacgtaagtctcttactttaaaccttattacagaaatgggacgcttgccaacatttatgactcaaaaggcacgtaatgcattagataacttagcagtccttcataccgcagaagccggaggcagagcgtataatcatgcgctatccgaattaccggaaaccctcgaaaccttactccttctcactttactagctaccgtaacagggggaatatttttatttttgatgagtggaaagggaataggaaaaatgacacttggaatgtgttgcataattactgctagcatattattatggtacgcacaaatacaaccacactggatagctgcctctataattcttgaatttttcttgatcgtcctacttataccggaaccagaaaaacagagaactcctcaggataatcaactcacatatgtcgtgatcgcaattttgacagtggtcgcagctacgatggcaaacgaaatggggtttcttgagaaaactaagaaagacttgggcttaggaagcatcacaacacaagaatccgaaagtaatattctcgacattgatttacgacctgctagtgcgtggactttatatgcggtagctacgacatttgtaactccgatgctaaggcatagtatagaaaacagcagcgtaaatgtttctttaaccgctatagcaaatcaagcgacggtcttaatggggcttggaaaaggatggccactaagcaagatggacattggagtaccgctcttagcaataggttgttatagccaggtcaaccctatcaccttgactgcagcgttattattacttgttgcgcattacgctataatcggtccaggcttacaggccaaggctaccagagaagcacaaaagcgagcggcggcaggaattatgaaaaatccgacggttgatggaataacagtcattgacctagaacctataccatacgaccccaagtttgagaaacaattagggcaagtaatgttattgattctatgtgtaacacaagtattgatgatgagaacaacgtgggccctatgcgaggctttaacattagcaaccgggccaatcagcactttatgggagggtaaccctggacgattttggaatactactattgctgtaagtatggcaaatatatttcgtgggagctaccttgcaggagctggattattgttttctataatgaaaaatacaacaaacaccaggagaggtactggcaatataggagagactctcggtgaaaagtggaaatctagacttaatgcgttaggcaaatcagaatttcaaatttacaagaaatcggggatccaggaggtagatcgaacgctagccaaggaaggaataaaacgcggagagacagaccaccatgcggtaagtagaggctcagcaaaattgagatggttcgtagagagaaatatggtgacacctgaaggaaaggtagtggatttaggatgtggaagaggaggatggtcatattactgtggagggctcaaaaacgttagggaagtcaaaggactcactaaaggaggtccgggacacgaagaacctatacctatgtcaacatatggctggaatttagtgagattacaaagtggagtagacgtattctttacgcccccagaaaaatgtgatacattgctgtgtgatattggggaatcatccccaaatcccactatagaggcaggtagaaccctaagagtattaaatcttgttgagaactggctaaacaataacacacagttctgtataaaagtccttaatccttacatgccaagcgtaatagagaaaatggaggctttacaaaggaaatatgggggtgcactggtaaggaaccctttatcaaggaacagtacccatgaaatgtactgggtaagtaacgcaactgggaacatagtaagctctgtgaatatgatctcacgaatgctcattaatcgctttacgatgaaacacaagaaggctacttacgaaccggatgtagatttaggcagtggaacccgcaacattggaatagaatccgagataccaaatcttgatattataggaaaacgaatagagaaaataaaacaagagcacgaaacatcatggcactatgatcaggatcacccatataagacttgggcataccacggttcttatgagacgaagcaaaccggctctgcatcgtctatggttaacggtgtagtaagactgttaacgaaaccatgggatgtcgtacccatggttacacagatggcaatgacagatacgactccttttggccaacaaagagtgttcaaagaaaaagtggacacaagaacacaagaaccgaaggaaggtactaagaaattaatgaaaataaccgccgaatggctctggaaagagttaggcaaaaagaaaacaccacgtatgtgtacaagagaagagtttaccaggaaagttagaagtaatgctgcactcggagccatatttacggatgaaaataaatggaaatcagctagagaagccgtagaggatggacgattttgggaactcgtagatcgcgaacgtaatctacacctagaaggaaagtgtgagacctgtgtatataacatgatgggaaaacgcgagaagaaactaggggagttcggtaaagcaaaaggatcaagggccatatggtatatgtggttaggcgcaagatttctagagtttgaggccttaggatttctaaacgaagatcattggttctcgagagggaactcactatccggagtagagggtgaaggccttcataggctggggtatatcctcagggacgttggcaagaaagaaggaggggctatgtatgcagatgacacagccggatgggacaccaggataacactagaagacttgaagaatgaagaaatggtaacaaaccacatgaaaggtgagcacaagaaactagctgaggctatttttaaattaacttatcagaataaagtcgtacgagtacaacggccgacacccaggggaacagttatggacataatttcacgaagagatcagcgaggatcaggtcaagttgggacatatgggttaaacacattcacaaatatggaagcccaactcatacgacagatggagggagaaggtatctttaagtccatacaacatctcacagccacggaagaaattgctgttcaaaactggctcgctcgcgtcggcagagagagactcagccggatggctatatcaggagatgattgtgtagtgaaaccaatagatgataggttcgcgtcggcacttacggctcttaatgacatgggtaaagttcgaaaggatatacaacaatgggaacctagcaggggatggaacgactggactcaagtgccgttttgctcacatcattttcacgagcttgtgatgaaagacggccgagtgctagtggtaccgtgcagaaatcaagatgagttaatcggtcgagcgagaatttctcaaggtgccggatggtctttaaaggaaacagcatgcctcgggaagtcatatgctcagatgtggaccctaatgtactttcatcgacgagatttaaggttggccgcaaacgcaatatgttctgcggttccttcccactgggtacctacctctcgaactacatggagcattcacgctaagcacgaatggatgaccacagaagatatgcttgccgtatggaatagagtgtggattcaagagaatccatggatggaagacaaaacaccggtggaatcgtgggaggaggtgccatatttaggcaagagggaagatcaatggtgcggctctctaattggtttgacatctagagccacttgggctaaaaatatccaaactgcaataaatcaggtgcgcagtctcattggaaatgaagaatacaccgattacatgccatcaatgaaaaggttcagaagagaagaagaggaggctggtgtattatggtag

SEQ ID NO: 22468 - RNA, 9876 nt, synthetic construct
  misc_feature 1..9876: note = derived and/or modified CDS sequence (opt6) from DENV-2__EU482639__SS-prME
  source 1..9876: mol_type = other RNA
acagccggtgtcatagtgatgcttatacccacagctatggcattccacctcaccacgcgtaacggtgaaccacacatgatagtagggagacaagaaaaagggaaatcattattatttaaaaccgaagacggcgtgaacatgtgtaccctaatggctatagacttaggggaattatgtgaagatacaattacatataagtgtccactattgagacaaaacgaaccagaagacatagactgctggtgtaatagtacgtccacatgggtaacctatggtacatgtacaacaaccggcgaacacaggcgcgaaaagcgatctgtcgcactagtaccacatgtaggcatgggcctcgaaacccgaacagaaacttggatgtcatccgagggtgcatggaaacatgtacaaaggatagaaacttggatactccgacaccccggtttcaccattatggctgctatattagcttatacaataggaactacacactttcagagagcccttattttcatcttacttactgcagttgccccaagtatgactatgcgctgtattggtataagtaatcgagacttcgttgaaggagttagtggaggttcatgggtagacatagtattggaacacgggagctgcgtcactaccatggctaaaaataaaccgacattagattttgaactaatcaaaacagaagcaaaacaacctgcaactcttcggaaatattgtatagaagccaaacttacaaacacgaccactgagtctagatgcccaactcaaggggagccatctttgaatgaagaacaggataaacgattcatatgtaagcattcaatggtcgatcgcggttgggggaatggttgcggactatttggcaaaggcggaatcgtcacatgtgccatgtttacttgcaaaaagaatatggaaggtaaagtcgtccaacctgaaaacttagaatacactatcgtaataacacctcattcaggcgaagaacatgctgtgggaaatgatacaggaaaacatggaaaggaaatcaagattactccccaatcatctattaccgaagcagagcttactggatatggtaccgtcactatggagtgctcgccccgaaccggacttgatttcaatgaaatggtactcttacaaatggaagataaggcatggttagtacataggcaatggtttcttgacctccctctaccctggctaccaggcgccgatacacaaggttcgaactggatccagaaagagaccctagtaactttcaagaacccacatgcgaaaaagcaagacgtagtagtactgggttcgcaagagggtgcaatgcacactgccctgacaggagcaacggaaatccaaatgagcagtgggaacctattgtttacggggcacctaaaatgtcgcttacggatggataagctccaactgaaagggatgtcgtacagtatgtgtacaggaaaattcaaaatcgtgaaagaaatagcagaaacacagcatggcacaattgtaatcagagtacagtacgaaggagatggctctccttgcaaaataccatttgagatcaccgatttagaaaagagacacgtattaggacgactaattaccgttaacccaatagttacagaaaaggactccccagtcaacatagaggccgaaccaccctttggagacagctatattataataggagtggaacctgggcagcttaaactaaactggtttaaaaaaggaagtagtataggacaaatgttcgagactactatgagaggagcaaaacggatggccatattaggagatactgcatgggatttcggaagtcttggaggagtgttcacatcgatcggtaaggcacttcatcaagttttcggcgccatttacggggcggcattttccggagtaagttggactatgaaaattctgataggtgtcataataacttggattggcatgaatagcagatcaacaagcctatcagtctctctggtgttggttggggttgtaactctatatttaggagcaatggttcaagctgactccggatgtgttgtatcatggaaaaataaagaattaaaatgtggtagcggaatttttattacagacaacgttcacacatggacagaacagtataaattccaaccagaatctccatcgaaactggcttccgcgatacaaaaagcacacgaagaaggtatctgtggtatacgatctgtaaccagactagagaatttaatgtggaaacagattaccccagaactaaaccatatattaagtgaaaatgaagttaagctgacaataatgacaggagatataagagggatcatgcaggctggaaaaagaagtttaaggccacaacccacagagctaaaatactcgtggaagacatggggaaaagcaaaaatgctgagtacggagagtcataatcaaacattcttaatagatggccctgagaccgccgagtgtcctaatactaatagagcatggaacagtcttgaagtagaagattatgggttcggtgtctttacgacaaatatttggcttaagttacgagaaaagcaggatgtgttttgtgacagtaaactcatgtcggccgcgatcaaagataatcgtgcagtacatgcagacatgggatactggattgagtcggccttgaatgacacctggaaaatggagaaagcatcttttatcgaagttaaatcatgtcattggccaaagagtcacactctatggagcaatggtgtacttgaaagtgagatgataattccgaaaaattttgccgggcccgtatctcaacataactaccgtccaggataccatacgcaaactgccggaccttggcacctaggaaagttggaaatggacttcgacttatgtgagggcacaactgtcgttgtgactgaggactgcggaaatcgtggtccctctctaagaacaacgaccgcgtccggcaaacttataacagaatggtgctgtaggtcatgtaccctccctcccctaagatatagaggagaggatggctgctggtacggcatggaaattaggccgctaaaagaaaaggaagaaaaccttgtaaattcattagtcacggcaggtcatggccagattgacaacttttcactaggagtgttaggtatggctctttttctagaagaaatgctgagaacacgtataggtacaaaacatgcaattctccttgtagcagtatcttttgtaaccctaatcactggtaacatgagtttcagagatctcggtagagttatggttatggtgggggccaccatgacagatgatataggcatgggcgtcacttatctagcactgctggctgctttcaaagtaaggcccacctttgcagctggattactattacgaaaacttacgtctaaagaactaatgatggccacgatcggtatagcattactaagtcagtcaactattcctgaaactattctagaattaactgatgccctagcgcttggtatgatggtcttaaaaatagtacgaaatatggaaaaataccaattagcagtaacaattatggctatctcttgtgttcccaatgcggtaattttacaaaacgcctggaaggtctcctgtacaatactagcagcagtgagcgtcagtcctctactcctcacatcttctcaacagaaagcagattggatccctctcgcgctcacaatcaaaggactaaaccccacggcaatatttttaacaaccttaagtagaacaagtaaaaaacgatcttggcctcttaatgaagcaatcatggccgtcggtatggtatctattctcgcctcgtcattacttaagaatgatataccaatgacaggtcctctcgtagcaggaggattactaacagtctgttacgtactgacaggaaggtcagcagatttggaactagagcgagcagcagatgtaaaatgggaggaccaagctgaaatttctggctcaagcccaatattgtcaataacaatttctgaggatggttcaatgagcattaaaaacgaagaagaagaacaaacacttaccatattaattaggacagggcttctagttatttctggtgtattcccagtctcgataccgatcacggcagccgcttggtatctgtgggaagtaaaaaagcaacgagcgggagtgttgtgggatgtccccagcccaccaccggtggaaaaggctgagctggaagatggtgcatatagaattaaacaaagaggcatattggggtatagccagattggagcaggagtgtacaaagaagggacgttccatacgatgtggcatgtcactagaggcgctgtattaatgcatcgaggaaaacgaatagaaccatcatgggcagacgtaaaaaaggaccttatctcatacggtggcggatggaaactagaaggagaatggaaagaaggagaagaagttcaggtccttgcgttagagcctggtaaaaacccaagggcagtccaaaccaaaccaggtattttcaagacgaatactggtacgatcggcgcagtgagcttggatttcagtccgggaactagtgggtcacctatcgtagaccgaaaaggaaaagtcgtcggcttgtacggtaacggggtggttacacgaagtggagcgtatgtttcggcaattgctcaaacagaaaaatcaatagaagataatcccgaaattgaggacgacatattcagaaaaaagagattaaccatcatggatttacacccaggcgcaggaaaaactaaaagatacctgccagcaatagtcagagaagcaataaagagaggtttacgtacgttaatacttgcgccgacgcgggtagtggcggccgaaatggaggaagcactgagaggacttccaattcgctatcaaacgacagctataaaaaccgagcataccggtcgtgagattgtagatttaatgtgccacgccacgttcacaatgcgccttttaagccccgtgcgggtccctaactataatcttatcataatggatgaagcccacttcaccgaccctgctagtatcgccgcaaggggttatatatcgacccgtgtagagatgggagaggccgcaggaatattcatgactgctacgccaccgggttcccgcgatccatttccgcaatccaacgcgcccatcatggatgaagaacgagaaatacctgaacgaagctggaattcgggtcacgagtgggtgacggattttaagggaaaaactgtatggttcgttccgagtataaaagctggaaatgatatagccgcatgcctgcgaaaaaatggtaagaaagttatacaattatcacgaaaaacttttgatagcgaatatgtaaaaactcgtgcaaatgattgggactttgtggtgactactgatattagcgaaatgggtgctaacttcaaggctgagagagtaatagatcccaggagatgtatgaagcccgtgattcttacagatggtgaagaaagagtaattttggcaggcccaatgccagtaacacacagctctgctgcacaacgacggggacgaattggacggaatcccaaaaatgaaaatgatcaatacatctatatgggtgagccattagaaaacgatgaagattgcgctcattggaaagaagcgaaaatgctactcgataatataaacactccggaaggcattataccgtcgatgtttgaaccagaaagggaaaaagtagacgcaatagacggcgaatataggctacgaggagaagcaaggaagacatttgtagatcttatgagacgcggagacttaccagtatggttagcttacaaagttgctgccgaaggtataaactatgccgacagaaagtggtgcttcgatggaatcaaaaataaccagatattagaggagaacatggaagtagaaatatggacaaaagaaggtgaacgtaaaaaacttaaaccaagatggttagatgcgcgaatatattcagatcccctcgctctgaaagaattcaaggaattcgcagcaggaaggaaatcattaacactaaaccttatcacagaaatgggaagattgccaacattcatgacgcagaaagccagaaatgctctcgataatttggctgttttgcatactgcggaagctggaggcagagcatacaatcatgcattatcagaacttccagaaaccttagaaacattacttttactaactcttctagctactgttacgggcggcattttcctctttctcatgtctggaaagggaataggcaaaatgacattaggcatgtgctgtataataacggcttctatactcctttggtatgcacagattcagccacactggatcgctgcatcaataatactagaattttttctaattgtactgcttatacccgaaccagaaaaacaaagaacaccacaagataatcaactaacatatgtagtgatagctatacttacagtagttgcagctacgatggcaaatgaaatgggattcctagaaaaaacaaaaaaggacctcggtcttgggtcaataacaacacaagagagcgagagcaacatactagacatagacctaagaccggcctccgcttggactttatacgcagttgctacgacactagtaactcctatgttaaggcacagtatagaaaatagctctgttaatgtaagcttaacagcaatcgcaaaccaagcaacagtactaatgggcttggggaagggatggcctttatcaaagatggatattggagtgccactactagctatcggttgctattcgcaagtcaacccgataacccttacggcagctcttctactgctggtagcgcattatgcgataataggacctggcttacaagccaaagcaacaagagaggcccaaaaaagagcagcagcgggtataatgaaaaacccaacagtggatggaatcaccgttattgacttggaacctataccgtatgatccaaaatttgaaaaacaactaggtcaagtcatgttactaatactgtgcgtaacgcaggtactaatgatgagaacaacatgggccttgtgtgaagctttaactctggcaacaggaccaatttcaacactttgggaaggaaaccctggtcgattctggaatacaactatagcagtttctatggcaaacattttcagaggtagctatctagcaggagcaggcttactattttcaatcatgaaaaataccactaatactcgacgagggacaggaaatataggtgaaaccttaggcgagaaatggaaatcaagactcaatgcattaggtaaatccgaattccaaatctataaaaagtccggtattcaagaagtagaccgtacactagcaaaagaaggcataaagaggggagagaccgaccatcacgctgtatcccggggatcagcaaaactacgatggtttgtcgagcgtaatatggtaactccagaaggaaaagttgttgatttaggctgtggtcgaggcgggtggtcttactactgcggaggcctaaaaaatgtaagagaggtaaaagggcttacaaaagggggtccaggacatgaagaacctataccaatgagcacatacggttggaacttggtacggttacaatctggtgtagacgtattttttacaccaccagaaaaatgcgagacactgttatgtgatatcggagaaagctctccgaatccaacaattgaagctggaagaacattacgagtactaaatctagtagaaaattggcttaataacaacactcagttctgcattaaagttctgaatccatacatgcctagtgtaattgaaaaaatggaagctcttcaacgaaaatacggtggtgccttggtcaggaatccattgagtagaaactctacacacgaaatgtattgggtttccaacgcaacgggaaacatcgtgagttcagttaatatgatatcgagaatgcttatcaatagatttactatgaagcacaaaaaagcgacgtacgagccagatgtcgacttaggttcaggaacccggaatattggtatcgagtccgaaattccaaatctggacattataggaaaacgtatagaaaaaataaaacaggagcacgaaacctcatggcattatgatcaagaccacccttataagacctgggcgtaccatggtagctatgaaaccaagcaaacgggtagtgcatcaagtatggttaatggcgtggtacgccttcttacaaaaccatgggatgtagtgccaatggttacgcaaatggctatgacagacactacaccattcggacaacagagagtcttcaaagaaaaagtcgatactagaactcaggaacctaaggaggggacaaaaaaattaatgaagataaccgcagaatggttatggaaagagctggggaagaaaaaaactccacgcatgtgtacacgagaagagttcacacgaaaggttcgttcaaatgccgcattgggagctatctttactgacgaaaacaaatggaaaagtgccagagaagcagtcgaggacggtaggttttgggaattagtggatcgtgaacggaatcttcatcttgagggcaaatgcgagacatgtgtctacaacatgatgggaaaaagagaaaaaaaattaggcgaattcgggaaggcaaaagggtctagggcgatatggtatatgtggcttggggcacggtttttagagtttgaagctctgggtttccttaatgaagatcattggttttcaaggggaaattcgctatcaggagtagaaggcgaaggcctacacagattaggatatatactaagggatgtgggtaaaaaagaaggcggggctatgtatgcggacgatactgcaggttgggatacacgtatcacgttagaagatctcaagaacgaagaaatggttacaaatcatatgaaaggtgagcataaaaaattagcagaagcaatttttaaactgacgtatcagaacaaagtagtacgtgtccagaggccaacgccaagggggactgtaatggatattatcagccgaagggaccaacgaggtagcggtcaagtaggaacatacgggctcaatacatttactaatatggaagcgcaactaatacgccaaatggaaggtgagggcatatttaaaagcattcagcatctaacagcgacagaggaaatagctgtacaaaattggttagcgagagtagggagagagagattatcaagaatggcgataagtggagatgactgtgtagtaaaaccaatagacgatcgatttgccagcgccctaactgcgttaaatgatatgggtaaaattaggaaagacattcaacaatgggaacctagtcgaggttggaatgactggactcaagtacctttctgttctcaccatttccatgaactggtaatgaaagatgggcgcgttctagtagtcccgtgtcgaaatcaagatgaattgatcggcagggcaagaatatcacaaggtgccggttggagcttaaaagaaacggcttgtttgggaaagtcgtacgcacaaatgtggactctgatgtattttcatagaagagacttaaggctcgcagctaatgctatatgttcggccgtgccttcacactgggtgcctacatcaagaaccacatggtcaatccatgctaaacacgagtggatgactactgaggatatgctcgctgtgtggaatagagtctggatacaagaaaatccctggatggaagataaaactcctgtagaatcctgggaagaagtgccttatttaggaaaacgagaggatcaatggtgtggttctttgatcggacttacttcaagagcaacgtgggcaaaaaatatccaaaccgccattaaccaggtccggtcactcataggaaatgaggaatacactgattatatgccatccatgaaacgatttcgaagagaagaagaagaagcaggtgtattatggtaa

SEQ ID NO: 22469 - RNA, 9876 nt, synthetic construct
  misc_feature 1..9876: note = derived and/or modified CDS sequence (opt6) from DENV-2__EU482766__SS-prME
  source 1..9876: mol_type = other RNA
accgccggtgttattgtaatgctaattccaacggctatggcctttcatctaacaactagaaacggtgagccacacatgatcgtaggaagacaagaaaaaggcaagtctctactatttaagacagaggatggggtcaatatgtgcactttgatggctattgatcttggagaactatgtgaggatacgataacgtataaatgcccattactcagacaaaatgagcctgaggatatagactgttggtgtaacagcacatcaacctgggtgacctacgggacatgcaccacaaccggggaacaccgccgtgaaaagagatcagttgcactcgtaccacacgtcggcatggggctcgaaactcgaacagaaacatggatgagcagtgaaggggcgtggaaacatgttcaacgaattgaaacctggatattaagacacccaggattcacaataatggctgccatattggcttacacgatagggacgacacattttcaacgagccttgattttcattctactgactgcagtggctcccagcatgactatgagatgcataggaattagtaaccgcgattttgtggaaggagtatcaggagggtcctgggtagatatcgtactagaacatggctcatgcgtaacaacaatggctaaaaataaaccaaccttagatttcgaattaatcaaaacagaggcaaaacaacccgctaccttgagaaaatactgtattgaagctaaacttaccaacacaactacggaaagtagatgtccgacacagggagaaccaagtctaaacgaagaacaagataagcgtttcatatgcaaacactcaatggttgatcgaggatgggggaacggctgcggtttatttgggaaagggggaatcgtgacgtgcgctatgttcacttgtaaaaaaaatatggaaggaaaagtagtgcagcctgaaaatctcgaatacaccatagttataacacctcattctggcgaagaacatgcagttggcaatgacaccggtaaacacggaaaagaaatcaaaattaccccgcaaagcagcataaccgaagccgaattaaccgggtacggaacagttacaatggaatgtagcagcagaaccggactcgactttaacgaaatggtgcttctacaaatggaggacaaagcctggctagtacatagacaatggttccttgacttacctttaccgtggctacctggtgctgacacacaaggatcaaattggatacaaaaagagacactagtaacttttaaaaatccccatgctaaaaaacaagatgtagtcgtgttaggaagtcaagaaggagcaatgcatacagcattaaccggcgctacggaaatacaaatgtcgtcaggaaacttactcttcacgggtcatttgaaatgtcgattacgaatggacaaactgcaactaaaaggaatgtcctacagtatgtgcacaggtaaattcaaaatagtgaaggaaatcgcggaaacacaacatggaactattgtgatacgggtgcaatatgaaggagatgggtcgccttgtaagatcccctttgaaataaccgacttagaaaaaagacatgtactcggcaggttgataaccgtgaacccaattgtgactgagaaggatagtccagttaacatagaagcggaaccacctttcggggacagttatataattattggcgtagaaccgggtcaattaaagctaaattggttcaagaaaggaagtagtatcggacaaatgtttgagaccactatgagaggagcaaaaagaatggccattctgggagataccgcctgggactttggctctctgggaggagtcttcacgtccatcggtaaagcactacaccaagttttcggagcaatttatggtgccgcattctctggtgtctcttggacaatgaaaatattgatcggggtcataataacgtggattggaatgaactcgagaagcacatcactatcagtatcattggtactcgttggtgttgtaaccctgtacctgggagccgtggtgcaagcggatagtggatgtgttgtgagctggaaaaataaggaactgaagtgcggatcgggaatatttataacggataatgtccatacctggactgaacaatataaatttcaacctgaatccccttctaaattagcgtcagcaatacaaaaagcacatgaggaaggcatatgtggaatacgatcagtgaccagactagaaaatttaatgtggaaacaaatcacaccagagttaaatcacatactgtccgaaaatgaagtaaaattgacgattatgacaggagatattaaagggatcatgcaagctggaaagcgaagtctacgaccacaaccaactgaattaaagtactcttggaaaacatggggtaaagccaagatgttatctactgaaagccataatcagacctttttgattgatggaccggagacggcagaatgccctaataccaatcgagcctggaatagcttggaagtggaagactacggatttggcgtttttacgaccaatatatggcttaagttaagagaaaaacaagacgtcttttgcgactctaaactcatgtctgcggcgatcaaagacaaccgcgctgtccatgctgatatgggttattggatagagtcggcccttaatgacacatggaaaatggagaaagccagtttcatagaagtcaaaagttgccattggcctaaatcacatacattatggagtaacggtgtgctagaatccgaaatgatcatacccaagaacttcgcaggacctgtatcacaacacaactaccgtccaggatatcatactcaaacggcaggaccatggcacctcgggaagctggaaatggattttgatttctgtgaaggtacgacggtcgttgttactgaggattgtggaaaccgtggccctagtctacgcacaacgacagcctcgggaaagcttataaccgagtggtgctgtagaagctgtacattaccgccattgcgataccgtggagaagacggatgttggtatggcatggaaataaggccattaaaagagaaagaagaaaatctcgtaaactcattagttacagcagggcacggtcaaatagacaatttttctctgggagtactcgggatggcgctattcttagaagaaatgttgagaacaagaataggcacgaaacatgcaatcttattggtagctgtcagctttgttactcttatcacaggtaatatgagctttagagatcttggcagagtgatggtcatggttggagcaactatgactgacgatataggtatgggggtgacctacttggccctgttagcagcatttaaggtccgccctacatttgctgccgggctattgttaagaaaactgacaagcaaagaactaatgatggctacgattggaatagcactattatcgcaaagtacaataccagagacgattttggagttaactgacgccctagccctaggtatgatggtactaaagatagtcagaaatatggaaaaataccagttagcagttactataatggcaatttcatgtgtacctaacgcggtcatccttcaaaacgcttggaaagtatcttgtacaattctagcagccgttagcgtgtcacctctgttgttaacatcatcacaacaaaaagcggactggatacccctagcattgacaataaaagggcttaaccccacagctatcttcctaacaactctatcacgaactagcaaaaagagaagctggcccttaaacgaagcaataatggcagtggggatggtaagtattctagcctcctcgttattaaaaaatgacattcctatgacaggacctttggtcgctggtggactgttaacggtatgttacgtattaactggtaggagcgcagatctagaattagaacgagctgcagatgtaaaatgggaagatcaagcagaaatctctggatcgagtccgattctttcaataactattagtgaagacgggtcaatgtcaataaaaaacgaagaagaagaacaaactcttactatactcattagaactggtcttctagtgataagcggagtgtttcccgtttccattccaatcacagcagccgcctggtacttgtgggaggtaaaaaagcaacgtgccggtgtattatgggacgtaccaagtccaccaccagttgaaaaagcggaactcgaggatggggcatatcgaatcaaacaaagaggaatactgggttattcccaaatcggtgccggtgtttataaagaaggtacttttcacacaatgtggcatgtcacccgtggagcggtattaatgcacagagggaaaagaatagaaccaagttgggcagacgtgaagaaagatttaatatcttatggaggaggttggaaactagagggagaatggaaagagggcgaagaagtacaagtacttgcattagaacccggtaaaaatcccagagcggtgcaaaccaaaccaggaattttcaagacaaacacaggcaccattggagcggtaagtcttgatttttcccctgggacgagtggatcccccatagtagaccgtaaaggaaaggtggtcggactttatggaaatggagtagttacaagaagcggagcttatgtatccgcaatcgcacaaacagaaaagtctatcgaagacaatcctgagatagaggacgacatatttcgaaaaaaaagattgacaataatggatctacaccctggagctggtaaaacaaaaagatacttacctgcaatcgtgcgagaagccataaaacgagggttacgaaccctaatcttggcgccgactagagtagtagctgcagaaatggaagaggcattaagaggattacctatcagatatcagacacctgccatcaaaaccgagcacacaggacgagagatagtagatctaatgtgtcacgcgacattcacaatgcgacttcttagcccggtacgtgtgccaaattacaatctcattatcatggatgaagcgcatttcacagacccagcgagcatagcagccaggggatatatctccacacgagtagaaatgggtgaagcagccggaatattcatgaccgcaactccaccaggttcacgggaccccttccctcagagcaatgctcctataatggatgaagaaagagaaatacccgaacgatcgtggaactcaggacatgagtgggtaacagatttcaaagggaaaacagtttggttcgtcccttcgattaaggcaggtaatgacattgcagcatgtttgagaaaaaatgggaaaaaagtgatacaactgagtcggaagacattcgattcagagtatgtcaaaactagggcaaatgattgggattttgtagtcacaacagatatatccgaaatgggagccaactttaaggctgaaagggttatagatccccggagatgtatgaagcctgtaatattaacggacggagaagagcgggtcattctcgcaggaccgatgccagttacacactctagcgcggcacagagaagaggtagaataggcagaaatccgaagaatgaaaatgatcagtatatttacatgggggaaccgttggagaacgatgaagattgtgcgcactggaaagaggcaaagatgcttctagataacataaacacgcccgaaggtatcattccttcgatgtttgaaccagagcgtgaaaaagttgacgcaattgacggagaatatcgactaaggggggaggcacgcaaaacatttgttgacttaatgcgtagaggagacctaccggtatggttggcatataaagtagcagccgaaggaataaactatgccgacaggaagtggtgcttcgatgggataaaaaacaatcaaatactggaggaaaatatggaagttgaaatttggacgaaggaaggagaaagaaaaaagctaaaaccgcgctggttagacgcacgaatatattcagaccctttggcattgaaggaatttaaagaatttgcagccggtcgcaaatctcttacattaaacctaataacagaaatgggccgtcttcccaccttcatgacccaaaaagcacgaaacgcgctggataacctagcagttttacatacggcagaagctggcggacgtgcatacaatcatgcattatctgagttaccagaaacactagagacgttattactgctcaccctactagcgaccgtaactggaggaatttttctattcctgatgtcaggaaagggcatcggtaaaatgacgctaggcatgtgttgcataattactgcatcaatactcttatggtatgctcaaattcagcctcattggatcgcggcatctattattctggaattctttcttatcgtattactaattcctgagccggaaaaacagaggactcctcaagacaaccaattaacatatgtagtaatcgcgattttaaccgttgtagcagcaacgatggctaatgaaatgggatttctagagaaaacgaaaaaggacctgggcttaggcagtataaccacgcaagaaagcgaaagtaacatcttggacatagatctcagacccgcatcagcatggacactttatgcagtagctacaactttcgtaactccgatgttgcgacacagcattgaaaattcatcagtgaatgtttcgctaaccgccatagccaatcaagcgactgttctaatgggtctcggtaaggggtggcctttgtcgaaaatggacattggagtacccttacttgccataggttgctattcccaagtgaaccccatcacactgacagcagcattactgctattagtagcacattatgctataattggccctggacttcaggcaaaagcaaccagagaagcacagaaaagggcagcagctggaataatgaagaatccgacagtagatggtataacagtgattgatctggaaccaataccatatgatccgaagttcgagaaacaattaggacaggtcatgctattgatactatgtgtgacgcaagtactcatgatgcggacaacctgggcattatgcgaagcactgaccttagctacggggccaataagtacactgtgggaaggcaatccaggaagattctggaatactacaatagccgtatccatggcaaacatatttcgaggctcttacctcgcaggtgcaggattattattttccattatgaaaaatacaacatccactcgaaggggtacaggcaatattggggaaactctaggtgaaaagtggaagtcacgattaaatgcattaggtaaatcagaattccaaatatacaagaaatctgggatacaagaagtagatcgaacgttagcaaaagaaggtattaaaagaggggaaacggatcatcacgccgtaagccgtggatcagccaagctaagatggtttgtagagcggaatatggtaacaccagaaggaaaagtagtagatttaggttgtggacgcggcggttggagttactactgcggaggtttaaaaaacgtaagagaagtaaaagggttaacaaaaggggggcccggacatgaggaaccaataccaatgagcacatacggttggaatttagtccgacttcaatcaggtgtagatgtcttcttcacacctcccgaaaaatgtgacacacttctatgtgacataggcgagtcatctcctaaccctacaatagaagcgggacgtacactaagagtacttaatttagtcgaaaattggttaaataataatacacagttttgtattaaggtcctaaatccttatatgccgagtgtaatagaaaaaatggaggcactgcagagacaatacggcggggccctagttagaaatccattatcaagaaatagtacgcatgagatgtactgggttagtaacgcgacaggcaatattgtttcttcagtaaatatgataagtcgaatgctaataaaccgattcaccatgaagcacaaaaaagcgacatacgaaccagatgtcgacttaggatccggtacaagaaatataggaattgaatcggagattccaaatctggacataatcggaaaacgaatagaaaaaataaaacaggaacacgaaataagctggcattatgatcaagatcatccatacaaaacgtgggcatatcacggatcatatgagacaaagcagactggatcagctagtagtatggtaaacggcgttgttagactattgacaaaaccgtgggacgtggtaccgatggtaacacaaatggccatgacagatactaccccatttggtcaacaacgcgttttcaaagaaaaggttgacactaggacacaagagccaaaggaaggcaccaaaaaattaatgaaaatcacagctgaatggttatggaaagaactcgggaagaaaaaaacaccaagaatgtgtacaagggaagaattcactagaaaggtaagatccaatgcagcactgggagcaatttttacagatgagaataaatggaaatcagcacgtgaggcagttgaggacggtagattctgggagttggtcgacagagagagaaatttacacttagaaggcaaatgcgagacatgcgtctacaatatgatgggtaaacgcgaaaaaaaattaggtgaattcgggaaggcaaaaggaagtagagctatttggtatatgtggttgggagcaagatttcttgaattcgaagcactgggatttctaaacgaagaccactggttctcacgcggtaactctctatccggcgtggaaggagagggactacatagactcggttatatcctgcgagatgtaggtaaaaaagaaggcggagccatgtatgcagacgacacagcaggctgggataccagaatcacattggaggatctaaaaaatgaagaaatggtcaccaaccatatgaaaggtgagcataaaaaattagcagaagcgatattcaaattgacataccaaaataaggtagtaagagtccaaagaccgactccaagaggaacggttatggacataatatcaagacgagaccagcgaggttctggacaagttggtacttatggcctaaataccttcacaaatatggaagctcaacttattcgccaaatggaaggtgaaggtatatttaaatccatacaacacctaactgcaacagaggaaattgctgttcaaaactggttggctagagtgggccgagaaagacttagcaggatggctatatcaggggacgattgcgtcgtaaaaccaatagatgacagattcgcatctgcactgacagcgcttaacgacatgggtaaagtacgaaaagacattcaacaatgggaacccagtagaggttggaacgattggacgcaagtaccattttgttcccatcattttcatgaattggtaatgaaagatggccgtgtattagttgtgccatgcaggaatcaagatgaattgataggtcgtgccagaataagccaaggagcaggttggagtctaaaagagacagcttgtttaggcaagtcctacgcccaaatgtggactctaatgtattttcatcggcgtgatttaagattagcagcgaatgctatatgttcggcagtaccatctcattgggtaccgaccagtcgcactacttggtcaatacacgcaaaacatgaatggatgactactgaagacatgcttgcagtatggaatcgggtatggatacaagaaaacccgtggatggaagacaaaactccagtcgaaagttgggaggaagtaccatatcttggtaaaagagaagaccaatggtgtgggtccctcataggtctaacttccagagctacctgggcaaagaacatacaaactgctatcaaccaagtacgatccctcataggtaacgaagaatatacggattatatgccgtcgatgaaaagattcagacgtgaagaagaggaagcaggcgtactttggtga

SEQ ID NO: 22470 - RNA, 9876 nt, synthetic construct
  misc_feature 1..9876: note = derived and/or modified CDS sequence (opt6) from DENV-2__EU482695__SS-prME
  source 1..9876: mol_type = other RNA
actgcaggcgttatcgttatgcttattcctaccgcaatggcatttcacttaaccacacgcaatggagagcctcatatgattgttgggcgacaagaaaagggaaaatccctactctttaaaacagaagacggggtgaatatgtgcacattaatggcaatagacctgggcgaattatgcgaagacacaatcacatataaatgtccactattaagacaaaatgaaccggaagatattgactgctggtgcaatagtactagtacatgggttacctatggaacttgtacaacaacaggagaacaccggagggaaaaacggagtgtggcattagtgcctcacgtaggtatgggtctagaaaccaggacagaaacatggatgtcctctgaaggagcatggaaacatgttcagagaatagaaacctggatactgagacatcctggatttaccattatggccgcaattttagcatatacaatcggaaccacgcattttcaaagagcactaatctttatattattgacggcggtggcaccttcgatgacaatgcgctgtataggcataagtaacagagattttgtagaaggggtaagcgggggatcatgggtagatatagtactggaacacggttcttgcgtaacaactatggcaaaaaacaaacctacactagatttcgaacttataaagactgaagctaaacagcctgcaacactcagaaaatattgcatagaagctaaattgaccaacactacgacggaaagccgttgtccaacacagggagaaccgagtcttaatgaagaacaggataaacgttttatctgcaaacatagcatggttgatagaggttgggggaatggatgtggattgtttggcaaaggagggattgttacctgcgccatgtttacgtgtaaaaaaaacatggagggtaaagttgtgcaacctgagaatttggaatacacaatcgttattactccccattcaggtgaagaacacgccgtaggtaatgataccggtaaacatggcaaagagataaagatcacaccacagtcgtcaattacggaggcggaactaacagggtatggaaccgtcacaatggaatgttcacccagaacgggcttagacttcaacgaaatggtattactccaaatggaggacaaagcatggcttgtgcatcgacagtggtttttagacttgcccttaccttggctaccaggcgcagacactcaaggtagcaactggatacaaaaggaaacgttagtaacttttaaaaatccccatgcaaagaaacaagatgtagttgtattaggcagccaggaaggtgctatgcacacggcattaacaggagccactgagattcaaatgtcttcaggtaatctattattcaccggccatcttaaatgccggttaagaatggataagcttcaattaaaaggtatgtcttatagcatgtgtactggaaaatttaaaatcgtgaaagaaatagctgaaacacagcacggcaccatagtaattcgtgtgcaatacgaaggtgacggatcaccttgtaaaataccgtttgaaatcaccgatttagaaaaaagacatgtattgggacgtttgattactgttaacccaatagtaactgaaaaggacagccccgtaaatatcgaagcagaaccaccatttggcgattcatatattataataggagtcgaacctggacaattaaaattaaactggttcaaaaaaggaagttcaatcggccaaatgttcgaaactacaatgcgtggggctaaaagaatggcaatcttgggagacacagcctgggacttcggatctctagggggagtatttacaagcattggaaaagcgttacatcaagtcttcggagcgatctatggagcagccttctcaggcgtaagctggacaatgaagatattaatcggagtaatcatcacttggataggaatgaattcgcgtagtacaagtctatccgtctcactagtgttagttggcgttgtaacgctatatctaggagcaatggtacaagctgactcaggctgtgtggtaagttggaaaaataaagaacttaaatgtgggtccggcatatttataacggataacgtacatacatggactgaacagtataaattccagccggagtcaccatcaaagttagcctcggcaatccagaaagcgcatgaagaaggcatctgtggcatacggagcgttactagacttgaaaacctaatgtggaaacaaattaccccagagttaaaccacatactcagtgagaacgaggtgaaactaacaatcatgactggggatatacgagggataatgcaggctggaaagcgttcactaagaccccagccaacggaactaaagtactcgtggaagacgtggggaaaggccaaaatgttatctaccgaatcacataatcaaacatttctgatcgatggcccagaaacagcagaatgccccaataccaacagagcgtggaatagcttggaggtcgaagattacggtttcggtgttttcaccacaaatatttggctaaaactacgggaaaagcaagatgttttttgtgactcaaaacttatgtcagctgcaataaaggacaaccgagccgtgcatgcagacatgggatattggatcgaaagtgcattaaacgatacatggaagatggaaaaagcttcctttattgaagtaaaatcatgtcactggccaaaatcgcatactttatggtcaaacggagtgctagaatcagaaatgataatcccgaagaattttgcaggcccggtgtcgcaacataattaccggccaggataccatacccaaacagcgggaccttggcatttaggaaaattagagatggactttgacttatgtgaaggaacgaccgtcgtcgtgaccgaagattgtggtaaccgtggaccttcactacgaacaacaaccgcatctgggaaacttataactgaatggtgttgcagatcgtgtaccttaccaccccttcgataccgtggagaagacggctgttggtatggcatggaaataagacctttaaaagaaaaggaagaaaatcttgtaaattcattggttactgccggccatggtcaaattgataatttttcacttggtgttttaggtatggctttatttttagaagaaatgttacggacaagaatcgggacgaagcatgctattctattggttgctgtctcttttgtaactttaataactggaaatatgtccttccgggatttaggtagggtcatggtaatggtcggcgccaccatgaccgatgatataggaatgggcgtaacatacctagctttattggccgcgtttaaagtccgcccaacgtttgctgccggcctacttttacgaaaacttacgtcgaaagaacttatgatggccaccattggtattgctctactaagccagagtacaataccagaaacgatacttgaactgaccgatgcattagcattgggaatgatggtcttgaagatcgttagaaacatggagaaataccagttagccgttacaatcatggctatcagctgcgtaccaaatgctgtcatactacaaaacgcatggaaagtctcttgtacaatattagcggccgtttcagtttcacccctactcctcacaagtagccagcagaaagcagattggatcccattagcattaactataaagggtctaaaccccaccgcaatatttctaactacactttcaagaacctcaaaaaagagaagctggccattaaatgaagctattatggcggttggaatggtatctattctagcatctagtttattaaaaaatgacattcctatgacaggtcccttagtggcaggaggacttcttacggtatgttatgtactgacaggtagaagcgctgatctggaacttgaaagagcagccgacgtgaagtgggaggaccaagcggaaataagcggtagttcgccgatattgagtataactatatcagaagacggatctatgtcaatcaaaaacgaagaagaggagcaaacactaacaatactaatcagaacaggtctcctagttatttcaggtgtatttcctgtaagcataccaattactgcagccgcatggtatttatgggaagtaaagaaacaaagagcgggtgtgctatgggatgttccgtctccaccgccggttgaaaaagcggaattggaagatggtgcttacaggattaaacagcgaggcatcttggggtattcgcaaataggtgcaggggtttataaagagggaacctttcatacaatgtggcatgtaactcgaggggccgtactcatgcatcgtggaaagcgtattgaaccttcatgggcagacgttaagaaagacctaatttcttatggaggcggatggaagctagagggggagtggaaagaaggagaagaagtccaagttttggccctggaaccaggaaaaaacccaagagcagtgcaaacgaaaccaggaatattcaaaacaaatacaggcacaattggggcggtttcacttgatttcagtcctggtacaagtggaagtccaattgttgatagaaaagggaaagttgttggtctatatggaaatggagtagtaacaaggtccggggcctatgtgtcggcaatagctcaaacagaaaaaagtatagaagacaacccggagatagaagatgatatcttcagaaaaaagcgcctaacaataatggatctacatcctggcgcaggaaaaaccaaacgatacctaccagccattgttcgagaagcaataaaacggggactaagaacgctcatcctagcgcccacccgtgtcgtagcagccgagatggaggaagctctcagggggttgccaatccgatatcaaacaactgccataaaaacagaacatacaggacgagaaattgttgatctgatgtgtcatgcaacatttacaatgaggcttctgagccccgttagagtacctaattacaacctcataattatggatgaagcccatttcaccgatcccgcgagtattgcagcgcgaggttatatcagcaccagagtggagatgggtgaggcagctggtattttcatgacagctacgcccccggggtctcgtgatccatttcctcaatcaaacgcccctataatggatgaagaaagagaaattcccgaaagatcctggaactccggacatgaatgggtaaccgactttaaggggaaaacagtatggttcgtcccaagtatcaaagcaggaaatgacattgcagcgtgcctaagaaaaaatggtaaaaaagttatacaattaagtaggaagacattcgatagtgaatatgtaaaaacacgagctaatgattgggactttgttgtaacaacagatattagcgaaatgggagctaatttcaaagcggagagagtcatagatccaagaaggtgtatgaaacccgtgattcttacggatggagaagaaagagtcatattagcaggaccaatgccggtcacacactcctcagctgctcaacggcgaggacgaataggccgaaatcctaagaatgagaacgaccagtatatatacatgggcgaaccattagaaaacgacgaagattgtgcccattggaaagaagcgaaaatgctcttagataatattaatacaccagaaggaataattccctcaatgttcgaaccagaacgagagaaagttgacgcaatagatggagaataccgcctaagaggagaagctcgtaaaacattcgtagacctgatgcgaagaggtgatttacctgtgtggctagcttacaaagttgccgcagaaggaataaactacgccgatagaaaatggtgctttgacggtataaaaaataatcaaatattagaagaaaacatggaagtcgaaatatggaccaaggaaggggaaaggaaaaaacttaaaccccgctggttggatgctcgaatatattccgaccccctagcactcaaagaatttaaggaatttgcagcaggaagaaaaagtctgactctaaatttaattacagaaatggggagactcccaacttttatgacgcaaaaagcacgtaacgcacttgacaatcttgcggtattacataccgcagaagcaggcggaagggcctataatcacgccctttcagaattgccagaaacgttagaaacattattattacttacgttactagccaccgttaccggcgggatattcttattcctgatgtctggtaaaggaattggcaaaatgactttgggaatgtgttgcattattactgccagcatccttttgtggtacgctcaaattcagccgcattggatagctgcatcaataattctcgagttctttcttatagtcctcttaatacctgaaccagaaaaacaaagaactccacaagataatcaattaacatatgtggttatagccattttaacagtcgtagcagctacaatggcaaacgagatgggcttcctcgaaaagacgaagaaggatttaggactcggcagtataacaacacaagaaagcgagtctaacattttggatatagatttgaggcctgctagtgcgtggacactatatgccgtagcaactacttttgtaacaccaatgttgaggcactccattgaaaattcttcggtgaacgtaagtttgactgccattgctaaccaagccacagtcctaatgggactgggcaaggggtggcccctatcaaagatggatatcggcgtcccactcctcgctattggatgttactctcaagttaacccgattacattgaccgctgccctcctgctactggttgcgcattacgcaataataggtccgggtttacaagcaaaagcgacacgcgaagcccaaaaaagagcagcagctggaattatgaaaaacccaacagtagatggtattacagttattgatttagaaccgataccttacgatccaaaatttgaaaaacaactagggcaggtgatgttattaattttatgtgtcactcaggtactaatgatgagaacaacatgggctctatgtgaggcactaaccctcgcgacaggtcccatcagtaccttatgggagggaaacccagggagattctggaacaccacaatagccgtttcaatggcaaacattttcaggggaagttacttagcaggtgctggtttactatttagcataatgaagaacacaacaaacacaagaagaggaaccggaaacataggagaaaccttgggcgaaaaatggaagagtcggttaaatgcgctaggcaaatcggagttccaaatttacaagaaatccgggattcaagaagtagatcgaactcttgccaaggaagggataaaaagaggggagactgaccaccacgcggtctcgcgaggtagtgcaaaattaagatggttcgttgaaagaaatatggttacaccagaagggaaagtggtagatttaggctgcgggaggggagggtggtcatattactgtggaggtctaaaaaatgtaagagaggtaaaaggcttgactaaaggaggccccggtcacgaagaacctatccccatgtcgacgtacggatggaatcttgttagactgcaaagtggagtagacgttttttttacgccaccagaaaaatgcgatacattattatgtgacataggggaaagctcgcctaaccccacaatcgaggctggacggacattaagagtactcaacctcgtcgaaaattggctgaacaacaatacacagttctgcataaaggtcctgaatccatacatgccgagtgtcattgaaaaaatggaagcattgcaaaggaagtatgggggagcactagtacgcaaccccttaagcagaaattcaacacatgaaatgtattgggtaagtaacgcaactgggaacatagtatcatccgttaatatgattagtagaatgctcataaacagatttacaatgaaacataaaaaggcgacatatgaacctgacgtggacctgggttcgggcacacgaaatatcggaattgaatctgaaatccctaatctagatataataggaaagcgcatcgaaaaaataaaacaagaacatgagactagttggcactacgatcaagatcatccatataaaacatgggcataccatggatcgtacgagacaaagcaaacaggatcggcgtcttcaatggtaaacggtgttgtgagattacttacaaaaccatgggatgtcgttcctatggttacacagatggcaatgacagataccactccctttggacaacaaagagtgtttaaagagaaagtcgacacacgaacacaagagccaaaagaaggaacaaaaaaacttatgaaaataactgcggaatggctatggaaggagttaggcaaaaaaaaaacacccaggatgtgtacaagagaggagtttactagaaaagtacggtcaaatgccgcgttgggcgcaatatttacagacgaaaacaagtggaaaagcgcccgcgaagctgtcgaagatgggagattctgggagttagtagaccgtgaacgcaatcttcatctagaaggcaaatgcgaaacctgcgtttataacatgatgggaaaacgggagaaaaagttaggagaatttggaaaagcaaaaggaagtcgcgcgatatggtatatgtggctaggtgcgagatttttagaatttgaggccttaggttttcttaacgaagaccactggttttctagaggcaactcattatcgggggtagaaggagaaggattgcaccgacttggatatatcctaagagacgtgggtaaaaaagaggggggagcgatgtatgcagatgacaccgccggatgggacacacgaattactctagaggacttaaagaacgaagaaatggtgactaatcatatgaaaggagaacacaaaaaactagcggaagccatttttaaacttacgtaccaaaacaaagtggttcgggtgcaaagacctacgccgaggggaactgtcatggacatcatatctcgccgagaccaaaggggttcgggccaagtaggaacatacggtctaaatacctttacaaatatggaagctcaattaatcagacaaatggaaggagagggaatatttaaatctatccaacacctcacagcgactgaggaaatagcagttcaaaactggttagcaagggtgggacgcgaacgtttatcacggatggcgataagtggtgacgattgtgttgttaaaccaattgatgaccgcttcgcaagtgcgctaacagcattgaacgacatgggtaaagtacggaaagacatccaacaatgggagccatctcgtggttggaatgattggactcaagtcccattctgtagtcatcattttcacgaattggttatgaaggacgggagagtgttggttgttccatgtagaaatcaagacgaactgataggaagagcacgtattagccagggagcaggatggtctttaaaggaaacggcttgccttggaaagagttatgctcaaatgtggacattaatgtatttccaccgacgtgatctccgtctcgccgcaaacgcaatatgtagtgcggtaccatcacattgggtcccaacgagccgcactacttggtctatccatgcaaaacacgaatggatgacaactgaagacatgttagcagtttggaacagagtatggatacaggaaaacccatggatggaggacaaaactcctgtagaatcatgggaagaggtcccgtatctaggtaagcgtgaagatcaatggtgcggctctctgatcggattaacatcaagagcaacatgggctaaaaatattcaaacggctattaaccaggttcgatccctcatagggaatgaagaatataccgactacatgccttcaatgaaaagatttcgcagagaagaagaagaagccggcgtgttgtggtaa

SEQ ID NO: 22471 - RNA, 9876 nt, synthetic construct
  misc_feature 1..9876: note = derived and/or modified CDS sequence (opt6) from DENV-2__EU482769__SS-prME
  source 1..9876: mol_type = other RNA
acggcgggagtaatagtaatgctaattccgactgcaatggcctttcaccttactactcgaaatggggaaccacatatgatagtaggacgtcaggaaaaaggaaaaagtctcctgttcaaaaccgaagatggagtaaatatgtgtacactaatggcaattgatctcggagaactttgtgaagatacgataacctataaatgcccacttttgagacagaacgaaccagaagatatcgattgttggtgcaactccacttcgacgtgggtgacttacggaacgtgcaccaccacaggggaacaccgaagagaaaaacgctctgtagcgctcgtaccgcatgttggaatgggattggaaactagaacagaaacgtggatgagctctgaaggagcatggaaacacgtacaacgaatagaaacatggatcttaagacatccgggtttcacaatcatggcagcaatactggcgtacacgataggaacaactcactttcaaagggccctaatcttcattctactaacggcagtagcaccatcaatgacaatgaggtgcataggtatctctaaccgcgactttgtggaaggcgtttcaggaggttcgtgggtagatatagtcctagaacatgggtcatgtgtaactacaatggcgaaaaataaaccaacgcttgactttgaattaatcaaaactgaagcaaaacaaccagcaacattaagaaaatactgcatagaagcaaaattaaccaatacgacaaccgagtcaaggtgcccaacacaaggagaaccatccctaaacgaggaacaggataaaagattcatttgtaaacattcaatggttgatcgtggatggggaaatggttgcgggttattcgggaaaggcggcattgtaacgtgtgctatgtttacttgcaagaaaaatatggaaggaaaagtagtacaacctgaaaatttggagtatacgatagtaataacaccacacagcggggaagaacatgcagtcgggaacgataccggtaaacatggtaaagagataaaaattacacctcaaagctcaatcacagaagcagaattaacaggatatggcacagtaacaatggagtgttctcctaggactggtctcgatttcaacgaaatggtgctattgcaaatggaggacaaggcttggttagtacataggcagtggtttttagatttaccattaccttggttacctggtgctgatacacaaggctcgaattggatccagaaagaaacacttgttacattcaaaaatccgcacgccaagaaacaggatgttgtagttctgggatcccaggaaggtgcaatgcacacagcactaacaggggctacggaaattcagatgtcttcaggaaatctactatttacaggacacttaaaatgtcgactacgaatggacaaactgcaattaaaagggatgagttacagtatgtgcacaggtaaattcaaaatagtaaaagaaatagccgaaacacagcacggaacaatagtaataagagtccagtatgagggcgacggttcgccttgtaaaataccattcgagatcactgacctagaaaaacgtcacgtcttaggtcgtctaatcacagttaacccgattgtaactgaaaaagacagccctgtaaatatagaagccgagccgccatttggagatagttacattataatcggtgtagaaccgggacaactaaaactgaattggttcaagaaaggatcgagtatcgggcaaatgtttgaaaccacgatgaggggcgccaaaagaatggccattttaggagatacggcatgggacttcgggtccttgggcggagtgtttacaagtataggtaaagcattacatcaagtatttggggcaatttatggagcagctttctctggagtgtcatggaccatgaaaatattgataggggttattataacttggattggcatgaactcaagatcaaccagtctatcagtatcgcttgtacttgtcggtgtagtaacattatatttaggcgcgatggttcaagctgactcgggctgtgtagtctcatggaaaaataaagaattaaaatgtggttcgggaatattcatcaccgataatgtccacacctggactgaacaatacaaatttcagccagagtctccaagtaaactagcatcagccatacaaaaagcacacgaagaagggatatgcggtataagaagcgtaactagactcgaaaatctgatgtggaaacaaataacacctgaacttaaccatatattatcagaaaatgaagtaaaactaactataatgacgggggatattcgtggaatcatgcaagcaggaaaacgttcattgcgaccacagccaaccgaactaaaatactcttggaaaacatggggaaaagctaaaatgctatcgaccgaaagtcataaccaaacatttctaatagatggtcctgagactgcagaatgccccaacacaaatagagcttggaacagcctagaagtggaagattatggctttggcgttttcacaacaaatatttggctcaaattaagggagaaacaagatgtcttttgtgattcaaaactaatgtcggcagcaataaaagacaatcgagcggttcacgccgatatggggtattggattgaaagtgcactcaatgatacttggaaaatggaaaaagcatcttttatagaggtaaaatcatgtcactggcctaaaagccacactttatggagtaacggtgttctcgagagtgagatgatcatacctaaaaattttgcaggcccagtatcccagcataattacagaccaggatatcacactcagactgccggaccatggcatcttggcaaactcgaaatggatttcgacttgtgcgaaggcactacggttgttgtaactgaggactgcggtaatagaggcccaagcctacgcacaacaacagcatccgggaagttaatcaccgagtggtgttgtcgtagttgcacgcttccacctctgagatacagaggggaagacggatgttggtacggaatggagatacgtcctcttaaggagaaagaagaaaacttagtaaacagcttagtcacagcaggtcacgggcaaatcgacaatttttccctcggagtgctaggaatggccctattcttagaggaaatgctaagaaccaggattggcacaaaacacgccattttgcttgtcgcagtaagtttcgtgacattaattacgggaaacatgtcctttcgagacttagggagagtgatggtgatggtgggagctacaatgacagacgacataggaatgggagtaacatacttagcattattagcagcctttaaggtacgcccgaccttcgcggcaggcctcctgcttagaaagttaaccagtaaagaactaatgatggccacgataggaatagctttactctcgcagtcaacgattcccgagacgatacttgagttaactgacgcattggcgttaggtatgatggtcctaaaaatagtaaggaatatggagaaataccaactagcagtcacaataatggcaatatcatgcgtacccaatgcagttattttacaaaatgcatggaaagtctcatgcacgatattagctgcagtcagcgtcagcccattattacttacttcttctcaacaaaaagcagattggattccattagccctaactataaaaggtctaaatccaacagccatattcttaacaacactaagtcgcactagcaagaaaaggagctggccgcttaacgaagcaatcatggccgttggtatggtcagcatactagcttccagtttacttaaaaatgatattccaatgacgggaccgttagttgcaggaggattgttaacagtatgctatgttttaaccggcaggtccgctgatctggaactagaacgcgcggccgacgttaaatgggaagaccaagctgaaatatcaggttcgagccctattctcagcatcacaatatccgaagatgggagtatgtctataaagaatgaggaggaagaacaaacgttgaccattcttatcaggacaggcctattagttataagtggagtcttcccagtaagtatacctattactgccgcggcatggtatctttgggaggtcaagaaacaacgagctggtgtattatgggatgtcccttctccacctccagtggagaaggctgaactagaagatggggcttatagaataaagcaaagaggaatcttagggtactcacaaatcggcgctggtgtatataaagaaggaacttttcacacaatgtggcacgtgacaagaggtgctgtgctaatgcatcgggggaaaagaatcgagccttcgtgggcggatgttaaaaaggatctaatctcatatgggggtggatggaaactagaaggcgaatggaaggaaggtgaagaagtacaagtattggcgctagagccaggcaaaaatccgagagcagttcaaactaaaccgggcatttttaaaactaataccggtacgattggagctgtatcgttagattttagccctggtacttctggatccccaatcgtggatcgaaaaggtaaagtcgtgggcctatatggaaacggggtcgtgactaggtcaggagcgtatgtaagtgctattgctcaaaccgagaaaagtatagaggacaatcccgaaatagaggacgatatatttagaaagaaacgtcttacaattatggatctacacccaggagccggcaagaccaagcgatacctacccgctattgttagagaagcaattaaaagaggcctaagaaccctaatactggccccgacccgtgttgtagcagcagaaatggaggaggcattaagaggtctaccgatccgataccagacgactgcaataaaaacagaacataccggaagagaaatagttgatctcatgtgtcatgccaccttcactatgagactattatctccagtaagagtacccaactataacttgataatcatggatgaggcacatttcacagatccagcgtccattgcagcacggggatatatttcaactagggtagagatgggtgaagcagcaggaatcttcatgaccgcgacccctccgggatcaagagatcctttcccccagtccaatgcaccaataatggacgaggaacgtgagatacccgagcgatcatggaatagtggccatgaatgggtgaccgattttaagggcaagacagtttggttcgtacctagtataaaagcaggtaatgatattgctgcctgtctgaggaaaaatggcaagaaagtaatccaattatcgcgaaagacattcgatagtgagtacgttaagacaagagcaaatgactgggacttcgtcgtgacaacagatatatcagaaatgggtgctaactttaaggccgaacgtgtcatagatccaagacgctgtatgaaaccagttattttgactgatggagaagaacgagtaatattagcaggaccgatgcccgttactcacagtagcgctgcacaacgcagggggcgcataggcagaaaccccaaaaacgagaacgaccaatacatatatatgggagaacctcttgaaaatgatgaagactgcgcgcactggaaagaggccaagatgctcttggataatatcaataccccggaaggaataataccctctatgttcgaacctgaacgagaaaaagtcgacgctattgacggcgagtatcgtctgagaggggaagctcgaaaaaccttcgtggacctgatgcgcagaggggaccttcctgtttggttagcctataaagtggctgcagaaggtataaattatgcagataggaaatggtgttttgacgggattaaaaataatcaaattttagaggaaaacatggaagtcgagatatggaccaaggagggagaacgaaagaaattgaaaccccgatggctcgatgcaaggatatattcggaccctttggcattaaaagagttcaaggaatttgcggctgggagaaaatccctcacattaaacctaataaccgagatgggtcgcttgcctacatttatgacacaaaaagctcgaaatgcacttgataacttagctgtattacatactgctgaagcagggggtagggcctataatcatgcactaagtgaattaccagaaactctggaaactttgctattgttaacgctcttagccacagtcactggaggaatatttttgtttcttatgtcaggcaaaggaataggaaagatgactctagggatgtgttgtataattacagcctcaatactcttatggtatgcacagatacaaccacactggattgctgcaagtatcatactagagtttttcctaattgttctattaatccctgaaccggaaaaacagcgaacgccacaagacaatcaattgacgtacgtagtaatagcgattctcaccgtagtagctgcaacaatggcaaatgagatgggctttttagaaaagacgaagaaggacttgggattaggtagtataacaacgcaagaatcagaatccaatatactggatatcgatttaagaccggcctcagcatggacactatacgcagtagcaacgacttttgtaacacctatgcttagacatagtatagaaaattctagtgtgaatgtcagcttgactgcaatcgccaaccaagcgacggtactcatgggactaggcaaaggttggcctctcagtaagatggatatcggtgttcccttattagccatcggttgctattcacaggttaatcctatcacattaacagcagctctattgcttcttgtagctcattatgctataattggtccaggactacaggcaaaagccacaagggaagctcaaaaacgcgcggctgcaggcatcatgaagaacccaacagtagatggtattacggtcattgacctagagcccataccatacgatcctaaattcgagaagcaactagggcaagtgatgctgttaatattatgcgtaacacaagtattaatgatgagaactacatgggctctatgcgaggcactgacattggctacaggtcctatttcaacattatgggaaggaaatcctggtagattttggaacacaacaatagcagtatcaatggctaatatctttaggggttcatatcttgcaggagctggactattattctcaatcatgaaaaatacaacaaacacacgaagaggaacgggcaacattggagaaacattaggtgaaaagtggaaatcaagactaaatgcccttggtaagtcagaatttcaaatttacaagaaatctggaatccaagaagtagatcgtaccctagcgaaagaaggaataaaacgtggtgaaacagaccaccacgccgtttctcggggctccgcaaaattgcggtggtttgtagaaaggaatatggtaactccagagggaaaagtagttgacctaggttgtggcagaggcggttggagttattattgcggaggattaaagaacgtgcgtgaagtgaaaggattaacaaaaggtggacccggacatgaagaaccaattccaatgagtacctatggttggaacctagttcgactccagagcggggttgatgtcttctttactccaccagagaaatgtgatactcttctatgcgacatcggagaaagctcgccgaaccctaccatagaagctggacgaacattacgagtcttaaatcttgttgagaactggttaaataataatacacaattctgcatcaaagtacttaatccttatatgccgagtgtaattgagaaaatggaagccctccaaagaaaatatggaggggcacttgtacggaatcctttgagtagaaatagtacccatgaaatgtactgggtttcaaacgccacaggtaatatcgtaagcagtgttaatatgataagccgtatgttgataaacagattcaccatgaagcacaagaaagcgacttacgaaccagacgtggatttggggtccggaactagaaatataggcatcgagagcgaaatccccaatttagacataataggtaagaggatcgagaaaattaagcaagagcatgaaacaagttggcattatgatcaggatcacccttacaaaacgtgggcttatcacggatcttatgaaacaaaacaaacaggctctgcaagctctatggtaaacggagtagtgcgattgttaactaaaccatgggacgtagttcccatggttactcagatggcaatgacggacactactccatttggacagcaacgtgtcttcaaagaaaaagtagacacgcgcacccaagagcccaaggaaggaactaagaaattaatgaaaattacagcagaatggctctggaaagaattaggcaaaaagaaaactccgcggatgtgtactcgagaagagttcactagaaaagtccgatcaaacgctgcgcttggggctatatttacagatgaaaataaatggaaaagcgccagagaagctgtagaggacggaagattttgggaactcgtcgatagggaaagaaacttacatttagaagggaaatgtgaaacctgtgtatataatatgatgggtaagagagagaagaaactaggtgaatttggtaaagcgaaaggttcaagagctatctggtacatgtggcttggagcacgattcttggagttcgaagctctaggcttcttaaatgaggaccattggtttagcaggggtaactcattatcgggtgtcgaaggagaaggtctacataggctaggatacatactaagagacgtcggcaagaaagaaggtggggctatgtacgcagatgacacagcaggttgggatacacgaataacgttagaagatctaaagaacgaggaaatggtaacaaatcatatgaaaggtgagcataaaaagctagctgaggcaatcttcaaactaacttatcaaaacaaggttgttagagtacaaagacctacacctagagggactgttatggatatcataagccgacgtgatcaaaggggctcaggtcaggttggaacttacggacttaatacatttacaaatatggaagcacagttgataaggcaaatggaaggggagggtatatttaaaagtatccagcatctaacagctaccgaggaaatagccgtacaaaactggcttgctagggtaggtagagaacggctttcgcgtatggctataagtggtgatgactgtgttgtcaaaccaattgatgacaggttcgcatcagcgttaactgctctgaacgacatgggaaaggttagaaaggacatacaacagtgggaaccatcgagaggatggaatgattggacgcaagtaccgttttgcagccatcactttcatgaattggtaatgaaagacggaagggtcttagtagtaccatgtcgaaatcaagatgaattaataggtcgagcacgtataagccaaggggccgggtggagcctaaaagagacagcgtgtctgggcaagagttatgcacaaatgtggacattaatgtacttccatcgaagagatttacgattagccgctaacgctatatgttcagcggtaccctctcattgggttcctacaagtaggacgacttggagcattcatgccaaacatgagtggatgacaacggaagatatgttagcagtttggaaccgcgtatggatacaagagaatccgtggatggaggacaaaacgccggttgaaagttgggaggaggttccatacttagggaagagagaagaccagtggtgcggatcaatgatcggattaacgagtcgagcaacctgggcgaaaaatattcaaacagctattaaccaggtaagaagtctaataggaaatgaagaatatatagattatatgccaagcatgaagcgctttagaagagaagaggaagaagccggggtactatggtaa

SEQ ID NO: 22472 - RNA, 9876 nt, synthetic construct
  misc_feature 1..9876: note = derived and/or modified CDS sequence (opt6) from DENV-2__EU482696__SS-prME
  source 1..9876: mol_type = other RNA
actgcaggggtgattgtaatgttaataccaactgctatggcatttcatttaacaacaaggaatggcgaaccgcatatgatcgtaggtaggcaggaaaaaggaaagagcttactttttaaaacagaagacggggtgaatatgtgtacgttaatggcaattgaccttggggaattatgtgaagatactataacttacaaatgtccattacttcgtcaaaatgaaccagaagatatagattgttggtgcaatagtacttccacatgggtaacatatggaacctgcacaacaaccggagagcacagaagagaaaagagaagcgttgcccttgtaccccatgtgggaatgggactagaaacccgtacagaaacatggatgtctagtgaaggggcatggaaacacgtccaaagaatcgaaacatggatattaagacacccaggttttacaattatggcggcaatactagcttatacaatcggaacgactcattttcaacgagctctgatttttatacttttgacagctgttgccccatctatgacaatgcgatgcataggcatttcaaatagagacttcgttgaaggcgtttcagggggatcttgggttgacatagttctcgaacatgggagctgcgtaacaacaatggccaaaaataaaccgacgcttgatttcgaattaataaaaactgaagccaaacaaccagcaacactaagaaaatattgcattgaagcgaaactcacgaatacaactactgaatcacgctgtccgacccaaggagaaccttcactgaacgaggaacaagacaaacgattcatatgtaaacactctatggtagatcgtggctggggtaacgggtgtgggctattcggtaaaggaggcatagttacttgtgctatgtttacatgtaagaaaaatatggaaggaaaagtcgtgcaaccagaaaatttagaatacacgatagttattacaccgcattccggagaagaacacgcagtaggaaatgacacaggaaaacacggaaaagagataaaaattacaccgcaatccagtataacagaagcagagttaacagggtatgggacagtaacaatggaatgtagtccgcgaactggattagactttaatgaaatggttctactccagatggaagataaagcgtggttagttcatagacaatggttcttagatttaccactcccatggttgcctggggcagatactcaaggatctaattggatacaaaaagaaactttagtaacttttaaaaacccgcacgccaagaaacaagatgtcgtcgtactcggtagtcaggagggagccatgcatacagctctaacgggtgcaacagaaatacaaatgtcttcaggcaatcttcttttcacaggtcatctgaaatgtagacttaggatggacaaacttcaactaaaaggaatgtcctatagcatgtgcacaggtaaattcaaaatagtcaaagaaatagctgagacacagcatggtacaattgtaatacgtgtgcagtatgagggggatggtagtccgtgtaaaataccatttgaaataactgatcttgagaaaagacatgtcttgggaagactaatcacggtaaacccgatagtaaccgagaaagactctccagtcaatatagaagctgaacctccgttcggtgattcgtacattatcataggggttgaaccgggtcaattgaaattgaattggttcaagaaaggaagctcaataggacaaatgttcgagacaacaatgagaggagccaaaagaatggcaatactaggagataccgcctgggattttggctcactagggggcgtgttcacttccatagggaaagcacttcatcaagtattcggagcgatctatggtgcggccttttcaggagtttcgtggaccatgaaaattcttataggagttattataacatggatagggatgaacagcagatcaacttcattgagtgtatcgctagtattagtcggtgtagttacactttacctgggcgctatggtccaagcagatagcggatgcgtcgcaagttggaagaataaagaattgaaatgcggatctggcattttcatcacagacaatgtccatacgtggacagaacaatataagtttcagccagaaagtccaagtaaacttgcctctgccatacagaaagctcatgaggaaggtatatgtggcatcagatctgtgacgagactcgagaacttgatgtggaaacagattaccccagagttaaatcacattctgtcagaaaacgaagtcaaacttactatcatgacgggggatatcaaaggtataatgcaggcgggaaagagaagtctacgtccacaaccgacggagttgaaatactcttggaaaacatggggtaaagcaaaaatgttatcaacagagtcacacaatcaaacatttttaatagatggacctgagactgccgaatgtcccaacacaaacagagcatggaatagtctcgaagtagaagactacgggtttggagtgttcaccacaaatatatggcttaaactccgagagaaacaagatgtcttctgcgatagcaaattgatgagtgccgctataaaagataacagagccgtccatgcggatatgggctattggatagagtcagctttgaacgatacatggaagatggaaaaagcctcattcattgaagtaaaaagctgtcactggccaaaatcacacacactatggtctaacggcgtattagaaagtgaaatgattattcccaaaaactttgccgggccagtctctcaacacaattatcgacctgggtaccatactcagactgctggtccctggcatttgggaaaacttgaaatggattttgatctttgtgaaggaacaaccgtcgtcgtgacagaagactgcggaaacaggggtccatcattacgtactaccaccgcgtccggcaagttaataactgagtggtgttgtcgttcatgcaccctgccgccccttcggtatagaggtgaagatggctgttggtatggaatggaaattagaccactgaaagaaaaagaagaaaatctggtaaatagtttggttaccgccggccatggacaaatagataatttctcactaggcgtactcggtatggccctctttttagaagaaatgctccggactaggataggtactaaacacgcaactctcttagtagcagtttccttcgtaactctaatcacaggcaacatgtcgtttagagatctagggcgagttatggtaatggtaggggcaacaatgacagacgatataggaatgggggttacatatctagccctactcgctgcatttaaagtacggccgacatttgccgccggtcttctcttaagaaaactaacaagtaaagagttaatgatggcaacgattggaattgctcttttatcccaatcaactataccggaaacaattctcgaattaactgacgcattagcactaggaatgatggttttaaagatagtacgaaacatggaaaaatatcaattagcagtaacaattatggcgattagctgtgtgcctaatgccgtaatcctccaaaatgcctggaaagtatcttgtaccatccttgccgccgtaagtgtatcaccacttttactgaccagctctcaacaaaaggcagattggattccattggcgctaactattaagggactgaatcccaccgcaatatttttaacaactctatcgcgaacaagtaagaaacgatcgtggccattaaacgaagcaataatggcggtaggcatggtgagcattctagcgtcttcactactaaagaatgacatcccaatgacgggaccattggtggcaggaggcctattaacagtatgttatgtattaactggaaggagtgctgatcttgagcttgaacgggctgcagatgtaaaatgggaagatcaagccgaaatttctggaagtagccccatcttatcaataaccatatcggaggacggaagcatgagcataaagaatgaagaagaagaacaaacattaacaatattaataaggactggactccttgttatatcgggagtatttcctgtatccattccaataaccgcagcggcatggtatctttgggaggttaagaaacaacgagcaggcgtactttgggatgtgccttcaccgccacctgtagaaaaagctgaattagaagacggagcctacagaatcaaacagagaggtattttaggttatagtcaaattggagccggcgtttataaagaaggaacttttcacacaatgtggcatgttacacgtggagctgttttaatgcatagagggaaaagaattgaaccatcatgggcagatgtcaagaaagatttaataagttatggaggcggctggaaactggaaggcgaatggaaggagggagaagaggtacaagttttagccttggaacccggcaaaaacccacgtgctgtacagacaaaaccgggaacatttaaaactaacacgggcacaataggagctgtatcgctagatttttcaccaggaacctctggcagtccgattgtagacagaaagggaaaggttgtaggactgtacggtaacggcgtcgtaactagaagtggggcctatgtatcagccatagcgcaaacagaaaaatctattgaggataaccctgagattgaagacgacatattcaggaagaagcgtttaacgattatggatttacacccaggcgcgggaaaaactaaacgctacctacctgctatcgtacgggaagcgattaaaagaggattaagaacccttattctcgccccaacgagagtagtagcagctgaaatggaagaagcactaagggggctaccgatacgatatcaaactccggcaataaaaacagaacatactggacgagaaattgttgaccttatgtgtcacgcaacctttactatgcgattattaagcccagtacgagttccaaattacaacctaataattatggatgaagcgcatttcacagatccagcgagcatagcagctcgtggatacatttcaacacgagtggaaatgggagaagctgctggtatttttatgaccgcaactcctccgggttcacgtgatccatttccccaatccaatgctccaattatggatgaagaaagggaaatacctgaacgcagctggaactccggccatgaatgggtgacagacttcaaaggtaagacagtttggtttgtcccgagcatcaaggcgggtaatgacattgcagcatgtttaaggaaaaacggcaagaaagttatccaattgtctcgaaaaacatttgacagtgaatatgtgaagacaagggcaaatgattgggacttcgtagtcacaactgatataagcgaaatgggagcgaacttcaaggccgaacgggtcatagacccgcgtaggtgcatgaaacctgttatactaacagacggtgaggaaagggtaatattagccggaccaatgccggtgacacattcatcagcagcccagcgcagggggaggattggcagaaatcccaaaaatgaaaacgatcaatacatatatatgggtgaaccattagagaatgacgaagattgcgcgcattggaaggaggcaaaaatgcttttagataatatcaacactccagagggtataataccttctatgttcgaacccgaacgagagaaagtggatgctatagacggagaatatagacttcgaggtgaagcccggaaaactttcgttgatttgatgagacgtggagatttgccagtttggttagcctataaggtagccgcagaaggaataaattatgccgacaggaaatggtgttttgatggaattaaaaacaatcaaatactggaagaaaacatggaagttgagatatggacaaaagaaggcgaacgtaagaaattgaaacctagatggttagatgcaagaatttactccgacccactagcgttaaaagaatttaaagagtttgcggccgggagaaagtcgttgacactgaatctgataacagaaatgggtagacttcctacatttatgacacaaaaggccagaaacgcattagataacctggcagtgctccatacagcagaggcgggaggtcgagcctacaaccacgctttaagtgaattaccagaaactttagagacacttctcctgctaacactcctcgcgacagtaaccggaggcatattcctgtttttaatgagtggtaaaggaattgggaaaatgacattggggatgtgttgcatcattacggcatcaatattactatggtacgctcaaatccagccacattggatcgcagctagcataattttggagttctttctcatagtactactaatcccggaaccagaaaagcagagaactccacaggataatcaattaacatatgttgtgattgcaatattaaccgtagttgcagctaccatggcaaatgaaatgggattcctcgagaaaaccaagaaagatcttggtttaggttctataactacccaagagtccgagagtaacatccttgatatagatttaaggcctgcaagtgcttggaccctgtacgcggtagctaccacattcgttactccaatgctcaggcatagtatagagaacagttcggtaaatgtatcactaacagccatagcgaatcaagccactgtactgatgggtcttggtaaaggctggcccctttcaaagatggacataggggtaccactgttagcaattggttgttactcacaagtgaatcctattactttgaccgctgctctattgctattggtagcacattatgctataattgggccaggattacaggcaaaagcaactagggaagctcagaaaagagcagcagcaggaattatgaaaaatccgactgtagacggaattaccgtgatagatttagaaccaatcccttatgacccgaaattcgaaaaacaactggggcaagtcatgctacttatattgtgtgtaacacaagtactgatgatgagaactacttgggcattatgtgaggctttgacattagcaacgggtcctatttccacactctgggagggcaatcctggccgattctggaatactacgatcgccgtgagtatggctaacattttccgtgggtcatacctagctggagcaggtttgttgttttcaattatgaagaatacgacgagtacccgacgagggaccgggaatataggagagacgctaggggaaaaatggaaaagtaggctaaatgcactaggaaaatccgaatttcaaatatacaagaaatcaggtatccaagaagtagataggacgttagcgaaagaaggcataaaaagaggggaaaccgatcatcatgctgtaagccgtggaagtgcaaagctacggtggtttgtagagcgtaatatggtaacacctgagggaaaggttgttgacctaggatgcggaagaggaggttggtcatattattgtggcggcctgaaaaacgtcagagaagttaagggtctaacaaaaggagggcctggccatgaggaacctataccgatgtcaacatatggatggaaccttgttaggctgcaatcgggagttgacgtattctttacaccaccagaaaaatgtgacaccctactttgtgacataggagaaagttccccaaaccctaccatagaagcaggccgaacgttaagagttttgaatcttgtagaaaactggttaaataacaacactcaattctgtattaaagtccttaacccttacatgccaagcgttatcgagaaaatggaggccttacaaagaaaatacggcggagccctagtaaggaacccactttcacgaaattctacccatgaaatgtattgggtgtcaaacgccacaggaaacattgtatcttcagttaatatgataagtcgtatgcttataaatagatttactatgaaacataagaaagcgacgtatgaaccagatgttgacctgggatcaggaacccggaatattggtattgagtccgaaataccaaacctcgacataattggaaaaagaatagagaaaattaagcaagaacacgagacgagttggcattatgaccaagatcatccatacaaaacatgggcatatcatgggtcttatgagacaaagcaaaccggatcagcaagttccatggttaatggtgtagtgagattgttaaccaaaccatgggacgtggtaccgatggtaacacaaatggctatgacagatacaacaccattcgggcaacagcgagtgtttaaagaaaaggtagacacaaggacgcaggagcccaaggaagggactaaaaagctaatgaaaatcactgcagaatggctatggaaagagcttggaaagaagaaaacccctagaatgtgcacaagagaagaatttacacgtaaagtccgttccaatgcagctttgggggcgatatttactgatgaaaataaatggaagtcggccagagaagctgtcgaagacggtagattttgggagctagttgacagagaacgtaacctccatctcgagggtaagtgcgagacctgtgtatataatatgatgggcaagcgcgaaaagaaattaggagaatttggaaaagcgaagggaagtcgcgctatatggtatatgtggcttggggcacgattcctcgaatttgaggcgttaggatttttaaatgaagatcattggtttagtagaggaaactcattatctggggtggaaggggaaggactacatagactaggatacattcttagagacgtttctaagaaagaaggcggagcaatgtatgcagatgacacagccggctgggacacgaggattacactcgaggacctgaaaaatgaggaaatggtaacaaaccacatgaagggagagcataagaaacttgcagaggcgatattcaaactaacctaccaaaataaagtcgtgagagttcaacgacccaccccaagaggaatagtaatggatataatatctagaagagatcaaagaggcagcggacaagttggtacatatggtcttaataccttcacaaacatggaagcgcaactaattcgccaaatggaaggagaaggaatattcaaaagcatacaacatttaacagcagctgaagaaattgtggtgcagaactggttagcccgagttggaagggagagattatctagaatggccatctcaggtgatgattgcgtagtaaagccaatagacgataggtttgcctctgctctaacggccctaaatgatatgggtaaagtaagaaaggatatacagcagtgggaaccgtcacgaggctggaatgattggacacaagttcctttttgttctcatcatttccacgaattagtaatgaaagatggtagagtcttagtggtcccgtgtagaaaccaagacgagttgatagggagagctcgaatatcgcagggcgctgggtggtccttgaaagaaacagcgtgcctaggtaaatcatacgcccaaatgtggacccttatgtactttcaccgaagagacctacgactcgcagctaatgcaatatgtagcgctgtgccgagtcactgggtccctacaagtaggaccacgtggtcaatacatgccaaacatgaatggatgacgacggaagatatgctagcagtatggaatagagtttggattcaagaaaacccttggatggaagataaaactcccgtcgaaagttgggaagaagtgccatacctgggaaaaagagaagaccaatggtgtggcagcctaatcggtcttacgagtcgagcgacgtgggcgaaaaatatacaaacagctatcaatcaagttcggtctctaattggcaacgaagagtacactgactacatgcctagcatgaaaagatttcgccgtgaagaggaggaagctggtgtactatggtga

SEQ ID NO: 22473 - RNA, 9876 nt, synthetic construct
  misc_feature 1..9876: note = derived and/or modified CDS sequence (opt6) from DENV-2__KC294207__SS-prME
  source 1..9876: mol_type = other RNA
acagcaggagttattgtcatgctgataccgactgcgatggcatttcacctgacgactcgaaatggagaacctcatatgattgtcggtagacaagaaaaaggaaagagcttactttttaaaacagaagatggagttaatatgtgcaccttaatggcaatagaccttggtgaactttgcgaagatacgataacgtataaatgtccattattgcgacaaaatgaacctgaagatatagactgctggtgcaattcgacatccacatgggtcacatatgggacttgtacaacgacaggtgaacatagaagggaaaagcgcagcgttgctcttgttcctcacgtaggaatgggactagaaaccagaactgagacatggatgtcatctgaaggcgcctggaaacatgtccagagaatcgaaacctggattttacgacatccgggttttacgattatggcagccatcttggcctacactattggtaccacacacttccaaagggcattaatttttatcttgcttactgcggttgctccaagtatgactatgcgatgtattggtatttctaacagggatttcgtagaaggtgtatccggagggagttgggtagatatcgtgttagaacatggcagttgtgtaacaactatggccaaaaataaaccaactctggacttcgagctgataaaaacagaggcaaaacaaccagctactctaagaaaatactgtatcgaagctaaactgacaaatactacaacagaaagcagatgcccaacccaaggtgaaccgtcactaaacgaggaacaggacaaaaggttcatttgcaaacacagcatggttgacaggggttggggaaatgggtgcgggttgttcgggaaaggtggtatagtaacgtgtgcaatgtttacctgtaagaaaaatatggagggcaaaattgtacagccagaaaatttggagtacacaattgttataacacctcacagcggagaagaacatgcagtcggaaacgacacaggaaaacatggcaaagaaataaaaattacccctcaatcttcaaccacagaagcagagttaactggatacggcactgtaaccatggaatgctccccacgaactggattggattttaatgaaatggtgttactacaaatggaagataaagcctggttagtgcaccgtcaatggtttctagacctaccgctcccttggttaccaggagctgatactcaagggtctaattggatacaaaaagagacactcgttactttcaaaaacccacatgcgaagaaacaggatgtagtagtattaggaagtcaagaaggtgcaatgcacacagcgctgactggtgcaacggaaatacaaatgtccagtggcaacttactttttacaggtcatttaaaatgtagattgagaatggataaattgcaacttaaagggatgagctactgtatgtgtacaggaaaatttaaaatagttaaagaaatagcggaaacgcaacatggtaccattgtaatcagagtacaatacgagggagacggttcgccatgcaaaattccatttgaaataacagacttagagaaaagacatgtactaggacgtcttattaccgtcaatccaatagtcacagaaaaagattccccagttaacattgaagcggaaccacctttcggagattcctacattatagtcggagtagaaccgggtcaactaaaactcaattggttcaagaaaggatcgagtataggtcaaatgttcgaaactaccatgaggggagctaaaagaatggcgattttgggtgatactgcatgggattttgggtcgctaggaggtgtctttacctcaattggcaaggctttacatcaagtattcggtgctatttatggcgcagctttctctggcgtttcatggactatgaaaatacttattggagttatcataacatggatagggatgaactccaggtccacatccttgtctgtatcattggtattggtaggggttgtaactttgtatttaggggccatggtacaagccgatagtggatgcatagttagctggaaaaataaagagttgaaatgcggttcaggcatattcatcacagacaatgttcacacttggactgagcagtataaatttcaacctgaatctccgagtaaacttgcaagcgccatacagaaagcacatgaagaaggaatctgcggtatacgatcggtcacacggttagaaaatctgatgtggaagcagataactccagagcttaaccatatactgtctgaaaatgaagttaaactaacaataatgactggggatataaaaggtattatgcaagcgggaaagaggtcattgcgaccacagcctacggaactgaaatattcctggaaaacatggggcaaagccaaaatgctaagcacagaatctcataaccaaacatttttaatcgacgggccggaaactgcagaatgtcctaacacgaatcgggcatggaactcattagaagtcgaggattacggttttggagtatttacgaccaatatttggcttaaactaagagaaaaacaagacgtattttgcgactccaaactcatgtcagctgctattaaggacaatcgagccgttcatgcggatatgggatactggatagaatccgcattaaatgatacatggaaaatggaaaaagcatcgtttattgaagtgaaaagctgtcactggccaaaaagccataccttgtggtctaatggtgtactggagagcgaaatgataatacctaaaaatttcgctggtcccgtctcacaacacaattaccgtccaggttatcacacgcagacagcaggaccgggtcatcttggcaaactggaaatggacttcgatctttgtgaaggaacaacagtggtagtaacagaagactgtggcaatagaggtcccagcttgcgtactacaacagcctcagggaaactaataactgagtggtgttgtagatcgtgcacccttccaccgctgagatataggggagaagacggatgctggtacggaatggaaataagaccactaaaagaaaaggaagaaaatttagtaaatagtctagtaactgctggtcatggccaaatcgataatttctccctgggagtactcggtatggctttatttctagaagaaatgttacgaactcgtgtgggaaccaaacacgcaatcttgcttgtcgctcttagctttgttacgctaatcacaggaaatatgagtttccgcgatttaggacgtgttatggtaatggttggagctacaatgactgacgatattggcatgggagtaacttacttagcactcttggctgcgtttaaagtacgaccaacattcgccgcaggcttattactgaggaaactaacgtcgaaagagctcatgatggccactattggcatagcactactaagccaaagcacactcccagaaaccatccttgaattaacagacgctctcgcacttggcatgatggcgttgaaaatagtaagaaatatggagaaataccaattagcagttacgatcatggctatttcatgtgttccgaatgctgtaatacttcaaaatgcatggaaagtcagctgtaccattctcgctgcggtaagtgtatctccgttactgcttacttcatcacaacaaaaagcagattggataccactagcgttaacaataaagggcctaaacccaaccgcaattttccttacaacattatccagaactagcaagaaacgcagttggccactaaatgaagcaataatggcagtcggtatggtaagtatcctcgcttcaagccttctcaaaaatgatatccccatgacaggacccctagttgctggaggtttattaaccgtctgttacgtcctcacaggaagaagcgcagatttagagttagagcgggcagcagatgtgaagtgggaggaccaagccgagatctcgggaagtagcccaattttgagtattactatatcagaagatggttcaatgtcaatcaaaaatgaagaggaggaacaaacattgacaatactaatcagaaccgggttactcgtaatctctggtgtcttcccagtatcaatccctatcacggctgcagcatggtacttatgggaagttaagaaacagcgagcgggtgttctctgggatgttccatcaccaccaccagtaggtaaagccgaacttgaggatggcgcgtatagaataaaacaacgtgggatattgggatactctcaaataggagcaggagtatataaggaaggtacttttcatacaatgtggcatgttacaagaggagccgtactaatgcatcgcggaaaaagaattgaaccatcatgggcggacgtgaagaaagatttaatatcttatggcggaggctggaaacttgaaggcgaatggaaggaaggagaagaagttcaagtcctcgccctagagccgggtaaaaatccccgagcagttcaaaccaaaccaggaatcttcaaaaccaatacaggaactataggagcagtgtccctagacttcagccccggcacatcgggatcacctattgttgatcgaaaaggtaaagtagtagggttgtatggaaatggagtggtaacgcggagcggtgcatatgtttcagcaattgcgcaaactgagaaaagcatagaagataaccctgaaatagaagacgacattttcagaaagaaacgacttactattatggacttacatcctggagcaggaaaaaccaaacgttatttacccgcgatagttagagaagcaattaagcgagggttaagaactttgatcttagcaccaacaagagtagtcgcagcggagatggaagaagccttaagaggtcttcctataagatatcaaaccccagcgatcagggctgagcacacaggacgggagatagtagacttaatgtgccatgctaccttcacaatgagacttttaagcccagtacgagttcccaactacaatctgataataatggatgaagcgcatttcactgacccggctagtattgcagcaagaggatatattagcacgagagtagaaatgggagaagccgcaggcatatttatgaccgcgacccctccgggctcaagagatccgtttccacagagcaatgcgcctattatggatgaggaacgtgaaatacctgaacgaagctggaactctggacatgaatgggtcaccgattttaaaggaaaaactgtctggttcgtgccctctattaaggcaggtaatgatattgctgcttgccttaggaaaaatggtaagaaagtaattcagttatcgagaaaaacgttcgattctgaatacgttaaaacaagagcgaacgattgggattttgtcgtcacaactgacataagtgagatgggcgcaaatttcaaagccgaacgtgttatcgacccccgtagatgtatgaaaccggtgatccttacagacggtgaggaacgagtcatcttagctggtccgatgccggtgacacattctagcgcagcacaacgcagaggccgtattggaagaaaccctaaaaatgaaaacgatcagtatatatacatgggagaaccactagaaaacgatgaagattgtgctcactggaaggaggcaaaaatgctgctcgataatattaacacgcccgagggcatcattccatccatgtttgaacctgaacgggaaaaagtggacgcaatagacggggaataccgattacgcggagaagccagaaagacttttgtagatctaatgcgcagaggagatttgcctgtatggctagcatataaagtcgcagcagagggaatcaactatgccgatagaaaatggtgcttcgacgggataaagaacaatcaaatacttgaagaaaatgtagaagtcgaaatttggacaaaagaaggcgaaagaaagaaactaaaaccgagatggctcgacgcacgcatatatagcgatccattagctctaaaagaatttaaagagtttgctgctgggcgcaaaagtttaacactaaatcttataacggagatgggacgtctacctacatttatgacccaaaaagctagaaatgctttggacaaccttgcagtcttacatacggcggaagtaggcggcaaggcgtatacacatgctctatcagaattaccagaaacgttagaaactctcctgctattaacactattggcagctgtcacaggaggcatatttttgttcctaatgagtggaaaaggagtggggaagatgaccttgggcatgtgctgcattattactgcttcaattcttttgtggtacgcacaaatacaaccacattggatagcagcatcgataattctcgagttctttttaatagtactgcttattcccgaacctgaaaaacaacgaacgcctcaggataaccaactaacttacgtcgttatagccattttaactgtagtggcagctacaatggctaatgaaatgggattccttgaaaagaccaagaaagacctagggttcggaagtataacaactcaagaaagtgaaagcaatatattggacatagacctcaggccagccagtgcatggacattatacgcagtagctacaactttcgtgacacctatgttgagacattcaattgaaaactccagtgttaacgtgagtctaactgcaatcgcaaatcaagctaccgttttaatgggtttaggaaaaggctggcccctaagcaaaatggacataggagtgccattgttagccattggatgttattcccaagtgaatcctattacactgactgcagcactactattactggtcgcacattatgcgatcataggacctgggctccaagcaaaggccactagggaagcgcagaaacgtgccgcggccggaattatgaagaaccccaccgtagacggaataactgtcatagatctagaaccgataccttacgatccaaagttcgaaaaacaactaggtcaggttatgctactaatattatgtgtaacacaagtgttaatgatgagaacaacatgggccttgtgcgaggctttaaccctagcgaccggaccgatatctaccttatgggaaggaaatccaggacgtttttggaatacaactatagcagtatcgatggcgaatatcttccggggtagttatctagccggtgcgggattacttttcagtatcatgaaaaatactacgaataccagaagaggaacaggaaatgtgggagagacactaggagaaaaatggaagtcacggctaaatgcattaggtaagtcagagtttcagatatataagaaaagtggtatccaagaagtcgacaggacattagcaaaggaagggataaaaagaggtgaaacggatcaccacgcggtaagtagaggctctgctaaactaagatggtttgtggagcgtaacatggtaacacccgaaggtaaagttgtggatttaggatgcggaagaggcggttggtcctactactgcggtggtctgaaaaacgtaagagaagtaaaaggattgacaaaaggtggtcctggccacgaagaacctatcccaatgtcaacgtatggatggaacctagtccgattacaaagtggcgttgatgtcttcttcactccaccggaaaagtgcgataccctcttatgcgacataggagaaagttccccgaatccaacaatcgaggcgggaagaacgctgagagttctgaatcttgtcgaaaactggctaaacaataatacacaattctgcataaaagttctaaacccttatatgccttcggtaatcgagaaaatggagacacttcaaagaaagtatggaggcgctctcgtaagaaatccactatcaaggaatagtacccatgaaatgtattgggtctctaatgcgacgggcaacatagtatcaagcgtgaatatgattagcaggatgctaataaaccggtttactatgaaacacaagaaagctacatacgaacccgatgtagacttaggaagcgggacacgtaacatagggatagaaagtgaaatcccaaatctggatattgtgggaaagcgtatagagaaaattaaacaagaacatgagacatcatggcactatgaccaagatcatccctataagacttgggcttaccatggatcctatgaaactaaacaaacaggctcagcgtcatcgatggtaaatggtgtagttaggctcctaacaaaaccctgggacgttgtacccatggttacgcaaatggctatgacagatacgaccccattcgggcagcaacgtgtatttaaagaaaaagttgacactagaactcaagaaccgaaggagggtaccaagaaattaatgaaaattacggcagagtggctctggaaagaattgggaaaagagaaaacaccaaggatgtgtactcgcgaagagttcacaagaaaggtcaggagtaacgcagccttgggcgcagttttcacggatgaaaataaatggaaaagtgctagagaagctgtagaagatggacgattctgggaattagtagatagagaaaggaatctacacttagaaggcaaatgcgaaacgtgtgtttacaacatgatgggaaaacgagagaagaaactgggagagttcggaaaagccaaaggttctagggctatatggtatatgtggttaggggcgcggttccttgaatttgaagcacttggttttctcaatgaagatcactggttctcacggggaaatagcctaagcggggttgaaggggaaggactacatcgactagggtatattctacgagaagtaggcaagaaagaaggaggagctatgtatgcagacgatacagcaggctgggatactagaataacattagaagatttgaaaaatgaagaaatggtcacaaatcatatgaaaggagaacacaagaaactagcagaagctatctttaagctcacataccagaataaagttgtaagagtacaacgaccgactcctagaggcacagttatggatatcatctcaaggaaagaccaacgtggtagcggtcaagtaggaacttatggtttaaatacatttacaaatatggaagcacaacttattcgacagatggagggagaagggatcttcaaatcaattcaacacttaaccgcaaccgaagaaattgcagtacaaaattggcttgcgagggtgggacgagaacgactttcaaggatggcaataagtggagacgactgcgtggtaaagcccattgatgacagattcgctagtgcccttaccgcgttaaatgacatgggaaaagtacgaaaagatattcaacaatgggaaccaagtagaggttggaatgattggacacaggtacctttctgttcccaccactttcatgaattagtaatgaaagacggaagggttctcgttgtaccgtgcagaaatcaagacgaactaattggacgagcaagaatcagtcaaggggcaggttggtcacttaaagaaacagcatgtctaggtaaatcatatgcccaaatgtggacactcatgtatttccatcgacgcgacctaagactcgctgccaacgcgatttgtagcgccgtccctagtcactgggtgccaacaagcagaactacgtggtcgatccacgctaagcacgaatggatgacgacggaggacatgttagtggtttggaatcgagtatggattcaagaaaatccgtggatggaggacaaaactcccgtagaatcatgggaagaagtaccatatcttggaaaacgagaagaccaatggtgtggcagtcttatcgggttaacgtctcgagcaacatgggcgaagaatatccagaccgcgatcaaccaagttcggtcactaatcgggaatgagggatacacagactatatgccctcgatgaaacgtttcaggcgtgaagaggaagaagcaggagtactctggtga

SEQ ID NO: 22474 - RNA, 9876 nt, synthetic construct
  misc_feature 1..9876: note = derived and/or modified CDS sequence (opt6) from DENV-2__KC294208__SS-prME
  source 1..9876: mol_type = other RNA
actgctggtgtgatagttatgttgatcccaactgcaatggcattccatttaactacacgaaatggtgaaccacacatgatagtaggccgacaagaaaaaggaaaaagtctgcttttcaaaacagaagacggtgttaatatgtgtacattgatggcaatagatttgggagaactttgtgaagatactatcacatacaaatgtccattactacgtcaaaatgaacccgaagatatagattgctggtgcaatagcacatctacttgggtgacgtatggaacatgcacaacaacaggagaacacagacgagagaaaagaagtgtagctctagtcccacacgtgggaatgggtttagaaactagaaccgaaacatggatgtcttcggaaggtgcttggaaacacgttcagaggattgaaacatggatacttcgtcatccaggattcacaattatggcagcaattctagcatatacaatcgggacaacacactttcaacgagcgttgatttttatactattaactgctgtcgcacctagcatgacaatgcgatgtattggtataagtaatagagattttgtcgaaggagtatcaggcggaagttgggttgatatcgttctagaacacggcagttgcgtaaccactatggccaaaaataaacctacccttgacttcgaattaattaaaaccgaagcaaaacaaccagcgacattaagaaaatattgtatagaagcaaaattaacaaatacgacaacggagtccagatgtcccacacaaggagagccatctttaaacgaagaacaagacaaacgtttcatctgtaaacattcgatggtggaccgaggctggggtaacggatgtgggttattcgggaaaggaggaatagttacctgtgcaatgttcacatgtaagaagaacatggaggggaagatagtacaacccgaaaatttagaatacacaatagttattacaccccattcaggcgaagaacatgcagtgggaaatgatacaggcaaacacggcaaagaaataaaaattactccacagagctcaacaacagaggcagagctgactgggtacggcacggtaacaatggaatgtagtcctaggacgggcttagattttaacgaaatggtacttctacagatggaagacaaagcatggttagtccaccgtcaatggttccttgaccttcctctcccatggttgcctggagctgatacacaaggatccaactggatacaaaaagagacccttgtgacatttaaaaacccccacgccaagaaacaagatgttgtagttcttggatctcaagaaggagcaatgcatacagctttaacaggagcgaccgaaatacagatgagtagtggcaatttactgtttacaggccatctaaaatgcagactcagaatggacaagctacaattaaaaggaatgagttattctatgtgcacagggaagttcaagatagtcaaagaaatcgctgagacgcagcatggcacaatagtaattagggtccaatacgaaggtgacggatcaccatgcaagataccatttgaaattacggatcttgagaagcgacacgtcctaggacgattgatcacggtcaaccctattgtaacggaaaaagactccccggtcaatatagaagcggaaccgccatttggtgatagttatattatcgtaggcgtggaacctggacaattgaaacttaattggtttaagaaagggagcagcatcggccaaatgtttgaaacaactatgcgaggagcaaaaagaatggcaatattaggcgatactgcatgggattttggatctcttggcggggtcttcacatctattggcaaggctttacaccaagtctttggagcaatatatggtgcagcattctcaggcgtgtcttggactatgaaaattctcataggagtcatcattacatggattggtatgaactcaaggtctacgtcactgagtgtatcattagtcttagtgggagtagtaactttgtatctaggagcaatggttcaggccgattctggttgcatagtaagctggaaaaataaagaactgaaatgcggcagtggaatttttataactgataatgtgcacacatggacagaacaatacaagtttcaaccggagtcaccgagtaagttagcaagcgcaatccagaaggcacatgaagaaggaatatgtggaataagaagcgtcacacgactagaaaatttaatgtggaaacagataaccccagaactaaatcacatactgtctgagaatgaagtaaaacttaccatcatgacgggggacataaaaggaattatgcaagcaggaaagagatcacttcggccgcagccaacagaactgaaatattcttggaaaacatggggcaaggcaaaaatgctaagtactgaatctcataaccagacatttctaatagatgggcccgaaacagctgaatgtccaaatactaatcgagcatggaactcccttgaagtcgaagattatgggttcggtgtatttaccaccaatatctggttaaaactccgcgaaaaacaagacgtattctgcgattccaaattaatgagcgcagcaatcaaagataatagagctgtccatgctgacatggggtactggatcgaaagtgccctcaatgatacttggaaaatggaaaaagcatcatttatcgaggtcaaatcgtgtcattggccgaagtctcataccctgtggtcaaatggcgtactagaatctgaaatgataatccccaaaaattttgctggaccagtgtctcaacacaactacagacccggataccacacgcaaactgcagggccgtggcatcttggtaaacttgaaatggattttgatttttgcgaaggaaccactgtcgtagtgactgaggactgtggtaaccgcggcccctcactcaggacaacaacagcgtccggaaaactaataactgaatggtgttgtagatcatgcacactacctccactccggtatagaggagaagacggttgctggtatggtatggaaatcagaccattaaaagagaaagaagagaacttggtcaatagtctagtaacagcaggccacggacaaatcgacaatttttccctgggtgtactcggaatggccctatttttagaggagatgctacggacaagagttggaactaagcatgctatattattagtcgccttatcattcgtcacattaataacaggtaacatgagctttagggatttaggtagagttatggttatggtaggggctacgatgacggatgatataggaatgggagttacttatttggccttattagccgcctttaaagtgagaccaacattcgctgccggattattactacgtaaattaacaagcaaagaactaatgatggcgaccataggaatagctttactttcacaatcaacccttccggaaacgattttagaactaacggacgcactcgcgttagggatgatggctttaaaaatcgtgagaaatatggaaaagtatcaattagcagttactattatggctataagctgtgttcccaatgcggtgatactgcaaaacgcatggaaagtgtcctgtacaatcctagccgctgtgagtgtgagtcccttgctgttaactagctcacaacaaaaggctgattggatccccctggcacttacaataaaaggattaaatcccacagccatattcttgacaaccttaagcaggacatcaaagaaacggagctggccactaaacgaggcaataatggcagtaggaatggtctcaatccttgcaagctccttattaaagaacgacatcccaatgactgggccactggtcgcgggaggattattaacggtttgctatgtactaacgggtcgaagcgcggacctagagttggaaagagctgcagatgtaaagtgggaagaccaagcagaaattagtggcagctcaccgatactgagcataacaatatctgaagatgggagcatgagcatcaaaaatgaagaagaggagcaaaccttaacgatactcattcgtactggattattagttatatcgggagtgttcccagtgtcaatccctattaccgctgcggcgtggtatttatgggaagtcaagaaacaacgagcgggggttctctgggatgtgcccagtcctccacctgtaggtaaagcagaactagaagatggtgcatatagaatcaaacaaagaggaatcttaggatattcacaaataggagcgggagtatacaaagaaggtacattccatacgatgtggcacgtaaccaggggagccgtgctgatgcatagggggaagagaatagaaccaagttgggcagatgttaagaaagacttaataagttacggtggaggctggaaactcgaaggagaatggaaggaaggagaagaggtccaggtactggcgttagagccaggcaagaaccctagagcagtccaaaccaaacccggaatttttaaaacaaacactggaacgattggagcagtatctctcgatttcagtcctggaacatcaggatcacccattgtagacaggaaaggaaaagtggttggtttgtatggaaatggagtcgtaacgagaagtggcgcatatgttagcgcaattgcgcagaccgagaaaagcatcgaagataatcccgaaattgaggatgacattttccgcaagaagagacttacaataatggatttacacccaggggccggtaaaacaaagagatatctcccagctatagtacgagaggctataaaaaggggtctacgcacgttgattttagcccccacaagagtagtagccgcagaaatggaagaagcattaaggggtcttccgataaggtatcaaactcccgcaattcgagccgaacatacaggtcgggagattgtcgatttgatgtgtcacgctacatttacaatgagactattaagtccagtcagggtaccaaactataacctcataattatggatgaagcacacttcacagacccagcgtctatagcggccagaggatatattagtacaagggtcgaaatgggggaggccgccggaatatttatgacagcgacgcctccgggaagtagagaccccttcccacaatcaaacgcacctattatggatgaggaacgtgaaatacccgagaggagctggaactccgggcacgaatgggttaccgactttaaaggaaaaaccgtatggttcgttccgtcaattaaagcaggtaatgatatagcggcatgcctccgaaagaatggcaagaaagtcattcaactcagtagaaagacattcgattcagaatacgtaaaaactcgagcgaatgattgggactttgtcgtgacaacggacatcagcgaaatgggggcaaactttaaagccgagagagttattgatccacgtaggtgcatgaaaccagtaatactaactgatggagaagaacgagtaattctagcaggtcctatgcctgtaactcacagctccgccgcgcagagaagaggacgaataggaagaaatccgaaaaatgagaatgaccaatatatctatatgggggaaccattagaaaacgatgaagactgcgcccactggaaagaagcgaaaatgttattagataacataaacacgcctgagggcattatccccagtatgttcgagcctgaaagagaaaaagtagatgctatagacggagaatatcgattgcgaggagaagctcgtaaaacatttgtggatttaatgcgtagaggtgatttaccagtgtggctcgcatacaaagttgcggcggaaggtattaattatgccgaccgtaaatggtgttttgacggtattaaaaataaccaaatcctagaggaaaacgttgaagtagaaatatggacaaaggagggagaaagaaagaaattaaagcctagatggcttgacgctcgaatttactctgatccactcgctctaaaagagttcaaagaatttgcggccggaagaaaaagtctgactttaaatttaattactgaaatgggtcgtctccccactttcatgacacagaaagctagaaatgcgttggataacttagcagtattacatactgctgaggttggagggaaggcttacacccatgctcttagtgaactgccggaaacgctagaaactttacttcttttaactttgctcgctgcggtcacaggtggaatttttctattcttaatgagcggaaaaggtataggtaagatgacattgggtatgtgttgcatcataacggcatcgatattactatggtatgcccaaatacaaccacattggatagcagcttctattattctagaatttttcttgatagtgctgctcataccagaaccagagaagcaaaggacaccacaagacaatcaattaacgtatgtagttattgcaattttaacagtagtggctgcaaccatggccaatgaaatgggatttcttgagaaaacaaagaaagatcttggctttgggagtataacaactcaagaatcagaatctaacatactggacatcgatctacgaccggcatctgcttggacactatatgcagttgcaacaacctttgtcacacctatgttacgacactcaatagaaaactcttccgtaaacgtatctctaacagcaatcgcaaatcaagcgacagttctcatgggactaggaaaaggatggccgttatcaaaaatggatattggagtgcctcttctagcaatcggatgttacagtcaagtaaatccaattacgctaaccgccgcactactcttattagtggctcactacgcgattataggcccgggtttacaggctaaagcaacaagggaagctcaaaaacgggcagcagcagggatcatgaaaaatccgaccgttgatggaataactgtcattgatttagaaccgataccatacgatccaaagtttgaaaaacagctaggtcaggtaatgttattaatcctctgcgtgacgcaagtcctcatgatgagaactacttgggcgttgtgtgaggctttaacattagctaccggaccaatatcaacgctctgggaaggcgatcccggcagattttggaatacaaccatcgctgtatcaatggcgaatatatttagaggctcctatttggcgggagctggtttactatttagtataatgaagaacacaactaacactaggcgcggcacaggaaacgtaggcgagacactgggcgaaaaatggaaatcacgattgaatgcactaggaaaatcggagtttcaaatatacaaaaagtcgggaatacaagaagttgacagaacattagccaaggaaggcataaaaagaggggaaactgatcatcacgccgtatcgcgaggcagtgcaaaacttagatggtttgtcgaacgaaatatggtaactcccgaagggaaagtcgtagatcttggttgtggaaggggaggatggagttactattgcggaggacttaagaatgtcagagaggtaaaaggactaacgaaagggggaccgggccatgaagaaccaattccaatgtctacctatggctggaacctggttcgactgcaaagcggtgtggatgtatttttcacgccaccagagaaatgcgacacactactatgtgatatcggtgaatcatcacctaacccaacgattgaagcgggacgtacacttagggttcttaacctcgttgagaactggctgaacaataatacccaattttgtatcaaggttctgaatccatatatgcccagcgtgatagagaagatggaaacacttcagcgaaaatatgggggagcattagttcgaaatcccttaagtcgaaacagcactcacgaaatgtactgggtatcaaacgcaactggaaatatagtgtcaagcgttaacatgatttcgagaatgttgatcaaccgcttcacaatgaaacacaagaaggctacgtacgaacctgatgtagatcttggcagtggcacacgcaacataggcatcgaatccgagatcccaaacttggacattgtaggcaaacgaatagagaaaataaaacaagagcacgaaacaagttggcactatgaccaagaccacccatataagacgtgggcatatcatggaagctacgaaactaaacaaaccggatctgcatccagcatggtaaatggtgtagtacgcttgctcactaaaccctgggatgttgtaccaatggtaactcaaatggctatgacagacacaacaccttttggccaacaacgagtcttcaaggagaaagttgacacaaggacgcaagagcctaaagaaggaacgaagaagctgatgaaaatcacagccgaatggctctggaaagagctcggtaaggaaaagacaccacgaatgtgtacgcgggaggaatttacccgcaaggtaagatcaaatgcggctctaggagcagtctttacagatgaaaataaatggaaaagtgcacgtgaggctgtcgaagacggaagattctgggagctagtggatcgagaacgaaacttgcaccttgagggaaagtgtgagacatgcgtatataacatgatgggcaaacgtgagaagaaactaggtgaatttgggaaagcaaaaggatcgagggctatctggtacatgtggctcggggccaggttcttagagttcgaagccttaggttttctaaatgaagatcattggttttcaagaggaaactcactaagtggtgtagaaggggaggggcttcacaggttagggtatatactgagagaagtgggtaagaaagagggaggcgcaatgtatgcagatgacacagcaggttgggacacaagaattaccctagaggatttgaaaaacgaggaaatggtaacaaaccatatgaaaggagaacataagaaattagcagaagccatcttcaaattaacgtatcaaaacaaagtagtaagggtccagcgtccgacaccaagaggaacggttatggacataatcagccgcaaagatcaacgaggttcgggacaggttggaacgtatggactgaacacgtttacaaatatggaagcccagctaataaggcaaatggaaggagaaggaatttttaaatctatacaacatttaaccgctactgaagagatagcggttcaaaactggttggctcgtgttggacgagagaggctatcaagaatggcgatctccggagatgactgcgtagtaaaaccgatagatgatagatttgcgtctgcactgacagcactaaatgatatgggaaaagttcgaaaggacatacagcaatgggagcctagtagaggatggaatgattggactcaagtaccattttgcagtcaccatttccatgaattagtaatgaaagacggacgagtattagttgtcccatgtagaaaccaggatgaattaattggacgagccagaatatcccaaggtgccggttggagtctaaaggaaacagcatgcctagggaaaagttatgctcaaatgtggacgctaatgtactttcaccggcgagatttacggttagctgcaaatgcaatttgctcagctgtaccatctcattgggtgcccacttcaaggacaacctggagcatccacgcaaaacatgaatggatgacaacggaagatatgctagtcgtttggaatagagtctggatacaagagaacccatggatggaagacaaaactccagtagaaagttgggaagaagtcccatatctaggcaagagagaagatcaatggtgtggatcactcattggtctaacaagtcgtgccacatgggctaaaaacatacaaacagccataaaccaggtccgctccttaataggcaatgaaggctacacagattacatgccgtccatgaaaagattccggagagaagaagaggaagcaggagtgttgtggtaa

SEQ ID NO: 22475 - RNA, 9876 nt, synthetic construct
  misc_feature 1..9876: note = derived and/or modified CDS sequence (opt6) from DENV-2__KC294209__SS-prME
  source 1..9876: mol_type = other RNA
actgcgggtgtaatcgtaatgttaattcctacagcaatggcatttcatcttacgacaagaaatggagaaccgcatatgatagttggaaggcaggaaaaaggtaaaagtctattattcaaaactgaagatggagtaaatatgtgtacactaatggcaatagatttaggtgaactttgtgaagatacaattacatataaatgccctttacttagacagaacgaaccagaagacattgattgctggtgtaacagtacatcgacttgggtgacctatggtacttgcactacaacgggagaacatagaagagagaaaagaagtgttgcattagtacctcatgtaggaatgggattggaaacaagaacagaaacttggatgagtagtgaaggggcttggaaacacgttcaaaggatcgagacatggatacttcgacatcccggctttacaataatggcagcgatcttggcatacactatagggacgacacacttccagcgagcacttattttcatattattaacggcagtagcgccatctatgactatgcgatgcatcggtatcagtaatagagactttgttgaaggtgtaagcgggggttcatgggttgatatcgtactagaacatggttcctgcgtaaccactatggccaaaaataaaccaacacttgactttgaattgatcaaaacggaagcaaaacaacccgcgaccctcagaaaatactgtatagaagcaaaattgactaacacaacaacagaatctaggtgcccgacccaaggagaaccctccctaaatgaagaacaagataaacggttcatatgtaaacattccatggtagatcgaggatggggtaacggatgtggattgtttggtaaaggtggaattgtaacatgtgctatgtttacatgtaagaaaaatatggaaggcaaaattgtgcaacccgaaaatctcgaatatacaatcgttattacaccacattcaggggaagaacatgcagtcggaaacgataccgggaaacatgggaaagagataaaaataacgccacaatcatcaaccacagaagctgaattaaccggttacggcaccgttaccatggaatgttcgcccagaaccggtttagattttaatgaaatggttttgcttcaaatggaagacaaagcatggctagtccataggcaatggtttttagaccttccactcccatggttacctggggctgatacccaaggatctaattggatccaaaaagagaccttagtgactttcaaaaatccacacgccaagaaacaagacgtagttgtgctaggctcccaggaaggagcaatgcacactgcgttaacaggagcaacagaaattcagatgtcgtcgggaaatcttctatttaccgggcaccttaaatgtcgattgagaatggataaattacaattaaaaggaatgtcctactctatgtgtacaggaaaattcaaaatcgttaaagaaatagccgagacccaacacggaactatagtcatccgcgtgcaatacgagggcgatggttcaccttgcaaaataccatttgaaataacagacttagaaaagaggcatgttctcgggcgactgataactgtcaaccctatcgttactgagaaagactcaccagtaaacattgaagctgaacctccctttggtgatagttacataattgtaggagttgaaccgggccaactcaagctaaattggtttaagaaaggctcaagtataggacaaatgtttgaaactacgatgcgaggtgcaaaacgaatggctattttaggtgacaccgcttgggactttgggtcgttgggaggagtatttacttcaataggaaaagcattacaccaagtattcggagctatatatggagcagcttttagcggagtgtcatggaccatgaaaatcttgataggtgtaataattacttggatcggaatgaactcacgatccactagcttaagcgtatctcttgtgttagtaggtgtggttaccttgtacttaggagcgatggtacaagcggatagcgggtgtattgtttcctggaaaaataaagagctaaaatgtggtagcgggatttttataactgataatgttcatacttggactgaacaatacaaattccagccagaatcaccctcaaaactagcatcggctatacaaaaagcgcacgaggaaggtatttgtggaattaggtctgttacccgacttgaaaatttaatgtggaaacaaatcaccccagaacttaatcacattctaagcgaaaatgaagtaaaattaaccattatgacgggcgatataaagggtataatgcaagcaggcaagcgctcattacgtccacaaccaactgaattaaagtattcatggaaaacatggggtaaggcgaagatgctctcaacagaatcccataaccaaacatttctaatagatggacccgaaaccgccgaatgcccaaacaccaaccgagcgtggaacagcttagaagtggaagactatggattcggagtattcactacaaacatatggctaaaacttcgagaaaaacaggatgtcttttgtgatagcaaactaatgtcagccgctattaaagataatagagctgttcatgcagatatgggttactggattgagtctgctttaaacgacacctggaagatggaaaaagcgtcttttatagaagtaaagagttgccactggccgaaatctcacacactctggtctaatggcgttctggaatcggagatgattatacctaaaaactttgcggggccagtcagtcaacacaattacagaccaggttatcacactcaaaccgcaggtccttggcatttgggtaagctggaaatggatttcgacttttgcgaaggcacaactgttgtagtaaccgaggactgtggtaatagagggccgtcactgcgaacaactacagcaagtggaaaattaatcactgaatggtgctgtagatcttgcacgcttccacctctaagatatagaggtgaagatggctgttggtacggaatggaaataagacctttaaaagaaaaagaagaaaatttggtaaacagcttagttactgcagggcacggtcaaattgataatttcagcctcggagttcttggaatggcactgttcttagaagaaatgttgcgtactcgagtagggactaaacacgcaatactcttggtagcactttcttttgtcacgctcataactggaaatatgagttttagagacctaggtagagtaatggtaatggtcggagcaacgatgaccgatgatataggtatgggtgtaacctatctagcattgctcgctgcgttcaaagtgagacctacttttgccgcgggtttgctcctacgcaaattgaccagcaaggagttgatgatggctacaataggaattgctttactatctcaatcaactctaccagagacaattttggagctcacagatgccttggctttaggcatgatggcgctaaaaattgtacgaaatatggaaaaatatcagttagctgttacaatcatggccatctcttgtgttccgaatgcagttatattacagaatgcgtggaaagtgtcttgtacgatactggcagcagtaagcgtaagtccgctgctgttaacgagctcacagcaaaaagccgactggataccattagcgctaacgataaagggattaaacccaactgcaatctttctcacgaccttatcacgtacgtctaagaaacgctcttggcccttaaatgaggcaataatggcggtaggcatggtgtctatattggcatcatcactattgaaaaacgatataccaatgacagggcccctagttgctggaggactactaacagtgtgctacgttttaacaggtagatcagcagacttagagttagagcgtgcggccgacgtgaaatgggaagatcaagcagaaatatcaggatccagtccaatactcagtataaccatttcagaagatgggtccatgtcaatcaaaaatgaggaagaagaacaaaccttaaccatattaatccgaactggactgctagtaataagtggcgtattccccgtgtcaattccaatcaccgcggctgcttggtatctttgggaggtcaaaaagcaacgggcgggtgtgttatgggatgtgccgtcaccgcctcctgtaggaaaggcggaactagaagatggcgcttacagaattaaacagagaggaatattaggatattcccaaataggcgcgggagtttataaggaaggaacgttccacaccatgtggcacgtgacgagaggcgcggtgcttatgcacagagggaagagaatagagccatcgtgggccgatgtcaagaaagacttaatttcatatggaggcggttggaaactagaaggtgagtggaaagaaggtgaggaagtacaggtacttgccttagaaccaggtaagaatccacgggccgttcaaaccaagccaggtatctttaagaccaacacgggaacaattggtgcagtgagtttggatttttctccaggaacatcaggaagtcctattgtagatagaaaaggaaaagtagttgggttatacggtaacggagtagttactaggagtggtgcatacgtgagtgcgatagcccaaaccgaaaaatcaattgaagataatccggaaatagaagatgacatctttagaaagaagcgactaactataatggatcttcatccgggagctgggaaaacgaaacgttatctgccagcaatagtacgtgaagccataaagagaggattaagaacactaatactcgcgccaacaagagtagtcgcggctgaaatggaagaagccttacgaggattaccaataaggtatcaaacaccagctatcagagccgaacatacaggtcgcgagatagtagacctaatgtgccacgctacattcacgatgcgtctattaagcccagtaagagttccgaactataatctaataattatggatgaagcgcatttcactgatccagcctctatcgccgctcgaggatatatctctactagagtagagatgggcgaagctgcaggaatctttatgactgcaacaccaccagggagtagagatccatttcctcaatctaacgcaccaattatggatgaggaaagagagattcccgaaagatcatggaactcggggcatgaatgggtcactgattttaaaggcaaaacggtatggttcgtcccaagtataaaagccggaaacgatattgccgcctgcttaaggaaaaacggcaagaaggtcattcaattgtcaagaaagacattcgactcggagtatgtcaaaactagagctaacgactgggatttcgttgtcacaacagacataagcgagatgggagccaattttaaagctgaaagagtaatagatccaagacggtgcatgaaacccgtaatattaaccgatggagaagaacgtgtgatattagccggaccgatgcccgtaacacatagctctgcagcacagcgtcgcggtcggattggacgaaatccgaaaaacgagaacgaccagtatatctatatgggagaaccactagaaaacgacgaagattgcgctcactggaaggaagcaaaaatgctattggacaatataaataccccagaaggcataatcccttcaatgtttgaaccggagagggagaaagtggatgctatagacggagaatatagattgaggggagaggcaagaaaaacgtttgtcgatcttatgagaagaggagacttaccagtatggttagcatacaaagtagctgcagaaggcatcaattatgctgaccgaaagtggtgttttgacggaatcaagaataaccaaattttagaagaaaacgtagaagtagagatctggaccaaagagggcgaaaggaagaaactgaaaccccggtggctcgacgcccgaatttatagtgaccccctcgctctaaaagaatttaaagaatttgctgcaggaaggaaatctctgacattaaatctaataactgaaatgggtaggttaccaacgtttatgactcaaaaagctagaaatgcactcgataacctagcagtattacatacggctgaagttggaggtaaagcatatactcacgcgttatccgaactaccggaaactctggaaacacttctgttattgaccttactggcagcagtgacaggtggaatatttctatttttaatgtcgggcaagggagtaggcaaaatgaccctaggtatgtgctgcataataacggcatcaatattattatggtatgctcagatacaaccacattggatcgctgcatccattatactagagttctttctaatagtcctgttaatacctgaaccagaaaagcaaagaactcctcaggacaatcaactgacgtatgtggttatagcaatcctcaccgttgttgctgcaacaatggccaatgaaatgggcttcttagagaaaaccaagaaagaccttggattcggctctattacaacacaagaatcagaatccaatatcttagatattgatctaagaccagcatccgcatggactttgtacgcggtggcaacaacatttgttacacctatgcttagacacagtattgaaaattcaagtgtaaacgtctcattgacagctatagccaatcaagctactgttttaatggggttaggtaaaggatggcctttaagtaaaatggatatcggggttccactactggcgatcggctgttatagtcaagtcaatccaataactttaacagctgctttattactattggtcgcccattatgctataattggacccggtctacaagccaaagccacaagggaagctcaaaaacgggcggcagcaggtataatgaaaaatccaaccgttgatggtataacagtaatagacctcgaacccataccatacgaccctaaatttgagaaacaactaggacaagtaatgctcctaattttatgtgttacacaggtattgatgatgcgtactacatgggcattgtgcgaagcgctaacattagcaaccggtcctatcagtacgctgtgggagggaaatcctggacgtttttggaataccacgatagctgtatcaatggcgaacattttcagagggagctatttagctggcgcaggtcttttattttcaatcatgaagaataccactaatactaggcgcggcacaggaaacgtgggggaaaccttgggagaaaaatggaaatcccgcttaaacgcacttggcaagtctgagtttcaaatttataagaaatccggtattcaagaagtggatagaaccttggcaaaagaaggaattaagagaggggaaacggatcaccatgcggtgagcagaggaagcgcaaaattgcgctggttcgtagaacgaaacatggttacaccagaaggtaaagttgttgatttaggatgcggccgtgggggatggtcatactactgcgggggtctaaagaatgtaagagaggttaaaggcttaacaaaaggcggaccaggacacgaagaaccaattccgatgtcaacatacggatggaacttagtacgacttcaaagtggcgttgatgtgttctttactcccccggagaaatgcgacacactcttatgtgacatcggagaatccagtccgaacccaacgattgaggctggacgtactcttcgagtactaaatttggtcgagaattggctaaataacaatacacaattttgtataaaagtgttaaacccttacatgccttcagttattgagaaaatggaaacactacaacgtaaatacggtggcgcattggtaagaaatccattatcacgcaattcaacgcacgaaatgtattgggtatctaatgccaccggaaatatagtctctagtgtgaacatgatttcgaggatgcttattaacaggtttacgatgaaacataaaaaggctacatatgaacctgacgtagacctaggatcaggtacacgtaatattggtattgaatccgaaataccaaatcttgatattgttgggaaacgcatcgaaaagataaaacaagaacatgaaacaagctggcattacgatcaagatcatccatataagacatgggcatatcatggctcatatgaaactaagcaaacaggaagcgcttcgtccatggttaatggagtggtaaggctcttaactaaaccatgggatgtagttccaatggttactcaaatggcgatgacagacaccacgccgttcggacaacaaagggtatttaaggagaaagttgatacgaggacacaggagcccaaggaaggtactaaaaagttgatgaaaattacagccgaatggttatggaaagaactcggtaaagagaaaacaccccgaatgtgtactcgtgaagagttcacacgcaaggtccgatcaaatgccgcccttggggcagttttcacggatgaaaataaatggaaatctgcaagagaagcggtagaggacggaaggttttgggaattagtcgatagagaaagaaatctacatcttgaaggcaaatgcgaaacgtgcgtttacaacatgatgggcaagagagaaaagaaattaggcgagttcggaaaagccaaaggatcgagggcaatatggtacatgtggctaggggcaagatttctggaatttgaggcattgggatttcttaacgaggaccactggttttcccgtggaaatagcttgtcaggcgtcgagggagaagggctccacaggctcggatatattctaagggaggtaggcaagaaggaaggaggggcgatgtacgcagacgacacagccggctgggatactcggataaccttagaagaccttaaaaatgaagaaatggttacaaatcatatgaaaggagaacataagaaactagctgaagcgatattcaaactaacctaccaaaataaagtggtaagagtacaacgaccaacccctcgtgggacagtaatggatatcatttctaggaaagatcagcgcgggtcaggacaagtcggcacatatggcttgaatacattcaccaacatggaagctcaactaataaggcaaatggaaggagaaggtatattcaaaagtatacagcatttaaccgccacagaggaaatagcggttcaaaattggttggcacgggttggtcgggagcggcttagccgtatggccatttcaggagatgattgtgtagttaaacccatagacgataggttcgcgtcagcacttacggctctgaacgatatgggcaaagttcgaaaagacatccaacaatgggaaccatcgagggggtggaatgactggacacaagtccccttttgctcgcatcatttccatgaattagttatgaaggatgggagggtcctagtagtaccttgccgcaatcaagacgaattgataggtagagcccgaatcagtcaaggagcaggatggtccctcaaagaaacggcgtgtctagggaaatcctatgcgcaaatgtggaccttgatgtattttcatcgaagagaccttagattggcagcgaacgctatatgctcagcagtcccatcccattgggtaccaactagcagaacaacctggagtatacacgccaaacacgaatggatgactactgaagatatgttagtagtatggaatcgcgtctggattcaagaaaatccctggatggaagacaaaacacccgtggaatcctgggaagaggtaccatatttggggaaacgcgaggaccagtggtgtggatccctgataggattgacatctagagcgacatgggctaaaaatatacagacagcaataaaccaggtacggagtctaatcgggaacgaaggatataccgattatatgccatcaatgaaaagattcagaagagaggaagaagaagcaggagtattatggtaa

SEQ ID NO: 22476 - RNA, 9876 nt, synthetic construct
  misc_feature 1..9876: note = derived and/or modified CDS sequence (opt6) from DENV-2__KC294214__SS-prME
  source 1..9876: mol_type = other RNA
actgcaggagttatagttatgttaattcccacggcaatggcgttccacctaacaactaggaatggggaacctcacatgatagttggtagacaagaaaaaggtaaatcactattatttaaaacggaagacggagtaaatatgtgtacattaatggcaatagatctgggagaactttgtgaagatacaataacttataaatgtccactattacgacagaatgaacccgaagatatagattgttggtgcaacagtacatcgacgtgggttacgtatggaacgtgtacaacaacaggtgaacacagacgagagaaaagaagtgtagcgcttgtccctcatgttggtatgggtttggaaactagaacggaaacatggatgtcatcagaaggtgcgtggaaacacgtgcaacgaatagaaacatggatcttacgacaccctggttttacaataatggcagcaattttagcgtacactataggcaccacccacttccagagagcattaatatttatattgcttacagcagtagcacccagtatgacaatgaggtgcattggcatatcgaaccgagacttcgtagaaggcgtaagtggtggttcatgggtagacattgtgttagaacacggcagttgtgtaacaacgatggctaaaaataaaccgactctagatttcgaattgattaaaacggaagcaaaacagcccgcaactttaagaaaatactgtattgaagcaaaattaacaaataccacaacagaatcccggtgtcctacccagggggaaccaagtctcaacgaagaacaagacaaacgtttcatatgtaaacatagtatggttgatcgcggatgggggaatggatgcgggctctttggaaaaggtggaatagtcacttgtgcaatgtttacctgcaaaaagaatatggaaggtaagattgtacagccagaaaacctagaatacacaatagtcataacacctcacagtggcgaagaacatgctgtaggcaacgatacaggtaaacatgggaaagaaatcaaaataacgccacaatcctccactactgaagcagaactaacaggatatggaacagtaactatggagtgctcgccacgtacgggtctagattttaacgaaatggtgttgttacaaatggaagataaagcgtggttagttcacaggcaatggttcttagatttaccacttccgtggttacctggggcggatacacaaggaagtaattggatacaaaaagagacattagttacatttaaaaatccacacgccaagaaacaggacgtggtggtacttgggagtcaagaaggagcaatgcacacagcattaacgggggctacagagatacagatgtctagcggtaacctactttttacgggacacttaaaatgccgattacgtatggacaaattgcagttgaaagggatgtcctattctatgtgtaccggaaaatttaaaatcgtaaaagagattgcggaaacacaacacggtactatcgtgattcgtgtccaatatgagggtgatggttcgccatgtaaaatcccgtttgaaatcacagacctcgagaaaagacatgtactaggaagactaatcacagtgaatccgatagtcactgaaaaagattccccagtaaatattgaagcagaaccaccctttggcgatagttatatcattgtcggggtagaacctggccaattaaaactgaattggttcaagaaagggtctagtattggacaaatgttcgaaaccactatgcgtggagcaaaacgaatggcgatattaggagacacagcatgggactttggaagtcttggaggagtattcacgagtatcggtaaagcactccatcaggtgttcggcgcaatctatggagctgcattttccggtgtctcctggacaatgaaaatactcatcggagtaattataacttggattggaatgaatagcagaagcacatcactctcagtcagcctggtgttagtgggtgtcgtcacactctatttaggcgcaatggtccaggccgactccggctgtattgtcagttggagaaacaaagaattgaaatgtgggtctggtatattcataacggacaacgttcatacttggactgaacaatacaagttccagccagaaagtccctcaaaactagcatcggccatacaaaaagcccacgaggaaggtatatgcggaataagatcagtaactaggctagagaatttaatgtggaagcaaataactcctgaactaaatcacattttgtcagaaaatgaagtcaaactcacgataatgacaggagacataaaaggaattatgcaagctggtaagagatctctgcgaccccaacccactgaacttaaatattcttggaagacatggggtaaagcgaaaatgttgtcaacggagtcacacaaccaaacatttttaattgacggaccagaaaccgcggaatgtccgaacacaaatagggcttggaactcgctagaagtggaagactatggttttggtgtatttactactaatatctggttgaagctccgcgaaaagcaagacgttttctgtgattcaaaattaatgagtgcagccataaaggataacagagctgtacatgctgatatgggctattggatcgaaagtgcacttaatgatacatggaaaatggaaaaggcctcattcatagaagttaagagctgtcattggccaaaatctcacaccttgtggtcaaacggagtattagaaagtgaaatgattatacccaaaaatttcgcgggaccagtatcgcaacataattacaggccgggctatcatacacagacagccggaccatggcatttaggtaaattagaaatggattttgatttttgtgaaggcacaaccgtggttgtgactgaagactgtggaaaccgaggaccatcgctcagaacgactactgcatcgggtaagttaataaccgaatggtgctgccgctcatgtacgctaccaccactaagatatagaggggaggatggctgttggtacgggatggaaataaggccgttaaaagaaaaagaagagaacttggttaatagcctagtaacagcgggacacggtcaaatagataatttttcactaggtgtactaggaatggcactatttctagaggagatgttaaggacaagagtgggaacaaaacacgcaatattgctagtggccctaagttttgtaactctaattacaggaaacatgtcgttcagagatcttggtagagtaatggttatggttggagccactatgaccgacgatatagggatgggtgttacttatttagcattacttgcagcattcaaagtaaggccaacttttgcggccggccttttgctccgtaaactaacaagtaaagagctaatgatggctaccatcggtatagcactgctttcgcaatccacgctccctgaaaccattttagaattaaccgacgctttggcactaggaatgatggcattaaaaatagtacgtaatatggaaaagtaccaattagcagtaacgataatggcaataagttgcgtaccgaacgctgttatacttcagaacgcatggaaagtctcttgtacaattctagccgcagtctcggtgagcccacttctgttaacatcaagtcaacaaaaagcagattggataccacttgctttgactattaaaggattaaatccaacagctatctttttaacgaccttgtctcggacctccaagaaacgctcctggcctctcaacgaggcaatcatggctgtcgggatggtgtccatcttggcatcttcactccttaaaaatgatataccgatgacaggacccttagttgctgggggattacttacggtctgttacgtattaaccgggagatcggcagacttagaattagagagagcagcagatgttaaatgggaagaccaggcagaaataagtggatcatcaccaatattgagtattactattagcgaggatggatctatgagtataaagaatgaggaagaggaacaaacattaacaattttaatacgaacaggactgctagtaataagcggggtgttccccgtctccatcccaattacagctgcagcatggtatttatgggaagtcaagaaacaacgagcaggagttttatgggacgttccttccccacccccagtcggaaaggcagaactcgaggatggagcgtacagaatcaaacagcgaggaatacttggatacagccaaataggtgccggtgtgtacaaagaaggtactttccacacgatgtggcacgtaacgagaggggcagttctgatgcacaggggaaagagaattgagccatcctgggcagacgtgaagaaagatttaatttcatatggcggaggttggaaactcgaaggagaatggaaagaaggagaggaagttcaggtattagccctcgagccaggcaaaaatcctagagctgtccaaacaaaaccaggcatcttcaagacaaacaccggtacgataggggcagttagccttgatttttctcctggaacaagtggttctccaatcgtagaccgcaagggaaaagtcgttggcctttatgggaacggcgtagtaaccaggagtggggcgtatgtctctgcgattgctcaaacggaaaaatcaatcgaagacaatccagaaatagaagacgatattttcaggaagaaacgtttgacaataatggatttacaccctggagctggcaaaacaaaaagatacctcccagccattgtacgagaagccataaaaagaggactgcgcactttaatattagctccgacaagagtcgtcgcagctgaaatggaagaagccctgagaggactcccaataagataccaaacccctgcaatcagagcagaacacaccgggcgggaaatcgtcgacttaatgtgtcatgcaacttttacaatgagactactatcaccagtacgagtgccaaattataatcttataattatggacgaagctcattttacagatcccgcatccattgctgcacgaggatatataagtactagagttgaaatgggcgaagccgcgggaatatttatgaccgcgactcctcccggatcaagagacccctttccacaaagcaatgcaccaatcatggatgaggagcgagaaattccggagagatcttggaactcgggtcatgaatgggttaccgactttaaaggaaaaactgtctggtttgtaccgtcaattaaagccgggaatgatatagccgcttgtttgcgcaagaatggtaagaaagtaatacagttatcgcgtaaaacatttgactccgaatatgtcaaaaccagggcgaatgattgggactttgtcgtaactaccgatataagtgagatgggagcaaattttaaagccgaaagggttatcgatccaagaagatgtatgaagccagtcatcctcacggacggtgaagaaagagtaatactcgcgggtcccatgcctgtgacgcatagttctgcagcacaacgtagaggacgaattggacgaaaccctaaaaatgaaaacgatcaatatatatacatgggtgaaccactcgaaaatgacgaagattgcgcgcactggaaagaggcgaaaatgctgttagataatataaataccccagaaggtatcataccatcaatgtttgagcccgagagggaaaaagtcgacgcaatagatggtgaatatagattacgtggggaagcgagaaaaacatttgtagacctgatgcggaggggagacttaccggtatggcttgcctataaggtagccgcggagggtataaattatgcagacagaaaatggtgcttcgacgggatcaaaaataatcaaatactagaggaaaatgtagaggtagagatatggacaaaagaaggcgaaagaaagaagctaaaaccccggtggttagacgcacgaatttatagtgatccattggcactaaaagagttcaaggagttcgccgcaggaagaaagtcattaaccctaaacttaataacagaaatgggacgtttgccaactttcatgacacaaaaggcaaggaatgcgcttgataatctggcagtccttcataccgccgaagttggtggtaaggcttatacacacgcactgtcggaattaccggaaaccttggaaacactacttttgttaacactcctagctgcagttacaggaggtatctttctgtttctaatgtccgggaaaggaatagggaaaatgacactaggtatgtgttgtatcataaccgcatctatattattatggtacgcacaaattcagcctcactggatcgctgcatcaattatactggaatttttcctcattgtcttattgatcccagaaccagagaaacaaaggactccacaggataatcagctgacatacgtagtaattgcaatattaacagtagtcgcggcgactatggctaacgaaatgggatttttagaaaagaccaagaaagatttgggcttcggtagtatcaccacgcaagaaagtgaaagtaatatattggacatcgacttacgcccagcgagtgcttggacgttgtacgctgtcgctactaccttcgtaacgccgatgctacgacacagtatagaaaacagtagcgttaatgtgagcctaacggccatcgcaaatcaagcaaccgtcttaatgggattaggaaaagggtggccgctctcaaagatggatataggagtaccacttcttgcaatcggatgttatagccaagtaaaccctataaccttgacagcagcactgcttcttctagtagcacattacgcgataataggaccaggactacaagcaaaggctaccagagaggcccaaaagagagccgcggcagggataatgaagaatccaacagtagatggtattaccgtgattgatttagaaccaataccgtacgacccaaagtttgaaaaacaacttggtcaagtgatgttactaatactgtgcgtgactcaagttttgatgatgaggacaacttgggcgctatgtgaagcgctaacacttgcaacaggtcccataagcactctgtgggaaggtaacccggggagattttggaacaccaccatagcggtatcaatggccaatatctttagaggatcatatttagctggcgcaggcctgttattctccatcatgaaaaataccaccaatacgcgtcgaggaacaggaaatgtgggtgagactctaggagaaaagtggaaatcacgattgaacgccttgggcaaaagcgaatttcaaatttacaagaaatcagggatacaagaagtagatcgaacgctagcaaaggaagggatcaaaagaggagaaacagatcatcacgccgtatcacgaggatcagcgaaactacgatggttcgtcgaaaggaatatggttactccggaaggaaaagtcgtcgatctaggatgtggcagagggggttggtcctactactgcggtgggctcaaaaatgttagagaagttaaaggtttgactaaagggggtccgggacacgaggaacccataccaatgtcaacatatggatggaacctcgtacgcttacaatcaggtgtagacgtattctttactccaccggaaaagtgtgacacgcttttatgtgatatcggcgaatcgagtccaaatccaacaatagaagccggaaggacactccgagtcctgaatcttgtggaaaattggctaaacaataacactcaattttgcattaaagttctcaatccatacatgccatcagttatagaaaagatggagaccctacaaagaaagtatgggggcgccctagttagaaaccctctatctcgaaattccacgcatgaaatgtactgggtaagtaatgcaactggtaacatcgtaagttcagtaaacatgatatcgcgtatgttaataaaccgatttactatgaagcacaagaaagctacatatgaaccggacgttgacttaggatcgggtaccaggaatattggcatagaatcagaaatacccaatctagatattgtcggtaagagaatcgagaaaataaaacaagagcatgagacttcatggcactatgatcaagatcatccctataaaacctgggcatatcatggatcatatgagactaaacaaacaggttcagcaagtagtatggtcaatggagtagtaagactcttgactaaaccatgggatgtagttccaatggtaacccaaatggctatgactgatacgacgccatttggacaacaacgcgtgtttaaggaaaaggtagatactcgaacacaagaacccaaagaaggcacaaagaaattaatgaaaataaccgcagagtggttgtggaaagaattggggaaggagaaaacaccgcgcatgtgcacaagagaagagttcacccgtaaagtaaggtctaacgccgcattgggcgcagtgtttacggatgaaaataagtggaaaagtgctcgtgaagccgtcgaggacggacggttttgggagttagtagacagagaaagaaatttacacttagagggaaaatgtgaaacgtgcgtatataacatgatgggaaagagggagaagaaactaggcgaatttggaaaagcaaaaggttctcgagcaatatggtacatgtggttaggtgctagatttttagaatttgaagcattaggatttctcaatgaggatcattggtttagcagaggaaattcactaagtggagttgaaggagagggtcttcatcgattaggttacatcctccgtgaagtaggcaagaaagaaggcggagcgatgtacgctgatgatacggcgggttgggatacacgtattaccctagaagaccttaagaacgaagaaatggttacgaatcacatgaaaggcgaacataagaaattagctgaagcaatatttaaactaacttatcagaacaaagtggtaagggtgcaaaggccgactccaagaggaactgtaatggacataatatcacgtaaggaccaacgtggatcaggtcaagtagggacatatggactcaacacatttacgaacatggaggctcaactaatacgacaaatggagggagagggtatatttaagtcaatccagcacctgacaacaacagaagaaatcgcagtccaaaattggcttgcgagagtggggcgtgagcggctctctcgtatggctatatctggtgatgactgcgttgtcaagccaatagatgatcgtttcgccagtgccctaacagcactaaatgatatggggaaagtccgtaaggacatacaacaatgggagccgagtcgaggctggaatgattggacgcaagttcccttctgttctcaccatttccacgaattagtaatgaaggatggccgagtgctagtcgttccatgtcggaatcaagatgaactaataggccgcgcaagaatatctcaaggcgcaggctggtcacttaaagaaacagcctgtttgggcaagagttacgcacagatgtggacattaatgtactttcacagaagggacttgcgcctagcagcaaatgcaatatgcagcgcagtgccgtcacattgggtaccgacgtcaagaacaacgtggtcaattcatgcaaagcacgaatggatgaccacggaggatatgttagtagtatggaatagagtctggatacaagagaacccttggatggaagacaaaactcctgttgagagttgggaagaagttccatacctcggaaagcgggaggatcaatggtgtgggtctcttataggtctgacgtcacgtgccacatgggccaaaaatattcaaaccgctatcaatcaagtaagatcattgatcgggaatgaaggatatacggactatatgccatctatgaagagattcagaagagaagaagaggaagccggagtattatggtaa

SEQ ID NO: 22477 - RNA, 9876 nt, synthetic construct
  misc_feature 1..9876: note = derived and/or modified CDS sequence (opt6) from DENV-2__KC294205__SS-prME
  source 1..9876: mol_type = other RNA
actgctggggtcattgttatgttaattcctacagcaatggccttccacttaacgacaagaaatggtgagcctcatatgatagttggacgtcaggagaaaggtaaatcactattatttaaaactgaagacggcgtcaacatgtgtacattaatggcgatagatttaggagaattgtgcgaagatacaataacctataaatgcccattactgaggcagaatgaaccggaagacatagattgttggtgcaactcaacgtcaacatgggtgacctacgggacctgtacaaccacaggggaacatcgcagggagaaaaggagtgtcgcactggtgccacatgttggaatgggattagaaactagaacggaaacctggatgtcatcggaaggcgcatggaaacatgttcaacgaattgaaacttggatattaaggcatccaggctttacgattatggcagcaatattagcttatactataggaacgactcattttcaaagagccttgatcttcatactacttaccgcggtagcacctagcatgacaatgagatgcataggcatctctaatagggacttcgtggaaggagtatcgggtggtagttgggtagatatagtcctggagcatggatcttgtgtaacgactatggcaaaaaataaacctacattagatttcgaactaattaagaccgaagcaaaacaaccggctacattgagaaagtactgcattgaagcgaaactaactaatactacgacagaatctagatgtcctactcaaggagagccctcccttaatgaggaacaggacaaaagattcatatgcaaacatagtatggttgacagggggtggggcaacggctgtggtctatttggaaaaggaggtatagtaacttgcgcgatgttcacatgtaaaaaaaacatggaaggaaaaattgtccaaccagaaaatttggaatataccatagtaattacacctcacagtggggaagaacatgcagtcggaaacgacacaggaaaacatggcaaggagatcaagataacccctcaatcatcgaccaccgaagctgaactaacaggttatggtactgttacgatggaatgctcaccccgcacaggcctcgatttcaatgaaatggtactcttacaaatggaagataaagcatggctagtacaccggcagtggtttctggatttacccctcccttggttgccaggcgcagacactcaaggatcaaactggatccagaaggaaacacttgtcacgtttaagaacccacatgccaaaaaacaagatgtagtagtattaggaagtcaagagggggcgatgcatacagcccttaccggagcgactgaaattcaaatgtcatcagggaacttgctatttacgggacatctgaaatgcagattaagaatggataaactacaattaaaaggtatgtcatactcaatgtgtacaggaaagttcaaaattgtaaaagaaatagctgagacgcagcacgggaccatagttatcagagtccagtatgagggtgatggtagtccatgtaaaattccttttgagataacagatttagaaaaaagacatgtcttaggccgacttataacagttaatcccatcgttacggaaaaagattctcccgttaatatcgaggcagaacctccgtttggcgattcttatataattgtaggggtggaaccaggacagctcaaacttaattggtttaagaaaggttcgtccataggtcaaatgtttgaaacgacaatgcgaggagcgaagagaatggctattctaggagatacagcatgggatttcggttctctgggaggtgtattcaccagcattgggaaagccctgcaccaggtatttggtgcgatatatggagcagcgttctcaggggtgtcatggaccatgaaaatattaataggagttataataacttggataggaatgaatagcagatccacgagtttaagtgtttctttagtactggtaggggtagttactctatatttaggagcgatggtacaagcggatagcggatgcatagtgagttggaaaaacaaagaactgaaatgtggtagtggcatattcattactgataatgtgcatacttggacagaacagtacaagttccagccagaatcaccgtcgaaattggcgtccgctatacaaaaagctcacgaagaaggaatttgtggaattagatctgttacacggcttgagaatcttatgtggaaacaaatcacgccagaactaaatcatatactcagtgagaatgaagtaaaactaacaattatgacaggtgatattaaaggtataatgcaggcgggcaaacgctcgttacgcccccaaccgacggaactaaaatatagttggaagacctggggaaaagccaaaatgctttccactgaaagccataatcagactttcctaatagatggaccagagactgctgaatgtccgaatacaaatcgggcatggaattctttagaggtggaggactatggattcggtgtgtttacaacgaacatatggcttaaattaagagaaaagcaagacgttttctgtgactcaaagcttatgagcgctgctataaaagataatagagccgtccacgcagacatgggctattggatagagtcagcgttaaatgatacctggaaaatggagaaagccagctttatagaagtaaaatcgtgtcattggcccaaatctcatacgttatggagcaacggggtactagagagtgagatgataatacccaaaaattttgcagggccggtgtctcaacacaattacagacccggttatcacacccaaactgcgggaccctggcacctcgggaaactagaaatggacttcgatttttgtgagggtacgacggtggtagtaacagaggactgcggaaacaggggtcctagtttgagaacgacaacagcatcggggaaacttataacggagtggtgttgtaggtcttgcactttacccccacttagatacagaggagaagatgggtgctggtatggaatggaaatacgaccgttaaaagaaaaagaggaaaaccttgtgaattctctagtgacagccgggcatggacaaattgataacttctcattaggagttctcggtatggcattattcctggaagaaatgttaagaaccagagttggtactaaacatgccatcctacttgtagccttatccttcgtaactttaataacagggaacatgtcttttagggacttaggccgagtcatggttatggttggagcaacaatgacagatgatataggcatgggtgtaacttacctagcactattggccgccttcaaggtaagacccactttcgcggccggtcttttactaaggaaattgacgagtaaagagcttatgatggctacgataggaatcgcattactctcacagtcaactttacccgaaaccatcttggaattaacagacgcattggcattagggatgatggccctgaaaatcgtacgaaatatggaaaaatatcaactagcggtgaccataatggctatttcttgtgttcctaatgcagtcattttacaaaatgcttggaaagtctcgtgcactatattagcagcagtgagtgtgtctccattactgttgacaagttcacatcaaaaagcagactggattcccttagcgttaacaataaaaggtttaaatccaaccgctatatttctgacaacgctttcaagaacaagcaagaaaagatcttggccacttaatgaagcaatcatggcggttggaatggtctcaatattagccagctcacttttaaaaaatgatatacctatgacaggacccctagttgctggagggttattgacagtgtgttatgtcttaaccggaaggagtgcggacttggaactcgaaagagccgctgacgttaaatgggaagatcaagcagagatttcaggatctagccccatactctctataacaatcagtgaggatgggtctatgtctattaaaaacgaagaagaagaacagactcttactatactaatcaggacaggcttacttgtaatatccggtgtattcccagtaagtattccgattaccgctgctgcttggtacctatgggaggtaaaaaaacaacgagccggagtgctatgggatgtaccttcgccgcctccagtaggcaaggccgaattagaagatggcgcataccgtataaaacaacgcggcatcttgggatattcgcaaattggggcgggagtatataaagaaggcacttttcacacaatgtggcatgtaactaggggcgcggtgcttatgcacagaggtaagaggattgaaccatcatgggctgacgttaaaaaagatcttattagctatggtggtggttggaaactagagggcgagtggaaagaaggtgaagaagtgcaggtactagcgctcgaaccaggcaaaaaccctagggcagtacaaaccaagccgggtatttttaaaactaatactggcacaattggggcagtgagcctagatttttcaccaggtaccagcggaagtccgatcgtcgaccgcaaaggtaaggttgtaggtctttacggcaacggagtagttacgcgctccggcgcatatgttagcgcgattgcacaaacggagaaatcaatagaagataacccagaaatcgaagatgacatatttagaaagaaaaggttgacaattatggatttgcatcctggggccggtaaaacaaaaagatatttgccagcaatcgttagagaagcaatcaaacgtggtttacggacattaatccttgcaccaacccgagtagttgctgctgaaatggaggaagcattaaggggtttacccataaggtatcaaacaccagcaatacgagctgaacatacagggagagaaatcgtagatcttatgtgccacgctacctttacaatgcgccttttaagtccagtaagagtaccaaactacaatttaataataatggatgaagctcattttacagatccagcaagtattgcggcaagggggtatataagtacacgagttgaaatgggtgaagccgctgggatattcatgactgcaacaccaccgggctcaagggacccatttccccagagtaatgcaccaataatggacgaagaaagagagataccagaacgaagttggaatagtggtcatgaatgggtaacggactttaagggcaaaacggtatggtttgttccatcaattaaagccggcaacgacattgcagcgtgccttcgaaaaaatggtaaaaaggtgatacaattgagtcgaaaaacattcgattctgagtacgttaagactcgggcgaatgattgggattttgtggtaactacagatatttctgaaatgggagccaatttcaaagctgaacgagtgatcgatccaaggcgctgtatgaaaccagtgatcctaacagacggcgaagaacgtgtcattttagccggcccaatgcctgtgacacacagctctgctgctcaacgaagaggtagaataggacgaaacccaaagaacgaaaacgaccaatacatctatatgggagagccattggaaaacgacgaagactgtgcacattggaaagaagctaaaatgctccttgacaacataaacacccccgaaggaatcatcccatccatgtttgaaccggagcgggagaaagttgatgcaatcgacggagaataccgtctcagaggagaggctcggaagacatttgtagatttaatgagacgaggggacctccccgtatggttggcttacaaggttgcggctgaaggtatcaattacgctgacagaaaatggtgtttcgatggaataaaaaataaccagattcttgaggagaacgtggaagtagagatatggaccaaagaaggcgaacgtaaaaagttaaaaccccgatggcttgacgcgaggatttatagcgacccgttagcactgaaagaatttaaagagttcgctgcggggcggaaatctctaacgctaaatctaattacagagatggggcgattaccaacattcatgactcaaaaggcgagaaatgcgttagataatctggctgttttacacacagctgaagtcggggggaaggcgtatacgcacgcactatccgaactccctgaaaccttggagacgttgctacttttaaccctactagctgccgtaaccggcgggatttttctattcctcatgagcgggaaggggataggcaaaatgacccttggtatgtgctgcataatcacggcaagtattctactatggtatgcacagattcaaccccactggatcgcggctagcatcatacttgaattttttctaatagtactactgatcccagaaccggagaagcagaggactccgcaagacaaccaactcacatatgttgtcatagccatattaacggtcgttgcagcaactatggcaaacgaaatgggcttcctagaaaaaacaaaaaaagatttgggatttgggagtattactacgcaagaaagcgaaagcaatattttggatatagacttacgaccggcgtcggcgtggactctatacgcagtcgcgactacatttgtcacaccaatgttaagacacagcatagaaaacagttcagttaacgtaagcttaacagcgattgctaaccaagccacagtactaatgggattaggtaaaggttggccgctaagtaagatggatataggggtcccactgttagcaataggatgctatagtcaagttaatcccataaccctaacagcagcccttctgcttttagtggcacattatgcaataataggtcctggacttcaggcaaaggcaacaagagaagctcaaaaacgtgcagccgccggtattatgaagaatcctaccgtagatggaattacagtgattgatctggaacccataccttacgatccaaagttcgagaaacaactcggacaggtaatgctcctgattctctgtgtcactcaagttctgatgatgcgaacaacgtgggcactatgcgaggctctaacactagccacgggtccaatatcaacattatgggaaggcaaccctggaagattctggaacactacaatcgccgtgtcaatggcaaatatttttcgaggaagttacttagctggtgcaggtcttctattctcaataatgaaaaatacaacaaacacgagaagaggaacaggaaacgttggagaaactcttggcgaaaaatggaaatctcgattgaatgctttgggaaagagtgagtttcaaatatacaaaaaaagtggaatacaggaggtggatcgaaccttagctaaagaaggaatcaaacgaggtgaaaccgatcatcatgctgttagccgaggctctgcaaaattgcgctggttcgtcgaaagaaatatggtcaccccggaagggaaggttgttgatctcggttgcggacgtggtgggtggtcttattattgtggtgggctaaaaaatgtaagagaagtaaaaggactaacgaaagggggccctggtcacgaagaacctatacctatgagcacatatggctggaacctggtaaggttgcaatcgggcgtagacgtattctttacgcccccagagaaatgtgacaccctattgtgcgatatcggagaaagtagtccgaatccaacaatagaagccgggagaactttgcgtgtacttaatcttgtagaaaattggctaaacacaaacactcaattctgcataaaagtacttaatccctatatgcccagtgtcatcgaaaaaatggaaacattacaacgaaagtacggtggtgcacttgtgcgcaatccattatctaggaattctactcacgaaatgtactgggtcagtaatgctactggtaatatcgtctcttcggtaaatatgatatcacgcatgttaataaaccggttcacgatgaagcataaaaaagccacctatgaaccagatgttgatctagggtcaggaaccaggaatataggaatcgagagtgagattccaaatcttgatatagtaggtaaaaggatcgaaaaaataaaacaggaacacgaaacgagttggcactacgatcaggatcacccctacaaaacatgggcataccacggatcttatgagaccaagcaaaccggaagcgctagctccatggtaaacggcgttgttagactacttaccaaaccatgggatgtagtaccaatggttacacaaatggccatgactgacacaactccattcggtcaacaaagagttttcaaagaaaaagtcgacactagaacacaagagccaaaagaaggcaccaaaaaactaatgaaaataactgctgaatggttgtggaaggaacttggaaaagagaaaacgccaagaatgtgtactagagaagaatttacacgtaaagttagaagtaatgctgcgcttggcgcagtatttacagatgaaaataagtggaagtccgctagggaggcggtcgaagatgggaggttctgggaattagtggaccgagaaagaaatttgcatttggaaggaaaatgtgaaacctgcgtgtacaatatgatgggtaaacgagagaaaaaacttggagaattcggcaaagctaaggggtcaagggcaatatggtatatgtggttaggagcacgtttcttagagtttgaggcactaggatttttaaacgaagaccattggtttagcagaggtaacagtttgtcgggagttgagggtgagggtcttcatagactgggatatatactccgagaagtaggtaaaaaagagggtggcgctatgtatgcggatgacactgctggttgggacacccgcatcaccctagaagatttaaaaaatgaagagatggtaacaaatcatatgaaaggagaacataagaagctagcagaagccatatttaaattgacttatcagaacaaagttgtacgggtgcaaagaccaacaccgaggggaacagtaatggacataataagcagaaaggatcaacgtgggtcaggacaagtaggtacatacgggctaaacacgttcactaatatggaagcccagcttattcgacaaatggaaggggaggggatattcaaatcgatccaacacttaacagcgaccgaagaaatcgcagtacaaaattggttggccagagtaggaagagaaagattgagcagaatggctattagcggggacgactgtgtcgtgaaacccatagacgacaggtttgcatcagcactaacggctttaaacgatatgggaaaagtgcgcaaggatattcaacaatgggagccgtcacgcggatggaatgattggacacaggttcctttctgctcccatcactttcacgaactagttatgaaagatgggcgtgttctagttgtcccttgccgaaatcaagacgaactgatcggaagagcaaggatcagtcaaggcgcaggatggtccctcaaagagacagcatgccttggtaaatcatatgctcaaatgtggacattaatgtactttcatcgaagggacttaagattggcagcaaatgcaatatgctctgcagtaccatctcactgggtacctaccagtcgcacgacatggagcattcatgcaaagcatgagtggatgacgacagaagatatgttagttgtatggaacagagtgtggatacaagaaaatccatggatggaagacaaaacaccagtggaaagttgggaagaggtcccttatttaggaaaacgagaagaccagtggtgcggaagtttaattggacttacatctagggccacgtgggctaaaaacatccagacggcgattaatcaagtaagatctctaatcggcaatgaaggatatacggattatatgccaagtatgaaacgttttagaagagaagaagaagaagcgggagtattatggtaa

SEQ ID NO: 22478 - RNA, 9876 nt, synthetic construct
  misc_feature 1..9876: note = derived and/or modified CDS sequence (opt6) from DENV-2__KC294210__SS-prME
  source 1..9876: mol_type = other RNA
acagcgggagtgatagtcatgttaattccaacagctatggcatttcatctgacaacacgcaacggagaaccacatatgattgttgggagacaggaaaaaggtaaaagcctattgtttaaaaccgaagacggagtgaatatgtgtacactaatggctatagatttgggagaactatgtgaagacacgattacgtataaatgtcctcttctgcgtcaaaatgaaccagaagacatagactgctggtgtaactcaacatccacatgggtaacatacggaacatgcacaaccacaggtgagcacagacgagagaaaagaagcgtagcattggtaccacacgttggtatgggattagaaacaaggactgaaacatggatgtcatcggaaggcgcatggaaacatgtccaaagaattgaaacttggatattaagacatccaggttttacaatcatggcagcgattctggcatacacgataggcactacacactttcagagagcgctgatatttatcctattgacagctgtggcaccatctatgacaatgcgatgtatcggcataagtaaccgtgatttcgttgagggggtttcgggaggatcttgggtagatatagtactggaacatggcagctgtgtgacaaccatggcgaaaaacaaaccgacgctagatttcgaacttattaaaactgaagcaaaacaaccagctaccctacgaaaatattgcatagaggcaaaacttaccaatactactacagaatcacgttgtccaacacagggagaacccagtttgaatgaagaacaggacaaacggttcatatgtaagcattcaatggttgatagagggtggggaaatggatgcgggttattcggcaaaggtggcattgttacgtgcgccatgttcacatgtaagaaaaatatggaaggaaaaatagtacaaccggaaaaccttgaatacaccatcgtaatcacaccacactcgggcgaagaacacgctgttgggaacgatacagggaaacacggtaaagaaatcaaaattacaccccaatcgtcaaccactgaagcggaattaactgggtatggaactgtaatgatggaaagctcaccaagaacaggcttagactttaacgaaatggtcttacttcagatggaagacaaagcctggttggtacacaggcaatggttcctagacttgcctctaccatggctacccggcgctgatacacaaggatcaaattggatacaaaaagaaaccctcgtgactttcaaaaatccacatgccaagaaacaagacgtggttgtcctgggaagccaagagggagcaatgcacacggcattaacgggtgcgaccgaaatacaaatgtcaagcggaaacctgttgttcacaggacatctgaaatgccgattaagaatggataaattacagttaaaagggatgtcatatagcatgtgcacgggcaagtttaaaatagttaaggagatagcagaaacacaacatggcacaatcgtaatacgggttcaatatgaaggcgacgggtctccatgtaaaattcccttcgaaattacagacttggaaaagagacatgttctagggagattaataaccgtaaaccccatagttaccgaaaaagactccccagttaacatagaagcagaacccccattcggcgatagctacattattgtcggggtagaaccaggacagttaaaactaaactggttcaagaaaggatcatcaataggtcagatgtttgagactactatgagaggagcaaagaggatggctattttaggagatacagcgtgggattttggcagcctaggaggcgtgttcacctctatcggaaaagcgctacaccaagtatttggggctatctatggagctgcttttagtggcgtctcatggacaatgaaaatattgataggtgttattataacatggattggaatgaactcaaggtcaacctcgctcagtgtatcccttgttctcgttggagtagtaacattatacttaggagcgatggtacaagcagattctggatgcattgtgagctggaaaaataaagagctaaagtgtggttcgggtatatttatcacggataacgtccacacttggaccgaacaatataaattccaaccggaatcaccaagcaaacttgcctctgcaatccagaaggcacatgaagagggtatatgtggaatacgaagcgtgacaagacttgaaaaccttatgtggaaacagattacaccagagcttaatcacattctaagtgaaaacgaagtaaaacttacaatcatgacgggagatataaaaggcattatgcaagctggcaaacgatctttgagaccccaaccgacggaactaaaatacagctggaaaacgtggggcaaggcaaaaatgctttctactgaaagtcataaccagacgtttcttatagatggtcccgaaactgcagaatgtccaaatacgaatcgggcgtggaactctttagaagtcgaagattacggattcggagtttttactacgaatatttggctaaaattacgagaaaaacaggatgtattttgtgattccaaattaatgtccgcagcaatcaaagataacagggcagtgcatgctgacatgggatactggattgaatctgcactgaacgatacatggaaaatggaaaaagcctcattcatagaggtaaagtcatgtcactggccaaaaagccatacattatggtctaacggtgtcctagaaagcgaaatgatcattcccaaaaatttcgctggaccagtttcgcaacataattatagacctggatatcacacacagacagctgggccatggcatctaggcaaactggaaatggactttgacttttgtgaaggcacgaccgtagtggtaactgaagattgtggaaatagaggaccgtcgttacgaacgacaacagctagcggaaagttaattaccgagtggtgctgcagatcatgtacgctacccccattacggtatagaggggaggatggttgctggtatggtatggagattcgcccccttaaagaaaaggaagaaaatttagttaactctttggtaacagcaggtcatgggcaaatagataatttcagcttaggcgtactagggatggctctgttcctcgaggaaatgctaaggacgagggtcggtacaaagcatgccattctattagtggcattgtctttcgtaacactaataaccggaaatatgagctttagagacctaggtcgtgtcatggttatggtcggcgcaacgatgaccgatgacataggaatgggtgtaacttatctagcacttctcgcggcattcaaagtaagacctacattcgctgctggtctcctgttacgaaaacttacaagtaaagaactaatgatggcgactatcggcattgcattactatcacaaagcacattgccagaaacgatcttggaattgacggatgcactcgcacttggaatgatggctttaaaaatcgtaagaaacatggaaaaatatcagctcgcagtgacaattatggcaatatcttgtgttccaaatgctgttattctccagaatgcgtggaaagtttcatgtaccatccttgctgctgtctccgtatcaccattactacttacctcctcccaacaaaaggctgactggatcccgcttgcgctcacgattaaaggactcaaccccactgcaattttcttgacgacactttccagaacatcgaaaaagagatcatggcctcttaacgaagctataatggccgtaggaatggtaagcatactagcttctagcctactgaaaaatgatataccaatgactgggcccctcgtagctggtggtctcctgactgtatgttatgtgttaacgggacgaagtgcagacttagaattagagcgcgccgcggatgtaaaatgggaagaccaagcagagatcagcggcagtagcccaatattatcaattacgatatcagaagatggttcaatgtctatcaaaaatgaagaagaagaacaaacattaactatattaataagaacagggttattagttatatccggcgtatttccggtatcaataccgattaccgcggccgcatggtacttatgggaagtaaagaaacaaagggctggcgtcctatgggacgtgccaagtcctccaccagtgggaaaagccgaacttgaggatggagcttatagaattaaacaaaggggaatacttggatacagtcaaattggcgcaggagtatataaggaaggcacgttccacacaatgtggcacgtgactagaggagcagtactcatgcatagaggcaaaaggatagaaccaagttgggctgacgtgaagaaggatcttatttcgtatggaggaggatggaaattagaaggagaatggaaagaaggtgaagaggtacaagtcctagctttagaacccggtaagaatccccgggctgtacaaacaaaaccaggtatattcaaaacaaatacaggtacaattggagccgtttctctggacttttcacctggtacatctggaagtccaatagttgatagaaaaggaaaagttgtaggattgtatgggaacggtgtggtcaccaggtcaggagcatatgtatctgctatagctcaaacagaaaaatctatagaagacaatcctgaaattgaagatgatatcttcaggaagaaaagactcacaattatggatcttcacccaggggcaggcaagaccaaacgatatcttccagcaattgttagagaggcaataaaaagaggattaaggacacttattctcgcaccgacaagagtcgtggctgcagaaatggaagaggctctacgaggacttcctatacgctatcaaacacccgctatacgtgcagaacacactggacgagaaatagtcgatctaatgtgccacgcaacgttcacaatgcgcttgctgagccccgtgagagtgccgaattacaatttaataatcatggatgaggcccactttacagatccggcgagtatagccgccagagggtatatttctacaagagtagaaatgggtgaagcagctggaatttttatgactgcgacaccaccggggagccgagatccgttcccacaatccaatgcaccaatcatggatgaagaaagagaaatccctgaaagaagctggaatagcggtcacgagtgggtaacagacttcaaaggtaaaactgtttggtttgttccctcaataaaagcaggaaatgatatagcagcttgtctacgtaaaaatgggaagaaagtgattcaactaagtcgaaaaacttttgatagtgaatatgtgaaaactagggcaaacgattgggattttgtcgtaacgacggatataagtgagatgggagcaaatttcaaggcagagagggtaattgatccaagacgttgtatgaagccggtaatactcacagatggagaagaaagggttatcttagcaggcccaatgcccgtcactcacagtagcgcagcacagcgacgtggaagaataggaaggaacccaaagaatgaaaatgaccaatatatttatatgggagagccactagaaaacgatgaagattgtgcccactggaaagaagcaaaaatgctacttgacaatattaacactccagaaggaattattcctagtatgttcgaacctgagagagaaaaagtagacgctattgacggagaatacagattacgaggagaagccagaaaaacatttgtggatctaatgaggcggggagatttaccagtatggttagcatacaaggtagcagcagaagggatcaattacgcggacagaaagtggtgttttgatggtattaaaaacaatcaaatactagaagaaaacgtagaagtagaaatatggactaaagaaggagaaaggaagaaacttaaacctcgttggttggatgcacgaatctatagcgatcccctcgcgctcaaagaatttaaggagttcgcggctggacgtaagagcttaacgttgaatttgataaccgaaatgggtaggcttccaacatttatgacccagaaagcaagaaatgcacttgataaccttgcagtattgcatacagcagaagtaggaggtaaagcctacacacatgccctaagtgaattaccagagactttagaaacactactattactcactctcctggcagcagttacaggaggtattttcctctttctaatgtctggaaaagggataggaaaaatgacgttgggcatgtgctgtattatcacagcctctattttactatggtacgcacaaatacaaccccattggatagctgcgtctataattctcgagttcttcctgatagttttacttatccccgaacccgaaaaacagcgaacacctcaggacaaccaattaacgtatgtcgtcatcgcgatcctgactgtcgttgcagcaactatggcaaatgaaatgggatttttagagaaaaccaagaaagacctcgggtttggatccataaccactcaagaatcggaatcaaacatcttggacattgacttgaggccagccagtgcatggactctctatgccgtagccactacatttgttacaccaatgttaaggcattctatagaaaattcatcggtcaatgtttctctaacagcaatagcaaaccaagcaacggtcttaatggggctaggcaaaggctggccgctgtctaagatggatataggggtgccactgttggcaataggatgctattcgcaagttaatccaataacgctaaccgcagctctgctacttcttgtagctcactacgctataataggccccggattgcaagcaaaagcaaccagagaagctcaaaaacgagcggctgctgggataatgaaaaatcccactgtagatggtataacagtgatagatttggaacctatcccgtacgatcccaagtttgaaaaacagctcggccaagtaatgctcttgattttatgtgtaacacaggttcttatgatgcggacaacgtgggcattatgtgaagcccttactttagccaccgggcccatatctactctctgggagggaaatccaggccgtttttggaataccaccatagcagtgagtatggcaaatatttttagaggaagttatttggcaggagccggactccttttcagtatcatgaagaatacgacaaatactcgtagagggacaggaaatgtcggtgaaactttaggagagaaatggaaatctagacttaacgcccttggaaaaagcgagttccaaatatacaagaaatcgggcattcaagaagtagaccgcacattggctaaggaaggcattaaaagaggcgagactgatcaccatgcggtaagtagagggagcgcaaaacttagatggttcgtagaaaggaacatggtcacaccagaaggaaaagtggtggatttgggttgtgggcggggtgggtggagttattattgcggaggccttaaaaacgtaagagaagtaaaaggactaaccaaagggggccctggtcacgaagaacctattcccatgtctacgtatggctggaatcttgtacgactacaaagtggagtagacgtcttctttacccctcccgaaaagtgcgacacattattatgcgacatcggagaatcatctcctaatccgacaattgaagccggtagaactcttagggtgcttaacttagtagaaaactggctaaataataatactcaattttgcatcaaggttttgaatccttacatgccgtcggtaatagaaaagatggagactcttcaaagaaagtacggtggagccctagtccgcaatccactgtcacgtaactcaactcatgaaatgtattgggtgagcaacgcaacaggcaatattgtttcaagtgtgaatatgatatccagaatgcttattaacaggtttactatgaaacataaaaaggcaacgtatgaaccagacgtagatttaggaagtgggaccagaaatattggaatagaaagcgaaattcctaatcttgatattgtaggaaaaagaatcgaaaagattaagcaagaacacgagacttcatggcattacgaccaggaccacccatacaaaacatgggcatatcatggtagttatgaaactaagcaaacgggttctgcatcaagtatggtaaatggtgtagtaagattacttacaaaaccttgggatgtcgttcctatggtaacgcagatggcaatgactgatacaacacctttcggacagcaaagagtctttaaggaaaaggtagatacacgaacacaggaaccgaaagagggaacaaagaagctaatgaaaatcacggcagagtggctctggaaggagcttgggaaagaaaagacaccaagaatgtgcaccagggaagaatttacgaggaaagttcgttcaaatgcggccttgggagccgtttttactgacgagaacaaatggaaaagtgcaagagaagcggtagaagacggccgattttgggagctagtcgatagagaaagaaacctacacctcgaaggcaagtgcgaaacatgtgtctataacatgatggggaaaagagagaagaaattgggagagtttggtaaggcaaaagggagtagagctatctggtatatgtggttaggagcaagatttttagagtttgaagctctaggcttccttaacgaggatcattggttttcgagaggtaatagtcttagcggagtagagggtgaaggtctacacagattaggatacatactcagagaagtaggtaaaaaggaagggggtgccatgtatgcagacgatacggcgggatgggatacccgaataacactagaggatctcaagaatgaagaaatggtaacaaatcacatgaaaggagaacacaaaaagttagccgaggcaatattcaaactcacttaccaaaacaaggtagttcgagttcaaaggccaacgccccgtggcaccgtcatggatatcatttcccgtaaagaccagaggggatcaggacaagttgggacgtacggtttaaatacattcacaaacatggaagcacaactgattcgacaaatggaaggcgagggaatatttaaatcaatacagcatttaacagcgacagaggagatcgcagtccaaaactggttagttcgagtcgggagagaacgcctatcaagaatggccatcagtggcgacgactgtgtagtgaaacccatagatgataggtttgcctccgcactaactgctctaaatgatatgggcaaagtcagaaaggatatacagcaatgggagccgtccagggggtggaatgactggactcaagtaccattctgctcgcatcactttcatgaattagttatgaaagatgggcgagtgctagttgtaccttgtagaaatcaagatgaattaataggtagagctcgtatcagccagggggctggatggtccctaaaagaaacagcatgcttaggaaaaagctatgctcaaatgtggacattaatgtatttccatagaagagatttacgtttggcagcaaacgcaatctgttcggcggtaccaagtcattgggtaccgacgtcgaggacgacatggtcaattcacgccaagcacgaatggatgaccaccgaagacatgttggtcgtttggaatagagtatggatacaagaaaacccttggatggaagataaaacaccagtggagtcatgggaagaggtcccttatctaggtaaacgtgaagaccaatggtgtggcagcttaattgggctgacttcgcgagccacgtgggccaaaaacatccaaacagctattaatcaggttcgttcgttaataggcaatgaaggttacacagactatatgccatcgatgaaacgattcagacgtgaggaggaggaagcgggggtattatggtag

SEQ ID NO: 22479 - RNA, 9876 nt, synthetic construct
  misc_feature 1..9876: note = derived and/or modified CDS sequence (opt6) from DENV-2__KC294215__SS-prME
  source 1..9876: mol_type = other RNA
actgccggtgtcatagtaatgctaataccaactgccatggcattccacttaaccacaaggaatggggagccacacatgatcgtaggtagacaggaaaaaggaaaatccttactgttcaaaacagaagatggagtgaatatgtgcacactaatggcaatagacttgggagaactatgcgaagacaccataacatacaagtgccctctccttcgacaaaatgagcccgaagatatagattgttggtgcaactcaaccagtacttgggttacttatggaacgtgtacaacgacaggagagcataggagagaaaagcgatctgttgcacttgtaccgcacgtgggaatgggtttggagactcgcacggaaacgtggatgtctagcgaaggtgcgtggaagcacgtacagcgaatagaaacgtggatactacgacacccaggattcaccataatggcagcgatcttagcctacaccataggtaccacgcacttccaaagagctttaatatttatattgcttacagctgtagcacctagtatgaccatgcgctgtataggtataagtaacagggattttgtagaaggcgtctcgggaggttcctgggtggacatcgtcttagagcacggaagctgcgtaacgacaatggccaagaataaaccaaccttagacttcgagctgataaagacggaagctaagcaaccggcaacgttaagaaaatactgtattgaagcaaaattaaccaacacaacaaccgaaagcagatgtccaactcagggggagccttcgctgaacgaagaacaggataaaagattcatttgtaaacactcaatggtcgataggggatggggaaacggatgtggattgttcggaaaaggtggtattgtcacttgcgcaatgtttacatgcaaaaaaaatatggaaggaaaaattgtacaaccggagaatctggaatatactatagtaattacgccccattcgggggaagagcacgcggtcggtaacgatactggcaaacatggaaaggagatcaagataactccacagagcagcacgactgaggcagaacttacaggatatggaacagtaactatggaatgtagcccaagaaccggtttggattttaacgaaatggtcctactacagatggaagacaaggcatggttagtccatagacagtggtttctcgatttgcctttaccctggctgcctggagccgatacacaagggtctaattggatacagaaagagactctggtaacttttaaaaacccacacgcgaaaaaacaagatgtcgttgtgttgggttctcaggagggagctatgcataccgctttaactggtgcgactgaaattcaaatgtctagtggcaatctactttttacgggccatctaaaatgtagattgcgaatggacaaactgcaactaaaaggtatgtcctattcaatgtgtactggaaaatttaaaattgtgaaagagatagccgaaacacaacatggaaccatcgtcatcagagtgcaatatgaaggagacggtagtccctgcaaaattccatttgaaattactgatcttgaaaaacgacatgtactaggacggctgataacagtaaacccaatagtaacagaaaaagactcgccggttaatatagaagcagaaccaccattcggggactcttacatcatagttggagtggaacctggacaattaaaattaaactggttcaaaaagggctcgagtatcggacaaatgtttgaaacaacaatgaggggagcgaagagaatggctatattaggggataccgcttgggacttcggatccttaggtggagtttttacgagtatagggaaagctctacatcaagtgttcggagcaatatatggtgcagcattctctggtgttagctggaccatgaaaatactaataggtgtaatcatcacttggatagggatgaactcgcggagcaccagcctaagcgtctcactagtattagtaggtgttgtgactctctatttaggtgctatggtacaggcagattctggatgcatcgttagttggaaaaataaagaactaaaatgtgggtcaggaatttttataactgataatgtacatacatggacagaacaatacaaattccaaccggagtcgcccagtaaattggccagcgcaattcaaaaagcgcatgaggagggaatatgcggcattaggagcgttacccggcttgaaaacttaatgtggaaacaaataactcccgagcttaatcatatattatctgagaatgaagtcaagctcactatcatgacaggtgacataaaaggaatcatgcaagccggtaagagaagcctccgaccacaaccaactgaattaaaatacagttggaagacttggggcaaagcaaaaatgttatcaacagaatcccacaatcaaaccttcttgatagatggacctgaaacagcagaatgccctaacactaacagggcttggaacagcttagaagtagaagattacggattcggcgtattcacgacaaacatatggctcaaactaagagaaaaacaagatgtcttttgtgattccaaattaatgagtgcagcaattaaggataaccgagctgtgcatgcagacatgggttattggattgagtcggccctgaatgatacatggaaaatggaaaaggcgtcttttatagaagtcaagtcatgtcattggccgaagagtcatacactctggtctaatggggtacttgaatctgaaatgataataccaaaaaatttcgcagggccagtatctcaacacaactatcgtccagggtatcatactcaaactgcaggtccttggcatctaggaaagttggaaatggattttgacttctgtgaaggtacaactgttgttgtcaccgaagattgcggcaacaggggaccatcattaaggacaacaacggcgtcaggtaaacttattaccgaatggtgttgccggtcgtgcactttgccaccgttacgctatcggggggaagatggatgttggtatggcatggagatacgcccgttaaaagaaaaagaagaaaacctagtaaattcccttgtgaccgctggacatggtcagatagacaatttctctctaggcgttctcggaatggcgttattcctggaagaaatgcttagaactcgagtagggacaaaacatgcaatacttctggtggcactctcatttgttacattgatcaccgggaatatgtcatttagagatctgggcagagtaatggtcatggtgggtgctacgatgaccgacgatattggcatgggtgtgacgtatcttgcacttctagcggcatttaaggtaagaccaaccttcgctgcaggattattattaaggaagttgacatccaaagaattaatgatggcaacgataggaatagctctactgagtcaatcaactctgcctgaaaccattttggaactaactgatgcattagccttaggcatgatggcgttaaaaatcgtcagaaacatggaaaaatatcagttagcagtaacaataatggcaattagttgtgtaccaaacgccgtaatactacaaaatgcctggaaagttagctgtactatattagccgccgtatctgtcagtcctctattgttgacctcatctcaacaaaaagcggattggattccattagcacttaccatcaaagggcttaacccaacggcgatatttctaactactttatcgagaacttctaaaaagcgaagttggccattaaatgaagctataatggcagtcggaatggtaagcatattggctagtagtttattaaaaaacgatattcctatgacaggaccactagtcgcaggtggtttactaacagtatgttacgtattaactgggcgatctgcggatctagaattggaacgggccgcagatgttaaatgggaggaccaggcagaaatatcggggtcctcaccaatattatcaattacgatatcagaagatggcagtatgtctataaaaaacgaagaggaagaacagacgttaacaatactaatacgcactggacttctcgtcatctcaggggtctttcccgtgtcaatacctattactgcagcagcatggtacctttgggaggtaaaaaagcaacgtgctggagtgttatgggacgtaccatcgccaccaccagtgggtaaagccgaattagaagatggagcgtataggataaaacaacgaggcatactaggctatagtcaaattggtgcaggcgtatataaggaaggcacgtttcatactatgtggcacgtaacgaggggagccgttctgatgcacagagggaaaagaatagaaccatcctgggcggatgttaaaaaagatttaatatcatacggaggaggatggaaacttgagggagaatggaaagaaggtgaggaggtgcaggttttagctctagaaccaggtaaaaatccccgggcggtccaaacgaagccaggaatctttaaaacaaatacgggtacaatcggcgccgtgagtcttgacttcagccctggaacaagcggtagtcctatcgtcgatcgaaaaggaaaagtagttggcttatatggaaatggagtagtcacgcgtagcggagcatatgttagtgcaatcgcgcaaactgagaaatcgatcgaagacaatccagagatagaggatgacatattcagaaaaaaacggttaacaataatggatctgcacccaggcgcaggaaaaactaagagatacctacctgcgattgtacgggaagctataaaaagaggtctaagaaccttgattcttgctccgacaagagttgtggcagcagaaatggaggaagctctgcgcggtctacccatccgataccaaactccagcaattagagcagaacacaccgggagggaaatagtggacttaatgtgtcacgctacctttacaatgaggttattatcacctgtgagagtcccaaattataatctaataataatggatgaagcacattttacagatccagctagtatagcagcgcggggatacatatcaaccagagttgaaatgggtgaagctgcaggaatattcatgaccgcgaccccccctggctcaagagatcctttcccacaatctaatgccccaattatggatgaggagcgtgaaataccagagagatcatggaattccgggcacgaatgggttacagattttaaaggaaagacagtctggtttgtccccagcatcaaggcgggaaatgacatagcagcatgtctaagaaagaacgggaaaaaagttatacaattgtcacgtaagacatttgactctgagtacgttaaaacaagagcgaatgattgggatttcgtagtaacaacagatatttcagagatgggggctaactttaaggcggagagagtaattgacccgaggagatgtatgaagcctgttatactaacggacggagaagaaagagtaatactagccggaccgatgccggttactcactctagcgcagctcaaaggcggggaagaatcggacgtaaccctaaaaacgaaaacgatcaatacatctatatgggagaaccgctagaaaatgatgaggattgcgcacactggaaagaagctaaaatgttgcttgataatatcaatacgcccgaaggtataatcccgagtatgtttgagccagagcgtgaaaaagttgacgccatcgatggagaatatagattaaggggagaggcacgcaaaacattcgttgatctaatgagaagaggagacctaccagtatggcttgcttacaaagtagctgccgaaggtattaattacgcagatagaaaatggtgctttgatggtattaaaaataatcaaatactagaagagaacgtagaggttgaaatatggactaaagaaggagaaagaaaaaaattgaaacctcgttggttggatgcgaggatttattctgacccactggcactaaaagaatttaaagaatttgcggcgggtcgcaaaagtttaaccctaaaccttattaccgaaatgggccgactcccaacatttatgacccaaaaagcaagaaacgcattagacaaccttgctgtgttgcatacagctgaagttggtggtaaagcatatacacatgcactgtcagagttaccagaaactttagaaactctactacttctaacactactagccgcagtgacaggtggaatatttctatttctaatgagtggcaaaggtatcggaaaaatgacattagggatgtgttgtattattaccgcaagtatattattatggtatgcccaaatacaaccacattggatcgcagcttcaataatattggagttcttccttatagtattacttatcccagaacctgaaaagcaacgcactccccaagacaatcaactaacatatgtggtaattgcgattctaacagtagttgcggcgaccatggccaacgaaatgggatttttagagaagacgaagaaggatttaggatttggatccattactacacaagaatcagaatcgaacatattagacatagacttgcgacctgcatcagcgtggacgttatatgctgtggcgactacatttgtgactccaatgttgcgccacagcatagaaaacagcagtgtaaatgtaagcctcactgccattgcaaaccaagcgacagtcctcatgggattgggcaaagggtggccactatccaaaatggatataggagtacctttattagctatcggatgttattcgcaggtgaatcctataaccttaacagcagcactattactactggttgcacactatgcgataatagggcccggcttacaagcaaaagcaacaagggaggcccaaaaacgtgctgcagccggaataatgaagaatccaaccgttgatggtatcactgtcatagaccttgaacctattccatacgacccaaaatttgaaaagcaattaggacaagtcatgctcctcatactctgtgtaactcaagtcttaatgatgaggaccacatgggccctttgcgaagcactcactttagcaactggacctattagcactctgtgggaagggaatcccggaaggttctggaacacaactatagcagtttcaatggcgaatatttttcgcggttcatatcttgccggagcaggattattatttagcataatgaaaaacacgactaatacaagaagaggtactggaaacgtaggagaaacgttgggtgaaaaatggaaatctagactcaacgcgttagggaaaagcgaattccaaatttacaaaaaatcaggcatacaagaagtagatcgaacactggctaaggaagggatcaagcggggcgagacagatcatcatgccgtttcaagaggctccgccaaactgagatggttcgtagagagaaacatggtaacaccagaaggtaaagttgtcgacttaggttgcgggcgaggtggttggagttattattgtggaggactaaagaatgtccgggaggtaaaaggactaacgaaaggtggacctggccatgaagaacccattccaatgtcgacatacggatggaatctagtaagactacaaagcggggtagacgtctttttcactcctcctgagaaatgcgatacattgttatgcgatataggcgagagtagccctaatccgacaattgaagcagggagaactctgcgcgtactcaatttagtggaaaattggctaaacaataatacgcaattctgtatcaaagttcttaacccatatatgccgtccgttatagaaaaaatggagacattacaaaggaaatacggaggcgcattagtaaggaatccactatcgcgaaattccacacacgaaatgtattgggtatcgaatgctacggggaatattgtatcgtcagtaaacatgatctcacgtatgcttataaatagatttactatgaaacataaaaaagcgacgtacgaacccgacgtcgacctcggcagtggtacaagaaacataggtatagaatcagaaattcccaacttagatatagttggaaaacgaattgagaaaattaaacaggagcacgaaacttcctggcattatgatcaagatcacccttataaaacatgggcataccacggaagttacgagacgaagcaaaccgggtcagcatcaagtatggtaaatggagtcgttaggttattgacaaaaccttgggacgtagtgccaatggtaacacaaatggcgatgacagatacaaccccatttggtcagcaaagagttttcaaagaaaaagtggacactcgaacacaagaaccaaaagaagggacaaaaaaattgatgaaaataacagcaaagtggctttggaaagaattaggcaaagagaaaacgccaagaatgtgtaccagagaggaattcacaaggaaggtacgcagcaacgccgcgcttggtgcggtatttactgatgagaataagtggaaaagtgcacgtgaagcagtggaggatggacgattctgggaactggtggatagagaacgaaaccttcacctagaaggcaaatgcgaaacatgcgtatataatatgatgggaaaaagagaaaagaaactgggtgaatttggaaaagctaagggtagcagagctatttggtacatgtggttaggagcacgattccttgaatttgaagcattaggattcctaaatgaggatcactggttcagccgtggaaatagtttaagtggggtagagggagagggtctacatagactcgggtatattctaagagaagtggggaagaaagaaggtggtgcaatgtatgctgacgataccgccggatgggatacgagaataacattggaagacttaaaaaacgaagaaatggtgaccaatcatatgaaaggggaacataagaaattagccgaagctatatttaagcttacttatcagaataaggttgtacgagtacaacgtcccactcctagaggaaccgtaatggacataatcagtcggaaggaccagaggggttctgggcaagtggggacttacgggttgaacacctttacaaacatggaagcacaactgattcggcaaatggaaggagaaggaatttttaagtcgattcaacacttaacagcaaccgaggaaatcgcagtgcaaaattggctggctagggtaggcagagaacgcctatcaagaatggcaatatccggtgacgattgtgttgtcaagccaatagacgacagatttgcaagtgcattaactgcgttaaacgatatgggaaaagtgaggaaggacattcagcagtgggaaccatctaggggctggaatgactggacgcaagtgccattttgctcacaccacttccacgaattagtgatgaaggacggcagagttcttgtagtaccctgccgtaatcaagacgaacttataggtagggcacgtatttcgcagggggcaggatggtcattaaaggaaaccgcgtgcctaggcaagagttacgcacaaatgtggacattaatgtactttcaccggcgagacttacgattagctgccaatgcgatttgttcagctgtcccatcacattgggtacctacctcaaggacgacttggagtatacatgctaaacatgaatggatgacaactgaagatatgttagtagtgtggaacagagtatggatacaggaaaatccctggatggaagataaaacaccagtggaaagttgggaagaagtcccttatctaggcaagagagaagatcaatggtgtggaagcttaatagggttaaccagcagagctacctgggctaaaaacatacaaacagctatcaatcaagttaggtctctcatcggtaatgagggatacacggactatatgccatcgatgaagagatttaggcgtgaagaagaagaagcaggggttctgtggtaa

SEQ ID NO: 22480 - RNA, 9876 nt, synthetic construct
  misc_feature 1..9876: note = derived and/or modified CDS sequence (opt6) from DENV-2__KC294216__SS-prME
  source 1..9876: mol_type = other RNA
acggctggtgtgataattatgctaattcctacagcaatggcctttcacctaacaactagaaatggtgaaccacatatgatagttggtaggcaagaaaaaggaaaatcgttattatttaaaacagaagatggagtcaatatgtgcacattgatggccattgatttgggtgaactgtgtgaagacaccattacgtacaaatgcccattattacgtcaaaacgaaccagaagatatagactgttggtgtaattctacgtcaacttgggttacttatggaacatgtacgacgacaggagaacacagaagagaaaaacgtagtgttgcgcttgtcccacacgtaggtatgggactagaaacaagaacagaaacatggatgtctagtgaaggagcgtggaaacacgtacaacgtatcgaaacctggatcctacgtcacccaggattcgctattatggcggctattctagcatatacaattggaacgactcattttcaaagggcactaatatttatacttcttacagccgtggctccctcgatgacgatgagatgtataggaatctcgaatcgagactttgtagaaggagtcagtggtggtagctgggttgacatagttctggaacacgggagctgcgtaacaaccatggcgaaaaacaaaccaaccttggacctagaactaataaaaacagaagccaaacagcccgcaacattaagaaaatactgcattgaagctaaactaaccaacacaacaaccgaatctcgatgtcccacacaaggtgaaccaagtcttaacgaagaacaagataaaagatttatatgcaaacacagtatggttgatcgtgggtgggggaatggatgcggactatttggaaaaggagggatagtaacatgcgctatgttcacttgtaagaaaaatatggaaggcaaagtagtactccccgaaaacctagaatacaccattgtgataacaccacacagtggtgaagaacatgctgtagggaacgatactggaaaacatggtgaagaaatcaaaataacacctcagtcgtctattactgaagccgaacttacaggatacggtacggtcacgatggaatgttcaccacgaacaggtctcgattttaatgagatggtattgcttcaaatggaagaaaaagcatggcttgtccaccggcaatggttccttgacttaccattaccttggttaccgggagccgacactcaaggttccaattggatacagaaagaaacattagtaacatttaaaaacccccatgccaagaaacaagatgtagtcgtactaggttcacaagaaggagcaatgcacaccgccctgacaggggcaacagaaatacaaatgagctctggaaacttattattcacaggccatcttaaatgcagattgagaatggataaattacaactcaaaggaatgagttatagcatgtgtacgggtaaattcaaaattgtcaaagaaatagcggaaacacaacatggaacgatagtcattagagttcagtatgagggtgatggaagtccgtgcaaaataccttttgagataatggatctcgagaaaaggcatgtactaggaagactgattacagtcaatccgatagtgacagagaaagattcaccagtaaacatagaagcggagccgccattcggtgacagttatatcattataggggttgagcccggacaattgaaactaaattggtttaagaaaggctctagtattggacaaatgtttgaaactactatgagaggtgcaaaacgaatggcaatcttaggtgataccgcttgggatttcggttcgttgggaggagtgtttacttctatcgggaaagcgctccatcaagtcttcggagctatatatggagctgcattttcaggcgtgtcatggacaatgaaaattctcattggtgtgattataacttggatcggtatgaatagtagatcgacaagtctttcagttagcttagtattggttggagtagtaaccttgtacttaggcgcgatggtgcaagcagattctgggtgtgtagtaagttggaaaaacaaggaacttaaatgtggatctggtatattcattacagataatgttcatacatggaccgaacaatacaaattccaaccggagtcaccatcgaaactagcctcggcaatacaaaaagcgcatgaggaaggcatatgcggaattagaagtgttaccaggcttgagaacttgatgtggaaacagatcactcccgaattaaaccacatattaagtgaaaatgaagtaaaacttacaataatgaccggcgacataaagggtataatgcaagctggaaaacgttcgctgagaccgcaaccaacagaattaaaatactcatggaagacatggggaaaggcaaagatgctaagtacagaatcacataatcaaacctttttaatcgacggacccgaaacagctgaatgtccaaacacgaacagagcatggaactctctagaggtagaagactatggatttggcgtatttaccacgaatatatggttgaaattgcgtgaaaaacaagatgtattttgtgatagtaagctcatgtcagcagctatcaaggacaatcgagctgttcatgcagatatgggatattggatagaatcagccttaaatgacacatggaaaatggaaaaggcttcatttatcgaagtcaaaagctgccattggcccaagtctcacacactttggtcaaatggagtactagagagcgagatgattatcccgaagaatttcgcaggtccagtatctcaacataactataggcctggatatcacactcaaacagctggtccttggcatcttggtaaattagagatggattttgatttttgcgaagggactacagtagttgtaacagaggattgtggcaacaggggcccttcactgcggacaacgacggcatcaggaaaacttataacggaatggtgctgtaggagttgtactctgcctccattacgttatagaggagaagatggatgttggtacggtatggaaatacgtcctctaaaggaaaaggaagaaaatttagttaattcccttgttactgcaggacacggtcaaatagataatttcagtctcggagttttaggcatggcgctctttctagaagaaatgctacgaacgagagtggggacgaaacatgctattctcttagtagctgttagttttctaacactaataacaggcaatatgagtttccgagatttaggccgagtaatggtcatggtgggggtagcaatgacggacgacataggaatgggagttacttatctagcacttctggcagcattcaaggtaaggcccaccttcgcagctggactattattgaggaagttaacatcgaaagagctaatgatggccactattggtataaccctactctcacaatctaccacgcccgaaacaatcttagagcttacagatgctctcgcattaggaatgatggtattaaaaatagtgcgcaatatggagaagtatcaacttgcagtaaccattatgacgatatcttgtgtcccaaacgcaatgattttaattaatgcctggaaagtctcatgcacaattctggcagtagtctccgtaagtccacttttattaacctcatcccaacagaaaacagattggattccgttagcattaaccataaaaggattaaatcccaccgccatcttcttaaccacgttatctcgaacgtccaagaaaagaagttggcctctaaacgaagctgttatggcggtcggaatggtaagcattcttgcttcatcattactcaaaaatgatatacctatgacgggtcctcttgttgctggcggtttactaacagtatgttacgtgctaaccggacgaagcgcagaccttgaattagaaagagcagccgacgttaaatgggaggaccaagcagaaatatcagggtcatcgccaattttatccataacaattagtgaggatggatcaatgtctatcaaaaatgaagaagaggagcaaacattaacaatactcatccgcactgggctattggtaatatcaggagtatttccagtgtccattcctataaccgcagctgcgtggtatttatgggaagtacggaaacaaagagcgggggtattatgggatgttccgtcccctcctccagttgaaaaagccgagttagaagacggagcttatcggatcaagcagagaggtatactaggttacagtcaaatcggagccggagtgtacaaagaagggacatttcacacaatgtggcatgtcacaaggggtgctgtgcttatgcatagaggaaaaagaattgaacctagttgggcagacgtcaagaaagacctaattagttatggagggggttggaaactggaaggagaatggaaagaaggagaagaagtacaagtattagccctagaacctggtaagaatccaagagcggtacaaacgaagccggggttgttcaagactaatacagggactatcggagcagtctcattagactttagcccgggaacaagcggcagccccatagtggatcgaaaaggaaaagtagtaggactgtatggtaatggggtagtaacccgctcgggggcctatgtatctgcaattgcacaaaccgagaagtcaatcgaggataatcctgaaattgaggacgatatatttcgcaagaaacgtcttactataatggatttgcatcctggagcgggcaaaactaaaagatacctaccagccatagttagggaagcaattaaaaggggcctcagaacactaattctcgcgccaacgagagtagtcgcagcagagatggaagaggctctcagaggtttacctatcagatatcaaacaccagctatcagagcagagcatactggtcgtgaaatagtagatttaatgtgtcatgcaacctttacgatgagattattaagtcccgtccgagtaccaaactacaatcttataataatggatgaagcacattttactgatccggcctcaatagcagcacgtgggtacataagcacaagagtagaaatgggagaagcagcgggaatcttcatgaccgccacaccaccaggatcacgggatccattccctcaatctaatgctcctataatggatgaagaaagagaaatacctgagcgaagttggaactccggacatgaatgggtaacagatttcaaaggtaaaaccgtctggttcgtaccgtcaataaaagctgggaacgatatagccgcctgccttcgcaaaaatggcaagaaagttattcaactttcaagaaaaaccttcgatagtgaatacgtgaaaacgagagcgaacgattgggactttgttgtcaccactgatatatcagaaatgggagcgaactttagagcagaacgcgttatagacccgagaaggtgcatgaaaccagtaatactaaccgatggagaagaaagggtaatacttgcaggaccaatgccagtaacacattccagtgccgctcaacgacgcggccgagtaggccggaatcccaaaaacgagaacgaccagtacatctacatgggagaacctttagaaaatgacgaagattgtgcacattggaaagaagcaaaaatgcttctagacaatataaacacaccagagggcatcattccatctatgttcgaacctgaaagagagaaagtcgatgccattgacggcgaatataggttgcggggagaagcacgaaaaactttcgtagacttaatgaggcgtggagatcttcccgtatggttagcttaccgagtagccgccgagggcataaattatgcagacagaagatggtgctttgatggaatcaaaaataaccaaatactagaagagaatgttgaggtagaaatctggacaaaagaaggcgaaaggaagaaacttaagccccgttggctggacgcaagaatatatagcgaccctctggcgttgaaagaatttaaagagttcgcagctggacgtaaaagtttaacactaaatctgataacagaaatgggccgattaccaacattcatgactcaaaaagcaagaaacgccctggataatcttgctgtcttacatacagcggaagcgggaggacgtgcatataatcacgcactctctgaactacctgaaacacttgaaaccttattattactaacacttttggctaccgtgacaggtggaatctttttatttctaatgagtggaaaaggcatcggcaaaatgacgttaggaatgtgctgcattattactgcatctatattgctatggtacgcgcaaattcaaccacattggattgcagctagtataatattggagttctttttaatcgtactcttgatccccgaaccagaaaaacaaagaacacctcaagataatcaattaacttatgttgtaattgctattcttacagtagtggctgcaaccatggcaaatgagatgggatttcttgagaaaactaaaagggatctcggtctagggtcgataaccacacaagaatcagaaagcaatatcctagacattgacttgcgaccggctagtgcttggactttatacgcggttgcgacaacttttgtgacaccgatgctccggcacagtatagaaaattcgtcggttaatgttagtttaaccgccattgctaaccaagctaccgtactgatgggtctgggaaaaggctggccattgtcaaaaatggacataggagtgccacttctggcgatcggttgttactcccaggttaatccgattacacttaccgctgcattattactactcgtggctcattatgctattataggcccaggattacaggcaaaagccacaagagaagcgcaaaaacgagctgctgccggcataatgaagaatccgacagttgatggaataacagtaatagatcttgaaccaataccctacgatcctaagttcgaaaaacaacttggccaagtcatgctgctcatactatgtgtaacgcaagttttaatgatgagaactacctgggcactctgtgaggctctgacgttggctactggccccataagcacgttatgggagggtaatcctggccggttctggaacacaaccatcgcggtgagcatggctaatatatttcgaggtagctatttagcaggagccggactactattttctataatgaaaaataccactaatactagaagaggaactggcaatataggagaaacacttggagaaaagtggaaaagccgtctaaatgcattaggaaagagtgagttccaaatatataagcgttcaggcattcaagaagtcgatagaaccctagcaaaggagggtataaaaaggggcgagacagatcaccatgctgtaagtcgaggttctgcaaagctgcgatggtttgttgaaagaaacatggtgacaccagagggaaaagtagtagatttagggtgcggtagaggaggttggagctactattgcggaggtttgaagaacgtccgagaagtaaaaggacttactaaagggggtcctggtcacgaagaaccaatacccatgtcaacttacggctggaatctagttagactacaatctggtgtagatgtattctttacaccgccggagaaatgtgacacacttctttgcgatataggcgaaagttcacccaatccaacaattgaagcgggacgaacactaagagtgttaaacttggtcgaaaattggttgaataataacacacaattttgtataaaagtcttgaacccttatatgcctagtgtaatcgagaaaatggaaactttacagagaaaatatggaggagcgttagtccggaatcccctatccagaaattcaactcatgaaatgtactgggtctcgaatgctacgggtaacattgtgagtagcgtgaatatgatttcgcgaatgctaataaatagatttaccatgaagcataaaaaggcgacctatgagcccgacgttgaccttggttctggtacacgaaatatcggaatcgagtcagaaattcctaatcttgccataattggcaaaaggattgagaaaataaaacaagaacatgagacctcatggcactacgaccaggatcacccatataagacttgggcctatcatggatcgtacgaaactaaacaaaccggaagtgcatcgtcaatggttaacggagtggtcagactactaacaaagccatgggatgttgttcccatggtgacacaaatggcaatgacagatacaacaccatttggacaacaacgagtgtttaaggagaaagtcgatacccgaacccaagagcccaaggaaggaaccaagaaattgatgcgcataacagccgagtggctctggaaggaattggggaagaagaaaacaccacgcatgtgcacgagagaggagttcacgagaaaggtcagatcaaatgcagcgttaggagcgatatttacagatgaaaacaaatggaaatcagctagagaagccgtagaggactcgcgattctgggaactggtagaccgcgaacgaaacttacacttagaaggaaaatgcgagacatgcgtatataacatgatgggaaagcgtgagaagaaacttggagagttcggtaaggcaaaaggtagccgcgcgatatggtacatgtggcttggtgcgcgttttcttgagttcgaagccctagggtttcttaacgaagaccactggttctcacgagggaactcattatccggcgttgagggagaaggcctacatcgactcggatacatattaagagatgtaagcaagaaagagggcggagctatgtatgcagatgacacagcaggctgggacactcgaattaccctagaagacctaaagaacgaagagatggttaccaatcatatgaaaggagaacataagaaattggccgaggcagtatttaagttaacctaccaaaataaagttgtgagagttcagaggccaacaccgagaggaaccgttatggatattatttctagaagagatcagagggggagcggtcaggtcggaacatatggtctaaatacttttaccaatatggaagctcagttaatccggcaaatggaaggagagggtatttttaaatcaattcagcatctcacagctactgaagaaattgctgtacaaaattggctagctagggtgggcagagaacgtctaagcaggatggctataagcggtgatgattgcgtcgttaaacctctagacgaccgattcgcatctgcattaactgcgcttaacgacatggggaaagttagaaaagatatacaacaatgggagccaagcaggggatggaacgattggactcaagtccctttttgttcgcaccattttcatgagctggtgatgaaggacggacgggtcctagtagtgccatgccgaaaccaagatgaattaataggtagagcaagaatctcacagggagcagggtggagcttaaaagaaacagcatgcctagggaaaagctatgcccaaatgtggacccttatgtactttcatcgtcgtgacctaagattagccgcaaatgctatatgtagcgcagtaccaagtcattgggttcccacgtccagaaccacatggagtatccatgcaaagcatgagtggatgactaccgaagatatgttggcagtctggaatagagtatggattcaagaaaatccttggatggaagataaaacacctgttgaatcttgggaggaagtaccttatcttggtaagagagaagaccaatggtgcggcagccttatcggattgacatcgcgagctacctgggctaaaaacattcaaaccgcgataaatcaagttcgatctttgataggcaatgaagaatatacagattatatgccatcaatgaaacggttccggcgtgaagaagaagaagcgggagtcctctggtaa

SEQ ID NO: 22481 - RNA, 9876 nt, synthetic construct
  misc_feature 1..9876: note = derived and/or modified CDS sequence (opt6) from DENV-2__KC294218__SS-prME
  source 1..9876: mol_type = other RNA
acggcgggcgtgatagtcatgttgattcctacagccatggcttttcatcttacgacacgtaatggcgaaccacatatgattgtagggcgacaagaaaaagggaaaagtttactatttaaaacagaggacggagtcaacatgtgcacgttgatggctatcgatttgggcgaattatgtgaagacactattacttataagtgtccactccttcgacagaatgaacctgaagatattgattgctggtgtaactcgacatcgacgtgggtaacttacggaacatgcactacgactggggaacatagaagagaaaaaagatcggtagctctagtaccacatgttggaatgggactagagaccagaacagaaacgtggatgtcttcagaaggggcttggaaacatgtacagcgtatagaaacctggatattacgacatccaggctttacaataatggcagcaatattagcatacacaatcgggaccacacatttccagagagcattgatattaatattattaacggcagtagcgccgtcaatgaccatgcgctgcataggaatcagtaatcgagatttcgttgaaggagtgtccggtggatcatgggtggatatagttcttgaacacggctcatgcgttaccaccatggcaaaaaacaagcctacattggattttgagttaataaaaaccgaagctaaacaacctgcaactctaagaaaatactgcatagaagcaaagctaacaaatacgacgactgaaagtaggtgtcccactcagggggaaccttccttaaacgaagagcaagacaaacgatttatctgcaaacatagcatggtcgaccgaggttggggtaatggatgcggattattcgggaagggcggaatagttacatgcgcaatgtttacgtgcaaaaaaaatatggaaggcaagatagtgcaaccagagaatttagaatatactattgtgataactccacatagcggcgaagaacacgcagtaggaaatgacacaggtaaacatggaaaagaaattaagataactccacaaagttctacaacagaagcagagttaaccggatacggtactgtaacaatggaatgcagtccaagaacaggattagatttcaacgagatggtactactccagatggaagataaagcatggttggtacatcggcagtggtttttagacctcccgcttccctggttaccaggggcagacacacaaggttccaactggattcagaaggaaactttagtcacgtttaagaacccacacgcgaagaaacaggacgtggtggtactagggagccaagaaggtgctatgcacactgctctgacaggagcaactgaaattcaaatgagttctggaaatctcctttttactggtcatttaaaatgtcgtttacgaatggataaactccagcttaagggaatgtcatattccatgtgcacaggaaagtttaagatcgtaaaagagatagcagaaacacagcacggtacgatagttattcgtgtacaatacgaaggtgacggcagtccatgtaaaatccccttcgaaatcactgatttagaaaagcgacatgtacttggaagattaataacagtaaacccgatagtcacagaaaaagattcacctgtaaatatcgaagcagagccgccattcggagactcttacattattgttggagtagagccgggtcaattaaaattaaattggtttaaaaaaggttcgtcaatagggcaaatgtttgaaactaccatgcgaggagcaaaaagaatggcgatcttaggtgacaccgcttgggattttggatcattagggggggtctttacatctataggtaaagcgcttcatcaggtttttggtgcaatatacggcgcggccttttcgggggtaagttggacgatgaaaatcctaataggcgttataataacatggataggaatgaattcgcgctccacaagtttaagtgtttctttagtgttagtgggagtagttacattgtacttaggtgccatggtacaagcagattctggctgcatagtaagttggaaaaataaagagttaaagtgtgggtctggaatttttataacagacaacgttcatacctggacagaacaatacaagtttcaaccagagagtccaagtaagttggccagcgctatacagaaagcgcatgaggaaggaatatgcggaattagatcagtcacgcggttagaaaacttgatgtggaagcaaattactccagaattaaaccacatcttatcagagaacgaagtgaaactaacgattatgaccggcgatataaaaggcatcatgcaagcggggaaaagaagcctgagaccacaacctactgagttaaagtatagttggaaaacctggggtaaagcaaaaatgctctcaacagagtcccacaaccaaacttttctcatagatggtccagaaacggcagaatgtcctaatacaaaccgcgcatggaattccttggaagtagaagactacggcttcggtgtcttcacaaccaacatttggctaaagctaagagaaaaacaagatgtgttttgtgactcgaaattaatgagtgctgcaataaaagataatagggcggtacacgcagatatgggttattggatagaaagcgcacttaatgacacttggaagatggaaaaggcctcgtttatagaagtcaaatcatgtcactggccgaaatcacatacactttggagtaatggggtactagagagcgaaatgatcatacccaaaaactttgctgggccagtatcacagcacaattataggccaggttaccacactcaaacagccggtccgtggcaccttggtaagttagaaatggatttcgatttctgtgaaggaacaacagtagttgtaacagaagattgtggtaatagaggaccaagtttaagaacgacaacagcgagtggaaaacttattacagaatggtgttgtagaagttgtacactaccccccctcagatacagaggagaagatggctgctggtacggcatggaaattcgtcccctaaaagagaaagaggaaaatttagtgaactcgctagtcacagctggccatggacaaatagataacttctcactgggtgtattaggaatggcactatttttagaagaaatgttacgaactcgagtaggtacaaaacacgcaatacttctagtcgcactgtccttcgtaacattaataacaggcaatatgtcctttagagacctcggaagagtaatggttatggtaggcgctactatgacggatgatataggaatgggagttacgtacctagctttattagcggcgtttaaagttaggccgacattcgctgcaggattgttactcagaaaacttacttcgaaagagcttatgatggctacaattggaatcgctttattaagtcagtccacgctacccgaaactattcttgaactaacagatgcgttagcactagggatgatggcactgaagatagtcaggaatatggaaaagtatcagttagctgttaccattatggcgatcagttgtgtacctaatgctgttatcttacagaatgcatggaaagtgtcatgtactattttagccgcagtatccgtgagtcctctattattaacgtcatctcaacaaaaggcagattggattccgttggctttaactatcaaaggactgaatccaacggcgatctttctaacgacacttagtcgaacttcaaagaagcgaagttggcccctcaatgaagctattatggcggtaggaatggtatcaatattggcttcttcactcttgaagaacgatatacctatgactggaccactagttgctggagggttattaactgtttgctatgttctgacaggaagatcagctgatctggaattagaacgcgccgcggatgttaaatgggaagatcaggccgaaatatcgggatcatccccaattttgtcaataacaattagtgaggatggatctatgtctatcaagaatgaagaagaggaacaaaccctgacgattcttatacgaaccggtttattagtaatcagcggtgtattccctgtttctattcccataaccgccgcagcctggtatttatgggaggtaaagaaacaaagagctggagtgctatgggacgtaccgtcgccacctccagttggcaaagcagagttagaagatggagcataccgaataaaacaaagaggaatcttaggttactcacagattggcgcaggtgtttataaagaaggaacatttcatacaatgtggcatgtaacaagaggcgcagtcctcatgcaccgcggaaaaaggatagaacccagctgggcagatgttaaaaaagacctaataagttacggaggaggttggaaattagaaggagaatggaaagaaggagaagaggtacaagttctagctttggaaccaggaaagaaccctagagcggtacaaacgaagcctggaatatttaaaaccaatactggaactatcggtgcagtatcccttgacttctcaccgggaacgagcggaagtccaatagtcgaccgtaagggtaaagtagttggattatacggtaatggggtagtaacaagatcaggtgcatacgttagtgctatagcccaaactgaaaaatctatcgaagacaatcctgagattgaagatgatatatttagaaaaaaaaggttaactataatggacctacaccccggtgccggtaaaacgaaaagatatctaccagcaatcgtccgagaagcaataaaaagaggactgcgaaccttaatcttagctccgacacgggtggttgctgcagaaatggaggaggcactgagaggcctgcctatccgatatcaaacgcctgcgataagagctgaacacacaggaagagaaatagttgaccttatgtgccacgctacatttactatgagacttctaagccctgtacgggtcccaaattataacttgataataatggatgaggctcattttacagatccagcttcaatcgctgcaaggggatacatctccacaagagtggaaatgggcgaagctgctggcatttttatgactgctacacctcccggaagtagagacccctttccacagtcaaacgctccaatcatggatgaagagcgggaaataccggagaggtcatggaactcgggtcatgaatgggtaactgacttcaaaggtaagactgtatggtttgtgccatcaataaaagctggaaatgacatagcagcatgtttacgaaagaacggtaaaaaagttatacaactctccagaaaaacttttgactccgagtacgtaaagacgagggcgaatgactgggacttcgtcgtaacgacagatatcagtgagatgggagcaaatttcaaagcagaacgagtcatcgaccctagacgttgtatgaaaccggtcatattgaccgacggggaggaacgcgtgattctagcaggccccatgccagtaactcattcatctgcagctcaacgacgtggacgcatcgggcggaacccaaaaaatgagaacgatcaatacatttacatgggggaaccactagaaaacgatgaagattgtgcgcattggaaggaggcaaaaatgctattagacaatataaatacgcctgaaggaataataccgagcatgttcgagccagaacgagagaaggttgatgccatagacggagaatatcgattgagaggcgaggccaggaagacttttgttgacctcatgcgaagaggcgacctcccagtctggcttgcatataaagtagcggcagagggaataaattatgcagacagaaagtggtgtttcgacggtattaagaataatcaaatattagaagagaacgtagaagtagaaatatggacgaaggaaggtgaaagaaaaaaattaaaaccaagatggctggatgcacgaatctactcagatcctttggctttaaaagaatttaaggaattcgctgccggaagaaaatcgctcacgctaaatcttataactgaaatgggtcgactccctacttttatgacacaaaaggccagaaatgccttagataaccttgcagtactacacactgctgaggtaggcgggaaagcctacacacacgcactatctgagttacctgaaacacttgagaccttgttactattaaccctactagcagcggtcacaggtggaatatttttatttttaatgagcgggaaaggtattggtaaaatgaccttgggaatgtgctgtataattactgcatcgatacttttgtggtacgcgcagatccaaccgcattggatagccgcgagtattattttagaattctttctaattgtactgttaataccagaacctgaaaaacaacgcactccacaagacaatcagttaacgtacgtagtcatagcaatattaactgttgtcgcagcgacaatggcaaatgagatgggattcttagaaaagacaaaaaaagacttaggcttcgggagcataacaacacaagaaagtgaatcaaacatcttagatatagatttaagaccagcatctgcctggacactgtatgcagtggccaccacttttgtaacaccgatgctaagacattcaatagaaaattcgtcggtaaatgtttcactcacggccattgctaaccaagcaaccgtcttaatgggtttaggaaaaggatggccattaagcaagatggatattggagtcccattgctggcaataggctgttattctcaggttaatccgatcacacttaccgcagctttattacttttggtagctcactatgccataattggaccaggattgcaagcaaaagctaccagggaagcacaaaaacgcgcagcagcaggcattatgaaaaacccaactgtagacggaattacggtaatagatttagaacctataccttatgatccaaaatttgagaaacaactcgggcaagttatgttattaatcttgtgcgtaacacaggtattaatgatgagaactacgtgggctttatgtgaggcattaactcttgctacgggaccaattagcactttgtgggaaggaaatcccggtagattttggaatacaactatcgcagtctcaatggccaatatatttaggggtagctacctggccggcgctggcctattattctcgatcatgaaaaacactacgaacacaagacgtggaaccggaaacgtaggggaaacactgggtgagaaatggaaatctaggctaaatgcgctaggcaaatcggaattccaaatctataaaaagtcaggaatacaagaagttgatagaaccttagccaaagagggaataaaaagaggagagacagaccatcatgccgtatccaggggttcagccaagttacgttggttcgtggaaagaaacatggtaacgcctgaaggaaaggtcgttgacctcggatgtggacgaggtggctggtcctattactgtggtggattaaaaaacgttcgtgaagtcaaaggattaacaaaaggtggaccgggacatgaggaacctattcctatgtcgacctatggatggaatttagttagactacaaagtggggtagatgtattttttactcctcctgaaaaatgtgatacactcctttgcgacattggtgaaagctccccgaatccgaccatcgaagcaggtcgaacattaagagtattaaatttggtcgaaaactggctcaacaacaatacgcaattctgcataaaagttttaaatccgtatatgccaagcgtaatcgaaaaaatggagaccttacaacggaaatacggtggtgcactagttagaaacccgttatcacggaattcaacacatgagatgtactgggtgagcaacgcaacgggaaacatagtatcttcagtaaacatgatatcacggatgctcataaatagattcaccatgaaacacaaaaaggcgacttacgaaccggatgtcgatctaggatccggcactcggaatattggcatagaatcggaaattccaaacttagatatcgtcggaaagagaattgaaaaaatcaaacaagaacatgagacaagttggcactacgatcaagaccacccatacaaaacatgggcatatcatggaagttatgaaacaaaacagactgggagtgcaagtagtatggtgaatggagttgtacgcctattaacaaaaccttgggacgtagttccaatggtaactcaaatggcgatgacagacacaacaccattcgggcaacaaagagtttttaaagaaaaagtcgacaccaggacacaagaacctaaagaaggtactaaaaaactaatgaaaataacagctgaatggctttggaaggaactaggaaaagagaagaccccaagaatgtgtacacgagaagaattcacaaggaaggttaggtcaaacgcagctttgggagctgtattcacggatgagaataaatggaagtcagccagagaggcagtggaagatggtagattttgggaacttgtagatagagaaagaaatctgcacttagaaggcaaatgtgaaacatgcgtttacaatatgatgggtaagagagagaagaaactaggagagtttgggaaagctaaaggatcccgggcaatttggtacatgtggttaggagctaggttcctagaattcgaagccttaggatttcttaatgaggatcattggttttcacggggtaactcactaagtggagtcgaaggcgaaggtctgcacagacttggttatattttgcgcgaagtagggaaaaaggaaggtggagcaatgtatgctgacgataccgcaggctgggatacccggatcacgcttgaagacttgaaaaatgaagaaatggtaaccaaccatatgaagggagaacataagaaactagcagaagcaatatttaaactaacatatcaaaataaggtagtgagagtacaacggcccaccccaagagggaccgtcatggacataatctcaagaaaagatcaaaggggttcaggtcaagtgggtacatatggactaaacacatttactaatatggaagcccaactaatacgacaaatggaaggagaaggcattttcaagagtatccaacaccttacagccactgaagaaatagcggtccagaattggctagctagggtgggaagagaacgattaagcagaatggcaatatcaggtgacgactgtgtagtaaagcccatagacgatagatttgcctccgcattaactgctctaaatgacatgggtaaggttcgcaaggatattcaacaatgggaacctagtagaggatggaatgattggactcaagtaccattttgttcgcatcactttcatgaactagtcatgaaagacggacgagtacttgtagtaccttgtagaaatcaggatgaattaataggacgcgcgaggataagtcaaggagccggatggagtttgaaagagactgcgtgtttaggtaaatcttatgctcagatgtggaccttaatgtattttcaccgaagggatttacgccttgctgccaatgctatatgtagcgcagtcccatctcactgggtacctacgagccgtacaacttggagtattcatgcgaagcatgaatggatgacgaccgaagatatgctagtagtgtggaaccgcgtttggatacaggagaatccctggatggaagacaaaacgcctgtagaaagttgggaggaagttccctacctgggtaagagagaggaccaatggtgcggaagcctcattggtttaacaagtcgagcgacatgggccaaaaacatccagactgcaattaatcaagtacggagtctaataggcaatgaggggtatacagactatatgccctcgatgaaaagatttcgtcgtgaggaagaagaagcaggtgttttatggtaa

SEQ ID NO: 22482 - RNA, 9876 nt, synthetic construct
  misc_feature 1..9876: note = derived and/or modified CDS sequence (opt6) from DENV-2__KC294220__SS-prME
  source 1..9876: mol_type = other RNA
acagccggtgtaattgttatgctaatacctacggcaatggcttttcatctaacgactcggaatggggaaccacacatgatagtaggtcggcaggaaaaagggaaatcactgctatttaaaacggaagatggtgttaatatgtgcacacttatggccatcgatttgggagaactatgtgaagatacaattacctacaaatgtcctttacttcgccaaaatgaaccagaagatattgattgttggtgtaattcgactagcacgtgggttacttacggtacgtgtacaactactggtgaacatagaagagaaaaacgaagtgtagcattagtacctcacgttggtatgggtctagaaactcgtaccgaaacatggatgtcttctgaaggagcatggaaacacgtacagagaatcgaaacatggattttacgacacccaggcttcacaataatggcggcaatattagcatacactataggtactacacattttcaaagagctcttattttcatattattaaccgctgtagcgccgtcaatgacaatgagatgtatcgggataagcaatagagactttgttgaaggagtgagcgggggatcgtgggttgatattgtattggagcatggcagttgtgtaactaccatggcgaaaaataaaccaactttggactttgaactcattaaaactgaagctaaacagccagcaacattaagaaaatactgtatcgaagctaaacttacaaatacgacaacagagagtcgttgtcccacgcagggcgagccgtctttaaacgaagaacaagataaacgattcatttgcaaacattcaatggttgatcgaggatgggggaatggatgtggtcttttcgggaaaggaggaattgttacttgcgctatgttcacctgtaagaaaaatatggaggggaaaatagtgcaaccagaaaatttagaatatactatagttatcacaccccattcaggtgaagaacacgcagttggtaatgatacgggcaaacatggtaaagaaataaaaatcacacctcaatcgagtaccacagaggctgaactcacgggctacggaacggttactatggagtgttcaccgaggacaggattggattttaatgaaatggtactactacaaatggaagataaagcctggctagtgcatcgtcagtggttcctggatttaccacttccctggcttcctggtgctgatacccaaggatccaattggatacagaaagaaactttggtgactttcaaaaatccgcatgctaagaaacaagacgttgtagtattaggttcgcaagagggagctatgcatacagctctcaccggggctacagaaatacagatgagttcaggaaatctacttttcacaggacatttaaaatgtagactacgcatggataaattgcagttgaaaggaatgagttactccatgtgcactggcaaatttaaaattgtaaaagaaatagcggaaactcaacacggaactattgttataagagtacaatatgaaggagacggttctccgtgcaaaatcccattcgaaataacagatctggagaaaagacacgtcttaggacggcttatcactgtaaaccccatagtaactgaaaaagatagtccggtaaacatagaagcagaacctcctttcggagactcctacattatagtcggggtagaaccaggtcaactgaaactaaattggtttaaaaagggatcgtctataggtcaaatgtttgaaactactatgcgcggcgctaaacgaatggctatcttgggagatacagcatgggatttcgggagtctagggggagtgttcacaagtattggaaaagcacttcaccaagtgtttggggcgatctatggggcagccttttcaggtgttagctggactatgaaaatactaatcggggtaatcatcacttggattggaatgaatagcagatcgacatcattaagcgtgagtctcgttttggtaggagttgtaacactgtacctaggagccatggttcaagctgattcagggtgcattgtttcgtggaaaaacaaagaattgaagtgtggcagtggaatttttattaccgacaacgtacatacatggacggaacagtataaatttcagccagaaagcccttcaaaattagcgtcagctatccaaaaagcacacgaagaagggatttgcggtataagatcggtcacaaggcttgagaaccttatgtggaagcaaatcacacccgaacttaatcatatcctatcagaaaatgaagtgaagttaaccataatgacaggggacattaaaggaataatgcaagccggtaagagatcgcttaggcctcaaccaaccgaattaaaatattcttggaaaacatggggaaaagcaaagatgctgtcaacggaatcacataatcaaacattccttattgatggacctgaaactgccgaatgcccgaatacaaatcgtgcttggaatagcttagaagtagaagattatggatttggggtatttaccacaaatatatggttaaaacttagagaaaaacaagacgtattctgtgactccaaactaatgagtgcagcaataaaagataaccgagccgtacacgctgatatggggtactggatagaaagtgctttgaatgacacgtggaaaatggaaaaagccagttttatcgaagtcaaatcatgccactggcccaagtcacacaccttatggtctaatggtgtattggaaagtgaaatgattattcctaaaaactttgcagggccagtatcacaacacaattacaggccaggatatcacacacaaaccgctgggccatggcatcttggaaaacttgaaatggactttgatttttgcgaaggaactactgtagtagtaacagaagactgcgggaataggggtcctagtttaagaacaacaacagcaagtggaaaacttatcactgaatggtgttgtcgttcttgcaccttaccaccattaagatatagaggtgaagatggttgctggtatggaatggaaatcaggcctctgaaagaaaaagaagagaatttagtaaatagtttagtcacagcaggtcatggccaaatcgataacttttctttaggagtattgggcatggctttatttctcgaagagatgttaagaacccgggttggtactaagcatgccatattgcttgttgcattatcctttgtaactcttatcacgggaaacatgtcgtttagagatttaggccgtgtaatggtcatggtaggagccacaatgacggatgatatcggtatgggtgttacatatttggctttgctagctgcgtttaaagtaagacctacgttcgcagcaggactattactaagaaaacttaccagtaaggaattaatgatggctacgattggaatcgctctgttatctcaatctacactaccagaaactatccttgaattaactgacgcgctagcgctagggatgatggccttaaaaattgttagaaatatggagaaatatcagctagcagtgaccattatggcgataagctgtgtaccaaatgctgttatacttcaaaatgcttggaaagttagttgcactatattagcagctgtctcagtatctcctctgctcctcacctcgtctcaacaaaaagccgactggatcccgcttgccctcacaatcaagggcttaaaccccacagctatatttcttactactctgagcagaacctccaagaaaagaagctggccactgaacgaggcaataatggcagttgggatggtatcaattctagccagtagtttattgaaaaatgacatacccatgacagggccacttgtcgcgggcggactattgacagtatgttatgtcctaacgggcagatcagccgaccttgaattagaacgggccgcggatgtaaagtgggaagatcaagcggaaatttcagggagtagcccaatcttaagcattacaataagtgaggatggatcaatgagcatcaaaaatgaagaagaggagcaaacattgacaatcttaattcgcactgggctgttggttataagcggggtgtttccagtgtcaatacccattacggcggcagcctggtatctatgggaagttaagaaacagagggcaggcgttttatgggatgtaccgagtccaccgcctgtaggtaaggcggaactagaagatggtgcatatcggataaagcaaagaggaattttgggttactcccaaattggtgccggggtatataaagaaggcacatttcatacgatgtggcatgttactagaggtgcagttttaatgcatcgagggaaaaggatagagccctcatgggccgatgtaaagaaggatttaatttcttatgggggaggttggaaactagaaggcgagtggaaggaaggagaagaagttcaagtgctggctcttgaacctggtaagaacccacgtgcagtccagacaaaaccaggaatatttaaaacgaatacaggaactataggagccgtttcgctagatttttctccaggaacaagcgggagcccaatcgtggatagaaaagggaaagtggtgggactatatgggaatggagttgtgacaaggagtggggcgtatgtatcagcaatagcacaaacagaaaagtccattgaagacaaccctgagatcgaagatgacattttccgtaagaaacgtttaaccatcatggacttacacccaggagctggtaaaaccaaaagatatttaccagctattgtaagggaggctataaaacgcggcctaaggacgctcattttagcacctactagagtagtcgccgcagaaatggaagaagccctaagaggtcttccaatacgataccaaacccccgccataagagcagaacataccggaagggaaatagttgatctaatgtgtcacgctaccttcactatgcgccttttatctcctgtacgtgttccgaattataacttgattataatggatgaagcacattttacagatcctgctagtatcgcagcaaggggttatataagcacacgagtagaaatgggtgaggctgcaggcatatttatgacagcaacccctccaggcagtagagatccgtttcctcaaagcaatgcacccataatggacgaagaacgtgaaatccccgagagaagctggaactctgggcatgagtgggttactgattttaagggtaaaactgtctggttcgttccttcaataaaagcaggcaatgatattgcagcatgcctgaggaaaaatgggaagaaagtaatacagttaagtcgaaaaacattcgattcagagtatgtaaaaacccgggcgaatgattgggacttcgtcgttacaaccgatataagtgaaatgggggctaacttcaaggcagaacgagttattgacccaaggcggtgtatgaaaccggtcatacttaccgacggtgaagaaagggtcatactcgcaggaccaatgcccgtgactcatagcagtgcagcacagagaagggggagaattggtagaaaccccaaaaatgagaacgatcaatacatatatatgggcgagccattagaaaatgatgaagattgcgcccactggaaagaggcgaaaatgctactcgataatatcaatacaccggaaggcattataccgagcatgtttgaaccagaacgtgagaaggtagatgctatagatggagaatacaggctgaggggtgaagcaaggaaaacttttgttgatctaatgagaagaggggacttaccagtatggttagcatacaaagtagcagcggagggaataaattatgcagacagaaaatggtgcttcgatggaataaagaataatcaaatattagaagaaaacgtcgaagtggagatttggacgaaagaaggagaaaggaaaaagctcaaaccaagatggctcgatgctcgtatttatagcgaccccctcgcgctaaaggaatttaaagagttcgcagcaggacgcaagtcattgactttaaatttaattaccgaaatgggacgactacctacttttatgactcaaaaagccagaaatgcccttgacaacctagctgtacttcacactgccgaagtcggcggtaaagcatatactcatgctcttagtgaattgccagaaaccttagaaacacttttgcttttaacactcctggcggcggttacgggtggtatatttttgtttctgatgtcaggtaaaggtataggaaagatgacattaggaatgtgttgcataataactgcttcgatactgttatggtatgcgcaaatacagcctcactggattgcagcgagcataatcctggaatttttcctaattgttttgttgataccggagccagaaaagcagcggacaccgcaagacaaccaattaacatacgtagtaatagcaattctgactgttgtagctgctacgatggcaaatgaaatggggttcctggagaagacgaagaaggatctaggattcgggtcgattacgacgcaagaaagtgaaagcaacatcctagatatagacctcagaccggcatcagcatggactctatacgccgttgcaacaacatttgtgacgccgatgttaagacactctattgaaaacagttcagttaacgtcagcttgacagccatagcaaatcaagcaactgtattgatgggtttaggaaaagggtggccgttatcgaagatggatattggagttcctttactagcgatcggctgttatagtcaagttaatcctataacacttactgcggcgctattgctactcgtagcccattatgcgataatcggaccaggacttcaagcaaaggcgacacgtgaagctcagaaacgagcggcggctggcatcatgaaaaatcctacagtcgatggaataacagtgatcgatctagaacctataccttatgatccgaaattcgaaaaacaattgggacaggttatgctcttaatattgtgtgttacacaagttcttatgatgagaacaacgtgggcgttatgcgaggctttaaccctagctacaggacccatttcaaccttatgggaaggaaatcccgggagattttggaacacgactatagctgtgtcgatggcaaacattttcagaggcagttaccttgcaggagcaggacttctattcagtataatgaagaacacaacaaatacgaggagaggcacaggaaatgtcggagaaactttaggtgaaaaatggaaatcgcgtcttaatgcattaggaaaatccgaatttcagatctataagaagagtgggattcaagaggttgaccggactcttgctaaggaaggaataaagcgaggagaaacggatcaccatgctgtttcgcgaggttcggctaaactacgatggtttgtcgagcgaaacatggtaacccccgagggtaaggtagtggatttaggatgtggtagaggaggatggagttattattgcggaggccttaaaaatgtacgcgaagtgaaaggacttactaaaggtggaccagggcacgaagaacctatccccatgtcaacttatggctggaacttagttaggttacagtcgggagtcgatgtgttctttaccccacctgaaatgtgtgatactcttctttgtgatatcggagaaagcagcccaaatcccacaattgaagcgggacgaaccttacgagtcttgaatctagtcgaaaattggttgaacaataatacacaattttgcattaaggtattaaacccatatatgccatcagtaatcgagaaaatggaaacattacaaagaaaatatggtggagcattagtaaggaatccattgtctagaaatagcacccacgaaatgtattgggtatcaaacgctactggaaatatagtatcaagcgtaaatatgatatcaagaatgttaataaatcgatttacaatgaaacataagaaagctacctatgagcctgacgtagatctgggatctggtacaaggaacatcggtatagaatctgaaatacctaacctggatattgtgggcaaaagaattgagaaaataaagcaggagcacgaaacgtcttggcactatgatcaagatcacccttacaaaacttgggcttatcatggatcatacgagactaaacaaactggtagtgcttcgtctatggtgaatggagtggtaaggctactcactaaaccatgggacgttgttccaatggtaacacaaatggcaatgaccgacacaacaccttttggacagcagcgcgtgttcaaagaaaaagtagacacaagaacacaagaaccaaaggaagggactaagaaattaatgaaaatcacggctgaatggttgtggaaggaactaggcaaagagaaaacacccagaatgtgtactcgagaagagtttacccggaaggtacgcagtaacgctgcgcttggagcggtgttcaccgacgaaaacaagtggaagtctgccagagaagccgtggaggacgggcgtttctgggaattagtagatagagaaagaaatctacatttggagggaaagtgtgaaacgtgtgtctacaatatgatgggcaaaagagaaaagaagttaggtgaatttggcaaagccaaaggaagcagggcaatatggtatatgtggctcggagcaagatttttagagtttgaggctctgggattcttgaatgaagatcattggttttcgcgtggtaattcgctatctggtgtagagggagaaggattacataggcttggatatatattaagagaggttgggaagaaagaaggtggtgctatgtacgcagatgatactgctgggtgggatacccgtattacattggaagatctcaaaaatgaggaaatggttactaatcatatgaagggtgaacacaagaaactagcagaagcaatatttaaactaacatatcagaataaagtggtccgtgtacagcgacccacaccaaggggtacagtaatggatataatcagcagaaaagaccagcgaggaagcggccaggtaggtacctatggtttaaatactttcacaaatatggaagcacaattaattagacaaatggaaggagaaggtatattcaaaagcatacagcacttgacagcaacggaggagatagccgtacaaaattggttagcaagggttggacgtgaaagattaagtagaatggcaatatccggggacgactgtgtagtcaaacctattgacgatagatttgcgtcagcgttaacagcactaaatgacatgggaaaagtaagaaaagacatacaacagtgggaacccagtcgaggttggaacgattggacccaagtaccgttttgcagtcaccatttccatgagctagtaatgaaagatggaagagtgttagtggtaccatgccgtaatcaagatgaattaatagggcgtgcaagaatatcccaaggtgcaggatggagtttaaaagaaactgcatgtctagggaaatcttatgcacaaatgtggacgctcatgtactttcatagaagggatcttcgcctagcagcaaacgctatctgttctgctgtgcccagtcattgggtaccaacaagtagaacgacatggtccatacatgccaagcatgaatggatgacaactgaagatatgctagttgtctggaatcgggtgtggatacaggaaaatccttggatggaagataagacgccagttgagagttgggaagaagtaccatatctagggaagagggaggatcagtggtgcggttctttgataggactaacaagtagggctacttgggccaaaaatatacaaacagctataaaccaagtacgcagtttaataggaaacgaaggttacacagattatatgccatcaatgaaaagatttagacgggaagaagaggaagcaggcgtcttatggtga

SEQ ID NO: 22483 - RNA, 9876 nt, synthetic construct
  misc_feature 1..9876: note = derived and/or modified CDS sequence (opt6) from DENV-2__KC294221__SS-prME
  source 1..9876: mol_type = other RNA
accgcgggtgttatagtaatgctgataccaacagctatggcctttcacctgacaacacgaaacggagaacctcacatgatagtcggtaggcaagaaaaaggaaaaagtttattgttcaaaactgaggatggagtcaatatgtgcacactaatggcaatcgatctaggagagctctgcgaggatacaataacttataaatgccctctcctccgacaaaacgagcccgaggatattgattgttggtgtaatagtacttcaacgtgggtaacttatggcacatgcactactaccggggagcacagaagagaaaaacgtagtgtagctttggtgccccacgtaggtatgggtctagaaacccgaacagaaacttggatgtcttcagagggcgcatggaaacacgttcagaggatcgaaacatggatattaagacacccgggttttacaattatggcagccatattagcttacacaattgggacaactcatttccagagagcattaatattcatattacttaccgccgtagcgccatcgatgacgatgagatgcataggaatatccaaccgagattttgttgagggagtaagcggtggatcgtgggtcgacatcgtgttagaacacggcagctgcgtgacaactatggcgaaaaataagcctacactagattttgaacttataaagaccgaagcgaagcagcctgcaacactcagaaagtactgcatagaagcaaagctaactaatactacaacagaatcccgctgccccacgcaaggggagccttccttaaatgaggaacaagataagagatttatttgtaagcatagtatggttgatcgtggatggggtaatgggtgtggattattcggtaagggaggaattgtcacatgtgcaatgttcacttgtaaaaaaaacatggaaggaaaaattgtacaaccagaaaatcttgaatatactatcgttataacccctcactcgggggaggaacatgccgtaggaaacgatacgggaaaaagaggaaaagaaatcaagataactccgcagtcatctactacagaagctgaattgacagggtacggaacagtaaccatggagtgcagccctcggacaggactggatttcaacgaaatggtgctcttacaaatggaggacaaagcttggctagtacatcgacaatggttcttagaccttcccctaccatggctacctggagcagatacacaggggtcaaactggatccagaaagaaacactagttactttcaagaacccgcacgctaaaaaacaggacgtggtggtacttggatctcaggaaggcgctatgcatacagccctcacgggggccacagaaatacagatgtcaagtggcaacctactatttactggtcacctaaaatgcaggttaaggatggacaaactgcagctaaaaggcatgtcatatagcatgtgcactggcaaatttaaaattgtaaaagagatagcagaaacccagcatggaactatagtcatacgagtccaatatgaaggtgacggctcaccatgcaaaatcccctttgagataacagatttggagaagagacatgttttagggagactcataacagttaaccccatcgtaaccgaaaaagacagtccagtaaatatagaagccgaacccccttttggtgatagctatataatagttggagttgagccaggccaactaaaattgaattggtttaagaaaggttcaagtatcggacagatgtttgaaacaacgatgcgaggggcaaaaagaatggccatacttggtgatacggcctgggatttcggctccctaggtggagtctttaccagcatagggaaagcactacaccaagtctttggcgcaatatatggtgcagcatttagtggcgtttcctggacaatgaaaattctaattggagttataataacctggataggaatgaactcaagatctactagcttgtctgtatcgctagttctcgtgggggttgtcacattgtacttgggtgcaatggtgcaagcagattcgggttgcatagtatcatggaaaaataaggagttaaagtgcggctccggtatatttattacagacaacgtccatacgtggaccgaacaatataaattccaacctgaaagtccaagtaaattagcatcggcaatacaaaaagcacatgaagagggaatctgcggtatcaggtctgtaacacgtttagagaacttgatgtggaagcaaataacaccagagctaaatcatatactcagtgaaaacgaagttaaactgacaataatgacaggtgacatcaaaggaattatgcaagcaggaaaaagaagtctacgcccgcagccgactgaattaaaatatagctggaaaacctggggaaaagcgaaaatgctcagtacagaatcgcataaccagacttttctaatagatggtcctgagaccgcggaatgtccaaataccaatagagcgtggaacagtctcgaggttgaagactacggatttggtgtattctcgacgaatatctggttaaaactccgggagaaacaggatgtattctgcgattcaaagttaatgtccgccgcaataaaagataacagagcagttcacgcagacatggggtattggatagaatcagcattaaacgacacctggaagatggagaaagcttcttttattgaagtaaaatcgtgccattggccaaagtcgcatacactatggagtaacggagtcttagaaagcgaaatgatcataccgaagaattttgcgggtcctgtttcacagcataactaccggcctggatatcacacacaaaccgctggcccgtggcatttaggcaaactcgaaatggatttcgacttctgtgaaggcacaactgttgtagtcaccgaggactgtgggaataggggtcctagtcttcgtacaactacggcttcagggaaacttattactgagtggtgttgcagaagttgcacactacctccacttagataccgaggtgaagacggatgttggtacggtatggaaataaggccccttaaggagaaagaggaaaatttagttaactctttggttactgccggacatggtcaaattgataatttctctctaggagtgttggggatggcattattcttggaagaaatgcttaggactagggtcggtactaaacatgcaattttgcttgtagctctttcctttgttacattgataactggtaacatgagctttcgagatctcggcagagtaatggttatggttggcgcaaccatgacggacgacattggaatgggggtaacatatttggcattattagccgccttcaaggttcggcctacattcgccgctggattgttattgagaaaactgacttcgaaagagttaatgatggcgactataggaatagccttattatcacaaagtaccctaccagaaactatactcgagctgacagacgcactcgccctaggaatgatggcactaaaaatagtaagaaatatggaaaaatatcaattagccgtcacaattatggcaatctcatgtgtaccaaatgctgtaatattacaaaacgcttggaaagtctcatgtacgattctggccgcggtttctgtctcaccgttacttttaacatcatcacaacagaaagcggattggatacccctagcattaaccataaaaggactaaatccaacagccatctttttaaccacattatcacgtacttctaaaaaacgaagctggcccttaaatgaagcaataatggcggtagggatggtttcaattctcgcatcttcattactgaaaaatgatattccaatgacaggaccattggtagcgggtggattactaactgtgtgctacgttttgacaggtcgttcagccgatctagaactagagagggcagcggacgtaaaatgggaagatcaagccgaaatcagtggcagcagccctatattaagtataacaatctcagaagatggttcgatgtcaataaaaaatgaagaagaagaacaaactttaacaatcctcataagaaccggtctgttggtgataagcggagtcttcccagtttccataccgattacagccgccgcgtggtacttatgggaggtaaaaaaacaacgtgctggtgtactttgggacgttccctctcctccgccggtaggtaaagctgaattggaagacggagcatatcgtattaagcaacgcgggatccttggatatagtcagatcggggcgggagtctacaaagaaggtacttttcatactatgtggcacgtcactcgcggagcagttctcatgcatagaggaaaaagaattgaaccttcatgggctgacgtaaaaaaagacctaatctcatatggaggggggtggaagttagaaggggagtggaaagaaggtgaagaagtgcaagtgctagcgctggagcctggaaaaaatccgcgagctgtacagacgaaacccggaatatttaaaacaaacactggaacaattggggctgtatccttagatttttccccaggtacttccggaagcccaatagtagatagaaaaggaaaagttgtaggcctatatggaaatggagtggtaacccgatccggggcatacgtatcagcaatcgctcaaacagaaaaaagtatagaggataatccggaaattgaagacgacatatttagaaaaaaacggttgacaatcatggatctccatcctggagccggtaaaacaaaacgttacctaccagccattgtccgagaggcgataaaacgaggtttaagaacgcttatactagcaccaacacgcgtggttgcagcagaaatggaggaagcactaagaggcctaccaatccggtaccaaactccagcaataagagcagagcatacaggacgggaaatcgtagatttgatgtgccatgcaacatttaccatgagattattatcacccgttagagtcccaaattataatctaatcataatggatgaagcacattttacagacccagctagcatcgccgccagaggatatatctccacacgcgtagaaatgggagaggcagccggtatattcatgacagccaccccaccaggctcaagagacccattcccacaatctaatgcaccaataatggatgaagagagagaaataccagagcggagttggaacagcggacatgaatgggtgactgattttaaaggcaagactgtatggttcgtgcctagtattaaagcggggaacgatattgctgcgtgcctacgtaagaatggtaaaaaggtaatccaactgagccgtaaaacctttgatagtgaatatgttaagacaagagcaaacgactgggattttgtagtaaccacagatatttctgaaatgggagcaaattttaaagcagaacgagtaattgacccaaggcgatgtatgaagccagtaattcttactgatggcgaagagagagttatacttgcaggaccaatgcccgtcactcatagctcagctgcccaaaggagaggaagaattggacgaaaccccaaaaatgagaatgatcagtacatatacatgggcgaacctctagagaacgatgaggactgcgcccactggaaagaagccaaaatgctactcgataatattaatactccagaaggaatcataccttctatgtttgaacctgagagagagaaggtagatgccattgatggtgaatacagactcagaggagaagcacgaaaaacgttcgttgatttaatgaggcgtggcgatctcccagtatggttagcttataaagtagcggcagaaggaattaactacgcagacagaaaatggtgtttcgatggaattaaaaataaccagatattggaagaaaacgtagaagtagaaatctggactaaagaaggcgaacgaaaaaaattaaagccgagatggctagacgcaagaatttattcagacccactcgctttaaaagaatttaaggagtttgcggcaggacgaaaatcattaacattaaatttaattactgaaatgggacgtctcccaacgtttatgactcaaaaggcacgtaatgccttagacaacctagcggttttgcacactgctgaagtgggcggaaaagcatacacccacgcactgtcagagttgccagaaaccctagagacattattattattaactctacttgcggcagtaacagggggaatattccttttcctaatgtccggcaaaggtatcggtaaaatgactctaggcatgtgttgtataataacagcaagcattcttttatggtatgcccaaatacaaccgcattggatagcggcttcaataatattagaattttttcttattgttctattgattcctgaacccgagaaacaacgaacacctcaagacaatcaattaacttatgtagttattgcaatcttgacagttgttgctgcaaccatggcgaatgagatgggttttctggagaaaactaagaaggatctaggtttcggcagcataactactcaggaaagtgaatcaaatatattagatatagacttacgtccagcaagcgcatggacgctttacgccgttgctactacttttgtcacaccaatgttaagacattctatcgaaaattcttcggtaaatgtttcactaacggctatagccaatcaagcgacagtactaatgggcctgggaaagggatggccattgtcgaaaatggatatcggagtaccacttttggcaatcggatgttattcgcaagtgaatccgattacactcaccgctgcccttttactcttggtagcgcattatgccataattggcccaggtttacaggctaaagcaactagagaagcacaaaagagagcggcagcgggaattatgaaaaatccaacagttgacggaattacagtgattgacctcgaacccataccatatgatccaaagttcgaaaaacaactgggacaagtaatgttgttaatactatgtgtaacacaagtcctaatgatgcgaactacctgggctttgtgtgaggccttaacattggcgacgggaccgataagtactttgtgggagggtaacccaggcagattttggaataccacaatcgcagtttccatggcaaacatattcagaggatcctacctggcaggcgctggcttattgttttctataatgaaaaatactacgaatacgaggagaggtactgggaatgtaggtgagactttgggagaaaaatggaaatcaagacttaacgctttaggaaaaagcgaatttcaaatatataaaaaatcaggtatacaagaggtagaccgcacactagcaaaagaaggaattaaacgaggcgaaactgatcatcatgcagtgtcccgaggatcagcaaaattaaggtggtttgtagaacgaaatatggtaacacccgaaggaaaagtagtagatcttggttgcggtcgaggggggtggagctactattgcgggggacttaaaaacgtacgcgaggtaaaaggacttactaagggaggaccaggccatgaggagccaatcccaatgtcaacatacggatggaacttagtacggcttcaatcgggagtagatgtcttcttcacaccccccgagaaatgtgatacacttctctgtgacataggtgagagttcaccaaacccaacaatcgaagcaggtcgtacactaagagtattaaatctcgtagaaaactggctcaacaacaatacacaattttgcattaaagttttaaatccatacatgcccagtgtgattgagaaaatggagacactccaacgtaagtacggaggagcattagtaagaaacccactatctagaaattcaacccatgaaatgtattgggttagcaatgcaaccgggaacatcgtatcttcagtgaacatgatatcacgtatgctaataaatcgatttacaatgaaacacaaaaaagccacttacgagcctgatgtggatttgggttcaggcactagaaacataggtatagaatcagaaatacctaatttagatatcgtaggaaaacgaatagaaaagataaaacaggaacacgaaacatcatggcactatgatcaagatcatccttataagacatgggcttaccatgggtcatacgaaaccaagcaaacaggtagtgcatcgagcatggtaaatggagtggtgcggctcttaactaaaccatgggacgtagtcccaatggttactcaaatggcgatgactgacactaccccatttggtcagcaaagagtatttaaagaaaaagtcgatacaagaacccaagaacctaaagaaggaacaaaaaaactcatgaaaataaccgccgaatggctatggaaggaactcgggaaagagaaaactcctagaatgtgcacaagagaggaattcacgaggaaagtacgatcgaatgcagcacttggagctgtattcactgacgagaataaatggaaaagcgctagagaagccgtcgaagacggcagattttgggaattagttgatagagaaagaaacctacatttagagggcaaatgtgaaacgtgcgtatataacatgatgggcaaaagagaaaaaaaattaggtgaatttgggaaagcgaagggaagtcgagctatatggtatatgtggctcggagccagatttctagaattcgaagctctcggatttttaaacgaagatcactggttctcccggggaaacagcctctccggggttgagggcgaaggactgcatcgactcggatatatccttagagaagttgggaagaaagaaggaggggcaatgtatgctgatgatacggctggctgggacacacgaatcacgcttgaggacttaaaaaacgaagaaatggtaacgaaccacatgaaaggtgaacacaaaaaattagcagaagcaatatttaagctaacttaccagaataaagttgttagagtacaacggcctaccccccgaggtacagtaatggatattatcagtagaaaagaccaaagaggcagcgggcaggtaggtacttatggactcaacacgtttacaaacatggaggcacaattgattcgtcaaatggaaggtgagggaatatttaaatccatccagcacttaacggcaacggaggaaatagctgtacagaattggttagcacgggtaggacgggaaaggcttagtcgaatggctatctctggagatgactgcgttgtcaaaccgattgatgataggtttgcctcagcactcaccgcattaaacgatatgggcaaagttagaaaagacatccaacaatgggaaccctcaagaggctggaatgactggacacaagtcccgttttgctcacatcactttcatgaactagttatgaaggacggtcgtgttttagtagtaccatgtcggaatcaggacgaacttataggaagggccagaatttcgcaaggcgcaggatggtcgcttaaagaaaccgcttgtctagggaaatcctatgcacaaatgtggaccttaatgtactttcacagacgtgatctacgtctagctgccaacgcaatctgtagtgcagtcccaagccactgggtccctacgagcagaacaacatggtcgatccatgccaagcatgaatggatgactacagaggatatgctcgtcgtatggaaccgagtatggatacaagaaaatccatggatggaggataaaaccccggtagaaagttgggaagaagttccatatcttggaaaaagggaagatcagtggtgtggaagtttgattggtctaaccagtcgtgcaacatgggccaaaaacatacaaacagcgattaatcaggtcagaagccttattggaaatgaaggttacactgattacatgcccagcatgaaaagatttagacgcgaagaagaagaagcaggagttctctggtga

SEQ ID NO: 22484 - RNA, 9876 nt, synthetic construct
  misc_feature 1..9876: note = derived and/or modified CDS sequence (opt6) from DENV-2__KC294223__SS-prME
  source 1..9876: mol_type = other RNA
acagctggtgtcattgtaatgctaataccgaccgcaatggcttttcatctcactactcgaaatggagaaccgcatatgatcgttggaaggcaggaaaaagggaaatcgctattgtttaaaactgaagatggagtaaatatgtgcactttaatggctatagatctaggcgaattatgcgaagacacgataacctataaatgtccattattgaggcaaaatgaaccagaagatatcgactgttggtgtaatagtacatcaacctgggtgacatacggtacatgtactaccaccggtgaacaccgacgagagaaaagaagcgttgcattagtacctcatgtcgggatgggcctagaaacgcgaactgaaacatggatgtcatcagaaggtgcttggaaacatgttcaacggattgaaacatggatcttaagacatccggggttcacaataatggctgcaatcctcgcttatacaatcggaacaacacactttcaaagagccttaatttttattttgctcacagcagtcgcaccttctatgaccatgagatgtataggtatatctaatagagattttgttgaaggggtgtctggtggaagctgggtcgacattgttttagaacacggatcttgtgtaactaccatggcaaagaataaacctaccttggacttcgaactaataaaaactgaagccaaacaaccagcgaccctacggaaatactgcatcgaagcgaaacttacaaatactaccactgaatcaaggtgtcccacacaaggagaaccgagtttaaacgaagaacaggataagaggttcatctgcaaacattccatggtcgatcgaggctggggaaacggctgtggacttttcggaaaaggagggatagtaacatgtgcaatgtttacttgtaagaaaaatatggaaggaaaaatcgttcagccagaaaatctggagtatacaattgtcattactccgcatagcggtgaagaacacgctgttggtaatgacacaggcaaacatggaaaagagataaagataactccacaaagctccactactgaagcagagttgacaggctatgggacagtgacaatggagtgctctccacgtacaggtctagatttcaacgaaatggtattgttgcaaatggaagataaggcctggttagtacatcggcaatggtttctagatttgccgttgccatggctccccggagcagatacccaaggttcgaattggatacaaaaagaaaccctagttacatttaagaatccccatgcaaagaaacaggacgtagtcgtattaggttcacaagaaggcgcaatgcatacagcgctgaccggagcaacagagatccaaatgtcgtcaggaaatcttttatttacgggacacttaaaatgtagattaaggatggataagctgcaacttaagggaatgagttatagtatgtgtacagggaagttcaaaatagttaaagaaatagcggaaacacagcatggaacgatagtcattagagtgcaatatgaaggagacggatctccgtgtaaaataccatttgaaataacggacttagaaaaacgacatgtacttggcagattaatcacagtcaacccaatagtcacggaaaaagactctccggtaaatatcgaggctgaaccgccgttcggagactcctatatcatcgttggagttgaaccagggcagctaaaactaaactggtttaaaaagggttctagtatcggtcaaatgtttgaaacaacgatgcgcggagctaaacgtatggcaattctaggtgataccgcatgggattttggatcgttaggaggagtctttacatccattggcaaagcattacatcaggtctttggagctatatacggggctgcgttctcgggtgtatcttggacgatgaaaattcttattggtgtaataataacctggataggcatgaacagccgaagcacttccctatcagtcagtctagtgcttgtaggagtcgtgactctgtatttaggtgcaatggtccaggctgacagcggctgcattgtatcgtggaaaaataaggagttgaaatgcggtagcggaatatttataacagacaacgttcatacatggactgaacaatacaaattccaaccagaatcaccaagtaaactagcatcagctatccagaaagcgcatgaagagggaatatgcggcataagaagtgtgacgagattagaaaacttgatgtggaaacagataacccctgagttgaaccacatcttgtccgagaatgaagttaaactaacaataatgaccggagatatcaaagggataatgcaagccggaaaaagatcgttacgacctcaacctacagagttaaaatatagctggaaaacctggggtaaagcaaagatgctaagcacagaaagtcataaccaaacgttccttatagatgggccagagacggcagaatgtcccaatacaaatagggcttggaactctctggaggttgaggactacggatttggagtctttactactaatatctggttaaaattgagggaaaaacaagacgtattttgtgatagcaagttaatgagcgcggcaataaaagacaatcgcgcggtgcatgcggatatggggtattggatagaatccgctctgaacgacacatggaaaatggaaaaggcttcgtttatagaagtaaagtcttgccattggccaaaatctcataccttatggagcaatggagtacttgaatcagagatgataattcccaaaaattttgctggaccggtttcacaacataattatcggcctggctatcatacgcaaacagcaggaccttggcatttaggaaagttagaaatggattttgacttctgtgaaggtacaacagtagtggtaacagaagattgtggcaatagagggccttctctaagaactacgacagccagtgggaaactaattacagaatggtgttgtagatcctgtacgctaccaccattacgttatagaggtgaggacgggtgctggtatggcatggaaatccggccactcaaagagaaagaagaaaacttggttaatagcttggttaccgctgggcatggtcaaatcgacaacttttcccttggcgtcttaggtatggcattgttcctcgaagaaatgctaagaacacgagtaggcacaaaacatgccatattgttagtagcgttgtcatttgtaactttaataacggggaatatgtcatttagggatctgggtagagtaatggtaatggtgggcgcaaccatgactgatgatataggcatgggtgttacataccttgcactgttagctgcatttaaagtaaggccgactttcgctgcgggcttattattaagaaaacttacatccaaggaattaatgatggccacgatcgggatagcattattgtcacaaagtacactcccagaaacgatattagaactaacagatgctttagcacttgggatgatggcactaaaaatagtcagaaatatggaaaaataccaactagcagtaacaataatggctatcagttgcgttccaaacgctgtaatcttacagaacgcctggaaagtatcctgcaccattctggcagcagtatcggttagcccacttctgctaacaagttctcaacagaaagcggactggattccgctcgcgttgacaattaaaggactgaaccctacggctatattcttgactaccctttcaagaacgtctaaaaagcgctcctggcccctaaacgaagcaataatggccgttggtatggtatcgatcctagcttcgtcgctattgaaaaatgacatcccaatgacaggaccacttgtagcgggtggattactaactgtctgttatgtactaactggaagaagcgcagacttagaattagagcgcgctgcggacgttaagtgggaagatcaggcagaaatatctggatcaagccctatcctaagtataactatctccgaagatgggtcaatgtcaatcaagaatgaagaagaagaacaaacattaactatactaattcgaacggggttactcgtgataagcggtgtcttcccagtctcgatcccaattacagcagctgcctggtacctatgggaagtgaagaaacaaagagcaggagttctctgggatgtaccatctcctcccccggttggaaaggcagaactcgaagatggagcttatagaattaaacagaggggtatcctcggctacagccaaatcggtgcaggagtatacaaagaaggtacatttcatacaatgtggcacgtgacaagaggcgcagtattaatgcatcgtggaaagcgaatagaacccagctgggccgatgtgaagaaagaccttatctcatacggaggaggctggaaattagaaggggagtggaaagaaggcgaagaagtccaagtactagcattagagcccggtaaaaatccccgtgcagttcaaacaaagccaggcatctttaaaaccaatacagggaccataggagcagtgagtttagattttagcccaggaacaagcggctcacctatagtagaccgtaaaggtaaggtagtaggattatatggaaatggggtagtaacaagatccggagcttacgtaagcgccattgcacaaactgagaaaagcatagaggacaatccagaaatagaagatgatatatttaggaagaaaagactaactatcatggacctacacccaggagccggaaaaacaaaacgctatttacccgccatcgtaagggaggccataaaacgaggactaaggactttaattttagctccaacacgagtagtagccgcagaaatggaagaagcgcttcgaggacttccaatcagataccaaactccggcgattagggcagaacatacaggacgtgaaatagtcgacttaatgtgccatgcaactttcacaatgagattgctctcgccagttagagttccaaattataatttaataatcatggatgaagcccacttcacagaccctgcaagtatagcagcaagaggatatataagtacaagagttgagatgggtgaagccgcaggaatatttatgacagccacaccaccaggaagtagggatccatttcctcaaagtaacgcaccaataatggacgaagaacgagagataccagagaggagctggaacagcggacatgaatgggttaccgattttaaaggcaagacagtttggtttgtcccatcaataaaagcaggcaatgatatagcagcttgcctacgtaaaaatggtaaaaaggtaattcaattaagccgaaaaacatttgatagcgaatatgtaaaaacaagggctaatgattgggatttcgtagttactactgatatttctgaaatgggagcaaactttaaggctgagcgtgtaatcgacccaaggcgttgcatgaaaccagtaatactcactgacggcgaagagagagttattcttgctgggccaatgcccgttacacactcttctgcggcacaacggagagggaggataggcagaaatcctaaaaatgaaaatgaccaatacatttacatgggggaaccattagaaaatgatgaagattgtgctcattggaaagaagctaaaatgcttttagacaacataaacacacccgaaggaattattccaagtatgtttgaaccagaaagagaaaaagttgacgcaatcgatggagaataccgactaagaggggaagcaagaaagacgtttgtggatcttatgagaagaggggatctccccgtgtggttagcgtataaagtagctgcggaaggtattaattatgcagatagaaaatggtgcttcgacggtatcaaaaataaccaaattttagaagaaaatgtggaagtggaaatatggactaaggaaggtgaaagaaagaaattaaaacccagatggctggatgctcgtatttattctgatcctctagccttgaaagaatttaaagagttcgctgcgggtagaaaaagtctaacgctaaacttaatcactgaaatggggagactaccaacttttatgacgcaaaaagccagaaacgcacttgacaatcttgccgtacttcacaccgcggaagtaggcggaaaagcatatacacatgcgttatcagaactacctgaaaccctagaaacgttactccttctaacattacttgccgcagttacaggcggaattttcttattcttaatgtcaggcaaagggataggaaaaatgacattagggatgtgctgtataataaccgcaagtatattgctatggtacgctcaaattcaaccgcactggatagctgcgagcataattttggagttcttcttgattgtattactaattcctgaacctgaaaaacagcgaacaccccaagataaccagctgacctatgtggtgatcgcgatcctaacagtcgttgcagcgacaatggcgaacgaaatgggattcttagagaaaactaagaaagacttaggtttcgggtcaataactacccaggaatcagagtccaatatcctagatattgatttgcgacccgctagtgcatggacattatacgcggtcgccaccactttcgtaactccaatgttacgtcacagcatagaaaacagttcagttaatgtgagtttaaccgccatagcgaaccaagcaacagtccttatggggctgggaaaagggtggccactatcaaaaatggacataggggtgcctctactagcaataggatgttattcccaggtgaatccaattactttaacagctgcacttttacttctagtagcacactatgccataataggcccaggcttacaagctaaggcgactcgggaagcgcaaaagcgagcagccgccggtataatgaaaaacccgacggtagacggaataactgttatagatttggaaccgatcccttacgacccgaaattcgaaaagcaattaggccaagtaatgctcttgatcctgtgcgtaacccaagtcttaatgatgaggacgacttgggcattatgcgaagcgttgactcttgcaacaggtcctataagtacgttatgggaaggcaacccggggagattctggaacacaaccatagccgtctctatggctaatatcttcaggggttcttacttagccggtgcgggccttctctttagtataatgaagaacacaaccaacactcggagaggcacaggtaatgtaggggaaacgttgggagaaaaatggaaaagtagactgaacgcgctcggtaagtccgagttccaaatctataagaaatcaggtatccaggaggttgatcgtactctagccaaagaagggataaaaaggggagaaaccgatcaccacgcagtaagtagggggagtgctaaattaaggtggtttgtagaaagaaacatggtgactccagaaggtaaggttgtagatttgggatgtgggcggggagggtggtcatattactgtggcggcctgaaaaatgtacgagaagttaagggactcacaaagggaggaccaggacatgaagaacctatcccaatgagcacttatggatggaatctcgtaaggctccaaagtggtgttgatgtattctttacaccacctgaaaaatgtgatactttattatgcgatatcggagaatcttcgccgaaccctacgatcgaagccggtagaaccttaagagtattgaacctcgttgaaaattggttaaataacaacacacaattctgcataaaggtgcttaacccatacatgcccagtgttatagagaaaatggaaaccttacaacgtaaatatggaggcgcattggttagaaaccctttatcaaggaacagtacgcatgagatgtattgggttagcaacgcaactggtaatatagtaagcagcgtgaatatgattagcaggatgttaattaatcgtttcacaatgaaacacaagaaagccacatatgaaccagatgtagatctagggagtggtacaagaaacataggaatagagagcgaaattcctaaccttgacatagttggtaaacgaatagagaaaataaaacaagaacacgaaacaagttggcactatgaccaagaccatccatacaagacctgggcgtatcatggctcatacgaaacaaaacagaccggtagtgcttcgtcaatggtgaacggggtcgtacgacttttaacgaaaccatgggatgtcgtccccatggttactcaaatggccatgacggacacgacacccttcggtcaacaacgtgtattcaaagaaaaagtagatacaagaacacaggaaccgaaagaaggaactaagaaactaatgaaaataacagccgaatggttatggaaagaattaggaaaagaaaagacaccgagaatgtgtacaagagaagaatttacacgcaaagtaaggagcaacgcagcgttaggtgctgtctttaccgatgaaaacaagtggaagtccgcgagagaggctgtagaagacggacgattttgggaattggtagacagggagcgtaatttacatctcgaaggaaagtgcgaaacgtgtgtctataatatgatgggtaaaagagaaaagaagctcggagagtttgggaaagctaaaggaagcagggcgatatggtatatgtggctaggtgcaaggttcttagaatttgaggctttagggtttctaaatgaagaccattggttctcccgcggtaattcactgagtggtgtagagggtgaagggctgcaccgtcttgggtatatattacgagaagtgggaaagaaggaaggtggggcaatgtatgcagacgatacggccggttgggacacacgcatcacattagaagatctaaagaacgaagaaatggtcacaaatcacatgaaaggagaacacaaaaagttagcagaagcaatatttaaactaacttaccaaaacaaggttgtgcgcgtccagaggccgacgccaaggggcactgtgatggacataatttcaagaaaagaccaacgaggaagcggccaggtgggcacatacggcctgaatacattcaccaatatggaagcccaacttatacgtcaaatggaaggagagggaatattcaaaagtattcaacacttgacagcaactgaggaaattgcagtccaaaactggttagcacgtgtggggagggagagactctcaaggatggctattagtggcgatgactgtgttgttaaaccaattgacgacagatttgcgtcagccttaacagcgttaaatgacatgggaaaagtaagaaaggacatccagcagtgggaaccatcacgcggttggaatgactggacgcaagtaccgttttgcagccaccatttccacgaattagtcatgaaagatggacgggttctggttgtaccatgcagaaatcaagacgaacttataggacgagctcgcatatcgcaaggtgcaggatggagtctcaaagaaaccgcgtgcctcggaaaatcatacgctcagatgtggacattgatgtattttcatagaagggacttaagattagccgctaacgcaatatgcagcgctgtcccatctcactgggtgcctacaagtagaacaacctggagtatacacgctaagcatgagtggatgacgacggaagatatgcttgttgtatggaaccgcgtatggatacaagaaaatccttggatggaggataaaaccccagtcgaaagctgggaagaggttccgtacctgggtaaacgggaagatcaatggtgcggatcactaattggactaacatcaagagcaacatgggccaaaaatatccagacagccataaatcaggtccggtccctgattggaaatgaggggtataccgattatatgcccagtatgaaaagatttcgaagagaagaagaggaagccggcgtattatggtga

SEQ ID NO: 22485 - RNA, 9876 nt, synthetic construct
  misc_feature 1..9876: note = derived and/or modified CDS sequence (opt6) from DENV-2__FJ906959__SS-prME
  source 1..9876: mol_type = other RNA
acagcgggaatgattataatgttaatacctacagtaatggcatttcacctgacgacaaggaacggcgaaccacacatgatagtatcacgccaagaaaaaggtaaatccctattattcaaaacagaagatggagtaaatatgtgcacattaatggcaatggacctaggagaactgtgcgaagatactattacctataaatgtcctttcctcaaacaaaatgaaccagaagatatagactgttggtgtaattcaacaagtacgtgggtaacatatggtacttgtacaactaccggagaacataggagagagaaaagatctgttgctctggttccccatgtaggaatgggattggaaactcgtactgaaacttggatgtccagtgaaggagcttggaaacacgcacaacgcatagaaacatggatattaagacaccctggatttacaataatggcggcaatactagcatacacgataggaactacacactttcaacgtgcactaatttttatattattaacagcggtagcaccctccatgacaatgcgatgcattggaatatcaaaccgagattttgtggaaggtgtatcaggtggatcatgggtagacatagttttggaacacggttcttgtgttactactatggctaaaaataaacccactttggattttgaacttattaaaacagaagccaaacaacctgcaactctacgaaaatattgtatagaagctaaactgacaaatacaaccacagacagtagatgcccaacacaaggcgaaccatctctaaatgaagaacaagacaaaagattcgtctgcaaacattcaatggtagaccggggatggggaaatggctgtggcctgtttgggaaaggtggtattgtaacatgcgctatgttcacatgcaaaaagaatatgaaggggaaagtagtacaaccagaaaatcttgaatatacaatagtaataacaccccattcgggtgaagaacatgcggtgggtaatgatacaggcaaacatggaaaagaaataaaaatcacacctcaatcgtcgattacggaagcagaactaacggggtatgggactgtcacaatggaatgttctccgcgtacaggtctcgacttcaatgaaatggttctccttcaaatggaaaataaggcttggctagtgcacaggcaatggtttctggatttacctttaccatggttaccaggtgcagacactcagggaagcaattggatacaaaaagaaaccctggtcacgtttaaaaatccacatgccaagaaacaggacgtagtggtattaggttctcaagaaggagccatgcacacggctctaacaggtgctacagaaatacagatgagctctggaaatcttttatttacgggccatttaaaatgtagactgagaatggacaaactccaactaaaaggtatgagctacagtatgtgcactggaaaattcaaagtcgtcaaagaaatcgctgaaacccaacacggcacaatcgtaatacgggtacaatacgaaggcgatggaagcccctgtaaaataccattcgaaatcatggacttagagaaaagacacgtcctaggaagattaataaccgttaatccgatagtgacagaaaaagactctccagttaatattgaagcagaaccaccttttggagattcttatataattataggagtagaaccgggacaattaaaactaaattggtttaagaaaggaagttcaatagggcagatgatcgaaaccaccatgcggggagcaaaacgtatggcaatcttaggggacaccgcatgggatttcggatctctaggaggggtattcacctcaatcgggaaagcactacaccaagtcttcggagcaatatatggtgcagcctttagtggagtcagttggattatgaaaatcctgattggagttatcataacttggattgggatgaactcaagaagtacatccttatctgttagtcttgttctggtcggagtagttacactgtatctcggtgttatggttcaagcggactctggatgcgttgttagttggaaaaacaaagaactaaaatgtggttctggcatttttataacagacaacgtacacacttggaccgaacaatacaaatttcagccagaaagtccgtcgaaattggcgagcgctatacaaaaggctcatgaagaaggaatatgcggcattagaagtgtaactcgtttagaaaacctaatgtggaaacaaataacacccgaattaaatcatattttaagtgaaaacgaagtaaaacttacgattatgaccggagacataaaaggaattatgcaagcgggaaagcgcagtttacaaccacagccgactgaactcaaatattcgtggaaaacatggggaaaggccaaaatgctatcaacagaatctcataaccagactttcttaatagatggtcctgaaacggcagaatgtccaaatacgaatagagcttggaacagtctagaagtcgaagactacgggttcggtgtatttactacgaacatctggttaaaattaagagaaaaacaagacgtcttttgcgactcaaagctcatgagcgccgcgatcaaggacaaccgggctgtacacgctgacatgggatattggatcgaatcagctctgaatgatacatggaagattgaaaaggcttcattcattgaagtcaaatcatgccattggccgaaaagccacacactatggagcaatggtgtgttagaaagtgaaatgatcattcctaagaatttcgcaggtcctgtttcacaacacaactatcgaccaggttatcacactcagactgctgggccatggcacttaggcaaattggaaatggattttgacttctgtgaaggaactacggttgtggtaacggaagactgcggaaacagaggcccctccttacgtaccacaacagccagtggcaaattgataacagaatggtgctgtcgatcctgcactctgccaccattgagatatagaggtgaggacgggtgttggtatgggatggaaatcagaccattaaaggaaaaagaagaaaatctcgtcaattcgctcgttactgcgggacatggtcaaatagacaactttagcctaggcgttctgggcatggctttgtttctagaagagatgttgagaacacgagtggggacaaaacacgcgatactgttggtagcagtttcattcgtaacattgatcacaggcaacatgtcatttagagaccttggtcgcgtcatggttatggtaggagcaaccatgacagatgatattggcatgggcgtaacatatctagcgctattagccgcattcaaagtcagaccaacattcgctgccgggctactacttagaaaactaacctctaaagaacttatgatgacaactatcggcatagtactactttcacaatcgaccatacccgaaacaatactagagcttactgatgcccttgctctaggtatgatggtcttaaaaatggtgcgcaaaatggaaaagtatcaactcgcagttactataatggcaatattatgtgtacccaatgcagtgatacttcaaaatgcgtggaaagtttcatgtacgatattagcagtagtgagcgtatctcctttatttttaacaagttcgcaacaaaaagcggattggattccactggcattgacgatcaagggcttaaacccgactgcgatattcttaacaactttatcaagaacaaataaaaagagatcatggcccctaaatgaagcaataatggctgttggcatggtaagtattctagcatcgtcactattaaagaatgatataccaatgacaggtcccctagttgccggtgggcttctgactgtttgttatgttttaacaggacgatcagcagatctagaacttgagagggcagcagatgttaaatgggaagatcaagcagaaatttcgggatcaagtcccattttatctattactatatccgaagacggcagcatgagcatcaaaaatgaggaggaagaacagacgttaacgatccttataaggacaggtcttctggtcatcagcggactattccctgtgtctatacctataaccgcagcagcttggtacctgtgggaggtcaagaaacaacgagcgggtgtattatgggatgtaccaagtccgccaccagtaggaaaagccgagctcgaagatggggcgtaccgtataaaacaaaaaggaattttaggttattcacagataggggctggagtttataaagaaggaaccttccatacgatgtggcacgtcacaagaggagcggttcttatgcacaaggggaaaagaatcgagccatcgtgggcggatgtgaagaaagatttgataagttacggtgggggctggaaattggagggtgaatggaaggaaggtgaagaagttcaagtgttagcattggaacctggtaaaaaccccagagcagtacaaacaaaaccagggctgtttaaaaccaacgcgggtaccatcggagctgtgagtttagacttctcgcccggcacttcgggtagtcccattattgataagaaaggaaaagtagtaggtttatatggaaacggagtggttacgagaagcggggcctatgtgtctgcaattgcgcagaccgagaaaagtatagaagataaccctgaaattgaggacgacatatttcgaaaaaggaaactgaccataatggatcttcatccaggagcaggaaagacaaaaagatatttacccgcaatagtaagggaagcaatcaaacgaggactgcggactctcatcctcgcgccaacgagagttgtggcagcagaaatggaagaagcgttgagaggacttcccataagatatcaaactcctgctatacgagcagaacatactggtcgtgaaatcgtagatttgatgtgtcatgccacatttacaatgagacttctatctccagtacgggttccaaactacaatcttatcattatggatgaagcacactttacagacccggccagtatagccgctagaggttacataagtactagagtagagatgggagaggccgcaggaatatttatgacagctaccccgcccggtagccgagacccattccctcagtcgaatgcccctataatggatgaggagagagaaattcctgaaaggagttggtcaagtggtcacgaatgggtaacagactttaaaggcaaaactgtatggttcgtaccatcaattaaagcggggaatgacattgcagcttgtctgaggaaaaacggtaagaaagttatacaactgagccgaaaaacatttgactcagaatatgtaaagacaagaactaacgactgggacttcgtagttacaactgacataagtgaaatgggagcgaacttcaaagcagaacgcgtaatcgacccacgaagatgcatgaagccagtaattctaacagatggggaggaaagagttattttagccgggccgatgcctgtgacccattctagcgctgctcaaagaagaggtagaatcggcagaaatcccaaaaatgagaatgatcaatatatctatatgggcgaacctctagaaaacgacgaggattgtgcccactggaaagaagcaaagatgcttctcgacaacatcaacacgccagaaggaatcataccgtctatgttcgagccggaaagagaaaaagtagatgcaattgatggagaatacagactgagaggggaagcaagaaagacgtttgttgatctaatgagacggggagacctacccgtttggttagcatatcgagtggcggcagagggaataaactatgctgacaggagatggtgcttcgatggaatcaaaaataatcaaatactggaagaaaatgtagaagtagaaatatggactaaggaaggtgagcgtaagaaattaaaaccgagatggttagatgctcgtatttattcggacccattggcattgaaagagttcaaggagttcgcagcagggaggaaatcattaactcttaatttaattactgagatgggaagattaccaacatttatgacccaaaaagcaagggatgcactggacaatcttgcagtattgcataccgcggaagccgggggccgcgcatacaatcatgctttgagcgaacttcccgaaacccttgaaacattgttgttacttacactacttgcgacggtcaccggtggaatcttccttttcctaatgagtggaaggggtattggtaaaatgacacttggaatgtgctgtataataaccgcaagtattctattatggtacgcacagatacagccacactggatagctgcaagtataatattagagttcttcttaatcgtgttactcatacctgagccagaaaaacaacgtaccccgcaggacaatcaattaacttatgtggtaatagcgatcctaacggttgtagcagcaaccatggcaaatgaaatgggattcttagaaaagaccaagaaagatctaggactaggttcaattacaacacaacagccggaatcaaatattttagacattgacctgagaccagcatcagcatggaccctatacgcggtcgccactacttttgtaaccccaatgcttaggcattcaatcgagaactccagtgttaatgtgtctcttacagctatcgcaaaccaagctacggtactaatgggactaggaaagggatggcccctcagcaaaatggatatcggggtaccattgctagcaataggttgctacagtcaagtaaacccaataaccctaactgccgctctcttcttactggtagctcactatgctatcatcgggccgggacttcaagctaaagccacgcgtgaagctcagaaaagagccgctgcggggataatgaagaatcctacagtagatggtatcacggtaattgatctagacccaatcccatatgacccaaaattcgaaaagcagctcggtcaagttatgctcttagtactttgcgtaacgcaagtactgatgatgcgaactacatgggcgttatgcgaggctttaaccctagcaaccggcccgataagtacattatgggaaggaaacccgggtagattttggaatacaacaatagcagtaagcatggctaatatcttcagaggttcttacttagcgggagctgggctactcttctcaattatgaaaaataccactaatacacggcggggaaccggaaatattggagagacgctcggcgagaaatggaagtcacgcctcaatgccctaggcaaaagcgagttccaaatatataagaaatcgggaatccaagaggtcgatagaactttggctaaggagggcataaaaagaggagagacggaccatcatgccgtatctagaggttctgcaaaactacggtggttcgtagaaagaaatatggtaacgcctgaaggtaaggtagtagatttaggatgtgggaggggtggatggtcatattactgtggcgggctcaaaaatgtgcgagaagtaaaaggtctaaccaaaggagggccgggacatgaggaaccaattcccatgagcacatatgggtggaacttagtgcgacttcaatcaggtgttgatgtcttctttacccctccggaaaagtgcgatacactcttatgcgatatcggtgaatcgagtccaaatcctaccgttgaagccggcagaacgttacgcgtccttaacttagtagaaaactggttgaataacaacactcaattttgcatcaaagtacttaacccctatatgccatcagttatagagaaaatggaggccctacagagaaaatatggaggtgcattggtacgtaatcctctatcacgcaattccactcatgaaatgtactgggtgtcaaatgcaagtggtaacatcgtctcatcagtaaacatgataagcagaatgctaattaaccgcttcacgatgcgtcacaagaaagcaacgtacgaacccgatgtcgatctgggaagtggaacacgaaatataggaatagaaagcgaaattccaaatctcgatattattggcaaaaggattgagaaaataaaacaagagcatgaaacatcatggcactatgaccaagaccatccatataaaacatgggcatatcatgggtcatacgagacaaaacaaaccgggagtgcaagcagtatggtaaatggagtagtaagactacttacaaagccttgggacgtagtcccaatggtaacacagatggccatgacagacacaactcctttcggacagcaaagagtattcaaagagaaagtggataccagaactcaagaacccaaagaaggcaccaagaaactaatgaaaataacagcggagtggttatggaaagagctcgggaagaagaaaacaccaaggatgtgtactagagaagaatttacgcgaaaagtaagatcaaacgctgcattaggagctatttttacagacgaaaacaaatggaaaagtgctagggaagccgtggaagattcaaggttttgggagttagtagacaaagaaagaaacctccaccttgaaggtaagtgcgagacatgtgtatacaatatgatgggaaaaagagagaagaaacttggggagttcgggaaagcgaaggggagtagagcaatatggtatatgtggttaggagcccgtttcctagagttcgaagcactgggattcctgaatgaggaccactggttttcacgagaaaattccctaagtggcgttgaaggggagggactacataaactgggctacattttacgagacgtttccaagaaagaaggaggagctatgtatgctgacgatactgctggatgggacacaaggataacactagaagatctgaaaaacgaggaaatggtaactaaccacatggaaggcgaacataagaaactagccgaagctatatttaaacttacgtaccaaaataaagttgttagagttcaaagaccaacacctaggggaactgtcatggatataataagcagaagagaccagcgcggtagcggccaggtcggaacgtatggcttaaacacttttacaaacatggaagcacagctaatacgacaaatggagggcgagggagtatttaaatcgattcagcatttgactgtaactgaggaaatagcagtacagaactggcttgctagggtcggacgagagcgactatcaagaatggctataagcggtgatgattgtgttgttaaaccattagacgataggttcgctagtgcactaacggcccttaatgatatgggtaaagtacgaaaagatatacagcaatgggaacccagcagaggttggaacgattggacacaagtacctttttgctcacatcacttccatgaattaattatgaaagatggcagagtacttgtagttccgtgtagaaatcaagatgaattgattggccgtgcacgaataagtcaaggtgccggttggtcactgagagaaacagcctgcttagggaagagttatgcccagatgtggagtctcatgtactttcatagaagggacttaaggctggcggcaaatgccatatgcagcgctgtccccagccactgggtaccaacttcccgtacaacgtggtccatacatgcaaaacacgaatggatgaccacagaagatatgctaactgtatggaatagagtatggatacaggaaaatccttggatggaagataagactcccgtcgaaagctgggaagaaattccatatctaggcaaaagagaagatcaatggtgtggtagtctaataggactcacatcaagagctacatgggctaaaaatatccaaacagctattaatcaagtacgaagtctaataggaaatgaagaatatactgattacatgccatctatgaaaagatttcgtcgggaggaagaggaagctggagttttatggtag

SEQ ID NO: 22486 - RNA, 9876 nt, synthetic construct
  misc_feature 1..9876: note = derived and/or modified CDS sequence (opt6) from DENV-2__KF360005__SS-prME
  source 1..9876: mol_type = other RNA
actgcaggggtgattatcatgcgcatccctactgcaatggcatttcaccttactacacgcaatggggaacctcatatgatcgtttcaaaacaagaaaaaggtaaatctttattattcaaaacagaagatggcgttaatatgtgtacactaatggcgatggacctaggagaattatgtgaagatacgataacatataattgcccactattgcggcaaaacgaacctgaagacattgattgttggtgtaatagcacaagtacttgggttacatatggcacttgcactgcgacaggagaacatcgacgtgagaaaagatctgttgcgctagttcctcatgtagggatgggtttagaaacaagaacagaaacctggatgtcatcagagggcgcatggaaacatgctcaaaggattgaaacgtggatccttcgacatccgggtttcacaataatggcagctattctagcttataccataggaactacatatttccaacgagtactcatatttatcttattaaccgcagttgcaccatctatgacaatgcggtgcatcggtatatctaacagggatttcgtagaaggcgtatctggtggatcttgggtagatattgtgttagagcacgggagttgtgtgacaacaatggctaaaaacaaaccgacactagattttgagttaatcaaaactgaagcgaaacaaccagctacattaagaaaatactgtatagaagcaaaattaaccaatacaacgactgccagtcgttgcccaacccagggggagccgagtttgaatgaggagcaagataaaaggtttgtttgcaaacactccatggtaggtagaggctggggagatggttgtggactctttggaaaagggggtattgttacttgcgctatgttcacttgcaagaaaaatatggagggaaaaatagtacaacccgaaaatttagagtacactatagtggtaacaccccattctggtgaggaaaacgcagtaggaaatgacacaggtaaacacggaaaagaaatcaaagtaacgccccaaagttccataacagaggcggagttaacaggctatggtacagtaaccatggaatgtagcccgaggacaggactggattttaatgaaatggtattgctgcaaatggaaaacaaagcatggcttgtccacagacaatggttcctagatctaccactaccttggttaccaggcgccgatatacagggaagcaattggatacaaaaagagaccctggtaacatttaaaaaccctcacgccaagaaacaggacgtagtagtacttggttcccaggaaggagcgttacacactgcactgacaggtgcaacggagattcaaatgtctagcggtaatttactattcactggacatctaaagtgtagattgaggatggacaaacttcagttaaaaggtatgtcatattcaatgtgcacagggaaattcaaagtcgtaaaggaaatagcagaaactcaacatgggacgatagttgttagaatacaatatgagggagacggttcgccatgtaaaataccttttgaaataatggatttggaaaaacgccatgtgcttgggagattaataaccgtaaatccgattgtaacagaaaaagattcaccagttaatatagaagcggaaccaccttttggcgactcgtacataattataggagtcgagccaggccaacttaaactttcctggttcaagaaagggagctctattgggcaaatgtttgaaactaccatgcggggtgcaaagagaatggcgatactaggggatacagcatgggatttcggatcattaggaggagtcttcacaagtatcggaaaagcgttgcaccaagtgtttggtgcaatttatggagctgcctttagcggggtatcttggacaatgaagatactcattggcgtggtaatcacttggatcggaatgaatagcagatctacaagtctctccgtgagcttagtactcgtgggagttgtcactctttatcttggggtaatggttcaagcggacagtgggtgcgtagtgtcttggcgtaataaagaactgaaatgtggttctggaatattcataacagacaatgttcacacatggacagaacaatacaaattccaaccagaaagtccatcaaagttagctagcgcaatacagaaagcacatgaagaaggaatatgcggaattaggagcgtaacacgtttagaaaacctaatgtggaaacaaataactccggagctaaatcacatactgtcagagaatgaagttaaattgagcatcatgacgggtgatataaaaggaattatgcaagcaggaaaaaggagtttaaggccacagccaactgaactaaaatacagctggaaaacgtggggtaaagcgaaaatgctctccaccgaaccacataatcagacatttctcatcgacggtcctgaaacagccgaatgcccgaatactaacagggcctggaactctttagaagtagaggattacggctttggagtattcactacaaatatatggttaaagttaaaagaaaggcaagatgtattttgtgacagcaaactaatgagcgcagcgatcaaagataaccgagcggtacatgcagacatgggttactggatagaatcagccttaaatgatacctggaaaatagaaaaggccagcttcatagaagttaaaagttgtcattggccaaaatctcacacgttatggagcaacggcgtactagagtccgagatgataatacccaaaaattttgcaggacccgtatcacaacataattatagaccaggataccatacacagactgcggggccgtggcacctaggtaaattagagatggatttcgatttctgcgaaggaacaacagtagtcgtaacagaggattgcggtaatcgaggacctagtcttagaactactacggcatccggtaaactcatcactgaatggtgttgccgctcatgcacgctaccaccgttaaggtacagaggggaggatggttgctggtatgggatggaaattcggccattgaaagagaaagaagaaaacttagtcaactctcttgttacagcaggacacggacagattgacaacttttcactaggagtcttgggtatggctttatttttagaggagatgctccgaacccgcgtagggacaaaacacgctgtactgctcgttgctgtctcattcatgaccttgatcacaggcaacatgagttttagagaccttgggcgtgtaatggttatggtcggtgcagcaatgacggacgatattgggatgggtgtcacttacctcgcactgcttgctgcattcaaagtaagacctaccttcgcagcaggtctacttttaagaaaacttacctcaaaagaattaatgatgacaacgattggaatagtactcttaagtcagtcaactacaccagaaacaatattagagctcacagacgcattagcattgggtatgatgatcctaaagattgtacgaaatatggagaaatatcaactcgcagttacaattatggcaattttatgtgtgcctaatgcagtcatattacagaacgcctggaaagtaagttgtacgattctagccgctgtatcagtttcaccattgctcctaacaagtagccaacaaaaagctgactggatacctttggctttaacgattaaaggattaaatcctactgcaatcttcctcaccactttgagcagaactaataagaaaaggtcttggccgctgaatgaggctataatggctgttggaatggtcagtatattagcatctagcctactaaagaatgatatacctatgaccggtcctctagtagctggcggactgctcacagtatgctatgtgttaaccggcagatctgctgacctagagctggaaagagctgcagacgtccgatgggaagatcaagccgaggtctcaggatcatcgccaatattaagcataactatctctgaggacggaagtatgtccatcaaaaacgaggaagaagaacagactttaacaatactaatacgtacaggactattggttatatcgggcttgtttccagtatcaatcccaatcactgctgcggcttggtatctatgggaagttaagaaacaacgcgcgggggtgctaagtgcagtgccatctccaccgcccgttgggaaagccgagttagaagatggagcttatagaattaaacaaaaaggcattctaggatatagtcaaattggggccggtgtttacaaagaaggaacatttcatacaatgtggcatgtaacccgaggcgcggtacttatgcacaaaggcaaacgtatagagccttcgtgggcagatgtgcgcaaagatctcataagttatggagggggaagaaagttagaaggtgagtggaaagagggggaagaggtgcaagtgctggctcttgaacctggcaaaaatccgcgtgcagtacaaacaaagcctggtttatttaagacaaatactgggacaataggcgcagttagcttggacttttcaccaggggcctcaggaagtccaattgttgacaagaaaggaaaagtagtgggattatacggtaatggtgtagtcaccagaagcgggacttatgtcagcgcgatagcccaaacggagaaaagtattgaagataatcccgaaattgaagatgacatatttcgcaagaaaagattaacaattatggacttacatccaggcgcaggaaaaacaaaaaggtacttaccggcgatagtgagagaagcaatcaagagaggactgagaactctaatattggctccgacaagagtagtagcagctgaaatggaagaggctctaaggggactaccaatcagatatcagacgccagcaatcagagccgaacacaccggaagagaaattgtagatttaatgtgccatgctaccttcacgatgagactcttatcgccagtgagggttccaaattataatttaatcataatggatgaagctcatttcactgatccagcgagtatcgccgcccgaggttacatatcaacacgcgtcgagatgggagaagctgccggaatatttatgacagcaactcctccagggagccgagatccatttcctcaatctaatgctccgatcatggatgaagaaagagaaattccagagagatcatggaactcaggacatgagtgggtgactgatttcaagggtaagacggtgtggttcgtaccctcgatcaaagccggaaatgatatcgctgcttgtttaagaaagaatggtaagaaagttattcagctatcaagaaaaacgtttgactcggaatatattaaaacgaggactaacgactgggatttcgtagtgacaactgacatatcagaaatgggagctaattttaaagcagaacgagttattgatccaagacggtgcatgaagcctgtaatactcactgacggagaagaacgtgtcatactagccggccccatgccggtaacacacagctcggctgcacaaagaagaggccgaattggaagaaatcccaagaatgaaaatgatcagtacatctatatgggagaaccgctagagaacgatgaagattgtgcgcattggaaagaagctaaaatgctattagataatataaacactcccgagggaatcatacctagtatgttcgaacctgaaagggaaaaggtggatgcaatagatggagagtatagattacgtggagaggcccggaagacgttcgtagaccttatgcgtagaggggaccttcccgtgtggctagcttaccgggttgcggctgaaggaataaattatgctgatcggagatggtgctttgacggaataaagaacaaccaaatattggaagaaaatgtagaagttgaaatatggacaaaagagggagaacgtaagaaattgaaaccgagatggttggatgctcggatatattccgatcccttggcattaaaagaatttaaagagttcgcggcaggtcgaaagtcactgacgctaaatcttataactgaaatgggacgacttccaacattcatgactcagaaggccaggaatgcattagacaatcttgcggtgttacatacagcagaggcaggcggcagagcttacaatcatgctctatccgagctccccgagactcttgagaccctcttgcttcttaccctattagccactgtaactggaggaatatttctttttcttatgtctggaaaaggcattggaaagatgaccctgggaatgtgctgtataattacagcctccatattactatggtacgcacaaatacaacctcattggatagcagccagtataatactcgagtttttccttatagtccttctgatacctgaacccgagaaacaaaggactccacaggataaccaattaacttatgtggttatagcaatacttactgtagtggcagcgactatggcaaatgaaatgggctttttagagaaaaccaagaaagatttcgggttagggagtattgctacacaacaaccagaatctaatatcctagatatagatcttcgtcctgcttcggcttggacactatacgccgtcgcaacaaccttcataacaccgatgctacgtcacagcatagaaaattcatcagtcaacgtcagtctaacagccatagctaaccaagcgacagtattaatgggtttagggaagggttggccgctatcaaagatggacataggggtaccattactagcaatcggatgctacagtcaagttaaccccataactttaactgctgcgctattgttactggtggcacattacgccataattggtcctggtttacaagcaaaggccacaagagaagcacagaaaagggctgccgctggcataatgaaaaaccctactgctgatggaataaccgtaatagatttggatcctatcccctacgatcccaaattcgaaaagcaattaggccaagtaatgttattagtattatgtgtaacacaagtgctcatgatgcgtaccacctgggcgttatgcgaagctctgaccctagcaaccggtcctatatctacactctgggaaggtagtccgggaagattttggaatacaacaatcgctgtatctatggctaatatctttagaggatcatatttagcaggagccggactattgttctcaattatgaaaaatacaacaaacacaagacgaggaacgggcaacacaggagaaacattaggtgagaaatggaagaatcgacttaattcgttaggcaaaagcgagttccaaatttacaaaagatcagggatacaagaagtggatagaactctcgcaaaagagggtataaagagaggtgagacagatcatcatgcagtatcaagaggcagtgcgaaattgaggtggttcgttgagcgcaaccttgttacgccggaaggtaaggtagtagatttaggatgcggacgtggaggttggagctactactgtggaggactaaagaacgtgcgggaagtgagaggattaacaaaaggaggacctggacatgaagaacctattcctatgtcgacctatggatggaatctagtgaggttacagtcgggagtagatgtgttcttcacgccaccagaaaaatgcgatacactactatgtgacattggcgagagcagccctaaccctacagtagaagctggtcgtaccctgagggtattaaacctagtcgagaactggctgaacaacaacacccaattctgtattaaggtattgaatccatatatgccaagtgtgatagagaaaatggaaactttacaaagaaaatatggaggcgctttagtcagaaatcctttgtctagaaatagcacacatgaaatgtactgggtctcaaatgcatcggggaatatagtgagtagcgtgaatatgatatcaagaatgttgataaatagattcacaatgcgccataagaaagcaacatatgagccagatgtagacctcggttcaggtacacggaatatagggatagaatcagaaacgccgaatctagatattattggcaagaggattgagaaaataaaacaagaacatgagacgtcatggcattatgaccaggatcatccttataaaacctgggcatatcacggatcttacgaaacgaaacaaaccggatcagccagtagtgttgtaaacggagtcgttcgtctattgacaaagccatgggacgttataccaatggtgacccaaatggctatgacggatactacaccatttgggcaacaaagagtatttaaagaaaaagtggatactcgaactcaagaaccaaaagaaggaactaaaaagctaatgaagattacagctgaatggctctggaaggaattagggaagaagaaaacacccagaatgtgcactagggaagaatttgcgagaaaggtgagatcgaatgccgcattaggcgctatattcacagacgaaaataaatggaaatctgcccgagaagctgtagaggactctagattttgggagcttgtggataaagagagaaatcttcacttagaagggaaatgcgaaacttgtgtatataatatgatggggaagcgagagaagaaaataggtgaatttgggaaggcaaaaggaagcagagcagtatggtatatgtggctaggcgccagatttctagaatttgaagctcttgggttcttaaacgaagaccactggttttccagagaaaatagcttatctggagtagagggagaaggacttcataaacttggatatatcctaagggaagtatcaaagaaagaagggggagcaatgtatgcggatgatacggctggatgggacactagaatcactttagaggatctaaagaacgaggaaatggtcacaaaccatatggaaggggaacacaagaaattagctgaagcaatatttaaactaacttatcaaaataaagtcgttagagtccagagaccaacaccgaggggaactgtaatggatataatcagccgaagagaccaacggagcagcggacaggtcggaacatacggattgaacacattcactaatatgggggcacaattaattcgtcaaatggagggcgaaggagtattcaaaggaatccagcatcttactgccacagaggaagttgccgtacaggactggttggctagggtcggacgagagcgactatctcgaatggcgataagcggtgacgattgtgttgttaaaccgctggatgacagattcgcaagcgctcttactgctctaaacgatatgggaaaagtacgaaaagacatacaacaatgggaaccatctagaggatggaatgattggactcaagtacctttctgttcacatcatttccatgagttaataatgaaagacggacgggtgttggtagtaccttgccgtaatcaagatgaattgatagggagagcaagaattagtcaaggcgcaggttggagtctgagggaaactgcatgtctgggcaaaagctacgcacagatgtggtcattaatgtattttcatcgaagaggattaagactagcggcaaatgcaatatgcagtgctgtaccaagtcactgggtacctacatcccgaactacatggagcatccatgcacgacacgagtggatgacaactgaagacatgcttactgtttggaatcgtgtatggatccaagagaatccctggatggaagataaaacaccggttgagtcgtgggaggaaataccctaccttggaaaacgcggcgatcagtggtgtggaagtttaatcggtttaacaagtcgagctacatgggctcgaaatatacaaacagccattaatagagttagaagtcttatagggtctgaaggatataccgactacatgccctcgatgaaaaggttcaggcgagaagaggatgaagcaggagtattgtggtga

SEQ ID NO: 22487 - RNA, 9876 nt, synthetic construct
  misc_feature 1..9876: note = derived and/or modified CDS sequence (opt6) from DENV-2__KJ010185__SS-prME
  source 1..9876: mol_type = other RNA
acggctggtgttataattatgcttattcccacagcaatggcgtttcatctaactactcggaacggtgaacctcatatgatagtgtctaaacaagaaaaaggtaaaagtctactttttaaaacagaagacggggtgaatatgtgcacattgatggcaatggatctaggcgaattgtgtgaagacactataacatacaactgtccactgctacgacaaaatgaaccggaggatattgattgttggtgcaatgcaacatcaacatgggtcacgtatggcacgtgtacagcaacaggcgaacataggagagaaaaacgttcagttgctctagtgcctcacgtcgggatgggcttagaaactaggacagagacgtggatgtcatcagaaggggcttggaaacacgctcaacgaattgaaacgtggatattacgacatcctggatttacaataatggctgctattctagcttacacaataggcacaacatactttcagagagtcttaatttttattctattaacggcagttgcgccgtcaatgacaatgcgttgtataggaataagcaatagagatttcgtggaaggtgtaagcggagggagttgggtagacatagtactagaacatggtagctgtgtcacaactatggccaaaaataaaccaacactagattttgaactaataaaaacagaggcgaaacagccggctactctacgaaaatattgtattgaagcaaaactcactaatactactacagccagtaggtgtccaacccaaggtgaaccatccttgaatgaagaacaagacaaaagatttgtgtgcaaacatagtatggttgataggggatggggtaatggatgcggattattcggtaaaggaggcatcgtgacctgcgcaatgtttacttgtaagaaaaacatggagggtaaaatagtccaaccagagaatttggagtacacaatcgttgtaacacctcactcaggggaagagaatgcagttggaaacgataccggcaaacacggtaaagaaataaaagtaactccacaatcatcgataactgaggcagaattgacagggtatggaacagttaccatggaatgctcacccagaacaggtttagactttaacgaaatggttctactccaaatggagaataaagcatggctggtgcaccgtcaatggttcctggatctaccattgccatggctgcctggggcagatattcaaggctcaaactggatacaaaaagaaaccttagtaacgttcaaaaatcctcatgctaagaaacaggatgtcgtcgtactgggcagtcaagagggggcgatgcacacagcgttaaccggagccaccgaaatacagatgagcagcggaaacccactatttacgggacatttgaagtgcaggttgaggatggataaactacaacttaaggggatgtcatatagtatgtgcacgggaaagtttaaagtggtaaaggagatagccgaaactcaacacgggacaattgttgttcgtatccaatatgagggggatggatccccatgtaagattccatttgaaataatggatttagagaagaggcacgttttaggtcgtcttatcacagtaaatcctatcgtaactgagaaagattctccagtaaatattgaagcagaacctccgttcggagactcttatattatcataggggtggaacctggacaacttaaattaagttggtttaagaaagggtcttctataggtcagatgtttgaaactaccatgcgaggtgcgaaaagaatggctatattaggggacactgcctgggacttcggatcacttggaggcgttttcacaagcataggaaaagctctacatcaagtatttggtgcgatatatggtgcagcattctcaggcgtatcgtggacaatgaaaatattaataggtgtcgttataacatggataggaatgaatagtagatctacttcgttgagtgtgagtttggtacttgttggagtcgttacactttatcttggggtcatggtgcaagcggattcaggctgcgtagttagctggaaaaacaaagaattaaaatgtggaagcggcattttctttacagataacgtacatacttggacagaacagtataagtttcaacctgaatcccccagcaaactcgcaagtgcaatacagaaggctcatgaagaaggaatttgcggtatacgaagtataaccagattagataatttaatgtggaagcaaataaccccagagctaaaccatatattgagtgaaaatgaggttaaattaagtatcatgacgggagatataaagggaataatgcaagccggaaagcgttcattaagacctcaacctactgagctaaaatattcttggaaaacctggggtaaagctaaaatgttgtctacagagccacacaatcagacctttctgatagacggtcccgaaacggcgcaatgcccaaatacaaacagagcctggaactctttggaagttgaagactatgggtttggggtgtttacaaccaatatctggttgaaactaaaggaaagacaagacgtattctgcgactcaaaattgatgtctgcagctataaaagataatagagcggttcatgcagatatgggatactggatagaatcggcgcttaatgatacgtggaaaatcgaaaaagcgtcctttatagaagtaaaaagctgtcattggccgaaaagtcacacactttggtctaatggagtactagaatccgaaatgataattcccaagaatttcgcagggcctgtgtcacaacacaattacagaccaggatatcacacccaaacagcaggaccctggcacttaggaaagttagaaatggattttgacttctgcgaaggaactaccgtagtagtcactgaggattgtggtaataggggacccagtttgcgtactacgacagcatcaggaaaactaattacggaatggtgctgcagatcatgtactctaccaccactgcgttatagaggggaagacggctgctggtatggcatggaaatacggccattgaaagaaaaagaagagaatctcgtcaactctttggtgactgcaggccatggccaaatagataatttcagtttaggagtgctaggaatggcgttgtttttggaagaaatgcttagaacgagggtcggaacgaaacacgccgtcctcctagttgcagtatcgttcatgacactaataacaggaaatatgtcatttagggatttaggtagagttatggttatggtcggcgctgcgatgacagatgacattggtatgggagttacatatttagcacttctcgcagcatttaaagtgcgacccacgtttgcagcggggctactactaaggaaattaaccagtaaagagctaatgatgaccactataggtatcgttctattgtcgcaaagcacaacacctgaaactattctggagcttacggacgccctggcattaggaatgatgatcttaaaaatagtaagaaacatggaaaagtaccagttagcggtaactattatggccattctatgtgtcccgaacgcggttatactacaaaatgcctggaaagtaagctgtactatacttgcggctgtatcagtaagcccgttactattaacgagttcacaacaaaaggctgattggataccgctagcactcactattaaaggtcttaatcccacagcaatctttttgacaacattgtctcgaacgaataagaagcgaagctggccactaaacgaagctattatggcggttggcatggtaagtatactagcctccagtctcctgaaaaacgacattcccatgactggacctctagtcgccggagggctactaacagtatgctacgtgctaacaggcaggtcagcggatttggaattggagagagcagctgacgtcaggtgggaggatcaggctgaaatcagtggatcttcaccaatattaagcattacaatttcggaagacggaagcatgtcaattaaaaatgaagaggaagaacagacactaaccatactcattagaacgggccttttagtcataagcgggttgtttcccgtatcaattccaataacagcagcagcttggtatttatgggaagtaaagaaacaacgtgctggggtattatgggatgtaccaagtccgccgcctgtaggtaaggctgaattagaggacggggcatatcgaataaaacagaagggaatactagggtattcacaaataggggccggtgtctataaagaaggtacatttcatacgatgtggcacgttacaagaggggcggtgttaatgcacaaaggaaaacgtatagaaccttcatgggcggacgttagaaaggatctcattagttatggtggtggatggaagttagagggagagtggaaagaaggagaagaagtacaagtattggcgctagaacccggtaaaaatccccgggctgtgcaaacaaaacccggattatttaaaacgaacaccggaacgatcggggcagtgtcccttgattttagtcccggaacttctggatcaccaatagtggacaaaaagggtaaggttgtaggcctatatgggaatggagtagtaacaagaagtggaacttacgtgagtgcaattgctcaaactgaaaagagcattgaagacaacccagagatagaagatgacatatttcgaaagaagcgattaactatcatggacctccatcccggggcaggaaaaaccaaacgatacctgcctgcgatcgtcagagaagcgataaagcgaggtctgagaacactaatacttgcacccacacgggtagttgctgctgaaatggaagaggccctgagaggcttgccaatacgatatcagacaccagcaataagggccgagcatacaggtagggaaatcgtagacctaatgtgtcatgccacttttaccatgcgactgctcagtcccgtacgagtcccaaactacaaccttatcataatggacgaagcccactttaccgatccagcatccatcgcagcacgtggatatattagcaccagagtagaaatgggggaggctgctgggatattcatgacagcaactccaccaggttcacgcgatccctttccacaatcgaatgcaccaatcatggacgaagaacgggagattcccgagagaagttggaactctggtcatgaatgggtgactgattttaagggaaaaacagtatggtttgtaccatccattaaagccgggaacgatatagctgcctgtttaaggaaaaatggcaagaaagttattcaattatcaagaaagacatttgatagtgaatatataaaaacaagaaccaatgattgggactttgtggtaacaacggatatttcagaaatgggtgcgaattttaaagcagaaagagtaatagacccacgacgatgcatgaagccagtaattttaaccgatggagaagaacgtgtaatactagctggaccgatgcctgtaactcacagctccgcagcgcaacggagaggacgtataggacgaaatcccaaaaacgaaaatgatcaatatatatatatgggagaaccactcgaaaatgatgaagactgcgcacattggaaagaagcaaagatgttactagacaatataaacactccagaagggataattcctagtatgttcgaacctgagagagaaaaagtagacgcgatcgatggtgaatatcggctacgaggagaagctagaaaaacgttcgtggatctaatgagaagaggggatctaccggtgtggctagcctacagggtagcggcagaaggcataaattatgccgataggcgatggtgttttgatggtattaagaataatcaaatattagaagaaaacgtcgaagtagaaatttggacaaaagaaggagaaaggaagaaattgaaaccccgttggttagacgcgaggatttattcagacccccttgccttaaaggaatttaaagagttcgcggcgggaagaaaaagtctgaccttaaatctcataaccgaaatggggaggcttccaactttcatgacacagaaagcaaggaatgctctcgataatctagcagtactccatacggccgaggcgggcgggagagcctataatcacgcgctatcggagttgcctgaaaccctagaaactttattactcctaacactattggctacagtcaccggagggatatttctttttctaatgtctggaaaaggtataggaaagatgaccttaggaatgtgttgtattattaccgcttcaatactattatggtatgcgcaaattcagccgcattggattgcggcttctataattttggagttctttctcatagttttactaatcccagagccagaaaaacaaagaacaccacaggataatcaattaacatacgtagttatagctatactaacggtggtggcagcgacaatggctaatgaaatgggtttcttagagaaaaccaagaaagattttggattgggctcaatagccactcagcagccagaatctaacatcctagatatcgatctacgccctgcttcagcttggacattgtatgcagtagccacaaccttcattacaccaatgctgaggcacagtatagaaaactccagtgtaaatgtatccctaactgcaatagcaaatcaagcaactgtgctaatgggtttaggaaaagggtggccgttgtctaaaatggatattggagtcccactattagctataggatgttattctcaagtaaatcctataacgctgactgctgcgctactcttattagtagcacactatgccatcattggaccggggctacaagcgaaagctagtagggaggctcagaaacgtgccgcagcgggaattatgaaaaatcctacggtagatggtatcacagtaatagacctagacccaattccatatgatccaaaatttgaaaaacaacttggccaagtaatgctattaatcctatgcgtaactcaagttctgatgatgaggacaacatgggccctctgtgaagcgttaacattggcaaccggtcctatatcaacgctttgggaaggaaatcccggaaggttttggaacacgactatcgcagtgtctatggcaaacattttccgaggttcatacctggccggtgcaggattattattttccataatgaaaaatacgaccaatacaagaagagggactggaaacactggtgaaacgttaggcgaaaagtggaaaaatagagtaagtctgttaggaaaaagtgaatttcagatttataaacgaagtggtatccaagaagtggataggacattggctaaagaaggaattaaaagaggtgaaacggatcatcatgcggtgtccagaggtagtgctaaacttcgctggtttgtcgaaaggaatctagttacacctgagggaaaagtagtagatttgggttgtgggcgaggtgggtggagttactattgtggcgggttgaaaaatgtaagagaggtaaaagggcttaccaaaggaggaccagggcatgaggaacctattcctatgagcacatatggttggaatcttgtgcgtctcctgacaggagcagacgtattctttactcctccagaaaaatgtgacacattgctttgcgacattggtgagagtagtcctaaccccactgtggaagcggggagaacattaagggtattaaacctcgttgaaaattggctaaacaacaacacccaattttgcataaaggtcttgaatccttacatgccaagtgtaattgaaaagatggaaactttacaaagaaagtacggaggtgccctagtccgcaaccccctctcaagaaattcaacacacgagatgtattgggttagtaatgcatcaggaaatatcgtaagcagtgtaaacatgataagtaggatgttaatcaacagatttacaatgcggcataagaaagctacatatgatcccgatgtggaccttgggagcggaacgaggaatatcgggatagagtcagagaccccaaatttggatataattgggaaacgtatagagaaaataaagcaagaacacgaaacctccagacactatgaccaagaccatccatataagacgtgggcgtatcatggctcatatgagaccaaacaaactggaagcgcaagttcaacagtgaatggggtggtaagactactgacaaaaccgtgggatgttataccaatggtaacccaaatggccatgacagataccaccccattcggacaacaacgagtgtttaaagaaaaagtcgatactagaacccaagaaccaaaggaaggaaccaaaaagttaatgaaaattacagctgagtggctctggaaagagttaggtaagaagaaaacacctagaatgtgtacacgagaggagtttgccagaaaagttcgttccaacgcagcgttaggcgcgatattcacagatgaaaataaatggaaatctgcgagagaggcggttgaagattcgaggttttgggagctagtggacaaagaacgaaacctgcacctggaaggaaaatgcgaaacctgtgtgtataatatgatgggcaaaagagagaagaaaattggagaatttggaaaagcaaaaggtagcagagctatttggtatatgtggttaggagcaagatttctggaatttgaagccttaggattcttaaatgaggatcattggtttagtagagaaaattccttaagcggggtcgaaggtgaagggttacataaattgggatatatactaagagaagttagcaagaaagaaggcggagctatgtacgctgacgatacagctggatgggataccagaataacattagaagacctcaaaaatgaagagatggtcactaatcacatggagggtgaacataagaaactagcagaagcaatattcaagctaacctatcaaaataaagtagttcgggtacaacgaccgacaccaagaggtacggtcatggatataatctcgcgaagagatcagagagggtctgttcaagtgggcacatatggtttgggaacattcacaaatatgggtgcccaattaatcagacagatggagggagaaggggtgtttaaaggtatacagcacctcacggcaactgaagaagtagcagtacaagattggcttgcgagagtcggcagagaacgtctctccagaatggcaatttccggagacgattgtgtagttaaacctctcgacgatcgtttcgcaagcgctttaacagctcttaacgatatgggcaaagtacgaaaggacatacaacaatgggaaccctctagggggtggaatgactggacacaggtaccattctgttctcatcatttccacgagctaataatgaaagatggccgagtattagtagtcccttgccgaaatcaagatgagctcataggacgtgcaagaatatcccagggtgcaggatggagcctcagggaaacagcatgcctaggaaagtcatacgcacaaatgtggtcactcatgtattttcatagaagagatctacgtttagcggcaaacgctatatgttcggcagttccatcccactgggtgccaacaagtagaactacatggagcatacacgctgggcacgagtggatgactacagaggacatgcttacagtctggaatcgggtatggattcaagagaacccatggatggaagacaagacccctgtcgagagttgggaggaaatcccctatctaggaaaacgtgaagatcagtggtgcggatcgttaattggactaacgagccgtgcgacctgggctcgtaacattcaaacggcaataaatcaagtaaggagcctaataggctcagaagaatacacagattatatgccatcaatgaagagatttggccgagaagaggaagaggccggagtattatggtag

SEQ ID NO: 22488 - RNA, 9876 nt, synthetic construct
  misc_feature 1..9876: note = derived and/or modified CDS sequence (opt6) from DENV-2__KJ010186__SS-prME
  source 1..9876: mol_type = other RNA
accgctggtgtcattattatgttaatacctaccgcaatggcgtttcatctaaccacgagaaatggggaaccgcacatgattgtatctaaacaagaaaaaggaaaatctctgttatttaaaactgaagatggggtaaatatgtgtacccttatggcaatggacttgggagaactttgtgaagatacgataacatataattgcccactgctaagacaaaatgaaccagaagatatagactgttggtgtaatgctacaagcacatgggtaacgtacggaacatgtacagcaaccggagaacataggagggagaaaagatcagtagcattagtcccacatgtcggaatgggattagaaacaaggacggaaacatggatgagctcggaaggagcatggaaacatgctcaaagaattgaaacatggattctacgtcatccaggttttactataatggctgcaatactagcatatacaattggaacaacctactttcaaagagtcttaatttttatactgttaacagcagtggcgccatcaatgacaatgcgttgcataggtataagcaatagggacttcgtcgaaggagtttcaggtggatcttgggttgacatcgtcttggaacatggaagttgtgtaacaacaatggccaaaaataaaccgactctggacttcgaattaataaaaacggaagcaaaacaaccggcgacactaagaaaatactgtatagaagctaggttaaccaacacaactacagcatcaagatgccctacacaaggagaaccctctttaaatgaagaacaagataaacgattcgtatgtaaacacagcatggtagatcggggatggggaaatggatgtggtttatttgggaaaggtggaatcgtaacctgcgcaatgttcacatgcaagaaaaatatggagggaaagatagtacaaccggaaaatttagaatacactattgtcgttactccacatagcggagaagaaaacgcagtaggtaatgacacgggtaagcatggtaaggaaataaaagtaacgccacaatcatcaataactgaagctgaacttacaggatatggaacggtaactatggagtgctcacctcgaacgggactagactttaacgaaatggtgttgctacagatggaaaacaaagcatggttagtacacagacagtggtttctggaccttccactaccttggctaccaggagcagatattcaaggcagcaactggattcagaaagaaactttggtaacttttaagaaaccccatgccaagaaacaagatgttgttgttttaggaagtcaagagggtgcaatgcatacggctctaacaggagcaacagagattcaaatgagctcgggtaacctgctattcactgggcacctaaagtgcagactaagaatggacaagttacaactaaaggggatgtcatacagtatgtgcactggtaaatttaaagtagtaaaagagatagcagagacgcaacatggaaccattgtggttagggtccagtacgaaggagatggatcgccttgcaaaatccctttcgaaatcatggatcttgaaaaacgacatgttctcggaagactaattacagttaatccaattgtaactgaaaaagattcaccggtaaacatagaagcagaaccaccatttggtgacagttatatcataataggagttgaaccaggtcagttaaaacttagttggtttaaaaagggttcgagtataggccaaatgtttgagacaactatgcgtggggcgaaaagaatggcgatattaggcgatacagcatgggatttcggctccttaggtggtgtatttacaagtattgggaaggcattgcatcaagtttttggagcaatatatggagcagccttttccggggtttcttggactatgaaaatcctaatcggagttgttattacttggattggtatgaactcaagatctacttcgttaagcgtctccctagtattggtaggcgtagtgactttatatttgggtgtgatggtccaagcagactcagggtgtgttgtatcatggaaaaatactgcattgaaatgcgggtcaggtatctttataactgacaatgtacacacatggacggaacagtacaagtttcagccagaatctccatcaaagttagcctcggcaatacaaaaagctcacgaggaagggatatgcgggattcgaagcgttactaggcttgaaaacctgatgtggaagcagatcacacctgaattgaatcatattctctcggaaaatgaggtcaaattgtcgatcatgacgggtgacataaaaggcattctacaagctggtaaaagatcattacgtccgcagccaacagagttaaaatacagctggaaaacctggggaaaggccaaaatgctctccactgaaagtcataatcaaacctttcttatagatggtccagagactgccgaatgtcctaataccaacagggcctggaactccttagaagtagaggattacggattcggagtattcacaacaaacatctggctaaaattgaaggagaggcaggacgtgttttgtgattccaaattaatgtcggcagcgatcaaggataatagagcagtgcatgcggacatgggatattggattgagtcagcattgaatgatacttggaaaattgaaaaagccagctttatagaggtaaaatcttgccattggcctaaaagtcacaccctatggagtaacggggtccttgagtctgagatgattataccgaaaaattttgcaggaccagtatcacaacataattatagacctggttatcacacccaaacagctggtccgtggcatctagggaaactcgaaatggattttgatttttgcgaaggaactactgtagttgttaccgaagactgtggaaatagaggaccatcactacgaaccaccactgcttcaggcaaattgatcacagaatggtgttgccgtagttgcactttacctccactacgttaccgaggagaagatggttgttggtacgggatggaaatcaggccattaaaagaaaaagaggaaaacctggtgaacagcttagtcacagccggacacggccagattgataatttcagccttggtgttttgggaatggcactatttctggaagagatgctaagaacacgagtaggaaccaaacacgcagttctcttagtcgcagtatccttcatgacactgataaccggaaacatgtcatttcgcgacctgggtcgagtaatggtgatggtcggagcagccatgacagatgatattggcatgggcgtaacttacctagcattattagccgcatttaaagttagaccgaccttcgcagctggacttctattgcgaaaattaacatcgaaagaacttatgatgacaactataggcattgtcttattgtcacaatccactacgcccgaaacgatcttagaacttaccgatgctttagccctgggcatgatgatacttaagattgttaggaacatggaaaagtatcaacttgcggtaacaatcatggcaattttatgtgtccctaacgctgtcatactacaaaatgcatggaaagtgtcctgtactattctggcagctgtctcagtttcacctctattattgaccagcagtcaacaaaaagctgattggattccattagctttgactataaagggactcaaccctacggccatcttcctaaccacattatcgcgaacgaataagaagaggagctggcccctaaacgaagcaataatggctgtgggcatggtctctatcttggcatcaagtctcttgaaaaacgatataccaatgaccggtcccctcgttgcgggaggattattgacggtttgttacgtgctaacaggacgaagtgcggacctagagttagagagagccgcagatgtaaggtgggaagatcaggcagaaatttctggatcttcccctatccttagtataaccatctcggaggatggtagtatgagcatcaaaaatgaagaagaagaacaaacattaacaatactgattaggacagggctcctagtaatttctggactatttcctgtgtctattccaatcacggcggctgcctggtatctttgggaggtcaagaaacaaagggccggtgttctatgggacgtaagatcataccctcccgtgggtaaagcagaacttgaagacggagcatacagaataaagcaaaaaggaatattggggtactcacaaataggtgcaggagtttataaggaaggaacattccacacgatgtggcatgtcacacgtggtgcagtattgatgcacaagggaaaaaggatagaaccttcatgggctgacgttagaaaagatttgatttcttatggaggagggtggaaattagaaggggagtggaaggaaggtgaggaggtccaagtgttggcattagaaccaggcaaaaatccacgcgcagtgcagacgaaaccgggtttatttaaaactaatacaggaactataggagcagtcagcctagactttagtccaggtacgagcggtagcccaatcgttgacaaaaagggtaaagtggttggactatacggaaacggggtggtgacaagaagtggtacgtatgtatcagccattgctcaaacagagaaatctattgaagacaatccggagatagaagacgacatatttaggaagaaacgactaaccataatggacttacacccaggtgctggaaagaccaaacgatatctcccagcaatagttagggaagcaataaagcgaggacttagaacgctgatcctcgcaccaacaagagttgtagcagccgagatggaggaggctttacgaggacttccgataaggtaccagacacccgccatcagggctgaacatactggacgagaaatagtagacttaatgtgtcatgcaacgtttacaatgcgcttactttcaccagtcagggtcccgaattacaacttaataataatggatgaagcgcattttacagatccggcatcaatcgcggcgagagggtacatttctactagagtggaaatgggagaagctgccggaatattcatgactgcgaccccaccaggatcaagagatccttttccgcaaagcaatgccccaattatggacgaagaaagagaaatacccgaaagaagctggaactccgggcatgagtgggttaccgacttcaaagggaagaccgtctggtttgtaccatctataaaagccggtaacgatatcgcagcttgcttaaggaaaaacggaaagaaagttatccaattaagtagaaaaacgttcgattcggaatatataaaaacgcgaacaaacgactgggactttgttgtaactactgatattagcgaaatgggggctaactttaaagctgaacgggtgatagacccgaggcgatgcatgaaaccggtaattttaacagatggtgaagagagagtgatattagctgggcccatgccggttacacattcatcagcagcacaaaggagaggaagaatagggagaaatccgaaaaacgaaaacgatcagtacatatatatgggagaacctttagagaacgacgaagactgcgcccattggaaagaagcaaaaatgctattagacaacatcaatacgccagaaggaataattccatcgatgtttgaaccggagcgagaaaaagtcgatgcaatagacggcgaataccgtttacgaggagaagcccgaaaaacgtttgttgatcttatgagacggggtgatctaccagtttggctggcgtacagagttgcagccgaagggataaattacgctgatagacgatggtgcttcgatggtattaaaaataatcaaatattagaagaaaacgtcgaagtagaaatttggacgaaagaaggggagagaaagaaacttaaaccgcgctggttagatgctcgtatatattccgatccactagcactaaaagaatttaaagaatttgcagctggacgaaaatcgttgacattaaatttaatcacagaaatgggcagattacccacttttatgactcaaaaggcaagaaatgctctagataatctagcagtgctacataccgcggaggcaggaggccgagcgtataatcacgcactttcggaactacctgaaacactcgaaaccctgctacttttaacgttattagcaacagtcacagggggaatctttctatttttaatgtctggtaagggtatcggaaaaatgactttaggaatgtgctgtataataacggcatccatactcctatggtatgcccagatacagcctcattggatagctgcttcaataatattagaatttttcctaatagtattacttattccagaaccagaaaaacaaaggacccctcaagataaccaactaacttacgttgtaattgctattctcacagttgtagcggctactatggcgaatgaaatggggttcctagagaaaactaagaaggattttggtctcggatctatagctactcagcaaccagagtcgaatatcctcgatatagatctaagacccgctagtgcgtggacattatatgccgtcgccacaacgtttatcacaccaatgcttcggcatagcattgaaaattctagcgttaatgtctctctaacagcgatagcgaaccaagctaccgtattaatgggcctcggaaaaggatggcctttaagtaaaatggatatcggtgtgccactacttgcgataggctgttattctcaagtcaacccaataacactaacagcagcactgcttctactcgttgcccactacgccatcattggaccaggtctacaggctaaagctacccgagaagctcaaaaacgcgctgcagccggaatcatgaaaaacccaactgtagatggaattacagtaattgacctggatccaataccatatgatcctaaattcgaaaaacagttgggacaggtaatgctacttgtattatgtgtgacccaggtgttaatgatgagaaccacatgggcactttgtgaagccctaacgctggccacaggaccgattagtaccttatgggaaggaaaccctggaagattctggaatacaacaatagccgtttcaatggctaatatattccgaggaagttacttagcaggggctgggcttctgttctcgataatgaaaaacacaactaacacaaggaggggaacaggcaacaccggtgaaacactaggtgagaaatggaaaaatcggttaaattcccttggaaaaagtgaatttcagatttataaaaggtcaggtatacaagaagttgatagaacgttagccaaagagggaattaagagaggagagacggaccatcatgccgtctcaaggggatcggcaaaattgagatggtttgtagaaaggaatttagtaaccccagaaggaaaagtagtggacttaggttgtggccgagggggatggtcctattattgtggaggtttaaagaacgtcagggaagtgaaaggactaacaaaaggcggtcccggacacgaagaacctatcccgatgtcaacatacggctggaacttagtccgccttcaaagcggggtcgatgtgttctttacaccaccagaaaaatgtgatacactcctttgcgatataggagagtcaagtcctaatcctactgtagaagccgggaggacattgagagtacttaacctcgtggaaaattggttgaataataatactcaattctgcataaaggttttgaatccatatatgccaagcgttatcgagaaaatggaaacattacagcgtaagtatggaggcgctttagttagaaacccattatcccgaaacagcactcatgaaatgtattgggtctcaaacgcctccggtaacatagtgagctccgtaaatatgatatcacgaatgctaattaatagattcactatgcgtcataagaaagcaacatacgagccagatgtagatctaggaagcggaactaggaatataggaattgaatcagagacacctaacttagatataattggaaagcgaatcgagaaaataaaacaagagcatgaaactagctggcattatgatcaagatcatccgtataaaacgtgggcttatcatggttcctacgaaactaagcaaaccggatctgctagttcaatggtaaatggagtcgtgcggttacttacgaaaccttgggatgttattcctatggttacacaaatggctatgactgatacaactccttttggacaacaaagagtatttaaagagaaagtagacactagaacacaagaacctaaagagggcactaagaaattaatgaagataacagcggaatggctgtggaaagagctgggtaagaagaaaaccccaagaatgtgcacaagagaggagttcgcgcggaaagtccgttcaaatgcagctctaggcgcaatctttacagatgagaataaatggaaatctgctagggaagctgtggaggattctagattctgggaattagtggacaaagagaggaacttacatctagaaggaaagtgcgaaacttgtgtatataatatgatgggaaaacgagagaagaaaattggtgagttcgggaaagctaaaggatcacgagcaatttggtacatgtggttaggtgcaagatttcttgagtttgaagcattaggttttctgaatgaagatcattggtttagtagggaaaacagtttatcaggagtagaaggagagggcctacataagttaggttacatactgagagaagtatcaaagaaagaagggggtgctatgtacgctgatgataccgcaggatgggatacccgtataacgttagaagatctcaaaaatgaagagatggtaactaaccacatggaaggtgagcacaagaaactagcggaagccatttttaaattaacgtatcaaaacaaagtcgtacgcgtccagagaccaactcctcgcggaaccgtcatggatataattagccgcagggaccagcgtggcagtggtcaggtaggaacatacggtttaaacacctttactaacatgggcgctcaattgatacgccaaatggagggtgaaggggtattcaagggcatacaacacttgacggcaaccgaagaagtcgccgtacaggattggctggcgagggtaggtagggagagactttccagaatggctatatcgggggacgattgcgtagtaaagccactcgatgatcgtttcgctaatgcattaacagcacttaacgacatgggcaaagtacgaaaagacatacaacaatgggaacccagtcgagggtggaacgactggacacaggtgccgttttgtagtcaccactttcacgagctaatcatgaaagatggaagggtattagtggtaccatgccgaaaccaggacgaacttataggcagagcaagaattagccaaggtgctggatggtcattaagagagaccgcctgcttaggtaagtcatatgcgcaaatgtggagtttgatgtacttccatagaagagacctacgtttagcggcaaacgcgatttgcagtgctgtacccagtcattgggtgccaacatctagaacaacttggtctattcatgcaaggcacgaatggatgacaactgaagacatgttaaccgtatggaacagagtttggatacaggaaaatccttggatggaggataaaacacctgtggagagctgggaagaaatcccatacttggggaaacgcgaagaccagtggtgcggatccttgatcggcttgactagcagagcaacatgggcgagaaatattcaaacggctatcaaccaggtaagaagcctcattggcagtgaggagtacactgattatatgcccagtatgaaacgattcagacgtgaagaagaagaagccggagtcttgtggtaa

SEQ ID NO: 22489 - RNA, 9876 nt, synthetic construct
  misc_feature 1..9876: note = derived and/or modified CDS sequence (opt6) from DENV-2__KF955364__SS-prME
  source 1..9876: mol_type = other RNA
acggctggcgtaataattatgttgatacctacagcaatggcatttcatcttacaacacgaaacggtgaaccacacatgatcgtaggcaggcaggagaagggaaaatctcttctatttaaaaccgaggatggagttaatatgtgcactttaatggccattgacctaggcgaactttgtgaagatacaatcacatacaagtgtccgctgcttaggcaaaatgaaccggaggacatagactgttggtgtaatagtacctcaacctgggtcacatatggaacttgcacgacaactggcgaacacagacgagaaaaaaggtcagtggcactggtaccgcatgtaggtatgggactcgaaacgcgtactgaaacgtggatgtcatctgagggagcctggaagcacgtacaaagaatagaaacatggattttgcgacatcccggtttcaccattatggcagctatactggcatataccataggtacaacacattttcaacgagcgttaatattcattctattaacagcagttgcaccatctatgacaatgagatgtattggtatcagcaaccgtgactttgtagagggagtatcaggtggatcctgggtcgatatagtgttagaacatggcagctgcgtgactacaatggccaaaaacaagcccactcttgacttcgaactaataaaaacagaagcaaaacagccagcaacactcagaaagtactgcatcgaagcaaaattaacaaacactaccaccgagagcagatgtcccacccaaggagaaccttccttaaacgaggaacaagataaaagatttatctgcaaacattctatggtagatcgaggttggggaaatggatgtggactatttggaaaaggagggatagttacgtgcgcgatgtttacttgtaaaaaaaacatggagggtaaggtagtacttcctgagaatctggaatatacaatagtaataacgcctcattccggagaagaacatgcagtgggaaacgacaccggaaaacatggtaaagaaattaaaataactccacaaagctcaatcacagaggcagaactcactgggtacggtacagttactatggaatgcagccctagaactggcctagattttaacgaaatggtcttactgcaaatggaagataaggcatggctagttcaccgtcaatggttcctagatttgcccttaccatggctacctggtgcagatacacaaggttcaaattggatacaaaaagagacattggtcaccttcaaaaacccacacgcaaaaaaacaggatgtagtcgtactaggatcgcaagagggcgcgatgcacacagctctaactggagctacagaaattcagatgtcaagcggaaatttattattcacgggacatctaaaatgtagactgcgtatggataaactgcaattgaagggcatgagttattccatgtgtaccggcaagtttaaaattgttaaggaaatagcagagacacaacatggtacaattgtcataagagtacaatacgaaggagatggatcgccatgtaaaattccttttgaaatcatggatctggaaaaaagacacgtattaggtcgactcattacagtcaatcctatagtcaccgaaaaagacagcccagttaatattgaagccgaacctccctttggggattcctatataataataggagtggaaccgggacagttgaaattaaactggttcaagaaggggtcatcaataggtcaaatgtttgaaaccaccatgcgaggagcaaagcgtatggccatcctaggagacaccgcctgggacttcgggagcctaggaggcgtctttacgtcaatcggaaaagccttgcaccaggtatttggagccatttatggtgcagccttcagtggtgtgtcatggaccatgaaaatattgattggcgtcataattacatggatagggatgaactctcgtagcacatctttaagtgtatccctggtattggtgggtgtggtaacactatatctaggtgtcatggtacaagccgacacaggatgcgttgtaagttggaagaacaaagaattgaagtgcggctccggaatattcataacggataacgttcacacatggactgaacaatataaatttcaacctgaaagccccagtaaattggccagtgctatacaaaaagcacatgaagaaggaatctgcgggattagatcagtaactagactggagaatcttatgtggaagcaaatcacacctgaattgaaccatatcttatcagagaatggagtaaaattaacaattatgacaggcgacataaaaggaataatgcaggcaggaaaacggagtttaagaccccaaccaacagaactcaaatactcttggaaaacgtgggggaaagccaaaatgttgtcaacagaatcgcataatcagacatttttaatagatggtcctgaaaccgcagaatgtcccaatactaatcgggcttggaacagtttagaagtagaagattatggatttggagtcttttcaactaacatatggctaaaattgagggagaaacaagatgtattatgcgattctaagttaatgtccgcagcgattaaagacaatagggcagtacacgcagatatgggatactggattgaaagtgcattaaacgatacttggaaaatggaaaaggcgtcattcatagagataaagtcatgtcattggccaaaatcacataccttgtggtcaaatggtgttttggaaagcgagatgattattccgaagaactttgctggaccagtatcacaacataactatagacccggttaccacacacaaaccgcaggaccatggcaccttggaaagttagagatggactttgatttttgtgaggggaccacagtagtagtaactgaagattgtggtaacaggggcccaagtttaaggactactacagcatcggggaaattgatcaccgaatggtgttgtcgaagctgtactctaccaccactaagatatcgaggagaggatggttgttggtatggtatggaaataagacctttaaaagagaaagaagaaaacctggtcaatagtttggtaacagcgggacatgggcagatcgacaatttcagtcttggagtgttaggaatggcactcttcctggaagaaatgttgagaactcgggtcgggacaaaatatgccattctcctcgtagcagtatcatttgtgacattaatcacgggcaatatgtcctttcgtgacctgggacgggttatggttatggtaggcgcgaccatgaccgacgacataggtatgggggtgacctatctagcgttacttgcggccttcaaagttcgacctacatttgcggcgggtttactccttcgtaagttaacaagcaaggagctaatgatggcaacgataggcattgcactactaagccaaagtacaattccagagacaatccttgaactaaccgatgcgctggcccttgggatgatggtccttaaaattgtgcgaaatatggagaaatatcaattagcagtgaccattatggctatctcatgcgtaccaaatgcagtgatcttgcaaaatgcttggaaggtaagttgtacgatattagcagcagtcagcgtttccccattattgttgacgtccagccaacaaaaagcggattggattccgttggcattaacaataaaaggtctaaatccgactgcaatttttctaaccactctgtctcgcactagcaaaaaacgatcatggccattgaatgaagcagtgatggcagtcggtatggtttcaatattggcttcatctcttctaaagaatgatattcctatgacaggcccgctagtcgctggaggattattaacggtgtgctatgtcttaacggggaggtctgcggatctcgaattagaaagggccgctgacgttaaatgggaagatcaggcagagataagtgggagctcacctatactaagcataactatatcagaagacggctctatgtcaattaaaaatgaagaggaagaacatacgctaacaattctaattcgaacagggcttctagttatatctggcgtatttccagtttcaattcccataactgcggcagcttggtatttgtgggaagtgaaaaagcaaagagcgggggtactgtgggacgtgccatcacccccacccgtaggtaaagctgagctcgaagatggtgcgtatcgaattaaacaaagaggtatattcggttatagccaaataggcgccggtgtctataaggaaggtactttccacacaatgtggcatgtaacgaggggagccgtactaatgcatcgaggtaaaagaatagaaccgtcgtgggccgatgttaaaaaggacctaatctcatacggcggaggctggaaactggagggggaatggaaagagggtgaggaagtgcaagtcctagcactagaacccggaaagaacccgagagcagtgcaaacaaaacctggtctatttaaaacaaatacgggaaccataggcgccgtaagcctagatttcagccctggtacgagtggttcacctattgtagatcgcaaagggaaagtagttggactatacggaaacggtgtagtaacaagatcaggagcctatgtaagtgcaattgcacaaacagaaaaaagtatagaagataatccagagatagaagatgatatattccggaaaaaacgacttacgataatggacctacacccaggagcaggtaaaaccaaaagatacttaccagcaattgtaagagaggcaatcaagcgcggtctgagaacattgattttagcaccaactagagttgttgcagcagagatggaagaagcacttcggggactaccgatacgataccaaacaccagctataagggcagaacatacggggagggaaatagtagacctcatgtgccatgcaacctttacaatgagattgctgagtcctgtgagggtcccaaattataacttaatcattatggacgaagcacactttacagacccagcatcgattgcggcgcgtgggtatatatccaccagagtcgaaatgggggaggcggccggaatattcatgacagccacaccacccggaagtagggatcctttcccacaaagtaatgcgccaataatggacgaagaacgagagattccagaaagatcttggaactccgggcacgaatgggtaacagatttcaagggtaagacagtttggttcgtgccatcaataaaagccggaaacgatatcgcagcctgtctcaggaaaaacggcaaaaaagtaatacaactatcgcgaaaaactttcgattccgaatacgtgaagacaagggctaatgattgggattttgtagttactaccgacatatcggaaatgggtgcaaatttcagagccgaacgtgtaatagaccctcggaggtgcatgaaacctgtaatcctcacggacggtgaggagagagtaatactggcaggacctatgccggtcacgcatagtagcgctgcgcaacgaagaggcagaataggaagaaaccccaaaaatgaaaacgatcaatatatctacatgggcgaaccgttggaaaatgatgaagattgtgcacactggaaagaagcaaaaatgctattagacaacattaatacacctgaaggtatcataccaagtatgttcgagcctgagagagaaaaggtcgacgcgatcgacggcgaataccgacttaggggcgaagcacgcaaaacatttgtggacttgatgagaagaggagacctaccagtatggttggcttaccgcgtagctgcagaggggatcaattatgcagacagacgttggtgttttgacgggatcaaaaataatcaaatcttagaagaaaacgtagaggtcgaaatctggactaaggagggagaaagaaaaaagctcaaaccaagatggctagatgcgcgaatttacagtgatcccctcgcattaaaggagtttaaggaatttgcagcgggtaggaaatctttaactctgaatctaatcacagaaatgggacgcctgccgacatttatgacgcaaaaagcaagagacgctttagataatttagcagtgctacatactgcagaagtagggggcagagcgtataaccacgccttatcggaactaccagaaactctggaaacactgttactgttaaccttattggcaactgttacaggtggtatctttctattcctgatgtcaggaaaaggcattggaaaaatgaccttggggatgtgctgtataataacggcttcaattctcctgtggtacgctcaaattcaaccacattggattgcggcaagcatcatactagaatttttcctcatagtgttattgattccagaacctgaaaaacaaagaacaccacaagacaatcaacttacctatgtagtgatagcaatactaacagtagtcgccgcgacgatggctaatgagatgggatttttggagaaaaccaaaaaggaccttggcctaggaagcattacaacacaggagtcagaaagcaacatattagatattgatttgcgaccagcatcagcatggacgctatatgctgtagccaccacttttgtgaccccaatgttacgacactctatagaaaatagcagcgtcaatgtgtcattaaccgcgattgctaatcaagcaacggtgctaatggggctaggaaggggttggccattaagcaaaatggacattggcgtccctttattggctataggttgttactcccaggtaaatccaataactttgaccgctgctctcttactgctagttgcacattacgccataattggccctgggttacaagctaaagcaacacgcgaggcccagaaacgaacagcagctggcataatgaagaatcctactgttgacgggataaccgtcatagatttagaacctataccttatgatccaaaatttgaaaaacaattgggccaagtcatgctactagtgctatgcgtaacacaggtactgatgatgaggacaacatgggcgctatgtgaagcactcactctcgcaactggtcctataagtactctatgggaagggaaccctggacgattttggaatacaacgatagctgtatcaatggctaacatttttcgagggagttacctagcgggagcaggacttttattttcgatcatgaagaacacaactaatactaggcgaggcacaggaaacattggtgaaacattaggagaaaaatggaaaagccgactcaacgctctaggaaaatcggaattccaaatctataaaaaatccggaattcaagaggtcgatagaactttagcaaaagaaggcataaaaaggggcgagacagatcaccatgcggtgtctcgaggatctgcaaaactgagatggtttgtggaaagaaatatggtgacacctgaaggaaaggtagttgacctgggatgcggcagagggggttggagctattactgcggtggactaaaaaatgtacgagaggttaaggggctaacaaaaggtgggcccggacatgaagaaccgatcccaatgagcacctacggatggaacctagtaagactacagtcaggagtagacgtcttctttacaccccctgaaaaatgtgacacattactatgcgatatcggagaatcgtcacctaatcccacaattgaagctggaaggacattacgagtgctaaatttagtagaaaattggttaaacaataatacccaattttgcgtaaaagtcttaaatccatatatgccttccgtgatagagaaaatggaaacgctacaacgaaaatatggcggtgcactcgtaagaaatccgttatctcgaaactcaacacacgaaatgtattgggtttcaaatgcaacggggaatatcgtaagttcggtaaatatgatttcccgaatgttgataaatagatttacaatgaaacataaaaaagctacctacgaacccgacgttgacttgggctcaggaacgagaaatataggaattgaaaacgagatacctaatttggatataataggaaagcgtattgaaaaaataaaacaagagcatgaaacgagttggcattacgaccaagatcatccttacaaaacatgggcgtatcatggctcttacgagacaaaacaaacaggaagtgcaagtagtatggtgaacggcgtcgttaagttgctgactaaaccatgggatgttgtaccaatggttacacaaatggcaatgacagatacaactccattcggtcaacaacgtgtatttaaagaaaaagtagatacgcgaactcaagagccgaaagaaggaacaaaaaaattaatgcgtatcaccgctgaatggctctggaaagaacttgggaaaaaaaagacaccccgcatgtgtacccgtgaagaatttacacgaaaagtaagatcgaatgcggcactgggggcaatatttacagatgagaataaatggaaaagcgcacgcgaagcagtcgaagatagtaggttctgggaattagttgatagggagagaaatttacatttagaagggaagtgtgaaacctgcgtatacaacatgatgggtaaacgagaaaagaaattgggagaattcggaaaagctaaaggatcccgtgctatatggtatatgtggttaggggcacgatttctggagtttgaagcgttagggttcctaaatgaagatcactggttcagcagagggaattcactgtcaggagtagaaggagagggccttcataagctaggatatattttgagggatgtcagcaagaaggaaggtggtgcaatgtatgcggatgatacagctggctgggacacaaggataacgctggaagatttaaaaaatgaagagatggtcaccaatcacatgaaaggagaacacaaaaagttagctgaagcaattttcaaactcacttatcagaacaaggtagtaagggttcaacgacccacaccgaggggaaccgtcatggacataatcagccgcaaggaccaaagaggctctggacaagtcggaacatacggtctgaacacattcactaatatggaggcgcaacttattagacaaatggagggcgagggtattttcaagagtatccaacgactaacagtaacagaagaaattgcagtacaaaattggctagccagagtgggaagagaaagactcagtcggatggcaatatcgggggatgattgtgttgttaaaccattagatgatagattcgcaagtgcgttaacggctctcaatgatatgggcaaggtgagaaaagacatacagcaatgggaaccttctagaggctggaacgattggacacaggtacccttctgcagccaccattttcatgaactagtaatgaaagacggcagggtacttgtagtgccatgtagaaatcaagacgaacttataggaagagcgagaatatcacaaggcgcaggttggtccttaaaggaaacagcctgtctaggaaagagctatgcgcaaatgtggactttaatgtatttccatagaagagatttaaggctagctgctaacgccatctgctctgcagtcccgagccattgggttccaacctccaggacaacttggtcaattcacgcaaaacacgagtggatgactactgaagatatgcttgccgtatggaacagagtctggatacaagaaaacccgtggatggaagacaaaaccccagtagaatcctgggaagaagtcccctatctaggaaaaagagaggaccaatggtgcggaagccttattggcctaacatcaagagcaacctgggctaaaaatatccaaactgcaataaatcaagttagatcgttaattgggaacgaagaatacaccgattatatgccgtctatgaagcgattcagaaaggaagaagaagaagcgggagtcctgtggtag

SEQ ID NO: 22490 - RNA, 9876 nt, synthetic construct
  misc_feature 1..9876: note = derived and/or modified CDS sequence (opt6) from DENV-2__KF955372__SS-prME
  source 1..9876: mol_type = other RNA
actgcaggagtgattataatgttaattccaactgcgatggcgttccatctcaccactcgcaacggtgaaccacacatgattgtgggaaggcaagaaaaaggaaaaagcctattatttaaaacggaagatggagtcaatatgtgtactcttatggcgatagatttaggagaattgtgcgaagataccatcacatataaatgtccattgctgagacaaaacgaaccggaagatatagactgttggtgtaactccaccagtacgtgggttacatatggtacttgcacaacaacgggagaacatagacgagaaaaacgaagcgtagcattagtaccacacgtgggtatgggactggaaaccagaactgaaacatggatgtcgagtgaaggtgcatggaaacatgttcaaaggatagaaacatggattttacgacaccctggattcacaataatggcagcaattctcgcatatactatcggtacgactcattttcaaagagcactgatatttatattgcttaccgcagtagcgcctagcatgaccatgagatgtattggtattagcaatagagatttcgtggaaggggtatcaggaggcagttgggttgatatagtactagaacacggctcctgtgttactacaatggcgaaaaacaaacctactctagactttgaactaattaaaacagaagcaaaacaaccagccactttacgaaaatactgtatagaagcgaaattaacaaacacaacgacagagtcgagatgtccaacgcaaggcgaacctagcctcaacgaggaacaagacaaacgttttatctgtaaacatagcatggtcgataggggctggggtaacggctgtggtctctttggtaaaggaggaatagttacatgtgcaatgttcacatgtaagaaaaatatggagggaaaagtagtacttccagaaaatcttgaatatacaattgtcataacacctcatagtggagaagaatatgcagtaggaaatgacaccggaaaacacggtaaagagataaaaattacaccacaatcgtcaataacagaagctgagctaaccggatatggaacagtaaccatggaatgctcgccaagaacgggcttagatttcaatgaaatggtgcttttacaaatggaggacaaggcttggcttgttcatagacaatggttcctagaccttcctctaccatggctaccgggagcagacactcaaggttcaaactggatacaaaaagaaacgttagttacattcaaaaatccgcatgccaagaaacaagatgtagtagtgctaggatcccaagaaggagcaatgcacacagcattgactggagcaactgagatacagatgtcttcaggaaatctgctttttacgggacacctaaaatgtcggctccgaatggacaaattacaactgaaaggaatgtcatacagtatgtgcacagggaaattcaaaattgtgaaagagatagcggaaacacaacacggaacaattgtaataagagtacagtatgaaggagacggatcgccctgcaaaataccatttgaaataatggacttagagaaacggcacgtcttagggagattaataactgtgaatccgatagttacagaaaaagactcaccagttaatgtagaggccgaacctccatttggagatagttacataattattggtgttgaacccggacaattaaaactaaattggttcaagaaaggatcttcaataggtcagatgtttgaaacaacaatgagaggggcaaaaaggatggcaattttaggtgatacggcatgggatttcggatccttgggtggtgtattcacctcaatagggaaggcactccatcaggtgtttggagcaatatacggagctgcgttcagcggcgtcagctggactatgaagatactcatcggggtaatcattacctggatagggatgaactcgcggagtacttcattaagtgtttccctagtccttgttggcgtagtcacgttgtatctaggagtgatggttcaagccgactcaggttgcgtagtaagttggaaaaacaaagaacttaagtgcgggtccggaatatttataacagacaatgttcacacttggacagagcaatacaagtttcaaccagaaagccctagcaaattagcatccgcgatacagaaagctcacgaagaaggcatctgtggtatacgatcagtaacgaggctcgaaaatctgatgtggaaacaaattacgcccgaattaaatcacattttgagcgaaaatgaagtcaagctaaccattatgacaggagacataaagggtataatgcaggccggaaaaagatcactcagaccgcaaccaactgaactaaaatactcatggaaaacttggggcaaagccaaaatgctgagtaccgaaagtcacaaccagacttttcttatagatggaccggaaacagcagagtgtcccaataccaacagagcctggaatagtcttgaagtagaggactatggatttggcgttttcagcacaaacatatggctaaagctacgcgaaaaacaggacgtattctgtgattcaaaattgatgtctgctgcgattaaagacaaccgggccgtacacgcagacatgggatactggattgaaagtgcactaaacgatacatggaaaatggaaaaggcttctttcatagaagtaaagtcgtgtcattggccaaaaagtcataccctatggtccaacggcgtactagagagtgaaatgataatacccaaaaattttgctgggcccgtaagtcagcataattatcgcccgggttaccatacgcagaccgctggcccctggcatctaggtaaattagaaatggatttcgatttttgtgaagggacaacagtcgtagtgacagaagattgcggtaatagaggaccgagcttacgaaccacaacggcttcaggcaaacttattacagaatggtgctgcaggagttgtacactaccgccgttaagatatcgaggtgaagacggttgttggtacggaatggaaataaggcccctaaaagaaaaggaagaaaatcttgtaaactcgctagtcaccgctggacatggacagattgacaattttagcttaggggtactggggatggctctcttccttgaggaaatgttaaggaccagagttgggactaaacatgccattctgctagtcgcagtttcattcgtaaccttaattacaggtaacatgtcatttagggatttgggaagggtaatggttatggtaggagcaactatgactgacgacataggtatgggcgtgacctacctcgcgctattggccgccttcaaagtcaggccgacttttgcagccggtctcttattacgcaagctaacatctaaagaacttatgatggcaacaatcgggatagcactcctatcacaaagcactatcccagaaacaatactagaactaacagatgcattagcgctaggtatgatggttttaaaaatcgtccgtaacatggaaaaataccaacttgcggtcacaattatggctatatcgtgtgtaccgaacgcggtaatactacagaacgcgtggaaggtcagctgcaccattctcgcagcagtaagcgtctcacctttattactaacgagctcacagcaaaaggctgattggataccactagctttaacaataaaaggcttaaatcctacagcgatattcttaaccaccttgtccagaaccagcaagaaaagaagctggcctttaaatgaagccgtaatggcagtaggtatggtttcaatactggcgagtagtttactcaaaaacgatataccaatgacgggcccactggtagcgggtggactactaacggtctgttatgtactcactggaagatccgctgacttagaattggagcgagctgccgacgttaagtgggaagaccaagcagaaataagtggatcatcacctatcttaagcattacaataagtgaggacgggagcatgtcgatcaaaaatgaagaggaggaacaaacccttacgatattaattcgtacaggtttattagtcatatcgggtgtgttcccagttagcataccaataacggcagctgcctggtacttgtgggaggttaagaaacaaagagcgggagttttgtgggacgtaccgtcacctcctcctgtcggtaaagcggaactagaagacggagcataccggattaaacaacgaggaatctttggctatagtcagatcggagctggtgtatataaagaaggcacttttcatacgatgtggcacgtgacccgtggagcagtgttaatgcatagaggtaaaaggattgaaccgtcctgggcagacgtaaagaaagatttaatatcttatggtggcggatggaaactcgagggggagtggaaagaaggtgaagaggtccaggttttagctctagagcccggcaaaaatccccgagctgtacagacaaaacccggattgttcaaaacaaacacaggtacgattggtgctgtatcgctagactttagtccaggaacctcgggcagcccgatcgtggatcggaaagggaaagtagttgggttatacggaaatggtgtggtgacgagaagcggtgcatacgtttcggcaatcgcacaaaccgagaagtcaatagaagataatcccgaaatagaagatgacatctttagaaagaaaagactgactataatggatctacatccaggagctggcaaaacaaagcgatacctaccggcgatagtaagggaggcgatcaagaggggattacgaacactaattttggcaccgacacgggtcgttgccgcggaaatggaggaggctttgcgtggattacctatacgttaccaaacaccagcaatacgggctgagcacactggaagagagatagttgacttaatgtgtcacgcgacgtttactatgagactactatcaccggtacgcgtcccaaattataatctaataataatggatgaagcacacttcacagacccagctagcacagccgctagaggttacataagtacaagagtagaaatgggagaagcggcaggaatttttatgacagcgacgccgcctggtagtcgagacccattcccacaaagtaatgcgccgatcatggacgaagaaagagaaattcctgaacgttcgtggaatagcggtcacgagtgggtcacagatttcaagggaaaaacagtctggtttgtaccgagtataaaagcaggcaatgatattgccgcatgcttgaggaaaaacggcaagaaagtgatacaattgtctagaaagacattcgattctgaatatgtaaaaacaagggctaatgactgggactttgtagtaactacagatatcagtgaaatgggagcaaacttccgagccgaaagagtaatagatccacggaggtgcatgaaacctgtcatcctaaccgacggagaggaaagagtaatattggcgggtcctatgccagttacccattcatccgcggctcaaagaaggggtagaattggacgcaaccccaaaaacgaaaacgaccaatatatatatatgggtgagccacttgaaaatgacgaagactgtgctcattggaaagaagcaaaaatgctcctagataacataaataccccggagggaataataccttcaatgtttgaacccgaacgagaaaaagtagatgctattgatggcgaatacagactacgaggggaagctaggaagactttcgtagacctgatgagacgtggggatcttcctgtatggctagcataccgcgttgcggcagaaggaattaactatgcagacagaaggtggtgctttgacgggatcaaaaataatcaaatattagaggaaaatgtggaagttgaaatatggacgaaggaaggtgaacgaaagaaattgaaacctagatggctcgacgcacgaatatattcagatcccctggctttaaaagagttcaaagagtttgctgcgggtcggaagtcgttgacgttaaatttaataactgaaatgggccgactgcctacgtttatgacacaaaaagctagagacgcgctggacaatctagctgtcctacacactgccgaagtcggtggtagagcgtataatcatgctctgtctgaattgccagaaactttagagacactcttactattgacactgcttgctacagtaacgggaggtatctttctattccttatgagtgggaaagggattggtaaaatgactctaggtatgtgttgtatcataacggcctcaatacttctatggtacgctcaaatacaacctcattggatcgccgcatcaatcatacttgaatttttcctgatagtcctactcataccagaaccagaaaaacagaggactccccaagataaccaactaacttatgtcgttatcgcgatactgacagtggttgccgcaacaatggcaaacgagatgggatttctagagaaaaccaagaaagatctcgggctcggttcgataaccacgcaagaatcggaatcaaacatcctagatatcgatttacgaccagcatctgcatggacactttatgcagtggcgacaacatttgtaactccaatgttgcgacatagcattgaaaatagctcagtaaatgtatcattaaccgcgatagcaaatcaagctacagtactgatgggcttaggaagagggtggcccttaagtaagatggatataggagtcccgctactagcgataggctgctactcccaagtgaatccaatcactctcacagccgcgctattgttgctggttgctcattatgcaatcattggtcctggattacaagcaaaagcaaccagagaagcgcagaaaagagctgctgcaggcataatgaagaaccctacagttgacggaatcacagttatcgatctcgaaccgattccttatgacccaaagtttgaaaaacaattgggacaagtcatgcttttggtgctctgtgtaacccaagtactcatgatgaggacaacatgggctttatgtgaagcactaactcttgccacgggtccgattagcaccctatgggaagggaatccaggtcgattttggaacacaacaatagccgtaagtatggcgaacatatttcgtggttcttatcttgcaggcgccggactattgttcagcataatgaaaaatactacaaacacccgtagaggaactggcaacattggtgagactctaggggaaaaatggaaatctcgattaaacgctttagggaagtctgagttccaaatatacaagaaatccggaatacaagaagtagaccgcacactcgcaaaagagggaatcaaaagaggcgaaacagaccatcatgcggttagtcgaggatcagcaaaacttagatggtttgtggaaagaaatatggtaactccggaagggaaagttgtagacctgggatgtggaagaggcggatggtcttactactgtggcggtttgaaaaacgtaagagaagtcaaaggattaaccaaaggaggccctgggcatgaagaacccatccctatgagtacttacggttggaacctagttcgcctacagtctggagttgacgtcttctttacccctcctgaaaaatgcgatactctactttgtgacattggtgaatcgagccctaatcccactattgaggcaggtagaaccctaagggtactcaaccttgtagaaaactggttaaacaacaacacacaattctgcataaaagtactaaatccttacatgccatctgtaatagaaaagatggaaactctacagagaaagtatggaggcgctttagttagaaacccattgagtagaaatagcacacatgaaatgtattgggtgagtaatgcaacagggaatattgtaagttcagtaaatatgatcagccgcatgttaataaatagatttacgatgaagcacaagaaagcaacctacgagcccgacgtagacttaggcagtggtacgagaaacattggaatagaaaacgaaataccaaatctagatattataggaaagagaatagaaaagataaaacaagagcatgaaaccagttggcactacgaccaggaccatccttataaaacgtgggcctatcacggctcgtatgaaacaaaacagacgggttcagcaagcagtatggtaaacggtgtggtgcgattattaaccaaaccgtgggacgtggtacccatggtaacacaaatggcaatgactgatacaacaccattcggtcaacaaagagtttttaaagaaaaagtggacacgagaactcaagagccaaaagaaggtactaagaaattaatgaggatcacagcagaatggctctggaaagaattaggtaaaaagaaaactcctaggatgtgcactcgagaagaatttacaagaaaagtacgcagcaatgcagctttaggggcaatattcacggatgaaaacaaatggaaaagtgctcgggaagccgttgaagacagtcgattttgggagctcgtcgatagagaacgcaatttacatttagaaggaaaatgcgaaacatgtgtttataacatgatgggaaaaagagagaagaaactaggagagttcggcaaagctaaggggagtagggctatttggtacatgtggctgggagcacgatttctggagtttgaagcactaggatttttaaacgaagatcattggttcagtagaggcaattcattatcaggagtagaaggggaaggtctccataaacttggatacattcttcgagatgtcagcaagaaagaagggggagcgatgtatgcagacgacacagccggatgggacacacgaatcaccctagaagacctgaaaaatgaagaaatggtcaccaatcacatgaaaggtgaacacaagaaactagcggaagcaatatttaaactaacgtaccaaaacaaagtagtgagggttcaacgtccgactccacgaggaaccgtcatggatataataagtaggaaagaccaaagaggctcaggacaagtaggaacatacggacttaacacgttcactaatatggaagcacaattaattagacaaatggagggtgaaggaatatttaaatctatacaaagattaacagtaacggaagaaatcgcggtacaaaattggttagcacgggtaggcagagagcgactgtcgagaatggctatttctggggacgattgcgtggttaaacctttggacgaccgattcgcatctgctcttacagctcttaacgatatgggtaaagtcaggaaagacatccagcaatgggaaccatctaggggctggaatgattggacccaagtgccattttgcagccatcactttcacgaattagttatgaaagacgggcgagttttagtagtaccttgtcgaaatcaagatgagctaatcggaagggccagaatatcccaaggggcaggatggtccttaaaggaaacagcatgtctaggaaaaagctatgcacaaatgtggacactcatgtactttcatagacgagatcttagactagctgcaaatgctatttgtagtgcggttccgtctcattgggtgccgacaagtcgaacgacatggtctatacatgcaaaacacgaatggatgacaacggaggatatgctagcagtatggaaccgcgtatggatacaagaaaatccatggatggaagataaaactcccgtagaatcatgggaagaggttccatacttaggaaaaagagaagaccagtggtgtggatccttaatcggcttaacttcaagagctacatgggccaaaaacatacagacggctataaaccaagtaaggtcattaatcggtaatgaagaatatactgattatatgccctctatgaaacgttttaggaaagaggaggaggaagcgggcgtgctatggtaa

SEQ ID NO: 22491 - RNA, 9876 nt, synthetic construct
  misc_feature 1..9876: note = derived and/or modified CDS sequence (opt6) from DENV-2__KF955373__SS-prME
  source 1..9876: mol_type = other RNA
accgcaggagttatcataatgttaatacctacggccatggcatttcacctaacgacccggaatggagaaccccatatgattgtcggcagacaagaaaaaggcaagtctttgctatttaaaacagaagatggcgtaaatatgtgtacactaatggcgattgacttaggcgaactctgcgaagatacaatcacctacaaatgtccattactaaggcagaatgaacctgaggatatagattgttggtgtaatagcacatcaacatgggtcacttacggaacttgtaccacgaccggtgaacatagaagggaaaaacggtcagtagcactagtacctcatgtgggtatgggtctagagacacgtacagagacttggatgagtagtgagggagcatggaaacacgtacaacgaattgaaacatggatcttaaggcatccaggttttacaataatggcagctatactcgcctatacaataggaacgacacattttcaaagagctttaatctttattttacttacagctgtcgctccttctatgacaatgagatgtatcggaatctccaatcgtgactttgtagagggagtgagcggtggcagttgggtcgatattgtactagagcacggaagttgtgtcactaccatggcgaagaataaacctacactcgactttgaactaattaagactgaagctaaacagccagcaaccctacgaaaatattgtatcgaagctaaacttacaaacaccacaaccgaatcgcgctgtccgacacagggcgagccaagccttaatgaggaacaggataaaagatttatatgtaaacattcaatggtggacaggggctggggcaacggttgtgggttatttgggaagggaggcatagtaacttgtgctatgtttacttgcaaaaaaaatatggagggcaaggtagtcttaccagagaatctagaatacacgatagttataacccctcacagcggtgaagaacatgcagtaggaaatgataccggtaaacatggaaaagaaataaaaatcactccacaatcctccataaccgaggccgaactaactggatacggtacagtaaccatggaatgttcaccgcgtacgggacttgactttaatgagatggtcttgctccaaatggaagacaaggcctggctagtccatcgccaatggtttctagacctcccgctaccctggctacctggtgctgacacgcaaggttccaactggatccaaaaagaaacgttagttacattcaagaatccacatgctaaaaaacaagatgttgtagttcttggtagtcaagaaggcgcaatgcacacagctttaacaggagccacagaaatacaaatgagtagtggcaacctcttattcacggggcatcttaaatgcagattacgtatggataagctacaactcaagggcatgagttattcaatgtgtacaggaaagtttaagattgtcaaagaaatcgcagaaacacaacatggaacaatagtaatacgggttcaatacgagggtgatggtagcccatgcaaaataccattcgaaataatggacttggaaaaaagacatgtcctggggagacttataaccgtaaaccctatagtaacagaaaaagacagtccagttaatattgaagccgaaccgccatttggtgatagttatataatcatcggggtggaaccaggtcaattaaaacttaactggtttaagaaaggaagtagtataggtcaaatgttcgaaacaaccatgagaggagcaaagcgtatggcaattctaggagacacagcatgggactttggttcccttggaggagtattcactagcatcggcaaagcattgcaccaagtttttggagcgatatatggtgctgctttctcaggagtatcctggactatgaagatattaattggggtaataatcacgtggataggaatgaattctcgaagtacgtcgctaagcgttagcctagtgctagtaggagtggttaccttatacctaggcgtaatggtacaagcagattcaggatgtgtagtaagttggaaaaataaagaactcaaatgcggtagtgggatctttataacggacaatgtacatacttggaccgaacaatacaagtttcaaccagaatcgccctcaaaactagcgtcagcaatacagaaggcacatgaagaaggaatatgcggtataagatcagtgacgcgattggaaaatcttatgtggaagcagatcacaccagaattgaaccacattttaagtgagaacgaggtaaaactaactattatgacaggggacataaaaggaataatgcaggcaggcaaacgatcgctacgtccgcaacctactgagcttaaatactcctggaaaacatggggaaaagcaaaaatgctctcgacagaaagtcataatcagacgtttttaatcgacggaccagagacagcagagtgtcctaatacgaacagagcatggaatagcttagaggtagaagactatggattcggggttttctcaacaaatatatggctaaagttacgagagaaacaagacgttttttgcgactctaagttaatgtccgcagcgattaaggacaatcgtgcagtccatgcggacatgggatattggatcgaatcagcattaaacgatacatggaagatggaaaaagctagttttattgaagtaaaatcctgtcattggcccaaatcgcatacactatggtcaaatggagttctcgaaagcgagatgataatacccaagaattttgcaggtccggtgtctcaacataattatcgacccggctaccacactcaaacggctggaccatggcacttaggaaaacttgagatggatttcgacttttgtgagggaacaaccgtagtggtaactgaagattgcggaaataggggacccagccttagaaccacgacagctagtgggaagctcatcacagaatggtgttgccgatcatgtactcttccaccgcttagatatcgaggcgaggatgggtgttggtatggtatggaaatacgcccactaaaagaaaaagaggaaaatttagttaattctttggttactgctgggcatggacaaattgacaacttcagccttggtgtgcttggtatggcattgtttctggaagagatgttacgtacaagggtgggaacaaaacatgccattctattagtggcggtctcttttgtaactcttataaccggaaacatgtctttccgtgacctcggcagagtgatggttatggttggcgccacaatgacagatgatattggcatgggagtaacatatctagcattacttgcagcatttaaagttcgtcccacatttgcagccggactactactacgaaaactaacctcgaaagagttaatgatggcaactataggcatagcactgctatcccaatccacaatccccgaaacgattctagagttaactgatgcattagcattaggaatgatggttctcaaaattgtacgaaacatggaaaagtatcaattagccgtcactatcatggcaatatcttgtgttccaaacgcagtaattctgcaaaatgcttggaaagtgagttgcactatcctagctgcagtctccgtatcccctttattgcttacaagttcacagcaaaaagccgattggattccccttgcacttacaattaaaggattgaatccgacagccatattccttacaacactatcaaggacatcaaagaagaggtcctggcctttaaatgaagcggttatggctgtagggatggtttcaattttggcgagttcactattaaaaaacgacatcccgatgaccggccctctagttgcagggggtttactcaccgtatgctatgtgctgacgggccgatcagctgatctggaattggaacgcgctgctgacgtaaaatgggaggaccaggcagagataagcggttccagtcctatattgtcaataacaattagtgaggacggaagtatgtctattaaaaatgaagaagaagaacacactttaaccattttaattaggactggcttactagtcataagcggtgttttccccctttctataccaatcacagcggctgcatggtatttgtgggaagttaaaaaacaaagagcgggcgtgctatgggacgttccttcaccacccccagtgggcaaggccgaacttgaagatggagcatatcgaattaaacaacggggtattttcggatatagccaaataggagcgggcgtatacaaagagggaacctttcacacgatgtggcatgtcactagaggagcggtcctaatgcacagaggcaagcgaatagaaccctcatgggcggatgtaaagaaggatcttatctcctatggtgggggttggaaattagaaggagaatggaaagaaggcgaagaagtccaagtattggcgctagaacccggaaaaaatccgagagcagtgcaaacaaaaccaggacttttcaagactaataccggaacaattggcgcagtaagcctcgatttcagcccaggaacaagtggaagcccgatagtggataggaaaggtaaagttgtcggcctctatgggaatggtgttgtcacccgaagtggtgcatacgtatcagcaatagcacaaacagaaaaaagcatagaggataatccggaaatagaagacgacatttttaggaagaagcgcttaacaataatggatctacaccctggcgcgggaaaaacgaaaagatacttacctgctatcgttagagaagcaataaaaagaggacttcgtacgttgattctagctcctacaagggtagtagcagcagaaatggaagaagccttaagaggattgccaataaggtatcagacgccagcaatacgagccgaacacactggccgggaaattgtagatctaatgtgccatgcaacctttacaatgcgactcttatcacccgtaagagtgccgaactataatttgattattatggatgaagcgcactttaccgatccagcatcgattgccgcacgtggatatatatccactcgagtagaaatgggcgaggccgctggtattttcatgacagccacgccacccgggtctagagacccgtttcctcagagcaacgcgcctatcatggacgaggaacgagaaattccagaacgatcatggaattccgggcatgaatgggtaacagatttcaaaggaaagactgtatggttcgtcccttctataaaagcaggtaacgatattgcagcgtgcttaaggaaaaatgggaaaaaggtaatccaattgtcgaggaagacctttgattcagaatatgtaaagacaagagcaaatgattgggattttgtagtaaccacggatatatcggaaatgggagcaaacttcagagcggagcgagtcatagatccaaggagatgcatgaaacccgtgattttaaccgacggagaagaaagggtaatattagcgggaccaatgccggtaacacacagctcagcagcccaaagaagaggcagaattgggagaaatcccaaaaatgaaaacgaccaatacatatacatgggagaacccttggaaaacgatgaagactgtgcacactggaaagaagcgaagatgttactagataatatcaacactccagaagggatcattcccagcatgtttgaaccagaaagggaaaaggtagacgcaattgatggagaatatagattaagaggggaagccagaaagacgtttgtcgatctgatgcgtcgaggagatttacctgtatggttggcatatcgagtggcagctgaaggaattaactatgccgaccgcaggtggtgtttcgatggtattaaaaataaccaaatactggaagagaatgtggaagtagaaatatggacaaaagaaggtgaaagaaaaaagttaaaacctagatggctcgatgctcgaatatacagtgatccgttagccttgaaagaattcaaagaatttgcagctgggagaaaatcactaacgctaaatttaataactgaaatgggaagattacctacgtttatgacacaaaaagcaagagacgcacttgataacctagcagttttgcataccgccgaagttggaggccgtgcttataatcacgctttatccgaactacccgagactttagagaccctattactattaacattgctagcgactgtcactgggggcatattcctatttctaatgtctggaaagggaattggcaaaatgacactgggaatgtgctgtataatcactgcatccatcttactatggtacgcgcaaatacaaccacattggatagcagctagtataatattagaattcttcctaatagtcctattaatcccagaaccagaaaaacaacgtacgcctcaggacaaccaattgacttacgttgttatcgcaattcttacagttgtagcggcgactatggctaatgagatggggttccttgaaaagacgaaaaaagaccttggtttaggaagtataacaactcaagaatctgaatcaaacatactagatatagatttacgtccagcaagcgcctggactttatacgccgtagccactacttttgtaacacccatgttaagacactcaatagaaaacagtagcgtaaatgtatcattaactgccatagcaaatcaagcgactgtactgatggggttaggtagaggttggccactcagcaagatggatataggggttcccctgttagctataggttgttattcacaagttaatcccatcactttaacagccgctctactcctactagtagctcactatgcaatcattggaccaggactacaagctaaagcaacacgcgaggcacaaaaacgcgcagctgcgggaataatgaagaacccaacagttgatggaataactgtaatagatctcgagcccattccttacgatcctaaatttgaaaaacaattagggcaagtaatgttacttgtcctctgtgttacacaagttctaatgatgagaacaacatgggcgctatgtgaagctttaacgctagcaaccggtccaatttctacactatgggaggggaatccaggacgtttctggaataccactattgccgtgtccatggcaaatatattccgtgggtcatatttagcaggagcgggactgttattttccattatgaaaaacactactaacactaggcgtgggacagggaatataggagagacgctaggagaaaaatggaaatctcgattaaatgcgcttgggaaatcggaatttcaaatttataaaaagtcgggaattcaggaggtggatagaacgctcgctaaagagggtataaaacgcggcgaaacggaccatcatgcagtaagtcgtggatcggccaaattacgatggttcgtagaaaggaatatggtaacaccagaaggaaaagtagtcgatctaggctgcggacgaggtggctggtcatattactgcggaggcttaaaaaatgtaagggaagtaaagggcttaacaaagggtggccctggtcacgaagaaccgataccaatgtcaacatatggatggaatctcgttcggctacaaagcggagtagacgtgttctttacgccacctgaaaagtgcgatacactgttgtgcgacataggagagtctagcccaaaccccaccattgaggcagggcgcacgctccgagttctaaatctagtagaaaactggctaaataacaacacacagttttgtattaaggttctcaatccctacatgccatcggtaatagagaaaatggaaacgctccaaaggaaatatggaggagccttagtaagaaaccccctcagtaggaacagcactcacgaaatgtactgggtttcaaatgcaactggaaacattgtatcctcggtgaacatgatatcgcggatgcttattaataggtttactatgaaacacaagaaagcgacttacgaaccagacgtggacttaggatcgggaacacgaaatataggaattgaaaatgaaataccgaacttagacattataggaaaaaggatagaaaagattaaacaggaacacgagacatcttggcactatgatcaagatcacccatacaagacttgggcctaccatggctcatacgaaacaaaacaaacaggaagcgccagcagcatggtcaacggagtagtgaaactcctcaccaagccctgggacgttgtaccaatggtaacacagatggcgatgacagacactacgccgttcggacaacaaagggtgtttaaggaaaaagtagacacacgaacacaagaacccaaagaaggtacaaaaaaattgatgagaataactgctgaatggctttggaaagaattaggcaaaaaaaaaaccccaagaatgtgcacaagagaagaatttaccaggaaggtccgatcaaatgcggcattaggagccatatttacggacgaaaataaatggaagtctgcgagagaagcggtcgaagactcaaggttttgggaactagtagatagagaaagaaatcttcatctggaaggcaagtgcgaaacatgtgtgtataatatgatgggtaaaagggagaaaaaattaggagagtttggaaaagccaaaggctctagagctatctggtatatgtggctaggggcccgattccttgaatttgaagcattgggttttttgaatgaagatcattggttttcaaggggcaattctctctcaggagtagaaggggaggggttacacaagctaggatacatcctgagggatgtatctaaaaaggaaggtggcgcaatgtatgccgatgatactgcgggatgggatacccgaataactttagaggaccttaagaacgaggaaatggtcactaaccatatgaagggtgaacataagaaactagcagaagctatttttaaactaacttatcaaaacaaagtcgtacgtgtccaacggccaacaccacgcggtaccgtaatggacattatttcaagaaaggaccaacgaggatcaggtcaggttggcacatacggattaaatacgttcactaatatggaagcgcagttaattagacaaatggaaggggagggtatctttaaaagtattcagagactaacggtgacggaggagattgctgtacagaattggctagctagagtcggtagagaaagactaagcagaatggcaatatctggagacgattgcgtcgtaaagccattagacgaccgcttcgctagcgcgctaacggcattaaatgatatgggtaaggtaagaaaagacattcaacaatgggaacctagtcgtggatggaacgattggacgcaggtacctttctgttcccatcatttccacgaactagttatgaaagacggccgcgttctggtagtgccatgtaggaatcaggacgagctaattggtcgcgcaagaatttcacaaggtgcaggttggtcgttgaaagaaactgcatgtttgggaaaaagctacgcccaaatgtggacccttatgtatttccaccgaagagacttacggctagcagcaaatgcaatttgttccgccgtaccttcccactgggtccccaccagtcgaacaacctggtccatacacgcaaaacatgaatggatgaccacggaagatatgctggccgtctggaacagagtttggatacaagaaaacccatggatggaggacaaaacgcctgtagaatcgtgggaagaggtaccatacttaggtaaaagagaagatcaatggtgtggttccctcattggtctgacgagtagagccacatgggcaaaaaatatacaaactgccattaaccaagttagatcactcattggtaatgaggagtatactgattatatgccatctatgaaaaggttccgtaaagaagaggaggaggcgggagttttatggtaa

SEQ ID NO: 22492 - RNA, 9876 nt, synthetic construct
  misc_feature 1..9876: note = derived and/or modified CDS sequence (opt6) from DENV-2__GQ868600__SS-prME
  source 1..9876: mol_type = other RNA
acagccggtatgattataatgctaataccgaccgtaatggcatttcacttgaccacaagaaacggtgaaccacacatgattgtatccagacaagaaaaaggtaagagcttactatttaaaacaaaagacggtaccaacatgtgcacactaatggctatggatcttggggaactttgcgaagacacaataacgtacaaatgtccatttcttaaacaaaacgaacccgaagatatagactgttggtgcaacagtacctcgacatgggtcacatatggtacttgtacgaccactggggaacataggagagaaaaacgttcagtagcattagttccacacgtaggaatgggactcgaaacccgtaccgaaacatggatgtcaagcgaaggtgcatggaaacacgcgcaacgtatagaaacgtggattctacgacatccagggttcaccataatggccgcaatattagcatacacaataggaacaactcattttcaaagagtactaattttcatcttacttacagcaatagcaccttcgatgacaatgagatgtataggaatcagtaatagagattttgttgagggagtgagtggtggaagctgggttgacatcgtgttagaacatggaagctgcgtgactacgatggctaaaaataaaccaacactcgatttcgaactaatcaaaactgaagcaaaacaacctgcaacactccgaaaatactgcatagaagcaaaattaaccaatactactacagactccagatgtccaacgcaaggagagcctaccctcaatgaagaacaagacaaaagatttgtttgtaaacattcaatggtagatcggggatggggtaacggatgtggtctttttggcaaaggaggaatagtgacttgcgcaatgtttacttgtaagaaaaatatggaggggaaaatagtgcaaccagaaaatctagaatacaccgtcgttataacaccgcatagtggcgaagaacacgcggttgggaacgacacaggaaaacatgggaaagaagttaaaataaccccacaaagttccataaccgaggcagaactgacaggatatgggaccgtaactatggaatgcagcccaagaacaggtctggatttcaacgaaatggttcttttacaaatggaggacaaggcatggctagttcacagacaatggttcttggatctaccactcccgtggttgccgggcgcagacactcaaggctcgaactggattcaaaaagaaacacttgtaacttttaagaacccgcacgcgaaaaagcaagacgtagtcgtactgggaagtcaagaaggagcaatgcacactgccttaacaggtgcgacggaaatacaaatgtcgtccggaaatttattatttactggccatttaaagtgccgactcaggatggataaacttcagttaaaaggaatgagctattcaatgtgcacgggtaaatttaagatagtgaaagaaattgctgaaacacaacatggaacaattgtaatacgcgtgcagtacgaaggagatggctcaccgtgtaaaatccctttcgaaataatggatcttgaaaaacgtcatgttctcggccggctgataacagtaaatccaatagtaactgagaaggattcacccgttaatatagaagcagaaccgccatttggcgattcatacattataatcggagtcgaaccaggacagttaaaactagattggttcaagaaaggatcatctattggacagatgtttgaaactaccatgcgtggtgccaagagaatggcaattctaggagatacagcctgggatttcggatcgttaggtggagttttcacttctattgggaaagcattgcatcaagtttttggcgccatctatggcgcagcctttagcggagtaagctggactatgaaaatcctaataggagttattataacatggattggaatgaactcaagatctacaagcctgagcgtaagtctcgtcctagtaggcatcgtgacgctctatttaggagtaatggtccaggctgacagtgggtgcgtagtctcctggaaaaacaaagagcttaaatgcggcagcggaatatttgtcactgacaacgttcatacgtggactgaacagtacaaattccaaccggagagcccatcaaaattagcatccgcaatacaaaaagcccacgaggagggaatctgcggtataagaagcgtcaccaggttagaaaacctaatgtggaaacaaataacgagcgagctcaaccatattttatcagaaaatgaagtgaaactgactataatgacaggcgatataaaaggaataatgcaggtagggaaaagaagtctacggcctcaacccacagaactaaggtactcgtggaaaacgtggggcaaagccaaaatgttaagtacagaattgcataatcagacctttcttattgacggaccagaaactgcagagtgccctaatacaaaccgagcttggaactcgcttgaagtagaggattatggcttcggggtattcaccaccaatatctggctaaggttaagagagaaacaggatgctttttgcgacagtaagttaatgtcggctgcaataaaagacaatagagcggtacatgcggatatggggtattggattgaatcagcactaaatgatacatggaaaatagaaaaggcatcctttatcgaagtcaagtcgtgtcattggccaaaatcccatacgctatggtcgaatggtgtactggaaagtgaaatggtaattcccaaaaattttgccgggccagtcagtcaacacaataatagaccgggatatcatactcaaacggccggaccatggcacctcgggaaattagaaatggattttgatttttgtgaaggaacgactgtagttgttacggaggattgtggcaatcgggggcctagtttgaggacaactaccgcatcgggaaaattaattacagagtggtgttgcagatcctgtacgttaccaccacttagatacagaggtgaagacggttgctggtacggtatggaaataaggccacttaaagaaaaagaagagaatttggtctcgtctttagtaacagcgggacacggtcaaattgacaacttctcactgggtattttaggtatggcacttttcctagaagagatgctgcgaacacgagtcggcaccaaacatgctatactcctagttgctgttagtttcgtcacattaataacgggtaacatgagttttcgggatctgggtagggtgatggttatggtgggagcaacgatgacggatgatattgggatgggagtcacgtatctagcactattagcagcatttaaagtcagaccgacattcgccgcaggactactactcaggaaactcacctccaaagagttaatgatgacaacaattgggatcgtacttttaagccaatcgagtattcctgaaactatactagaactcacagatgcccttgcccttggaatgatggtcttgaaaatggtgagaaacatggaaaaataccaactagcagtaaccattatggcgatactttgtgtacctaacgcagttatactgcagaacgcttggaaagttagttgcacaattctagcagtggtttcagtgtcaccgttattattaacatcatctcagcaaaaagctgattggattcctttagcccttacaattaaaggccttaaccctacagctatattcttaaccacactatcaaggactagcaagaaacgatcatggcctttaaatgaagcaatcatggctgttggcatggtatctatattagccagttctctgctaaagaatgatatccccatgacgggacctctggtggctggaggcctattgacggtttgttacgtattaacgggtagatcagctgatttagaacttgaaagggcaaccgacgtaaaatgggatgaccaggcggagatctctggaagcagcccaatactatcgataacgatcagtgaagatggtagtatgtccattaaaaacgaagaagaagaacaaacactaactattctgattagaacgggcttattagtcataagcggactctttccagtcagcatacctataaccgccgcggcgtggtatctttgggaagttaagaaacaaagggcgggagtattatgggatgttccttcaccacctccagtaggaaaagccgaattagaagacggagcttatcgtataaaacaaaagggtattcttggttattcccaaatcggagcaggagtctataaagaaggaacatttcatacgatgtggcacgttacaagaggtgcagttttaatgcataaggggaaaagaatagaaccatcctgggctgatgtcaagaaagacctgatcagttatggaggaggctggaagttggaaggcgaatggaaagaaggggaggaggtacaagtgctggcgctggaaccaggcaaaaatccaagagcagtacaaactaagcctggcctattccgtacgaatactggtaccataggcgcagtctccttagatttttctccaggaacatcaggatcaccaatagttgacaagaaaggaaaagtagtcggactatatggaaacggcgttgtaacacgatcaggtgcatacgtatcggcaatcgcccaaaccgagaaatctattgaggataacccggaaatagaagacgatatatttagaaaaagacgtctcacaattatggatttacatccgggggcaggtaaaacgaagcgttacttgcccgcaatagtacgtgaggcaataaaacgcggactaagaacattgattctggcacctacacgtgttgttgcagccgaaatggaagaagcacttaggggactaccaataagataccagaccccggcaattagggcagaacatacgggcagagaaattgttgatttgatgtgccacgcaacgtttacaatgagactattatcgccaatacgagttcccaactacaacttaataatcatggatgaagcacactttacagatccagcctcaattgcggcaagaggatacataagtacaagagtcgaaatgggtgaagcagcgggaatttttatgactgcaacaccacccggatctcgagatccttttcctcaaagtaacgcaccgataatggatgaagagagagaaattccggaacgttcctggaacagtggtcacgaatgggtcacggatttcaaaggtaaaactgtttggtttgtgccgagtatcaagaccggcaatgatatagcagcatgtcttcggaaaaatggaaagcgtgtcatacaattatcaagaaaaacatttgattcggaatacgtaaaaacacgtacgaatgattgggacttcgtcgtgacgacagacatatcggaaatgggggctaattttaaagcagaaagagtgattgatccccgtagatgcatgaaaccagtcattctcacagatggtgaagaacgtgtcatactagcaggaccaatgcccgtaacgcattctagtgcagctcaacgtagaggcagaataggtcggaaccctaggaatgagaatgatcaatatatttatatgggcgaaccactggaaaatgatgaagattgtgcccattggaaagaagcgaagatgttattagataacataaacacgccagaaggtattataccatcaatgtttgaacccgaacgtgaaaaagtggatgctattgacggtgaataccgcttgagaggcgaagctagaaaaacatttgtagatcttatgaggcgaggtgatttacccgtatggttagcctataaagtcgccgcggaaggaattaactatgcagaccgacgatggtgtttcgacggaacaaggaacaatcaaatacttgaggaaaacgtagaggttgaaatctggacaaaggaaggggaaaggaagaaacttaaaccaagatggctagatgccagaatatattctgaccctctcgcacttaaagaatttaaggagttcgcagcgggaagaaaatcgctaaccttaaacttaattactgaaatgggaagattaccaaccttcatgactcaaaaagcacgagatgcgttagataacctagctgtactgcatacagccgaagctggcggcaaggcttacaaccatgcgctgagcgaattaccagaaacacttgaaactttgttattattgacccttttggcgaccgttactggtggaattttcctattcctaatgtctgggcgaggcattggaaaaatgaccctaggaatgtgctgtatcataacggcctcgatcttgctgtggtacgcccaaatacaaccacattggatagctgcaagcataatactggagttcttcttaatcgttctgcttataccagaaccagaaaaacagaggaccccacaagacaatcagctgacatatgtaatcattgcaatattaacggtggttgctgcgacaatggcaaatgagatgggttttctagaaaagactaagaaagacttaggtcttggaaacatagctacacaacaacctgaaagtaatatattagatattgacctccggccagcaagcgcatggactctttatgcggtcgccacaacttttattactccgatgcttcgccactcgatcgaaaattcgtccgtaaacgtatctttaaccgcaattgccaatcaagctacggtattgatgggattagggaaaggttggccactcagtaaaatggatatcggggtccctctccttgcgataggttgttactcccaagtaaaccccataacacttacagctgcgctactattgctggtggcacactacgcgataatagggcctggcttacaagctaaagccacaagagaagcccaaaagcgagctgctgcaggaataatgaagaatcctacagtagacggtattacggtaattgatcttgatccgataccttacgatccaaaattcgaaaaacagttaggacaagtaatgttattagtcctttgcgtcacccaggtactcatgatgagaacgacctgggcgttatgcgaagcgcttacactcgctaccgggcctgttagcaccctttgggagggaaatccaggaagattttggaacacgacaatcgcagtcagcatggcaaacatctttagaggaagctacctggcaggagctggtcttttgtttagtattatgaaaaatacaacaagtaccaggagaggcacgggaaatataggagaaactttaggtgaaaaatggaagagtaggttaaatgcattgggaaaaagtgagtttcaaatatacaagaaaagtggtattcaagaagtagaccgcactttggcaaaggaaggaattaaaagaggggagactgaccatcatgctgtcagcagaggtagtgccaaattgagatggtttgtcgaacgaaatctagtgacaccagagggtaaggtagttgacttaggttgtggccgcggcggatggagttactactgcggcggattgaaaaacgtaagggaagtgaaaggattgacaaaaggcggccccggacatgaagaaccgattcctatgagcacttatgggtggaacttagttcgactacagagcggagtggacgtcttctttgtcccaccagagaaatgcgacacattgctatgcgacataggagaatcttctccaaatccaacagtagaagctggtagaacactacgagtactgaacttggtagaaaattggcttaataacaacacacaattttgcgtaaaagtgttaaatccatatatgcctagcgtaatcgaaaggatggaaactctacagcgtaaatatggcggagccttggtaaggaatccgttatcaagaaacagcactcacgagatgtactgggtatcaaacgcgagcggaaacatagtttcatccgtcaatatgataagtagaatgcttattaacagattcactatgcgacataagaaggcgacttacgaaccagatgtagacctaggaagtgggacccgtaatattggaatcgaatctgaaacgccaaacttagatatcattggaaaaagaatcgagaaaattaaacaagaacatgaaacgagttggcattatgatcaagaccatccctataaaacgtgggcatatcacggtagttacgaaacaaaacaaacaggcagcgcttcgtcgatggtgaatggtgtcgtccgcctattaacaaaaccttgggatgtagttcctatggtgacccaaatggcaatgactgatacaacaccattcggacaacaaagagtatttaaggaaaaggtagacacaagaacacaagaacctaaagaggggacaaagaaattaatgaaaatcactgcagaatggctctggaaagaactcggcaagaagaaaacaccacgaatgtgtacacgggaagagtttacgaagaaagtcagaagtaatgcggcattaggagccatattcacggatgagaataaatggaaatcggccagagaagccgtcgaagactcacgtttctgggagctagtagataaagaaagaaatctacacttggagggcaagtgtgagacttgtgtttacaatatgatgggaaaaagagagaagaaacttggtgagttcggtaaagcaaaaggatcaagggcgatatggtacatgtggcttggtgcccgattccttgaatttgaagcattgggatttttaaatgaagaccattggtttagccgtgaaaattcgcttagtggtgtggaaggtgagggactccacaaactaggctacatattgagagaagttagtaagaaagaaggtggagcaatgtatgccgatgatactgccggatgggacacacgtataacaattgaagatctcaaaaacgaagagatgataacaaaccatatggcgggggaacataagaaattagcagaagcaattttcaagttaacatatcaaaataaagtggtaagagtacagcgaccgaccccaagagggaccgtaatggacattatcagtcgtagggaccaaagaggatcggggcaagtaggaacatacggcctaaatacatttactaatatggaagcacaattaatcaggcagatggaaggagaaggcatatttaagagtatacaacatctgactgctagcgaagaaatagcggtacaagactggcttgtgcgagtaggacgagagagactgtcgaggatggctatatctggagatgactgcgtggtaaaaccactagacgacaggttcgcccgagcactaacagcgctaaatgatatggggaaagtaagaaaagacattcaacagtgggaaccaagccggggctggaatgattggacgcaagtacctttttgctcgcatcactttcatgaactcattatgaaggatggacgcacacttgtggtaccatgcagaaatcaagacgaactaataggacgtgctcgtatatcgcaaggtgcaggatggtcactgcgagaaacagcttgcctaggaaagagctatgcacaaatgtggtcgttgatgtactttcataggagagacctcaggctagctgcaaatgccatatgtagcgctgtcccaagccattgggttcccacaagtcgcacaacatggtccattcatgcttcccacgaatggatgacaaccgaggacatgctgaccgtgtggaacaaagtatggatattagagaatccctggatggaagataaaacacctgtagaaagttgggaggaaattccatatttaggcaaacgtgaagatcaatggtgtggaagtctaattggacttacatctcgggcaacctgggccaaaaatatacagacagctatcaatcaggttaggtcattgataggtaacgaggagtatacggactatatgccatcaatgaaaagatttaggcgagaagaagaagaagcaggagtcttatggtaa

SEQ ID NO: 22493 - RNA, 9876 nt, synthetic construct
  misc_feature 1..9876: note = derived and/or modified CDS sequence (opt6) from DENV-2__KF955359__SS-prME
  source 1..9876: mol_type = other RNA
acggcaggagtgataatcatgctaataccaactgcaatggctttccatttgacaacaagaaatggggagccacatatgattgtaggaagacaagaaaaaggaaaaagcctattattcaaaacagaagatggagtaaacatgtgcacgctaatggcaatagatttaggtgaattatgtgaagatactataacatacaaatgtcctcttttacgtcagaacgagcctgaggatattgattgttggtgtaattcgacaagtacttgggttacatacggaacctgcactacaacgggcgaacatagaagagaaaaacgtagtgtggcactggtgcctcacgtaggaatgggattagaaacgagaacagaaacatggatgagttcagaaggcgcatggaaacacgtccagagaattgaaacgtggatattaagacatccaggattcactacaatggcagcaatacttgcttatactataggaacaacccacttccaaagagccctaatttttatattactaacagccgtagctccatcgatgactatgcgctgtattggtataagtaatcgtgattttgtcgaaggcgtgagtggaggttcttgggtagatatagtactagaacatggaagttgtgtaacgacaatggccaaaaataaaccaacgctcgactttgaattaataaaaaccgaagccaaacaaccagcaatcctgcgtaaatactgtatagaagccaaacttaccaatacaaccactgaatcacgatgtccgacacaaggagaaccatcactgaacgaagaacaagataaaaggtttatatgcaaacattctatggtcgatcgaggttggggtaatggatgtggtctattcggcaaaggagggattgtgacgtgtgcaatgttcacctgtaagaaaaatatggaaggaaaagtggtattaccagaaaatctcgaatacactatagttatcacgcctcacagtggtgaagaacacgcggtgggaaatgacactgggaaacacggtaaagagataaaaatcactccgcaatcgtccataactgaagctgaacttacaggatatggaacagttacaatggaatgttcaccacgtactggcttagactttaacgaaatggttctactgcaaatggaagacaaagcatggttggtacacagacagtggtttcttgacttaccattaccttggttgccaggagcagatacccaaggatccaattggatccagaaagagaccttagtcaccttcaaaaatccacatgccaagaagcaagatgtagtagttcttggaagccaagaaggggcgatgcatacagctttgactggagcgacagaaattcaaatgagttcaggaaatctactatttacaggacatttaaaatgtagattacgcatggataagttgcaactgaaaggcatgtcttactcaatgtgtaccggcaaattcaagattgtaaaagagatagcagaaacacaacacggtaccatagttattcgagttcagtacgaaggggatggctcaccatgtaagatcccgttcgaaattatggatctagagaaaagacatgtcctgggaagactaataactgtaaacccgatagttactgaaaaagattccccagtcaacatagaagctgaaccaccatttggggacagctatattataataggtgttgaacccggacagcttaagctcaattggtttaaaaaggggagttcaataggacagatgttcgaaaccacgatgcgcggcgctaagcggatggcaatcctaggagacacagcatgggactttggttcgcttggaggtgtgttcacgtcgattgggaaagcattacaccaagttttcggagcgatttatggtgcagcatttagtggagtaagttggacgatgaaaattctgataggggttataataacatggataggaatgaatagccgtagcacctctctcagtgcatctctggtgcttgtaggtatagtcacattatatctaggagtgatggttcaagcggacaccggctgtgttgtcagttggaagaacaaagagttaaagtgcggatcaggaatatttatcacagataatgttcatacttggactgaacaatacaaatttcaaccagaatctccgtcaaaacttgcctcagcaatacaaaaagctcatgaggagggtatttgcggcattcgcagcgttacaaggctagaaaatctaatgtggaagcaaattactcccgaactgaatcacatattgagcgaaaacgaagtaaaactaacaatcatgactggagatattaaaggcataatgcaggcaggaaagagaagcctcaggcctcaaccaacagaattgaaatatagttggaaaacatggggaaaggcgaaaatgctgtctacagaaagtcataatcaaacatttctaatagatgggcctgaaacagcagaatgccccaacaccaatagagcttggaactccttagaagtagaagattacggcttcggggtgttctccacgaatatctggctgaaactacgagaaaaacaagatgtcttctgcgactctaaactcatgtcagctgcaattaaagacaaccgggcagttcacgcagatatggggtactggatcgaatctgccctaaacgatacctggaaaatggaaaaagccagctttatagaaatcaaatcgtgtcactggccgaaaagtcacacactatggtccaacggagtcctcgagtccgaaatgatcatacctaagaattttgcgggtcccgtatcgcaacacaattacaggccgggataccatacacaaacagcaggaccatggcacttaggaaagctagagatggatttcgacttttgcgagggtacaaccgttgttgtaacagaggactgtggcaaccggggtccgtctttaaggacaaccacagcctcaggtaagctaattactgagtggtgctgccgttcatgcactttgcccccactaagatacagaggggaagatggttgttggtacggtatggaaatcagaccactcaaagaaaaagaggagaacctagtcaactctctagtgacagcaggtcacggtcaaatagataattttagtcttggtgtcctcgggatggctctgtttctagaggaaatgctacgaacaagagtaggcactaaacatgccatcctattagtagcagtctcattcgttactttaataacagggaacatgtcattccgagacctaggacgtgtcatggttatggtcggagctacaatgaccgatgacattggtatgggggtcacatatctagctcttttagcagctttcaaagtgagacctactttcgcagcaggattgctcttacgaaagttaacctctaaagaactaatgatggccaccatcggtatcgctttgctgagccagagcacaataccagaaaccatcctggaactgacagacgcattggctctaggaatgatggtactaaaaatagtccgaaatatggaaaaatatcaactagcagtaacaataatggcaatctcgtgtgtacccaatgcagttatattacagaatgcatggaaagttagttgcacgattctggccgctgtaagtgtgtctcctttactcttaacatcgagccaacaaaaagctgattggataccgctcgctctgactattaaaggtctaaatcctacagcaatctttttaacgacgttgtctagaacatctaagaaacgaagttggccattaaatgaggctgtaatggcagttggaatggtatcaatacttgcatcatctctgttaaagaacgatattccaatgactgggcccctagttgctggtggactactgacagtttgctatgttctaacgggtcgtagtgctgatttagaacttgaaaaagcagctgacgtcaaatgggaagatcaagctgaaataagtgggagttcgccaatacttagcatcacgatctcagaagacggctcaatgagcattaaaaatgaagaggaagaacatacattaacaatattaataagaacaggattattagtcatttcaggagtgttcccagttagtataccgattacggctgctgcatggtatctttgggaagtcaagaaacaacgtgcaggagtactatgggatgtgccttcccctcctccagttggtaaagctgaattggaggatggcgcatatcgaataaaacagaggggaatatttggatactctcagataggcgctggagtttataaggaaggtacttttcataccatgtggcacgtaacacgtggggctgtccttatgcacagaggcaagcgcattgagccctcctgggcggatgtcaaaaaggatttgataagctatggagggggatggaagctagaaggcgaatggaaggaaggagaagaagttcaagtcctcgctttagaaccgggaaagaatccacgcgcagttcaaacaaaaccaggattgtttaaaacaaacacggggacaataggtgcagtaagcctagattttagccccggaacctcgggtagtcctatagtagatcgaaaaggcaaagtggttggattatatggaaacggtgtagtaaccagatccggagcatatgtgagcgccatagcgcaaacagagaagtccatagaggataacccggaaatcgaagatgatattttcagaaagaaaagattaacaataatggacttacatccaggggcaggaaaaactaaaagatatttaccagcaatagtccgtgaggcgattaagcgcggattaaggactctaattttagcacccacacgcgttgttgcggccgaaatggaagaagcactaagaggattacctatacgatatcaaacaccggctatacgtgctgaacatacaggccgagaaatagtagatttaatgtgtcatgcgacatttaccatgagactactatcccccgttcgtgttcccaattataacttaattataatggatgaggcccattttacagacccagctagtatagcagcacgtggttacataagtactcgagttgaaatgggagaggcagcaggcatatttatgacagcaacccctcccggttccagagatccttttccgcaatctaatgctcctattatggacgaagaaagggaaattccggaacgaagctggaatagcggccatgaatgggtgacagatttcaaaggcaagactgtgtggtttgtaccctcgataaaagcaggaaacgacattgcagcgtgtcttaggaaaaatggcaagaaagttattcaattgagcagaaaaacttttgatagcgaatacgttaaaacaagagcgaacgattgggactttgttgtgacaaccgatatatcagagatgggagctaacttccgagcggaacgagtaatcgatccccgaagatgtatgaaacctgtgatattgactgatggtgaagaacgagtcattcttgctggcccgatgcctgttacgcacagctccgctgcacagcgacgaggaaggataggccgcaatcctaaaaacgaaaacgatcagtacatatatatgggggaacctcttgagaacgacgaagattgcgcacattggaaagaagcaaaaatgctgttagataacataaatacgcccgaagggattataccctcaatgttcgaacctgaacgtgaaaaagtcgatgcaattgatggagaataccgcttacgaggcgaagcccgtaagactttcgtagacctaatgcgtcgtggagaccttcccgtatggttagcatatagggtagctgcagaagggatcaactatgcagacaggcgatggtgcttcgacggaataaagaataaccaaatattggaggaaaacgttgaggtcgaaatatggactaaggaaggtgaaaggaagaaattgaagcctcgctggctggacgcccgtatttattcagaccctttagccctgaaagagttcaaagaatttgcagccggaagaaaatctcttacattaaatcttataacagaaatgggtcggctacctacctttatgactcaaaaagctagagacgcattagacaatttggctgttttacatacagccgaagtaggaggcagagcatacaaccatgcgttaagcgaactaccagagacactagaaacactcctacttttaacactgttagccacggtgacgggtggaattttcctatttttaatgagtggtaaaggaattgggaaaatgactcttggcatgtgctgtatcataactgctagcattcttctctggtatgcccaaattcaaccccactggatagcagctagtattatcttagaatttttcttaattgtactgctcatccccgaaccagaaaagcaacgcacaccccaagataatcagcttacgtatgtagtaatagcaattctaacagtagtagcggctacgatggcgaatgaaatgggattcctggaaaagaccaagaaagacttaggtttaggaagtataactactcaagaaagcgagtccaatatactagacatcgacttgcgcccggcatcagcatggacactgtacgccgtagcgacgacatttgtgacgcccatgctaagacatagtatagaaaactcatccgttaacgtatctttgacagcaatagctaatcaagcaaccgtattgatgggattgggtagaggatggcctttatcaaaaatggatataggagtaccgctactagccattggatgttattcacaggtcaaccccataacattgactgctgctttgcttcttcttgtagcacattatgcaataatagggccaggattacaagcaaaggcaacaagagaagcgcagaaaaggactgcagcagggataatgaagaatcctacagttgacggtattaccgtcatcgatctcgagcctataccctacgaccctaaattcgaaaaacaactaggccaagtaatgctattggtattatgcgtgacacaagtacttatgatgaggacaacttgggctttgtgtgaagcccttaccttagcaacaggaccaatatcgacattatgggaaggaaaccctggcagattctggaatactacaatagcagtaagtatggccaacatatttaggggaagctacttagcgggtgcgggattattgttttctattatgaaaaataccaccaatactcggaggggcacaggaaacattggagaaacattaggtgaaaagtggaagtctagattaaatgcattgggaaagagcgagtttcaaatttataagaaatccggcatacaagaagttgatagaactttagcaaaagaaggaataaaacgcggagaaactgatcatcatgcagtgagcagaggttccgccaaattacggtggtttgtggagcggaacatggtgactccggagggaaaagttgtagatttgggctgtggacgcggcggatggagttattattgtgggggtctgaaaaatgtgcgggaagtaaagggactaactaaaggcggacctggtcatgaagaaccgattccaatgtccacctatggatggaacctcgtcagacttcaaagtggggtcgacgtattcttcactccaccagagaagtgtgacaccttgttgtgcgatattggcgaaagctcgcctaatccaaccattgaagcaggacggactctgcgagtattaaatctagtagaaaattggctgaataataacacgcagttttgtgtaaaagtattgaacccttatatgcctagtgttatagaaaagatggaaactttacaacgaaaatatgggggtgctctagttagaaatccattgagtcgaaacagtactcacgaaatgtactgggtaagcaatgcaacaggaaatattgtctcttcagttaatatgatttcaaggatgctaatcaataggtttacaatgaaacataagaaggccacctacgagccggatgtggatctagggtctggaacgcggaacatcggtattgaaaatgagatccccaatctagacattatcggaaagcgcatcgagaaaatcaaacaagagcacgaaacatcttggcactatgatcaagatcatccatataaaacatgggcatatcatggaagctatgaaaccaaacagaccgggtctgcttcatccatggtaaatggtgttgtcaaattattgacaaaaccatgggatgtagtgcctatggtaacccaaatggcgatgactgatacaactccattcgggcaacaacgcgtatttaaagaaaaagttgataccagaacccaagagcccaaagaaggaacgaagaaattaatgagaattacagcagaatggctatggaaagaactcggcaagaagaaaactccaaggatgtgcacacgcgaagagtttacaagaaaagtacgatccaacgcagctctaggagcaatattcacagacgagaacaaatggaaaagtgcgagggaagcagttgaggactctaggttttgggagctagttgatcgagagcggaacttacacctagaaggaaaatgcgaaacatgcgtctataatatgatgggaaaaagggagaagaaattaggggaatttggtaaagccaaaggttcacgagcgatttggtatatgtggctgggagctaggttcctggaatttgaagccctgggatttctgaacgaagaccattggtttagccgtgggaacagcctctcaggtgtagagggtgaaggtctccacaagttaggttatatactcagagacgtttcaaagaaggaaggaggagcaatgtatgcagatgatacagcagggtgggataccaggataaccttggaggacctcaaaaacgaagagatggtaactaatcatatgaagggcgaacataagaaacttgcagaagcaatatttaaattaacatatcaaaataaagtagtccgtgttcaaagaccaacaccgcgcggaaccgttatggacattatttcgaggaaagatcaacgtggtagtggacaagttgggacgtatggtctcaatacttttacaaacatggaagcccaactcatacgacagatggaaggggaaggtatttttaaaagcattcaaagactaacggtgactgaagaaatagcggtgcaaaattggttagcgcgcgtcggacgagagaggctatcaaggatggcgatatctggcgacgattgtgtagtgaaaccattggatgatcgtttcgcctctgcactgacagcattaaacgacatgggtaaagtccgtaaagatatacaacaatgggaaccttcgagaggatggaacgattggactcaggtacccttctgttcgcatcattttcatgaattagtcatgaaggatggaaggatgttagtcgtaccttgtaggaaccaggacgaattaataggcagagctcgcatttcccagggagcaggatggagtttgaaagaaacagcatgcttgggtaaatcatatgctcagatgtggacactaatgtatttccatagacgagacttgcgccttgctgctaacgcaatatgtagtgcagtaccatctcattgggtacccacatcaaggacgacgtggagtatacacgctaaacatgagtggatgacgactgaagatatgctagccgtttggaatagagtatggatacaagagaacccatggatggaagataaaacgccggtagaatcttgggaggaggtaccctacctaggtaaaagagaagaccaatggtgtgggagtttaataggattaacatcgagagcgacttgggcgaagaacatccaaacagctataaaccaagtcagatctctcatcggtaatgaggagtatacagattatatgccatcgatgaaaagatttagaaaggaagaagaggaagcaggcgtactgtggtaa

SEQ ID NO: 22494 - RNA, 9876 nt, synthetic construct
  misc_feature 1..9876: note = derived and/or modified CDS sequence (opt6) from DENV-2__KF955360__SS-prME
  source 1..9876: mol_type = other RNA
actgcaggcgtgataatcatgcttattcctactgccatggcgttccacctaactacgagaaacggtgaaccacacatgatagtggggaggcaagaaaaagggaaatcactattatttaaaacagaagacggggtgaatatgtgtaccctaatggcaatagacctcggtgaactctgcgaagacactatcacatataaatgcccattactacgacaaaatgaaccggaggacatagactgctggtgtaactcaacaagtacgtgggtaacatacggaacctgtgcgacgaccggagagcacagaagagagaaaaggagtgttgcattagtaccacatgtaggaatgggactcgaaacaagaacagagacttggatgagctcggaaggggcatggaaacacgttcaaaggatagagacatggattctaaggcatcctgggttcacaataatggcggcaatcttagcctatacaattggtacaacccattttcaacgagcgttaatattcatactattaaccgctgttgctccttccatgacgatgaggtgtatcggcatttccaacagagattttgtcgagggtgtatcaggtggatcttgggtagatatagtcctagagcatggtagctgcgtaacaaccatggctaaaaataaacctacattagatttcgagctaataaaaaccgaagctaaacaacccgccaccctcagaaaatattgcatcgaagcaaaactgactaacaccacaactgaaagccgatgtcccacacaaggagaacctagtctaaatgaagaacaagataaacgatttatatgtaaacacagcatggtagatagagggtgggggaatggttgcggactgttcggtaaaggcggtattgtcacatgcgcaatgtttacatgcaagaaaaatatggaaggtaaagtggttttgcctgagaatctcgaatacaccattgttattactcctcatagtggggaagaacatgccgttggtaatgatacgggaaaacacggcaaagaaattaaaataaccccacaaagcagtattacagaagcagaactaacaggctatggaacagtcaccatggaatgttctcctcggactggtctagattttaacgagatggttcttctgcaaatggaagacaaagcatggctcgtacataggcaatggttcctcgatctcccactcccttggttacctggtgctgatacacaaggtagtaactggattcaaaaagaaacgctggttactttcaaaaaccctcatgctaagaaacaagacgtagtcgtgctaggatcccaagaaggagcgatgcacactgctctgacgggagccactgaaattcaaatgtcgagtggcaacttattgtttaccggtcacctaaaatgtcgacttagaatggataaattacaactaaaaggaatgtcatattcaatgtgtacaggaaaattcaaaattgtcaaagaaattgccgaaacgcaacatggtacaatcgtgatccgagtacaatatgaaggcgatggaagcccatgcaaaattccattcgaaattatggatttagagaaaagacatgtattaggacgactgattacggtaaacccaattgtaactgaaaaagattcgccagtaaatatagaagctgagccaccatttggtgattcttacataataattggtgttgagccaggtcaattaaaattgaattggtttaaaaagggttcgtccattggacaaatgttcgaaacaaccatgcgcggggctaaaaggatggccatcctaggcgatactgcttgggattttggttcgctgggaggagtatttacatccattggcaaagcgttgcaccaagtgttcggtgctatttatggagctgcattctctggtgtgtcatggacaatgaaaattctaattggcgtaataatcacatggataggcatgaactcgagatctacttcgcttagcgtatcattggtattggtaggggtggtgacattgtatctcggcgtgatggttcaagcagacagtggatgcgtagtatcttggaagaataaagaattaaagtgcggctcaggaatctttataactgataatgtccatacttggactgaacagtataaattccagcctgaatcaccctcaaaacttgcgtcagcaattcaaaaagctcacgaggaaggaatttgtggaataaggagtgtcacgcgattagaaaatctaatgtggaaacaaatcactccagaattaaaccacatccttagtgaaaacgaagtgaaattgaccattatgactggtgatatcaaaggtataatgcaggcaggaaaacgttcgctaagacctcaaccaacggaacttaaatacagttggaaaacatggggtaaggcaaaaatgctgtcaaccgagtctcacaatcaaacattcctaattgatggtcccgagacggctgaatgtccaaacacaaacagagcatggaactctctagaagtcgaagactatggatttggagtcttttcaacaaatatttggttgaaattacgggagaagcaagatgtattttgcgatagcaaactaatgtcggcagcaataaaagacaatagagctgtgcacgctgacatgggttattggattgaatctgcattgaatgatacttggaaaatggaaaaagcatcatttatagaaataaaatcatgtcattggcccaagtctcatacactatggtcaaacggtgtattagaaagtgagatgattattcctaaaaatttcgccgggccagtaagtcagcacaattaccgacccggttatcatacgcaaacagcgggtccctggcatttgggtaaattagagatggatttcgatttctgcgaagggacaacagtagttgtaacagaggattgtggtaacagggggccttcgctgcgtacaactacggcaagtggcaagttaataaccgaatggtgctgccgtagttgtacattgcccccgttacgatatagaggagaagacggttgttggtacggtatggaaataagaccattaaaggaaaaagaggagaacttagttaacagcttagtaaccgccgggcacggtcaaatagacaacttctcgttaggggtattaggaatggcacttttcctagaggaaatgctgagaacaagagtcggcacaaaacatgccatactattagttgctgttagcttcgtgacgttaattacagggaacatgtccttccgggatctcgggagagtaatggtaatggtaggcgcaacgatgacggatgatataggaatgggagtgacctatcttgcattattagcggctttcaaagtgcgaccaacattcgcagctgggttactattacgtaaactaacctcgaaagagctaatgatggctaccataggcatagccttattgagccaaagtacaataccagaaacaatactagaattgactgatgcgctagcgctaggcatgatggttctgaaaattgtaagaaatatggaaaagtaccaacttgcagtcacaatcatggccatatcttgtgtaccgaacgccgtgatactacaaaatgcatggaaagtgagttgcacaattcttgccgcggtaagcgtcagtccgttgttattaacaagttcgcaacagaaggctgattggataccattggcgctcactataaaagggctcaatccgacagcaatatttttgacaacgttatcgagaacctcaaagaaacgatcttggcctctcaacgaagccgtaatggcggtaggtatggtaagcatactagcaagctctctattgaaaaatgatataccgatgaccggccctttagtagctggcgggctcctgactgtctgctacgtattaacagggcgctctgcagacttagagctcgaaagagcagcggatgtcaagtgggaggatcaagcagaaatatctggctcgtcccctatcttaagcatcactatatcagaagacggaagcatgtccatcaaaaatgaagaggaagaacatacactgacgattctaattagaacaggactcttagtcatttctggcgttttccctgtttctataccaatcactgcagcggcctggtacttatgggaggtcaaaaagcagagggccggtgtattatgggacgtaccaagtccgcccccagttggaaaggcggaactagaagatggagcatatcggatcaagcaacgaggtattttcggatattcacaaataggcgcaggagtatacaaagaggggacattccatactatgtggcacgtgactcgcggtgctgtgctaatgcatcgtgggaagagaatagaaccctcatgggcagatgtcaagaaagacctaatttcatatgggggtggctggaagctcgaaggagagtggaaggaaggggaagaagttcaggttctagccctagagcccggcaaaaatcccagggccgtgcaaactaaaccgggcctatttaaaacgaatactgggactataggagctgttagtcttgacttctctcccggaacaagcggaagtcccatcgtcgatcgaaaaggaaaagtggtaggactgtacggtaatggtgtagtcactcgttcaggcgcatatgtgagcgcgatagcacaaactgaaaagtcaatagaagacaatcccgaaatagaagatgatatatttaggaagaaaaggcttacaataatggacctacacccaggtgccggtaagactaaaagatatcttccagcaatagtaagggaggcgataaagcgaggattaagaacattaatactagcccccactcgcgttgttgctgcagaaatggaggaagccctacgaggtctacccattagatatcaaacccctgcgatcagagcagagcacacaggaagggaaattgttgaccttatgtgtcatgcgacgttcacgatgagactactgtccccagtaagagtccctaactataaccttatcataatggacgaggctcatttcactgatccggcaagcatcgcggcaagagggtacataagcactagggtagagatgggcgaagccgccggaatatttatgacagcaacccctccaggtagtagagacccattcccacaatctaacgcaccaatcatggacgaagaacgggaaataccagaacgctcctggaacagcggccatgagtgggtaacagattttaaggggaagacagtttggtttgtccctagcataaaagctggcaacgatatagcagcatgtttacggaaaaatggcaagaaagtcattcaattatctagaaagaccttcgactcagagtatgtaaaaaccagggcgaatgattgggactttgtggtcacaactgatataagcgagatgggagcaaactttcgagctgaacgtgtaatagatccacgtaggtgcatgaaaccagtcatcttaactgatggggaagaacgtgtcatattggcgggaccaatgccagtaactcatagtagcgccgcccagcgaagaggtagaatcggtagaaaccccaaaaatgagaatgatcaatacatctacatgggagaaccattagaaaacgatgaggattgtgcacactggaaagaggctaaaatgctactagataacataaatacccccgaaggaatcataccaagcatgttcgaacccgaaagggagaaggttgacgcaatcgacggagagtatagattaagaggggaagcgcgaaagacatttgtcgacttaatgagacgtggagacctgccggtttggctagcatatagagttgccgcggaagggattaattatgcagacagacgatggtgcttcgatgggattaaaaacaaccaaattttagaagagaatgtcgaggtggaaatatggactaaggaaggagagaggaagaaactaaagccacgttggctggatgcaagaatctactccgaccctttagctttgaaagagttcaaagagttcgcggcagggagaaaatcactaacgctaaatctgataacagaaatgggtagactacccacgttcatgacccaaaaagctcgtgatgcgcttgacaatctagcggtactccatactgctgaggtaggaggtagagcatataaccatgcattaagtgaacttccagaaacactagaaactttattattactaactttattagcaactgtcacaggaggaatatttcttttcttgatgtctggaaagggtataggaaaaatgaccctaggcatgtgttgcattattacggcgtctatactcctttggtatgcccaaatacagccccactggatcgcagcaagtattatcttggagttctttctaattgtccttttaatacccgaaccggaaaaacagaggacgccccaagacaaccaacttacttatgtcgttatcgcaattctcacagtagtagcagcgactatggccaatgaaatgggatttttagagaaaactaagaaagatttaggcctcggatcaataacaacccaagaaagcgaaagcaacatattagatattgacttacgaccagcatctgcctggacattatacgcagtcgcaactactttcgtgacgcccatgctaagacatagtatagaaaattcaagtgtcaacgttagcctgactgcaatagctaatcaggccacagtgttaatgggactaggaaggggatggccattaagcaaaatggatataggcgtgccactattagcgattggttgctacagtcaagtgaatccaataactttaacagctgcgctactactattagtagcgcattacgcaataatcggaccagggttgcaggcgaaggctacacgggaagcacaaaagcgcacagcagctggaataatgaaaaatccgacagttgacggaattactgttattgatcttgaacccataccctatgatcctaagttcgaaaaacaattgggccaagtaatgttattggtactttgcgtaacccaagttcttatgatgcgaactacttgggcactctgcgaagccctaacgctcgccacaggacctatctctacattatgggaaggaaacccgggccggttctggaacacaacaatagctgtaagcatggctaatatattcagaggatcatatttagctggggcaggattattatttagcatcatgaagaataccacaaacactagaaggggcacaggcaacataggtgaaaccttgggcgaaaaatggaaaagtcgcctcaacgcgctgggaaaatcagaatttcaaatatataagaaatccggtatacaggaagtcgatagaacattggcaaaagaagggataaaaagaggggaaactgaccaccatgcggtgtctcgaggttctgcgaaactcaggtggtttgtcgaacgcaatatggtaacgcctgaaggaaaagttgtagacctcggttgtggtcgcggagggtggagttactactgcggtggtctaaagaatgttagagaagtaaaaggtttaacaaagggtggacctggacacgaagaaccaataccaatgagtacttatgggtggaatctcgtcagattacaatccggagtggatgtgttctttactccgccagaaaaatgcgatactctactttgtgatattggtgagtcaagtcctaaccctactatagaggctgggcgtacacttagggtattaaatctggtagaaaactggcttaataataatacacaattttgtattaaagtacttaatccttatatgccttccgttatcgagaaaatggaaacgttacagagaaaatatggaggggcgctcgtaagaaatccactatcaagaaattcaacccatgaaatgtattgggtcagcaacgctactggtaacatagtttcttctgtcaacatgataagtagaatgctcatcaaccggttcactatgaaacataaaaaggcaacatatgaaccagacgtcgatttaggatcaggtacacgcaatataggaatagaaaacgaaatacctaatcttgatattataggtaaaagaatagagaaaattaaacaagagcatgaaacatcatggcactatgatcaagaccacccatataaaacatgggcttatcacgggtcatacgaaactaaacaaacgggtagtgcatctagtatggtcaacggcgtagttaaactgttgacaaaaccatgggatgttgtcccaatggtaactcaaatggcgatgactgacacaactccttttgggcaacagagagtctttaaagaaaaggttgatacgaggacccaagaaccaaaagaaggcacaaagaaactcatgcgaattactgcagaatggctgtggaaggaactaggaaagaagaaaactccccgaatgtgtactagagaagaatttacgcgcaaagtacgatctaatgcggctctaggggccatattcactgatgaaaacaaatggaaaagtgctcgtgaagcagtcgaagactccagattctgggaattggtcgacagagaaagaaatctgcacctcgagggtaaatgcgaaacgtgtgtctacaacatgatggggaaaagagagaagaaacttggagagtttggcaaagctaagggttccagagcaatatggtatatgtggctgggagctagatttttagagttcgaagcactaggcttcctcaatgaagatcattggttctctagaggaaattcactatccggagtggaaggcgagggcttgcacaaactggggtacatccttcgggatgtatctaagaaagaaggaggggcaatgtacgcagacgatacggctggatgggacacgagaataactctagaagacttgaaaaatgaggaaatggtgacaaaccacatgaaaggcgaacataagaaactagcagaggccatatttaagctgacatatcaaaacaaggtcgtaagagtccaacgtccaacaccacgcggaacagtaatggacatcatatcccgaaaagatcaaagaggcagtggacaggtaggcacgtatggcttaaataccttcacaaatatggaggcccaactcattagacaaatggaaggagaaggcatattcaaatctatacaaagactaaccgtcacagaagagatagctgtccaaaactggttggcacgcgtaggaagagaaaggctcagcagaatggcaatatcaggtgacgattgcgtcgtaaaaccgcttgacgaccgatttgcttcagcgttgaccgcactaaatgacatgggaaaggttcgcaaagatatacaacaatgggaaccttcacgaggatggaatgattggacccaagttcctttttgcagtcatcacttccatgaattggtcatgaaggacggtcgcgtactggttgtaccctgtcgcaatcaagacgaattaatcggcagggcaagaataagccaaggggctggctggtctcttaaggaaacagcgtgcctaggaaaaagttacgcacagatgtggacgctaatgtattttcatagacgagatctaagacttgcagccaatgctatctgttctgctgtaccctcgcactgggtaccaacaagtcgaactacctggagtattcacgcaaaacatgaatggatgactactgaagatatgcttgcagtctggaatcgagtctggatccaagaaaatccatggatggaagataaaacaccagtcgaatcttgggaagaagtaccttatttaggaaagagagaagatcaatggtgtggttccttaattggcctgactagcagggctacctgggccaaaaatatacaaacggctattaaccaagtacgaagccttataggtaatgaagaatacaccgactatatgccgagcatgaaaagattcagaaaagaagaagaagaagcaggagtgctatggtga

SEQ ID NO: 22495 - RNA, 9876 nt, synthetic construct
  misc_feature 1..9876: note = derived and/or modified CDS sequence (opt6) from DENV-2__KF955363__SS-prME
  source 1..9876: mol_type = other RNA
acggctggggtcattattatgctaatacctaccgcaatggcatttcatctaacgacgcgaaacggcgaaccacacatgattgttggaagacaagaaaaaggaaaaagtctcttgttcaagacagaagatggtgttaatatgtgtacgttgatggcaattgatttaggggaactatgtgaagataccataacttacaaatgtcctttgttaaggcagaatgaaccggaagatattgattgttggtgtaattctacaagcacttgggtgacttatggaacctgcactaccacaggggaacatcgacgagaaaaaagaagcgtagcgctggttccccatgttggaatgggacttgaaactcgtacagaaacgtggatgtcatctgaaggagcctggaaacatgttcaacgaatagagacatggatattaagacaccctgggttcacaattatggcagcaatactagcttatacgataggaactactcattttcaacgcgccctgatctttattcttttaactgccgtggctccgagcatgacaatgagatgcattggcatatccaacagagattttgtggaaggcgtaagtggaggatcttgggtggacattgtcctggaacatgggagttgtgtaacaactatggccaaaaataaacccactctcgactttgaacttattaaaacagaagccaaacagccagccacattacgtaaatattgcattgaagcaaaactaacgaacactactacagaatcaaggtgccccactcaaggagaaccgagcttaaatgaagaacaagataagcgatttctctgtaaacatagcatggttgaccgcggatggggaaacggctgtggtttgtttggaaaagggggtattgttacctgcgcaatgtttacttgtaaaaaaaatatggagggtaaggtagtacaaccagaaaacctcgaatatactattgtaataacccctcattcaggtgaagaacatgcggtaggaaacgacacaggcaaacatggcaaagaaataaaaatcactccacaatcctcaataacagaggcagaacttacaggctatggtacagttacaatggagtgttctcctagaacaggtcttgacttcaatgagatggttcttttacagatggaggacaaagcttggcttgttcatagacagtggttcttagatcttcctcttccgtggctgcccggagcagatacgcagggtagcaattggattcagaaggaaacattagtaactttcaagaatcctcacgcaaaaaaacaagacgttgtagtgctcggaagccaagaaggagcaatgcatacagctctcacaggtgcaaccgaaattcaaatgtcatctggtaacctattatttacggggcatctgaaatgcagactaagaatggacaaattacaactaaaagggatgagttattctatgtgcactggtaaattcaaaatagtcaaggaaatagctgaaactcaacacgggactatcgtaatacgagttcaatatgagggagatggatccccatgtaagatcccattcgagatcatggatcttgaaaagagacatgtcctagggcgtctgataactgttaatcccatagtgacggaaaaagattcccccgtaaacattgaggctgaacctccctttggagactcatatatcatcattggagtagaacctgggcaacttaaacttaattggtttaagaaaggatcatcaataggtcaaatgttcgagacaacgatgcgaggtgctaaaagaatggcaatcctaggagatacagcgtgggactttggaagtttagggggagtattcacaagcataggtaaagcactgcaccaagtttttggggctatatacggagcggctttctccggcgtcagctggacaatgaaaattttaataggagtaataatcacatggatcggcatgaatagtcgaagtacgagtctatccgtctccttagtactggtgggagtggttacgttgtatctaggagctatggtgcaggctgattctggctgcgtcgttagttggaaaaataaagaattaaagtgcggctccggaatatttattaccgataatgtccatacatggacagagcaatacaaatttcaacctgagagcccgtccaagttagcctctgccatccagaaggcacatgaagaaggaatttgtggaatacgctctgtaacacgtctcgagaacctgatgtggaaacaagtcaccccagaattaaatcatattttaagtgaaaacgaggttaagcttactatcatgacaggtgatattaagggtattatgcaagccggtaaaagatctttaagaccccaaccgaccgaattaaagtatagctggaaaacttggggtaaggctaagatgctctcaaccgaatcccacaatcaaacgttcttgatagacggccctgaaacagcggaatgccccaatactaacagagcttggaattcacttgaagttgaggactacggttttggagtgtttacaaccaatatctggctaaagctaagagaaaaacaagacgttttctgtgactctaaattaatgtccgctgccataaaagataaccgcgcagttcacgcagatatgggttattggattgaaagcgcactaaatgacacgtggaagatggaaaaagcaagctttattgaagttaaaagttgtcattggcccaaaagccacacattatggagtaacggcgtacttgaaagcgaaatgataataccaaagaactttgcaggtccagtctcacaacataactatcgtccaggttaccatacacaaacggccggtccttggcacctagggaaattagaaatggatttcgatttctgtgagggtacaactgtcgtggtaaccgaggactgtggtaataggggtccaagtctaagaactacaacagcgtcaggaaagctcataacagaatggtgttgtagatcttgtactttaccaccacttagataccgaggtgaagatggttgctggtacggaatggagataagaccccttaaggagaaggaggaaaacttggtaaattcactagttactgcaggccatggacaaatagataatttctccctaggggtgttaggaatggctttgttcttagaagaaatgttacggacgagagtgggaacaaaacatgcgatattattggtagcggtttcttttgtaacgctaataacgggaaacatgtcatttagggaccttggtcgagtgatggttatggtaggcgccactatgacagatgacatcggaatgggagttacatacttagccttgctcgcagcttttaaagtaagaccaacgtttgcagcaggattactactaaggaaactgactagcaaagaacttatgatggccacaataggcattgcactattatcacaatcaacgatacccgagacaatactagagctaacggatgcgttggcactcggtatgatggtattaaagatagtaagaaatatggaaaagtaccagctggccgtcacaataatggcaataagctgtgtaccaaatgcagtgattttacaaaatgcatggaaagtatcatgtacaatactagcagcagtatccgtttcacccttattactaactagcagtcaacaaaaggcagattggataccattagcattaacaatcaaaggcttgaatccaacggccatctttctgacgacactatcaagaacctccaaaaaaagatcatggccactcaatgaagcaatcatggcagtaggaatggtctcgattctggcatcttcactactcaaaaacgatataccaatgactggccctctagtggcagggggacttcttactgtttgttatgtgctcacaggtagaagcgctgatctagagctagagagagcagcggatgtcaaatgggaagatcaagcagaaatatcaggttcaagcccaattcttagtataacaatctcagaagatggatcgatgagtataaaaaatgaagaagaagaacaaacacttacaatcctaatacgtacgggtttattggtgatttcaggtgtattccctgttagtatacctataacggctgcagcttggtacctctgggaagttaaaaaacaacgggcgggtgtactatgggacgtaccatctcctcctcctgtaggaaaagcagaactagaggacggcgcataccgaatcaaacaacgtggcatattaggctattcacaaataggtgcaggggtttataaagaaggtacgttccacaccatgtggcatgtaactaggggagcggtattgatgcacagggggaagagaatagaaccatcgtgggcagacgtcaagaaagatctgatatcgtacggaggaggatggaaattggaaggtgagtggaaagaaggagaggaagtgcaggttttggcactagagccaggcaaaaacccaagagcagtacaaacaaagcccggattgttcaaaacaaatacaggaaccataggagctgtgtcactagacttctctcccggtacctcagggtcgcccattgttgataggaaaggaaaagtagtgggtttgtacggaaacggtgtagtaactagatctggcgcctatgtcagtgccatagcacagacagaaaagagcatagaagataacccggaaatcgaagatgacatcttcagaaagaaacgattaacaataatggatctgcatcctggagcaggtaaaaccaagaggtatctaccagcaatagtcagagaagccataaaaagggggctacgaactctcatactggcaccaactcgggtagtagcagcggaaatggaagaagcgttaagaggactacccattcgatatcagactccggctataagagcagaacatacaggtcgagaaatagtggatttaatgtgccacgctaccttcactatgaggttgttaagccctgttagagtcccaaattataatctaataatcatggatgaggcgcactttacagatcctgcaagtattgctgcccggggatatattagtacgagagtagaaatgggtgaggctgcagggatcttcatgacggcaacaccacccgggagcagagatccttttcctcagagtaacgcccccattatggatgaagaaagagagatacctgaacgttcttggaatagcggacatgaatgggtaaccgactttaagggtaagaccgtatggtttgtgccatccataaaggcaggtaatgacattgccgcatgtttacgcaaaaatggcaagaaggtaattcaattaagcagaaagacattcgacagcgagtatgttaaaacgcgagcaaatgattgggactttgttgtaacaacagatatatcggaaatgggcgcaaattttaaagccgagagagtgattgatccgcgaagatgcatgaaacctgtcattcttacagatggtgaagaaagggtcatattagctggtccaatgccagtaacacattcctcagctgcacagagaagaggaagaataggaaggaacccgaaaaacgaaaatgatcaatatatatacatgggagaaccgctcgaaaatgacgaagactgcgcacattggaaagaggcaaaaatgttattggataacataaacactccagaaggtataattcctagtatgtttgaaccggaaagagagaaagtagacgctattgatggtgaatataggctacgaggcgaggcaagaaagacttttgtagatctcatgagacgcggcgatctcccagtttggttagcatacagagttgctgcggagggaattaactatgctgaccgaaggtggtgctttgacggaataaagaataatcaaatactggaagagaatgttgaagttgagatatggactaaagaaggtgaaagaaagaaactaaaaccacggtggctcgatgcccgaatatactcagatccgttggcacttaaggagttcaaagaatttgcagctggtcgcaaaagtttaacgttaaatctaattactgaaatgggacgactcccaacgtttatgacccaaaaagcgagagacgcactcgacaatctagcagtcctgcacacggctgaagcaggtgggaaagcttataaccacgcgctttccgaattaccagaaactctcgagacactattgttgctgaccttactagctaccgtgaccggtgggatattcctatttctaatgtctggcaaagggattggtaaaatgactctaggaatgtgttgtattataacagcatcaatactactctggtatgctcaaatacaaccgcactggatagcagcctccatcattttagagttctttctaatcgttttgctcataccagagcctgaaaaacagcgtactcctcaagataatcaactcacttacgtcgtgatagcgatactcacggttgtagcggctacaatggcaaacgagatgggatttcttgaaaaaaccaagaaagatttaggactgggaagcatcacgactcaagagagcgagagtaatatattagacatagatttacgacctgccagtgcgtggacattatatgcagttgcgaccactttcgttacccccatgctaagacattctattgaaaatagttctgttaacgtaagcctaactgcaatagcaaaccaagctactgtattaatgggattgggaaaaggctggccacttagcaaaatggacatcggagtacctctcttggcaataggatgctactcccaagtcaaccccataacgcttactgccgcactcttattgttagttgctcattacgctataataggtcctggactacaagcgaaagcaacgagagaggctcagaagagggccgcggctggtataatgaaaaatccaaccgtggacggaattacagtaattgacctggaaccaataccatatgatcctaaatttgaaaaacaattaggccaagttatgttactgatactatgcgtaacacaagtcctcatgatgcgaacaacttgggcactatgtgaggcactaactctggccacagggcctataagtacgctgtgggaagggaatccgggcagattttggaatacaacaatagctgtttccatggcgaatatctttcgagggtcatatttagcgggagctggcctcttattttccataatgaaaaacaccacgaatactcgaaggggaacaggtaacataggggaaacgttaggagagaaatggaagtccagattaaacgctctcggaaaatctgaatttcagatctacaaaaagtctggtatacaagaggtagacagaaccctcgctaaagaaggaatcaaaagaggcgaaacagatcaccatgcagtatcaaggggatcagctaaactaaggtggtttgtagagcgtaatatggtaacccctgaaggcaaggtagtcgacttggggtgtggtcgaggtggctggagttactactgcggaggcttaaaaaatgtacgtgaggtaaaaggtttaaccaaaggaggaccaggacacgaggaacctatacccatgagcacatatggttggaaccttgtacgactacaatcaggagtcgacgtattttttaccccgccagaaaaatgtgacactctactatgcgatataggagagtcaagtccaaacccaacaatagaagcaggtagaactttgagagtattgaacttagtggagaattggttaaacaataatacacaattttgcatcaaagttttaaacccttatatgccgtcagttattgagaaaatggaaacccttcaaagaaaatatggcggagcgctagtgcgaaatccactatccagaaatagcacacacgagatgtactgggtgagcaacgcaactgggaatattgtatcatcggtaaacatgatttcccgaatgcttatcaatcgcttcaccatgaaacataaaaaggcaacttacgaacccgatgtcgatttaggctccggtactagaaacatagggatagagtcggagatacctaacctggacataattggaaaacgaatagaaaaaatcaagcaggaacacgagacaagttggcattatgatcaagatcacccatacaagacttgggcttaccatggaagctacgagacaaagcaaactggctctgccagttcaatggtaaatggtgtcgtacgattattaaccaaaccgtgggacgtagttcccatggtaacacaaatggctatgacagacacgacaccattcggacaacaacgtgtctttaaggaaaaagtagatactagaacacaagaacccaaagaagggacaaaaaaacttatgaaaataacagctgaatggctctggaaagaattaggtaaaaaaaaaacaccacgaatgtgtaccagggaggaattcaccagaaaagtccgtagtaacgctgcacttggggctatatttaccgatgaaaacaaatggaaatcagcccgtgaggcggtagaggactccagattctgggaattagtagatagagaaagaaacttacatcttgaaggaaaatgtgaaacttgtgtctacaatatgatggggaaaagagaaaagaagttaggtgaattcggaaaagctaaagggagcagggcaatatggtacatgtggctaggtgcacgattccttgagttcgaagcactgggatttcttaacgaggatcattggtttagtaggggaaattctctatctggggtggaaggggaaggcttacataggctcggatatatcctgagagacgtcagtaaaaaagagggtggagctatgtacgctgatgataccgcaggctgggatacccgaattactctagaggatttaaaaaatgaagaaatggtaacaaatcatatgaaaggcgagcataaaaaactcgctgaagcaatattcaaattaacttatcaaaataaagtagtaagggtgcaaaggcctacaccccgtggtacggtaatggacataatttcgagaagggatcaacgtggatcaggacaagttggtacatatggtctaaatacatttactaacatggaggctcagctcattcggcaaatggagggcgagggtatctttaaaagtattcaacacttaacggttacggaagagattgccgttcaaaattggttggcaagagtagggcgagaacgcttatcccgaatggtaatctcaggagacgattgtgtagttaaacctctagatgatcgattcgcaagcgctctaacagcactgaacgatatgggaaaagttcgtaaagacattcaacaatgggagcccagcagagggtggaatgattggactcaagtacctttctgcagtcatcatttccacgaactagtaatgaaagacggtagagtattagtagtcccgtgtagaaaccaagatgagctcattggaagagctagaattagccagggagcagggtggagtttaaaagaaacagcttgcctaggaaaaagctacgcacagatgtggacgctcatgtattttcaccggagagacttaaggttagcagcaaatgcaatctgttccgccgtaccttcacattgggtacctaccagccgaactacatggtccatccatgcaaaacatgaatggatgaccacggaagacatgttagcagtttggaatagagtttggattcaggaaaatccatggatggaagacaaaacacctgtagagtcttgggaagaagtaccttatcttggtaaacgtgaagaccaatggtgcggaagcttaatcgggctaacttcacgtgcaacatgggcgaaaaacatacaaaccgcaataaaccaggtccgatcccttataggtaacgaggaatacaccgattatatgccctcaatgaaacgtttccgacgcgaagaagaagaagcaggagtcctctggtga

SEQ ID NO: 22496 - RNA, 9876 nt, synthetic construct
  misc_feature 1..9876: note = derived and/or modified CDS sequence (opt6) from DENV-2__EU726767__SS-prME
  source 1..9876: mol_type = other RNA
tccgctggtatgattataatgctaattcctactgttatggcatttcatttaaccacgagaaatggagaaccccacatgattgtgtcaagacaagaaaaagggaaatccttgttgtttaaaactgaagatggagtgaatatgtgcacattaatggcaatggatttaggcgaactctgtgaagacactattacatataaatgtccgctattaagacaaaatgaacccgaagacattgattgttggtgtaacagtacttctacgtgggtgacatatggaacctgtgcaactaccggagaacatcgacgcgagaaaagaagtgtggccctagttccacatgtcggaatgggactagaaacaagaacagaaacgtggatgagttccgaaggcgcatggaaacatgctcaacgtattgaaacgtggatattaagacacccagggtttacgataatggctgcaatattagcatatacgataggcacgacacacttccaaagagctctaatattcattctgctcacagcggtcgcaccatctatgactatgaggtgcattggcataagcaatcgagacttcgtggaaggagtatccggcggatcatgggttgatatagttttagaacacggatcatgcgtaaccactatggcaaagaataaacccactttagactttgaactgatcaaaactgaagcaaaacaaccagcaacattaaggaaatactgtatagaagcaaaattgactaatacaacaactgaaagccgatgtcccacacaaggagaaccatctttaaaagaagaacaagataagcgatttgtttgcaagcacagcatggtagatagaggatggggcaatgggtgcgggctgttcggtaaaggcggcattgtaacatgtgctatgttcacctgtaaaaagaatatggaaggaaaaatagtacaacctgaaaatttggaatacacaattgtagtcaccccacacagtggcgaggaacacgcagtggggaatgacacgggaaaacacggaaaagaaattaaggtaactccccaaagttctataactgaagccgagctaaccggctatgggacagttactatggagtgtagtccacgtaccggcctagattttaatgagatggtgttgttacaaatggaaaataaagcctggttggtgcatagacaatggtttcttgaccttccattaccttggttgcctggagcagacacacaaggaagcaattggattcaaaaagaaacgcttgtcacgtttaaaaatcctcacgccaagaagcaagatgttgtagtactaggctcacaagaaggtgccatgcataccgcacttacaggggcgacggaaattcaaatgagtagcggaaatctactcttcactggtcatctaaagtgccgtctaagaatggataaacttcaactcaagggaatgtcttacagcatgtgtacaggtaaatttaaggtagtaaaagagattgccgagactcaacatgggactatagttattcgcgttcaatatgaaggggatggatcaccctgtaaaattccatttgaaatcatggacctcgagaagaggtacgtgcttggtagattaataactgtcaatcctatcgtcacggaaaaagactcccctgtgaatattgaggctgaaccaccttttggagactcatatattatcattggagttgaacctggtcaactaaaattgaactggtttaagaaaggatcgagcataggacaaatgttcgaaaccacaatgagaggcgccaaacgcatggctattttaggtgataccgcatgggattttggcagtttgggcggcgtctttacgagtattggaaaagccctacatcaagtatttggagcaatatacggagcggcgtttagtggtgtgtcctggacaatgaagatactaattggcgtcattattacgtggattggaatgaacagtagaagcacatctctcagcgtttcattagtccttgtaggaattgttactctctacctaggtgtaatggttcaggccgactcaggatgtgttgtctcatggaaaaacaaagaactgaaatgcggaagcggcatctttatcactgacaatgttcacacctggacggaacaatataaatttcaaccagaaagtccgagcaaattagcgtctgccatacaaaaagcacaagaagaaggtatatgtggcatcagaagcgtcactaggcttgaaaatttaatgtggaaacagataacgcctgagttgaaccacatactggctgaaaatgaagttaagctcacaataatgacaggcgacgtaaaaggtataatgcaagctggcaagagaagtctcagaccccaacccacagaactaaagtattcttggaaaacatggggcaaagcaaaaatgctatctacagagtcccacaatcaaacctttttaatagatggaccagagactgcggaatgccctaatactaatagagcgtggaactccttagaagtcgaagactacggttttggggttttcacaaccaatatatggttaaagttaaaagaaaagcaagacgcattttgtgattcaaagttaatgagtgccgcgataaaagataatcgagcagtacatgcagatatgggttattggatcgaaagtgcgctaaacgatacatggaagatagaaaaagcgtcatttatagaagttaaaaattgtcattggcccaaaagtcatacattgtggtctaacggtgtactagaaagcgaaatgataataccgaaaaacctggcggggcccgttagtcaacacaactatagacctggctaccatactcaaatcgcaggtccttggcatctagggaaactagaaatggactttgacttctgtgagggaactaccgtcgttgtcacagaagattgtggtaatagaggtccatcacttcgtacaacgacggcatctggtaaacttattaccgagtggtgttgtagaagctgcaccctacctccactacgctacagaggagaagacggttgctggtatgggatggagattagaccgttaaaagaaaaagaagaaaacttggtaaatagtcttgtcacagcaggccacggacaagttgataacttttcgttaggcgtactgggtatggcattatttctagaagaaatgctacgaacgagagttggaactaaacatgcaatattgctagtagctgttagcttcatgacattaataacagggaacatgagcttcaaagacctaggtagagtggtcgttatggttggagctgcaatgactgatgatattggcatgggagtgacctatttagcacttctagccgctttcaaggtacgaccaaccttcgctgcaggacttttactaaggaaactaacaagtaaagaattgatgatgactactataggaatagcgttactatcccaaagtaccataccagaaacaattctcgaattaacagatgcattggctctgggcatgatggttttgaaaatggtacgaaatatggaaaagtaccaattagccgtgacaataatggctatcttatgcgtgccaaatgcagttatactacaaaacgcgtggaaggtttcctgtacaattctggcagtcgtctccgtgtctccattgttactaactagcagtcaacagaaaacagactggatcccgctagcattgactattaaagggttaaaccctactgccatattcttaacaacattatcaagaaccagcaagaaacgatcatggcccttaaacgaagcaataatggctgtcgggatggtgtctattttggcctcaagtctactgaaaaatgacattcccatgacgggacctcttgtagctggcggtctattaaccgtctgctatgtcttaacagggcggagcgcagacctagagctggagagagcgactgatgtaaaatgggaagaccaagccgagataagcggatcgagcccaattctaagcattacaataagtgaagacggatcaatgagcatcaaaaatgaagaggaagaacagacgttaactatattaataagaacgggattattagtcataagtggactcttcccagttagcatcccaataacagcagcggcatggtatttgtgggaggtcaagaaacagagagcaggggtactttgggacgttccgtcaccaccccctatgggaaaagccgagctcgaagatggagcctatcgaataaaacaaaaaggaattttagggtatagccaaataggggctggagtgtacaaagaaggaaccttccacactatgtggcatgtgacgcgtggagcagtcttaatgcacaaaggaaaaagaatagaacctagctgggcagacgttaagaaagatttaatatcatatggtgggggatggaaattggaaggagaatggaaagaaggcgaggaagtacaagtgttagcgcttgaaccaggtaaaaatccgagggcagtccaaacgaagcctggattatttaaaactaacgctggaacaataggggcagtttcgcttgacttttcaccaggaacgtccggtagtccaatcatcgacaaaaagggtaaggtggtagggttatatggaaacggagtagtaacacggagtggagcttacgtttccgcgatagcacaaaccgagaaatccatagaagataatcccgaaatagaggatgatatatttaggaagagacgacttactattatggacctacacccgggtgctggaaaaacgaaaagatatttaccagcaattgtaagagaggcaataaaacgagggttgcggacattaattcttgctccaactcgggtagtcgcagcggagatggaagaggctttacgaggcctcccaattagataccaaaccccagctattagagctgagcatactggcagggaaatagtagatttgatgtgccacgctacgtttactatgcggttactcagccctgtaagagtaccaaactataaccttataataatggacgaagcgcattttacggatcctgcttccatagctgccaggggatacatttcaacacgagtcgagatgggggaagctgcaggcatattcatgacagcaactcctcctggatcgagagatccttttcctcaatcaaacgcaccaatcatagatgaagagagagaaataccggaacgaagttggaactctggccacgagtgggttacggatttcaaaggcaaaacagtatggtttgttccatctatcaaggcgggcaatgatatcgccgcatgcctaaggaaaaatggtaagaaagtgatacaactatcaagaaaaacatttgacagtgagtatgtaaagacaagaacaaatgattgggattttgtcgtaaccactgatatttccgaaatgggtgcaaatttcaaagcagagcgtgttatagatccgcggcggtgtatgaaaccggttatattaacagatggggaggagagagtaatactagctggcccaatgccagttactcatagttctgcggcccagcggagaggccgcattggtcgaaaccctaaaaacgaaaacgatcaatacatctatatgggtgaaccattggaaaacgacgaagactgtgcgcactggaaagaggcgaaaatgttgcttgataatataaacacgcctgagggcataatccctagtatgtttgagccagaaagagagaaagtagatgcgatagatggggaatatcgtcttcgaggcgaggctagaaaaaccttcgttgacttgatgcgccgaggagatctaccagtgtggttggcctacaaagtagcggcagaaggtataaactatgcagatcgacgatggtgcttcgatggaatcaaaaataaccaaattcttgaagagaacgtagaagtggaaatctggactaaagaaggagagcgcaagaaattaaaacccaggtggctggatgccagaatatacagtgatcctttagcactgaaagaatttaaagagttcgctgcaggacgaaaatctcttaccctaaacctgatcacagaaatgggaagattgccaaccttcatgactcagaaaaccagagatgcattagacaatctggcggttttgcatacagcagaagcaggagggcgggcttataatcatgcgctatcggaacttccagaaacgctagaaacacttctgttgctcacgttattagccacagttaccggaggaatattcctattcttaatgagcggtcggggtatcggaaagatgacattaggaatgtgctgtattataacagcctccatcctattatggtatgcgcaaattcaaccccactggattgcggcctcaatcatcctagagttcttccttattgtgctattaataccagagccggaaaaacaacgaacgcctcaagacaatcaattaacttatgtggtcattgcaatattgaccgtggtagctgcgacaatggcaaatgaaatgggcttcttagagaaaactaagaaagacctaggcctgggtagtatcgtaacgcaacaaccggaaagcaacatactagacatagatcttcgacctgcctcagcatggaccttatacgctgtagcaacgacttttgtaactcctatgctaaggcattctatagaaaactcaagtgtaaatgtaagtctaacagctatagccaaccaagcgaccgtactaatgggactcgggaagggatggccgctatcaaaaatggacataggagttccactgctagctattggctgttattcacaagtaaatccaattacattaactgcagccctactgttactcgtcgcacattatgcgattatcggcccaggtcttcaagctaaagctaccagagaagcgcagaaaagagcagccgctggtatcatgaaaaaccctaccgtagatggtataactgttattgatttagatcccatcccatatgaccctaaattcgaaaagcagttgggacaagtcatgcttttagttttatgcgtgacacaggtactaatgatgagaacaacgtgggccttatgtgaggctttgaccctggcgaccggtccaatcagcacgctttgggaaggaaatccaggaagattttggaacacaacaatcgctgttagtatggcaaatatatttagagggtcgtacttggctggagccggattattattttcaatcatgaaaaatacgactaatacacgtaggggcacaggtaatataggtgaaactctaggagagaagtggaagtctagactaaatgctctaggaaaatcagagtttcaaatctataaaaagagtggaatacaggaagttgacaggacattggcaaaagaaggaattaaacgcggggaaacggaccaccatgcggtcagtaggggttcagccaaacttcgatggttcgtcgaacgaaatatggtaaccccagaaggtaaagtcgttgaccttggctgtggacgagggggatggagctattattgtgggggcctcaaaaatgtaagggaagtaaaaggtcttaccaaagggggaccgggtcatgaagaacctataccaatgagtacatatggttggaatttagtcagattgcagtcgggtgtagatgtcttctttataccacctgaaaaatgtgacactttgttatgtgatatcggtgagtcttcaccaaatcctacggtcgaagctggcagaacgctaagggtcttgaatttagtagaaaattggttgaataataacactcaattttgtataaaagttctgaatccatatatgcctagcgttatcgagaaaatggaggcactacaaaggaaatacggaggagccctagtaaggaaccccctttctagaaactccacacatgaaatgtactgggttagtaatgcaagcggaaatatagtttcttcagtgaatatgatttccaggatgttaattaatagatttacaatgcgtcacaagaaagcaacttatgaaccggatgtagacttgggctcaggaacaagaaatattggcattgaatcagaaatacctaacctagacataataggtaaaagaatagagaaaataaagcaagaacacgaaacatcatggcattatgaccaggaccacccctataagacatgggcctatcacggctcctatgaaactaaacaaaccggatcggcgtctagtatggttaacggggtagtccgactgttaaccaaaccttgggacgtcttacccactgtgacccaaatggctatgacagatacaaccccatttggtcaacaacgtgtattcaaggaaaaggtagacacaagaacgcaagaacccaaagaaggcactaagaaactaatgaaaatcactgcagaatggctatggaaagaactaggaaagaagaaaacccccaggatgtgcactagagaagaatttaccagaaaggttcgtagtaacgcagcattaggagccgttttcactgatgaaaataaatggaaaagtgcaagagaggcggtcgaagactcgagattttgggaattagtagacaaagaacgctcattgcatttagaaggaaaatgcgaaacgtgcgtatataatatgatggggaagagagaaaagaaactcggcgaatttggcaaggctaaaggctctcgagcgatttggtatatgtggttaggagcaaggtttctcgagttcgaggctcttggattcctcaacgaagatcattggttctcgagggaaaattcattgagtggggtggaaggcgaaggactccataaactaggatacatactaagggatgtatcaaagaaagagggaggtgcgatgtatgctgatgatacagcgggatgggacacaagaatcacactggaggatttgaaaaatgaggagatggtgacgaatcatatggaaggcgaacataagaaattagccgaggccatattcaaattaacgtatcaaaataaagttgtacgagtacaacgacctacacccagagggactgtgatggatattatatcacgcagggaccaaagaggttctggacaagtcgggacatatggcttaaatacattcaccaatatggaagcccagttaatccggcaaatggaaggagagggtgtcttcaagaatatacaacatctaactgttaccgaagagattgcggtgcagaactggctggcccgtgtcggaagggagcgactatctaggatggctatttcaggagatgattgtgttgtgaaaccgttagacgatagattcgcatcagccctaacagcgctaaacgatatgggcaaaattagaaaagacatccagcagtgggaacctagcagaggatggaatgactggacgcaagttccattctgttcacatcacttccacgaattaataatgaaagatggccgagtgttagtcgtgccttgtcgtaatcaagacgaacttattggacgagcacgaattagccaaggagcgggttggagcctcagagaaacggcatgtctgggaaaaagctatgcacagatgtggtcgctaatgtactttcataggagagatttacgccttgccgcaaacgcaatttgttctgctgttccttcccattgggtaccaacttctcgaaccacttggagcatacatgctaaacatgagtggatgacgacagaggatatgctaacagtttggaacagggtatggattcaggaaaacccctggatggaagataagacgccggttgaaagttgggaagagataccttatttaggaaaacgagaagaccaatggtgtggcagtttaataggtttaacaagcagagcaacatgggccaaaaacatacaagctgccatcaatcaggtaaggagcttaattggaaacgaggaatatacggactacatgccctccatgaaaagatttaggcgggaagaagaggaagcaggagttttatggtaa

SEQ ID NO: 22497 - RNA, 9876 nt, synthetic construct
  misc_feature 1..9876: note = derived and/or modified CDS sequence (opt6) from DENV-2__EU687246__SS-prME
  source 1..9876: mol_type = other RNA
tccgcagggatgattataatgttaatcccgacggtgatggcttttcatctaacaacccgaaacggcgaacctcatatgatcgtcagtatccaggaaaaaggtaaaagtctcttattcaaaacagaggatggagtaaatatgtgcaccttaatggctatggacttaggggagttatgtgaagatactattacatacaaatgtccattattgagacaaaatgaaccagaagatatcgactgctggtgcaatagcaccagtacctgggtcacatacggtacatgtaccacaacaggcgaacatagaagagaaaagagaagcgtggccttggtgccccatgttggcatgggactggaaacacgtaccgaaacgtggatgagttcagaaggagcgtggaaacacgcacaacgcattgagacctggatactaagacatcctggatttacaattatggcagcgatccttgcctatactattggcacgactcattttcaaagagcactcatttttatattgctgaccgcagtagccccatccatgacaatgagatgtatcggtataagcaacagagatttcgttgaaggagtaagcggtggcagctgggtagacatagttttagaacacggaagctgtgtgacaacaatggccaaaaataagcccacactagactttgaattaattaaaacagaggcaaaacaaccagcaactttgagaaaatattgtatagaggcaaaattaacaaatacaactacagaatcacgctgcccaacccaaggagagccatctcttaaagaagaacaagacaaaagatttgtatgcaaacatagcatggtagatcgagggtggggtaatggatgtggtttatttggcaaaggtggaattgtcacttgcgccatgttcacgtgcaaaaagaatatggaaggcaagatcgtgcaaccggaaaatctcgaatacactatcgttgtaacaccgcattcgggtgaagaacatgccgtcggaaacgataccggcaaacacggaaaagaaataaaagtgactcctcagtcctctataaccgaagccgaactgactggatacggtacagtcacaatggaatgctcacctcgaacaggtttagatttcaacgagatggtgctcctacaaatggaaaataaggcgtggttagtacaccgacaatggtttcttgacttgcccctaccatggttacccggtgccgacactcaaggttctaattggatacaaaaggaaactttagttacctttaaaaatcctcatgctaaaaaacaagacgtagtcgtattaggaagtcaagagggtgctatgcatacggcactaacaggggcgacagagattcaaatgagctcaggaaatttgctgttcacgggacatctaaagtgccgattaagaatggataaattacaactaaaaggcatgagttattcaatgtgtactggaaaatttaaggtcgtaaaagaaatcgcagaaacgcagcacggcaccatagttataagggttcagtatgaaggagacggctccccgtgtaaaataccatttgaaataatggatctagaaaaaaggtacgtgttaggccgtttaatcacggtaaatccaatagtgacagagaaagattctccggttaatatagaagcggaacccccttttggcgactcgtatatcattattggggtcgaacctggacaacttaaactaaattggtttaaaaaaggatcgtctataggacagatgttcgagacgacaatgagaggggccaagaggatggcgatattgggagatacagcgtgggattttggttccctggggggagtatttactagtattggaaaagcactccatcaggtctttggcgcaatctacggggcagccttctcgggagtttcatggacgatgaagatcttaattggtgttattattacctggatcggcatgaatagtcgttcgacatccttaagtgtatcgttagtattagttggaattgtaacgttgtacctaggagtgatggtacaagccgattccggttgtgtggtttcctggaaaaataaagaacttaaatgcggaagcggaatctttattacagacaacgtacatacgtggaccgagcagtacaagttccaaccagaatcgcctagtaaattggcgagcgccatacagaaggctcaagaagaaggcatatgtggaataaggagcgttacaagattggaaaatttaatgtggaaacaaatcacaccagaattgaatcatatactggcggaaaatgaagtaaaacttacaattatgacgggagatatcaaaggaataatgcaagccggtaaacgatcacttaggcctcaacctacagaactaaaatactcatggaaaacatggggaaaagcgaaaatgttgtcaactgaatctcacaaccagaccttcttaatagatggaccggaaactgctgaatgtccaaatactaacagagcgtggaacagcttagaagtagaagattacggatttggcgttttcacgacgaacatatggttaaagttgaaagaaaaacaagatgctttttgtgactcgaaactaatgtctgctgcaattaaggacaatagagcagtacacgcggacatgggatattggatagaaagcgcattaaatgatacatggaaaattgaaaaggcttctttcatagaagtgaagaactgccattggccgaagagccacacactatggagtaacggcgttcttgaaagtgaaatgattatacccaaaaatctagccggtccggtatcacaacacaattatagaccaggataccacactcaaattgctggaccttggcatctaggaaaactcgaaatggactttgatttttgcgatggaactactgtagtagtgactgaagactgtggaaatagaggcccttctttacggacgaccacggcctcaggtaaattaattacggaatggtgttgtagaagctgcaccctaccacctttgagatacagaggtgaagatggctgttggtatggaatggagataaggcctttgaaggagaaggaagagaatttagtaaacagtttagtgaccgccggtcacggacaggtcgataattttagtcttggagtccttggcatggcattgttcctagaagagatgctccgaacccgagtcgggacgaaacacgctatattattagtagcattatcatttgttacgcttataaccggtaatatgtcatttaaggatttgggaagggtagtagtaatggttggggcgacaatgaccgacgatatcggtatgggtgttacttaccttgccctccttgcagcatttaaagttagacctactttcgcagcaggattattactccgtaaacttacctcaaaagaattaatgatgacgaccattggaattgtccttcttagccaatctaacataccagaaacgattctcgaactaactgatgcgctagcattaggaatgatggtattaaaaatcgtacgggatatggaaaaatatcaactagcagtaactattatggctatattatgcgtacctaatgctgtcatattacaaaatgcctggaaggtgtcttgtactatattagccgttgtgtcggtctccccattactcctaacatcatctcaacaaaagacggactggataccgttggctctcactataaaagggctgaatcctactgcaatctttttaactacactttcacggaccaacaaaaaacgaagttggccactaaacgaagccataatggcagtcggtatggtatcaattctagcgagttcgttactcaagaatgatatacctatgacaggacccctagtcgctggaggattattaactgtatgctacgtattaacaggcagatcggcagatttagagcttgaacgagccacagatgtgaaatgggaggatcaggcagagattagtggaagctcgccgatattatcgataacaattagcgaagacggatctatgtctattaaaaatgaagaagaagagcagaccctgacaatacttataagaactgggttattagtaatatctgggttatttccggtatccatacctataacagcagctgcatggtatctatgggaagttaaaaaacaaagagccggtgtcctgtgggacgttcctagcccaccacccatgggaaaggctgaactagaagacggagcataccgcataaaacaaaagggaatattagggtattcacaaataggtgcaggcgtttataaagaagggacgttccatactatgtggcacgttactcgaggtgcggtattgatgcacaaaggtaagagaatagaaccatcatgggccgacgtaaaaaaggatctcatttcatatggggggggatggaagctagaaggagaatggaaggagggcgaagaggtacaagttcttgcactagagcctgggaaaaatccgagggcagtacaaactaaaccaggactttttaaaaccaacactggcacaatcggtgctgtgagcttggacttttcacccggtacatcgggatcccccataattgacaaaaaaggcaaagtcgtaggtttatatggcaatggagtagtcactcgtagcggcgcgtacgtatctgcaatagcgcaaacagaaaaaagtattgaagataaccctgacattgaagatgatatctttaggaaaagacgcctgactatcatggatctacaccctggagcagggaaaactaagcggtatctacctgcaatagtgcgggaagctatcaagcgggggttaagaactttgatattggcaccaacgcgagtggttgctgcggaaatggaagaagctttaagaggtcttcccattcggtatcagacaccagctattcgagccgagcatactggacgtgaaatagtcgatctgatgtgtcacgctacttttacaatgcgtcttctatcgcctgttcgagttccaaattataaccttataattatggatgaggcgcacttcactgatcccgctagtatagcggcacgaggttacatctcgacgcgggtagagatgggcgaggcagctggtatattcatgacagcaacaccacccggatcaagagatccttttccccagagtaacgcacccatcattgatgaggaaagagaaataccagagagatcttggaacagtggacacgaatgggtgactgactttaaaggaaagactgtgtggttcgtaccaagcataaaagctggaaacgatatagctgcctgtttaaggaaaaatggaaagaaggttatacagttaagtcgaaagacgtttgattcggaatacattaaaacaagaactaatgattgggatttcgttgtaacaacagatatcagcgagatgggcgcaaactttaaagccgaaagagtaatagacccaagaagatgtatgaagccagtcatactgacagacggggaggagagagtaattctggccgggcccatgcccgttacacattctagtgccgcgcaaagacgtggccgtatcggacgcaatcctaaaaatgaaaacgatcagtatatctatatgggagaacctctcgaaaatgatgaggattgtgcgcactggaaagaagccaaaatgttacttgacaatataaacacacccgaaggaataatacctagcatgtttgaacccgagagagaaaaagtagacgccattgatggagaatataggctacgcggtgaggcaagaaaaacattcgtagatctaatgcgtagaggcgatttaccagtgtggctagcgtataaagtggcagcagaagggataaattatgcggatagaaggtggtgttttgacggcattaagaacaatcaaatcctagaagaaaatgtcgaggtcgaaatatggacaaaagaaggagaaagaaaaaagttaaaaccgcgatggttggatgctagaatttactctgatcccctagcactgaaagaatttaaagagtttgccgcaggaagaaaaagtttaactctcaacctaatcacagagatgggccgattgcccacatttatgacacaaaagactcgagacgcattggacaaccttgctgtattgcatacggctgaggcgggaggaagagcttataaccacgcgctcagtgaactaccggaaacgctagaaactcttttattgcttactctcttagccacagtcacaggagggatattcctgtttttaatgtcagggcggggaattggaaaaatgacactaggtatgtgttgcatcataacagccagtattttattatggtatgcccaaattcaaccccactggatcgcagcttctatcatcctagaatttttcctaatagttttgttgatacccgaacctgaaaaacaacgcacccctcaagacaaccaactaacctatgtcgtaattgcaatacttacagtagttgctgccacaatggctaatgaaatgggatttctagaaaaaacaaaaaaagacttgggattaggatctatagctacgcaacaaccggaatctaatatactagacatagacctgcgaccagcttctgcttggactttatacgctgtggcaacgacgtttataactcctatgctaagacattccatagaaaattcatcagtgaatgtctccttgactgcaatagctaatcaagcaacagtattaatgggcctcggtaaaggttggccattatctaaaatggacataggggtaccgcttttagccataggttgctactcccaagtaaatccaatcacattgaccgcggcactgctgctcctgattgcacattatgctattatcggacctggactccaagcaaaagcgactagggaggctcaaaaacgagcagcagcagggataatgaaaaatccaaccgttgatggaattacagtgatagacctcgacccaataccgtatgacccaaagtttgaaaaacagctaggacaagtgatgttactcgtcctgtgtgtaacacaagtcctaatgatgcgtaccacatgggctctctgtgaggcactaacgttagcaacgggcccaatttccaccttgtgggaaggtaatccgggaagattttggaatactacaatagcggtgtcgatggcaaatatattccgtgggtcttaccttgcaggggcagggcttctgttctctatcatgaaaaatacaacaaatacacggagagggactggtaatattggtgaaaccttaggcgaaaaatggaaaagcagattaaatgcccttggaaaaagtgaatttcaaatttacaagaaatcgggtatccaggaggttgaccgaacattagcaaaagaagggattaagagaggcgaaaccgaccatcatgcggtaagtcgagggtctgcaaaattacgatggtttgtggaacgtaatatggtaacaccagaaggtaaggtggtcgatttaggctgtggcagagggggatggagttattactgtggaggattaaaaaacgtcagagaagtgaaaggattaacgaaaggcggacccgggcacgaagaaccaatacctatgagtacctatggatggaacttggtgcggctacaatcgggagtagacgttttctttataccacctgagaaatgtgacactttactatgtgacataggtgagtcttcaccaaaccctactgtcgaagcaggtaggacattaagagtattaaatttagtagaaaattggttaaacaataatacgcaattctgcattaaagttctaaatccttacatgcctagcgtaattgaaaagatggaaaccctccaacgaaaatatggcggggccttagtcaggaatccattaagccggaactcaacgcatgaaatgtactgggtctcaaatgcctcgggcaatatcgtatccagcgtcaacatgatatcaagaatgttaattaacaggtttactatgcgacacaaaaaagctacgtatgaaccagatgtagacctgggtagtggtacacgaaatattggaatagaaagcgaaatcccaaatctggacataataggaaaaaggatcgagaaaattaagcaagaacacgaaactagctggcactatgaccaggatcatccatacaaaacttgggcttatcacgggagctatgaaaccaagcaaacaggaagtgcatcctcaatggtaaacggtgtagtccgactcctaactaaaccttgggatgttctcccgacggtaacacaaatggcaatgacagatacaacgccatttggtcaacaacgtgtttttaaagaaaaagtcgacactagaacacaggaaccaaaggagggtaccaaaaaactaatgaaaattaccgcagaatggctatggaaggagttggggaagaaaaaaacaccaagaatgtgtacgcgagaagaattcactagaaaagtgagatcaaacgctgcattaggagcgatatttactgatgagaataagtggaagtccgctcgtgaagcggtagaggattcaaggttttgggaactagtagacaaagaacgcaacttacatctagagggtaaatgcgagacgtgtgtatataatatgatgggtaaacgagaaaaaaaactaggtgagttcggtaaagcaaaaggctctagggcaatatggtatatgtggctaggggcaagatttcttgaattcgaagcattaggctttctaaatgaagaccattggttttcaagagaaaacagcttatcaggggtagaaggagaaggacttcataagctaggctacatcctgagggatgttagtaagaaagagggtggtgctatgtatgctgatgatacagctgggtgggacactcgcatcacattggaagatcttaaaaacgaggaaatggtaacaaaccatatggaaggagaacataagaagttagcagaagcgatctttaaactaacataccagaacaaagttgtaagagttcagaggccaacccctagaggcactgtcatggacataataagtagaagagatcagcgagggagcggccaagtggggacgtacggattgaatacgttcacaaacatggaagctcagttaataagacaaatggaaggggaaggagtgtttaaaaacattcagcacttaaccgtaaccgaagaaatcgcggtccaaaattggctagcccgggtagggagagagagattgagcagaatggcaatatcaggtgatgattgtgtagttaaacctcttgacgacagatttgcaagtgcattgactgcattaaacgacatgggcaagatcagaaaggatatccagcaatgggaacccagtagaggctggaacgattggacacaagtacccttctgtagtcatcattttcatgaactaatcatgaaagatggccgggtcttagtagttccgtgcaggaaccaagatgaactaataggtcgagcgcgaatttctcaaggagcgggatggtccctacgggaaacagcatgtttagggaagtcctacgcccaaatgtggagcctcatgtattttcatcggcgggatttaagattagcagctaatgccatttgctctgcagtcccaagccactgggttccgacttcaagaactacttggtccattcacgctaaacatgaatggatgactaccgaagatatgctgacggtctggaatcgggtctggatccaagaaaacccctggatggaggataaaacgccagtggaatcatgggaagaaattccatatttgggaaaaagagaagatcagtggtgtggttctctaatcggccttacgtcgagagcgacgtgggcaaaaaatatacaagctgcaataaatcaagtaagatctttaataggatccgaggaatatacagactatatgccctcaatgaaaagatttcgccgcgaagaagaggaagcaggagtgttatggtaa

SEQ ID NO: 22498 - RNA, 9876 nt, synthetic construct
  misc_feature 1..9876: note = derived and/or modified CDS sequence (opt6) from DENV-2__FJ639828__SS-prME
  source 1..9876: mol_type = other RNA
agtgtaggaatgataataatgttaattccaacagtaatggcattccatcttacgactagaaatggagaacctcatatgattgtaagcattcaagaaaaagggaaatccttacttttcaaaacggaagacggagtgaatatgtgcacactaatggcaatggatttgggagaactatgcgaagacaccattacttacaaatgtccacttttaagacagaacgaaccagaagacattgattgttggtgcaattcaacaagtacatgggtaacatatggtacttgtaccactacgggtgaacaccgtcgcgaaaaacgcagtgtagcattggttccacatgtaggaatgggtcttgaaacgcgaacggaaacatggatgagttcagaaggtgcatggaaacacgcacaaagaatagaaacatggattctgagacatcctggattcacaataatggcagcaattcttgcgtatacaataggaactacacactttcaacgaacattgattttcatactgcttactgcagttgctccttcgatgacaatgagatgcataggtattagtaatagagacttcgtagagggtgtaagcggcggctcatgggtagatatcgtattggaacatggatcgtgcgttaccactatggctaaaaataaaccaacactagatttcgaactaataaaaaccgaggcgaaacaaccagctacccttcggaaatactgtatagaagcaaaactgactaatacaaccactgaatctagatgtccaacacagggagaaccaagtcttaaagaagaacaagacaaacgattcgtatgtaaacacagtatggttgacagaggttggggaaacggatgtgggctatttggaaaaggcgggattgtaacttgtgctatgttcacttgtaagaaaaatatggaaggtaaaatagtgcagcccgaaaatttagaatatacaatagtggttactccacattctggtgaggaacatgcggtggggaatgacacggggaaacatggaaaagagatcaaagtaactccacaatctagtattacggaagctgagcttactggctatggcactgtcactatggagtgttctccgagaacaggactagattttaacgaaatggtcctattacaaatggagaataaagcgtggctcgtacatcgacaatggtttttggatttgccattaccatggctcccgggagcagatactcaaggaagtaattggatacaaaaagagactctagtaacgtttaaaaatccacatgccaagaaacaggatgtcgtggtattaggaagccaggaaggtgccatgcatactgcactaactggagcaacggaaatacaaatgagttccggaaatttactattcaccggccacttaaaatgccgcctacgcatggacaaactacagctaaagggtatgtcatattcaatgtgtacaggcaaatttaaagtagtcaaggaaatcgctgagactcaacacggcactatcgtcatccgagttcaatatgagggagatggctcgccctgtaaaattccattcgagataatggatcttgaaaagcgatacgtactcggaagattgataacagtaaatcctatagcaactgaaaaagattcacctgtcaatattgaggcagaacccccatttggagatagctatattataattggcgttgaaccaggtcaacttaaactcaattggtttaagaagggaagttcaataggccaaatgtttgaaacaaccatgcgaggagcaaaacgtatggccattttaggcgatactgcttgggacttcggtagcctgggaggggtttttaccagcataggaaaagcgttacatcaggtatttggggcgatttatggagctgcattttcaggcgtatcatggacaatgaaaattttaataggagtaattattacttggattgggatgaatagtagaagtacctctctgtcagtcagtcttgtcctagtaggagtggttactttataccttggggtaatggtacaggcagattcaggttgcgttgtatcgtggaaaaacaaagagttgaagtgtggatctggaatatttataaccgataatgtacacacatggacagaacagtataaattccaaccagaatcaccctcgaaattggctagcgctatccaaaaagctcaggaagagggcatatgtgggattagatcggtaaccagactagaaaacttaatgtggaaacaaataactccagagttaaaccatatactcgcagaaaacgaagtaaaattgacaataatgacaggagatattaaaggaattatgcaagcgggaaaaagaagtctcagaccacaaccgactgaattaaagtattcatggaaaacctggggcaaagctaaaatgttaagtacagaaagccataaccaaactttccttatcgacggaccagagactgcggagtgcccaaataccaatcgtgcttggaacagtttagaagtcgaagattacggttttggagtatttactactaacatctggctaaaactcaaagaaaaacaagatgctttctgcgacagcaaacttatgtccgcagcaataaaagataatcgcgcagtacacgctgatatggggtactggatcgaaagcgctctaaacgacacctggaaaattgaaaaggcctcatttatagaagtcaaaaattgtcattggccgaaatcccatacgctatggtcgaacggagtattggaatccgagatgataatacccaaaaacttagcaggacctgttagccagcataactacagaccgggatatcacacacaaattgctggtccgtggcatctaggaaaattagaaatggatttcgacttttgtgatgggactacagttgttgttactgaggactgtggtaatcggggcccgtccctcagaactacaacggcatcgggaaaattaatcaccgaatggtgttgccgttcatgtacactaccacccctccgataccgcggcgaagacggatgctggtatggtatggaaataaggcctttaaaagagaaagaagagaacttggtcaactcactcgttacggcgggacatggtcaggtcgataacttctcactaggagtgttaggcatggcactatttctggaagagatgttacgtactagagtcggcaccaaacatgcaatattattagtagcagtatcgtttgttacgttgatcactgggaacatgtctttcaaagatttaggccgcgtagtagtaatggtaggagcaacaatgacagatgatataggtatgggcgtcacgtacctcgctctcctagctgcatttaaagtcagaccgacttttgctgcgggactatttcttagaaagttaacctcaaaagaactaatgatgaccacaataggaatagtcttattgtcccaatcaacattgcccgaaactatacttgaattgactgatgccctcgcattgggaatgatggttttgaaaatggtaagggatatggaaaagtaccaactggcagtaacgataatggcaatattatgtgttccgaatgccgtaattttacaaaatgcatggaaagtttcatgtactatacttgccgtggtaagtgtttcgcctttactactaacaagttcacaacagaagactgattggatccccttagcattaacgataaagggtttaaatcctacagcaatatttttaacaacgttatcaagaacaaataagaaaaggtcatggccactaaatgaagcgatcatggcggtcggcatggtatctatactcgcgtcctcacttctaaagaatgatataccaatgacgggaccacttgtagcagggggtttactgaccgtttgttacgtgctaacagggagatcagccgatttagaacttgaaagggctacggatgtgaaatgggaagatcaagcagaaatcagcggatcaagtccgattctatcaatcacaatatctgaagatggctccatgtcgattaaaaatgaagaagaagaacaaactctaacgatcctaatacgaacagggttattagtaataagtggtttatttcctgtttccattccaataacagcggctgcatggtatttatgggaagtgaagaaacaacgtgcaggcgtgctttgggatgtaccgtcacctcctccgatgggaaaagctgaactagaagatggtgcatacagaatcaaacaacgaggaatactaggatatagtcaaataggtgcaggagtatataaagaggggacatttcatacaatgtggcatgtcacaagaggagcggtactcacacataaaggaaaaagaatagaaccgtcatgggcggacgtaaagaaagaccttatatcctacggaggcggctggaaacttgaaggtgaatggaaagaaggagaagaagtgcaagtgctagcactagaacccggcaaaaatccaagagcagtacaaacaaaaccaggtttatttaaaacaaatacaggtacaatcggcgcagttagtctagatttttcgcccggaacatcgggtagtccgattatagataagaaaggaaaagtagtgggattgtatgggaacggagtcgtgaccagatctggagcatacgtaagtgcgatagcacagacagaaaagagtatcgaagacaatcctgacatagaagatgatatttttagaaaacgtcggctaacgattatggatctacacccgggagccggaaaaaccaaacgctacttgcctgctatagtccgtgaagcaataaaaagaggtctaagaacacttatattggctccaacaagggtggtagccgccgaaatggaagaggcactaagagggttacctatacgatatcagactccggccatacgggcagaacacaccgggcgggagatcgttgacttaatgtgtcatgcaacatttactatgagactcttatcacccgtaagagtaccaaactataacttaatcataatggacgaagctcattttacagaccccgcctcaatagccgcgagaggttacatatcaacaagggtagaaatgggagaagccgctggtattttcatgacggccacacctccgggatcgcgggatccattccctcaaagcaacgctcccatcatcgacgaggaacgagaaattcctgaaagatcgtggaactcaggtcacgaatgggtaacagattttaaaggaaaaacagtatggtttgtacccagtattaaagctggtaatgacattgctgcttgcctgcgcaaaaatggcaagaaagtcattcagctaagtcgcaaaacttttgatagcgaatacgttaaaactcgaacaaatgattgggattttgtagttacaacagatatatccgaaatgggggcaaactttaaggcggaacgagtaatagaccctcgtcgatgcatgaaaccagttatacttacagacggggaagagagagtaatattagcaggccctatgccggtaacacattccagcgcagcacaacggagggggcgaataggacgaaaccccaaaaatgaaaacgatcagtatatatatatgggggaaccactagagaatgacgaagactgtgcccattggaaggaagcgaagatgctgttagacaatataaacaccccagaaggcataataccatcaatgttcgaaccagaaagagaaaaagtcgatgcaattgacggtgaataccggctaagaggagaagcgaggaaaacttttgttgacttgatgaggagaggcgatctaccggtttggctagcatataaggtagccgctgaaggtataaactacgccgataggcgatggtgttttgatggaatcaaaaataatcaaatactagaggagaacgtggaagttgaaatttggacaaaggagggcgagcgaaagaagctcaaaccacgctggttagacgccagaatttatagcgaccctttggcgctaaaggagttcaaagaatttgcagcaggccgtaagagtttaacactaaacctgatcactgaaatggggaggttaccaacatttatgacacagaaaacaagagacgcactcgacaacctcgccgtcctacacaccgcggaagctggcggtcgagcgtataaccacgctttaagtgaacttccagagactctagagacgcttttactcctcacactattggctacagtaaccggaggtatattcctatttctcatgtcgggcagaggaattggcaaaatgaccttaggaatgtgttgcatagttacggcctcaatcctattatggtacgcacagatacagccgcactggattgcagccagcattatactagagttctttctaatagtacttctgatcccggaaccggaaaaacagcgaactccgcaggataaccaactaacatatgtggtaatcgcaatcttaacggtcgtagcagcaacaatggccaatgagatgggtttcctagagaaaactaagaaagacctcggtttaggatcaatcgctacccaacaaccagaaagcaacatccttgacatagacttgagaccggcatcagcttggactctatatgctgtcgcgacgacttttgttacaccaatgcttcgacattctattgaaaatagcagtgtaaatgttagcctaacagctattgctaatcaagccactgtattaatgggattaggaaaaggctggcctctgtcaaagatggacataggcgcgccattattagctattgggtgctacagccaagtaaaccccataacattaaccgctgcgctactactactcgttgcacattacgcaataatcgggccaggtctccaagcgaaggcaacccgcgaagcccaaaaacgagcagcagcaggcattatgaaaaacccaaccgttgatggaattaccgtaatcgatctagatccaatcccgtatgacccaaaatttgagaaacaattaggtcaagtaatgctcttagttctatgtgttacccaagtattaatgatgagaaccacttgggccctatgcgaggcactaacactcgcaactggaccaattagcacactctgggaaggaaatccagggcgattctggaataccacgattgctgtgtcaatggctaatatctttcgcggatcatatttagcaggagctggattactattctcgattatgaaaaatactacaaatagccggcggggtactggaaatataggcgagacactaggtgaaaagtggaaatccaggctaaacgccctcggcaaatcagagttccaaatctataagaaatcaggaatacaggaagtagataggacgctagctaaagagggaatcaaaagaggtgagacagatcatcatgctgttagcaggggcagcgctaaattaagatggtttgtcgaaagaaatatggttacacccgagggaaaagtagttgacttaggatgtgggcgcggaggatggtcctactactgtggtggacttaaaaacgtacgcgaggtaaaaggactaactaaaggagggccaggtcacgaggaaccaataccaatgagtacttatggatggaacttagtaaggttacaatcaggtgtggacgtgtttttcatacctccagaaaaatgcgatacactgttgtgtgacataggagaatcttcgccaaatccaacggtcgaggcaggaagaaccctcagagtactaaacttggtagagaactggttaaacaacaatacgcaattttgtataaaggtattaaatccatacatgccgtcagttatagaaaagatggagacattacagagaaaatacgggggcgcccttgtccgaaatccattatcacgtaactcaacacacgaaatgtactgggtaagcaatgcaagcggaaatattgtatcaagcgtaaatatgatctctcgtatgttgattaataggttcacgatgaggcacaagaaagccacctatgaacccgatgtagacctagggagcggcactagaaatatagggatagaaagcgagataccgaatttggatatcataggaaaaagaattgaaaagataaaacaagagcatgaaacatcatggcattatgaccaggatcatccatataaaacctgggcgtatcacggttcctacgaaacgaaacaaactggtagcgcttcatcgatggtaaatggtgtagttagactattaacaaagccttgggatgtactaccaacagttacacaaatggcaatgactgacacaactccgttcggacaacaacgcgtttttaaagaaaaagtagacacgcgaacacaggaaccgaaagaaggcactaagaaattaatgaaaattactgcagaatggttgtggaaggaactaggcaagaagaaaacccccagaatgtgtactagagaagaatttacaaggaaggttaggtcaaatgccgcactcggagctatattcacagacgagaataaatggaagtcagctcgagaagcggtcgaagactcaagattttgggaattagtggacaaagagcgaaaccttcatctggaaggtaaatgtgagacatgcgtctataacatgatgggtaagcgtgagaagaaactgggggagttcggcaaagctaaaggaagtagagcgatttggtatatgtggttgggtgcaagattcttagagttcgaagccctcggatttttaaatgaagatcattggttttcaagagagaacagtctgagtggcgtagaaggagaaggcctccatcggttaggttatatcctacgagacgtaagcaagaaagaaggtggtgccatgtatgctgacgatacagcaggatgggacacacgcattacgttagaagatttgaaaaatgaagaaatggtcaccaaccatatggaaggagaacataagaaattggcagaagcgatcttcaaactgacatatcaaaacaaagtggtgagagtgcaacgaccaacaccaagaggtacagtcatggatataatcagcagacgcgatcaaagaggctctggacaagtaggaacatatggactaaacacattcacaaacatggaggctcagttaataaggcaaatggagggtgaaggtgtatttaaaaacattcaacatcttacagtaacagaagaaatcgcagtacaaaattggctggccagggtaggtagagaaagactttcaaggatggctatttccggagatgactgcgtagtaaagcctctggacgatagatttgcgagtgcattaaccgctctgaatgacatggggaaaatccgcaaagacatccaacagtgggagccttctcgtggttggaatgattggactcaagtaccgttctgttcacatcattttcacgagttaataatgaaggacgggagagtgttagtggtaccatgtagaaaccaggatgaactcatcgggcgggctaggataagtcaaggagcaggatggtccttgagagaaactgcatgtctaggtaaaagctatgcacagatgtggagcctcatgtatttccacaggagagatctacgacttgctgccaacgctatatgcagtgctgtaccttcacactgggtaccaacgtcacggactacctggtctattcatgcgaaacatgagtggatgacaaccgaagatatgctgacagtatggaaccgggtctggatacaagaaaacccgtggatggaagataaaaccccagttgagagttgggaggaaataccttacctgggaaagcgggaggatcagtggtgcggctcgttgataggtttaacctccagagccacatgggccaaaaatatacaggcagctataaaccaagtaaggtctctaataggtaacgaagagtatactgattatatgcccagcatgaagcgttttcgtagggaagaggaagaggctggtgtcttatggtaa

SEQ ID NO: 22499 - RNA, 9876 nt, synthetic construct
  misc_feature 1..9876: note = derived and/or modified CDS sequence (opt6) from DENV-2__FJ639829__SS-prME
  source 1..9876: mol_type = other RNA
agcgtaggaatgataataatgctaatacctacagtcatggctttccacctgaccacacgcaatggagaaccacatatgattgtatcgattcaagaaaaaggtaaatccctactgttcaaaaccgaagatggagtgaacatgtgtactttaatggctatggacctgggcgaactgtgcgaagatactataacatataaatgcccactactgcgtcaaaatgaacccgaagacatagattgctggtgcaactcaacaagtacgtgggtaacatacggaacgtgtaccacaaccggtgaacacagacgggagaaacgttcagtagccctagtacctcacgtagggatgggattagaaacacgtaccgaaacgtggatgtcaagcgagggtgcttggaaacatgcacaaagaatagaaacatggattctgagacatccaggcttcaccattatggcggccattttagcatatacgatcggtactacccattttcagcgcactttgatattcatccttttaacagcagtagctccctcaatgacaatgcggtgcattggtatttccaacagagatttcgtagaaggcgtctcgggtgggtcctgggttgatatcgtactagaacatgggtcgtgtgtaacaacaatggcgaaaaacaaacccacactagatttcgaattaatcaaaacggaagcaaaacaaccagcgactcttagaaaatactgtatagaagccaaactaaccaataccactaccgaatcacggtgccctactcagggcgaaccaagtctgaaagaagaacaagacaaaaggtttgtatgcaaacatagtatggttgataggggatggggaaatggctgcggtctatttgggaaaggtggtatagtgacatgtgccatgttcacgtgtaagaaaaatatggaaggaaaaatagtccaaccagaaaatttagaatatacaatcgttgtaacgccacacagtggagaggaacatgccgtagggaacgataccggtaagcacggaaaagaaattaaagttactccacaatctagtataacggaagccgaattgactggctacggaacagtgacaatggaatgcagcccacgcacaggactagatttcaatgaaatggttttattacaaatggagaataaagcctggcttgtacatcggcaatggtttctagatttacctcttccctggctaccaggcgcagatactcaaggatcaaactggatacaaaaagagacattggttactttcaaaaacccccatgccaagaaacaagatgttgtcgtattggggtcccaggaaggtgccatgcatacagccctaaccggggctacggagatacaaatgtcgtcggggaacctactatttacagggcatttaaagtgtaggttgagaatggataaattgcaattaaaaggaatgtcgtacagtatgtgtacaggtaagttcaaagtagttaaagaaatagcggaaacgcaacacggtactatagtaataagagtccagtatgaaggcgacggaagtccatgcaagataccttttgaaataatggacctggaaaaacgatacgtactaggtaggttaattacagtaaatccgatagtaacggaaaaagatagccctgtcaatatcgaggcggaaccacctttcggggattcttatataataatcggcgtagaaccgggacaattgaaattaaattggtttaaaaagggatcaagtataggccaaatgttcgaaaccactatgcggggagctaaacgtatggcaattttgggtgataccgcatgggattttggctcattaggaggtgtatttacgtccattggtaaagcattacatcaagtgtttggagcaatatatggtgcagcgttttcaggagtgtcatggacgatgaaaattctgatcggggtgataataacgtggattggtatgaatagccgatcgacttcattgtccgtatcattggtcttagtaggcgtggtgacactatatctaggagtgatggtacaagcggatagtggatgcgttgtatcatggaagaacaaggaactaaaatgtggttcgggaattttcataaccgataatgtccacacctggactgaacaatataagtttcaacctgaaagtccttcaaaacttgcaagtgcgatccaaaaggcacaagaggagggaatatgtggtattcgttcagtaaccagactagaaaatttgatgtggaaacagattacaccagagctaaatcacatcttagcggagaatgaagtaaagctaaccataatgaccggagatatcaaaggaattatgcaagccggcaaacgcagtttaagaccacaacctactgagctaaaatactcgtggaaaacatggggtaaagcaaagatgctgagtaccgaatcacacaatcagacttttctcatcgatggcccagaaacagctgaatgtcctaacactaatagagcttggaactctctagaggtagaagactacggattcggggtgtttacaacaaatatttggctcaaactgaaagaaaaacaagacgctttctgtgacagtaagttaatgagtgcagcaataaaagataatagagctgttcatgcagatatgggttattggatcgagtcagctttaaacgacacttggaaaatagaaaaggcatcgtttattgaagtcaaaaactgtcattggccgaaatctcatacactgtggtctaacggggtattagaaagcgaaatgataatacccaaaaatcttgcagggcccgtttcacaacataattacagaccaggttatcatactcagatagcgggcccttggcatttaggaaagctggaaatggattttgacttttgtgacggcacaacagtggtggtaactgaagactgcggaaatcgtggtccttcactacgaacaacaaccgcaagtggtaagttaatcacagagtggtgttgtaggagctgcaccctcccacccctacggtatcgcggagaagacggttgttggtacggtatggaaattagacccttgaaagaaaaggaagaaaatctagtaaacagcttagtaactgcaggacacggacaagtggataacttttcattaggcgttctcggtatggccctgtttttggaagaaatgttacgtaccagagtgggaaccaaacatgcaatactcctggtagcggtgtcattcgttactctcattactggcaatatgtcatttaaggatctaggaagggttgtagtaatggtaggtgctacaatgaccgacgacataggaatgggcgttacatacttggctctattagccgctttcaaagtacggcctacctttgctgcaggtctattcttacgtaagttaacttcaaaagagcttatgatgactacaatcggtattgtgctccttagccagtcaactattccagaaacaatattagaattaaccgacgcattggctcttggtatgatggttcttaaaatggtaagggatatggaaaaatatcagttggcagtgactattatggccattttatgcgtacctaatgccgttattttgcagaatgcctggaaagtatcatgcaccatactagccgtcgtttcggtctcaccgttgctactaacatcatcccaacagaaaaccgattggattccattggctttgaccatcaaaggtttgaatccaactgcaatttttctcaccacattaagccgtaccaacaaaaagcgatcgtggccgttaaatgaggcaatcatggccgttgggatggttagtattttagcatcgagcttactaaagaatgacatcccgatgactggtccattagtcgcaggaggattactaactgtatgctatgttctaacgggcaggtcagctgatttagagcttgaaagggcaactgatgttaaatgggaagatcaagctgagatttcaggcagcagccctatattgtcaatcacgatatcagaagacggatcaatgtctatcaaaaacgaggaagaagaacaaactctgacgatattgataagaaccggtttattggtaatctcaggactatttcctgtgagcatacccatcacagcagccgcatggtatctctgggaagtgaaaaagcaaagggcaggcgtgctttgggatgtcccaagtccaccaccaatggggaaagcagaactggaagatggagcataccgtataaaacaacgaggaatattaggatatagtcaaataggagctggcgtctacaaagaaggcacctttcatacgatgtggcacgtcactaggggagctgttttaactcataaagggaagcggatcgaaccatcatgggcggacgttaagaaagacctcatttcttacggcggcggctggaagttggaaggagagtggaaggaaggtgaggaagttcaagtactagcccttgagccgggcaaaaatccacgagccgtgcaaacaaaaccgggtctattcaagacaaatacagggacaattggtgctgtgagtctagacttttcaccaggaacatctggttcgccaattatagataagaaaggaaaagtcgtaggattgtatggaaatggggttgttacacgatctggagcatatgtttctgcgatagcacagacagagaaatctatagaggataatccagatatcgaggacgatatattcagaaaaaggcgcttaacgatcatggacctccatcctggcgcaggtaagacaaaacgttacctgccggcaatagtgagggaagctatcaaacgaggattaagaactctgatattagcaccgacccgtgtagtagctgctgagatggaagaggcactaaggggtttaccaatcagatatcaaacaccagcgattcgcgcagaacacacgggaagagaaatagtagacttaatgtgtcatgcgacatttacaatgagattactatccccagttagagtccccaactataatttaatcattatggatgaagcacactttaccgaccctgctagcatagccgcaagaggatatattagtactagggtcgaaatgggagaagcagctggtatatttatgacagcaacacccccgggatcgcgcgatccctttccgcagtccaatgcgcctattatcgatgaagaaagagaaataccggagcggagttggaacagtggccacgagtgggtcacagatttcaagggaaaaacagtatggtttgtaccttcaataaaagcaggtaacgatatagccgcttgtcttaggaaaaatggcaagaaagttatccagctcagcagaaaaacattcgattccgaatacgtaaagacaagaaccaacgattgggattttgttgtaacgacagacatcagcgaaatgggcgccaattttaaagccgagagggttattgaccctagaagatgtatgaaacctgtcattcttaccgacggggaagaaagagttatactcgctgggcccatgcctgttactcattcatcagccgctcagaggcgaggacgtatcggacgtaacccaaagaacgaaaacgaccaatacatatatatgggagagcctctagagaatgatgaagattgcgcccactggaaggaggccaaaatgttactagataatataaacactcctgaagggataatacctagtatgtttgaacccgaaagagaaaaagtcgatgcaatagatggtgaatatagactgaggggtgaggcacgtaaaacttttgtggaccttatgcgtagaggggatttaccagtatggcttgcatacaaagtagcggcagaaggaataaattatgcagacagaagatggtgtttcgacgggatcaagaacaatcaaattctcgaggaaaatgtagaagtagaaatctggaccaaggagggtgagaggaagaaattaaaaccaagatggctagatgcacgaatatattcagatccactcgcattaaaagagtttaaagagttcgcagcaggccgcaaaagccttactttaaacctgatcactgaaatgggaaggcttccaactttcatgacacagaaaacgagggacgccttagataatttggcagtattgcatacagccgaagctggaggccgagcttataatcatgcattatctgaacttccagaaaccctggaaacattattgctcctaacattgttggctactgtcactggcggcatattcttatttttgatgtcagggagaggaatcgggaaaatgacattaggaatgtgttgcatagtaacagcgtctatattactatggtatgcacaaatacaacctcactggattgcggcatcaatcatattagagttcttcttaattgtactattaattccagaaccagaaaagcaaagaactcctcaagacaatcaactaacatatgtagtaatagcaattcttacagttgtcgcagcgactatggctaacgagatgggattcttagagaaaaccaagaaagatctaggactcgggtcaatagctacacaacaaccagaaagcaatattttagacattgacctaagacctgctagtgcttggactttatatgctgttgcgacaacgttcgttacacctatgctgcgccattcaattgagaacagttcagtcaacgtttcattaacggccattgctaatcaggctacggtactgatgggtttagggaaaggttggccattgtccaagatggacattggagcacctttattagccatagggtgctactcacaagtcaatccaataacccttacagctgccttattactattagtggcacattatgcgatcattggaccaggacttcaagcaaaagccacaagggaagctcagaaacgggcggcagcaggaataatgaaaaaccccactgtagatggaataaccgtgatcgacttggatccaatcccctacgacccaaaatttgaaaaacaactaggacaagtaatgctcttagtactttgcgtgactcaagtgttaatgatgagaacaacatgggccctttgtgaagcattaacactagcgactggtccaatttcgactttatgggagggcaacccgggaagattctggaacacgactattgccgtttcaatggccaacatttttagaggatcatatctcgctggtgcaggacttcttttcagtattatgaaaaatacgactaacagtcgcaggggaactggtaatatcggtgaaacattgggggaaaaatggaagtcacgtcttaatgccctaggaaaaagtgagttccaaatctataagaaaagcggcatccaagaagtcgatcgtacattggctaaagaagggattaaaagaggggaaaccgatcatcatgccgtgtcacgaggctcagcgaaattaaggtggtttgttgaaagaaacatggttacaccagaaggaaaagtcgttgatttaggatgtggtagaggagggtggtcgtactattgcggaggactcaaaaacgtgagagaagttaaaggactaactaaaggcggccccggccacgaagaaccgattcctatgagtacctatgggtggaacttagttagattacagagcggcgtagatgtatttttcattccaccagaaaaatgtgatacgttattgtgcgatattggagaaagcagccctaaccctacagttgaggcaggtcggactctaagggtcttaaatctagtagaaaactggttaaataacaatacccaattttgcataaaggtattgaacccatatatgccatctgttatagagaaaatggaaactctacaaagaaaatacggcggagctcttgtacggaatcctctatcgagaaatagcacacacgaaatgtattgggttagcaatgcgagtggtaacattgtctctagcgtaaatatgataagccgaatgctaataaacaggtttacgatgcgtcacaagaaagcgacatacgaaccagacgtagatttaggaagtggcacgcgtaatataggtatagaatccgagattccgaacttagacatcataggcaaacgaatcgaaaagattaaacaggaacatgaaactagctggcattatgatcaagatcatccgtataaaacttgggcttatcatggcagttacgaaacaaaacaaactggaagtgcatcgtctatggtaaacggtgtcgtgagattactcacaaagccctgggacgttctaccaacggtaacgcaaatggcaatgacggatacaactcccttcggacagcagagagtatttaaagaaaaagtcgacacaagaacacaagaacctaaggaaggaacgaagaaactaatgaagattacagccgagtggttgtggaaagaacttggcaaaaagaaaacaccgcgaatgtgcaccagagaagaatttacaagaaaagtaaggtcaaacgcggctttaggagccatatttacggatgaaaacaagtggaagtcagccagagaggctgtggaggattcgcgtttttgggagcttgtagataaagaaaggaacttacaccttgaaggaaaatgcgagacttgcgtctataatatgatggggaaaagagaaaagaagctaggagagttcggtaaagccaaagggtcacgggctatatggtatatgtggcttggggcaaggttcttagagttcgaagcactaggctttttaaatgaagaccattggttcagcagagaaaattcattatcaggcgtggagggtgaagggctgcaccgtttgggctatattctaagggatgtatctaagaaggaaggcggtgcaatgtacgctgacgatacagcgggttgggacacacgcattacattagaggacctcaaaaatgaagaaatggtaaccaatcatatggagggagaacacaagaaactcgcagaggcaatattcaaattgacataccaaaataaagtcgtgagagttcagcgaccgacaccacgaggtacagtaatggatatcatatcgcgccgcgatcaacgaggttcaggtcaagtagggacatatggtttaaacacatttacaaacatggaagcgcaactaattaggcaaatggagggagagggggtttttaaaaatatacaacatctaacggtcaccgaagagatagctgtgcaaaattggctggcaagagttggacgagaaagattatcgagaatggcaatctctggagatgactgtgtagtaaaaccgcttgacgatagatttgcaagcgctttaacagcacttaatgatatgggaaagataagaaaagacattcaacagtgggaaccaagtagaggttggaacgattggacacaagtaccgttctgctcgcatcattttcatgagctaattatgaaagatggcagagttttagttgtcccttgtagaaatcaagatgaactaataggaagggcccgaatatcacaaggagcaggttggagcttacgtgaaacggcatgtttagggaaatcctacgcgcaaatgtggagtttaatgtattttcataggagagacctaagactagcggcaaatgcaatttgtagcgctgtaccctcacactgggtaccgacatcaaggactacctggagtatccatgcaaaacatgaatggatgacaactgaggacatgctcactgtatggaatcgcgtatggatacaggaaaacccatggatggaagataaaactccggtcgagtcctgggaggaaataccatatttagggaaaagggaggatcaatggtgtggttcgttgatagggttaacaagcagggctacatgggcaaagaatatccaagtagccataaaccaggtaaggtctctaattggaaatgaggaatatacagattatatgccatctatgaagcgatttaggagagaagaagaggaagcaggcgtattatggtaa

SEQ ID NO: 22500 - RNA, 9876 nt, synthetic construct
  misc_feature 1..9876: note = derived and/or modified CDS sequence (opt6) from DENV-2__FJ639831__SS-prME
  source 1..9876: mol_type = other RNA
agcgctggaatgattattatgcttatccccactgttatggcattccatctaacaacacgcaatggggaacctcacatgatagtgagtatccaagaaaaagggaaatcgttgcttttcaaaaccgaagacggtgtaaacatgtgcacattaatggcaatggacttaggcgaactctgcgaagacaccataacttacaaatgcccgctgctaaggcaaaatgaacctgaagacattgattgttggtgcaatagtacatcaacttgggtcacttatgggacatgtactactacaggtgaacacaggagggagaaaagatcagtagcactggttccccatgtcggcatggggctcgaaacacgtacagaaacctggatgtcatctgaaggagcgtggaaacatgcacaaaggatcgaaacatggatactaagacatccaggattcacaattatggcagcaatactagcatacacaataggtaccactcactttcaacgggcgctaattttcatactattaactgcagttgcaccatcaatgaccatgcgttgtattggaatatcaaacagagactttgtagaaggagtttcaggaggttcttgggtcgacatagtattagaacatggctcctgtgttaccaccatggctaaaaataaacccacacttgattttgaactaattaaaaccgaagcgaaacaaccagctactctaagaaaatattgtatagaagcaaaactaacaaatacaacaaccgaatcaagatgtcctactcaaggcgaaccatcattaaaagaagaacaagacaaacgattcgtgtgtaaacatagtatagtagacagaggatggggtaatggatgtggactatttggtaaaggagggatagtaacatgtgctatgttcacatgcaagaaaaatatggaagggaaaatcgtacaacctgaaaacttagaatacacaatcgtagttactcctcatagcggtgaagaacacgcggtaggaaatgacactggaaaacatggtaaagaaatcaaagtgacacctcaaagctccgttacggaagcggagctaactggatacgggacggttacaatggaatgcagcccaaggacaggacttgattttaacgagatggttttactgcaaatggagaataaagcatggctagtacaccgacaatggtttcttgatttacctttaccgtggttacccggcgcagacactcaaggaagtaattggatacaaaaagaaaccctcgtcactttcaaaaatccacatgcaaagaaacaagatgtagtagttttagggtcgcaagaaggagcaatgcatacagctttgactggggcaaccgaaatccaaatgtcctcaggaaatttattgttcacagggcacttgaaatgtagacttagaatggataaattgcaattaaaaggaatgagttattcaatgtgtacaggaaaattcaaagtagtcaaagaaatagctgaaacacagcacggtacgatagttataagagtacaatacgagggagacggttcaccatgcaaaataccttttgaaataatggatctagagaaaaggtatgtcctagggagattaattactgtaaatcctatcgtgacagaaaaagattcacccgttaacattgaagccgaaccaccttttggagattcatacatcataattggagtagaacccggtcaactcaagttaaattggtttaagaaaggttcatcgataggtcaaatgttcgagacaacaatgagaggcgcaaaacgaatggcaattttaggagacacagcgtgggatttcggttctttaggtggagtattcacatccataggaaaggcgctacaccaagtattcggcgctatttacggcgctgcttttagcggcgtaagttggaccatgaaaatcttaataggagtaataattacgtggatagggatgaactcgcgttcaacatcgctgtcagtgagtttagttttggtcggaatagtaacactttatcttggcgtgatggttcaagcagattcaggatgtgttgtttcatggaaaaataaagaattaaaatgtggctccggaatctttatcacagataacgtccacacatggactgaacaatacaaatttcaacccgaatccccgtcaaagctcgctagtgcgatccaaaaggcccaggaagaaggtatctgcggtataagatccgttacccgactagaaaatctcatgtggaagcaaataacccccgaacttaatcatatcctagctgaaaacgaagtgaaactcactatcatgactggcgacatcaaaggcataatgcaagctggtaagagatcacttcgacctcaaccaacagaacttaagtactcatggaagacatggggaaaagcgaaaatgttaagcacggaaagccataaccagacttttcttatagacggcccagaaacggcagaatgtcctaatacgaatcgggcctggaactcgctagaagtagaggactatggcttcggtgtttttacaaccaacatctggcttaagttaaaagaaaagcaagatgccttctgtgattcaaaactaatgtcagctgcaataaaagataaccgagctgtacacgcagacatgggatattggatcgaaagtgcactaaatgatacctggaaaatagaaaaggcttcttttatagaagtgaaaaactgccattggcccaaatcacatactctgtggtcaaatggtgtcttagaaagtgaaatgattattcccaaaaatcttgcagggcctgtaagccaacacaactataggcccggatatcacacccaaatcgcagggccatggcacttaggaaagttagagatggatttcgacttttgcgatggcacaacagtagtcgtcaccgaggattgcggtaatcgaggcccatctcttcgtacaacaacagcaagcgggaagttaatcaccgagtggtgttgcaggtcttgtacactaccacccttgaggtatagaggagaggacgggtgttggtacggaatggaaatcagacctttaaaagaaaaagaagagaacctcgtaaatagccttgtaacagctggacatggacaaatagacaattttagcttaggagtcctaggaatggccttattcctcgaagaaatgttgcgtactcgagtcggaaccaagcatgccatattgcttgttgctgtatcttttgttacattaataacaggcaacatgtcatttaaagatttaggccgtgtagtcgtaatggtcggagccaccatgacagatgacattggtatgggtgtaacataccttgcactactagcagcttttaaagtcagacctacgttcgtggctggattattgcttcggaaactcacaagtaaggaactgatgatgaccacgattggaattgttttgcttagtcaatctacaattccagaaaccatactcgagttaaccgatgctctagcattaggaatgatggttctcaaaatagtacgagacatggagaagtatcagttagcagtaaccataatggccattctctgtgtacccaatgctgttattctgcaaaacgcctggaaggtgtcttgtaccattctagcagtggttagtgtttcacctcttctgttgacaagttcacaacagaaaacagattggataccattagcactaacgataaaaggtttaaatccaaccgcaattttcctaactactttatcaagaacgaataaaaagaggagctggccattaaacgaagccattatggcagtaggcatggtaagcattctagcatcatctctactcaaaaatgatataccgatgacaggcccattagtggcgggaggcctactcactgtttgctatgtactcacaggcagatcagccgatctcgaactggaacgcgcaacggatgttaaatgggaggaccaggcagaaatctctggcagcagccccattctatctataacgatttcggaggatggcagcatgtctataaagaatgaggaagaagaacagaccttgacaatattgatccggacgggacttttagtaatttccggtttgtttccagtcagcataccaattacagcagctgcatggtatttatgggaagttaagaaacaacgagcgggggttctctgggacgtaccctcaccgccacctatgggtaaagctgaattagaagatggagcataccgcattaaacaaaaaggagttttgggatatagtcaaattggtgcaggcgtatataaggaaggcacgttccacactatgtggcatgttaccagaggagccgtattaatgcacaagggtaagcgaattgaaccctcctgggcagatgtgaagaaagacttaatatcttacggtggcggatggaaactggaaggagaatggaaagaaggagaggaagtacaagttctcgcactcgagcctggtaaaaatcccagggcagtccaaaccaaaccgggcttatttaaaaccaataccgggactataggagctgtctcattagatttcagcccaggtacctccgggtcccccatcatcgataagaagggaaaagtagtcggactctatggtaacggagtagttactagaagtggagcatacgtttctgcaatagcgcaaaccgaaaaatctattgaagacaatcctgatatagaagatgacatttttcgaaaaagaaggcttacaatcatggacttacacccgggcgctgggaaaactaaacgatatctacctgccatagttcgagaagcaatcaagagggggctacgcacactcattttagcacccacacgagttgtggccgcagaaatggaagaagccttaagaggactacctataagatatcaaacaccagctatccgggctgaacatactggccgggagattgtagacttaatgtgtcatgcaactttcacaatgaggttattatctcccgtaagagtaccaaactataatctgataataatggatgaagcgcatttcactgatccagcctcaatagcggcgcggggatacataagtactagggtagagatgggagaagcagctggaatattcatgaccgcaaccccgcctggcagcagggacccttttccacaatcgaatgctcccatcattgacgaagaaagagaaataccagaaaggagctggaactccggacatgagtgggtaacagactttaagggaaagactgtatggtttgtaccaagcatcaaagccgggaatgatatcgctgcttgtctgagaaagaatggcaagaaagtcatacagctttcacgaaaaactttcgacagcgaatacgtaaagacccgtacgaatgattgggatttcgtagttacaacagacatatcagaaatgggggcaaatttcaaagctgaaagagtaatcgatcctaggaggtgtatgaaacccgtaatcctaactgacggcgaagaacgtgtcatattagcgggaccaatgccagtaactcattcctcggcggcacaacgaaggggtagaattgggagaaatcccaagaacgaaaacgaccaatatatatatatgggagagcctttggaaaacgatgaagattgtgctcattggaaagaagctaaaatgctactcgataacatcaacactccagagggaataatcccatctatgttcgagccagaacgagaaaaagtagacgcaattgatggagaatatcggcttcgaggagaagcaagaaagacatttgtagatcttatgcgccgtggtgatcttccagtatggttagcgtataaagttgcagctgagggaatcaattatgcagacagacgttggtgcttcgacggtatcaaaaataatcaaattctcgaggaaaacgtagaagtcgagatctggaccaaagagggagaacggaagaagttgaagccccgatggctggacgcaaggatatattctgatccactagccttaaaagaatttaaagaatttgccgcaggccgtaaatcgcttactctcaacttaataacagagatgggacgtctccccacgttcatgacacagaaaacccgcgatgcattagacaatctagccgtattacacacagcggaggccggtggacgggcgtataatcatgcattgtccgagcttcctgaaactttggaaactttgttattgcttacgctactcgccactgtaactggagggatattcttatttctaatgagcggtaggggaattggtaagatgacgctgggcatgtgctgtataattactgcaagtatcttactgtggtatgcacaaattcaaccgcactggatagcagcatccataatacttgagttcttcctgattgtacttctaattccagaacctgaaaaacagagaacaccacaggataaccagttaacatacgtagttatcgcaatcttaaccgtagtagcagctacaatggcaaatgaaatgggttttcttgagaagaccaagaaagatctagggctaggttctataacaacgcaacaaccggaatcgaacattttggacattgatttacgtcccgcatccgcttggactttatatgctgtagcaactacgtttgtaacccccatgctacgtcacagcatcgaaaacagcagtgtcaatgttagcttgactgctatcgcaaaccaagcaaccgtacttatgggcctaggcaaagggtggccgctatcaaaaatggacattggggttcctcttctagcaatcggatgttatagtcaagtgaatccaattacacttactgccgccctcttgctgttagtagcacattatgcaataattggaccagggttacaagcgaaagcaacgcgcgaagcgcagaaacgggcagcagcaggaattatgaaaaaccctacagtagatggcataacagtcatcgatttggatccgatcccatacgatccaaaattcgaaaaacaactcgggcaggttatgctgctcgtgttatgtgtaacccaggtactgatgatgcgaacaacctgggctatgtgtgaagccctcacccttgcaactggccccataagtacactatgggaaggcaatcctggacgattttggaatacgactatcgcagtctcaatggcaaatattttcagaggaagttaccttgcaggggcaggattgctattttcaatcatgaaaaacactacaaatacaagaagaggaaccgggaacataggtgagaccctaggtgaaaaatggaagagtcgtctgaacgctctaggtaaaagtgaatttcaaatctataagaaatcaggaatccaagaagtagataggacactagcaaaagaagggattaagagaggggaaacagatcatcatgccgtaagcagagggagcgccaaattgagatggttcgtggaaagaaatatggtcactccagaaggcaaagtagtcgatttaggctgtggacgaggaggttggtcatactattgtggtggattaaagaatgtcagggaagtgaaaggattaacaaaaggtgggccggggcacgaagaaccgattccaatgtcaacatatggttggaacctagtccgactgcaatctggggtagacgtcttctttatcccaccggaaaagtgtgacacactactatgcgacataggagagagttcaccaaatccaacggtagaagcaggaagaacgttacgagtattaaatttagtagaaaactggctaaataacaacactcaattttgtataaaggtacttaacccgtatatgccaagcgttatcgagaagatggaaacactgcaacggaaatacggaggagccttagtaagaaacccactcagtcgcaattctactcatgaaatgtactgggtttcgaacgccagtgggaatatagtatcttcagtgaacatgatttctaggatgctaattaatcggttcacaatgagacacaagaaaactacctatgagccagacgtggacttaggatctggtacaaggaacattggtatagaatctgaaatcccaaacttagatattatcgggaaaagaatagagaaaatcaaacaagaacatgaaacatcatggcactacgatcaagatcatccctacaaaacatgggcgtatcacggatcatatgaaacaaagcaaactgggagtgcctctagtatggtgaatggcgttgttcggctattgaccaaaccatgggatgtattgccaacggttacgcagatggcgatgactgacactacaccctttggacaacaacgggtatttaaagagaaagtcgatacccggacacaggaaccgaaagaaggaaccaaaaagctaatgaaaatcactgcagaatggttgtggaaggaactcggaaagaagaagacaccaaggatgtgtaccagagaagagtttacgcggaaagtacgctcaaatgcagctttgggagctatattcacagatgagaataagtggaaaagtgcacgtgaggcggtagaagatagtagattttgggagctagtagataaggaaagaaaattacatctcgagggcaaatgcgagacatgcgtttacaacatgatgggaaaaagagagaagaaacttggagaatttggtaaagctaaaggatccagggcaatatggtacatgtggctaggagctcgctttctagagttcgaggcactagggtttctcaacgaggatcactggtttagtcgtgaaaattcactatctggagtcgaaggtgagggtcttcataaactaggctacatcttgagggatgtgagcaagaaagaaggcggcgcaatgtatgctgacgataccgccggttgggataccaggataacactagaagacttaaagaacgaggaaatggtaactaaccacatggaaggcgagcacaagaaacttgcagaagcaatatttaaactcacatatcaaaacaaagttgtcagggttcaaagacctactcctcgcggaaccgttatggatataataagtcgaagagatcagcgtggttcagggcaagtaggtacatatggacttaatacatttacaaatatggaagcccaattaatacgacaaatggaaggagagggtgtcttcaaaaacatacaacacttaacagttactgaagaaatagcggtgcaaaattggcttgcaagagtgggaagagagcgactaagcagaatggcgatatcaggagacgattgcgtcgtaaaacccctagatgacaggtttgcaagcgcactaaccgcgttaaatgatatggggaaaattagaaaagacatacaacaatgggaaccttctcgtggttggaacgactggacacaagtacctttttgtagtcaccactttcatgaattaataatgaaggatgggcgagtcctagtagttccgtgtagaaaccaagatgagttaattggtagagcacgaatcagccaaggagcgggatggagcttaagggagacggcctgccttggaaaaagttatgcgcaaatgtggtccttgatatatttccataggagagacttacgtctcgctgctaacgcgatttgtagcgcggtgccatcgcattgggtgccaacatcaaggacaacctggtcaatacacgctaaacacgaatggatgacgacggaggacatgttgactgtttggaaccgtgtatggattcaagagaatccatggatggaagataaaacgccggtagaaagctgggaagaaattccctatctagggaaaagagaagaccaatggtgtggctcactaataggactcacatctagagcaacatgggctaaaaatatacaaacagcaataaatcaagtcagaagtttaataggaaacgaagaatacacggattatatgccctcaatgaagagatttagaagagaagaagaagaagctggtgtattgtggtaa

SEQ ID NO: 22501 - RNA, 9876 nt, synthetic construct
  misc_feature 1..9876: note = derived and/or modified CDS sequence (opt6) from DENV-2__FJ639832__SS-prME
  source 1..9876: mol_type = other RNA
tcagccggcatgattataatgttaatccctactgtaatggcgttccacctaacaacgaggaacggagagccacatatgatcgtagggatacaggaaaaaggcaaaagtcttttatttaaaactgaagatggggtaaatatgtgcaccttgatggccatggacttgggagaattatgtgaggataccattacatacaagtgcccgttacttagacaaaatgaacctgaagatatagattgctggtgcaatagcacatcaacatgggttacatatggtacttgcacaacaacaggtgagcatcgccgggaaaaacggagtgttgcactggttccacatgttggaatgggtttggagacacgcaccgagacgtggatgtcaagtgaaggagcttggaaacacgcccaaagaatcgaaacttggattctgcgacatccgggattcaccatcatggctgccatattagcttatacaataggaaccactcacttccaacgagtactgatcttcatcctactgaccgcagttgcaccatctatgacaatgagatgtataggtatatcgaacagggattttgtagaaggagtctctggtggatcctgggtagatatagtcctagaacatggaagttgtgtcacaactatggcgaagaataaacctaccttggatttcgaattgattaaaacagaggctaagcaaccggcaaccctaagaaaatactgtatagaagccaaactaacaaatacaactacggaaagccgatgtccgacacagggtgaaccatctttaaaggaagaacaagacaagagattcgtctgcaaacacagcatggtagacagaggttggggaaacgggtgcggattattcggaaaaggtgggatcgtgacctgcgcaatgtttacgtgtaaaaagaacatggaaggaaagattgtacaaccagagaatctggaatatacgattgtagtgaccccccatagcggggaggaacatgcagtaggaaacgatactggcaaacacggaaaggaaattaaagtaacgccccaatctagtataacggaagccgaactaacaggatatgggacagttacaatggaatgtagcccgagaaccggactagattttaacgaaatggttctactacaaatggagaataaagcttggctcgtccacagacaatggtttttagatctaccacttccatggttacctggagcggacaagcaagaatctaactggatacaaaaggaaacattggttacattcaaaaaccctcacgcgaaaaagcaagatgtagtagtactcggatcccaagaaggcgccatgcatacagcacttacaggcgcgacggaaatacaaatgtcaagtggtaatttattatttacaggccatctaaaatgtcggctgaggatggacaagctacaattaaaaggcatgtcttatagtatgtgcacaggcaaatttaaggtagtaaaggagatagctgaaacgcaacacggaacaatagtcattagagtacaatacgagggtgatgggtcaccttgtaaaataccgtttgaaataatggatttggaaaaacgatacgttttaggtagattgataactgtaaatccaatagtcactgaaaaggattcacctgtgaatattgaagctgagccgccattcggagattcatacatcattattggggttgaacccggacagctaaaactaaattggtttaaaaaaggttcatctattggtcagatgttcgaaacaacaatgagaggtgcgaaacgcatggctatattaggtgacactgcatgggatttcggaagtctaggtggagtctttacctcaatcggtaaagcactacatcaagtgtttggtgccatctatggtgcagccttctccggagtcagttggacaatgaaaatcttaattggtgtaataatcacgtggataggaatgaacagcaggtcaacttcgctctctgtttcgttagtccttgttgggatagtaacactctatttaggagtgatggtgcaagcagattctggttgcgtagtgagttggaaaaataaagaacttaaatgtgggagcggtattttcattacagataacgtacatacctggacagaacaatataaatttcagccagaatcaccatcgaaactggcatctgctatacaaaaagcccaagaggaaggcatctgtgggattaggtcagttacaagattggaaaacctaatgtggaaacaaatcacgcccgagttgaaccacatccttgccgaaaatgaagtgaaactaacaataatgacaggggacatcaaaggcataatgcaggcaggaaagagatctctaaggcctcaaccgaccgagttgaaatattcctggaaaacatggggcaaagcaaaaatgctcagcaccgaaagttataaccagacctttttaatagacgggccagagaccgcagaatgcccaaatacaaatcgggcttggaattccctggaggtggaggactacgggtttggtgtcttcaccactaatatatggttaaaattaaaggagaagcaagacgctttttgtgatagtaaattaatgtcagccgcgattaaggacaacagagcggtccacgcggacatgggctactggatagagtctgctctaaatgacacatggaaaatcgagaaggcgagttttatcgaagttaaaaactgtcattggcctaagagtcatactttatggtctaacggagtgttagagagtgaaatgattatcccaaaaaatctagcgggacctgtaagtcaacataattatagacctggttatcacacacaaatcgccggtccttggcacttaggcaaactcgagatggattttgatttctgtgacgggacaacagtcatagttactgaggattgcgggaatagaggcccttcactacgtacaacaacagcctcaggaaaattaataacagaatggtgttgcaggagctgtacacttcctcccctccggtacagaggggaggacggctgttggtatggcatggaaattcgccctctgaaggagaaggaggagaatttagtgaactcactggtaaccgcaggacacggacaggttgataatttctcactaggagttctaggaatggcactgttcctggaagaaatgttacgaacaagagttggaacaaaacatgcaattttgcttgtagcagtctcctttgttactcttattacgggcaatatgtcattcaaagatttgggtcgagtagtcgtaatggttggagccacaatggcggacgacataggtatgggagtaacttaccttgctcttcttgctgcatttaaagtaagaccaacatttgcggctggtttactattgcgcaaattaacctcaaaggagttgatgatgacaacaataggaattgtactattgtcacaatcaactatacctgaaactgtacttgaactaacggacgcactagcgttaggtatgatggtccttaaaattgtaagaaacatggaaaaataccaactagcggttacaataatggcaatactgtgtgtgccaaatgctgtaatccttcagaatgcatggaaagtatcgtgcaccattttagcagtagtttcggtctctccattacttctcacaagtagccaacaaaaaactgactggataccactagcattaacgataaaaggtttgaaccccacagccatctttctaacaaccttatccagaactaacaaaaagcgatcctggccattaaatgaagctataatggcggttggaatggtaagcatattggcgagtagcttattaaaaaatgacataccaatgacaggacctctagtagcagggggtttattaactgtatgctatgtcttgacaggcaggagcgcggacttagagttagaacgtgcaacggatgtcaaatgggaggatcaagcagagatatcaggttcatcacccattcttagcattacaataagtgaggacggaagtatgagcataaaaaacgaagaagaagaacaaacgctaaccatactcatccgtactggactgcttgtaatttcagggttatttcccatttcaattcctatcactgcggcagcatggtacctatgggaggttaaaaaacagagagcaggagtattatgggatgtaccaagtccacctccgatgggcaaagcagaattggaagatggggcctatagaattaaacaaaaaggcatactaggctatagtcagatcggagctggcgtttataaagagggtacctttcacactatgtggcatgtcacgagaggcgcagtattaatgcacaaaggcaaacgaatcgaaccaagctgggcagacgtaaaaaaagatttaatatcctatggaggaggttggaaattagagggagaatggaaagagggagaagaagttcaagtgcttgcattagaaccgggaaaaaatcccagggcagttcaaactaagccaggactcttcaagacaaataccggaaccataggagcagtatcattagatttttcaccgggcacaagtgggagtccaatcatcgataagaagggtaaagtggttggactatacggaaatggagtagtaacaaggagtggagcctatgtttctgctatcgcacaaactgaaaagagcattgaggataaccctgagatagaagacgacattttcagaaaaaggcgcttaaccatcatggatttgcacccaggtgcaggtaaaactaaaagatatttacctgccatagtgagggaagctataaaaagaggacttaggactctgatattagcaccaactagggttgtagctgcagaaatggaagaagctcttcgaggtttaccaataagataccaaactccagcaataagagcggaacacaccggcagagaaattgtcgatttaatgtgccacgccacgtttacaatgagactacttagcccagtgagagtacctaactacaatctgattataatggatgaagcacactttaccgaccctgcctcaatagcagctagaggttatatctcaacaagagtcgaaatgggagaagcagcaggaatattcatgaccgcaactccccccggatctagggacccgttcccgcagtcaaatgcacccattattgatgaagaaagagaaattcctgaacgctcctggaattcaggacacgagtgggtcactgattttaaaggcaaaacagtctggttcgtgccaagtattaaagcagggaacgatatagcagcctgcctgaggaaaaacggaaaaaaagtaatacaactatcccgcaaaacattcgatagtgaatatgtaaagactagaacgaatgactgggacttcgttgttactacagacattagcgaaatgggcgcaaattttaaagcagaaagggtaatagacccgcgccgctgtatgaagccagtaatattgactgatggagaagaaagagttattctagcaggccctatgcctgttacacactcgtcagccgctcagagaaggggccgaatcgggagaaatccaaaaaacgaaaacgatcaatacatctacatgggtgaaccactagaaaatgatgaggattgtgcccattggaaggaagcaaagatgttgttagacaacataaacacccccgaaggaataataccctctatgttcgagcctgagcgagaaaaagtcgatgctatagatggtgaataccgactgaggggcgaagcaagaaagactttcgtggacttaatgcggcgtggagacctaccggtatggcttgcatataaagtagctgccgaaggaattaattatgctgacagaagatggtgctttgatggaattaaaaataatcaaatattagaggaaaacgttgaggtagagatctggacaaaagaaggagagaggaaaaaactgaagcctagatggctagatgcgagaatctattcggatccattagccctgaaagaatttaaagaatttgcagctggtagaaaaagtttaacgttaaatttaatcaccgagatgggtagattacctacgtttatgacgcaaaagacgcgcgatgcgttggataaccttgcagttctacacactgcagaagcaggaggacgggcatataaccatgctctttcagaactaccggaaacgttagagacacttctcctattaacgttactagcgactgtcacagggggcatatttttattcctaatgagcggcagaggcataggaaagatgacacttggaatgtgttgcattattaccgcatctatattattgtggtacgctcaaattcagccccattggattgcagcatcgataatcctggaattttttttgattgttttacttatccccgaaccagaaaaacagcgtactcctcaagataaccaattaacctatgtcgtcatagctattttaaccgttgttgccgccaccatggcaaatgaaatgggttttctcgagaaaaccaagaaagacttaggattaggaagtattgccacacagcaacccgaatctaacatattagatatagatttgagaccagccagcgcatggacactatatgccgtagctacgacttttgttacccccatgctacgacacagcatagagaactccagcgttaacgtcagcttgacagcgatcgcaaatcaggctacggttttaatggggctaggcaaaggatggcctttgtcaaaaatggatataggcgttccgctattggctattgggtgctattcacaggttaatcctattacgttaactgcggcattactactactcgtagcacattacgcaattatcggtccaggattgcaagcaaaggctacgagggaagctcagaaacgagcggcggcaggaataatgaaaaatcctacagtagatggaataacagtcatagatcttgatccgataccgtacgaccctaaattcgagaaacaattaggtcaagtaatgctgctaatattgtgtgtcacacaagtcctaatgatgagaactacctgggcactctgcgaggcgttaacactagcaacaggaccaatcagcaccttgtgggagggtaatcctgggagattttggaacacaacaattgcggtatcaatggcgaatatattccgtggatcatatttggcaggggctgggctattattctccataatgaaaaataccacaaacacgagaagaggtacaggaaatataggagaaacattaggcgagaaatggaaaagtcggttgaatgcactgggaaaatcagagtttcaaatatacaagaagagtggaatccaagaagtagataggacactggcgaaagagggcatcaaaagaggggaaacggaccatcacgcggttagtcggggaagcgcaaagctacgatggttcgtagaacgaaatatggtcacgcccgaaggcaaggtagttgacctcggttgtggcagaggtggatggtcatactattgcggggggttgaagaatgtaagagaagtaaaaggcctaacaaagggagggcccggccatgaagaacccatcccaatgtcaacatacggctggaaccttgtaaggctgcaaagtggagtagacgtctttttcatccctccggaaaaatgcgatacactcttatgcgatataggggaaagttctcctaatccaactgtcgaagcaggcaggacacttagagtcttaaaccttgtagagaattggcttaataacaatacgcaattctgtataaaggtccttaatccatacatgccaagcgtcatagagaaaatggaggcgttacaacgtaagtatggaggtgcattagtacgaaatccattatcccgaaatagtacacacgaaatgtattgggtttccaacgcgtcagggaatatagtatcctcagtaaatatgatatccaggatgttaatcaataggttcacgatgagacacaagaaggccacgtatgagccagatgttgacttaggcagcggtacaagaaatataggaatcgaatcagaagtaccgaatctagatatcataggtaaaaggatagaaaaaataaaacaagaacatgaaacgtcatggcactatgaccaagatcatccttacaagacgtgggcttatcatggtagctatgaaacgaaacagactggatcagcatcaagcatggtcaatggcgtagtacgtttactaacaaaaccttgggacgtacttccaacggtcacgcagatggcaatgacagacacaacaccttttggacagcaaagagtcttcaaagaaaaagtagacacaaggacccaagaaccaaaggaaggcacaaaaaaacttatgaaaataacagcagaatggctctggaaggagttaggtaaaaaaaaaacgccacgaatgtgtacaagagaagaatttacgagaaaagtcagatcaaacgcagcgcttggagctatatttaccgacgagaacaaatggaaatcagctcgagaagcggtggaagacagccgcttttgggaactagttgataaagaacgtaatttacatttggaaggaaagtgtgagacttgtgtgtacaatatgatgggaaaaagggaaaaaaaacttggtgaatttgggaaggctaagggaagcagagccatatggtacatgtggctaggggcccgttttttagaatttgaggcattggggttcttgaatgaagaccattggttcagtcgagaaaatagtttaagcggagtagaaggagaaggtctacacaaattgggatatatacttcgagacgtcagtaagaaagaaggcggtgcaatgtacgctgacgatacagcagggtgggatacacgaataacactagaagaccttaagaacgaagagatggtcaccaatcatatggaaggagaacataagaaattggctgaggcaatatttaaactaacctaccagaataaagttgttcgcgtacaacgaccaacacctagaggaacagttatggacataatctcacgaagggatcaaagaggcagtggtcaagtcggaacatatggtctaaatacatttactaacatggaagcacagttaattcgacagatggaaggagaaggcgtttttaaaaacattcagcatctaacagtaacagaggaggtagctgtacaaaactggctagcgagagtcggtcgtgaacgtttgagtagaatggcaataagtggagacgactgcgtagtcaaaccattagatgatcggttcgcaaatgcacttacggctctaaatgatatgggtaaaattagaaaagacattcaacaatgggaaccatcaaaagggtggaatgattggactcaagttcctttctgttcacaccacttccatgaattgataatgaaagatggcagagtacttgtggtaccttgtagaaatcaagatgaactcatcggaagagcaagaatatcacaaggagcagggtggagtctacgcgaaacagcttgtctcgggaaatcatatgcgcaaatgtggagtcttatgtactttcatagacgcgatttgagattggcggctaatgccatctgcagtgcagtcccaagtcattgggtacctacaagccggacaacatggtcgatacatgccaaacacgaatggatgactaccgaagatatgttaacagtgtggaaccgagtatggattagggagaatccttggatggaggataaaaccccagttgaatcgtgggaagaaattccatacctagggaaacgcgaagatcaatggtgtggatctttaataggcttaacaagtcgagctacctgggcaaagaatatacaagcagctataaaccaggttagatccctaatcgggaacgaggaatacacggattatatgccatcaatgaaacgtttccgtagagaggaagaagaagcaggagtgctgtggtga

SEQ ID NO: 22502 - RNA, 9876 nt, synthetic construct
  misc_feature 1..9876: note = derived and/or modified CDS sequence (opt6) from DENV-2__FJ687434__SS-prME
  source 1..9876: mol_type = other RNA
agcgtgggaatgataattatgttaatacccacggtcatggcattccacttaaccactcgtaatggggaaccacacatgatcgtaagcatacaggaaaaaggtaaaagtttacttttcaaaactgaagacggagttaacatgtgtactctaatggccatggatttaggtgaattatgcgaggacactataacatataaatgtccgcttttacgtcaaaatgaaccggaagatatagattgctggtgcaattctacatcaacgtgggtcacatacggaacttgtaccacaacaggcgaacatcgccgagaaaaacgctcagtagcgttagttccacatgtaggtatgggtttagaaactaggactgagacttggatgtcttcagaaggtgcatggaaacatgcgcaaaggatcgagacatggatactaagacaccctggctttaccataatggctgcaattttagcctacactataggtactacccactttcagcggacattaatcttcatattattgacggcagttgctcctagcatgacaatgagatgtataggcatctcgaatagagactttgtcgaaggagtatcaggaggttcttgggtcgatatcgtgctagaacacgggtcttgtgttactacgatggctaaaaacaaacccaccttggattttgaattaataaagactgaagcgaaacagccagctacattaagaaagtactgtattgaagctcggctaactaatacaacgacagagagtcgatgtcctacacaaggtgaaccaagcctaaaagaagaacaggataagagatttgtttgtaaacacagtatggttgaccgaggttggggaaacggttgtggcctatttggaaagggaggcatcgtaacatgtgccatgtttacatgtaagaaaaatatggagggaaaaatagtacagcctgaaaacttagagtacaccatagtcgttaccccgcattcaggagaagaacacgcagtgggcaatgacacaggcaaacatggaaaagaaattaaagttactccacaaagttctattactgaagcagaattaaccggttatggtacggtaacaatggaatgctcaccaaggacatcattagatttcaacgaaatggtcctgctacaaatggaaaataaagcatggctcgttcatcgccaatggtttctcgatttacctctaccgtggttacccggtgcggatacgcaaggtagcaactggatccaaaaagaaacgttggtaacattcaaaaatccacacgctaaaaaacaagatgtggttgttttaggatctcaagaaggggctatgcacactgcgctaacgggagctacagagatacagatgtcgtcgggcaatctattattcacaggacatttaaagtgcagattgcgtatggataaactacaactaaaaggtatgtcttattcaatgtgcactggaaaatttaaagttgtcaaagagattgcagaaacgcaacatggtacaatagtgataagagtccaatatgagggagatggatcaccctgtaaaatacccttcgagattatggatttagaaaaacggtatgtattaggtcgactaatcacagttaaccctattgtaacagaaaaagattccccagtgaatatcgaagcagagccaccatttggggatagttacataataataggagttgagccaggacaattaaaactcaattggttcaaaaagggatcaagtataggccaaatgtttgaaaccacaatgcgcggcgctaaacgcatggcgattctgggggataccgcttgggatttcgggtcgctcggtggtgtttttactagcataggaaaagctctacatcaagtgtttggcgctatatacggagcggcattttcaggtgtatcgtggacgatgaaaatcttgattggtgtaataataacatggattggaatgaatagtcggagtaccagcttatccgtttccttagtattagtaggagtcgtgacattatacttaggagtgatggtacaggcagacagcgggtgcgtggtttcgtggaaaaacaaggaacttaagtgtggatctggaatcttcataactgataatgtacatacgtggactgaacaatacaaatttcaacctgagagccctagcaagttagcaagcgctatccaaaaagcacaggaagaagggatctgtggcattagatcggtcacaaggttagagaatctgatgtggaaacaaataacaccagaattaaatcatattttggcagaaaacgaggtaaaactaacaattatgacaggagatattaaggggataatgcaagcagggaaaagaagtttgcgaccccaaccaactgaattaaaatactcatggaagacatggggtaaagcgaaaatgttatcaacagaaagccacaatcaaacttttttgatagatgggcctgaaacggcagaatgcccaaatactaatagggcgtggaatagtctggaagtggaagattatgggttcggagtatttactacaaatatatggctgaaactgaaagaaaagcaagatgcattttgcgactcaaagctgatgtcagccgctataaaggataaccgagcagtgcacgcagatatggggtattggattgaatctgcattaaatgacacctggaaaatagaaaaagcttcatttatcgaagtaaaaaattgtcactggccgaaatcacacacactatggagcaatggagtacttgaatcagagatgattatcccaaaaaatttagcgggaccagtatcacaacacaattatcgacctggttatcatacacagatagctggcccttggcatttaggaaaactggaaatggactttgacttctgtgatgggaccacagttgtagtgaccgaagactgcgggaacaggggtccatcgcttagaaccactactgccagcggcaaactaataactgaatggtgttgtagatcgtgcactcttccaccattacgctaccgcggggaagatgggtgttggtatgggatggaaatacggccgctcaaggaaaaagaagagaacctagttaactctttggttacagcaggtcatggccaagtagataattttagtcttggagtcctggggatggccttgttcttggaggaaatgctcagaactagagttgggacaaaacacgcaatattattagtcgcagtgtctttcgtcaccctcatcaccggcaatatgtcctttaaagatctaggtcgtgttgtagttatggtaggtgctactatgacagatgacatagggatgggagtgacttatttagcgttgcttgcagcattcaaagtgagacctacatttgccgcgggccttctactaagaaaattaacttccaaagagctaatgatgaccactatagggatagtcttactgagtcagtctacgattcccgaaacaatattagagttgacagatgcattagccctgggtatgatggttctaaagatggtcagggacatggaaaaataccaactggctgtcacgataatggcaatcttatgcgtcccaaatgcggttatcctccagaatgcttggaaagtgagctgtacaatactcgccgtagtttcagtctcaccattattactcacatctagccaacaaaagacagactggataccgttagctcttaccatcaaaggattgaatccaacagcgatattcctaacaactctttcaaggaccaacaaaaaacgcagttggcctttaaatgaagcaattatggcagtaggtatggtatccatattagcaagtagtctactaaaaaacgacatcccaatgacaggccctctagtggctggtggcctactgacagtatgttatgtgctaacagggagatctgcggacctagaattagaaagagcaactgatgtcaaatgggaagaccaagctgaaataagcggaagttcaccaatacttagcataaccataagtgaagacggctcaatgtcaataaaaaatgaagaggaagagcaaacattaacaatactcatacgtaccggattgctagtgataagtggtctattcccagtatccatccctataacggcagcagcttggtatctatgggaagttaaaaagcagagagctggagtactttgggatgtgccaagtcctccaccaatgggtaaagcagaattagaagatggagcttacagaatcaaacaaagaggtatactgggttatagccaaataggggcaggagtatataaagaaggtacgttccatacaatgtggcatgtcactaggggcgctgtgttaatgcataaaggcaaaagaatagaacccagctgggccgatgttaaaaaagatttaatttcctacgggggcggctggaaactagaaggagaatggaaagaaggcgaagaggtccaagttcttgcattagagcccggaaaaaatcctagggcagtacaaacgaagccaggattattcaaaacgaatacagggacaattggagcggtcagcctagatttcagcccgggtaccagcggtagcccgatcattgacaaaaaaggtaaagtggtgggactatacggtaatggggttgttacacggagtggcgcttatgtaagcgcaattgcgcaaactgaaaagtcaatagaagataaccctgatatagaagacgatatatttagaaaaaggaggctaaccattatggatttgcatccgggcgctggaaaaacgaaacgataccttcctgcaatcgtaagggaagcaataaaaagagggcttaggactctgatattggcccccactcgtgtagtcgcagccgaaatggaggaagcattacgcggcctaccaattcgatatcaaacacctgcaatacgtgcggaacacactgggcgtgaaatagtagatttgatgtgtcatgccacatttactatgagattactgtcgccggtacgagtaccaaattataacctgataatcatggacgaagcacacttcaccgaccctgccagtatagcagcaagagggtacataagtacacgagtggagatgggagaagccgcgggtatttttatgacagcgaccccgcctggtagcagagatccattcccacaatctaacgctccaattatagatgaggaacgtgaaatacccgaaagatcttggaactcagggcatgagtgggtaacagactttaaaggaaagacggtatggttcgtaccatcgataaaagcgggaaatgatattgccgcatgtttgagaaaaaacggaaaaaaggtcatccagctctcacgcaaaacatttgacagtgaatacgtaaaaacacgcactaatgattgggatttcgtggtgacaacagatataagtgaaatgggtgcaaactttaaggccgagagagtaattgacccaaggagatgcatgaaaccggtcattcttactgatggggaagagagagtaatccttgcagggcccatgcccgttacacattcgtcagcagcacaacgtagagggagaataggtcgaaatcccaaaaatgaaaatgatcaatacatctatatgggagaacccctcgagaatgatgaagactgtgcacactggaaagaagcaaaaatgttactcgataacataaacaccccggaaggaataattccatctatgtttgagcccgagcgagaaaaagtggatgcaattgatggcgaatataggttacgaggtgaagccagaaagactttcgttgacctaatgcgcagaggtgacttgcctgtatggttagcttacaaggtggcagcggaaggaataaactacgccgacagaagatggtgcttcgatggcatcaaaaacaatcaaattttagaagaaaatgttgaggtagaaatttggaccaaagaaggcgaacgcaagaaactgaaacctaggtggttggacgcgcgtatttacagcgaccctttggctcttaaggaattcaaagagtttgccgcaggtagaaaatcattaacattaaatttaataacagagatgggaaggctaccgacattcatgacccagaaaacacgagacgctttagacaacctagcagtccttcacacagctgaggcgggaggcagagcctataatcatgccctaagtgaactacccgagaccttggaaacattgttattactaacattactcgcaactgtaactggtggtatatttctatttctaatgtctggaagaggcattggaaaaatgaccctcggtatgtgctgcatagtaaccgctagcatattactttggtatgctcaaatccagccgcactggatcgccgcttctatcatcctagaattcttccttatagtgttattaataccagaaccggagaaacagagaacgccgcaagataatcaactcacatatgtggtcattgctatattaacggttgtagcagcgacaatggcaaatgagatgggctttttagagaagaccaaaaaagatttaggcttaggatcaatagcgacacaacaaccagaaagcaacatactagatatagatttacgacctgcatccgcatggacgttatacgctgttgcaactacttttgtaacgccaatgttaaggcactctattgaaaatagcagcgttaatgtatcacttactgcaatagcaaaccaagcaactgtactaatgggattgggtaaaggctggccgctctcaaagatggatataggagcacccttattagccataggttgttactcgcaagtaaacccaataaccctgaccgctgctctccttctattagttgctcactacgcaatcatagggcccggtcttcaagctaaggctacacgagaagcacaaaagcgggcagctgctggaataatgaaaaacccgacggtggacggaataactgtaatagatttagatccaataccctatgacccaaagttcgaaaaacaactaggacaggctatgctattggtgttgtgtgtaacacaggttcttatgatgcgtacgacatgggcattatgtgaggctctgacactcgccacaggtccaatatctactctatgggagggaaatcctggccgattctggaacactactatcgctgtgagtatggctaatatattcaggggttcatacctagcaggtgccggactgctttttagcatcatgaaaaatacaacaaatagtagacgtggcaccggcaacataggggagactttaggagaaaagtggaaatccaggctcaacgcactcggtaaatctgaatttcagatctacaaaaaatcaggtatacaggaagttgataggacattagctaaggaggggatcaagagaggtgaaacagaccaccacgccgtatctagagggagcgccaagttgagatggtttgtagaaagaaatatggtaacaccagaagggaaggtagtagacctggggtgtggacgtggcgggtggtcatattattgtggaggactgaaaaacgtaagggaagtaaaagggctaactaagggaggaccaggccacgaggaaccaataccgatgtcaacctatggttggaatttggtgcgtctacaatcaggcgttgacgtattttttatcccacccgaaaagtgtgacacattactgtgtgacattggcgaaagttcacccaacccaactgttgaggcgggaagaactttgcgtgtacttaatttggttgaaaactggctaaacaataatactcaattttgcataaaagtgctgaacccatatatgccatctgttattgaaaaaatggaaaccctccaacgcaaatatgggggggcacttgtaagaaatccattatctcgaaattccactcatgaaatgtactgggtatcaaatgcttcaggtaacatcgtctctagcgtcaatatgatctcgcgaatgttaatcaatcgatttaccatgcgacataaaaaagccacctacgaaccagacgtagacctaggatctggaacaagaaacatcggcatagaatcggaaattcccaatttagacattattggaaaacgtattgaaaaaataaaacaagaacacgaaacatcatggcactacgatcaggatcatccatacaagacttgggcctaccatggatcctatgagacaaaacaaacgggtagcgctagctcaatggttaatggcgtggtgagactcttaacaaaaccttgggacgttctccccacggtaactcagatggcaatgacagatactacgccatttggtcaacaacgcgtgttcaaagaaaaagtagacacacgtactcaagaaccgaaggaaggaacaaagaagctgatgaagatcacagcagaatggttatggaaagaactaggtaaaaaaaaaacgccgcgaatgtgcacacgcgaagagttcactagaaaggtacgatctaacgctgccctcggcgcgatcttcacagatgaaaataaatggaagagtgcgagagaagcggtggaagactctcgtttctgggaattggtagataaggaacggaacttacacttagaagggaagtgcgagacctgtgtttataatatgatgggaaaacgtgaaaagaaattaggagaattcggtaaagcaaaaggttctagagctatatggtacatgtggttaggcgcacggttcctagaatttgaggcattgggattcttaaatgaagatcactggttcagtcgagaaaatagcctatcgggcgtagaaggtgagggtttacacaaattaggatacattttacgagatgtgtctaaaaaagagggaggtgcaatgtacgcggatgatacagcagggtgggacactagaataactttagaagatttaaaaaatgaggaaatggtaacgaaccacatggaaggagagcacaagaaattagcggaggctatattcaaactaacataccaaaataaagtagttcgggtgcaacgacctaccccaagaggcactgtaatggacatcatttctaggagggaccaacgcggtagcggacaggtgggtacatacggtcttaatacgtttaccaacatggaagcccaacttatacgacaaatggaaggggagggagtctttaagaatatacagcatttgactgtcacagaagaaatagccgtacagaactggttagcaagggtgggaagggaacgattatcacgtatggctatatcgggcgatgactgcgtagttaaaccactagacgatcgtttcgcttccgctttaacagcattaaatgatatgggaaagataaggaaagacatacaacaatgggaaccttcaagaggatggaatgactggacccaagttccattttgcagtcaccattttcatgaattaataatgaaagatggaagggttttggtcgtaccatgtaggaatcaggatgagttgataggtcgcgcccgaatttctcaaggtgcgggttggtcccttagagaaacagcatgtcttggtaaaagttacgcacaaatgtggtcattaatgtattttcaccggcgggacctcagattagccgcaaacgctatttgttcagccgtcccatcgcactgggtcccgacttcccgaacaacttggagtatacatgcaaaacacgaatggatgaccactgaggacatgctcacagtttggaaccgagtatggatacaagaaaatccatggatggaagacaagacaccagtagagtcttgggaagaaatcccctacttgggaaaaagagaggatcagtggtgtgggagtctaataggactaacatcacgagcaacatgggccaaaaatattcaagctgctataaatcaggtaagatcgttaatcgggaatgaggaatacacagactacatgccgtcgatgaaacgctttaggcgagaagaagaggaagccggagtattatggtaa

SEQ ID NO: 22503 - RNA, 9876 nt, synthetic construct
  misc_feature 1..9876: note = derived and/or modified CDS sequence (opt6) from DENV-2__FJ687439__SS-prME
  source 1..9876: mol_type = other RNA
tcagcaggaatgataattatgctaattccaacggtaatggcttttcatttgaccacgcgtaacggagaaccccatatgatcgtaggaatacaagaaaaaggcaaaagcctgttatttaaaaccgaagatggggtaaacatgtgtactcttatggctatggatctaggcgaactatgtgaagatacaattacatacaaatgcccgttattgcgacaaaatgaaccggaagatatagactgttggtgcaattccacatctacttgggtaacttatggaacgtgtacaacaacgggggaacaccggagagagaaaagatcggttgctttagtacctcatgttggaatggggctagaaacaaggacagaaacatggatgtcgagcgaaggagcttggaaacatgcgcaacgcatagaaacatggatactaaggcatccaggtttcactataatggctgcaatcttagcttatacgataggaacaacacatttccagagagcactaatatttattttgttaacggctgtagctcccagcatgactatgagatgtattggtatatcaaacagagactttgttgaaggggtatcaggaggaagttgggtagatatagtattggaacatggtagctgtgttacaacgatggccaaaaacaaacctactctagatttcgaattaattaaaaccgaagctaaacagccagccacattgagaaaatactgtattgaagcaaaattaaccaacacaacaacagaaagtcggtgtccgactcaaggagagccttccttaaaagaggagcaggataaaagatttgtgtgtaaacacagtatggtggatagaggatggggaaacggctgtgggttgttcggtaaaggtggaatcgtgacatgtgctatgttcacttgcaagaaaaatatggaagggaaaatagttcaacctgaaaatttagaatatacaattgtagtcaccccacattctggagaggaacacgctgtaggtaatgacacgggaaaacacggaaaagaaatcaaagtcaccccacaaagttccatcacagaagctgaacttacaggttacggaacggttactatggaatgctcaccacgaacaggcctagattttaacgaaatggttcttctacaaatggagaacaaagcatggttagtgcatagacaatggtttttagacttaccacttccgtggctgcctggagctgacaaacaagaaagtaattggatacagaaagagactttagttacattcaaaaacccacatgcgaagaaacaagatgtagtcgtgctaggatcacaggagggtgccatgcataccgctcttacaggggcaaccgagatacaaatgtcgagtggtaacttactttttacaggtcatctaaaatgtcgtttacgtatggataaattacaacttaaaggaatgtcttatagtatgtgtacaggaaaattcaaggtggtaaaagaaatcgcagaaacgcaacacgggacgatagtaattagagtacaatacgaaggagatggctctccgtgtaagattccgttcgaaatcatggatctggaaaaacgatacgttttaggccgtttaattaccgttaatccaattgctacagagaaggactcacccgtcaatatagaagcagagcccccttttggagattcttacattattattggcgtggaacccggtcaactgaaattgaattggtttaaaaagggatcgtcaattggacaaatgtttgaaacaacaatgagaggcgcaaaaagaatggcaatattaggcgatactgcctgggattttgggtcgttaggtggagtattcacaagtattggaaaagcgttacaccaagtatttggagcaatctatggagccgctttttccggtgtgagctggacaatgaaaattctgattggtgttattataacatggatcggaatgaacagtaggtcaacatccttatccgtatcactggtgcttgtaggaattgttacattgtacttgggagtcatggttcaagcagattcggggtgcgtagtgagttggaaaaataaagaactgaagtgtggatcaggaatatttatcactgataacgtgcatacatggactgaacaatataaatttcagccagagtcccccagtaaactagcatctgccattcagaaagcacaagaagaaggaatttgcggtattcgaagcgtaacaagattggaaaacctaatgtggaaacaaataacacccgaattaaatcacattctagctgagaatgaagtcaaattaactataatgacgggagatataaaaggtataatgcaagctggtaaacgtagtctccggccgcaaccgacagaattaaagtattcctggaaaacgtggggaaaagcgaaaatgctgagcacagaaagttacaaccaaacatttttaatagatgggccggaaacagctgaatgtcctaacaccaatagagcatggaacagcttggaagtcgaagactatggtttcggtgtatttacgaccaacatttggctaaaacttaaagaaaaacaagacgcattttgcgattcaaaattgatgtcagctgccattaaagataatagggcggtccacgcggatatgggttattggatagaatccgctttgaacgacacttggaaaatcgaaaaggcttcttttatagaagtcaaaaattgtcattggcccaagagtcacacattatggagtaacggggtattagaaagtgaaatgatcataccgaaaaatctagcaggacccgtttcacaacataattatcggccgggttaccatactcaaatcgcaggaccgtggcacttaggcaaacttgaaatggattttgacttctgcgacgggacaactgttatcgtcactgaagattgcgggaaccggggcccatcactaagaacaacgactgcatctggcaagctcataacggagtggtgctgccgatcatgtacactaccaccactccgataccgtggggaagacggatgttggtatggtatggagatcaggccgctaaaagaaaaggaagaaaacctggttaacagcctagttacagcgggacacggccaagtagataattttagcctaggcgtactaggtatggcgttgttcctcgaagaaatgttgcggaccagagttggcactaaacatgccattctattagtggcggtatcatttgtaactttaataacaggaaacatgagttttaaagatctcgggagagtcgtagtaatggtaggcgcaacaatggcagatgacattggtatgggggtcacttatctggcactactagctgcattcaaagtacgccctacctttgcagctggattattattacgaaaattaacatcaaaggaactgatgatgaccaccatagggattgtattactatctcagtcaacaatacctgaaactatcctagagttaacggatgctttggccttaggaatgatggttctaaaaatcgtgcgaaatatggaaaaatatcagcttgcagttaccataatggcgatattgtgcgttccaaatgctgtgatattgcaaaacgcttggaaagtatcctgtacaatcctagctgtagtttcggttagccccctacttctcacttcttctcaacagaaaactgactggatacccttagcactcactattaagggtttaaatcctactgctatttttctgacgactttaagtcgaaccaacaagaaacggtcatggcccctaaatgaagccataatggccgtgggaatggtaagcatactcgcaagctccttgctgaaaaatgacataccaatgaccgggccacttgttgctgggggattactaacagtatgctacgtattaacaggaagaagcgcagatctagaactcgaaagagccactgatgtcaaatgggaagatcaagctgaaatatcaggatcatctccaatacttagcattaccatctccgaggatggatcaatgtcaattaaaaacgaagaagaagaacaaactctaaccatcctcataaggacgggattattagtaatatcgggtctgttcccgataagcatacccattactgcagccgcatggtatttatgggaagttaagaaacaaagagcaggagttctatgggacgttccctcacccccacctatgggaaaggcagaactggaagacggagcatatcgtataaaacaaaagggcatattgggatattcccaaattggcgcgggtgtatacaaagaaggtacattccatactatgtggcatgttactagaggagcagtattgatgcataaaggaaaaagaattgaaccatcgtgggccgatgtcaagaaagatctaataagttatggcggaggctggaaattagaaggggagtggaaagaaggtgaggaagttcaagttttggcgctagaaccggggaagaatccgcgtgcggtacagacgaagccaggtctcttcaaaaccaacacgggtacaataggagcagtatctttagattttagccctggtacaagtggttcacccatcatagataagaaaggaaaagtagtgggactatacggtaatggcgtggtaacccgaagtggggcatatgtcagcgcaatagcacagaccgaaaaatcaattgaagacaatccagagatagaagatgatatatttcgtaaaagaagattaacgattatggacctacaccccggtgcgggaaaaacaaaaagatatctacccgcaattgtgagagaagctataaaaagaggcttacgaactctgatacttgcccccacacgggttgtagcagcagaaatggaagaagcattgcgtggtttacccattaggtaccagacaccagctataagagctgaacacaccggaagagagattgtggatttaatgtgtcacgctacttttacaatgcgcctactctcccctgtaagagtaccaaattacaaccttatagttatggatgaagctcacttcactgatcctgctagcatagctgcacgaggctatatatccacgcgggtcgaaatgggagaagcggcaggaatatttatgacagctaccccacctggtagccgagacccatttccgcaatccaatgccccaatcattgatgaagaacgagagataccggaacggagctggaactcgggtcacgaatgggtaaccgattttaaaggcaaaacggtttggtttgtaccttcaatcaaagcgggaaatgatatagcagcatgtcttcggaaaaatgggaagaaggtaatacagttgagtcgtaaaacttttgattcagagtacgtcaaaactagaactaacgattgggacttcgttgtgacaaccgacatatcggagatgggcgcaaattttaaagctgaaagagtgatagaccctaggaggtgcatgaaaccagttatactgactgacggagaagaaagagtaatattagcagggccaatgccagtgacccactctagtgcagcacagagacgtggccgcataggccggaatcccaaaaatgaaaatgatcagtacatttatatgggggaacctctagagaatgacgaagactgcgcacactggaaagaagccaaaatgctcttagataatatcaacacccctgaaggaataattccaagcatgttcgaaccggaacgcgaaaaagtagacgctatcgacggtgaatacaggttacgtggtgaagcacggaagacttttgtggaccttatgcgacgaggtgacctaccggtttggttagcatataaagttgcggctgagggaatcaactatgctgacagaagatggtgtttcgatgggatcaaaaataaccaaatccttgaagaaaatgtcgaagtggaaatttggactaaagaaggcgaacgtaagaaactgaaacccagatggctagacgccagaatttacagtgatccattagcgttaaaggagttcaaagagttcgcagcggggcgaaagtcactaacactgaacttaattactgaaatgggcaggctccccacgttcatgacacaaaagacgagagatgcattggataatctagccgtgttacatacggctgaagccggtggtcgagcctataatcatgctttaagtgagttacccgagacactcgaaacactattattactaactctacttgcaacagtaacagggggcatattcctatttctaatgagcggaaggggcatagggaaaatgacattaggcatgtgctgtattataacggcatcaatcttgctttggtacgctcaaatccaaccgcattggattgctgcatctataatcctggagttctttttgatcgtgttgcttatacccgagcccgagaagcagagaacaccacaagacaatcaactaacatatgtagtgatagcaattcttactgttgtcgcagccacgatggctaacgaaatgggtttcttagagaaaactaaaaaggatcttggattaggttcaatagcaacgcagcaaccagaatcaaatatattagatatagacttaaggccagcttccgcatggactttgtatgccgtcgcaaccacatttgtaacacctatgttaagacatagtatagagaacagcagtgtaaacatttcactaacagctattgcaaatcaggcgactgtattaatgggactaggaaaagggtggccattgtcgaaaatggatattggggtaccactcctcgcaattggctgttattcccaggtaaatcctatcactctgactgcagcactccttctgctcgttgctcactatgcaattataggtcctgggctacaagcgaaagctacgagagaagcacagaagagggcggcagcgggaataatgaaaaacccaactgtagacggtataactgtaattgatttagacccaattccatatgatccaaaattcgagaaacagttaggacaggtcatgctactaatactctgtgttactcaagtcctaatgatgagaaccacatgggcattatgtgaagcgttgacattagccacaggaccaatttcgacgttatgggaggggaatccaggaagattttggaacacaacgatagcagtttctatggctaacatcttccgcggatcttatctggcaggagctggtcttctcttctcgattatgaaaaacacaactaacacaagaagaggaactggcaacataggcgaaacattaggggaaaaatggaaatcccgtttaaatgcactaggtaaatctgaatttcaaatctataagaaatctggcattcaagaggtagaccggaccctcgctaaagagggaattaaaagaggagaaacggaccatcatgcagtaagccggggttccgcgaaattaaggtggtttgtagaaagaaacatggttactccagaaggcaaagtagttgaccttggatgcggccgaggtggttggagctattattgcgggggactgaaaaacgtccgtgaagtaaaaggtttaacaaaaggtggacccggacacgaagaaccaattcctatgtccacatatggttggaacttggtgcgactacaatccggagtggatgtatttttcattcctcctgaaaaatgcgacacgctattatgtgatattggagaatcctctccaaatccgacagtagaagcagggcgtacattacgcgtacttaatcttgtagaaaattggctaaataacaatacccaattctgtataaaagtactaaatccatatatgccgagcgtaatcgagaaaatggaagccctacaaagaaaatacggaggagcattagtaagaaacccacttagtagaaacagcacgcacgagatgtattgggtatcgaatgcctcgggaaatatcgtaagctcggtaaacatgatttcaagaatgcttattaacagatttaccatgaggcataagaaagctacttacgaacccgatgtagacttaggtagcggcacccggaatatcgggatagaaagcgaaatccctaatttggatatcatcggtaaaaggatagagaaaattaaacaagagcatgagacatcttggcattatgaccaagatcacccatataaaacatgggcgtatcacgggtcttacgagaccaaacaaacaggaagcgcatcaagtatggtaaatggagttgtcaggctgttgactaaaccgtgggatgttctaccgacggtaactcaaatggcaatgactgacacgacaccctttggacagcaacgagttttcaaagaaaaagtggatacaagaacccaagaacccaaagaaggaaccaagaaactcatgaaaataacagccgaatggctatggaaggaacttggtaaaaagaaaacaccaagaatgtgtacacgggaagagttcacacgaaaagtgcgcagtaacgcagccctaggagccatatttacagatgagaacaaatggaaaagtgcccgtgaagccgtagaagatagccgtttctgggagttagtagacaaagagagaaatctacatcttgaagggaaatgcgaaacatgtgtttacaatatgatgggaaagcgcgagaagaaattgggcgaatttggtaaagcaaaaggttcgcgagctatatggtatatgtggctaggggcacgattcttagagttcgaggctctcggttttctcaatgaagatcattggttctcgagggaaaacagcctaagtggtgtggaaggagaagggcttcataagctaggatacatactaagagacgttagcaagaaagaaggaggcgccatgtatgcagacgatacagctggttgggacacacgaataacactcgaagacttgaaaaatgaagaaatggtcactaatcatatggaaggagaacacaagaaactagcagaggctatatttaaacttacctaccaaaataaagtagtaagagtccaaaggcccacacctcgtggaactgtcatggacataatatcgaggagagatcaaagaggcagcgggcaggtagggacctacggtctcaacactttcaccaacatggaagcgcaattgatacggcaaatggaaggtgaaggagtattcaaaaacattcaacatttaactgtgaccgaagaggttgcagtacagaattggctcgcccgagtcggtagggagagattatctcgtatggccataagtggtgatgattgtgtggtaaaaccgctggatgacagattcgccaatgccctaacagcattaaacgatatggggaaaattcgaaaagatatacaacagtgggaaccctcaaaaggttggaacgattggacgcaagtaccattctgcagtcatcattttcatgaactaataatgaaggacggaagagttctagtagtaccctgcagaaatcaagatgagttgatcggaagggcaaggatatctcaaggcgcgggctggagtttacgggagactgcatgtctaggaaagtcatacgcgcaaatgtggagtctcatgtatttccatcggagggacctacgactagctgcaaacgcgatatgttcagcagttccaagtcactgggtcccaacaagcaggactacttggtcaatacacgcaaaacacgaatggatgacgactgaggatatgttgacagtatggaatagagtatggatacgagaaaacccatggatggaagacaaaacccccgtagaatcatgggaggagataccttacctgggaaagagggaagaccaatggtgtgggagtctcataggcttgacatctagagctacatgggcaaagaacatacaggcagcaataaaccaagtaagaagtctaatagggaacgaagaatatacagactacatgccttcaatgaaaagatttagaagagaagaagaagaagccggagtgctatggtga

SEQ ID NO: 22504 - RNA, 9876 nt, synthetic construct
  misc_feature 1..9876: note = derived and/or modified CDS sequence (opt6) from DENV-2__FJ687440__SS-prME
  source 1..9876: mol_type = other RNA
agcgctgggatgataataatgcttattccaactgtaatggcatttcatttaactacaagaaatggtgaacctcacatgatagttggtatacaagaaaaaggaaaatccttgcttttcaaaacagaagatggggttaatatgtgtacattgatggctatggatctcggagaattatgtgaagacacaattacgtacaaatgcccactattaagacaaaatgaaccagaagacattgactgttggtgtaatagcacatcgacctggattacctacggaacatgtacaacaacaggagaacatcgtcgagagaaaagatctgtagcattagtaccacacgttggaatgggactggaaactcgaaccgaaacttggatgtctagtgaaggagcatggaaacacgcacaacgaatagaaacatggatattacggcatccaggatttaccatcatggcggccatcctcgcgtatacaataggcactacgcatttccaacgcgccctgatcttcatacttcttacggccgtagccccgagtatgaccatgcgttgcatagggatcagcaatcgcgactttgtagaaggagtttcaggtggatcatgggttgacattgtactagaacatggatcctgcgtgacgaccatggcgaaaaacaaaccgaccttagactttgaacttataaaaaccgaagcaaaacaacccgctacgctgagaaaatattgtatagaagcaaaattaaccaatacaaccactgaaagtagatgcccaacccagggagaaccctcccttaaagaagaacaggacaaaagatttgtttgtaaacacagtatggtggaccgtggatggggaaacggatgtggattgttcggtaaaggaggaatcgtcacttgcgcaatgttcacatgcaagaaaaatatggagggcaaaatagtgcagccggaaaatctagagtacactatagtggttacacctcactccggtgaggaacatgcagtcggaaatgatacgggtaaacatggaaaagagataaaagtaaccccacaatcgagcattacagaggcagaacttacagggtacggaacagttactatggaatgttcccctagaaccggattggacttcaatgaaatggtcttacttcagatggaaaacaaagcatggttggtacacaggcaatggttcctagacctgcctctaccatggttaccaggagcagacaaacaaggtagcaattggattcagaaagaaactttagtaacatttaaaaatccccatgccaagaaacaagatgtggtagtattaggatctcaagaaggagcaatgcatacagccctgacaggagctacagaaatccaaatgtcaagtgggaatctcttgttcactggccacttaaaatgtcggcttcgcatggacaaattgcagctgaaaggcatgagctatagtatgtgcacaggtaaatttaaagtagttaaagaaatagccgaaacacaacatggcactattgtaatacgtgtacagtacgaaggagatggatctccttgcaaaataccttttgaaataatggatttagagaaaagatacgtattagggcgtctgataacggtcaacccaatagtaacagaaaaagattcacccgttaatatagaggctgaacctccgttcggagactcatacataataatcggcgttgaacctggacaacttaaattgaattggtttaagaaaggatctagtatcggccaaatgtttgaaaccacaatgcgaggtgcaaaaagaatggcaatattaggtgacactgcttgggactttggtagcctgggcggagtatttacttctataggtaaagccctgcatcaagtatttggagcaatatacggagccgcattttcgggggtgagttggactatgaagatacttataggagttattattacatggatcggtatgaactcacggagtacttcattgtcagtcagcttagtcctcgtgggtatcgttactctttatctaggagtaatggtgcaagccgattcaggttgtgttgtaagttggaagaacaaggaactaaaatgtggaagcggtatcttcataacagacaacgtacacacttggacagagcagtataaattccaaccggaatctccctctaaattagcatcagcaatacagaaagctcaggaggagggtatatgtggcattcgatcagtcacaaggttagaaaatcttatgtggaaacaaataacccctgagctaaaccatatactagctgaaaacgaagtaaaactaacaataatgacaggggacataaaagggataatgcaagcgggcaagagatccctgcgcccacagccaaccgaacttaaatacagctggaaaacatggggaaaagctaaaatgttatcgactgaatcccacaaccaaaccttcttaatagacggacctgagacagctgaatgccccaatacgaatagagcatggaactccttagaagtcgaagattacggttttggagtctttacaactaatatctggttgaaattaaaagaaaagcaagatgcgttttgtgactcgaaacttatgtccgctgccataaaagacaatagagctgtccatgccgacatggggtattggatagaatctgctctaaatgacacatggaaaatagaaaaagcgtcgtttattgaagtcaaaaattgccattggccaaaatcgcatacattatggtcgaatggtgttcttgagtcagaaatgattatacccaaaaacttagcaggacccgtatcacaacacaattaccgtcctggctaccatacgcagatagcaggcccttggcacctagggaaactagagatggatttcgacttttgtgatggtactactgtcatagtcacagaggattgtggcaaccgaggcccgagtctaagaaccacgaccgcaagcggaaaattgattacggaatggtgttgccgaagctgcactctaccccctcttaggtatagaggggaagacggttgttggtacggaatggaaatacgaccactcaaagagaaagaagagaaccttgtaaacagtctagtaacagctggtcatggtcaggtcgataatttttcgttgggagtactgggaatggcattgttcttggaggaaatgttgcgcacacgcgtagggactaagcacgcgattctattagtcgccgtatcatttgttactttgattaccggaaacatgagttttaaggatttaggaagagtagtagtaatggtaggtgctactatgacagatgatataggtatgggagttacatatttggccttattggctgcgttcaaagtaagacctacatttgcagccggattgttactacgaaaactgacaagtaaagaattaatgatgacgactattggtattgtattgttgagccaatccacaattccagaaacaatattagaattaaccgatgcactagcacttggcatgatggtactaaagatagtgagaaatatggaaaaatatcaactagcagtaacaattatggctatactatgtgtgccgaatgcagtgatactccaaaacgcctggaaagtctcgtgtactatactcgcggtagttagcgttagtcccctactactcacttctagtcaacagaaaactgactggataccactcgccctaactattaaaggtctaaatccgacggcaatcttcttaaccacactatcacgaacaaacaagaaaagatcatggcccttaaatgaggcaattatggctgttggtatggtgtcaattcttgcatcatctcttttaaagaatgacataccaatgaccggtccgctagtagcaggcggactactcacagtatgttacgttcttaccggcagatctgcggacttagagctagaaagggcaacagacgtcaaatgggaagaccaagcagaaatatcaggctcatcgccaatattaagtatcacaatatcggaagatggatctatgtcaatcaaaaatgaggaagaagaacaaacattaacaattctaatacggactggtctactcgtcatatcaggactttttcccgttagtattccaattacagctgccgcatggtacttatgggaagtaaagaaacaaagagcaggggttttatgggacgtaccaagccctccccctatgggcaaagcggaactagaagacggcgcttacagaataaaacagaaaggaatactcggatattcccagataggggctggagtttataaagaagggacgtttcacactatgtggcacgtaacaagaggagcagtcctgatgcataaaggtaaaagaatagaaccgtcatgggctgacgtcaagaaggatcttatttcttatggaggcggctggaaactagaaggagagtggaaagaaggagaagaggttcaggtgctagcactagaaccaggtaaaaatcctcgagcggtacagactaaacctggtttatttaaaacaaataccggaactattggagcggtttcactagattttagtcccggaacatctgggagccctatcatagacaagaaaggtaaggttgtaggactgtacggtaacggagtagtaactcgttctggggcttatgtctctgcgatagcacaaaccgaaaagtcaatagaagataatccagagattgaagatgatatattcagaaaacgacgtctaacgataatggacttacacccaggagctggcaaaacaaaacgatacttacctgcgattgtgagagaagcaataaaacggggtttacggacactaattcttgcacccacgcgggttgtcgcagctgagatggaggaagcgttaaggggactgccaattcgctatcaaacacccgcaattcgtgcagagcatacggggagagagatagtcgaccttatgtgccacgcaacatttacaatgagattactgtccccagtaagagtaccaaactataatcttataataatggacgaagctcactttactgatcctgcaagtattgcggcccgcggctatatatctacaagagtagaaatgggcgaggccgcaggtattttcatgacagcaacgcctcctggctcacgagaccctttccctcaaagtaatgccccaataattgatgaggaaagagaaattcccgaacggagttggaactccggacatgaatgggtcacagacttcactggtaaaaccgtctggttcgtacctagcataaaggctggtaacgacattgctgcatgcttaaggaaaaatggcaagaaagtcatacaattatcaaggaagacttttgactcggaatatgttaaaacaaggacaaatgactgggattttgtggtaaccactgacatctcagaaatgggtgccaactttaaagcagagagagtgattgatccacgtagatgtatgaagccggtcatattaacagacggagaggagcgagtgatattagcgggacccatgccagtcacgcattcaagtgcagcccagagacgaggaagaatcggtcgaaatccaaagaatgaaaatgatcagtacatctatatgggtgagcctctcgaaaatgacgaagactgtgcgcattggaaagaagcaaaaatgcttctggataacataaatacaccagaaggaatcatacctagcatgttcgaacccgaaagggaaaaagtggacgcaatcgacggcgaataccgactgcgtggagaagcgcgaaaaacatttgtagatctcatgaggcgcggagatttacctgtttggttagcatacaaagtggcagcagagggaataaactatgcagataggagatggtgctttgacggaatcaaaaataaccaaatattggaagaaaacgttgaagttgagatctggacaaaggaaggagagaggaaaaagttaaaaccaagatggttggatgcaagaatatactcagatccactagcattaaaagaatttaaggaatttgctgcggggagaaaatcgctgacattgaacttaataacggaaatgggtagattgccaacttttatgacacagaaaacgcgagacgctctcgacaatctagcagtgctacacacggctgaggcgggaggtcgcgcttataatcatgctttgtcagaactaccggaaacactggagaccttattattactcacactcctcgcgactgtgaccggaggtatatttcttttcttaatgtcggggaggggtataggtaaaatgactttagggatgtgttgtataattactgcgtcgatactactttggtacgcacaaatacagccacattggatcgcggccagtattatattagagttctttctaatagtgctccttatacctgaacccgaaaagcagaggacaccacaagataatcagctcacgtacgtagtcattgcaatattaaccgtagtcgctgctacaatggctaacgaaatgggattcttagagaaaacgaagaaagatttaggcctcgggagtatagctactcagcaaccagaatctaatattctagacatagaccttcgtccggccagtgcctggaccctatatgctgttgcaacaacattcgtgacgcctatgcttcggcatagcattgaaaacagtagtgttaacgtttcactaacggcaatcgcaaatcaagccacagttctaatggggttgggaaagggatggcccttatccaaaatggatataggtgttccgttacttgccataggatgttactcgcaagtaaatcccataaccctgaccgctgcgttactcttattagtggcgcattatgcaataatagggccgggacttcaggcaaaagcgacacgcgaagcacagaaaagagcagcagccggcattatgaaaaatcctacagtggatggcattacagtgatagatctcgacccaataccatacgacccgaaattcgagaaacagttaggtcaagtaatgttgctgatcttgtgtgtaacacaagttctgatgatgagaaccacgtgggccttatgtgaggctttgactttggccaccggtccaataagcaccttatgggaaggtaaccctggaaggttctggaacacaactatagcagtctcaatggcaaatatatttagaggatcatacttggcaggggccggcttattattctcaataatgaagaacacaacgaatacgagaaggggaactggaaacattggagaaactctcggggaaaaatggaagtccaggcttaacgctctcggaaaaagcgaatttcaaatatacaagaaatctggtattcaggaagtcgatagaactttagcgaaagaaggcataaagagaggagagactgatcatcatgcagtatctcgaggttctgcgaagttgagatggtttgtagaaaggaacatggttacacctgagggaaaagtagtcgatctcggatgtgggaggggtggatggagttattattgcggtggattgaaaaatgtaagagaagtcaaaggcctaacaaaaggaggtccagggcatgaagaaccaatacccatgtctacatacggctggaacctcgtaagattgcaaagtggagtggatgtctttttcataccacctgaaaaatgtgatacacttttatgtgatataggagaaagtagcccaaatccgacagtagaagccggaaggacgctacgagttttaaatctcgttgagaattggctaaataataacacacaattttgcataaaggtcctaaatccttatatgccatcggtaatagagaaaatggaagcattgcagagaaagtatggtggtgccctagtaagaaatccattgtcccgaaacagcacacatgagatgtattgggtctcgaatgcgtccgggaatatagtatcaagtgtaaacatgataagcagaatgttaattaacaggttcaccatgagacacaagaaagcgacatacgaacctgatgttgatttaggctcaggcacccgaaatataggtatagaaagtgaaataccaaatttagatataattggaaagagaatcgagaaaataaagcaagaacacgaaacaagttggcattatgatcaagaccacccatataaaacatgggcttaccacgggagttacgagacgaaacaaacaggatcagcttcttcaatggtaaacggagtcgtcagactgttaaccaaaccctgggacgtactcccgacagttacacagatggccatgactgacacgacaccattcggacaacaaagagtttttaaagagaaagtagacacaagaacgcaagaacccaaagaggggaccaagaaattaatgaaaataacggcagaatggctctggaaagaacttggaaagaagaaaaccccgagaatgtgtacgagggaggaatttactagaaaagtacggagtaacgcagcactgggagccatattcactgatgaaaacaaatggaaatcagctcgtgaagccgtagaagacagtagattctgggagctagtagacaaagaacgaaatctgcatctagagggcaaatgtgaaacttgtgtgtataatatgatgggtaaacgagagaagaaattaggagagtttgggaaagcaaaaggcagccgcgcaatatggtatatgtggctgggggcccgcttccttgaatttgaagcgcttggatttctaaacgaagaccactggttcagtagagaaaactcactcagtggggttgaaggagaaggactccataaattgggatacatcttaagggacgttagcaagaaagaaggcggagcaatgtatgcagacgacaccgcgggatgggacacccgaataacacttgaagacctaaagaacgaagagatggtaacaaatcacatggaaggagaacacaagaaactcgcagaagccatatttaagttaacttaccaaaataaggtagtgcgcgttcagagacctactccacgaggaactgttatggatatcatttctcgtagagaccaacgtggctcaggccaggtaggtacatacggattaaatacatttacaaatatggaggctcaattaataaggcaaatggagggtgaaggggtctttaagaatattcaacaccttacagctactgaagaaattgcagtacaaaattggctggctagagtggggagggaaagattatcacgtatggccataagcggggatgattgcgtcgttaaacctctggatgaccgttttgccaatgcgctaacagcactaaacgatatgggaaaaatcagaaaagacatacaacagtgggagccatccaaaggctggaacgattggacacaagtaccattttgttctcaccatttccacgagcttataatgaaagatgggcgggtcctagtagtaccatgccgaaatcaggacgaattaataggaagggccaggatcagtcaaggtgcaggatggtcgctaagagaaaccgcatgcctaggtaaaagttacgcacagatgtggagtttaatgtattttcatcgtagggatcttcgacttgccgctaatgctatatgttctgcggtgccaagccactgggtaccaacctccagaacgacatggtcaattcacgccaagcatgaatggatgacaacagaagatatgctaacggtatggaacagagtttggatacgagagaatccctggatggaagataaaactccagttgaaagttgggaagaaatcccctaccttggcaagcgagaagaccaatggtgtggatcactcatcgggttgacaagtagagcaacatgggccaaaaatattcaagcagcaataaatcaggtgcgatcattgataggaaacgaagaatatacagattacatgccatcaatgaaacgttttaggagagaagaagaagaggccggtgtgttatggtaa

SEQ ID NO: 22505 - RNA, 9876 nt, synthetic construct
  misc_feature 1..9876: note = derived and/or modified CDS sequence (opt6) from DENV-2__FJ687441__SS-prME
  source 1..9876: mol_type = other RNA
tctgcaggtatgataattatgctgattccaaccgtaatggcatttcacttaactactcgtaatggggaaccacatatgattgttggtatacaggaaaaaggtaaatcccttttattcaaaactgaagacggtgttaacatgtgcacacttatggcaatggatttgggagaattatgcgaagacactataacatacaaatgccccctgctcagacaaaacgaaccggaagatatcgattgttggtgtaactcgacatcaacatggataacatacggaacttgcactaccacaggagaacataggagagagaaaagatctgtagcccttgtaccacatgtaggaatgggactagaaacaagaacagaaacatggatgtcaagtgaaggagcgtggaaacacgcacaacgtattgaaacatggattctcagacatcctggtttcacgataatggccgctattctggcctataccataggaacaacacactttcaacgcgctctaatatttattctactgaccgcggtagcgccatcaatgacaatgagatgcattggtataagtaatcgagactttgtagaaggagtaagtggcgggtcgtgggtagacatcgtgttagaacatggatcctgcgtaacaacaatggccaaaaataaaccaaccttagattttgaattaataaaaacggaagcaaaacaaccagcaacattaagaaaatattgtatagaagctaaacttaccaacaccacaactgaaagccgttgtccaacccaaggggaacctagtctcaaagaagaacaagataaacgtttcgtatgtaaacattcaatggtagatcggggatggggaaatggatgtggactgttcggaaaaggaggcatagttacctgcgccatgttcacatgcaagaaaaacatggaaggcaaaatagttcagcccgagaacttagagtatacaatcgttgttaccccacactcaggagaagaacatgcggtaggaaatgatacaggtaaacacggtaaagagataaaagtcacaccacagtcttcaatcacagaagctgagctcaccggttacggcactgttacaatggaatgctcaccgcgcactgggcttgatttcaatgagatggtactactccaaatggaaaataaagcatggcttgtccatagacaatggtttttagatttaccgcttccttggctgccaggtgcagacaaacagggaagcaactggattcaaaaagaaaccttggtgaccttcaaaaatccccatgctaagaaacaagatgtcgttgttttaggatctcaggaaggtgccatgcacacagccctaacgggcgctacagagattcaaatgtcgtcaggtaatctcctattcactggacacctaaaatgccgattgagaatggataaacttcaattgaaaggcatgagctattctatgtgtactgggaaatttaaagtagtcaaagaaattgctgaaacacaacacggaaccatagtgataagagtacagtatgagggggacggatcaccgtgtaaaatcccatttgaaattatggacctggagaaaagatatgtactcggccgactaataaccgtaaatccaatagtaaccgaaaaagactctccagttaatatagaggcagaacctccattcggagacagttatatcatcataggcgttgaacccggccaattaaaactgaattggttcaagaaaggttcatccatcggacaaatgttcgagacaactatgagaggtgcaaaaagaatggcgatcctgggggataccgcatgggattttgggtccctgggaggagtttttacttcgattggtaaagcgttacatcaggtctttggagccatatatggagcagcatttagcggtgtcagctggacgatgaaaattcttataggtgtcatcatcacatggataggaatgaatagtcgctctacatcgttaagtgtttctctagtattagttggtattgttactttatatcttggcgtaatggttcaagctgacagtggatgcgtagtatcatggaaaaacaaggaattgaaatgtggtagtggaatttttattactgacaatgtccatacatggactgaacagtacaagttccagccggaatcaccatctaaattagcgagtgccatacaaaaagcgcaggaagaggggatttgtggcattcgttccgtcacacgcttagaaaatttgatgtggaagcaaataacaccagaattaaaccacatactagcagaaaatgaagttaaacttactatcatgaccggggacatcaaaggtatcatgcaagctggcaaaagatcattgagaccacaacccacggaactaaaatattcgtggaaaacttggggaaaagcaaaaatgctatcaacggagtcccataaccagactttccttatagacggcccggagacagcagaatgccctaacaccaatagagcgtggaacagtcttgaggtggaagattatgggtttggagtattcacaacgaacatatggctaaagttgaaggagaaacaagacgctttttgcgattcaaaactcatgtcagcagcaattaaggacaatagagccgtacatgcagatatgggctattggattgaaagtgcgctcaatgatacttggaaaatcgaaaaggcttcttttattgaagtcaagaattgtcattggcctaagtcacacacactctggagcaacggggttctcgaatccgaaatgataatacccaaaaatctcgctggaccagtatctcaacataactatagacctggataccatactcaaatagccggaccctggcatctaggaaaattagaaatggattttgatttttgcgacggaacaacagttatagtaacagaggattgcggtaatcgtggtccaagtctaagaaccactacagcttcaggaaagctcataacagaatggtgttgtcgatcttgtacgttacctcctctccgatacagaggggaagatggttgctggtatggtatggaaatacggccgttaaaagagaaagaagagaatttagtaaacagcctagtgaccgccggccatggacaagtcgataactttagtttaggggttctgggcatggctcttttcctagaagagatgctaagaacaagagtaggcacaaaacatgcgatcctattagtagcagtaagtttcgtgacgctaataacaggcaacatgagtttcaaagatttaggtcgggtagtcgttatggtaggggctaccatgacagatgacattgggatgggagtgacgtatctcgcactattagcagcttttaaagtcaggccaacgtttgccgcagggctattgttgagaaaattaacctcaaaagaattaatgatgacaaccatcggaatcgtattattgtcacaaagcaccatacctgagactatattagaactaacagatgccttggctctagggatgatggtgttaaaaatagttcgtaatatggaaaaataccagttagctgtgaccattatggcaattctatgtgttcctaatgcggtaattctacaaaacgcatggaaggtttcttgcacaatccttgctgtagttagtgtttcgccattactcttgacaagcagccaacagaaaactgattggattccattggctttaactatcaaagggctaaacccaacagcaatatttttgacaactctaagccggacaaataagaaacgatcttggccactaaatgaggcaattatggctgtgggtatggtaagtatattggcgagtagccttcttaagaatgatatacccatgacaggtccgttggttgccggcggactactgacagtatgttatgtacttactggaaggtcagcagatctagaattggaacgggcaacagatgtaaaatgggaagatcaagcagagataagtggaagttcacctatattaagcatcacgatatcggaagacggttcgatgagcataaagaatgaggaagaagaacaaaccctgacgatcttaatcagaacaggactattagtaatctctggactatttccagtgtcaattcctattacagcagcagcgtggtatctctgggaagtcaagaaacaaagagcgggagtgctctgggatgtaccaagcccgccaccaatgggaaaagcagagctagaagatggagcctacaggatcaaacagaaggggattcttggatactcacaaataggagccggagtctataaagaggggacttttcatacaatgtggcacgtaacaagaggcgccgttttaatgcataaaggcaaaagaatagagccaagctgggcagacgtaaagaaagatctgatctcatatggaggtgggtggaaattagagggagagtggaaagaaggcgaagaggtacaagtattagctcttgaaccgggtaaaaacccccgggccgtacaaactaaaccgggactatttaaaaccaacaccggaacgataggagctgtgagtttagacttttctcctggcacttctggatcgcctataatagataagaaagggaaagtagtgggcttatatggaaacggtgtcgttaccaggtctggagcatatgtatcagccattgcacaaactgagaaaagtatagaagataatcccgagatagaagatgatatatttagaaaacgaaggctaacaataatggatctacatccaggagctgggaaaaccaagagatacttaccagcaatcgtcagagaggcgataaaacgaggattacgaacgctaatactagcaccaacaagagttgtggcagcagaaatggaagaagccttgagaggactaccgataagataccaaacaccggctataagggccgaacacacgggaagagaaattgtagatctgatgtgtcacgcaacctttacaatgcgcttattatctcctgtgagggtcccaaattacaatctaataattatggacgaagctcacttcacagacccggccagtatagcggccagaggttatataagcacgagagtagaaatgggtgaagcggcagggatttttatgactgccacacccccaggaagtcgggaccctttcccacaatccaatgctcctattatagacgaagaacgagagatacctgagagatcctggaacagtgggcatgagtgggtgaccgatttcaagggtaagaccgtatggtttgtaccatcaatcaaagcgggcaatgacatcgcggcttgtctacgaaagaatggcaagaaagtcatacaactgtctagaaagacattcgattcagaatacgtaaagacacgaacaaatgactgggattttgttgtaacaacagacatttctgaaatgggcgcaaattttaaagccgaacgcgtgatagatcctaggcgctgtatgaaaccagttatactaacagacggagaagaaagagtaatactagcaggtcccatgcctgtaacgcatagttctgccgcccaaaggcgaggccgtattggaagaaaccccaaaaatgaaaatgaccaatatatatacatgggggaaccgctagagaatgatgaagattgtgctcattggaaggaggccaaaatgcttctagataatataaataccccagaaggtattatccccagcatgttcgagccagaacgagagaaggtggatgcaattgacggagaatatagattacgaggcgaagcacgaaaaacatttgtggacttaatgagaagaggggatttaccggtctggctagcgtataaagtcgcggcagaaggtatcaactacgcagatcgtaggtggtgctttgacgggatcaaaaataaccaaatattagaggaaaacgtggaagtcgagatttggacaaaggaaggagagaggaagaaactaaaaccaagatggcttgatgctcgtatttatagcgacccattagccctaaaagaatttaaggagtttgcggcgggaaggaaatcattaaccctcaatcttattacagagatgggtagactcccgacatttatgactcagaaaaccagagatgccttagataacttagccgtcttacacacagctgaagcgggcggcagggcatataatcatgcacttagtgaattgcctgagacacttgaaactctattattattaacgctgttagccacggtcaccggtggaatatttctctttctaatgagtgggagaggaatagggaaaatgacacttggaatgtgctgtattataacggcttctatattactctggtacgcccaaatacaaccacattggatcgctgcatcaattatactagagttctttctaattgttttacttattcctgaaccagaaaagcaaagaaccccacaagacaatcaattgacctacgtcgtaatcgccattcttacagtcgtagcagcaacgatggctaatgaaatgggtttcctcgagaaaacaaagaaagatttgggactaggtagtattgctacacaacagcctgaaagcaatattcttgatattgatttgcgacccgcaagtgcatggacactatacgcggttgcaacaacctttgtcactccgatgctacgacatagtatagagaatagctctgttaatgttagcctgaccgccatcgccaaccaagcaaccgtgctaatgggtttaggcaaaggctggccattatcaaaaatggatataggcgtgccactactagccatcggatgttattcacaagtgaacccaatcaccctaacagctgctctactactgctagtcgctcactatgctataataggacctggtttacaagccaaagcaacgagagaagcccaaaagcgcgcagctgctggtattatgaaaaacccaactgtagacggaataacagtaattgacctagatccaatcccttatgatccaaagtttgaaaagcagctaggacaagtaatgcttctgattctatgcgttacacaagtattgatgatgagaacaacatgggcactatgtgaggcccttaccttagctaccgggccgatatcaacactttgggagggaaaccctggccggttctggaatacaaccatcgcggttagtatggcgaacatctttcgggggtcttacttggctggcgcggggctactattttccataatgaagaatactacaaacacgaggcgtggaaccggaaacataggagagacgctgggggaaaaatggaagtcaaggttaaatgcacttggtaaatccgaatttcaaatttacaagaaatctgggattcaagaagtagacagaaccttagcaaaagaaggcataaaacgaggcgaaacagaccatcacgcagtaagccgtggatcggcaaaattaaggtggttcgtagaaaggaatatggtaacaccagaaggcaaagtagttgacctaggttgtggtcgaggaggatggagttactattgcggcggtctaaagaatgtaagagaagttaaaggtctcacaaaaggtggaccaggtcatgaagaacctatcccgatgagcacctatggatggaatctggttagattacagagtggagtcgatgttttctttataccaccagaaaaatgcgataccttactttgcgatatcggggaaagctctcccaaccctaccgtcgaagcaggtaggaccttacgagttcttaacttagtggaaaactggttaaacaacaacacacagttttgcataaaagtccttaatccatacatgccgtctgtaattgaaaagatggaggctttacaacgcaaatacggaggagcattagtacgaaaccctttgagcaggaactctacccatgagatgtattgggtatcaaacgcaagtgggaatatagtcagtagtgtgaatatgatctcacggatgctaattaataggtttactatgagacataagaaagctacatacgaacctgacgtcgacttaggctcaggaacgcgaaatatagggatagaatccgagatccctaatttagacataattggaaaacggatagagaaaattaaacaagaacacgaaacctcatggcactacgaccaggaccatccctataaaacatgggcgtatcatgggtcctatgagacaaagcaaacaggttcggcatcaagcatggtaaacggcgtagtacgcttacttacgaaaccctgggacgtcttaccaacggtgacgcagatggctatgaccgatacaacaccgttcggacaacagcgggtattcaaagagaaagttgacacaaggacacaggagcccaaagaaggaacgaagaaactcatgaaaatcacagctgaatggttatggaaagagctaggcaaaaagaaaactccaagaatgtgtacgagggaagagtttactcgaaaagtacgaagtaatgcggcactcggggctatattcacggacgaaaacaaatggaaatctgccagagaagcagtggaggactcaagattctgggagcttgttgataaagagagaaacttacacctggagggtaagtgcgaaacctgcgtgtataatatgatgggaaaacgagaaaagaaattaggggaatttggcaaagcaaaaggcagtagggcaatctggtatatgtggttaggcgctcgatttttagagttcgaggctttaggatttttaaatgaagatcattggttttcacgggaaaattcgttaagcggagtagaaggagagggtttacacaaattaggctacatcttacgtgacgtaagcaagaaagaaggcggggcgatgtatgctgacgatactgcaggttgggatacaaggatcacattggaagatttgaaaaacgaagagatggtaacgaaccatatggaaggagaacacaagaaattagcagaggctattttcaaactaacctatcaaaataaggtggtacgagtacagcgtccaacgccaagaggaacagttatggacataatatcacgcagagatcagcgcggaagtggacaggtagggacctatggcctaaacacttttactaatatggaagctcagctcataagacaaatggagggggaaggggtatttaagaacatacaacatctaacggccaccgaagagatagctgttcagaactggcttgcacgagtcggacgggagaggctttcaagaatggcaatctcaggtgacgattgcgtcgtaaaacccctcgatgatcgttttgcgaacgcattaactgctcttaatgatatgggtaaaatcagaaaagacattcaacaatgggaaccatcaaagggatggaatgactggacccaagtcccgttttgttcacatcattttcatgagctaataatgaaagatggccgagtgctagtagtcccatgcaggaaccaagacgaattgataggacgagctagaattagccagggcgccggttggtccctgcgtgagacagcatgtttaggcaaatcatatgctcaaatgtggtcactgatgtattttcaccgacgcgacttaagactagccgccaatgcaatctgctcagcagttccctctcactgggtacctaccagtagaactacttggtcaattcacgccaaacacgaatggatgactacagaggacatgttgacagtatggaacagagtttggattcgggaaaatccctggatggaggataagacgccggtcgaatcatgggaggaaattccatacctaggaaaacgagaagatcaatggtgtggaagtttaattggactcacaagtagggcaacgtgggccaaaaatatacaagcagcgattaaccaagtgcgctcgcttatcggcaacgaggaatacacagattacatgccctctatgaaaaggtttagaagagaagaagaagaggctggagttttatggtaa

SEQ ID NO: 22506 - RNA, 9876 nt, synthetic construct
  misc_feature 1..9876: note = derived and/or modified CDS sequence (opt6) from DENV-2__FJ687445__SS-prME
  source 1..9876: mol_type = other RNA
agtgttggaatgattataatgctaattccgacagtcatggcttttcatttaaccacccgaaacggagagccacacatgattgtgagcatccaagagaaagggaaaagtcttttgttcaaaacggaggatggagtgaatatgtgcacattgatggccatggacttaggtgaactatgcgaagacactatcacttacaaatgtccactcttgagacagaacgagccagaggacatagattgctggtgcaattccactagcacctgggttacctatggtacatgcaccacaactggagagcaccgtcgagagaaaaggagtgtagcattggtccctcacgttggaatgggtctagaaacaaggactgaaacatggatgagcagcgaaggcgcttggaaacacgcccaaagaatagagacatggatactgagacatcctggctttaccatcatggcagccatcttggcttacacaataggcactacacactttcaacgtactctaatatttattttactgacggcggtagcaccaagtatgacaatgcgatgtataggtatctcaaatagagacttcgtagagggcgtctcgggcggaagctgggtagatatcgtgttagaacacggcagctgtgtaactacaatggcaaagaataaacctactctcgactttgaactaataaaaactgaagctaaacaaccagcgactctaagaaagtactgtatagaagctaaactcacaaatacgactacagaatcacgatgcccgacacaaggagaacccagtctaaaggaagagcaggacaaaagattcgtatgtaaacatagtatggtcgatagaggatggggcaatggttgcggtttgttcggaaaaggtggaatcgtcacttgtgcaatgtttacatgcaaaaagaatatggaaggtaaaatagtccagccagaaaacttggaatataccattgttgtgacaccacacagcggtgaggaacatgccgtcggaaacgacacgggtaaacacgggaaagaaataaaggtgacacctcaaagctcgataactgaagcggagctaactggatacggtacggtgacaatggaatgttcgcctaggactggtttggatttcaatgaaatggtattgttacagatggaaaataaggcctggttagttcatagacaatggttcttagatcttcctctgccttggctaccaggagcagatactcaagggtccaattggattcagaaggaaactctagtaactttcaaaaaccctcatgctaaaaagcaagatgtagttgtgttgggaagtcaagaaggcgcaatgcacacagcgttaaccggagccactgaaatccaaatgtcatcaggtaatcttttatttactggccacctcaaatgtagattaagaatggataaacttcaattaaaaggaatgtcatacagtatgtgtacagggaaatttaaagtagtaaaagaaatagcggaaacacaacacggaacaatagtaataagggttcaatacgaaggggatgggtctccatgcaaaatacctttcgaaataatggatcttgagaaaagatatgtacttggtagactaattacagtcaacccaatagtgaccgaaaaggatagcccagtgaatatcgaagcagagccccctttcggagattcatatataatcataggggtagaaccaggccagctcaagttaaactggtttaaaaagggctcttctatagggcaaatgtttgagacaacgatgagaggagccaaacgaatggcaatattaggagacacagcttgggacttcggatcattaggaggagtattcacaagtataggaaaagcactgcatcaagtatttggagctatatatggagctgcatttagcggagttagctggacaatgaagatattgattggtgtcattataacatggataggtatgaattcccggtccacgagtctaagtgtaagtctggtattagttggggttgtcactctttatctaggagttatggtccaagcagattcgggttgtgtggtatcatggaaaaacaaagaactaaaatgcggaagtggtatttttatcacagataacgtccacacatggacagaacaatacaaatttcaaccagaaagcccatcaaagttagcttcagcaatacaaaaggcacaagaagagggaatttgtggtatacgtagcgtaacccggttagaaaacttaatgtggaagcaaatcaccccagagttgaaccatattctagctgagaatgaagtaaagttaacgatcatgacgggcgacataaaaggaatcatgcaagcaggtaagagaagcctcaggccgcaaccaactgagttaaagtatagttggaaaacctggggtaaggcgaaaatgttatcaacggaatcccacaaccaaacattcttgattgatggaccggaaacagcggagtgtccaaatactaatagggcttggaactccctcgaagtggaagactacgggttcggtgtatttacaacaaacatatggcttaaactcaaagagaagcaagatgcgttttgcgacagcaagttaatgagtgcagctatcaaagataaccgggcggtgcacgccgatatgggctactggatcgagtcagcgttgaacgacacttggaaaatagagaaagcgagctttatcgaagttaaaaattgccattggccaaaatctcacacactgtggagcaatggagtgctagagagtgaaatgatcattccaaaaaacttagcaggtccagtatcacagcataattatagaccaggatatcatacacaaatagctgggccttggcatttgggaaaattagaaatggatttcgacttttgcgacgggactacagtcgtagtcacagaagactgcggtaaccgcggcccaagtctaaggactacaacagcatcgggtaagttaattacagagtggtgttgtagaagttgtactctgccaccactcaggtatcggggtgaagacggatgctggtatggaatggaaatcagaccactcaaagaaaaagaagagaatctagtaaattcattagtcacagcagggcatggacaagtcgataacttctctttaggtgttttaggtatggcattatttttagaagaaatgctgagaacacgcgtaggtactaagcatgccatattattggtagctgtttcatttgttaccctaataactggaaatatgtcttttaaggacctgggtcgtgtcgtagtaatggttggggccacaatgactgatgacataggaatgggcgtgacttatttagccttactagcagctttcaaagtgcgccctacattcgctgcaggcttgttcctaagaaaattaacttctaaagaactaatgatgacaactataggaattgtattgttaagtcaaagtacgattccagaaacgattctagaattaacggatgcgctcgcactaggaatgatggttcttaaaatggtcagagacatggagaaataccagttggctgtaactatcatggcaattttatgcgtacccaatgctgtcatcttgcaaaatgcatggaaggtctcatgtacaatactagccgtagtgtctgttagccctctcctgttaacgagcagtcaacaaaaaacggactggatccctctagcgctcacaattaaaggactaaacccaactgcgatatttctcacaaccttatcaagaactaacaaaaaaaggagttggcccttaaacgaagcaataatggcagtaggaatggtctccattttggcaagttctctcttaaaaaatgatatacctatgaccggccctttagtggcagggggtctcctgaccgtatgttatgtgttaacaggaaggtcagcagatctagaacttgaaagggccacagacgtaaaatgggaagaccaggccgaaattagtgggtcgagcccaatattgagcataactatatcagaagatggttcaatgtcgataaagaatgaagaagaagaacaaacattaaccatactaatacgcacgggtcttctagtaatctcaggactatttcctgtgagtatacccataacagcagcagcctggtacttatgggaggtaaaaaaacagcgagctggagtgctctgggacgtccccagtcccccgccaatgggcaaagcagaactggaagacggcgcataccgaataaagcagcgaggaatcttaggatactcacaaatcggagcgggggtttataaggagggaacttttcacactatgtggcatgttacgagaggcgcggttctaacccataaaggcaagcgtatagaaccatcatgggccgatgttaagaaagatttaataagttacgggggaggatggaaactcgaaggcgaatggaaggagggagaagaggtgcaagtacttgccctcgaaccagggaaaaacccacgtgcggttcaaactaaaccaggattgttcaagacaaatacaggcacaataggtgccgtgagtttagatttttcacccgggacttcaggtagtcctataatagacaaaaaaggaaaagtggttggcctatacggaaatggtgttgtaacgcgatcaggcgcttatgtctcggcaattgctcaaacagaaaaaagtatagaggacaacccagacattgaagatgacatatttagaaaaagaagattgaccataatggacttacatcctggggcaggaaaaactaaaagatatttacccgctatagtgcgagaagcaataaaaagaggactaagaactctaatattggctcccaccagggttgttgctgcagaaatggaggaggctctgcgtggtttacccatacgataccaaacaccagctataagagccgagcacaccgggagggaaatagtagacctaatgtgtcacgcaacatttaccatgcgcctactcagtccggtgagagttcctaattataacctaataattatggatgaagcacactttactgacccagcatcgatagcggcgaggggatacatttcaacaagagtggagatgggggaagccgcaggcattttcatgaccgctacgccaccaggatcaagggatccgtttccacaatctaatgcacccataatagacgaggaacgagaaataccagaaagatcgtggaactcgggccatgaatgggttacagattttaaaggcaaaaccgtttggtttgttccatcaataaaagctgggaatgacatagcagcctgtcttagaaaaaacggtaaaaaggttatacaactatcacgcaaaacatttgactctgaatatgtaaaaacgagaacgaacgactgggattttgtagtaacaacagacatatcggaaatgggtgcgaactttaaagccgaacgagtaatagatccacgtagatgcatgaaacctgtcatactaactgatggagaagaaagggtcattctagcgggacccatgccagtcactcattcctctgcagcacagagaagaggaaggataggtcggaaccctaaaaatgaaaacgaccaatatatatatatgggtgaacctctagaaaatgatgaagattgcgcccactggaaagaagctaaaatgctccttgacaatattaatacgccggaaggaataattccctcgatgtttgaacccgaacgtgaaaaagtggacgctatagatggtgaatatagactcaggggcgaagcgagaaaaacatttgtagatcttatgagaaggggcgacctgcctgtatggttggcttataaggtagcagcagaaggtattaactacgcagataggcggtggtgcttcgatggaattaaaaacaaccaaatattagaggaaaatgtagaagtagaaatatggaccaaggaaggtgaacggaaaaaactcaaacctagatggttggacgcgagaatatacagtgatccattagcacttaaagaattcaaggaatttgctgctggtagaaaatcactcacactaaacctaataacggaaatgggaaggttgccaacatttatgactcaaaaaactcgagacgctttagacaacctggccgtgctacataccgcggaagcaggtgggagagcttacaaccacgccttaagtgaacttcctgagacacttgagaccttattgctccttaccctattggcaacagtcactggaggtatctttctttttcttatgagcggcaggggtatcggaaaaatgacattgggaatgtgctgtattgtgactgcttcgatattgttatggtacgcacaaatacaaccacattggatagccgccagcattatattagaattctttctgatcgtattgcttataccagaaccagaaaaacaacggacgccacaagataatcagcttacatatgttgttattgctattttaactgtagtagcagctacaatggcaaatgaaatggggttccttgaaaagaccaaaaaagaccttggtctaggttcaatcgctactcaacagcccgagtctaatattttggacattgacctacgtcccgcctctgcatggacactctatgcggtcgcaacaactttcgtcactccaatgttaagacattcaatagaaaactctagcgtaaatgtatccttaaccgctatagccaatcaggcaacagtactgatgggtcttggaaaaggttggccattaagtaagatggatataggcgcaccattattagcaattggctgctatagtcaagtaaacccaattacactcacagcagctttgttattgctcgtggcacactatgcaatcatagggcctggtctccaagctaaggcaacaagggaagcacaaaaaagagcagcggcaggaataatgaaaaacccaacagtagatggtatcacagtaattgacttggaccctataccacacgatcctaagtttgagaaacagttaggacaagtaatgctcctggtattatgtgttactcaagtacttatgatgcgaactacttgggcattatgtgaagcactaaccctggcgacgggacccatctcgactctttgggaagggaatccaggcaggttctggaacacaaccattgccgtgagtatggccaatatttttcgagggtcatacttagccggtgcaggcctactatttagcattatgaaaaataccacaaactctcgaaggggaacaggcaatattggagaaacattgggggagaaatggaaatctcgccttaacgcattaggtaagtcggaattccaaatttataaaaagagtggaattcaagaagttgataggactttagcgaaagagggaatcaaaaggggagagactgatcaccatgcggtctctcgtggatctgctaaattaagatggttcgtggagcgtaacatggtaacaccagagggtaaagtagtagacctcggatgtggaagaggtggttggagttactactgtggtggactcaaaaatgttcgagaggtaaaaggcttgacaaagggaggtcctggccacgaggaaccgataccaatgagtacctacggatggaatctagttagattacaatcaggagttgacgtgtttttcatcccaccagaaaaatgcgataccctcctatgcgatataggagagtcaagtcccaatcctactgtagaagcaggtcgaacgctcagagtactaaaccttgttgaaaattggctgaataataatactcaattttgcattaaagtgttaaatccttatatgccttcagtcattgaaaaaatggaaactttacaaaggaagtatggaggggcactagtacgaaatccgctttcccgtaacagcactcatgagatgtactgggtaagtaatgcaagtggtaacatcgtatccagcgttaatatgatatctcgaatgttgataaatcgatttactatgaggcacaaaaaagcaacctatgaaccagacgtcgacttaggttctggtacaagaaatataggtattgaatcagaaataccaaatttagatatcataggtaaaaggatagagaagattaaacaagaacacgaaacatcctggcattacgaccaagatcacccttataagacatgggcttaccatggttcctatgaaactaagcaaaccggtagcgcatcgtccatggtaaatggtgtagtaagacttcttactaagccttgggatgtcttgccaacagtaacacaaatggcaatgaccgatacaacaccgtttggacagcagagagtattcaaagaaaaagtagatacgagaactcaagagccaaaggagggcactaagaaattaatgaaaattactgcagaatggctttggaaagagctcggaaaaaaaaagacgcctagaatgtgcacacgagaggaattcacgcgaaaagtccgtagtaatgctgcactgggggcgatatttacggacgaaaataaatggaagagtgcaagagaagctgtggaagatagccgtttttgggagttggttgacaaagaaagaaacctccacctcgaagggaaatgcgaaacatgcgtgtacaatatgatgggtaaacgagaaaaaaaactaggtgaattcggaaaggctaaaggatcccgtgcaatttggtacatgtggttaggagctagatttcttgagttcgaagctttaggatttttaaacgaagaccattggtttagtagagaaaatagcttatccggtgttgaaggggaaggcctgcatcggttggggtatattctaagggacgtttccaaaaaagaaggtggcgccatgtacgcagatgatacggctggttgggacacaagaataacattagaagacttgaaaaacgaagaaatggtaacgaaccatatggaaggtgaacataagaaattagccgaagcaatcttcaagttaacataccaaaataaagtggtaagagttcagagaccaacacctaggggcaccgtaatggatataattagcagaagggatcaaaggggaagtggtcaagtgggtacttacggacttaatacgttcacaaacatggaagcacaacttataagacaaatggaaggagaaggggtctttaaaaatatacagcatttaacggtaaccgaggaaatagcagtacagaattggttagcacgagtaggaagagaaagattgtctaggatggcaataagtggggacgattgtgtagtaaaaccacttgatgacagattcgcatctgccttaactgcattaaatgatatgggcaaaatacgaaaagacatacaacagtgggaaccatcccggggctggaacgactggacacaagttcccttctgtagtcaccacttccatgaacttataatgaaagatgggcgagttttggtagtaccttgtcgcaatcaagatgaattaatcggaagagccagaatctcacagggggctggatggagtcttcgcgagaccgcatgcctaggcaaatcatacgcacagatgtggtctttaatgtattttcacagacgcgatcttagattggccgcaaatgcgatatgcagtgcagtaccatctcattgggtgcctacatctagaactacgtggtccattcatgctaaacatgaatggatgaccacggaagatatgctaacggtgtggaatcgagtatggatacaagaaaatccatggatggaagataaaacaccggtcgaaagttgggaagaaataccctatttaggcaaacgggaagatcagtggtgtggatccctgataggattaacaagccgagcgacttgggccaaaaacatacaggttgcaattaaccaagtcaggtccctgatcgggaatgaagagtataccgattatatgccaagcatgaagagatttaggcgggaggaagaggaagcaggcgtcttatggtga

SEQ ID NO: 22507 - RNA, 9876 nt, synthetic construct
  misc_feature 1..9876: note = derived and/or modified CDS sequence (opt6) from DENV-2__FJ687447__SS-prME
  source 1..9876: mol_type = other RNA
tctgcaggaatgataataatgttgattccaactgttatggcattccatttaacaacaagaaacggtgaacctcatatgattgtaggaatccaagaaaaaggaaaatcattactatttaaaacggaagacggagttaacatgtgcactctcatggcaatggatttaggtgaactgtgtgaagatacaattacgtataaatgtccactattacgacaaaatgaaccagaagacattgactgctggtgtaatagcacatcgacttgggttacatatggaacttgtactactacgggagaacatagacgagaaaaacgtagcgtagctcttgtcccacatgtaggaatgggtttagaaacaagaacagaaacttggatgagcagtgaaggagcgtggaaacatgcgcaacgaatcgaaacatggatcctcagacatccaggtttcaccataatggcggcaatcttagcgtacactatcggaaccacgcactttcaaagagcactaatatttatactattaacagcggtcgctccgagcatgactatgcgttgcatcggaatttcaaatcgcgattttgtagaaggagtaagcggtggcagctgggttgacattgtattagagcatggatcttgcgttactacaatggctaaaaacaaaccaacacttgattttgaacttataaaaacagaagcaaaacagcccgcaactttgcgtaaatactgtattgaagctaaactcaccaatacgacaaccgaaagtaggtgcccgacccagggagaaccaagtctaaaagaggagcaagacaaacgattcgtttgtaaacatagtatggtagataggggatggggaaatggatgcggattattcggaaaaggcggcatagttacatgtgcaatgttcacttgtaagaaaaatatggaagggaaaatcgtccaaccagaaaacttagagtatacaatagtggttactcctcattctggcgaagaacacgcagttggtaatgacactggaaaacacggtaaagaaatcaaagtcacaccacagagttcaataacagaggcagaactaactggatacggcacagttacaatggaatgttcgcctcgtacatctttggattttaatgaaatggtattactacagatggaaaacaaagcatggttagtacatagacaatggtttctggatctaccattgccatggctacctggcgcggacaaacaagaatcaaactggatccagaaagaaacacttgtaacttttaaaaatccacacgccaagaaacaggatgttgtagtccttggatcccaagaaggggcaatgcacactgcactcacaggagctactgaaattcaaatgagctcaggaaatttgttgtttacaggtcatttaaaatgcagactccgtatggacaagctacagttgaaaggaatgtcctatagtatgtgtaccggtaaatttaaggttgtcaaagaaatagccgagacacaacatggaacaatcgtcataagagtccagtatgaaggtgatgggtcgccatgtaaaattccttttgaaatcatggatctagaaaaacgatacgtgcttgggagactaatcacagtgaatcctatagtaacagagaaagactcaccagtgaacatagaagcagagcccccgttcggtgacagttatataattattggagtcgaacccggtcaattaaaactcaactggttcaagaaaggatcaagcattggacaaatgtttgagaccacaatgcgtggagcaaagagaatggcaattttaggcgatacggcgtgggattttgggagtctcggaggcgtttttaccagcatcggcaaagcacttcaccaagtattcggagctatatatggagcagcatttagtggagtctcgtggactatgaaaattctaatcggcgtgataataacctggatcggcatgaactccagatcgacatccctcagtgtgagcttagtcttagtgggaatagtaactttgtatttaggagttatggtacaggccgactctggatgtgtcgtaagctggaaaaataaagaactgaaatgcggttcagggatatttataactgataatgtacatacatggacagagcaatataaattccaacctgagtcaccctctaagctggcctcagcaatccaaaaagcacaggaggaaggtatatgtgggattagaagcgttactaggcttgaaaacctaatgtggaaacaaattactccagaactgaatcatattttagctgaaaatgaagttaaactaactataatgaccggagatataaaaggaattatgcaagcaggaaaacgatcacttcgtccccaacccaccgaactcaaatactcttggaaaacatgggggaaagccaagatgttaagtactgaaagctacaatcaaacattcctcatagacggccccgaaacagcagaatgcccaaacacaaaccgagcctggaacagcttagaagtagaagactacggctttggggtcttcaccacaaatatctggctaaagttaaaagagaaacaagacgccttttgtgatagtaaactaatgtcggcagcgataaaagacaacagagcggtacacgcagatatgggttattggattgaaagcgcgcttaacgacacttggaaaatagagaaggccagctttatagaagtcaaaaattgtcattggccaaaatcgcacacactgtggtctaacggagtattagagagtgaaatgatcatacctaaaaatcttgcgggacccgtttcgcagcataactatcgaccaggttaccacactcagattgcaggaccttggcacctcggaaaattagagatggatttcgatttctgcgatggcactaccgttattgttacggaggactgtggcaaccgaggaccttctttaagaacaactacggcctctggcaaattaataacagaatggtgctgtaggtcatgcaccttaccacccctaagataccgaggggaagatggatgttggtatgggatggaaatcaggcccctaaaagagaaagaagaaaacttagtaaattcgttagtgactgcaggacacggacaggtagataatttttctttgggtgtattgggaatggctttgtttcttgaagaaatgctgagaacacgtgttggaacaaaacacgcaatattattggtagccgtcagcttcgtaacactgataactgggaatatgtcatttaaagaccttggacgagttgtagtgatggtaggcgcaactatggcagatgatatagggatgggcgtcacttacttggctctgctcgcagcgtttaaagtcagaccaacatttgcagcaggtttactgctgcgaaagctcacatctaaagaactaatgatgaccaccatcggcatagtacttctctcccaatctacaattccagaaactattttagaattaacagatgcgcttgctttaggaatgatggtattaaaaatcgtaagaaatatggaaaaatatcagcttgcagtaaccataatggctatattatgcgtcccgaacgcagttatcctccaaaatgcttggaaagtaagctgcactattctcgcggtagtatcagtctccccacttctactgaccagttcccaacaaaagaccgactggattcctcttgcattaaccatcaaaggtctaaacccgacagcgatttttctaactacattatcacgtaccaataagaaaagaagttggccactgaacgaagccataatggcagtcgggatggtatctatcctcgcttcaagcctcctcaaaaacgatatacctatgacaggcccattagttgcaggaggtttattaacagtgtgctatgtgctgactgggcgatcggcagacctagaactggaaagagcaaccgacgtcaaatgggaagaccaagcggagatctcaggctcaagtcccatactaagtattacgatctcagaagacggctctatgagtattaagaacgaagaagaagaacaaacattgacgatcctgattcggactggattattagttatatccggtctctttcccatatccataccaattactgccgcagcttggtatttatgggaggtcaagaaacaaagggcaggagtcctttgggacgtaccatcgcctccaccaattggaaaagcggaactcgaggacggagcgtatagaattaagcagaaaggcattcttggttacagtcaaattggagccggagtatataaagaaggaacatttcacacaatgtggcatgtaacccgaggcgccgtccttatgcacaaaggcaaacgcatcgagccgtcatgggcggacgtgaagaaagatttaataagctacgggggaggatggaaactagagggcgagtggaaggaaggcgaagaggtacaagttcttgccttagaaccaggtaaaaatccgagagcagtacaaactaaacccgggttgttcaaaacaaatacaggtacaattggagctgtaagcctagactttagcccaggaacatctggctcacctatcatagataagaaaggaaaagtcgtcggcttgtatgggaacggcgtagtaacgaggtccggtgcatatgtttcagctatagcacaaacagaaaaatccatagaagataatccagaaattgaggacgacatctttagaaaaaggaggctaacgataatggacttgcatccgggtgcaggtaagactaagcgctatctgcccgcaattgtgcgtgaggcaataaaaagaggcctaagaactctaattttagcgcctactcgagtcgttgctgcagaaatggaggaggccttacgcggcttaccaatacggtatcagacaccagcaatacgcgctgagcacactgggcgggagattgttgaccttatgtgtcatgctacatttacaatgagactgctcagcccggttcgagtacccaattataatttgattataatggatgaggcacattttaccgaccccgcgtctatagctgcccggggatacattagtacacgtgtagaaatgggggaagcagctggaatttttatgacggcgacccctccaggtagcagggacccattccctcaaagcaatgcccccataatagatgaggaacgtgaaattccagaaaggtcgtggaatagcggccatgaatgggtcacagactttaaaggaaaaaccgtttggtttgttccaagtataaaagctggaaatgacatagcagcatgcctaagaaagaacggcaagaaagttattcagctatcacgtaaaactttcgattctgaatatgttaaaactagaaccaacgactgggactttgtagtgactacagatatatcggaaatgggggcgaactttaaagctgaaagggtaatagatcctagacgatgcatgaaacctgtcattctgaccgacggtgaagaaagggtaattttggccggaccaatgcccgttacacatagttcagctgcacagagacgcggacgaataggtagaaatccgaagaatgagaatgatcaatacatctacatgggcgagcccttggaaaatgatgaagactgtgctcactggaaagaggcaaaaatgttactagataatatcaatactcctgagggcatcatcccgagtatgtttgaacccgaacgagaaaaagttgacgctatagacggcgagtatcgactacgcggggaagcgaggaaaacatttgtggatctgatgcgaagaggtgacttacctgtttggctggcattcaaagtggcagcagaaggcatcaattacgcggaccgaagatggtgttttgacggtattaagaataaccaaatattagaagaaaatgtggaggtagaaatatggactaaagaaggggaacgtaagaaacttaaaccaagatggttagacgcgcgaatttattcagatccactagctctgaaagagttcaaagaatttgctgctggaaggaaatcacttaccctcaacttgattactgagatgggacgtctacctaccttcatgacccagaaaactcgtgatgccctagataatttagcagttcttcacacagccgaagcaggagggagagcttataatcatgcactttcggagttaccagagactttagaaacgttattgttgttgacactattggcaacagttacaggaggaatattcttatttctaatgtcaggtagaggcataggaaaaatgactttaggaatgtgctgcataatcaccgcttcaatcttgttatggtacgcccaaattcaaccacactggattgctgcatcaataattttagagttcttccttatagtactacttatcccagaacccgaaaagcagagaactccccaagataatcaactaacgtatgtagttatagcgatactcacagtagttgcagcgaccatggctaatgaaatggggtttctggagaaaactaagaaagatttaggccttggaagtattgcaacacaacaaccagaatctaatattcttgatattgatcttaggcctgcctcggcatggacgctgtatgctgtagctaccacatttgttacacctatgcttagacattcaatagaaaattcaagcgttaacgtaagtttaacagccatagccaaccaagcaacagtattaatgggcttaggcaagggctggccattatcaaaaatggatattggagtgccgctactggctataggttgttactcacaagttaatcccataaccttaacggctgccttactcctattagtggcccattatgcaattatagggccaggtcttcaggcaaaagccacaagagaggcacagaaaagagcagccgcaggaattatgaaaaatccaactgtggatggaattacggttatagatctagatccaattccctacgatccgaaattcgaaaaacaactcggacaagtaatgctgttaatattgtgcgtcacccaggtgctaatgatgcgaactacatgggcattatgtgaggctctaacactagcaaccggtcctatctcgacattatgggaaggcaatcctggtaggttctggaacacaaccatagcggtttctatggctaatatttttagagggagttacctagccggggctggtctattgttctccatcatgaaaaataccactaacacaagaaggggaacaggaaatatcggcgaaacactgggagaaaagtggaagtcgcgtctcaatgctctcggaaaatcagagtttcaaatctacaagaaatctggcatacaggaagtagataggactctagcaaaagaaggtataaaacgaggagaaacagatcatcatgcggtatcacgcggaagtgctaaattaagatggtttgtagaaagaaatatggtaacaccggaagggaaggtagtagatctcggatgcggccgcggaggatggtcatactactgcggcggattaaagaacgtacgcgaagtgaagggtctcacgaaaggaggtcccggacacgaagaacccataccgatgtctacgtatggttggaacctcgtaaggttacaaagcggagttgacgtattcttcattccaccagagaaatgcgatacattactctgtgatataggggaatcgtcacccaatcctactgtggaagctggaaggactttacgagtcctaaatttagtagaaaactggctaaacaataatacgcaattttgcatcaaagtattaaatccttacatgccatctgtaatcgagaaaatggaggcgttacaaaggaagtatgggggtgccctagtaaggaaccctctttcaagaaattctacgcatgaaatgtactgggtttccaatgcttccggaaatattgtctccagtgtgaatatgatatctagaatgcttataaatagattcacaatgagacacaagaaagctacgtatgaaccagacgtagatcttggatcgggaacacgaaatattggcatagaatccgaaatccccaatctagatattatcggtaaacggatagagaaaataaaacaagaacacgaaacaagttggcactacgaccaagatcacccctacaaaacgtgggcatatcatggatcctatgaaacgaaacagacaggtagtgccagttccatggtcaacggggtagtacggctactaacaaagccatgggacgtattacccacggttacgcaaatggccatgaccgacactacacctttcggacagcaacgagtctttaaagaaaaagtagatactaggacccaagaacccaaggaaggtaccaagaaattaatgaaaataaccgctgagtggttgtggaaagaactgggcaagaagaaaactccgaggatgtgtacaagagaagaatttactagaaaagtaaggtcaaacgcagctctcggagctatttttaccgacgagaacaaatggaaaagtgcaagggaagccgttgaagacagtcggttctgggaattagtagataaagaaagaaacctgcacttagaaggaaagtgcgagacatgtgtctacaacatgatgggaaaaagagagaagaaactaggtgagttcgggaaagccaaaggttctcgggctatatggtacatgtggttgggagcgcgcttcttagagttcgaagccctaggttttctgaacgaggatcattggtttagcagggaaaactcactctctggagtggaaggggaagggctacacaagttaggatatatactaagagatgtaagtaaaaaggaaggtggtgcaatgtatgcggatgatacagccggctgggacacacgaatcacattggaagatcttaagaacgaggaaatggtaaccaatcacatggaaggtgaacataagaaacttgccgaagccatattcaaattgacataccaaaataaggtagttagggtacaaagacctactcctcgaggcactgtaatggatatcatatccagacgtgatcaacgcgggtcaggccaagtaggaacatacggtctgaatacgtttacaaacatggaggcacagctgataagacaaatggaaggagagggagttttcaaaaatattcaacacctaactgtaactgaagaagttgccgttcagaattggcttgctcgagtgggaagggaacgattatcaagaatggccatttccggagatgattgtgttgtaaaaccactagatgacaggttcgctaatgcgctaacggctttaaacgatatgggaaaaattcgaaaagacattcagcagtgggaacccagcaaaggctggaatgattggacacaagtcccattttgcagtcaccatttccacgaattaatcatgaaagacggccgagtactggttgtgccgtgcaggaatcaagacgaattaataggcagagctcgtataagccaaggcgccggttggtcactaagagaaacagcttgtttaggtaagtcctatgcccagatgtggagtctcatgtattttcacaggcgagatttgagattagcagcaaacgcgatatgttcggccgtaccgagccattgggttcccaccagcagaactacatggtcgatacatgccaagcacgaatggatgacgactgaagacatgctaactgtatggaaccgagtatggataagagagaacccgtggatggaagataagaccccagtagagagctgggaagagataccatatctagggaaaagagaagaccaatggtgtgggagcttaattggactaacttccagggcaacatgggccaaaaatatacaagctgcaattaaccaagtacggtctttaataggaaacgaagaatatactgattatatgccatccatgaaacgtttccgcagagaagaagaagaagcgggagtcctctggtga

SEQ ID NO: 22508 - RNA, 9876 nt, synthetic construct
  misc_feature 1..9876: note = derived and/or modified CDS sequence (opt6) from DENV-2__FJ810411__SS-prME
  source 1..9876: mol_type = other RNA
agcgcagggatgataataatgttaataccaacagtaatggcattccatctcacaacaagaaatggagaaccgcatatgattgtgggaatccaggaaaaaggtaaatcattgttgtttaaaacggaagatggtgtaaatatgtgtacactcatggcgatggaccttggtgaactttgtgaagatacaatcacatataaatgtcccctgttgagacaaaatgaaccagaagacatcgattgctggtgtaacagcacatctacatgggtcacttatggaacttgtaccactaccggagaacatcgccgagaaaaacgatctgtagcattggtacctcacgtcggcatgggattagaaactcgaacggagacatggatgtcctcggagggcgcatggaaacacgcacagcggatagaaacttggatacttcggcatccaggctttacaattatggccgcaatcctagcatatacaataggtacaacacacttccaaagagcattaatatttattttgttgacagctgtagcaccgagcatgacaatgagatgtataggtatctcaaatagggacttcgtagagggcgttagtggcggttcatgggtggatatagtactcgaacatgggagctgtgtaacaacaatggcgaaaaacaaacctactttagatttcgaattgattaaaactgaagcgaaacagccggccacactacggaaatattgtattgaagccaaacttacaaacacaacgacagaatcacggtgtcctacacaaggggaaccgtcgctgaaagaagaacaagataaaagatttgtttgcaaacatagtatggtagatagaggttggggtaacggatgcggtttgtttggaaaaggcggtatagttacgtgtgcaatgttcacatgcaagaaaaatatggaaggtaaaatagtccagccggaaaatctagagtatacgatagtggttacaccacattctggcgaagaacatgcagttggtaacgatactgggaaacacggtaaagaaataaaagtgaccccacaatcgtccattacagaagcggagctcacaggttatggaacagttactatggaatgtagcccaaggacatccctagatttcaacgaaatggtattactccaaatggaaaataaagcatggctggtacatagacaatggtttttagatttaccacttccatggctgcctggggctgataaacaagaaagtaattggattcagaaagaaacacttgttacatttaaaaatcctcacgccaagaaacaagatgtagttgtgttaggatctcaagaaggagctatgcatactgctttaacaggtgcaacagaaattcaaatgagtagtgggaacttactattcacagggcacttgaaatgccgattgcggatggataaattgcaattgaaagggatgtcgtatagcatgtgcaccggtaaattcaaagtagtcaaagaaatcgcagaaacgcaacatggtactatagttataagggtacagtatgaaggcgatggaagtccttgtaaaattccatttgaaatcatggatcttgagaaaagatacgttttaggacgattaataactgtaaatcctattgtcaccgaaaaagactccccagtaaatatagaagcagaacctccattcggagatagctacataattattggcgtagagcctggacaattaaaattaaattggttcaagaaaggtagttcaataggtcaaatgttcgaaaccacaatgagaggagcaaaaaggatggcaatattaggagacacagcttgggattttggctccctagggggtgtatttacttcaattggaaaagcattacaccaagtattcggcgcaatttatggagcggcattttcgggagttagctggaccatgaaaatattaattggagtcataattacttggataggtatgaacagtagatcaaccagcctgagtgtatctttagtgctagttggcatagttactctttatttgggggtgatggtacaggcggactcaggttgtgtagtcagttggaaaaataaagaattgaaatgtggatccgggattttcataacggataatgtacatacgtggacagaacaatacaaattccaacccgaaagtccttcaaaattagcatcggctatccaaaaagctcaagaggaagggatatgtggtattagatcagtaacgagattggaaaatttgatgtggaaacagattactcctgaactcaatcacatactagcggaaaatgaagtcaaattaaccataatgacaggagacatcaaaggtataatgcaagctggaaaaagatccctcagaccccaaccgactgagctaaaatatagctggaaaacgtggggtaaagctaaaatgctcagcactgaaagttataatcaaacttttctaatagacggccctgaaaccgctgaatgtcctaatactaatagagcatggaactccttggaagtagaagactatgggtttggtgtctttaccacaaatatatggctcaaactaaaggaaaaacaggacgcattctgtgatagtaagttaatgagtgcagcaattaaggataatagagcagttcatgcagacatggggtattggatagagagtgccttaaacgacacatggaaaatagaaaaggcaagtttcattgaggttaaaaattgccactggcctaaaagccacactttatggtccaacggggttttggagtcggaaatgataattcctaaaaacctcgcaggcccggtcagccagcacaattatcgaccagggtatcacacccaaatagccggcccttggcacctcggtaagctagaaatggatttcgatttttgcgatgggactactgtaatagtgactgaagattgcggtaataggggcccctcactccgaaccacaaccgcatcaggaaaactcataacagagtggtgttgcagatcatgcacactaccacctctgagatatagaggagaagacgggtgttggtacggtatggaaatacgacctctaaaagaaaaagaagaaaacttagtaaattcactcgttactgctgggcatgggcaggttgataacttcagcctgggagtattgggtatggctttgttcttggaagaaatgcttcgaacaagagtcgggactaagcacgccatactattagtagccgtaagttttgtcacgctgattactggaaatatgtcattcaaagatttgggccgcgtcgtggtaatggtcggtgcaactatggcagacgatataggaatgggcgttacttacttagcacttctggcagctttcaaggtacgtccgacattcgcagccggcttattgcttaggaaattaacatcaaaagaactcatgatgaccacgataggaattgtcttactgagccaaagtacgattccggaaacaattttagaattaactgatgcactagccttgggaatgatggtattaaaaattgttaggaatatggaaaagtatcagctagcagttaccataatggccattttatgtgttcccaatgccgtaattctgcagaatgcctggaaagtatcatgtacaattcttgcagtagtaagcgtatcacctcttctcttaacaagttcccagcaaaagacagattggataccattagcattaaccataaaaggtttaaatcctaccgccatctttctaacaacgttaagtaggacgaataagaagagatcctggcccctaaatgaagcaattatggcggtagggatggttagtatactagcatctagcttactgaaaaacgatatcccaatgacaggacctttagtggctggtggactattgacagtatgttacgtattaacaggaagatcagcggacttggaactagagagagcgacagatgtaaaatgggaagaccaggcagaaatctccggatccagcccaatcttgtcaattacaatctcggaggatggttccatgtccatcaaaaatgaagaagaggaacagacactaacaattttaataagaacgggacttttagtgatttcgggcctatttcccataagtataccgataaccgcagcagcctggtatctctgggaagtgaagaaacaacgggctggtgtactctgggacgttccttctccaccacctattggcaaggccgagctggaagatggtgcatatcgaattaagcagaaagggatcttgggatactcccaaataggagcaggagtctacaaagaggggacctttcatacgatgtggcatgtaaccagaggggctgtattaatgcacaaaggaaaacgtatagagccaagctgggccgatgtcaagaaagatcttatatcttacggaggaggatggaagctggaaggggaatggaaagaaggagaagaagtacaagttctcgctttagaaccaggtaaaaaccctagagctgttcaaacgaaaccaggattatttaaaaccaatacggggacgatcggcgcagtatcattagatttttcacctggtactagcggtagccccataatagataagaaaggaaaagttgtaggcttatatggaaacggagtagtaactagatccggcgcctacgtaagcgccatagcacaaacagaaaagagtattgaagataatccggagattgaagacgatatatttcgaaaaagaagactcaccattatggaccttcatccaggagcaggaaaaacgaagcgatatctaccagcaatagtgcgagaagcaataaaaaggggacttagaacactaatattagcacctactagagtcgttgcagcagaaatggaagaagccctgcgaggattaccgatacgctatcaaacgcccgcaatccgagcagaacacactggaagagaaattgtggatttaatgtgtcatgcaacatttacaatgagactactaagcccagtgagagttcctaactacaatttaataatcatggatgaggcacattttacagatccggcatccattgctgctcgtggttatatatccactagggtggaaatgggtgaagcggctggtatatttatgactgcgactccaccaggaagtcgtgatccatttcctcaatctaacgcaccaatcatagatgaagaaagagaaatacctgaaagatcgtggaatagcgggcatgaatgggtcaccgactttaaggggaaaacggtatggttcgtgcccagcattaaagcggggaatgatatagcagcatgtttgaggaaaaacggaaagaaagtcattcagctatctagaaagacattcgatagcgaatatgttaaaacccgaacgaacgactgggacttcgtcgtaacgacagatatatctgaaatgggtgcgaattttaaagcagagagagttattgaccctaggaggtgcatgaaaccggtaattttaacggatggggaagaaagagtaatacttgcaggtccaatgcctgtaactcatagtagtgcggcccaacgccgcggtaggatcggacggaatccaaagaatgagaatgatcaatatatttatatgggtgaaccattagaaaatgatgaagattgtgcacactggaaagaggctaaaatgctcttggacaatataaacactccagagggcataatcccttcaatgttcgaacctgaaagagaaaaagtggacgcaatagatggcgaatatcgattaaggggagaggcccgaaaaacatttgtcgacctaatgaggcggggcgatctaccagtctggctggctttcaaagtggctgcagaaggcataaattacgctgaccgtcgatggtgttttgacgggatcaaaaataatcagattctagaagaaaatgtcgaggttgagatttggacaaaggaaggtgaaaggaagaaattaaaaccaagatggctagatgcaaggatatattctgacccactagccctcaaagaatttaaagagttcgctgctgggaggaaatccttgactttgaatctgataacagagatggggcgattaccgacgtttatgacacagaaaactagagacgctctagataatctggctgtgcttcatactgcagaggcaggaggcagagcatacaatcacgcgctttcagagctgcctgagaccttagaaacactgctattactaacgttgctcgcgactgttaccggaggcattttcttatttttgatgtctggtagggggattggaaaaatgacattgggcatgtgctgtattattacagcctctattcttttatggtatgctcaaatccagcctcattggattgcagcaagtataatacttgaatttttcctgatcgtacttctaattccggagccagaaaagcagcgtacaccccaggataaccagctaacttatgtcgtaatagcaattttaactgtggtagccgctactatggcaaacgagatgggtttcttagagaagaccaagaaagatctaggtttgggttctatagcaacacaacaaccagaaagcaatatacttgacatcgatttacgaccggcgagcgcatggacgttatatgccgtagcgacaacctttgtaacacccatgcttaggcacagtatagaaaactcatccgtcaatgtatcactcacagcaatcgccaatcaggcgactgtattaatggggctaggaaagggatggccgctaagtaagatggatataggagtaccgctactagctattggctgttacagccaggtcaatcccattactctgacagcagcattactactattggtcgctcattatgctattattggaccgggcctgcaggcaaaagccaccagagaggctcaaaaacgtgcggcagcgggtataatgaaaaatccaactgtagatggcataacagtaatcgatctagatcctatcccttatgatccaaaatttgagaaacaattaggacaggttatgctactaatactatgcgtcactcaagttctaatgatgagaactacttgggctctatgtgaagcattaaccctagctacaggacctatctcaaccttatgggagggaaacccaggtcgattttggaacacaaccatagcagtatcaatggcaaatatatttcgcgggagctacctagcaggagcaggccttctattcagtattatgaagaatacaacgaacacaagacgaggaacgggtaatataggagagacactaggggagaaatggaaatctcgattgaatgcactaggaaaaagcgagttccagatatacaagaaatcgggaatccaagaggttgataggacattagccaaagaaggaataaaacgtggcgagacggaccaccatgctgtgagtagaggctcggcaaaactccggtggttcgttgagagaaatatggtgacccccgaggggaaagttgtagatctcggctgtggcagaggaggatggtcatattattgtggcgggttgaaaaatgtgcgggaggtgaaggggcttacaaaaggaggaccaggacacgaagaacccataccgatgtctacctatggatggaacctggtgcgactgcaatcaggagtcgacgtgttcttcattccaccagaaaaatgtgacactctgctatgtgatattggcgagagctcgccaaacccaacagtagaagctggaagaacccttagagttttaaaccttgtcgaaaactggctaaataacaacactcaattttgtatcaaagtattaaatccctacatgccatctgttatagagaaaatggaagcactacaaagaaagtatggtggtgccctcgtgaggaatcctttaagcagaaactcgacacatgaaatgtactgggtgtcaaatgcgtcaggcaacatcgtttcgagtgtgaacatgataagtagaatgctaataaatagattcacaatgcgtcataagaaagccacttacgaaccagacgtggatttaggctcaggtacaagaaacatcggtatcgaaagtgaaataccaaacttagatattattggaaaacggatagagaaaattaagcaagaacatgagactagctggcattatgatcaagaccatccatataaaacttgggcctatcatggctcttatgaaacaaagcaaactgggagcgcatcgtcgatggtgaacggtgtagtacgtctattgaccaagccgtgggacgtgttaccgacggtaacacagatggcaatgactgatacaactcctttcggccagcaacgagtattcaaggaaaaagtagatacacgaactcaagagcccaaagaaggcaccaagaaattaatgaaaattaccgccgaatggttatggaaggagcttggtaagaagaaaactccacgcatgtgtacacgtgaggaatttaccaagaaagtacggtcaaatgcagcactcggagcgatatttaccgatgaaaacaaatggaaaagcgctcgagaagccgtagaagattcaaggttctgggaactcgttgataaagaacgaaatttacacttagaagggaaatgcgagacgtgtgtgtataacatgatgggtaagagagaaaagaagttgggggaatttggaaaagcaaaaggcagccgcgccatatggtacatgtggctcggggcaaggtttctagaatttgaagcactgggatttctcaacgaagatcactggtttagtcgtgaaaattctttatcgggtgtagaaggagaaggattacataaattaggctatatactacgtgatgtaagtaagaaagaagggggcgcaatgtatgcagacgatacagcaggctgggatacgcgaataacactagaagacctaaagaatgaagaaatggtaactaatcatatggagggagaacataagaaactagcagaagctatattcaaattgacatatcaaaacaaggttgtaagagtacaaaggcccacgccaagaggcactgtcatggatataatctcccgcagagaccagagaggttctggacaagtaggcacttatggcttgaatacattcacgaatatggaggcgcaactaataaggcaaatggagggtgaaggagtcttcaaaaatatacagcatctaacagttactgaggaggtcgcagttcagaactggctcgcacgtgttggaagggaacgtttatctcgaatggccatatcgggggacgattgtgtggtaaaaccgctcgatgaccgattcgcaaatgcattgacagcacttaatgacatgggtaaaataaggaaagacattcagcaatgggaaccttcaaaaggatggaatgattggacccaagtacccttttgttcacatcattttcacgaactcatcatgaaagacggacgcgtcctggtagtaccttgcagaaaccaagatgagctcatagggagagcgcgtataagtcaaggtgcaggatggtcgctacgagagactgcatgccttggaaaatcctatgcgcaaatgtggagtcttatgtattttcatcgtcgagatctaaggctagcggcgaatgcgatatgttcagcagtaccgagtcattgggtacccacctctagaacaacgtggagcatacacgctaagcatgagtggatgacaacggaagatatgctaacagtgtggaatagagtatggattagggaaaacccttggatggaggacaaaacgcccgttgaatcatgggaagaaattccctatttagggaaaagagaggatcaatggtgcgggagcctaataggcttaacaagcagggcgacttgggccaaaaatatacaagcggcaataaaccaggtgaggagcttaatcggaaatgaagaatatacggactacatgccatcaatgaaaaggttccgtcgggaagaagaggaggcaggggtactatggtga

SEQ ID NO: 22509 - RNA, 9876 nt, synthetic construct
  misc_feature 1..9876: note = derived and/or modified CDS sequence (opt6) from DENV-2__FJ744713__SS-prME
  source 1..9876: mol_type = other RNA
tcggcaggtatgatcatcatgttaattcccacggttatggctttccacttaactacgagaaatggtgaaccacacatgattgtagggattcaagaaaaaggaaaaagtttactatttaaaactgaagacggagtaaacatgtgtacattgatggctatggatttaggagaattgtgcgaagatacaataacatacaaatgcccactattaagacaaaatgaaccggaagatatcgactgctggtgcaatagcacatctacgtgggtaacttacggaacttgtactaccaccggagaacaccgaagggagaaacgatcagttgctttagtaccgcatgttggaatgggattggaaacccggacggaaacatggatgagttcagaaggcgcttggaaacatgcacaacggatagaaacttggattcttcgtcatccaggatttacaattatggcggcaatcttggcatatacaatcgggaccactcactttcaacgggctttaatatttatcttactaactgcagtagcaccaagtatgacaatgcgatgtataggcatatcaaatcgagacttcgtagaaggcgtatccgggggcagttgggtggacatagtacttgaacacggatcatgtgttacaaccatggccaaaaacaaaccaactttagatttcgaactgataaaaacagaagcaaaacaaccagcgacattgaggaaatattgtatagaagctaaactaacaaataccaccactgaatcacgctgcccaacacaaggtgaaccctctttaaaagaagaacaagataaaaggtttgtttgtaaacattcgatggtagatcgagggtgggggaacggatgcggattattcggaaaaggagggattgtaacatgtgcaatgttcacgtgcaagaaaaatatggaagggaaaattgtacagccagaaaatctggaatacactatagtagttactcctcacagtggtgaagaacatgcagtgggaaacgatacaggcaaacatggcaaagaaataaaagtcactccacaatcaagcataacagaagcggaactaactgggtacggtacagtaacaatggaatgtagccctagaacaagtttagattttaatgaaatggtactattacaaatggagaacaaagcgtggctggtacacaggcaatggttcctagacttaccactaccttggctacctggtgctgataaacaagagtctaactggatccaaaaagagacattagttacttttaaaaacccacatgcaaagaaacaagatgtcgtcgtgctaggcagtcaagaaggggcaatgcacacagcccttacaggcgctactgaaatacaaatgtcaagtggcaatttactttttacgggccacctgaaatgtcggctaaggatggataaactgcaattgaaaggtatgtcatatagtatgtgtactggaaaatttaaagttgttaaagaaatagccgaaacccaacacggaacgatagtcatacgagttcaatatgaaggagacggttcaccgtgtaaaatccccttcgagataatggatctagagaaaagatatgtgctaggccgactgatcactgttaatccgatagtaaccgaaaaagattcaccggtaaatatcgaagctgaaccaccattcggggatagttacataattataggtgtagaacctggccaactgaaattgaattggttcaagaaaggctccagtataggacagatgttcgaaacaactatgcgaggagcaaaacggatggccatccttggagataccgcatgggatttcgggtctctaggaggtgtcttcacgtctatagggaaggctttacatcaggttttcggggccatttacggtgcggcttttagtggtgtctcatggactatgaaaatactaataggagtaataataacgtggatcggtatgaatagtcgtagtacatctctctcagtttccctggttcttgtaggcatagtaactttatatttgggagtaatggtacaggccgattctggatgtgtagtgtcttggaaaaacaaagagctcaaatgtggtagtggcatattcattacggacaacgtacacacttggaccgaacaatataaattccagccggaaagtccttcaaaacttgcctcagcaatacaaaaagcacaagaagaaggaatatgtggtatacgatctgtaacacgcctggagaatttgatgtggaaacagataactccggaactaaaccacatattagcagaaaacgaagtgaaactgactatcatgacaggagatataaaaggaattatgcaagccggtaaaagatctttacgtcctcaacctaccgaattaaaatacagctggaaaacatggggaaaagcaaaaatgctgtctacggaaagctataaccaaacatttcttattgatggccccgaaacagcggagtgcccaaacacaaacagggcgtggaatagcttagaagttgaagactatgggtttggagtgtttactacaaatatctggcttaaattgaaggaaaaacaggacgcgttctgtgacagtaagctaatgtcagctgcgattaaagataatcgagctgtacatgctgacatgggttattggatagaatcagctctaaatgatacctggaaaatcgaaaaggcttcctttattgaagtcaagaattgtcactggcccaaaagtcatacactatggtccaacggagttttagagagcgaaatgataattcccaaaaacttagctggtccagtatctcagcataattatcgtcctggttatcacacccaaatagctggaccctggcatttaggtaagttggaaatggattttgacttctgtgatggaaccaccgtaatagttactgaagattgtggaaatagaggcccctcgcttcgtaccacaacggcaagcggtaaacttattacggaatggtgttgtagaagctgcactttaccaccattaagatataggggcgaagacggttgttggtacggtatggaaattaggcctttaaaggaaaaagaagaaaatcttgtgaacagtttagtaaccgcaggacacggacaggtagacaactttagtttgggggtcctgggcatggccttatttctagaggagatgctaagaacgcgcgtcggaacgaaacacgctatcctactggtcgccgtctcattcgtcacgctaataacaggtaacatgtcattcaaagacttgggacgagtagtcgtgatggtcggagccacaatggcagacgatattggaatgggagtcacctacttggcccttttagctgctttcaaagttcgacctactttcgcagcgggtcttttacttcgcaaactaacatcaaaagaactcatgatgacgactatagggatcgttctattatcacaatcgacaatcccagagacaattctcgagcttactgatgcgctcgcactaggcatgatggtcctcaaaatcgtaaggaatatggaaaagtatcaactagcggttacaatcatggctattctctgtgtaccaaatgcagtaatacttcaaaatgcatggaaggtaagctgtactatactagccgttgtatcggtatcaccactactacttacatcttcacaacagaagacggattggattccgctagcgctaacaataaaaggtctaaatccgacggcgatatttcttacgactttatcaagaacaaacaagaagagatcgtggccactcaacgaagcaataatggcagtcgggatggtgtccatccttgcaagctcattactcaaaaacgatatcccaatgacaggaccgctggttgcaggaggtttattaactgtatgctatgttttaactggtaggagtgctgatctagaattagaaagagcaaccgacgttaaatgggaggatcaagctgagataagcggctcgtcaccaattctatccataactatctccgaagatggaagtatgtccatcaaaaatgaagaggaagaacaaatactaacgatactcatacgtacaggattgctcgtaataagtggcctattccctatttcaatacccataacagctgcagcctggtatttatgggaagttaagaaacagagagccggagtcctatgggatgtgccctcaccaccgccaataggtaaagcagagctagaagatggcgcatatcgtattaagcaaaaaggtatactaggttatagccaaattggggcaggagtatataaagaaggaacatttcataccatgtggcatgtgacaagaggtgcagtcttaatgcacaagggaaaacgaatagagcctagttgggccgacgtcaagaaagatttgatatcgtacggaggagggtggaaacttgaaggcgaatggaaggagggagaggaagtccaggtcctcgcactggaaccaggtaaaaatccacgcgcagtacaaacgaagcctggattgttcaaaaccaacactggtacaataggggcagtatctttagactttagtcccggaaccagcggatctccgatcattgacaagaaaggtaaagtggtgggactatatggaaacggagtagtgacaagaagtggtgcttatgtcagtgcgatcgctcaaactgagaaaagtatagaagataacccggaaatcgaagacgacatcttcagaaaacgtcgcctaacaatcatggatcttcatcctggtgcaggcaagactaaacgctacttacctgcgatcgtaagggaagcaattaaaagaggattaaggacactaatcctagcacctacgagagtcgtagcagccgaaatggaggaagcattaagagggttaccgataagatatcaaactcctgctatacgagcggaacacacaggaagagaaattgttgacttaatgtgtcacgctacattcacaatgcgactactttctccagtaagagtcccaaactataacttaataatcatggatgaagcccacttcaccgatcctgcttcaattgcggctagagggtatatttcaaccagggtcgaaatgggagaggcagcaggtatttttatgacggcaactcctccgggttcacgagacccatttccacagtcaaatgcaccgatcattgacgaggaaagagaaattcccgaaagatcgtggaacagtggacatgaatgggtgacggacttcaaaggcaaaactgtctggtttgtaccttctataaaggctggcaatgatattgcggcatgtctcaggaaaaatggcaagaaagtcattcagctatctagaaaaacgtttgattccgaatacgtgaagacacgaactaatgactgggattttgttgtcactacggatatcagcgaaatgggtgctaacttcaaagctgaaagagttattgatcctaggaggtgtatgaaaccagtcatattaactgacggcgaagaaagagtaatattagcagggccaatgccagttacccactcctctgctgcccaaagaagaggcagaatcggccgaaatcctaaaaatgaaaacgaccagtacatatatatgggggagccactagaaaatgatgaagattgtgcccactggaaggaagcgaaaatgttgttagataacattaatactccagaaggaataataccaagcatgttcgaacccgaaagagaaaaggtggatgctatagacggtgaatatagattaagaggggaagcaagaaaaacctttgttgatttaatgagaagaggcgatctaccggtgtggctcgcatttaaagtagccgctgaaggaattaattatgcagacagacgctggtgctttgatggcatcaagaacaatcagatattagaagaaaatgtcgaagtggaaatatggacgaaagaaggcgaacgaaagaaactcaaaccgagatggttagacgcccgtatatactcagatcccttggcactaaaagaatttaaagaatttgcagcaggaagaaaatcactcactttgaacttaataaccgaaatgggtagactgccaacgttcatgacacaaaagactagagatgcactagacaatttagcggtactgcatactgcggaagccggagggagggcttacaatcatgcactaagtgaattgcccgaaactttagaaaccttactactactcacactcctagcaaccgtaacaggaggaatatttttattcttaatgtcgggtcgggggatcggaaagatgactttaggtatgtgttgtatcattacagcgtccatcctattatggtatgctcaaatccaaccgcactggatagcagcatctattatactagagttctttctaattgttctattaattccggaaccagaaaagcagagaacaccacaggacaaccaattaacctacgtagttatagctatactaaccgtggtggccgcaactatggcaaacgaaatgggtttcttagagaaaactaagaaagacctaggattaggatctatagctacacagcagcccgaatctaatatccttgatatcgatttaagacccgcctcagcgtggacattatatgcagttgctacaacctttgtaactccaatgcttagacactcaatcgaaaattcatcagttaatgtttctctcacagcgatcgcgaaccaagccacggtcctcatgggtctcggtaagggttggcccttatccaaaatggacattggcgtcccactattggccattggatgttactcacaagtaaaccctataacattaactgcggcattactgctcctagtagcgcattacgcaataataggaccgggactgcaagccaaggcgactcgcgaagcacaaaagcgagctgcagctgggatcatgaaaaaccccacggtagacggtataacagtcatagatctcgatcctatcccctacgacccaaaatttgagaagcagttgggccaagtaatgcttttaatattatgtgtgactcaagtattgatgatgagaaccacttgggcattgtgcgaggctcttaccctagctaccggaccaatttccacgttatgggagggaaatccgggccgtttctggaatactactatagcagtttcaatggccaatatattccgaggttcttatctcgccggagcagggctattattttcaattatgaagaatacaaccaatacaaggcgtggaaccggcaatattggtgaaacattgggagaaaaatggaaatcaagattgaatgcattaggcaagtctgagttccagatatacaagaaaagtggaatacaggaagtagacagaacactagcgaaagaagggatcaaaagaggcgaaaccgatcaccacgcggtcagcagaggaagtgcgaaacttagatggtttgtagaaaggaacatggttacgcccgagggaaaagtcgtagacctagggtgtggccgaggtggatggagttattattgtggagggctcaaaaacgttcgtgaagtaaaaggactaactaaaggtggaccaggtcatgaggaacccatcccaatgtccacatatggatggaacctagttcgattacaatccggcgtagacgtattctttattccacccgaaaaatgcgacacattactttgcgatatcggagaatcatcgcctaatcctacagttgaagctggaagaaccctaagagtgcttaatcttgtcgaaaattggctcaataataacactcaattttgtattaaagtgttaaatccgtatatgcccagtgtaatcgagaaaatggaggcgttacaacgtaaatatggaggggcattggttcgtaatcccctctcaagaaactctactcatgaaatgtattgggtttccaatgcatctggcaacatagtaagtagcgttaacatgatatcaagaatgcttattaataggtttactatgagacacaagaaggctacatatgaaccagacgtagacctagggtccggaacacgcaacataggtattgaatcggaaataccaaacctagatatcattggcaaaagaattgagaaaataaaacaggaacacgagacgtcatggcactatgatcaggatcacccatataagacttgggcttaccacgggtcttacgaaacaaaacaaacaggtagcgcatcgtcgatggtgaatggagtagttcgattgttaacgaaaccttgggatgttctcccaactgttacgcaaatggcaatgactgatacgacaccttttggacaacaaagggtttttaaggaaaaagtcgacacccgtacacaagaacccaaagaaggcaccaagaaactgatgaaaataacagctgagtggctctggaaagaactgggcaagaagaaaacccccaggatgtgcactcgtgaagagttcacaagaaaagtaaggagcaatgcagcattaggcgcaatttttacagatgaaaataaatggaaatcggcaagagaggcagtcgaagatagccgattttgggagcttgtagataaagaacgaaacctgcatttagaaggcaagtgtgaaacatgtgtatacaatatgatgggtaaaagagagaagaaactaggagaatttggtaaagcgaaaggatcgcgagctatctggtacatgtggctgggtgcccgtttccttgaatttgaagccctaggatttttaaacgaagaccattggttctcaagggaaaactcactatcaggtgtagaaggtgaaggcctgcataagttaggatacatactacgcgatgtatctaagaaagagggtggtgcaatgtacgcagatgacacagctgggtgggatacgcggattacactcgaagacctcaaaaatgaagaaatggtcacaaatcatatggaaggagagcacaagaaactggcggaggcgatcttcaaattaacctaccaaaataaagtagtaagagtccaaaggcctaccccacgaggcactgttatggacataattagtaggagagatcaacgaggatctgggcaagttggaacctatgggctcaacacgtttaccaacatggaggctcagctaatacgtcagatggaaggggagggcgtttttaaaaacatccagcaccttactgtaactgaagaagttgctgttcaaaattggctagcacgagttggcagagaacgtctaagccgaatggctataagtggagatgactgtgtagtgaaacccctcgacgaccgctttgcaaatgcacttacagccctaaatgatatgggtaagatacggaaagacatccaacaatgggaaccttcaaaaggatggaacgactggactcaagttccattttgttctcatcacttccatgagctgataatgaaagatggaagagtcttagttgtaccatgtcgtaaccaagatgagcttattgggcgtgcacgcataagccaaggagctggatggtcactaagagaaacagcatgtttaggaaaatcctacgctcaaatgtggtctctcatgtattttcatcgcagagacttaagactagcagctaatgcgatatgttctgctgtaccatcccattgggtaccaacatctcgaactacctggtcgatccacgcaaaacacgaatggatgacaacggaagatatgttaaccgtgtggaatagagtctggatacgagagaatccttggatggaagataaaacacccgttgagagctgggaggagattccatatcttggcaaaagagaagatcaatggtgtggaagcctgatcggattaactagcagggcaacatgggccaaaaatattcaagccgcgattaatcaggtaaggtcgctcattggaaatgaggaatacaccgattatatgccctctatgaaaagattccgacgcgaagaagaagaagccggtgtattgtggtaa

SEQ ID NO: 22510 - RNA, 9876 nt, synthetic construct
  misc_feature 1..9876: note = derived and/or modified CDS sequence (opt6) from DENV-2__FJ744714__SS-prME
  source 1..9876: mol_type = other RNA
agtgcggggatgatcattatgttgataccaactgttatggcattccatctgactacacggaacggagaaccccacatgattgtagggattcaagaaaaaggaaaatctttattatttaaaactgaagacggagttaacatgtgcactctgatggctatggacctaggagaactatgcgaagacacaattacatacaaatgtccactattgcgacaaaatgaaccagaagatattgattgttggtgtaattccaccagtacttgggtaacctacggaacgtgcacaacaacgggtgaacaccgaagagaaaaacggtctgtggcattagttccgcatgtgggaatgggactagaaacacgaactgaaacttggatgagctccgaaggtgcttggaaacacgctcaacgtatcgaaacgtggattcttagacacccagggtttacaataatggcggctatattagcatacaccatcgggacaacacatttccaaagagtactgatatttattctattaacggctgtcgcccccagtatgacaatgaggtgtataggaatctccaatcgagattttgttgaaggggtaagtggagggagctgggtagatattgtcttagaacatggctcttgtgtaacaacaatggccaaaaataaaccaacattagatttcgaactgataaaaacagaagccaaacaacccgcaaccctacgtaaatattgtattgaagcaaaattaacgaataccacgacggaaagcagatgccctactcaaggggaaccttcactcaaagaagaacaggacaaaaggttcgtctgtaaacacagcatggtcgatcgagggtggggcaatggttgcggcttatttgggaaaggtggtatcgtcacatgcgctatgttcacttgtaagaaaaacatggaaggaaaaattgtccaacccgaaaacttagagtacacaatcgtagtaacaccccatagcggagaagaacacgccgttggcaatgacacaggaaaacatgggaaagaaataaaagtaactccacagtcaagtataactgaagcagaattaacgggatatgggacagtaacgatggagtgtagtcccagaacaggactagactttaatgaaatggttttactgcaaatggaaaacaaggcttggcttgtacacagacaatggttcttagatctaccattaccttggcttccgggggctgataaacaagagtcgaattggatacaaaaagaaacacttgtaacgttcaaaaatccacatgcaaagaaacaggacgtagtggtgttgggatctcaagaaggagccatgcacacagcattaacaggagcaaccgaaatacagatgagtagtggaaacttactctttacaggtcatttgaagtgtcgattaagaatggataagttgcaattgaaaggtatgtcatatagtatgtgcacaggcaagtttaaagtagtaaaagagattgctgaaacacagcacggcactatagtgatcagagtacagtacgaaggagatgggtcgccgtgtaaaattccctttgaaatcatggaccttgagaaaagatacgtgttgggcaggttaattaccgtgaacccgattgtaaccgaaaaagacagtcctgtaaatattgaggcagaaccacctttcggcgatagttatataattataggcgtagaacctggtcaattaaaactcaactggttcaagaaaggtagttcgattggtcaaatgtttgaaacaacgatgcgtggagcaaagagaatggccatcttaggagatactgcttgggattttggaagcctaggtggagttttcactagcataggtaaagcattacatcaagtatttggtgcaatctacggagcagcattcagtggagttagttggacaatgaagattttaatcggggtcataataacctggataggaatgaatagtagatcaacttcactttccgttagccttgttcttgttggcattgtgacattgtatctcggcgtaatggtacaggccgattctggatgcgtcgtgagctggaaaaataaggaactaaagtgtggcagcggtattttcattaccgacaacgtccacacatggacggaacaatataaatttcaacccgaatcgccttcaaaattagcatccgcaatacaaaaagctcaagaagaaggcatatgtggcataaggtccgtcacccgattagagaatctgatgtggaagcagataactccagaattgaaccacatactggctgaaaatgaagtaaaattgacaataatgacgggcgacataaagggcataatgcaagcgggaaaacgaagcctcaggccacaacctactgaattgaaatactcatggaaaacctggggtaaagcgaagatgctgtcaacggagagctacaatcaaacgtttttaatagacgggcctgaaacagctgaatgccctaacactaatagagcctggaactccttggaggtggaagactatgggttcggtgtatttacgacgaacatatggttaaagttgaaagagaaacaagacgcattttgtgatagcaaattaatgagcgctgcaatcaaggataatcgtgctgtgcatgcagacatgggttattggattgaatcagcgctaaatgacacatggaagattgaaaaagcatcgtttattgaagttaaaaattgccactggccaaaatcacacactttatggtctaacggagtactagaaagtgaaatgataatacccaaaaatctagcgggaccagtaagccaacacaactaccgaccaggctaccatacacagatagctggaccctggcatcttggtaaactcgaaatggacttcgatttctgcgacggtacaacagtaatcgtcactgaggattgcggtaaccgcggtccaagtttgcgaaccacaacagcctcaggcaaattaataactgaatggtgttgcagatcatgcactttgccacccttacggtatcgtggtgaagacggctgttggtatggtatggaaattcgaccattaaaagaaaaagaagaaaatttggtgaacagcttagtaacagccggtcatggacaagttgataacttttctttgggcgtattaggaatggccctgtttctggaagaaatgttaagaacaagagtgggaacgaaacacgctattctactggtggcggttagctttgttacacttatcacgggaaacatgtcctttaaagacctcggtagagttgtggtaatggttggggctaccatggcagacgatatcgggatgggtgtcacatatctcgctcttttggctgcctttaaagttcgaccgaccttcgcagcagggcttttattaaggaagttgaccagcaaagagctgatgatgactactataggcatagttctattgagtcaatctactatccccgaaacggttctcgaactaaccgacgcccttgcccttggcatgatggtactaaaaatagtgcgcaacatggaaaaatatcaattagcggtaaccataatggctatcctatgtgtaccaaacgccgttatattgcagaacgcctggaaagtcagctgtacgatcttggcagtagtatccgtctctccactacttttaacttccagccaacagaaaactgactggatacctctagctctgacaattaaaggactcaaccccactgcaatattcttgactacattatctcgtacaaacaagaaaagatcctggccattaaacgaagcaataatggcagttggaatggtaagcatcctggcaagcagtttattgaaaaatgacattcctatgactgggcccttagtagccggaggactcctaacggtctgctacgtattaactggtcgaagtgcggatttagaattggaacgagctacggatgtgaaatgggaagatcaagcagaaataagtggaagtagtccaatactatcgatcacgatctctgaagacggatcaatgagtatcaaaaatgaagaagaagaacaaacactcactattctcatacgcaccgggctattagtaatttctggtttgttccccataagtattccaataacagcagcagcctggtatttatgggaggtaaagaaacaacgagcgggggtgctatgggacgtaccttcacccccgcctatgggaaaagcggaactggaagacggagcataccgtatcaagcagaaaagaatattagggtattcacaaataggtgcaggagtatataaagaaggtacattccacacgatgtggcatgtgactagaggtgcagtattaatgcataagggtaaaaggatagaaccatcatgggctgatgttaaaaaggatctaatttcgtacggaggaggatggaaactagaaggggaatggaaagaaggagaagaagtgcaggtcttggcactggagccaggaaagaacccgcgagctgtgcaaacaaaaccaggcttgttcaaaactaatacgggaacaataggtgctgtttcattagatttctcaccgggtacgtccggatcaccaataattgataagaaagggaaagtggtagggttatacggaaatggtgtagtcactaggtcaggagcatacgtgtcagccatagcccagacggagaaaagtatcgaagacaatccagagattgaagatgacatatttagaaaacgccgattaacgataatggacttacatcccggagcaggtaaaacaaaaagatatttgccagctatcgtacgtgaagcgattaaacgaggattaagaacattgatattagccccgacacgagttgtagcagcagaaatggaagaagccttacgaggtttacctattagatatcaaacccctgcaataagagccgaacatactggtagggaaatagtcgatttaatgtgtcatgccacattcacaatgaggttactatctcccgtaagggtaccaaactacaatcttatcataatggatgaagcacatttcacggatccggcatctattgcagctagaggctatataagcactcgagtagagatgggtgaggcagccggcatttttatgactgcaacgccacctggatcgcgtgatccatttccccaatccaatgcgccgatcatcgacgaagaaagggagatacctgaaagatcatggaacagcggacacgaatgggtgaccgactttaaaggcaaaacggtatggttcgtaccatctataaaagcaggcaacgacatcgcagcttgtctaaggaaaaacggcaagaaagtgatccagctaagtcgaaaaacatttgactcggaatatgtaaaaacaaggactaatgattgggattttgtcgtgacaactgatatatccgaaatgggggcaaactttaaagcagaacgagtgatagacccccgaagatgtatgaaacctgtcatattgaccgatggagaagaacgggttatattggcggggcctatgcctgtaacccattcaagtgctgcacaaagaagaggccgtataggaagaaaccccaaaaatgaaaatgaccaatacatctacatgggcgagcctctagagaacgacgaagactgcgcccattggaaggaagctaagatgctactggacaacatcaatacaccagaggggattatccctagcatgtttgagccagagagagagaaagttgatgccatagatggggaataccgactaagaggagaggcacggaaaacctttgtcgacttaatgaggagaggggatctgccagtatggcttgcttataaagttgctgcagaagggatcaattatgcagaccgaagatggtgtttcgatggaattaaaaataaccaaattctagaagaaaacgtagaggtcgaaatatggacaaaagagggggaacgaaagaaattaaaaccgagatggctagacgcaaggatatattccgatccacttgcgttaaaagaatttaaagagttcgcagcaggccgaaaaagtttaacgctaaatttaatcaccgaaatgggccgtttaccgacgttcatgacgcagaaaacacgcgatgcactggacaatctcgccgtcctccatacagcggaggctggagggagagcatacaatcacgccctaagtgaactaccagaaaccctggaaactcttcttttactaacgttactagccactgtaacaggaggaatatttttattcctcatgagtggaagaggaataggaaaaatgacgctaggaatgtgttgtataataacagcatcaatcctactatggtatgctcaaatacaaccccattggatagcggcctcaataatattagaatttttcctaatcgttctattaattccagaaccagaaaagcaaagaacaccccaagataaccaacttacctatgtagtaatagccatactgacagtcgtagctgcaacaatggcaaatgagatgggcttcttggagaaaaccaagaaagatctagggttagggtctattgccacccaacaaccggaatctaacatattagatatagacttacggcccgccagcgcgtggaccttatacgctgtggctacaacgtttgtaacgcctatgttacgacactcgatcgaaaattccagtgttaatgtctcattaacggcaatcgctaaccaagctacagtactaatgggtttagggaaaggatggccactatctaaaatggatataggcgttccattactagccattggctgttattcacaggttaatccaataactctcacagcagctttgttattattagtcgctcactatgctatcatagggccgggattacaagctaaagcaacgagggaagcgcaaaagagggcggccgcaggtataatgaaaaatcccactgttgacgggattacagtaatagacttggatcccatcccatatgatccaaaattcgagaaacagttgggacaggtaatgctacttatactctgtgtgacacaagtgttgatgatgcgaaccacatgggctctgtgcgaagcactcaccttagcaacggggcctatttctaccttatgggaaggcaaccccggtagattttggaatacaaccatagcggtatcaatggcaaacatatttaggggatcttatttagcaggggctgggctgcttttctcgataatgaagaacaccacaaatactcgaagaggaactggaaatataggagaaacgctaggagagaaatggaaatcaagattgaacgcattaggaaagtctgaatttcaaatttataagaaatcaggcattcaagaggtagaccgaacacttgctaaagaaggaatcaaacgaggagaaacagatcatcacgctgtgagccggggatcagcaaaattgagatggtttgtagaacgtaatatggtcactcctgaaggcaaagtcgtggatcttggttgcggtaggggcggatggagttactactgtggaggactcaagaatgtaagagaagtgaaagggctaaccaaaggaggtccaggacacgaggagcccattccaatgagtacatatggatggaacctagtcaggttgcaaagcggcgttgatgtatttttcataccaccggaaaaatgtgacacattattatgcgacataggcgaatcaagtcccaatcccacggtagaagcgggcagaactttgagagtccttaatctagttgaaaattggttaaacaataatacccaattttgtatcaaggtactaaacccatatatgccaagtgttatcgagaaaatggaagcgttacaacgaaaatacggaggagcgctagtacgcaacccgctctcaagaaacagtacacacgaaatgtactgggtatcaaacgcatcaggtaatatagtatcaagcgtaaacatgatctctagaatgttaattaacaggttcactatgagacataagaaagcaacctacgagcccgacgtcgatttaggaagcggaacccggaatatcggaatcgaatctgaagtccctaacctagacattataggaaaaagaatcgaaaagatcaaacaagaacatgaaacttcgtggcattacgaccaagaccacccttataaaacttgggcgtatcatggttcttacgaaacaaagcaaactgggtcagctagttcaatggttaacggggttgttcggctactgacaaagccatgggatgttttaccaactgttacccagatggcaatgactgatactacaccatttggacagcaacgtgttttcaaagaaaaagttgatacaagaacgcaagaaccaaaggaaggaaccaagaaactgatgaaaataacagctgaatggttatggaaagaactaggaaagaagaaaacaccaagaatgtgcacgcgagaagaatttacacgcaaagttagatctaatgccgctttaggggctatctttactgatgagaataaatggaaaagtgcaagagaagcagtagaagactctagattctgggaacttgtcgacaaagaaagaaatctgcatcttgaaggaaaatgtgaaacttgtgtatataacatgatgggtaagagagaaaagaagttaggagaatttgggaaggctaaaggcagccgcgccatatggtacatgtggctaggcgcacgctttctagaatttgaagccctcggcttccttaatgaagatcactggttctcgcgagaaaactcactctcgggcgtagagggagaaggattacacaaactgggttacatcctacgcgatgtctcgaagaaagaaggcggggcaatgtacgctgatgacactgctggatgggacacacgcattacattagaagatctgaagaatgaagaaatggtgacaaatcatatggaaggtgagcataagaaactagcagaagctatttttaaattgacataccaaaataaggtagttcgagtgcagaggcccacaccaagggggacagttatggacattatatccaggagagaccaaagaggaagcggacaagtagggacctacggtttaaacactttcactaacatggaagctcagcttatacgacaaatggaaggagagggggtatttaaaaatatccaacacctcacagtaacagaagaagttgctgtgcaaaattggctcgctagagtcggaagagaacgactaagtagaatggctatctcaggcgacgactgcgtggttaaaccacttgatgaccgatttgcaaatgctttaacagcgctaaacgatatgggtaagataagaaaggatatacaacagtgggaaccttccaaaggatggaatgattggactcaagtccccttttgttcacatcatttccacgaattgataatgaaagatggcagggtattagtcgttccttgtaggaatcaagatgaattaatagggagagcccgtatcagtcagggagctggctggagcttaagagaaacggcttgtctaggcaaatcttacgcacaaatgtggagcttgatgtatttccaccgtagggatttgcgcctagcagccaacgcaatatgcagtgctgttccatcccactgggtgccaacaagtagaacaacatggtcaatccatgcaaaacatgaatggatgaccacagaagacatgctaaccgtttggaatcgagtatggatacgggaaaatccctggatggaagacaaaacccccgtggaaagctgggaagaaataccctatctaggcaaacgagaagaccaatggtgcggttccttgatagggctcacctcacgggcgacgtgggccaaaaatatacaagcggcgatcaaccaagtaagaagtttgataggtaacgaggaatatacggattatatgccatccatgaaacgattcaggagagaagaagaagaagcaggggtactatggtaa

SEQ ID NO: 22511 - RNA, 9876 nt, synthetic construct
  misc_feature 1..9876: note = derived and/or modified CDS sequence (opt6) from DENV-2__FJ744716__SS-prME
  source 1..9876: mol_type = other RNA
agtgcaggaatgattataatgttgatccctacggtaatggcattccacttaacaacacggaatggagaaccgcacatgatagtcggtatacaagaaaaaggaaaatcactactattcaaaacggaagacggtgttaatatgtgcaccctaatggcgatggacttaggtgaactttgtgaagatacaataacgtacaaatgccccctattacggcaaaacgaaccagaagacattgattgctggtgtaatagtacctcaacctgggtaacctatggcacctgtactacaacaggtgaacaccgaagagagaaaagatcagtagcgttagtcccccacgttggcatgggactagaaacgagaactgaaacatggatgagttctgaaggtgcttggaaacatgcacaacggatcgaaacatggatattaagacatcctggattcacaatcatggcagcgatattagcttacacaattggcactacgcactttcaaagagtactaatcttcatactactaaccgcagttgcgccaagtatgactatgcgctgtataggaatatcaaaccgcgattttgttgaaggcgtttcaggaggatcgtgggttgatatagtcctggaacatggaagttgcgtgacaactatggctaaaaataaaccaacgttggacttcgaactgatcaaaacggaagcgaaacaaccggcaactttgagaaaatattgtatcgaagctaaactgacaaacaccacgactgagtcaagatgtccaacacaaggagaaccttcattaaaagaagaacaagataaacgctttgtatgcaaacacagcatggtagatagaggatggggcaacggatgcggtcttttcgggaaagggggcatagttacatgtgctatgtttacatgtaagaaaaatatggaaggaaaaattgttcaaccagagaatttagagtacacaatcgtggttacaccccattcaggtgaagaacacgcggtgggaaacgacaccggaaaacatggcaaagagataaaagtcactccacagtcgtcaattacggaggcagaattaacaggatatggtacagttactatggaatgttctcctagaacaggactggattttaatgaaatggttctactgcaaatggaaaataaggcttggctagtccatcggcaatggtttttggatctgccattaccttggttaccaggggctgataaacaagaatccaactggattcaaaaagagacactcgtgactttcaaaaacccacatgcgaagaaacaagatgtagtagtgctaggaagtcaagaaggggcaatgcacactgcactaacaggtgcaactgaaattcaaatgagctcaggaaacttgctgttcacgggacatctgaaatgtaggttaagaatggacaaactccaacttaaaggaatgtcctactcaatgtgtacaggaaaatttaaagtagtaaaagaaatagccgaaacacaacacggtaccatcgtcattagagtccaatatgaaggagacgggtctccttgcaaaataccttttgagataatggacttagaaaaacgatatgtacttggtagactaattacagttaatcctatagtcactgagaaggattcaccagtaaatatagaagcggagccaccctttggggactcgtatataatcataggggtagagccgggccaattaaaacttaattggttcaagaaaggatcgtctataggccaaatgtttgaaacaacaatgagaggagcaaaaaggatggctatcttaggcgacacggcctgggactttggtagtttgggaggtgtgttcacctcaataggaaaagccttacatcaggtatttggagcaatatatggagcagctttcagcggagtaagttggacaatgaaaattctgataggagtaataatcacatggataggcatgaatagtagatcaacttctctgagcgtcagtctagtcctagtgggaatagtgacattgtatttaggtgtaatggttcaagcggactctgggtgtgtagtgtcgtggaaaaataaagaacttaaatgcggatccggcatatttataactgacaacgtacatacatggacagagcagtataagttccaaccggagtcaccttctaaacttgcatcagccatacagaaagcacaggaagaaggcatatgtggaataagatctgtaactagacttgaaaacctaatgtggaaacaaatcaccccggaattgaatcatattctagcagaaaacgaggtcaaattaactataatgacaggagacataaaaggcataatgcaagcaggtaaacgaagcctacgcccacaaccaacagagctgaagtatagctggaagacttggggcaaagcgaagatgttatcgactgaatcatacaatcaaacatttcttatagacggcccggaaacggctgaatgtcctaacacgaacagggcatggaatagcttggaggtagaagattacggcttcggagtatttactaccaacatatggttaaaattaaaagaaaagcaggatgcattttgcgatagtaaactaatgagcgcggcgataaaagataaccgcgccgttcatgcagacatgggatactggatcgagtctgctttaaacgacacatggaaaatagaaaaggctagcttcatcgaagtcaaaaactgccactggcccaaaagccatacgctatggagcaatggagtactagaatccgaaatgattattcctaagaatctagcaggacccgtttcacaacacaattatcgaccaggctaccatacgcaaattgcgggcccttggcatctgggaaaactcgaaatggacttcgatttttgtgacgggaccacagtcatcgtcactgaagactgtggaaataggggacccagtttaaggactacaactgcatctggaaaactaataacggaatggtgttgccgaagttgtaccttaccacctttgcgctaccgaggcgaagatggctgctggtatggaatggagattcgtcccctgaaggaaaaagaagagaacctggtgaactcattggtaacggcaggtcatggtcaggtagacaacttcagtttgggtgtactcggcatggcattgtttttagaagaaatgttacgaactcgagtaggaaccaaacacgctatacttcttgtagcagtctctttcgttactctgataacgggaaacatgagttttaaagacttgggtagagtcgtagtaatggttggcgccacgatggcagacgacattgggatgggagttacatacctggcgttactagcggcttttaaagtgaggccgacatttgccgctggcctactattacggaaattaacaagtaaggaattaatgatgacaacaatcggtatagtgttattgtcacaatccacaataccggaaacagttcttgaactaacggatgctcttgcattaggaatgatggtcttaaagatcgttagaaatatggaaaaataccaactagcagttactataatggccatattgtgtgtcccaaatgcagtcatcctacagaatgcgtggaaagtctcttgcacaattctagcggttgtaagtgttagtcccttacttttgacatcaagtcaacagaaaactgactggataccccttgctctaaccatcaaaggtctaaacccgaccgctatttttctaacaactctttctcgcacaaataagaagagatcctggcctctaaacgaagcaattatggctgtaggcatggtttcaatactagcctctagtcttttaaagaatgacataccaatgacaggacccttagtagcgggaggacttttaacagtatgttacgtattaactggaagatccgcagatttagagcttgagagggcgaccgatgttaaatgggaagaccaggcagaaataagcgggtcaagtcctattctgtcgataacaataagtgaagacggcagcatgtcaatcaaaaatgaggaggaagaacaaacactaacaatcctgatccgcacaggcctattagtaattagcgggctgttcccaattagtatcccgataactgctgccgcctggtatttatgggaagtaaagaagcaaagagccggtgtactatgggacgttccatctccaccgcccatgggaaaagctgaactcgaagacggtgcgtacagaattaaacaaaaacgcatactaggttactcacaaattggtgcgggggtatataaagaagggactttccatacaatgtggcacgtaacgcgcggagccgtactaatgcacaaagggaaacgcatcgagccgtcgtgggctgacgtcaagaaagacttaattagctatggtggtggctggaaacttgagggagaatggaaagaaggtgaggaagttcaagtgttggcactcgagcctgggaagaatccaagggctgtccaaacaaaaccaggcctgtttaagacaaataccggtacgatcggagccgtaagtttagacttcagtcccgggacaagtggctcaccgataattgataagaaaggaaaagtagttggtctatacggcaatggagtcgttactagaagcggtgcgtacgtttcagcgattgctcagacggaaaaatctattgaagataacccagaaattgaggatgacatctttagaaaacgaagacttaccatcatggatcttcatcccggtgctggtaaaacaaaacgttacctacccgcaatagttcgggaggctatcaaacgaggacttagaacactgattctggccccgacccgcgtcgtggcagccgaaatggaagaggcattgcgaggattaccaataagataccagactccggctatacgtgcagaacacacgggtagagaaattgtcgatttgatgtgtcacgcaaccttcacaatgagattattaagcccagttagagtgccaaactacaatttaatcataatggacgaagcacattttactgatccggcctccattgcggcacgtggttacattagtacaagggtggaaatgggcgaagccgctggtatattcatgactgcaaccccgcccgggtcccgagacccattcccgcaatcaaatgcaccgataatcgacgaagaacgagaaattccggaaagatcatggaactcgggacatgaatgggtcactgactttaaaggaaaaaccgtctggttcgtcccttctattaaagccggaaatgacatcgcagcgtgccttaggaaaaatggtaagaaagttattcaattaagccgcaaaacgtttgattcggagtatgtcaaaacgagaacaaatgattgggattttgtggtaacgacagatatatcggaaatgggagctaattttaaagctgaaagggtaatcgatcctcgtcgttgcatgaaaccagtcatactaactgatggggaagaacgtgtgattctagcaggtcccatgccagttacccatagtagcgctgcacagaggcgaggtagaataggaagaaatcctaaaaatgaaaatgaccaatatatttatatgggtgaaccccttgaaaatgatgaagactgtgctcattggaaagaagcaaaaatgttactagacaatataaacacacccgaaggtataataccatctatgttcgaacctgagcgagaaaaagtagatgcgattgacggggaatatcgtttacggggagaagcaaggaagacattcgtggatctcatgaggagaggagatctacccgtatggttggcatataaagtagctgcggagggcataaactacgcagatagacgatggtgtttcgatggaatcaaaaacaatcaaatactcgaagaaaatgtagaagtcgaaatctggactaaagaaggggaaagaaagaaattaaaacccagatggttagatgcaagaatctattcagatcctttagcattgaaagagttcaaagagttcgctgccggtagaaaatccttaacgttaaatctcataacggaaatgggccgattgcctacatttatgacacagaaaacaagggatgctttagacaatttggcagtactcagaacagcggaagccggtggccgtgcttataatcacgcgttatctgaattaccagagacactggaaacgctattacttctaacactgcttgctacagttaccggcggtatatttctatttttaatgtctggaagaggaataggtaaaatgaccttaggtatgtgctgtataattacagcgtcgatacttctttggtacgcccaaatccaaccgcattggatagctgcttctatcatattagagttctttctaatagttcttttgattcccgagcccgagaagcaacgtacgcctcaagataatcaacttacctatgtggtgattgctattctcactgtcgtggctgcaacaatggctaacgagatgggatttcttgaaaagactaagaaagacttaggcttaggtagcatagcaacacagcaaccggaaagtaatatactcgatatagatttaagacctgcttcggcatggaccttatatgcggtcgcaactacttttgtcacaccgatgttacgacacagcatagaaaattcatctgtaaacgtcagtttgacggcgatagcaaaccaagcaactgtactaatgggactagggaaagggtggccattaagcaaaatggatataggtgtaccactcctagcgattgggtgttattcacaggtgaacccaataactttaacagcagcactattgctactggttgctcattacgccataatcggtccagggttacaagcgaaagcaacgagagaagctcagaaaagagcagcagccgggatcatgaaaaatcccactgtagatggaataacagttattgacttagatccaatcccgtacgatccaaaatttgaaaaacaacttggacaagtgatgttacttattttatgcgtaacgcaggtactcatgatgcgcacgacttgggcattatgtgaagctctcacgttggcgactggtccgattagtacactctgggaaggaaatccaggccgattttggaacactacaattgcagtcagtatggcaaacatatttagaggttcttatctcgccggtgcgggattactattttcaattatgaaaaacacaacaaatacgcgtagaggtactggaaacataggagaaactcttggcgaaaagtggaaatccagacttaacgccctaggcaaatcggaatttcaaatttacaagaaatccggaatccaggaggtggacagaacgctagcaaaagagggaattaaacgcggtgaaacggatcaccatgctgtatccagaggcagtgctaaattacgctggtttgtagaaagaaacatggttacacccgaaggtaaggtcgtcgacctcgggtgtggcagaggaggttggagttactactgtggagggctcaaaaatgtaagagaagtaaaaggtttaacgaaaggtggtcctggacatgaggagcccatcccaatgtcaacttacggctggaatcttgtgagactacaaagtggcgttgacgttttctttatacctccggagaaatgcgacaccctcctatgcgatattggtgaatcttcccctaatcccaccgttgaggcgggcaggacacttcgggtgctgaacctagttgagaattggctaaacaacaatacacagttctgtattaaagtacttaatccttatatgccttcagtgatcgagaaaatggaagcccttcaaagaaaatatggtggcgcacttgttcgaaaccctcttagtagaaactcaacacacgaaatgtattgggtttctaatgcatcaggaaatatcgtaagtagtgttaacatgatttcaaggatgcttataaaccgattcacaatgaggcataagaaagctacgtatgaacctgatgtcgaccttggatcaggaacacgaaatattgggatagagtcagaagtaccaaatttggacatcatcggaaaaaggatcgaaaagataaaacaagaacatgaaacaagttggcactatgaccaagaccatccatacaaaacttgggcatatcatggtagctacgagaccaaacagactgggagtgcttcgagcatggtaaacggagtcgtccggctattaactaaaccatgggatgtactcccaacagttactcaaatggcaatgacggacacaacgccatttggacaacaaagagtgttcaaagaaaaagtggacacccgaactcaagaaccaaaggaaggaacgaagaaattaatgaaaattacggcagaatggctatggaaagaattaggtaagaagaaaaccccacgaatgtgtactagggaagagttcacaagaaaggtaagaagcaacgccgcacttggagcgatattcacggatgaaaacaaatggaaatctgctagagaagctgtagaagatagtcgattctgggagcttgtagataaagagagaaacttacacttggagggaaaatgtgagacatgtgtctataatatgatgggcaaaagagaaaagaaacttggtgaatttggaaaagcgaaagggagcagggcaatatggtatatgtggctaggcgctcgattcttagagtttgaggcactcggctttctcaatgaagaccactggttttcacgagaaaatagtcttagtggagtagaaggagaaggattacataaacttggatatattttacgtgacgtgagcaagaaagaaggcggcgccatgtatgcagatgacaccgcaggttgggacacacgaataacattggaagacttgaaaaacgaggagatggtgacaaaccacatggaaggtgaacataagaaattagcagaagcgattttcaaactaacataccagaataaagtagtaagagtacaacgtcccacgccgcgcggcacagtcatggatataatcagcaggagagatcaaagaggatcagggcaggtaggaacctatggcctaaacacttttacaaacatggaagcccagctgataagacaaatggaaggtgaaggggtattcaaaaacattcagcacctgacagtcacagaagaggtggcagtccaaaattggttagcacgggtcggtagagaaagactaagtagaatggccatatcaggagatgattgcgtcgtaaaaccattagacgacagattcgcaaatgcactaacggccttaaacgatatgggaaagataagaaaagatattcaacaatgggaaccgtccaagggatggaatgactggactcaagttccattttgcagtcaccatttccacgaacttattatgaaagatggaagggtcttagtcgtcccctgtagaaatcaagacgaattaataggaagggccagaatcagtcagggagccggatggtccttaagggaaactgcttgcttggggaaatcatatgcgcaaatgtggagtctaatgtacttccataggagggacctacgactagcggcaaacgcaatttgtagtgccgtgccatcacattgggtcccaacaagtagaacaacatggtcaatacatgccaagcacgaatggatgactacagaagacatgctcacagtttggaatcgagtttggattcgagagaatccttggatggaagataaaacgccagtagaaagctgggaggagataccatacctaggaaaaagagaagatcaatggtgtggatctttaattggtttaaccagtagagcaacatgggccaaaaacattcaagcagcgatcaaccaagtaagaagtctaataggcaatgaagaatatacagactatatgccatctatgaaacgattccgcagagaagaggaggaagcaggagttttatggtga

SEQ ID NO: 22512 - RNA, 9876 nt, synthetic construct
  misc_feature 1..9876: note = derived and/or modified CDS sequence (opt6) from DENV-2__FJ744718__SS-prME
  source 1..9876: mol_type = other RNA
tcagctgggatgattataatgcttatccctactgtaatggcattccacctaactactaggaatggagaacctcatatgattgtgggaatacaagaaaaagggaaatcgttgcttttcaaaactgaggacggagtgaatatgtgcaccttaatggcgatggatctcggagaactgtgtgaagacactatcacatataaatgtccattattacgtcaaaatgaaccggaggacatagattgttggtgtaactccacaagcacatgggtaacatacgggacatgcacaacaacaggcgagcatcgacgagaaaaacgttccgttgcacttgtacctcacgtaggaatggggttggaaactcgaacggaaacgtggatgagtagtgaaggagcttggaaacatgcacaacgaatagaaacgtggatcttacgacatccaggctttactatcatggcagcaatcttagcatataccataggaactacgcattttcaacgtgtattaatctttatcttattgacagcagttgcaccgagtatgaccatgagatgcattggaatatctaaccgagactttgtagaaggcgtaagcggtgggtcgtgggtagacatcgtcctcgaacacggttcttgcgtaacaactatggcgaaaaacaaaccaacgttggattttgaattaataaaaacagaggcaaaacaaccggcaacgctaagaaaatattgcatagaagcaaaactcactaacactactactgagtctcgttgtccaacgcaaggagaaccttcgttgaaagaagaacaagataaacgctttgtgtgcaaacacagtatggtagatagaggatggggaaatggatgtgggctattcggcaaaggcgggattgttacctgtgcaatgttcacctgtaagaaaaatatggaaggtaaaatagtccaacctgaaaacctagaatacacaattgttgtgaccccacatagcggcgaggaacacgcagttggcaacgatacggggaaacacggaaaagaaataaaagtgactccacaatcaagcatcaccgaggcagaattgacaggatatgggactgttactatggaatgctcccccagaaccggtctagacttcaatgaaatggtattacttcaaatggaaaacaaagcgtggctggtccatcgacagtggttcttagacttgccattaccctggcttcccggtgcagataaacaagaatctaactggatacagaaggaaacattagtaactttcaaaaatcctcatgcaaagaaacaagatgttgttgtattgggcagtcaggaaggagccatgcatacagcgctgacaggtgcgaccgaaatacaaatgtcttccggtaaccttctgttcacaggtcacctaaaatgcaggctacgcatggataaattacagctaaaaggtatgtcttatagtatgtgtacaggaaaattcaaagtcgtcaaggagatagcagaaactcagcacggcacaatcgtcatccgagtacaatatgagggagacggatccccttgtaaaataccattcgaaataatggatttagaaaagcgatatgtgctaggtaggttaataacggtaaatccgatagttacagaaaaggattcacctgtaaatatcgaggcggaaccaccattcggagactcttacataataattggtgtagaaccaggccaacttaagttaaattggttcaaaaagggttcgtccataggacaaatgttcgaaacgacgatgagaggcgccaagagaatggccatcctaggtgatactgcgtgggactttggttcattaggtggagtattcacatcaatcggaaaggctctacatcaagtttttggagcaatatacggtgccgctttctccggggtatcctggacaatgaagatcttaattggagttataataacatggattggaatgaactcacgatcgacaagcctaagcgtcagcttggtcttagtgggaattgttacgttgtacctcggggtgatggtacaagctgacagtggttgtgttgttagctggaagaataaagaattaaagtgcgggtcgggaatctttataactgataacgtacatacttggactgaacagtataaatttcaaccggagtcccccagtaaattggcatcagcaatacaaaaagcgcaagaagaaggcatatgcggaatccgttctgtcaccagacttgaaaatctaatgtggaaacaaataactccagaattaaatcatatactagctgaaaatgaagtcaaattaacaataatgacaggagacataaaaggaattatgcaagctgggaaaagaagtttacgaccacaaccaacagaactgaagtactcgtggaaaacgtgggggaaagcaaaaatgttgtcaaccgaatcgtacaatcaaactttccttatagatgggcctgaaactgcagaatgtcccaatacaaatcgtgcatggaactctttggaagttgaagactatggctttggtgtatttacaacaaatatctggcttaaattaaaagagaaacaggacgcgttttgtgatagcaaattaatgtccgcggccattaaagataatagggcagtacacgctgatatgggttattggatagaatctgcgctaaatgatacttggaaaatagaaaaagccagctttattgaggtaaagaattgtcactggcctaaatctcatacgttatggtcaaacggtgtgctggaatctgaaatgattattcccaaaaatctagctgggccagttagccagcacaactacagaccggggtaccatacacaaatcgcaggaccttggcatctgggtaaactagaaatggattttgacttttgcgacgggacaaccgttatagttacggaggattgcgggaatagaggaccttcgctgaggaccacaaccgcgagtggcaaattgattacggagtggtgttgtcgaagctgtaccttgcctccattacgatatagaggagaagacggttgttggtacggcatggaaatacgcccgttaaaagaaaaagaagaaaatttagtcaatagtctcgttacagcgggacacggacaagttgataactttagcttaggagtcctaggtatggctttatttttggaagaaatgttacgtacaagagtgggcaccaaacacgcgatattacttgtagcggtaagtttcgtaactctaataacaggcaatatgagttttaaagatctaggccgagtagttgtgatggtgggagctacaatggccgacgatataggaatgggcgtgacatacttagcacttctggccgcatttaaagttcgtccaaccttcgctgctggactactgctaaggaaattaactagcaaagaattaatgatgacaacaataggcattgtattactcagtcagagcacgataccagaaactgtacttgaattaactgatgctttagctctcggaatgatggtacttaaaatagtacgaaacatggaaaaataccaactcgctgttaccatcatggcgattttgtgcgtcccaaatgcggttatactacaaaatgcatggaaagtaagttgtacaatccttgcagtcgtttcagtttctccacttctattgacgagtagtcagcagaaaactgactggattcctcttgcactcactataaaaggattaaatcctacggccatatttctaacgactttatcgagaacaaacaagaaaagatcttggccgttgaatgaggcaatcatggcggttggaatggtaagcatactggcaagcagcctacttaaaaatgatattccaatgacaggacctctggtagctgggggtcttctaacagtctgttatgttctaactggtagatccgcagatttagagttagaaagggcgacggatgtcaaatgggaagatcaagccgagatctcaggttcaagcccaattttgtcaattaccatatcggaagacggcagcatgagcatcaaaaatgaagaggaagaacaaacactcactattttaattcgtacagggttactggttataagcggtctttttccaatttcgattccgattactgctgcagcatggtatctctgggaagttaagaagcagagagctggtgtgctctgggatgtaccaagccctcctccaatgggaaaagctgaactggaagatggggcatatcgaatcaaacaaaagggtatactaggttactcacaaatcggtgcaggcgtatataaagagggaacattccatacaatgtggcacgtaacccgtggtgccgtgctaatgcataaaggaaaaaggattgagccatcgtgggccgatgttaagaaagacttaatatcatatgggggtggatggaaattggaaggggagtggaaggaaggcgaggaagtccaagtccttgcattagaacctggtaagaaccctagggccgtccagaccaaaccaggcctttttaaaactaatactggtactataggggctgtatccttagatttttctccaggaacatcaggatcccccattatagataagaaaggaaaagttgttggtctctatggaaacggtgtagtaacgcgttcaggcgcgtacgttagtgccatagcacaaactgaaaagagtattgaagataaccccgaaattgaagatgacatatttagaaaaagaagattgacaatcatggatcttcaccctggagctggaaaaacaaaacgatatcttccggcaatagtgcgtgaagccataaaacggggactgagaacgctaatcttagctccgacaagagtagtagctgcagaaatggaggaagcgttaaggggcctacccatacggtatcaaacacccgcgatcagagccgagcacaccggtagggagattgtagatctcatgtgtcatgcgacttttacaatgagactcctaagcccagttagggtacctaactataacctaattataatggatgaagctcatttcacagaccctgcttcaatagcagcaagaggatatatcagtactcgtgtagaaatgggcgaggctgcgggaatattcatgactgcgacaccgccaggatcgagagacccatttccgcaaagtaatgcacccattattgatgaagagagagagataccagagcgatcatggaatagtggacacgaatgggtaactgattttaagggaaaaacagtctggttcgtaccgtcgataaaagcaggtaacgatatagctgcctgcttacgtaaaaatggtaagaaagtgattcaattgagcagaaaaacttttgatagcgaatacgttaaaactagaacaaacgattgggactttgttgtaacaacggacatatcagaaatgggtgcaaactttaaggccgaaagggtaatagaccctcgacgttgcatgaaaccagtaatactaacagacggcgaagaacgcgttatactggccggtccgatgccagtgacccatagcagtgctgcgcaaaggcgcggaagaattggtcgcaatcccaaaaatgaaaatgatcagtatatatatatgggtgaaccattggaaaatgatgaagattgtgctcattggaaagaagcgaaaatgcttttggataacataaatacgcccgagggtatcattccaagcatgtttgaacctgaaagagaaaaagtcgacgcaatagacggcgaataccgtctaaggggagaagccagaaaaacattcgttgaccttatgcgacggggtgacttgccagtgtggttagcgtacaaagtggccgcagaaggtattaactacgctgatagaagatggtgtttcgacggtattaaaaataaccaaatactagaagaaaacgttgaagttgaaatatggaccaaagaaggagaaagaaagaaacttaaaccaaggtggttggatgcgagaatatatagtgacccactcgctctaaaggagtttaaagaatttgcagccggacgcaaatcacttaccttaaatctgataacggaaatgggcagattaccgactttcatgactcagaaaacgagagatgccctcgacaacctagccgtcttacatacagcagaggcaggaggcagagcatataaccacgctttgtcagaactaccagagacattggaaacattattacttcttaccttattagccacagtcacaggtggaatattcctatttctaatgagcggaagaggaatcggaaaaatgacactggggatgtgttgcataataacagcatccattctcctatggtatgctcaaattcagcctcactggatagcagccagcatcatcctggagttctttttgatagtattactaattcctgaaccggaaaagcaaagaacaccccaagacaaccaacttacgtacgttgttattgctattctaacagtagtagctgctacaatggcaaatgaaatggggttcttagaaaagacaaagaaagacttaggattaggttccatagcaacacaacaaccggaatcaaatatcctggatatcgatctgcgaccggctagcgcatggacgttgtacgcagtagctacaacatttgtaactccaatgctgaggcactcaattgaaaatagtagtgtaaacgtatccttgactgccatcgcaaaccaggcgacagtactcatgggattagggaagggatggccattgtcaaaaatggacattggggtcccgttactagccataggatgctatagtcaagtaaaccccattacattaactgcggcactattgctcttagtagctcactacgccattataggcccagggctgcaggctaaagcaaccagggaagcacagaaaagagcagcggctgggataatgaaaaatccaaccgtagacggaataacagtaatagacttagaccctattccatatgatccaaagtttgaaaagcagcttgggcaagtaatgcttcttattttatgcgtaacgcaagtattaatgatgcgaactacatgggcattgtgcgaagcgttaacgctggcgacaggaccaatatcaacattatgggaggggagtcctggtagattttggaacacaacgattgctgtaagtatggccaacatttttagaggcagttacctcgccggtgcgggtcttcttttctcgataatgaaaaacactactaatactcgccgaggtacagggaatattggggaaactctcggagaaaaatggaaaagtaggttgaatgcgttaggaaaatccgagttccaaatatacaaaaagagtggtatacaagaagtcgatcgaaccttggcaaaagaaggaattaaaagaggcgagacagaccaccacgctgttagtagaggttcagcaaaattgagatggtttgtagaacgaaatatggtaaccccagagggaaaagtagtagatcttggttgtggtcgcggtggatggtcgtactactgcggaggactaaagaatgtacgtgaagttaaaggcttaacaaaaggaggaccaggtcatgaggagccaatccccatgagcacgtatgggtggaatttagttaggcttcaatctggtgtcgatgtctttttcataccccctgaaaaatgtgatacactactctgcgatattggagaaagcagccctaacccaaccgtggaagctggaagaacacttcgagtgctaaatttagtagagaattggctcaataataacactcaattctgtatcaaagtcttaaacccttatatgccttctgtaattgagaaaatggaagcgttacaaaggaaatatggtggtgcgctagtcaggaaccctctctcgaggaactcgacccacgaaatgtattgggtatccaatgcttctggaaatatagtgagctcagttaacatgatatcacgtatgcttataaatagatttacaatgcgtcataaaaaggctacgtacgaaccggatgtagacttgggaagtggaaccaggaatatcggaattgaaagcgaagttcctaatctagacataataggtaaaagaatagagaaaataaaacaagaacatgaaacaagttggcattacgatcaagaccatccatacaaaacctgggcctatcatggaagttacgaaacaaaacaaactggaagtgcttcgtctatggtaaatggagtcgtacgcttattaaccaagccatgggatgttctaccaacggtcactcagatggccatgaccgacacgacgccatttggccaacaacgagtattcaaagaaaaagtcgatacacgaacccaagaaccgaaagaaggaacgaagaagctgatgaaaattacagctgaatggctctggaaagaattaggtaagaagaaaactccaagaatgtgtacacgagaagagtttacgagaaaggtcagatccaatgctgcgctcggcgcaatatttacggatgaaaataagtggaagagtgcacgcgaggcagtggaagatagtaggttctgggagttagttgacaaagaaaggaatttacatttagaggggaaatgcgagacatgtgtgtataacatgatgggcaaaagagagaagaaactcggagagttcggcaaggctaaggggtcacgggctatttggtatatgtggcttggtgccaggtttttagaatttgaagcattgggatttttaaacgaagaccattggttctcaagggagaacagtctaagtggagtagagggcgaaggactacataaattaggttatatactcagagacgttagtaaaaaggagggaggggcaatgtatgcggatgatactgccggatgggatacgcgtataacgttagaggacctgaaaaatgaagaaatggtaacaaaccatatggagggtgaacataagaaactagcagaagccatattcaaattaacgtatcaaaacaaggtggtacgagtgcaaagaccaacgccaagaggaacagtcatggacataattagtagaagagaccaacgcgggtctgggcaagttggaacgtatggacttaacacattcacgaacatggaggcgcaactcattagacaaatggagggggagggagtattcaaaaatatacaacatctgaccgtgaccgaagaagtcgctgtacaaaattggctggcaagagtgggtcgagagagattaagcagaatggctatcagcggagacgactgtgtagtaaaaccgcttgatgatcgtttcgccaatgccttaacagctctaaacgatatgggtaagatccgtaaagacatacagcaatgggagccatctaagggatggaatgattggactcaagtcccattttgttcacatcacttccacgaactaataatgaaggacgggagggtacttgttgttccttgtcgaaaccaggatgaattaattgggagggcgcgcatatcccagggtgcaggttggtctttaagggaaacagcatgcttaggaaaatcatacgcacaaatgtggtctttaatgtattttcaccgcagggatcttcgtttggccgctaacgctatatgttctgctgtcccttcacactgggtgcctacatctagaacaacctggtcgatccatgcaaagcatgaatggatgacgacagaagacatgctaacagtttggaaccgtgtatggatacgagagaacccgtggatggaagataaaactccagtagaatcatgggaagaaattccatacttggggaaacgtgaggaccaatggtgtggaagtttaataggactaacaagtagagctacatgggccaaaaatattcaagccgcaattaatcaagttagatcactaatcggtaatgaggaatatactgattatatgccctctatgaaacgttttcgacgagaagaagaggaagccggtgtattgtggtaa

SEQ ID NO: 22513 - RNA, 9876 nt, synthetic construct
  misc_feature 1..9876: note = derived and/or modified CDS sequence (opt6) from DENV-2__FJ744722__SS-prME
  source 1..9876: mol_type = other RNA
agcgtaggaatgataataatgctaataccgacggtcatggcatttcacctgacgactagaaacggagaaccgcatatgatcgtatcaatccaagaaaaaggaaaatcgcttttattcaaaactgaagatggagttaatatgtgtacattaatggcaatggatttaggagaactttgcgaagacactatcacgtataaatgtccacttttaaggcaaaacgaaccagaagatatcgattgttggtgcaatagcacctcaacctgggttacctacggtacctgcactactacaggagaacataggcgtgaaaaacgatcagtggcgctagtacctcacgtaggaatgggcttggaaacaagaacggaaacctggatgagctcagaaggagcttggaaacatgctcaaagaatcgaaacttggatactaagacatcctggtttcactatcatggcagctatactggcatatacaataggaacaacacactttcaacgtacgctaatcttcattcttctaacggcagtcgcaccatccatgacaatgagatgcatcggaatttccaacagagactttgttgaaggagtctctggaggcagttgggtggacatagtgcttgaacacggatcgtgtgttacaacaatggccaaaaataaacccactctggatttcgaattaatcaaaacagaggcgaaacagccagctacattaaggaaatactgtatagaagcaaaactaacaaatacaaccacagaatctagatgtccaacacaaggcgaaccgaatttaaaagaagaacaagacaaaagatttgtttgtaaacattccatggttgatcgaggatggggtaacggttgcggcttattcggaaagggtggtatagtaacatgcgcgatgtttacatgtaaaaagaatatggaaggaaaaatcgtccagccagaaaacttagagtataccatagtggttaccccgcattcaggcgaagaacacgctgtcgggaatgatactggtaaacacggaaaagagattaaagtaactcctcaatcttctataaccgaagcagaattaaccgggtatggcaccgtaaccatggaatgttcaccaagaactggactagatttcaatgagatggttttacttcaaatggaaaataaagcatggttagtacacagacaatggtttttagaccttcctcttccctggttgccaggtgctgacacacaaggatcaaattggatccagaaagagacattagttacatttaaaaaccctcacgccaagaaacaagatgtagttgtgctaggatcacaagaaggagcaatgcatacggccttaacaggagcgacagagatccagatgtcaagtggcaatcttttgttcaccggtcatctgaaatgtagactccgcatggacaaacttcaattaaaaggcatgagttatagtatgtgcacaggaaagttcaaagtagttaaagaaatcgcagagacacagcacgggacaatagtcatccgtgtacaatatgagggagacggttccccatgcaaaataccgtttgaaataatggatctcgagaagagatatgtcctaggaagattaattaccgtcaatccaatagtgacagaaaaagattctccagttaacatcgaagcagaacccccatttggggattcatatattatcataggagtcgaaccaggacaattgaaacttaattggtttaagaaaggatcgtctataggacagatgttcgaaacgaccatgcgaggagcaaaaagaatggcaattttaggtgacaccgcctgggactttggatcactaggaggtgttttcacatcaattggcaaggcgttgcatcaagtctttggagccatatatggagcggcttttagtggtgtttcatggacgatgaagatactaatcggagtaatcataacctggataggcatgaacagcagaagcacaagccttagtgtgtcattagttctagtaggagttgtaactttatacttaggagttatggtacaggcggattctggatgcgttgtatcatggaaaaacaaggaattaaaatgcggatctggaatattcataacagacaacgtccacacttggactgagcaatacaaatttcaaccagagtcacctagtaagttggcatctgcaattcaaaaggcacaagaggaaggaatatgcggtataagaagtgtcactagactcgaaaatctaatgtggaaacaaattacaccggaactaaatcacatcctagctgaaaacgaggtcaagttaacaataatgacaggagatattaaaggaataatgcaagctgggaaaaggtcattacgcccacagccaactgaacttaaatatagttggaaaacttggggaaaagcgaaaatgttatcgacagaatcgcataatcaaaccttcctaatagacgggccagagactgccgaatgtccaaatacgaatagagcatggaactctttagaagtagaagattacggctttggggtcttcaccactaacatatggttgaaattaaaagagaaacaagatgcattttgtgactctaaattaatgtctgcagctataaaagacaatagagccgtgcacgcggatatgggttattggatagagagcgcattaaatgacacttggaaaattgagaaagccagctttatagaggtcaaaaattgtcactggccgaaatcacacacgctatggtcaaatggtgtattggaaagcgaaatgatcatacccaagaacctggccggtccggttagtcaacataactatagaccaggctaccatacgcaaatagctggcccatggcatctagggaagctagaaatggacttcgatttttgtgacggaacaacagtggtagtcacggaagactgtggaaatagaggccctagcctcaggacaactacggctagtggaaaattaatcaccgaatggtgttgccgatcctgtactttacccccactaagataccgtggtgaggatggttgttggtatgggatggaaatacgcccattaaaggagaaagaagaaaatttggtcaactcacttgtaacagcgggccatggacaagttgataacttcagtttaggtgtacttggtatggctctatttttagaggaaatgctaagaacaagagttggcactaagcacgcaattcttctcgtggctgttagctttgtaacactaatcactggtaatatgtcctttaaagatctcggaagagtcgtagtgatggtaggtgctacgatgaccgatgacataggaatgggggtcacttatttagccctcctagcagcatttaaggtaaggccgacattcgctgctggcttattcttaaggaaattgacttccaaagaactcatgatgacaactataggaatagttttactctcccaatcaacaatcccagaaacgatattggaactaacagacgctcttgcactgggtatgatggttctaaaaatggtaagggatatggagaaataccaattggcagtcactataatggcgattctgtgcgtacccaatgcggtcattttacaaaacgcgtggaaagtatcttgtacaatactagctgtcgtcagcgtttcaccactacttctgacaagtagtcagcagaaaactgattggataccgctagctctaacaattaaagggctcaatccgacagcaatatttttaacgaccctgtcacgtactaataagaaaagaagttggccattaaacgaggctattatggcagtaggtatggtatcaatactcgcttcatctctacttaaaaatgacatacctatgacagggccgctagttgcaggaggactattaacggtttgttatgtgttaacaggtaggtctgcagatttggaacttgaaagagcaacagacgtaaagtgggaggaccaggcagaaatatctgggtcttccccaatcttatcgataaccataagtgaggacggttcaatgagtatcaaaaatgaggaagaagaacaaaccttaacaattttaattagaacggggcttcttgtgatctccggcttgttccccgtcagtataccaataactgccgccgcgtggtacctatgggaagttaagaaacaacgcgcgggagtgctatgggacgtcccgagtccaccaccaatggggaaagcagagctagaagatggtgcttacagaatcaaacaacgtggaatcctaggttatagccaaataggggctggtgtttacaaggaaggcactttccatactatgtggcacgtaacacgaggagcagtattgacgcataaaggaaaaagaatagaaccttcatgggccgatgttaagaaagacctgattagttacggcggtggttggaaattagaaggtgaatggaaagagggcgaagaagtacaggttctggcattagaacctggcaaaaatccacgagctgtacaaactaagcctggattatttaaaacaaatacagggacaataggtgctgtctcgctggactttagtccaggaacaagcgggagtcccattatagataaaaagggaaaggtagtgggcttatatggaaacggcgtagtgacaagatcaggggcctatgttagcgcaatagctcaaaccgagaaatcgatagaagacaatccagatattgaagacgacatattcagaaaacgtcgactgacaattatggacctacaccccggtgctggaaaaacaaagagatatttacccgcaatcgtgagggaagcaataaaaagaggtttaaggacactcattttagcacctacacgggtagttgcagccgagatggaagaagcacttagaggactaccaatacgctaccaaacccctgcaatacgggcagagcacacgggacgcgaaattgttgatctcatgtgccatgcgacattcacaatgcgactactatctcccgtcagagtgccgaactacaacttaattataatggatgaagcacacttcactgatcctgccagtatcgcagcccgcggctatatttccacacgtgttgagatgggtgaggcggcagggatttttatgactgccacacccccgggaagcagagacccgttcccacagagtaacgcacctataatcgacgaggagcgagaaatacctgaacgatcatggaacagtggtcatgaatgggtgacagattttaaagggaagactgtttggtttgttccatcaataaaagcaggtaacgatatcgcagcatgtcttaggaaaaatggtaagaaagtaattcaactatcgcgaaagacgttcgacagcgaatatgtaaagacaaggactaacgattgggatttcgtagtcactacagatatatccgagatgggcgcaaatttcaaagctgagagggtaatcgaccctcgaaggtgtatgaagccagtaatattaaccgatggtgaagaaagagtcatacttgccggaccaatgccagtaacccactcctcggccgcccagagaagaggaagaataggcaggaatccgaaaaacgaaaatgaccaatatatctatatgggagagccacttgaaaatgacgaagactgcgcccattggaaagaagcaaaaatgctacttgataatatcaatactcccgaaggtattattccatcaatgttcgaaccagaaagagaaaaggttgatgcgattgacggagagtaccgcttacgaggagaagctagaaaaacatttgtagacttgatgagacgaggtgatttaccagtctggctagcatacaaagtggcagctgaagggattaattacgcagaccgacgctggtgtttcgatgggatcaaaaacaaccaaatactagaagaaaacgttgaggtcgaaatttggacgaaagaaggggagaggaaaaagttaaaaccaagatggttggacgcaagaatatactcagatccattagcgttaaaggagttcaaagagttcgctgctggacgcaaatctctcacgttaaacttaataactgagatgggtcgattgcccacatttatgacccagaagacaagggatgcattggacaacctggcagtattacacacggccgaagctggcggtagagcatacaaccatgctttatctgaattaccagaaacactcgaaacgctattattgcttacactgttagcgacagttacaggaggaattttcctgtttcttatgtctgggcgcggaataggaaaaatgactcttggaatgtgttgcatagtaacagcaagtatactactatggtacgcgcaaattcagccccactggatagcagccagcataatcctggaatttttcctaatagtgctcctaatcccggaaccagaaaagcaaaggactccgcaggataaccaattgacatatgttgtaatagctatcctgacagtcgttgctgcaaccatggctaacgaaatgggatttctcgagaagaccaaaaaggatctagggctcgggagcatagcaacgcaacagccagaatctaatatattagatattgatcttaggccggcaagcgcgtggactctttatgcagtcgccacaacattcgtcacacctatgcttcgtcacagtatagaaaactcatcggttaacgtaagtttaactgctattgcgaatcaggctactgtgttaatgggtcttggaaaagggtggcccttatcaaaaatggacataggtgctccactgctagcaataggttgttactcccaagtaaatcctataacattgacagcggcacttttactattagtagcacactacgcaataataggtcctggactacaagcaaaagcgacacgtgaagcccaaaagagagcagctgcaggaattatgaaaaatccaacggtcgacggaataacagttattgacctagacccaatcccttatgacccgaaatttgaaaaacaactcggacaagtcatgctcctagttctctgtgtaactcaggttttaatgatgcgtacaacttgggcactttgcgaggctttgacgctagcaacaggtcctataagtacattatgggagggaaatccaggaagattttggaatacgacgattgcggtgtctatggctaatatatttcggggatcataccttgcaggagcgggactgttattcagtataatgaaaaatacaacaaacagcagacgtggaaccggtaatatcggagaaacactcggggaaaaatggaaaagtcgacttaatgctttaggtaaatcagagttccagatatacaagaaaagtgggatccaagaagttgatagaaccctcgctaaggagggaatcaagcgaggtgagacagatcatcatgctgtaagtagaggcagcgcaaaactacgatggtttgtagaacgtaatatggttaccccagaaggaaaagttgtcgaccttggttgtggcagaggaggttggtcttattattgtggcgggcttaagaacgtaagggaagttaagggattgacgaaagggggacccggacacgaagaaccaatcccaatgtcgacgtatggatggaacctggttagactgcaaagcggggttgatgtgttctttattcccccagaaaagtgtgatacacttttatgtgatatcggagaaagttccccaaacccaacagtagaggcaggtagaacacttcgtgtgctgaacttagtagaaaactggctaaataataacacccagttctgcatcaaggtcctcaatccttatatgcctagcgttatagagaaaatggaaaccttgcaacgcaagtatggcggcgctctagtaagaaatcccctttcgaggaacagcacacacgagatgtattgggtaagtaatgcaagcggcaatattgtctcaagcgtgaatatgatttctcggatgctaattaacagattcactatgagacacaagaaagccacatatgaaccagatgttgacctcggatcaggaacacgcaacatagggatagaatcagaaattccaaatttagacataatcgggaaacgcatagagaaaattaaacaagaacatgaaacatcatggcattatgatcaagaccatccgtacaaaacgtgggcctatcatgggtcttatgaaacaaaacaaaccggatcagcgagttctatggtgaacggagtagttcgcctactcacaaagccctgggacgtccttccaactgtaacacagatggcaatgactgacacaacccctttcggccaacagagagtttttaaagaaaaggtggacacccgaactcaagaaccaaaagaaggtacgaagaaattaatgaaaattacagcagaatggttatggaaagagttaggcaagaagaaaacacctcgaatgtgtacacgtgaagaatttacacgcaaagtaaggtcaaatgcagccctaggtgctatatttacagacgaaaacaaatggaaatcagctagagaagcagtcgaggacagtcgtttttgggagttagtggataaggaacgcaacctccatttagaaggaaaatgcgagacatgtgtatacaacatgatgggtaaacgcgagaagaaattgggagaatttgggaaagcaaaaggatctcgcgccatatggtatatgtggctgggtgcaagattccttgaatttgaggcattaggattcctaaacgaagatcactggttctcgagggaaaatagtttgtcgggagtagaaggagagggactgcatagactagggtacattctacgagatgtatcaaagaaagaaggtggggctatgtatgcggatgatacagcaggctgggataccagaataacgcttgaggacctcaaaaacgaagaaatggttactaatcacatggaaggcgagcacaagaaattagcagaagctattttcaaattaacatatcaaaataaagtagtaagggtccagagacctactccaagagggacagttatggatataatctcacgtcgagatcaacgcggatccggtcaagtgggaacgtatggtttaaacacctttaccaatatggaagcccaattgatacgacaaatggagggtgaaggagtgttcaaaaatatacagcatttaactgtaacagaagagattgctgtacaaaactggttggctcgagtgggacgagagcgattaagtagaatggcaatctcgggcgacgattgcgttgtaaaacctcttgatgatagattcgcatccgccctgactgctctgaatgacatgggcaaaatacgtaaggatatacagcagtgggaacccagcagaggctggaatgattggacacaagtcccattttgttcacatcatttccacgaacttattatgaaagatggccgagtccttgtagttccctgtcggaatcaagacgaattaattgggcgcgccagaataagtcaaggcgcaggatggtcattacgggaaacagcgtgcctcgggaagagttatgcgcaaatgtggtctctcatgtacttccacagaagggacttacgactagctgcaaatgctatatgcagcgcagtcccctcccattgggtccctacatctcgtacgacttggtcaattcatgccaaacatgagtggatgaccaccgaagatatgcttactgtgtggaatagagtatggatccaagaaaacccttggatggaggataagacaccagtagaatcgtgggaagaaattccatacttgggtaaaagagaggaccaatggtgcggttccttgatcggactgacatcgagagcaacgtgggctaaaaatatacaagtagcgataaatcaagttcggtcactaataggtaatgaagagtatacagattatatgccgagtatgaaaagattcaggcgtgaagaagaagaagcgggagtattgtggtag

SEQ ID NO: 22514 - RNA, 9876 nt, synthetic construct
  misc_feature 1..9876: note = derived and/or modified CDS sequence (opt6) from DENV-2__FJ744723__SS-prME
  source 1..9876: mol_type = other RNA
agcgtaggcatgattataatgctaatacctacagtcatggcattccatctgacgacccggaacggtgaacctcacatgatagtctcaattcaggaaaaaggtaaaagcctactttttaaaaccgaagacggtgttaatatgtgcacactaatggcaatggatttaggtgaattatgcgaagacacaataacatacaaatgcccactattaaggcagaatgaacccgaagatattgattgttggtgtaatagcacttccacgtgggtgacttacggcacgtgtactactactggagaacatagacgagagaaacgaagcgttgctttagtaccccatgtagggatgggattggaaacgcgaacagaaacatggatgtcttcagaaggtgcttggaaacatgcacaacgaatagaaacctggatattgcgtcatcccggattcacaattatggctgcgatactcgcgtacacaataggaacgacacattttcagaggacacttatatttattctattgactgcagtagcgccttctatgacaatgagatgcatcggcataagtaatcgtgactttgtagaaggtgtctcaggaggatcttgggtagacattgtacttgaacatggatcctgcgtaactactatggctaaaaataaaccaacgctcgattttgaactaattaaaacagaagcaaaacaaccggcaacgttaagaaaatactgtatagaagcaaaacttaccaacactacaacagaatctagatgtcccactcaaggagaaccttctctaaaagaggaacaagacaaaagatttgtctgtaaacattcgatggtagatcgtggatggggaaacggttgcggactatttggaaaaggtggaatagtaacatgcgcaatgttcacatgtaaaaagaacatggaaggcaaaatcgtacagcctgaaaacctagaatatactatagtggtaacaccccacagtggtgaagaacacgcggtagggaatgatactggaaaacatggaaaagaaatcaaagtaacaccccaatccagcatcaccgaagctgaactaacaggatacggaactgttactatggaatgtagtccacgtacgggtctagatttcaatgagatggttcttctacaaatggagaataaagcatggctagtgcaccgacaatggtttctagatcttcctttaccctggcttccgggcgctgacactcaaggatctaactggatacaaaaagagaccttagtaacattcaaaaacccccatgccaagaaacaggatgttgttgtgttaggatcacaggaaggggctatgcatactgcattgaccggagcaacagaaatacaaatgtcgtctggaaatctgttattcacaggacatttaaaatgtcgcctccgaatggacaaactacaacttaaaggaatgagctacagtatgtgcacgggaaaatttaaggtagtgaaagaaatagcagagactcaacatggaacaatcgtgattcgggtacaatacgaaggtgacggatccccatgtaaaattccattcgaaataatggatctagaaaaacgttatgtactaggaaggctcataacggttaaccctatagttacagaaaaagatagtccagtgaacattgaagcagaacctccattcggtgattcatatatcatcataggagtagaacctggacaactaaagttaaactggtttaaaaagggatcttcaataggacaaatgttcgaaactaccatgcgaggtgcaaaacggatggcgatactcggagatactgcttgggactttggttctttaggtggagtgtttacaagcataggtaaagcgctgcatcaggtattcggcgctatttatggcgcagcttttagcggtgtaagctggacaatgaaaatcttaataggagtcatcataacatggatcggaatgaactcaagatcaaccagcctcagcgtatccttagtcctggtgggagtggtaactttatatctaggtgtgatggtacaggcggactctggatgcgtagtatcatggaaaaacaaggagttaaagtgtggctcaggcatttttataacggataatgtacatacttggaccgaacaatataaatttcagcctgaaagtccttctaaactggcatcagcaatacagaaagcacaggaagaaggaatctgtggtattcgttcagtgacgagattggaaaatttaatgtggaaacaaattactccggagttgaatcatattttggctgaaaacgaagtgaaactaacaataatgacaggagatatcaagggtataatgcaggcaggaaaaagatcgctgcgcccacaaccgacagaactcaagtatagctggaagacatggggcaaagcaaaaatgcttagcactgagagccacaatcaaacctttctgatcgatggacctgaaaccgcggaatgccctaacaccaaccgggcatggaactctctcgaagtagaggattacggctttggagtctttacaaccaacatatggctaaagttaaaagaaaaacaagacgcattctgtgactcaaaactcatgtcggcagcaatcaaagacaacagagcagtgcacgcagacatgggctattggatcgaatcagccttaaacgatacatggaaaatagaaaaggcaagtttcatcgaagttaagaactgtcattggcccaaatcccatacattatggtcaaacggagtgttggaaagcgaaatgataatacccaaaaatctggctggtcccgtaagccagcacaactaccgacccggatatcatactcaaatagctgggccatggcatttaggaaaactcgaaatggactttgatttttgtgacggaacgacagtcgtggttactgaagattgcggcaacaggggcccttcactacgtacaactacagctagcggaaagctcatcacagagtggtgttgcagaagctgtacattgccacctttaaggtatagaggggaagacggttgttggtacggcatggaaattagacctttgaaggaaaaagaagaaaatttagttaatagtcttgtgactgcagggcatggacaagttgataatttctcattaggagttcttggaatggcattgtttcttgaagaaatgttacgcactcgcgtaggtaccaaacacgctatactacttgtagcggtatcatttgtaactttaattacgggaaacatgtcattcaaagacctgggtcgagttgttgtaatggtaggtgctacaatgaccgatgacataggcatgggagtcacctatctagcgcttcttgcggcgttcaaggtgagacctacgtttgcagcaggactctttcttaggaaattaacttctaaagaattgatgatgacaactataggaatcgttttactgtcgcaatcaaccattccggaaacaatcttagaattaactgatgcattggcacttggaatgatggttttaaagatggtaagggatatggaaaagtatcaactagcagttactattatggcaatactatgcgtgccaaacgcggtcatattgcaaaatgcttggaaagttagctgcacaattctagctgtggtatcagtcagccccttacttttaacatcatctcagcaaaagactgactggataccattggctttgaccataaaaggtctcaacccaacagcaatatttttaactacgctatctaggacgaataagaaaaggtcctggcccttaaacgaagcgataatggcagttggcatggttagtattcttgctagttccttactgaaaaacgacatacctatgacaggtcctttagtggctgggggtttgctaactgtatgttatgtcttaacgggaagaagcgcagacttggaactagaaagagcaactgatgtcaagtgggaagaccaagcggaaataagtggttcaagccccattttatccataaccatatcagaggacggttcgatgtcaatcaaaaacgaggaagaagaacagacacttacaatattgatacgaacagggcttctagttatatctggactctttccagtaagtataccaataacagcagcggcctggtatctatgggaagtcaagaaacaaagagcaggagttctctgggacgtaccatcgccgccacccatgggaaaagcagaattggaggatggagcttatcgtattaaacaacgagggattctaggttattcacaaatcggggcgggagtgtataaagagggcacattccatacaatgtggcacgtaacgcgaggggctgtattaacccataaaggcaaaagaattgagcccagctgggctgatgtcaagaaagatctaatttcctatggaggcggttggaaattagaaggtgaatggaaagaaggggaagaagtacaagtattggctttggaaccaggcaaaaatcctcgagcagttcaaacgaagcctgggctattcaagactaataccggaacaataggtgcagtatctcttgacttttcaccaggaacatcagggagccctattattgacaagaagggaaaggtcgtggggttgtacggtaatggcgtagtgacacggagcggagcctatgtaagtgccattgcccaaactgagaaaagtatagaagataatccagacatagaagatgatatttttaggaaacggcggttaacgatcatggatctccatccaggggcgggcaaaactaagagatatttaccagctattgtaagagaggcaataaaacgaggtttaaggacacttatattagccccaacacgtgtagtcgcggctgaaatggaagaagcattacgcgggttacccatccgatatcaaacaccagcaatacgcgccgagcacaccggccgcgaaattgtagacttaatgtgccacgcgacattcactatgagattgctatcaccagtcagagttccgaattacaacttgataatcatggacgaggcccacttcacggatccagcaagtatagccgcaagaggttatatatcaacccgagttgaaatgggtgaggctgcaggaatcttcatgaccgctaccccaccaggtagccgggatcccttcccccaatctaacgcaccgatcatcgatgaggaaagagaaatacctgaacgctcatggaactccggacatgaatgggtcactgattttaaaggaaaaacagtctggttcgtccctagtattaaggctggcaatgacatagcagcttgccttaggaagaacggcaagaaagtaatacagcttagtagaaaaactttcgacagcgaatacgttaaaactcgaactaatgactgggactttgttgtaacaactgacatcagtgaaatgggagcaaacttcaaagcagaacgtgtgattgatcctcgacgttgcatgaagccagtcattctcacagacggcgaagaaagagtaatcctggctggacctatgcccgtaactcatagctcagccgcacaaaggcgaggaagaattggcaggaatcctaaaaatgaaaatgatcaatatatatatatgggagagccgctcgaaaatgatgaagattgtgctcattggaaggaggcgaaaatgttattggacaacataaacacacccgagggcataataccaagtatgtttgaacctgagcgggaaaaggtagatgccatagacggagaatatcgattacggggcgaagcacggaagacttttgtggatctcatgcggagaggagacttaccagtttggctagcatataaggtagcggctgagggaataaattatgctgatagaaggtggtgttttgacggaattaagaataatcaaatcttggaagagaacgtagaagttgaaatatggacgaaagaaggagagagaaagaaactaaaaccacggtggctagatgcacgaatatacagcgatccgcttgccttaaaagaatttaaagaatttgccgctggtcggaagtcactaacccttaatttaatcacagagatgggcagactaccaacgtttatgactcagaagaccagggatgcactagacaatcttgctgtactgcataccgcggaagccggtggtagagcatataatcacgcattatctgaactcccggaaacgctagaaacgttattattacttaccttattagctacagtaactggtgggatcttcttgttcctaatgtctggccggggaattgggaagatgacactaggtatgtgttgcattgtaacagcatctatcttattgtggtatgctcaaatacagccacattggattgcagctagcataatattggaatttttcttgatcgtacttttaatacctgaacctgaaaagcaaagaacaccccaagacaaccaattgacgtatgtggttatagccattttaaccgtcgttgctgctacaatggcaaatgaaatgggcttcttggagaaaaccaaaaaggatttaggactagggagtattgcaacacaacaaccggaaagtaacatactcgacattgatctacgaccagccagcgcatggacattatatgctgtggcgactactttcgtgaccccaatgttgaggcatagtatagaaaatagctctgtaaacgttagcctaacagcaattgctaaccaagcaacagtgctaatgggattaggaaaaggatggccattaagtaagatggacattggtgcacctttattagcaataggttgttacagtcaggtaaatcctattactttaacagctgcacttttgcttctggtagcacactatgccataattggaccaggcttacaagctaaagcaacaagagaagcacagaaacgagccgctgccggaatcatgaagaacccaacagtggacgggataactgttatagatcttgatcctataccatatgaccccaaattcgaaaaacagttaggacaagttatgttgttagtcttatgcgtaacgcaggtacttatgatgcggactacctgggcgctttgtgaagccttaactctggctaccggaccaatttcgacattgtgggaaggaaatcctggaagattttggaataccacaatagcagtatcaatggctaacatattcagagggagttatttagctggtgctggcctgttattcagtattatgaaaaacaccactaatagtagaagaggaacaggaaatattggagagactctaggtgaaaaatggaaatcgcgattaaacgcattggggaaatccgagttccaaatttacaagaaatctggaatacaagaagtggacagaactttagccaaagagggaataaaacgaggtgaaacggaccatcacgccgtatcgcgcggaagtgcgaaattaagatggtttgtagagaggaatatggtaacacctgaaggcaaagttgtagacttaggttgcggtagaggaggatggtcttattattgtggcgggctcaaaaatgtacgggaggtaaaaggattaactaaaggtggccctggtcacgaggaaccaattcccatgagtacgtacggatggaatttagtaagactacaatcaggagtggatgtattctttatccctcctgaaaagtgtgataccttactttgcgacataggagaaagctcaccgaatccaactgtagaagcaggaagaacattgagggtacttaatcttgttgaaaattggctaaataataacacgcagttttgtattaaagtattaaatccatacatgccatctgtcatagagaaaatggaaacactacaacgtaagtacggaggagcgctggttaggaatcctttatcacgtaattcaactcatgagatgtactgggtgtctaatgcgagtggcaatatagtttcatctgtaaatatgattagtcgaatgctaattaatagattcaccatgaggcataagaaagccacatacgagccggatgtagatttagggagtggtacacgaaacattggaatagaatcggaaataccgaatttggatattattgggaaacgtatagagaaaattaaacaagaacatgaaacttcctggcactatgaccaagatcacccctataaaacctgggcgtatcatggctcctacgaaacaaaacaaacaggaagcgcatcgtcgatggtaaatggagttgttagactactaacaaaaccgtgggacgtacttccaacagtaacacaaatggcgatgacggatactacaccctttggacaacaacgtgtcttcaaggaaaaagtggatacacgcactcaggaacccaaagaaggtactaagaaactgatgaaaattaccgcagagtggctatggaaagaattaggtaagaagaaaaccccacgaatgtgcactagggaagagttcacacgaaaagttcgctctaacgcagcactcggcgcaatttttacagacgagaataaatggaaaagcgcgagagaagcagtagaagattctcgattttgggagctagtagataaagaacgaaacttacatctcgagggcaaatgtgaaacttgtgtatacaacatgatgggaaaacgggagaagaaactaggagagttcggcaaagcaaaaggttctagagctatatggtacatgtggctaggcgcaagatttttagagttcgaggctctaggatttttaaatgaagatcattggttcagtagagaaaattcactgtcaggtgttgaaggagaaggtttacaccgattgggttacatattgagagacgtgagtaagaaagaaggaggggccatgtacgctgatgacactgctggctgggatactagaatcacactagaagacctcaaaaacgaagagatggtcactaaccacatggagggtgaacataagaaattagcggaggcaatatttaaattaacgtaccaaaacaaggtagtaagagtccaacggccaacacctagaggtacggtcatggatatcatttcgagacgtgaccaaagaggatccggacaagttgggacttatggactaaacacttttactaatatggaagcgcagttaataagacagatggaaggtgaaggcgtctttaaaaacatccagcacttaaccgtcaccgaggaaaccgccgtgcaaaattggttagcacgagttggccgggaacgactaagtcgaatggcaatatctggagatgactgcgttgtaaagcctctagacgatcgctttgcctccgccctaacggcccttaacgatatgggaaaaataagaaaagatattcaacagtgggaaccatcccgaggatggaatgactggacacaagtacctttttgttcccatcactttcacgagctaataatgaaggacggtagggtccttgtggttccatgtcgaaaccaagacgaattaatcgggcgagcacgcatcagccaaggcgcgggatggtcgcttcgggagaccgcctgtctcgggaaatcctacgctcaaatgtggtcattaatgtattttcacaggcgcgatcttagattagctgctaatgcgatatgtagcgcggtacccagccattgggtaccaacatcacggacaacctggtcgatacacgcaaaacatgaatggatgaccacagaagatatgttaactgtatggaatagagtttggattcaggaaaatccatggatggaggataaaacgcccgtcgagtcatgggaagaaattccttatctgggaaagagggaagatcaatggtgcggaagtttaatagggttaacatctagggctacctgggctaaaaatattcaagtagccatcaaccaagttaggagcttaattggtaatgaagaatacacagactacatgccgagtatgaaaaggtttagaagagaggaagaggaagcaggagtattatggtag

SEQ ID NO: 22515 - RNA, 9876 nt, synthetic construct
  misc_feature 1..9876: note = derived and/or modified CDS sequence (opt6) from DENV-2__FJ744724__SS-prME
  source 1..9876: mol_type = other RNA
agtgcaggtatgattatcatgctaataccaacagtaatggcgttccatttaacaacacgcaatggagaaccacacatgatcgtaggaatacaagaaaaaggaaaaagtcttcttttcaaaaccgaagacggtgtaaatatgtgcacgctaatggcgatggacttgggagaattatgtgaagatacaataacctataaatgtccgttactgagacaaaatgaaccagaagacattgattgttggtgtaacagcacaagcacatgggttacgtatggaacatgcacaaccacaggagagcacaggagagagaaaagatctgtagcgttagttcctcacgtaggaatgggattagaaaccagaacggaaacatggatgtcaagcgaaggagcctggaaacatgctcaacgtatcgaaacttggatccttcgacatccaggatttacgataatggctgcaatcttagcatacacaatagggactacccattttcaaagagtcttgatatttattttgttaacagccgttgctccgtcaatgacaatgcgatgcatcggaatctcaaaccgagacttcgttgaaggagtttcgggaggatcatgggtggatatagtactagaacatggaagttgcgtcacaacaatggccaaaaacaaacctaccttagatttcgaattgatcaaaaccgaagcaaaacagcctgcaaccttgcgtaaatactgcatagaggcgaaacttaccaatacaacaactgaaagcagatgcccaacacaaggagagccatcattaaaagaagaacaagataaaagattcgtttgtaaacattccatcgtcgatagaggatggggcaatgggtgcggacttttcggtaaaggaggaatagtaacatgtgccatgtttacgtgcaagaaaaacatggaagggaaaatagttcagccagaaaatttagaatatacgattgtcgtaaccccacacagcggggaagaacacgcggttggcaatgatacaggaaaacacggaaaagaaattaaagttacgcctcagagctcagtaactgaggcagaacttacaggttatggcacggtcacaatggaatgttcgccaagaaccggattagattttaacgaaatggtcttattacaaatggaaaacaaagcctggctagtccataggcaatggtttctagacctccctcttccatggctacctggagcggataaacaagaaagcaattggattcaaaaagaaactctggtaacatttaaaaatccgcacgcaaagaaacaagatgtcgttgtattaggtagccaagaaggagccatgcatactgctctgacaggagctacagagattcaaatgtcaagtggcaatcttctatttacaggtcaccttaaatgcagattacgaatggacaaattacagttaaaaggaatgtcctattccatgtgtacgggaaaatttaaagttgtaaaagaaatagcagagacacagcatggaacaatcgttatacgcgtccaatacgagggtgacggatcaccctgcaaaatcccattcgagataatggacctagaaaaacgatacgtcctgggaagactcataacagtaaatccaatcgtgacagagaaagactctccagtgaacatagaagcagaaccgcccttcggggatagttacataataataggagtagaacccggacaattaaaacttaattggtttaagaaaggatcatctataggccaaatgttcgaaaccacaatgcgaggtgcgaaacgtatggccattctaggtgatacggcctgggatttcggttcgttagggggagtattcacgtcaattgggaaagcccttcatcaagtttttggagccatttatggagctgctttctcaggtgtttcttggactatgaaaatcttaatcggagtgataattacatggattggtatgaacagtagatcaaccagcctaagcgtatcattagtattagtcggaattgtgacactataccttggagtaatggtacaagccgattccgggtgtgtagtatcatggaaaaataaagagcttaaatgcgggtcaggaattttcataactgacaatgtacacacttggacagagcagtacaaattccaaccagaaagtccctcgaaattagctagtgctattcaaaaagctcaagaagaaggtatctgtggtattcgctccgtaactagactggaaaacctaatgtggaaacaaattacgccagaactaaatcacattctagcagaaaacgaagtaaaactaactattatgactggtgatataaaaggaataatgcaagctggaaaacgaagtttaagacctcagccaaccgaattaaaatactcatggaaaacctggggaaaagcgaaaatgctatctaccgaaagttacaatcaaactttcctaatcgatggacccgaaacagcagagtgccctaatacaaatcgagcctggaacagcttggaagtagaagattacggttttggagtcttcactacaaatatttggttaaaattaaaagaaaaacaagatgcattttgcgattcgaagttgatgtcggccgctatcaaggataaccgagccgtacatgccgacatgggatattggatagaaagtgcactgaatgatacctggaagattgaaaaagcatccttcattgaagtcaagaattgtcattggccaaagagccacacactatggtcaaacggagtgttagaatctgaaatgataatacctaagaatctcgcagggccagtctcgcaacataattataggcccggttatcatacccaaatagcaggaccatggcatctcggcaaacttgaaatggactttgacttttgcgatggtacaacggtagttgtcactgaggattgtggaaaccgtggaccatcactgcggacaaccactgcttcgggcaaacttattactgaatggtgttgtagaagttgtacgctacctcctttacgttaccgaggtgaagatggctgttggtatggaatggaaatacgacctttaaaggagaaagaggagaatttagtaaattcattagtaacagcgggccatggtcagatcgataactttagcctgggggtgctaggaatggcgttattcctcgaagagatgctcagaacaagagtaggcaccaagcatgccatacttttggttgcagttagttttgtcacacttataaccggcaatatgagttttaaagatttaggaagagtagtagtgatggtaggagccacaatggcagacgacataggcatgggggtaacatatctggcacttttagcggcttttaaagttcgccctacattcgcagcaggattactattacggaaacttacatcaaaagaactgatgatgacgacaataggtatagtgcttctctcacagagtacaattccggaaacagttttagagttgacagacgccttagctttaggcatgatggtcttaaaaatagtacgagacatggaaaaataccaattagcggttaccatcatggcgatactatgtgtccccaatgctgttatattacaaaatgcgtggaaagtatcatgtacaatactagcggtagtaagtgttagtccactccttttaacaagttcacagcagaaaactgattggataccactagctttgaccatcaaaggcttaaatccaacagctatcttccttacaacattgtcccgaactaataagaaacgctcgtggccgctaaatgaagcaattatggcagtaggaatggtgtcgatcctggcatcaagtctactcaagaatgacatcccaatgacaggacccttagtggcaggcggtctgctcacagtgtgctatgtactaacaggacgaagcgcagatcttgaactcgagagagcgacggacgttaaatgggaagatcaagctgaaattagcgggtcctccccaatattatctataacaataagtgaggatggaagtatgagtataaagaatgaagaggaagaacaaacactaacgatactcattcgaacgggactgttagtaatatccggtttattccctatctcaatcccaataacggccgcggcctggtatttgtgggaggtgaagaaacaaagagcaggagtactctgggatgtacctagcccgccaccgatggggaaagctgaattagaagatggggcgtacagaattaaacaaaagggaatcctcggatacagtcaaattggagcgggtgtttacaaggaaggaacattccataccatgtggcatgtaacaagaggagctgtgctaatgcacaagggtaagcgaatagaacccagttgggcagatgtcaagaaagatctgatatcatatggaggaggttggaaactagaaggcgaatggaaggagggtgaagaggtccaagttctagctctagagccgggcaaaaatccccgtgccgtccaaacaaaaccaggtctatttaaaacaaacacgggaacaataggagcagtcagcttagactttagcccaggtaccagtgggtcccctatcattgataagaaaggaaaagtagtcggattatacggtaacggggttgttaccagatcaggagcatacgtatccgctatagcccagacagaaaagtcaatcgaggataacccagaaatagaagacgatattttccgcaagaggcgactgacaatcatggatctgcatcctggagcgggaaaaacaaaacgatatttacccgcaattgttcgtgaagcaataaagcggggattaagaaccctgattctagccccaacacgtgtggttgctgcagagatggaggaagcacttcgaggtttaccaataagataccaaacaccagcaataagagctgaacatacaggtcgcgaaattgtcgatttaatgtgtcacgctacatttaccatgagattattaagcccagtcagagtgcctaattataacttaataataatggatgaggctcactttacggatccagcatctatagctgcaaggggatatatatccaccagggtcgaaatgggggaagcggcaggcattttcatgacagctacaccgcctggttcgagagacccatttccacaaagcaatgcgccaataatcgacgaagaacgagaaatcccagagcgttcgtggaatagcggtcatgaatgggttactgatttcaagggtaagacggtttggttcgtgccgtccattaaagccgggaacgacattgctgcctgcctacggaaaaatggtaagaaagttatacagttatccagaaaaacctttgattcagaatatgtgaaaacaagaacaaacgattgggattttgtggtgactacagatatctcagaaatgggagcaaattttaaggcagaaagagtcatagacccaagacgttgcatgaaacccgtcatactaaccgatggagaagaacgagtcatattagcaggcccaatgccggtcactcattcatcagccgcacaaagacgaggacggataggacgaaaccccaaaaacgaaaatgaccaatatatttatatgggagaaccgctggagaatgatgaagattgtgcccattggaaggaagctaaaatgttacttgataatataaataccccggaaggcataataccgtcgatgtttgaaccggaacgcgaaaaagtagacgctatagatggcgaatacagactaagaggagaagcaagaaagaccttcgtcgatttaatgagaagaggcgacctaccagtgtggttggcctataaagttgccgctgaaggaattaattacgcggaccgaagatggtgctttgacggaataaagaacaaccagatcttggaagaaaatgtggaagtcgaaatttggacgaaagaaggcgaacgcaaaaagctgaaaccgcgttggctcgatgcaagaatctattcagaccccctagctcttaaggaatttaaggaatttgcagctggaagaaagagtctaactttaaatctcataacagaaatgggaaggttgcctacgttcatgactcagaaaacaagagatgcgctagacaatcttgcagttctacacactgcagaagccggaggaagggcctataatcatgcattatcggaactcccggagactctagagacgctactcttacttacacttttggcgaccgtaacagggggtatctttctatttttaatgagcggaagaggtatagggaaaatgaccttagggatgtgttgtataattaccgcaagcattttattatggtacgcgcaaatccaacctcattggattgcagcatcaattatacttgagttctttttaatcgtccttttaatacctgaacccgagaaacagcgtacacctcaggacaatcagttgacttacgtagtcatcgctattctgacagtagttgctgcaactatggcaaatgaaatgggatttctagagaaaaccaagaaagacctaggtctaggttcaatcgctactcaacaacctgaatctaatattcttgatattgaccttcgtcccgcttcggcctggacgctatacgcagttgcaacaactttcgtaacacctatgcttagacacagcatagaaaactcatctgtaaacgtatcacttacagctatagccaaccaagctacggtattaatggggctgggtaaggggtggccactgtcaaagatggacataggtgtgcctttactagctattggttgctattcccaagttaacccaataacattgacagcggcgttattactacttgtcgctcattacgcaatcataggtccaggattacaggccaaggctacacgtgaagcacaaaaacgagcggctgctggaattatgaagaatccaaccgtcgatgggattactgtaatagaccttgacccgatcccatatgatcctaagtttgagaaacaattagggcaagtcatgctattaatattgtgtgtcacgcaagtgctgatgatgcgaacaacctgggcactgtgtgaagcccttacactagctacgggaccaatttccacattatgggagggtaatccaggtagattttggaacaccactatcgcagtatccatggcaaatattttcaggggaagctatctcgccggtgcagggttactattctccataatgaaaaatacgacaaacacaagacgaggcacaggtaatattggagaaacgttaggtgaaaaatggaaatcaagattgaatgcattaggaaaaagtgagtttcaaatatacaagaaatctggcatacaagaagtagatagaacacttgcgaaagaaggaataaaaagaggcgaaactgatcatcatgctgtaagccgaggatctgctaagttaaggtggtttgtcgaacgaaatatggtcaccccagaaggaaaagtggtggatctcggatgtggacgtggcggatggtcatattattgtggagggttgaaaaatgtccgtgaagtcaaaggtctaaccaagggtggacctggacatgaagaaccgataccgatgtctacatacggatggaacttagtacgccttcagtcaggagtggacgtattctttatacctccggaaaagtgtgacactcttttatgtgatattggtgagagttcgccaaatccaacagttgaagcaggtcgaacattgcgagtattgaacttggttgagaactggctaaataacaacactcaattctgtataaaagtcttaaatccatatatgccatcagttattgaaaagatggaggcactacaacgtaaatatggtggtgctcttgtaagaaaccctttatctcggaactcaacgcatgaaatgtactgggtgtcgaatgcaagtggtaatatcgttagctcagtcaatatgatatcaagaatgctcattaatcgattcacgatgagacacaagaaagcaacatacgaaccggacgttgatctcgggtcgggaaccaggaacatagggattgaatcagaagtacctaaccttgatattataggaaagcggatagaaaagataaaacaagaacacgaaacctcatggcactatgatcaagaccacccttacaaaacatgggcgtaccatgggtcctatgagacaaaacagacgggctcagcaagcagtatggtaaacggtgttgtacggctcctaacaaaaccttgggatgtattacctaccgtaacacaaatggctatgacagatacaacgccatttggacagcaaagagttttcaaagaaaaggttgataccaggacgcaagaaccaaaagaaggaaccaagaaactaatgaaaattacagcagaatggctatggaaagaacttggcaagaagaaaaccccgaggatgtgtacacgcgaagaatttacccgaaaagtacgcagtaacgctgctttgggagccattttcactgatgagaacaagtggaaatccgcgagggaagcagtagaagacagccgtttttgggagcttgttgataaagaacgaaacttgcatctcgaaggtaaatgcgaaacctgtgtgtataacatgatgggaaaacgtgagaagaaactaggggaatttggaaaagccaaagggagtagagccatatggtatatgtggctaggagcgcgatttttagaatttgaggctttaggcttcctaaatgaagaccattggttctcacgtgaaaattccctttcgggtgtcgaaggagagggcttacataagctcggatacattttgcgcgatgtaagcaagaaagaaggaggtgcaatgtatgctgatgacactgcaggatgggatactagaataacactagaggaccttaaaaatgaagaaatggtaactaatcatatggaaggagagcataagaaactagcggaagccatatttaagctaacttatcaaaataaggtcgtgcgagttcagcgtcccacgccacgtggcacagtcatggacataataagtagaagagatcaacgtggatctggtcaagtaggcacctatggattaaacactttcaccaatatggaagcccaacttatacgacaaatggaaggagaaggggtgttcaaaaatatccaacacttaacagtaaccgaagaagtcgctgttcagaattggttagcgcgcgtcggtcgagaaagactttcacgtatggccatctcaggagacgattgcgttgtcaaaccactcgatgatagatttgccaatgcattaacagcactaaatgatatgggtaagatccggaaggacatacaacagtgggaaccctctaaaggttggaacgattggacacaggttccattttgttcgcatcactttcatgagttaattatgaaggatggaagagttttagtagtaccatgtcgaaatcaagatgaacttatcggtcgagcaagaataagtcaaggggcgggttggagcctcagggaaacagcgtgtctaggaaaaagctacgcacaaatgtggtctctaatgtactttcatcgtcgagacttaaggcttgccgctaacgcgatatgctcagctgtgcctagccattgggtacccactagcaggactacatggagtattcatgctaaacatgaatggatgactactgaagatatgctaacggtttggaacagagtttggatccgagagaacccttggatggaggataagactccggtcgaaagttgggaagagatcccgtacttaggaaagagagaagatcaatggtgtggatccctaataggccttacaagtcgggctacctgggctaagaacatccaaacagccataaaccaagttagaagtttaattggtaacgaagagtataccgactatatgccatcgatgaagaggttcaggcgtgaggaggaggaggcaggcgttctatggtga

SEQ ID NO: 22516 - RNA, 9876 nt, synthetic construct
  misc_feature 1..9876: note = derived and/or modified CDS sequence (opt6) from DENV-2__FJ906957__SS-prME
  source 1..9876: mol_type = other RNA
tcggcagggatgataattatgttaataccgaccgtaatggcatttcatctgacgacaagaaatggagaaccacatatgatagtttcaatccaagaaaaaggaaaatctttactatttaaaaccgaagatggagtaaacatgtgtacattgatggctatggacttgggagaattatgtgaagacacaattacatataaatgcccactcctaagacaaaatgaaccagaagatattgactgttggtgtaactcaacctcaacgtgggttacgtatggtacttgcaccacaacaggagaacacagaagagaaaaacgatcggtggcgcttgtaccccacgtaggaatgggtctagaaaccagaacagaaacctggatgtcaagtgaaggagcatggaaacatgcacaaaggatagaaacttggattctacgtcacccaggattcactatcatggcagcaatactggcatacacgataggaacaacccatttccaaagagccctaatcttcattcttctaacagccgtagcaccgtccatgacaatgagatgtataggaatatctaaccgggatttcgttgaaggcgtgagtggcggtagctgggtggacatcgtgcttgaacatggttcatgcgtaacaacaatggctaaaaataagcctacattagactttgaactgattaagacagaagcaaaacaacctgcaacactaaggaaatattgcatcgaagctaaattaactaatacgacaaccgaatcaaggtgccccacacaaggtgaacctagtctgaaagaagaacaagacaaacggttcgtatgtaaacacagtatggtagatagggggtggggaaatggatgtggattgtttgggaaaggtggaattgtaacatgcgcaatgtttacctgtaagaaaaatatggaaggaaaaatagttcaacctgaaaatctcgaatacaccatagtagttacccctcattccggggaggagcatgccgtaggcaacgacaccggaaaacatggaaaggaaatcaaagtcacaccacaaagtagtataacggaagctgaactaacgggttacggaacagtaacgatggaatgttctcctagaacaggcctcgatttcaatgaaatggtactacttcaaatggaaaacaaggcgtggctggtacatcgacaatggtttttagacttacctttgccctggctgccaggcgctgataagcaaggatcaaattggatacaaaaagaaacattagtaacctttaaaaatccacacgccaagaaacaagatgtggtagtacttggcagtcaagaaggcgcaatgcataccgcgctaacaggtgctaccgaaatccaaatgtcatctgggaatctactattcacaggacatctaaagtgtagactacgtatggacaagctacagcttaagggtatgtcatattcaatgtgtacaggaaagttcaaggtggtaaaagaaatagcagagactcagcatgggacgatagttatcagagtacaatatgagggggatggaagtccctgcaaaattccattcgaaattatggacctagagaagagatacgtactaggccgtctaatcaccgttaatcccatagtgaccgaaaaggattctcctgtaaacatagaagctgaaccaccttttggagattcttatatcatcattggagtagaaccaggtcaacttaaactaaactggtttaaaaaggggtccagtataggacagatgttcgaaacgacaatgaggggtgctaaaagaatggctatattaggggacactgcttgggattttggaagtctagggggagttttcacaagtatcgggaaagcgttacaccaggtattcggtgctatctacggggcagcttttagcggagtgtcatggactatgaaaatcctgataggagttattataacctggataggaatgaatagtcgatcaacgagcctatcggtgagtctcgtacttgtaggaatagtaacgttatacctaggagtaatggtgcaggctgattcagggtgcgtagtttcttggaaaaacaaggagctaaagtgcgggagtggaatattcattactgacaatgttcatacatggacagaacaatataaatttcaacccgagagtccatctaaacttgcatctgcaattcaaaaggctcaagaagaaggaatctgcggaatacgaagtgtaacgaggctagaaaacctgatgtggaaacaaataactccagaattaaaccatatactagccgaaaatgaagtaaaacttacgataatgacaggtgacatcaaaggaattatgcaggctggcaaacgatctttaagaccacaaccgacagagctgaaatacagctggaaaacctggggtaaagcaaagatgctttctacagagtctcataaccaaacatttctaattgatggcccagagactgcagaatgccccaacacgaatcgagcatggaactctctcgaagtcgaggattatggatttggtgttttcaccaccaatatttggctaaaattaaaagagaaacaagatgcattttgtgatagtaagttaatgagtgcagctatcaaggacaatcgggcagttcatgccgatatgggatactggatagaatcggcattgaatgatacttggaaaatagagaaggccagctttattgaggttaaaaactgtcactggccaaaatcgcacaccctatggtcaaatggagtattagaaagtgaaatgataatccctaaaaaccttgcaggtccggtaagtcaacataattacagacccgggtaccacacacagatcgctggaccgtggcatctaggtaaattagaaatggatttcgatttctgcgacggtacaacagtagtagttacagaagattgtggaaatcggggcccgtcactacgaacgacaacagcgtcaggaaaattgataaccgaatggtgctgcagatcatgcaccttaccaccattgagataccgaggtgaggatggatgttggtacggaatggaaattcgaccgcttaaggaaaaagaggaaaacttagtgaacagcctagtaactgcagggcatggacaggtagacaacttcagcctgggagtactaggcatggcactgttcctagaagaaatgctaaggactcgcgtgggaaccaaacacgcgatactactcgtggcagccagcttcgtcacattgattacagggaacatgtccttcaaagatttgggacgtgtagtagtaatggtcggggccacgatgaccgacgatataggtatgggcgtaacttatttagcactcttagctgcatttaaggtacgtccaacattcgcagccggcttactactgcggaagctaacatcaaaagaactgatgatgactacaataggaatagtgttattatcgcaatcaaccattcctgaaacaatattggaacttactgacgccttagccctaggcatgatggttcttaaaatagtgagaaatatggaaaaataccaattagcagttacgatcatggctatcttatgcgtgccaaacgctgttatactacaaaatgcatggaaagtgagttgtactattcttgcggttgttagtgtctcacccctcctgttgacaagttcccaacagaaaacagattggatccctctcgcactcactatcaaagggttaaatcctacggcaatctttctaactactttaagccgcacaaataaaaagagaagttggcctttgaacgaagcaataatggccgtaggaatggtctccatattagcatcttcattactgaaaaatgatatcccaatgaccggtccccttgtcgcaggaggtttactcactgtttgttatgtacttacaggacgaagtgctgacctggagctggaaagagcgacagatgtaaaatgggaagaccaagccgaaatatcaggatcatcacctatactgtcaataacaatcagcgaagatggatcaatgtcaataaagaatgaagaagaagaacaaacacttactatactaattagaacaggcttgctagtaataagtgggttatttcccgtatctataccgatcactgccgcagcgtggtatttatgggaggtaaagaaacagagagccggagtgctctgggacgttcctagcccacctcccatgggaaaagcggaattggaagacggagcatatagaatcaaacagaaaggcatcctaggatatagtcaaatcggagcaggagtctacaaagaaggtacattccacacaatgtggcatgtcactcgtggggcagttttaatgcacaaaggtaaaagaattgaaccctcatgggccgatgtcaagaaagatcttataagttatggaggagggtggaaactggaaggtgaatggaaagagggtgaagaagtccaggtcctagcactagaacccgggaaaaatccaagggctgtacaaacaaaaccaggactctttaaaacaaacactggaaccatcggagctgtctcattagatttttccccgggtacgtctggatcccccattatagacaagaaagggaaagtcgtcggtctatatgggaacggggtagttacgagaagtggggcatacgtttctgcaatagcgcaaacagagaaaagtattgaagataaccctgaaattgaagatgatatctttagaaaaagaagattaacaataatggatttacatccaggcgccgggaaaactaagcgttatcttccagccattgtaagagaagctataaaacggggactaagaaccctgatcctggctcctacacgggtagttgcagcagaaatggaagaagcactacggggcttacctataagatatcaaactccagccataagagcagaacatacaggacgagagatagtagatctgatgtgtcatgcgacttttacaatgagactgctctcacccgtcagggtaccaaactataatctgatcataatggatgaagcgcactttacggatcccgcgtctattgcagcgcgcggttacatttcaacaagagttgaaatgggtgaagcagctggaatttttatgaccgcaacacctcccggttctagagatcctttcccacaatcaaacgcaccaataattgacgaggaacgcgagataccggaaaggtcttggaactcaggacatgaatgggtaacagattttaaaggaaagaccgtatggtttgttcctagtataaaagcaggcaatgatatagcggcatgcttgcgtaaaaatggtaagaaagtaattcaattatctagaaaaactttcgactcggagtatgtaaaaacaagaactaatgattgggatttcgttgttaccacggacatttctgaaatgggcgctaactttaaagctgaaagggttattgacccccgacgttgtatgaagcccgtcatactgaccgacggtgaggaacgggtgatactagccgggccaatgcctgttacacacagttcagctgctcaaagacgtggtcgtattggccgaaatcccaaaaacgagaatgatcagtatatatatatgggagaaccactagaaaacgacgaagactgtgctcattggaaagaggctaaaatgttgctagataacattaatacgcctgaaggcataataccttccatgttcgaaccagaacgcgaaaaagtagacgcgatagacggagaataccggctacgtggtgaagcacgcaaaacattcgtggacttaatgcgtcgtggcgatctcccagtttggcttgcatataaagtggctgcagagggtataaactacgcagaccgaagatggtgttttgatgggattaaaaataaccagatcctagaagagaacgttgaagttgaaatatggacaaaagaaggagagcgaaagaaattaaaaccacgttggctagacgcaagaatttatagtgatcctctggcattaaaagaatttaaagaatttgccgcgggcagaaaaagtctgacgttgaacttaatcaccgaaatgggtcgactaccaacctttatgacccagaaaacccgagatgctctggacaacctggcagttttacataccgcagaagctggagggcgcgcttataaccatgcactatccgaactacctgagacattagagaccctattgcttttaacattattagcaaccgtaacaggtggtatttttctctttcttatgagtgggcgcggcattgggaaaatgacgctaggcatgtgctgcatcataacagcgtcaatattactatggtatgcacagatccaaccacattggatagccgcatcgattatcttagaatttttccttatagtgttactaatacctgagccagaaaaacaaagaactccccaagataaccaactaacttatgtagtgatagcgatattgacagtagtagctgcaaccatggcaaacgaaatgggatttctagagaaaacgaagaaagacctaggattagggagtatagcaactcaacagcccgaatccaatatcctagatatagatctaagaccggcgtctgcatggactctttacgctgttgcgaccacatttgtaactcctatgctgaggcactcaatcgaaaactcatctgtgaatgttagcctcacagctattgcaaaccaggcaacagtgcttatgggtttaggaaaaggatggccactaagcaaaatggatataggagtgcctttgttagcgattggatgctatagtcaggtaaatcctattacactgacagcagcccttctgctcctagtagcccattatgctataataggtcccggcctacaagcaaaagcgacacgggaagcacagaaaagagcagcagcagggattatgaagaacccgacggtcgatgggataactgtcatagacctggacccgattccatatgacccaaaatttgaaaaacaacttggtcaagtgatgttacttattctttgtgttactcaagtcttaatgatgagaaccacatgggctttgtgtgaggctttaacactagctactggacctatatcaacactttgggaaggtaatccaggaagattttggaacacaacaatagcagtaagtatggcaaatatattccgcggtagttacctggctggcgctggacttctattctctataatgaaaaacaccacaaacacacgtcgcggtactggtaatataggggaaacattaggtgaaaaatggaaaagccgattgaatgctcttggtaaaagcgaatttcaaatatataaaaagagcggtatccaagaagttgaccgaacgctggctaaggagggaattaaaaggggtgaaactgaccatcatgcagtttcaagaggatctgccaagctccgttggtttgtagagcggaacatggtcacgcctgaagggaaggttgtcgacctaggttgtggaagaggtggttggagctattactgcggtggacttaagaatgtaagagaagtaaaaggtctaacgaaaggtggaccgggacatgaagaaccgataccaatgtctacttacgggtggaatttagtgaggttacaaagtggagttgacgtgttctttatcccgccagaaaagtgtgatacgttattgtgcgatattggtgagtctagcccgaacccaactgttgaagccggaagaacacttagggttctgaacttagtagaaaattggcttaataataacacgcaattttgcataaaagttttaaatccttatatgccatcagtaatagagaaaatggaggcattacaaagaaaatatgggggcgccctagtgaggaatcccttatctcgtaactcaacacacgaaatgtattgggtctccaacgcctcaggcaatattgtgtcatctgtcaatatgatatctcgaatgctaatcaataggtttacaatgagacataagaaagcaacttatgagccagacgtggatttaggatcaggcaccagaaatattggaatagagtctgagataccaaacttagacattataggaaaacgtattgagaaaattaaacaagaacacgagacaagctggcattacgaccaagatcatccgtataaaacgtgggcttaccatggatcctacgaaaccaaacaaaccggtagtgctagttctatggtaaatggagtagttcgtctactaaccaagccatgggacgtcttgcctactgtgactcaaatggcgatgacagataccacacccttcggacagcaaagagtgttcaaagaaaaagtagatacacgtacacaagagcccaaggaaggaaccaagaaactaatgaagattacagctgaatggctttggaaggagttgggaaagaagaaaacaccaagaatgtgtacgcgtgaagaatttacaagaaaagttagatcaaacgcggcactgggtgcaatatttactgacgagaataaatggaagtctgcgagagaagcggtcgaagactcgagattttgggaattagtggataaagaaaggaatttacacttagaaggaaagtgtgaaacatgtgtttacaatatgatgggaaagagagagaagaaattaggcgaatttggcaaagccaaaggatcaagagcaatctggtatatgtggctaggcgcacggtttttagagttcgaggctctaggatttttaaatgaagatcattggttcagtagggaaaatagcttatctggagtagaaggcgaaggcttgcataaattaggatacatcttgagagatgtgtcgaagaaagaaggaggagcgatgtatgcagacgatacggctggttgggatacaagaatcacgctagaagaccttaagaacgaagagatggttacgaatcacatggaaggggagcacaagaagctggcggaagcaatattcaaactcacttatcaaaataaagtggtgagagtgcaacggcccacgcccagaggaacggttatggatataataagtcggagagatcaaagaggcagcggacaagtaggtacttatggattaaatacttttacgaatatggaagcacaacttatcagacaaatggaaggagagggtgtatttaaaaacatacaacacttgacagttacggaagaaatagcagtacaaaattggctagcgagagtggggcgagagagactctcaagaatggcaatatcaggtgatgattgcgtagtaaagccactcgatgacagatttgcaaacgcacttacagcactgaacgatatgggaaaaattcgcaaagatatacaacagtgggagccatcaaaaggatggaacgactggacacaagtccctttctgttcccaccatttccatgaactgataatgaaggacggaagggtattggtagtaccatgccgtaaccaagatgaactaataggtagagcaagaatcagtcaaggggccggatggtcattaagagaaaccgcctgcctcggaaaatcatatgctcaaatgtggtcacttatgtatttccatagaagggatctcaggctggctgccaacgctatatgttccgctgtaccaagtcattgggtcccgacttcgcgtacaacatggtcgatccatgccaaacacgagtggatgacaaccgaagatatgctgacagtatggaaccgcgtatggattcaggaaaacccatggatggaagataaaacaccagtcgaatcttgggaagaaataccatatttaggaaaaagagaagaccaatggtgcggttcattaatcggtttaacctcaagagcgacgtgggctaaaaacatacaggctgccattaaccaagtccgaagcctaattggtaacgaagaatatactgattatatgccttctatgaagcgctttagacgcgaggaagaagaggccggtgtactttggtaa

SEQ ID NO: 22517 - RNA, 9876 nt, synthetic construct
  misc_feature 1..9876: note = derived and/or modified CDS sequence (opt6) from DENV-2__FJ906958__SS-prME
  source 1..9876: mol_type = other RNA
tcagtaggaatgataattatgttaataccgacagtaatggcatttcatctaactacgcgcaatggcgaaccacatatgatagtatctatacaagaaaaaggaaaatccttactatttaaaactgaagacggtgttaacatgtgtactctaatggcaatggatctaggagaattatgcgaagacactatcacgtacaaatgtccgttattaagacaaaatgaaccagaagatatagactgttggtgtaactccacatcaacctgggtaacatatggaacctgtactacaactggagaacataggagggaaaaacgttcagtagcgctagtacctcacgtcggcatggggttagaaacgcgtacagaaacatggatgtcttctgaaggtgcttggaaacatgctcaacgtatagaaacgtggatactacggcacccagggttcaccatcatggctgcaattttagcatacacaataggaaccacacactttcaaagagcattaatatttatactattgactgctgttgcaccgtctatgactatgagatgtattggcatttcaaaccgagactttgtcgaaggcgtatcgggaggatcttgggttgatatcgtgttagaacatggaagttgcgtgacaacaatggctaaaaataaacctactctggactttgaacttattaaaactgaagcgaaacaaccggctactctgcgaaaatactgtatcgaagcaaaattgaccaatacgacgacagaatcaagatgccccacacaaggagaacccagtctgaaagaagaacaagacaaaagatttgtctgtaaacatagtatggtcgatcgtggttggggcaacggttgtggactgtttgggaaaggagggatagttacttgcgcgatgtttacctgtaagaaaaacatggaaggaaaaattgtacaaccagaaaacttagaatacacgatagtagttacaccgcattcgggagaagaacacgctgtcgggaacgatacgggaaaacatggcaaagaaataaaagtcacccctcaatcatccataacagaggcagaactaactggatatggtaccgtgaccatggagtgcagtcctcggacgggtttggattttaatgaaatggtattgctccaaatggagaataaggcttggttggttcatcgacaatggttcctagaccttccgttaccatggctaccaggagcagatactcaagggagtaattggatacaaaaagaaactctcgttacgtttaaaaaccctcatgccaagaaacaagatgtggtagtgctggggtctcaagaaggtgctatgcatacggcactaacaggagcaaccgaaatccagatgagctcgggaaacttattatttaccggtcacttaaagtgtcgattacgaatggacaaactccagttgaagggaatgtcctattcaatgtgtaccggaaaatttaaagttgtaaaagaaatcgcagaaacacaacacggtacaatcgtaatccgcgtacaatatgagggcgacggttctccatgcaaggtcccatttgaaataatggatcttgagaaacgatacgtccttggtcgacttatcaccgtgaacccggtagtaaccgagaaagattctcccgtcaatattgaagcagaacccccgtttggagatagttacattataattggagtagagccaggacaactgaaacttaattggtttaagaaagggtctagtattggacaaatgtttgaaactactatgagaggggcaaaacgaatggcaatcttgggtgacacagcatgggatttcggaagtcttggtggagttttcacaagtataggcaaagctctacatcaagtattcggtgcaatatacggcgcagcatttagtggcgtatcttggacaatgaaaatactcatcggtgtaatcatcacctggattggaatgaactcccgttccacatcattatcagttagcttagtcctagtaggtatagtaaccctatacctgggcgtaatggttcaagctgacagtggctgtgttgtatcctggaagaataaagaactaaaatgtggttcaggtatatttataacagataatgttcatacatggaccgagcagtacaaatttcaacctgaatcaccctcaaaactagcaagcgcaattcagaaagcccaagaagagggaatatgtgggataagatccgtaacccgcctcgaaaatctaatgtggaagcaaattaccccagaattaaatcacatcttggcagaaaacgaagttaagttaacaataatgacaggtgatataaaaggaataatgcaggccggtaaaagatccctgcgaccacaacccaccgagcttaaatattcctggaaaacatggggtaaggccaagatgctttctacagaaagtcacaatcaaacattcttgatagacggtcctgaaactgctgagtgtccaaacactaacagggcatggaactcgctcgaagtggaggactatggtttcggagtctttacaacaaatatatggctcaaactaaaagaaaaacaggatgcattctgcgatagcaaactaatgtcagcggctgtcaaggataacagagccgtacacgcagatatggggtattggattgaaagtgccttaaacgatacatggaaaattgagaaagcatcatttattgaagtcaaaaactgccattggccgaagagtcatacattatggtctaacggtgtactagaatccgaaatgatcataccgaaaaatctcgctggtccggtgagtcaacacaactatcgacctggataccatacccagatcgcaggaccctggcatttgggaaaactagagatggacttcgacttctgtgacggcacaactgtcgtagtaacggaagattgtggtaaccgtggcccatcgctcagaactactaccgcctcagggaagctgataacagagtggtgttgtagatcttgcaccttaccaccgctgcgatatcgcggagaagacggttgttggtacggaatggaaatcagacctttaaaggagaaagaagagaacttagttaacagtctggtgacagccggacaaggacaggtagataatttttcattaggagtacttggaatggcattatttctagaggaaatgctcaggactagagtaggaactaagcatgctatacttttagtagcagtttccttcgttacgctcataacagggaacatgtctttcaaagacttaggtcgggtggtcgtcatggtcggagcaactatgactgacgacattggcatgggagttacatatttggcattactagcggcattcaaagtgaggcctacgttcgcagcaggattattgctcagaaaactcacatcaaaagaactaatgatgactacgataggaattgtgttactgtcacaaagcacgattccagaaaccattctcgaattaactgatgcattggcactaggaatgatggttctgaaaattgtaagagatatggaaaaatatcaactcgctgtaactattatggctatattatgtgtgccaaacgcagttatccttcagaatgcttggaaagtatcctgtacaatactcgccgtggtttcagtctctcctttgttactcacatccagtcagcagaaaacagattggatcccactggcacttacgattaaaggtctaaatccgaccgctatttttctaacaaccctctcgcgaactaacaaaaagcgaagctggcctttgaacgaggctatcatggctgtcggtatggtctcaattctagctagctcgttacttaagaatgacattcctatgacaggaccactcgtagctggaggattgcttacagtctgttacgtactcaccggaagaagcgcagacttagaactagaacgcgcgaccgatgtaaagtgggaagatcaagcagaaatatctggcagcagtccaatcctctctataacaatttcagaggatggatctatgagtattaagaatgaagaagaggagcagaccctcacaattctaataagaacaggattattagtaataagtggactatttcctgtcagtattcccataacagcagcagcttggtacttatgggaagtcaagaaacagagagctggtgtgttgtgggatgtaccaagcccaccacccatgggaaaagctgaactagaagatggagcgtacagaatcaagcaaaaaggaatcttgggatattcccaaataggcgctggagtgtacaaagagggcacgttccatacaatgtggcatgtaacacgtggagcagtactaatgcataaaggaaagcgaatagaacctagctgggcggacgtcaagaaagacctaatttcatatggcggaggatggaagctagaaggagaatggaaagaaggggaggaggtccaggttttagcacttgaaccaggaaagaatccacgagctgtacaaaccaaaccaggactattcaagacaaatacaggaaccataggagcggttagcctcgacttttcaccaggtacatcaggatcaccaataatagataaaaagggtaaagtagtaggactctacggcaacggtgtagtaactagaagtggagcctacgtttcggcgatagcacagacagagaagtcaatagaggacaatccggacatagaggatgacatcttccgcaaaagaagactgacaatcatggatctccatccaggggcagggaaaacaaagaggtacctaccagcgatagtcagggaggcgataaagagggggttgcgcaccttaatattggccccgacccgagttgttgctgcagaaatggaagaagcgctgaggggactacccatacgctatcagactccggctatacgagctgaacacacaggtagggaaatcgtcgacttaatgtgtcatgctacattcacaatgcgattacttagtccagtaagagttccaaattataatttgataatcatggatgaggcccatttcaccgaccctgcgtccattgctgcgagaggatatataagtactagagttgaaatgggagaagcagcaggaattttcatgactgctacacccccaggtagtcgagatccgtttccacaaagcaatgcccccataatcgacgaagaacgagaaataccagaacgcagttggaacagtggccatgagtgggttacagattttaaaggcaaaactgtttggttcgtcccttctatcaaagcaggcaacgatatagcagcgtgtttaaggaaaaatggtaagaaagtcatacaactcagtagaaaaacatttgactcagaatatgcgaaaacaagaaccaatgattgggattttgtagtaaccacagatattagcgaaatgggggcgaattttaaagccgaaagggtcatagatccccgaaggtgtatgaaaccggttatcttaacagacggtgaggaaagagtgatattggcaggcccaatgcctgtgacacactcgagtgcagcacagaggagagggcgaataggcagaaatcccaaaaatgaaaacgatcaatatatctatatgggggagcccctagagaatgatgaagactgtgcccattggaaagaagctaagatgttactagacaatattaatacacctgaaggaataataccctcaatgtttgaacctgagcgcgaaaaagtagatgcgatagacggcgaatatcgccttagaggagaagcgagaaaaacgttcgtagatctaatgaggagaggtgatttaccagtctggttagcctataaagttgcagcagaagggatcaattacgcagacagaagatggtgcttcgacggaatcaaaaacaatcagatattagaagaaaatgtagaagttgagatttggacgaaggaaggcgaaagaaagaaattaaagcccaggtggctagacgccaggatttatagcgatccactggcgctaaaagagttcaaggagttcgccgcaggacgaaagagtctaacattaaatttaataactgagatgggacgactacctacattcatgacgcagaaaacccgtgatgcattagataatctagcagtgctacatacagccgaggccggtggtcgtgcatataatcacgctctaagcgagctgccagagaccctagagactctactactgctaaccctactagcaacagtgacaggtggcatttttctattcctgatgagtggccgaggtataggaaaaatgactctcggaatgtgttgcatagtaacagcctcaattttattgtggtacgctcaaatccagccacactggatagctgcttcaattattctcgagttctttttgatagtattattaattcctgagcctgagaaacaacgtactccacaagacaatcagctgacttacgttgtgatagcaattttaactgtagtagccgcaaccatggctaatgaaatgggatttttggaaaagaccaaaaaggacctaggacttggctcaattgctacacagcaaccagagtcaaacatattggacattgatctccgaccggcgagcgcatggactctatatgctgtagccactacgtttgtaacgccaatgttaaggcattcaatagaaaacagctcagtgaatgtttcactaactgcgatagcaaaccaagccacagtgttaatggggctagggaaaggttggccattaagtaaaatggacataggagtccctctactggctataggatgttactcacaggtgaacccaattacgttaacagcagcacttttacttttggtggcgcattatgcaatcattggacctggattacaagcgaaagcaacgcgagaagcccaaaagcgcgcagccgcaggcatcatgaaaaatcctaccgttgatggtattaccgtgattgatctggatccaataccttatgacccaaagtttgaaaaacaacttggacaggtcatgctattagtattgtgcgtaacacaagtactcatgatgagaacaacctgggcattatgtgaggctttaacattagcaacaggacctatatctacgttatgggaaggaaatccaggcaggttttggaacacgacaatagcagtgtcaatggccaatatctttagaggatcttacttagctggcgcagggctattattctctatcatgaagaacactactaacacgagacgaggaactgggaacattggagaaacactcggcgaaaaatggaaaagtagactaaacgctctcggtaaaagcgagttccagatatacaagaaatcaggcattcaagaagtagatcggacattagcaaaagaaggcattaaacgaggtgaaacagaccatcatgctgtatcacgtggaagtgcaaaattaagatggttcgtcgaacgtaacatggtaacaccagagggaaaagtcgtggatctaggctgcggccgtggaggttggtcatactattgtggtggactcaaaaatgtaagggaagtaaagggtttaacaaagggtggaccaggacatgaggagcccataccaatgtctacttatggctggaatttagtcagactccaaagtggtgtcgatgttttctttatacctccggaaaaatgtgacacactactctgtgacataggagagtccagtcctaatcctactgttgaagcaggtcgcaccttacgagtactaaatcttgtggagaactggcttaataacaacacacagttttgtatcaaagttctcaatccatatatgccctctgttatagagaaaatggagacactacaacgaaagtacggtggtgccctagtgcgaaacccactgagcagaaattctactcatgaaatgtattgggtaagtaatgctagtggtaatattgtttctagcgtaaatatgatatccagaatgcttatcaatcgttttacaatgagacataaaaaggcaacttatgagcccgatgttgatcttggatcaggtacacggaatattggtattgaatcagaaattccaaacctagatattatcggtaaacgaatagaaaagattaaacaggaacatgagaccagttggcactacgatcaggatcacccttacaagacttgggcttaccatggcagttatgaaaccaagcaaacaggctcagcatcatcaatggtgaacggagtagtacgcctgttaacaaagccatgggacgtacttcctacggtcacccaaatggcaatgacagatacaacaccatttgggcaacaaagagtatttaaagaaaaggttgacacacgcacccaggaaccaaaggaaggaaccaagaaattaatgaaaataacggcagaatggttatggaaagaattgggaaagaagaaaacacccagaatgtgcacacgtgaagagttcaccaggaaagtcagaagtaacgcagccctaggagcaattttcacagatgagaacaagtggaaatcggccagagaagcggtcgaagacagccgcttttgggagttggtagacaaggaacggaacttacacttggaaggaaaatgtgagacatgtgtttataacatgatgggaaaaagagagaagaaattgggagagttcggcaaggcaaaaggatccagagccatctggtatatgtggctaggagcaaggtttcttgagttcgaagcacttggatttttgaatgaagaccactggttctctagggaaaatagtctctccggagtagagggagaagggctccataaactaggatacatcctcagagatgtatctaagaaagaaggtggtgctatgtacgcagacgatacagcaggttgggacactaggatcacattggaagatctcaaaaacgaggaaatggttacgaaccatatggaaggagaacataagaggttagcagaagcaattttcaaactcacatatcaaaataaagtagtccgagtacaaaggcctacgccgagaggcaccgtaatggacataatctcgaggagggatcaaagaggtagtggccaagtagggacgtatggcttaaacacgtttacaaacatggaggcacaattgatcaggcaaatggaaggagaaggagtgtttaaaaatatccaacacctgactgtaacagaagaaattgcggtacaaaactggctagccagggttggacgggaacgtctgtcacgcatggccatatcaggcgacgattgcgtagtaaagcctttagatgacagattcgcctcagcgctgactgccctcaatgatatgggtaaaattcgaaaagatatacaacaatgggaaccctcaagagggtggaatgattggacccaggtacctttttgcagtcaccactttcatgaacttatcatgaaagatggtagagtcctagttgtaccttgtcgaaaccaagatgaactaattggtcgagctagaataagtcaaggagcgggatggagcctacgtgaaactgcctgcctcggaaaatcatatgcacagatgtggtcactcatgtattttcatcgtagagacctccgtctggctgcgaacgcaatctgttccgccgtaccgtcacactgggtacctacctctcgaacgacatggtcaatacacgccaaacatgaatggatgactacagaagatatgcttacagtttggaatcgcgtatggattcaagaaaacccttggatggaagacaaaaccccagttgaatcatgggaggaaataccctatttaggcaaacgagaagatcaatggtgcggtagtctgatcggcctaacctctagagccacatgggccaaaaacatacaggctgcgatcaatcaagtcaggtctttaataggaaacgaagaatatactgactacatgccttcaatgaaacgattccgcagagaagaagaagaagccggggtcctttggtaa

SEQ ID NO: 22518 - RNA, 9876 nt, synthetic construct
  misc_feature 1..9876: note = derived and/or modified CDS sequence (opt6) from DENV-2__FJ898452__SS-prME
  source 1..9876: mol_type = other RNA
tcagcgggaatgattattatgttaattccaacagtaatggccttccacctaacaacaagaaacggagaaccgcacatgatagtagggattcaagaaaaaggaaaatccttactattcaaaacagaagacggagtaaatatgtgtactcttatggcgatggatttaggtgaattatgtgaagatacaataacgtacaaatgcccgttactacgacaaaatgaaccagaagacatcgactgctggtgcaattcaacatccacatgggtgacttatggaacttgcaccacaactggagaacatagaagagaaaaacgtagtgtggctctagtaccccatgtaggaatgggattagaaaccagaaccgaaacatggatgagttcagaaggagcgtggaaacacgctcaacgaatagaaacctggattttacggcatcccggatttacaataatggctgcaatactagcatatacgataggaacaacacacttccaaagggttttaatattcattctactaaccgcagtagcgccaagcatgactatgcgatgcataggaatttcaaatagagattttgtagaaggtgtaagtggaggaagctgggtagacattgtattagaacacggatcctgtgtaaccaccatggccaaaaataaaccaacacttgactttgaattaataaaaacagaagcaaaacagcctgcgaccttacgtaaatactgtattgaagctaaactaacgaatacaactacagaatcaagatgtccaactcagggtgaaccttcactgaaagaagaacaagataaacgatttgtatgcaaacatagcatggtagatcggggatggggcaatggatgtggacttttcggaaaaggaggaatagtaacttgtgcaatgtttacctgcaagaaaaacatggaaggtaaaatcgtccaaccagaaaacctggaatatactatagtcgtaacaccgcattcgggtgaagaacatgccgtgggaaatgatacaggtaaacacggaaaagaaatcaaagtaactccccaatccagtatcactgaagcagaacttactggctacgggactgtcactatggaatgtagcccgagaactggattagactttaatgaaatggtattgctacagatggaaaataaagcgtggttagtacaccgacaatggttcctagatctcccgctaccatggctacccggagcagacaaacaagaatcaaattggattcagaaagagactcttgtgactttcaaaaatcctcatgcgaagaaacaagacgtagtcgtacttggctcacaagaaggcgcgatgcacactgcgctaactggagctacggaaatacaaatgtcctccggaaatttattgtttactggacatttaaaatgtaggctcagaatggacaaattgcaactaaaaggaatgagttattctatgtgcacagggaaattcaaagtagtaaaagaaattgcggaaacccaacacggtactattgtaattagagtgcaatatgagggcgatggatctccttgtaaaatacccttcgaaattatggatctggagaaacgctatgttttagggagattaattaccgttaatccaattgtgaccgagaaagatagtccagtcaacatagaggcagaacctccattcggagattcctatattataataggcgtagagcctgggcaattaaaactgaattggttcaagaaaggttcttcgatcggccagatgtttgagacaacaatgcgaggagccaagcgtatggcgatattaggtgatactgcctgggattttgggagtttaggtggtgtatttacatcgataggaaaagcattacatcaagtgtttggagcaatatacggggcggctttctcaggtgtaagttggactatgaaaattttaataggcgtaatcataacatggattggaatgaactctagaagtacatcattaagtgtctcattagtactggtaggcatagttacgttatacctcggcgtgatggttcaagcagacagtggctgcgtggtttcatggaagaacaaagaattaaagtgcggctcgggtatatttattacagacaatgtacatacatggactgaacaatacaaattccagcctgaatcaccatcgaaactggcttctgctatacagaaggcccaagaagaaggtatatgtgggataagaagcgtgacgcgactagaaaatctaatgtggaaacaaattacaccggaattaaatcatatactagcagaaaatgaagtaaagctcacaattatgaccggtgacatcaagggtataatgcaagctggaaagagatctctccgtccacagccaacggagctaaaatacagctggaagacatgggggaaggcaaaaatgctctctacagaatcttacaatcaaacgtttttgattgacggaccagaaacagcagaatgcccaaacacaaacagagcatggaacagcttagaagttgaagactatggtttcggagtatttaccacgaatatatggttaaaacttaaggagaaacaagacgctttctgcgattctaaacttatgtcagcggcaattaaagataatcgtgcagtacacgcagatatgggatactggatagaaagcgcattaaatgacacttggaaaatagaaaaggcgtcattcattgaagtcaaaaactgtcactggccaaaaagtcataccctgtggtcgaacggcgtcctcgagagcgagatgataataccgaaaaatttagccggacctgtgagtcaacacaattatagacctggttatcatacacagatagccgggccatggcatctcgggaaattagaaatggacttcgatttctgtgacggaacgacagtcattgtcactgaagattgcggtaaccgtggaccaagtctaagaactacgactgcaagtggcaaattaattacagaatggtgttgcagatcctgtaccctacccccattaagatatcgaggtgaagatggttgctggtatggaatggagatacgtcctttgaaagaaaaagaagaaaacttagttaatagccttgtgacagctggacacggccaagttgataatttctcgctaggagttttaggaatggcactgttcttggaagagatgctcagaacccgagtgggaacaaaacatgcaattttactcgtagctgtctcatttgtaacattaataacgggaaacatgagtttcaaggaccttggtagggttgtagtgatggttggcgctacaatggctgacgatatcggtatgggagtaacttacctagcattactagcggccttcaaggtacggcctacatttgctgcaggacttttactgaggaaattaacgtcgaaagaattgatgatgacgaccattggaattgtattgttgagtcagtcaacgattccagaaacagtcttggaattaactgacgcgctagcattgggcatgatggtcttaaaaatcgttagaaatatggagaaatatcaacttgcggttactataatggctatattatgtgtacctaatgcagtaatacttcaaaatgcatggaaagttagctgcactattttggctgttgtctcagttagcccattgttattaacatcaagtcaacagaaaacggattggatcccattggcattgactataaaaggcctaaatcctaccgccatatttctaactacattgtcacgaactaacaagaaacgcagttggcctcttaatgaagctattatggcggtaggtatggtatccattctcgctagtagcttgctcaaaaacgatataccaatgactggccccttggttgcgggcggcttactaaccgtatgctacgtattgacgggacgttctgcagaccttgaattagaacgagccacagacgtaaaatgggaggatcaggccgaaatctcaggttccagtccaatactatcaatcacaataagcgaagacggaagtatgtccatcaaaaatgaagaagaagaacagacgttgaccatattgattcgtacagggttacttgtcatatcggggctctttccaatctctataccaattactgcagcagcatggtatttatgggaggtgaaaaagcagcgtgcaggagttttgtgggatgtaccctcaccaccgccaatgggaaaggcagaactagaagatggagcgtacagaataaagcaaaaagggatattggggtatagtcaaatcggagctggagtatacaaagagggaacattccacactatgtggcatgtaacacgaggagcggtccttatgcacaaagggaagcgcatagagccatcttgggccgatgtaaagaaagatctgatctcatatggaggtggctggaagttggagggggagtggaaagaaggagaggaagtgcaagtactggcactagagcccggtaaaaatccacgagctgtccaaacaaaaccaggactatttaaaactaatactggaacgataggagccgtcagcttagacttttctccagggacctctggaagtccaataatagataaaaaggggaaagtagtcggtttgtacggaaatggagtggtaacaaggagcggagcgtacgtaagtgcgatagctcaaacagagaaaagtattgaagacaaccctgagatagaagatgatatatttagaaagagaagattaactataatggacctacatccaggggccggaaaaacaaaacgttatcttccagccattgtccgagaagcaataaagaggggactacgtactcttatcctggcaccaacaagagtggtcgcagcagagatggaagaagcgttgcgaggactaccaataagatatcaaacacccgccatccgcgcagagcatacaggccgagaaattgtagacctcatgtgtcatgccacatttactatgagactcttaagtccagtgcgtgttcccaactacaatttgattattatggatgaagcacactttacagaccccgcttcgatagccgcacgtggttacatatctacgagagtcgagatgggcgaagctgctggaatttttatgactgcgactcctcctggatctcgagatccattcccgcaatcgaacgcgccaataatcgacgaagaaagagaaatacctgagagatcgtggaatagcggccacgaatgggtaacagacttcaagggaaaaacagtctggtttgtgcctagcataaaagcaggcaatgacatagcagcatgcctcagaaagaatggcaagaaagttattcaattgagcagaaaaacattcgattctgaatatgtcaaaacacgtactaacgattgggattttgtagttacaaccgacatttcggaaatgggagcaaattttaaagcagaaagggtaatcgacccccgtcgttgtatgaaaccagtaatcctgacagacggagaggagagagtgatcctcgctggtcccatgcccgtgactcatagttcagcagcacagcgccgagggcggatcggaagaaatcccaaaaatgaaaacgatcagtatatatacatgggtgaaccccttgaaaacgacgaagactgtgcacattggaaagaagctaaaatgctactagataacataaacacacctgaaggcatcattccttcaatgtttgaaccagaacgagaaaaagtcgacgcaattgacggtgaatataggctcagaggagaggcaagaaaaactttcgtggatctaatgcgacgcggtgaccttcctgtatggttagcttataaagtggcagccgaaggtataaattatgcggatcgtagatggtgctttgacggaattaaaaataatcagattttagaggagaacgtagaggtagaaatatggacaaaagaaggtgaacgtaagaaacttaaaccacgctggcttgatgccaggatatattcagacccattggctcttaaagagtttaaggaatttgctgcaggacggaaatctttaacgctaaatttaataacagaaatgggacggctcccaacctttatgacccagaaaacaagggatgccttagataatcttgctgtactccataccgctgaggcagggggacgcgcatataaccatgctttatcagaactaccagaaacgttagaaacactccttctcttaactctattggcaaccgtaacaggaggcatattcttatttttgatgagtggaaggggaatcgggaaaatgacattgggtatgtgctgtatcataacagcctccatacttctttggtacgcacaaatacaaccccattggattgctgcaagtattatactcgagttctttttaattgtcctgcttattccagaaccagaaaaacaacggactccacaagataatcaactcacatatgtggtaatagctatacttacagtggttgcggcaacgatggcaaacgaaatgggctttttagaaaagactaagaaagacttaggactaggctccatagcaacacaacagccagagtctaatatcctagacatagacctaaggccggcgagtgcatggacgttgtacgcagtggccacaactttcgttacgccaatgttgcgccattccatcgaaaatagcagtgtaaatgtttccttaactgctatagcgaaccaagcaaccgttcttatgggtttgggaaagggttggcccctaagcaaaatggacataggagttcctttgctagctatcgggtgctactcacaagtaaacccaataacgctcactgcggctctcttattattggtcgcccactacgccattattggacctggtcttcaggcaaaagcaacaagagaggcacagaaaagggctgctgcaggtattatgaaaaatcctacggtggatggaataacagtaatagatttggaccctatcccgtatgatccaaagtttgaaaaacagctaggccaagtaatgttattaattctatgtgtgacccaagttttgatgatgagaacaacatgggcgttgtgcgaagcattaacccttgccaccggcccaattagtacgttatgggagggaaatccgggaagattttggaatactacaatagcagtctcaatggcaaatattttccgtggaagctacctagctggtgcagggttactatttagcatcatgaaaaacactacgaacacgagaagagggactggcaacattggcgaaacgctgggtgagaaatggaaaagtagactaaatgctctaggaaaatccgagttccaaatatataagaaaagtggaatacaagaagttgatcgaacactagccaaagagggtataaaacggggtgagactgaccatcatgctgtgagtagaggtagcgctaaattacgatggttcgtagaacgaaatatggtaactccagaaggaaaagtagtagacttgggttgcggacgtggaggatggagctattattgcggcgggctcaaaaatgttcgcgaggtcaaaggccttactaaaggtggacctgggcacgaagaaccaataccgatgtcgacttatgggtggaatctggtgcgactccagagcggagtggatgtgttcttcatacctcccgaaaagtgcgacacattactttgcgacataggagaaagctctccgaatcctacagttgaagccggaagaacactgcgcgttctgaatttagtggaaaactggttaaataacaatacgcaattctgcatcaaagtcttaaatccttatatgccatcagtgatagagaaaatggaagcacttcaaagaaaatatggtggtgcgttggtccgaaacccactttcaagaaactctacccacgaaatgtattgggtatcaaatgcgtctggaaatatcgtaagttcagttaatatgatttcgcgaatgctcattaatcgttttactatgcgtcacaagaaagctacatatgaaccggatgtagatttagggtccggaaccagaaacataggcatagaatcagagataccgaatttagatatcattggaaaaagaattgagaaaataaagcaagaacatgaaacatcatggcactatgaccaagatcacccttacaaaacatgggcctatcatggttcttatgaaacgaaacaaacggggtctgctagttcaatggttaatggagtggttagacttttgaccaaaccatgggatgttttaccgacagtaacacaaatggctatgacggacaccacaccattcggtcagcagagggtattcaaagaaaaagtagatactagaacgcaagaaccgaaagaaggaacaaagaaactgatgaaaattacagctgaatggttatggaaagagttaggcaagaagaaaacaccaagaatgtgcacaagggaagaatttacgcgaaaagtaaggagcaacgcggcactaggtgcaatttttacagatgaaaataaatggaaatccgctagagaggctgtggaggactccaggttttgggaattggtagataaagaacgtaacttgcaccttgaaggtaagtgcgaaacctgcgtttacaacatgatgggaaaaagggagaagaaactcggtgagtttgggaaagcaaaaggaagcagagcaatatggtacatgtggcttggtgctagatttttagagttcgaagccttaggcttcctaaacgaagatcattggttcagtagagaaaatagcctaagcggagtagaaggcgaaggattacataaacttggatacatattacgcgatgttagcaagaaagaaggaggagcaatgtatgcagacgacaccgctggatgggacaccagaattacccttgaagacttgaagaatgaagaaatggtgacgaatcatatggaaggtgagcataaaaagttggccgaagcaatctttaaattgacataccagaataaggtagtacgagttcaaagaccaacaccaaggggaacggttatggacatcatttcgagaagagatcaaagggggtctggacaagttggtacgtacggtcttaatacttttacaaatatggaggcccagctaataagacaaatggaaggtgaaggggtattcaaaaacatacaacatctgactgtaacggaggaagttgcagtacaaaattggttagcaagagtgggacgtgaacgattatctcgcatggcaatcagtggagatgattgcgtagtaaagcccctagatgatcgatttgcaaacgcactcacagctcttaatgatatgggcaaaatccggaaggatatacaacagtgggaaccatcaaaaggctggaacgattggacccaagttccattttgcagtcatcattttcacgaactaataatgaaggacggtcgcgtattagtggtgccttgcagaaatcaagacgagctgataggaagggccagaataagccagggtgcgggatggtcccttcgtgagacggcctgtctagggaaatcatacgcgcaaatgtggagtctgatgtattttcacaggagggatctaagacttgcagcaaacgcaatttgcagcgcagtccccagccactgggtccctacgagtagaaccacctggtctatccatgctaaacatgaatggatgactacagaagatatgctaacagtatggaacagagtatggattcgtgaaaatccatggatggaagataaaacaccagtggaatcctgggaagaaataccatacttaggaaaaagagaggaccaatggtgtggtagtttgattggcctgacaagccgagcaacttgggccaagaacattcaagcagcaataaatcaggtaaggagcttgataggcaacgaggaatacaccgactatatgccttcaatgaaacgattcaggagagaagaagaagaggcaggcgttctatggtaa

SEQ ID NO: 22519 - RNA, 9876 nt, synthetic construct
  misc_feature 1..9876: note = derived and/or modified CDS sequence (opt6) from DENV-2__GQ868591__SS-prME
  source 1..9876: mol_type = other RNA
tcagcaggcatgataataatgcttatccctactgtaatggctttccacttaacaacaagaaatggtgaaccgcacatgatagtaagtagacaagaaaaaggcaaatcgctactattcaaaacagaagatggtgtgaatatgtgcacactaatggcaatggacttgggtgaattatgtgaagacaccataacttataaatgccctctacttagacaaaacgaacctgaagacattgactgttggtgcaatagtaccagtacatgggtcacctatgggacgtgcacaaccatgggggaacaccgtcgagagaaaagatcagttgctttagtcccccatgttggtatgggattagaaacacgaacagaaacgtggatgagtagtgaaggtgcgtggaaacacgtacaaagaatagaaacatggatactgcgccaccccggctttacaatgatggcagcaattctagcatatactatcgggacaacacattttcaaagagctctgatttttattctactaacagcagttaccccctcaatgaccatgagatgtattggtatgtcaaaccgcgatttcgttgaaggtgttagtggaggttcatgggtcgacatagttctagaacatggcagttgtgttacgacaatggccaaaaataaaccgacattagattttgaattaataaaaacagaagcgaaacaacctgctacattaagaaaatactgtatcgaagcaaaactaaccaacacaactacagaatcgaggtgtcccactcaaggcgaaccgtctcttaacgaagaacaagataaaaggtttgtatgcaaacattccatggtggataggggttggggaaatggatgcggcctattcgggaaaggtggaatagtgacatgtgcaatgttcaggtgcaagaaaaatatggaaggcaaagtcgttcaaccagaaaatctggaatatacaatagtcataactcctcactccggagaagaacacgcagttggcaatgacacagggaaacacggcaaagaaattaaaatcacaccacaaagctcaatcacagaagcagaattgactggctacggtaccgtgactatggaatgttcacctcgaactggactggattttaacgaaatggtcctgttacaaatggaaaataaggcttggctggttcaccgacaatggttcctagaccttccactaccatggcttccaggtgcagacacccaaggttcaaattggatacagaaagaaactttagtaacttttaaaaatccccacgccaaaaagcaagacgttgtagtgctaggatcacaagaaggagccatgcacacagcattaaccggggccacggaaatacagatgagtagtggaaacttgctatttacaggtcatctaaagtgcaggttacgaatggataaattgcagctgaaaggaatgagttacagcatgtgcacgggaaaatttaaggtagttaaagaaatagcggagacccaacatggtacaatagtaatccgagtgcaatatgagggtgatggaagtccttgtaaaattccattcgagattatggatttagagaaaaggcatgtattagggagactaataacagttaacccaatagtaacggaaaaagactcaccagtcaatatagaagcggaaccaccatttggtgatagttatataattattggcgttgagcccgggcagctaaaattgaattggtttaagaaaggaagttcaatcggacaaatgtttgaaaccacaatgcgaggcgcaaagagaatggccatattgggtgatacagcttgggattttggaagccttggtggggttttcacctcaatagggaaggctctacatcaagtttttggggccatttacggtgctgcgttcagtggagtaagttggactatgaagattcttatcggggtaattattacctggatcggtatgaactcacggagcacaagtttatctgtgacgttagtcttggttggaatagtcacgctatatttaggagtaatggttcaagcagatagcggttgcgttgtatcatggaaaaataaagagctaaaatgcgggtcaggcatatttataacagataatgttcatacctggacagaacaatacaagtttcaacctgaatctcccagcaaacttgcttcagcaattcaaaaagcgcacgaagaaggaatatgtggaattagaagtgtaactcgattggagaatttgatgtggaaacagataacgccggagctaaatcacattctctctgagaacgaggtaaagttaactataatgactggtgatatcaaaggaattatgcaagctggtaaacgttctttaaggccacaaccgacggaattgaaatatagttggaaaacttggggcaaagcaaagatgctttctacggaatcacacaatcaaacttttctaattgatgggccagaaacggcagaatgtcccaatacaaatcgtgcatggaactcactcgaagttgaggactatggttttggtgtttttacgaccaacatttggctgaaacttaaagagaaacaagacgtcttttgcgattctaaactaatgtccgcagcaatcaaagataaccgggcggtacacgcggatatgggctactggattgaaagtgccttaaacgatacctggaagatcgaaaaagcatcctttatcgaagtcaaaaattgccactggcctaaaagccataccttatggtcaaacggtgtattagaaagcgagatgataataccgaaaaatttggcaggacccgtttcccagcataattatagaccgggataccatacacaaattactggaccatggcacctagggaaattagagatggattttgacttctgtgacggtactacagtcgttgtaacagaggattgcggcaatagaggtccgtcattgcgaactactacagcgagcggtaaattgataactgaatggtgctgcagatcatgtacgttaccaccactccgatacagaggcgaagatggctgttggtatgggatggagattaggccgctcaaagaaaaggaagagaatcttgtaaatagtcttgtaacagcaggacacgggcaagttgataatttcagcctgggagtattaggtatggcgctttttctagaggaaatgttgcgaacgagagtgggaacaaaacacgcaatcctcttagtagcggtcagcttcgtcacactaatcaccggaaacatgagcttcagggacctcggacgagtcatggtaatggtgggcgccacaatgacagatgatataggaatgggcgtaacttacctagcactattggcagcttttaaagtacgaccaactttcgcagcagggctactgttaagaaaactcacaagtaaagaattaatgatgactaccataggaatcgtgctactatctcagtcaacgatacccgaaacaatcttggagctaaccgatgcgttagcattgggtatgatggtattaaaaatggttaggaatatggaaaaatatcaattagctgtaacgataatggctatcttatgtgtacccaacgcagtaatattgcagaacgcatggaaagtctcttgcacaatattagcagtggtatcggtctccccactgctattgacctctagtcaacagaaaaccgattggattccattagcattaacaattaaaggactaaacccaactgcgatatttcttactacattgtctaggacaagcaagaaacgatcctggcccctaaacgaggcgataatggccgttggtatggtttctatcttggcttccagtcttttaaagaacgatattcccatgacgggccccttagtagctggtggacttctaacagtttgctacgtccttactggaagatcagcagacctagaattagaacgtgcagctgacgtcaaatgggaggatcaagcagaaatttcaggatcctcgcctattctatctattaccatcagtgaggatgggagcatgagtatcaaaaatgaggaagaggaacagacactgactatactaatacgcacaggcttattggtaatctcaggacttttcccggtgtctatcccaattacggctgcagcctggtatttgtgggaagtcaagaaacagagggcaggcgtcctttgggatgttccgtcacctccgccgatgggaaaagcggaactagaagatggtgcatatagaatcaaacagaaaggaatattagggtattcgcaaataggggccggtgtatataaagaaggcacctttcacacgatgtggcatgtaactagaggcgcagttctcatgcacaaagggaagcgaatcgagccatcttgggcggatgtcaagaaagacctgatctcatacggaggaggatggaaacttgagggcgaatggaaggagggcgaagaggtccaggttttagccctcgaacccgggaaaaatccaagagcagtgcaaacaaaaccaggcctgtttaagacaaatgccggtacaattggtgcagtgagtttagattttagccctggcacgtcaggatcccccataattgacaagaaaggaaaagttgtgggactgtacggaaacggtgtagtgactcgaagcggggcatacgtatctgcgattgcccaaacggagaagtccatagaagataatccagagatagaagatgacatcttcaggaaaagacgactaacgattatggatttgcatccaggggctggaaagacaaaaagatatctacccgcaatcgtaagggaagcaattaaacgaggactgagaactttgatacttgcccctacaagagttgtagctgctgagatggaggaagcccttcgaggtctcccgatacgttatcaaactcctgctatccgagcagaacacacaggaagagagatagtcgatttgatgtgccacgcaacatttaccatgagattacttagtccagtccgagtaccgaattataatctcataattatggatgaagcgcactttacggatccagcctcaatagccgctagagggtatatttccacaagagtggaaatgggcgaggcggcgggtatatttatgacagcaacgccacccggatccagagacccgttccctcaaagtaatgcccccatcatagatgaagagagggaaataccggagagatcttggaatagcggccatgagtgggtaactgactttaaaggtaaaacagtatggtttgtaccctccataaaagcagggaatgacatagcagcatgccttcggaaaaatggcaaaaaggtaatacaattatcccgaaagacatttgattcagaatacgtgaagactcgtacaaacgactgggactttgtagttacgacagacataagcgaaatgggggccaacttcaaagcagaaagagtaatagatcctagacgctgtatgaagcccgttatcttaacagacggagaagaacgcgttatcctagcaggacctatgccagtaacacattcctcagcggcacaaagacgtggaagaataggtcgtaacccgaagaatgaaaatgatcaatatatatatatgggtgaaccacttgaaaatgatgaagattgtgcccactggaaagaagcgaaaatgctattggacaatataaatacgcccgaaggcataataccttcgatgttcgagccagaaagagaaaaagtagatgctattgatggtgagtataggctaagaggtgaagcacgtaaaacgttcgtcgacctcatgcgacgaggagatttaccagtttggttagcatatagagttgcagcagaaggtattaattatgcagacagaagatggtgcttcgacggtgtcaaaaacaatcagattcttgaagaaaatgtcgaagttgagatctggactaaagagggcgagcgtaagaaactcaaaccgagatggttggatgcaagaatttatagtgatccattagctcttaaagagtttaaagagttcgctgccggtagaaagagcttgactctaaacctaataacagaaatgggcagactccccacctttatgacgcaaaaggctcgagatgcactagataatttagcagtactacatactgcagaagcaggaggtagagcatacaaccatgctctctccgaattaccggagactcttgaaaccttattactcttaacactattagcgactgtaacaggagggatatttttatttttaatgagcggaaggggcatcggcaagatgacactcgggatgtgctgtataattactgcgtcaatactgctatggtatgcacaaatccagcctcactggatagctgcgagtataattttagaatttttcctgattgttttactaatcccagaacctgaaaaacaaagaacaccccaggataatcaactcacatacgtagttattgcgatcctaactgtcgtggcggcgacgatggcaaacgaaatgggatttttagagaaaactaagaaagatctaggtttagggtcaattgcgacgcaacagccagaaagcaatatattagatatagacttaaggcctgctagtgcatggacattatacgccgtagcaacgacattcgtaacaccaatgttgagacatagtatcgaaaattccagtgttaacgtttccttaacagcgattgcaaaccaagcgacagtgttaatgggtctaggaaaaggttggccgctaagtaaaatggacataggcgtccctcttctggcaataggatgttactcccaagtgaatcctataactctaaccgcagccctatttttgctcgttgcccattatgctataatcggaccaggacttcaagcaaaagctacaagagaagctcagaaaagggctgcagcaggaattatgaaaaatcctacggtagatgggataacagtgatagatcttgatccaataccatatgatcctaagttcgaaaaacaattaggtcaagtaatgctgctagtactatgtgtaactcaggtattgatgatgagaactacatgggcactgtgcgaggcactaacgcttgcaacaggtccaatatcaacattatgggaaggaaatcctggaaggttttggaatactactatcgctgtctcaatggctaatatatttcgcggtagttatttagcaggcgctggcttgctgttctcaattatgaagaacactactaatacccgtagaggaacagggaatattggtgaaacgttaggggaaaagtggaagagtagattgaatgcgctaggcaaaagtgagttccagatttataagaaatccggaatacaagaagttgatagaacgctagcaaaggaaggtataaagaggggcgagacagatcatcacgcggttagtaggggcagcgcaaaattaagatggttcgtggaaagaaatatggtaactccagaaggaaaagttgtggacctagggtgtggtagaggaggatggagttactattgtggcggactaaagaatgtcagagaagtaaaaggtttaacgaaaggaggacctggccatgaagaacctatacctatgtcgacctacggatggaaccttgtacggttacaatccggagttgatgtcttctttataccaccggagaaatgtgacacgctgctgtgcgacattggtgaatctagtccaaatcccactgtggaggccggacgtacattacgagtcctaaatttagtagaaaattggttaaataacaatacccaattctgcattaaggtcttaaacccctacatgccttctgttatagagaaaatggaagccctccaaaggaagtatggtggagcactcgtacgaaacccattatcacgcaatagcacacacgagatgtattgggtcagtaatgctagcggtaacatagtatctagtgtgaacatgatatcacgaatgttaattaatcgatttacaatgcggtacaagaaggcaacgtatgaacctgatgtagatcttgggagcgggactaggaatatcggaatagaaagcgaaattccaaacctggatataataggcaaaaggatagagaaaattaaacaggagcacgagacatcatggcattacgatcaagaccacccttataaaacatgggcctatcatggtagttacgaaacaaaacaaactggatcggcgtcgtctatggtaaacggagtggttcggcttttaaccaagccgtgggatgtcgtacccatggtaacacaaatggccatgaccgatacaacgccatttgggcaacaaagagtgtttaaagaaaaagtcgatactagaacacaagaacctaaagaaggaacaaagaagttaatgaaaataacagcagagtggctgtggaaagaactcggcaagaagaaaactccaagaatgtgtacgcgggaagagttcacaagaaaagtgagaagcaatgctgcgttaggagccatcttcgcagacgaaaacaagtggaaaagcgcaagagaagcagttgaggactcacggttttgggagctagtggataaagaaagaaatcttcatctagaaggcaagtgtgaaacttgcgtttataacatgatgggcaaacgtgagaagaaattaggagagttcggaaaagcaaaaggaagccgcgcaatatggtatatgtggttaggcgcaagattccttgaatttgaagccttagggtttctaaacgaagatcactggttctctcgtgagaactcgctatcgggtgtggagggagaaggtctacataaacttggttatatcttacgagacgtgtccaagaaggaagggggtgccatgtatgctgatgataccgccggttgggacactagaatcactttggaagatctcaaaaatgaggaaatggtcacgaaccacatggaaggtgaacataaaaagttagcggaagcaatatttaaacttacctatcaaaataaagtcgttagagtacaaaggccaactcctagagggacagtaatggacataatttctagaagagatcagagaggtagtgggcaagttggcacctacggtttaaatacgtttaccaatatggaagctcaattaatccgacaaatggagggcgaaggagtctttaagtctattcagcatttaacaattactgaagaaatcgccgtccagaattggcttgcccgcgtaggacgcgaacggcttagcaggatggcgataagtggggatgattgtgtagtaaaaccactagatgatcgttttgcaagtgcactaaccgcccttaacgatatggggaaaatacgaaaagatatacaacaatgggaaccatctaggggatggaacgattggacacaagtgcctttttgttctcaccattttcatgaactcataatgaaagatggtcgagtcctcgtcgttccatgcaggaaccaagatgaacttataggtcgagcaagaattagccagggagccgggtggagtttgagagaaacagcgtgcctaggtaagtcttacgcgcagatgtggagcctaatgtactttcaccgccgagacctcagactagctgcaaacgccatatgttccgcagtgccaagtcattgggtacctacatcgcgaactacgtggtctatccacgcaaaacatgaatggatgactacagaggacatgctaaccgtatggaacagagtgtggatacaggaaaacccctggatggaagataaaacgccagttgaatcatgggaggagatcccatacttaggaaaacgcgaagaccaatggtgtggctcgttaatagggttgacaagtcgtgccacttgggccaaaaatattcaagcagcgatcaaccaagtgcgatctttgataggcaacgaagaatataccgactatatgcctagcatgaaaaggtttcggagggaagaagaggaagcaggagtattatggtaa

SEQ ID NO: 22520 - RNA, 9876 nt, synthetic construct
  misc_feature 1..9876: note = derived and/or modified CDS sequence (opt6) from DENV-2__GQ868542__SS-prME
  source 1..9876: mol_type = other RNA
agcgcaggtatgataataatgctaataccaacagtaatggcgtttcatttaacaacgagaaatggtgaacctcatatgattgtgagtattcaagaaaaagggaaatccctgctttttaaaaccgaagacggagttaatatgtgcacactaatggcaatggatctaggggaactatgcgaagacacaattacatacaaatgtccgctgctaaggcaaaacgaaccggaagacatcgattgctggtgtaattctaccagcacttgggtaacttacggaacgtgtacaactacaggggaacatcgacgtgagaaaagaagtgtggcactggttccacatgtaggaatgggactagaaacacgtacagaaacgtggatgagtagcgaaggtgcatggaaacatgcacaacgcatagaaacttggatcttacgacatccaggatttacaattatggcagcgatattagcatatacgattggaacaacacattttcaacgcgctctcatattcatcctgttaactgcagtagcaccgtcaatgacaatgcgttgtataggcatttcaaacagagattttgtagaaggagtgagcggagggagttgggtagacattgtattagaacacggatcatgtgtaacaactatggccaaaaataaaccaaccctggattttgaactgataaaaacagaagctaaacaaccggcaactctcagaaaatattgcatcgaagcgaaacttacgaacacaactacggaatcacgatgcccaactcagggtgaaccctcgttaaaagaggagcaagataaaaggtttgtatgcaaacacagtatggtagatcgcggttggggcaacggatgtggacttttcggcaaaggagggattgtaacttgcgcaatgttcacttgcaaaaagaatatggagggcaagattgtacagccagagaatctagagtatactatcgtcgtcacacctcactcgggtgaagaacatgcagtaggaaatgacaccggaaaacacggtaaagagattaaagtcacacctcagtcttcaatcacggaagctgagctgacaggctatggtacagttaccatggagtgttcgccaagaaccggtttggactttaatgaaatggtattgctccaaatggagaacaaagcctggctcgtacatagacagtggttcttggatttaccactaccctggctacctggggcggatacacagggctcaaattggatacaaaaagaaacgttggtaacatttaaaaatccacacgcaaagaagcaggatgtagtcgttctgggtagccaagaaggtgcaatgcatacagccttgactggagcgacggaaattcaaatgtcatctggcaatctcctatttacaggccatttgaaatgtagattgagaatggataaattacaactaaaaggtatgtcttactcaatgtgtacagggaaatttaaagtcgttaaagaaatagcggagacacaacatggaaccatcgtgataagagtacaatacgaaggagatggcagtccatgcaagattccttttgaaataatggatctagagaaaagatatgtattgggtcgattaataacagttaatccaatagtcactgagaaagacagtcctgtaaacatagaagctgaacctcccttcggagattcatatattataataggagtggaaccaggccagctaaaattgaactggttcaagaaaggatctagtatcggacagatgtttgaaactacgatgagaggagctaagagaatggcaattctaggcgacacagcttgggatttcggttcgttaggaggggtgttcacgagcattggcaaagcacttcaccaggtttttggtgcgatttatggtgcagcatttagtggagtatcgtggacaatgaaaatactgatcggagtcataattacctggataggaatgaatagcagaagcacttctctaagcgtcagcttagtacttgtaggaatcgtaacattgtatctcggagtaatggttcaagcagatagcgggtgtgttgtgagttggaaaaataaggaactgaaatgcggatctggcatcttcataactgataacgtacatacatggacagaacaatacaagttccaacccgagtctcccagcaaattggcaagtgcgatccagaaagctcaggaggaaggtatatgtggtataagatcggttacacgacttgaaaatttaatgtggaaacaaataacgcccgaactcaaccacatcttggcggaaaatgaagttaaactcacaatcatgacgggagatatcaaaggaataatgcaagctggaaaacgttctctacgacctcagccgacggagcttaaatactcatggaagacttggggtaaggctaaaatgctttctacagagagtcataatcagacctttttaatagatggaccagaaacagctgagtgccctaatacaaacagagcatggaacagcctagaagtagaagattatggatttggagtattcacaacaaatatatggctgaaactaaaagaaaaacaagatgccttctgcgattcaaaattaatgagtgccgcaatcaaggacaatagggccgtacatgcggatatgggatattggattgaatcagcgctaaatgatacttggaagatagaaaaggctagtttcatagaggtcaagaattgccactggccaaaatcgcatacactatggagcaacggcgtattggagtcagagatgataatccccaaaaatttagccggaccagtcagccaacataactataggccaggttatcacacacagatcgccggcccatggcatttaggaaaacttgaaatggattttgatttctgtgatggaacaacggtagtagtgacagaggactgcggtaatagaggaccgtccctaagaacaactacggcatctggaaaattaattactgaatggtgttgtaggtcgtgcacactacccccgcttcgttacaggggagaggatggatgctggtatggtatggaaattcggcccctaaaagaaaaggaagaaaatttagtaaattctttagtaactgcaggacacggacaggtcgacaatttcagtttaggcgtattaggaatggctctatttttagaagaaatgctgcgaacgcgagtcggtaccaaacacgcgatactacttgtggccgtctcatttgtcactttaattacgggtaacatgagttttaaagatttaggacgtgtcgtagtgatggttggtgctacaatgactgacgatattggaatgggagtcacttatctagctctacttgcagcctttaaggtaagaccgacttttgcggcaggcctgttactaaggaaattaacaagtaaggaactcatgatgactacaataggcattgttctcctttcgcaatctacgattcctgaaacgatactcgagcttacagatgcgctcgctttaggtatgatggttctaaagatagtgcgaaatatggaaaaatatcaattagcagtgaccattatggcaattctctgtgttcctaacgctgtcatacttcagaatgcctggaaagtgagctgcacaatcctagcggtggtgtccgtaagccctttgctccttacatcatcccaacagaaaactgattggatccccctcgcattaacgattaagggattaaatcccacagcaatatttttaacaacactatcaagaacaaataagaagagaagttggccattaaacgaagccataatggcggtaggaatggtttcaattttagcttcatctctcctgaaaaatgacatccccatgacaggacccctagttgctgggggtctactgacagtatgttatgtcctgacaggacgaagcgctgacttagaactcgaacgtgcaacagacgttaaatgggaagatcaagcagaaataagcggatcatcacctatactttcgattacgatctcagaagacggatcaatgtcaatcaaaaatgaagaagaagaacaaacactgacaatattaattcgcaccggcctcctagtgatatcaggactcttcccggtctcgataccgattacagccgcagcatggtacttatgggaagtcaagaaacaaagagcaggagtattatgggacgtaccgtctccccctcccatgggcaaagctgaactagaagatggtgcctaccggatcaagcaaaaaggcatattaggttattcccagataggtgcaggagtatataaggaaggaacatttcatacaatgtggcatgtaacccgaggtgcagttctaatgcataaaggtaagcgtattgagccatcatgggccgacgtgaaaaaggatttaatatcatacggaggcgggtggaaattagaaggtgaatggaaggaaggggaggaggtacaggtgctagcactagaacctgggaaaaatccccgagcggttcaaaccaaaccagggctatttaaaaccaacacaggtacaataggtgccgtaagtttagacttctcaccgggcacatctggctcgccaatcatcgacaagaaagggaaggtagtcggcctgtatggaaatggtgttgtcacgaggtcaggtgcatacgtatccgccatcgcacagacagaaaaatcaatcgaagacaatccagaaatcgaagacgacatttttcgcaaaaggcgactaacaatcatggatttacatccgggggctggaaaaaccaaaagatacttaccagccatcgtaagagaggctataaaacgaggactaagaactttaatattggcgccaactagagttgttgcagcagagatggaagaagcactccgcggattacctattagataccagacccctgcgatccgagccgaacatacaggccgagaaattgtagacttaatgtgtcacgccacgtttactatgcggctactatcacctgtacgagtaccaaattacaacctaataataatggatgaagcgcattttacagatccggcttcgatcgccgcaagaggctatattagtacacgggtagaaatgggggaagccgcaggaatatttatgaccgcgacccctcctggtagtagagacccattccctcaatcaaacgccccaattatagacgaagaaagggaaatccccgaaagaagctggaactctggacatgagtgggtaactgattttaaaggaaagaccgtctggtttgtgcccagcattaaagccgggaacgatattgctgcctgcttaagaaagaatgggaagaaagtcattcaactatcgagaaaaacattcgactctgaatatgtcaaaacgcgaaccaatgattgggactttgtggtcactacagacatatcagagatgggggctaactttaaggcagagagagtgattgacccaaggcggtgcatgaaaccagtgattttaactgacggagaagaaagagtcatactagcaggaccaatgccagtaacacacagctcagcagcccaaagacgggggagaataggtcgtaaccccaaaaatgaaaatgatcaatatatatatatgggagaacccctagaaaacgatgaagattgtgctcattggaaggaagcaaaaatgcttctagacaatatcaataccccagaaggtataataccatcaatgtttgaacctgaacgtgaaaaagtcgatgcaatcgatggagaatatcggttaagaggggaagcaagaaaaacatttgtagatctgatgagacgaggagacctaccggtatggttagcttacaaggtagctgcagaaggaatcaattacgccgatcgtcgatggtgttttgatggaattaaaaacaatcaaattttagaagaaaacgtagaagtagaaatctggactaaagagggagaaaggaagaaattaaaacctagatggttagatgcacgtatttattcggaccctctagccctgaaagaatttaaagagtttgccgccggacgaaaatcactcactttaaacttgataacggaaatgggtaggttaccaacattcatgacacagaagacgagagacgcgctagataacctagcagtactccacaccgcagaagcgggaggtagagcttataatcatgcgctaagcgaattaccagaaacattagaaacattattactgttgacacttctcgctaccgtaactggtggcatctttttatttctaatgtccggaagaggaattgggaaaatgacacttggtatgtgttgcataatcacagcgtccatattgttatggtatgctcagatacagccccactggatagcagcgtcaataatacttgagttcttcttgatagtattactgatccctgaacccgaaaaacaacgcacaccgcaggataatcaacttacttatgtcgttattgcgatcttaactgtagtcgcagcgacaatggctaatgaaatgggatttcttgagaaaacgaagaaagatctgggactaggaggtattgcaactcagcagccagaaagcaacatattagacattgatctacgtccagcgagtgcctggacactatacgcagtagcgaccactttcgtcacacctatgttgagacacagtatagaaaacagttcagtcaatgtgtccttaaccgcaattgccaaccaggcaaccgttttaatgggtctcgggaaaggctggcctttgagcaaaatggatattggggtccctttgctggcaataggatgctattctcaagtcaatcctatcactctcacagcagcacttttattattggttgcacactacgcgattattggaccaggattacaggcgaaggcaactcgagaggcacagaaacgggccgcggcagggattatgaaaaatccaacagttgatgggataaccgttatagatttagaccccataccatatgatccaaagtttgaaaaacaattaggtcaggtcatgctgttagtcctgtgtgtcacacaagtccttatgatgcgtactacatgggccctctgtgaagcattaacattagctacaggtccaatctcaaccctatgggagggtaaccccggaagattttggaataccactatagctgtatcgatggccaatatctttagagggtcatatttagcaggagctgggttattattctcgataatgaagaatacaaccaatacaaggcgaggtacaggaaatattggagagacactaggagaaaagtggaagtctagattaaacgcacttggaaaatctgaatttcagatatataagaaatcagggattcaagaagtagatagaactttggctaaggagggaataaaaagaggcgaaacggaccatcacgcagtgagccgaggaagcgcaaaattacgatggttcgtggagagaaatatggtaactcccgaaggaaaggtcgtagacctaggttgcggcagaggaggctggtcatattactgtggcggcctcaagaacgtccgagaagtgaaaggtctaacaaaaggaggtccaggacacgaggagcctatccctatgtcgacttacggatggaatttagtccgacttcaatcaggggtcgacgtatttttcatacctcctgaaaaatgtgatacgcttttatgcgatattggcgaatctagcccaaaccctacggtcgaggcaggacgcaccttaagagtgttgaacctcgtagaaaattggttaaacaataatacacaattttgcattaaagtccttaatccatacatgccgtcagtcatagaaaagatggaagcactacaaaggaagtatggtggggcactcgtccggaatccactgagccgaaattcaactcacgaaatgtactgggtttctaatgcctcgggaaatattgtaagcagcgtaaatatgatctctcgaatgttaattaaccgatttacaatgcggcataagaaagcaacttacgaaccagatgtggatcttggttctggcactaggaacatcggaattgaatctgaagtacctaacctagacattattggaaaacgtatagaaaagataaaacaggaacacgaaacaagttggcactatgatcaggatcatccctacaaaacgtgggcctatcacggttcgtacgaaacgaaacaaacaggttcagcttcaagcatggtcaatggagtagtacgcttgttgaccaaaccttgggatgtcctaccaactgtaacgcaaatggcgatgacagacacaaccccatttggacagcagagggtgttcaaggaaaaagtagatacccgtacgcaggagcctaaagaaggtaccaagaagttaatgaaaataaccgcggagtggttatggaaagaattaggcaagaagaaaacaccaaggatgtgcacaagagaggagtttacacgcaaggtaagatcaaacgcggcacttggagccatattcacagatgagaataaatggaaatcagcaagagaagccgtcgaagattcacgcttttgggagctagttgataaagaaaggaacctacacttggagggaaagtgtgaaacatgtgtatacaacatgatggggaagagagagaagaaacttggggaatttgggaaagcaaaagggtcgagagcgatatggtatatgtggttaggggctagatttctcgagttcgaggcgcttggatttttaaacgaggaccactggttcagccgcgagaacagcctttccggtgtagagggagaaggattacataaattaggatacatcttaagagacgtttcaaagaaagaaggaggaacaatgtatgctgatgataccgcaggttgggatacaaggataacattggaagatttaaagaacgaagaaatggttacaaaccacatggaaggggaacataaaaagctagcagaagcaatattcaagctaacgtaccaaaataaagtagtaagagtgcagaggccaacgcctaggggcacagttatggacataatctctagacgagaccaaaggggatccggacaagttggtacttacggcctaaacacattcacaaatatggaagcccaattaattagacagatggaaggtgaaggagtatttaaaaacattcaacacctaacagttacagaagaaatagccgtacagaattggttggcccgagtcggtcgtgaaaggctatctcgaatggccatatcaggagacgattgtgtggtaaaaccactagatgaccgatttgcatcagctctcacagctctaaacgatatgggaaagataagaaaagacattcaacagtgggagccttctaggggttggaacgactggacgcaagttccattctgtagtcatcatttccatgaactaataatgaaggatggtcgggtgcttgtggtaccttgcagaaaccaggatgagctaattggaagggcaagaatcagccaaggagcaggttggagtctgagagaaacggcgtgtttgggcaaaagttatgcacagatgtggagcctcatgtacttccaccgcagggatttacgtttagcggccaacgctatatgttcagcagttccatctcattgggtacctaccagtaggacaacatggtcaatccacgcaaagcatgaatggatgactactgaagatatgctaacagtatggaatcgagtatggatacaggaaaatccatggatggaggataaaacacctgtcgacagttgggaggagataccctaccttggcaaaagagaggaccaatggtgcggatctttgatcggactcacttcacgcgccacgtgggcaaagaatatacaggctgctataaatcaagtaaggtcgctcattgggaatgaggaatacacagattatatgccgtccatgaaaagatttaggcgagaagaggaggaagcaggcgtgctctggtag

SEQ ID NO: 22521 - RNA, 9876 nt, synthetic construct
  misc_feature 1..9876: note = derived and/or modified CDS sequence (opt6) from DENV-2__GQ868544__SS-prME
  source 1..9876: mol_type = other RNA
agcgtagggatgataataatgcttattccaacagtaatggcattccatttaaccactcgaaacggtgagcctcacatgattgtatcaatacaagaaaaaggaaaaagtcttttatttaaaactgaagatggtgtaaatatgtgtacattgatggctatggacctcggtgagctatgtgaagatacaatcacttacaaatgcccattgctacgccaaaatgaaccagaagatatcgattgttggtgtaacagtacatcgacctgggtcacatatggtacctgcaccacaacaggagaacatagaagagagaaacgatcagtggccctagtacctcacgtaggcatgggattggaaacacgtaccgagacgtggatgtcctcagaaggagcatggaaacacgcacaaaggatagagacatggatcttaagacatccaggttttacgattatggcagcaatacttgcctatacaataggaacgacacacttccagagagccctcatatttatattacttaccgctgttgctccgagtatgactatgagatgtataggcataagcaaccgtgatttcgtagaaggcgtttccggtggaagttgggtagacattgttctagagcatgggtcctgtgtaacgaccatggcgaaaaacaaaccaacgctagatttcgaattaatcaaaactgaagcaaaacaaccagcaaccttacgaaaatattgtattgaagcaaaattaaccaatacgacaaccgaaagtagatgcccaactcaaggagaacctagtttaaaagaagaacaagataaacgattcgtttgcaaacatagtatggttgatagaggatggggaaatggttgtggattatttggcaaaggcggaatagtaacatgcgctatgttcacttgtaagaaaaacatggaggggaaaatagtacaaccagaaaatttagaatacactatcgttgttacgccacactcaggggaagaacatgcagtaggaaatgataccggaaaacatggaaaagaaataaaagtcactcctcaaagtagcataactgaggcagaactgacgggatatggaacagtaacaatggagtgttctccaagaacaggattagattttaatgaaatggttttacttcaaatggaaaataaagcatggctagtgcatagacaatggtttctggatctaccactcccatggttacctggagcggacacacaaggctcgaattggattcaaaaagaaactcttgtcacatttaaaaatccacacgccaagaaacaggacgtcgtcgtcctaggttctcaagaaggtgcaatgcacactgccttaactggagcgacagaaattcaaatgagttctggtaacttgctatttacgggacatttaaaatgtcgcctaagaatggacaaactacaactgaaaggtatgagttacagcatgtgcacaggtaaatttaaagttgtaaaagaaatagccgaaacacaacacggaacaatcgtcatacgcgtgcaatacgagggagatgggtcaccgtgtaaagtcccattcgaaataatggatttggaaaaacgctacgtacttggtcgcttaataaccgtaaacccaatagtgacagagaaagatagtcctgtaaatatcgaagctgagcctccatttggggattcgtatataataataggtgttgaaccaggccaattgaaactaaattggtttaagaaaggtagctcaattggccaaatgttcgagactacaatgcgtggtgcaaaacgtatggccatattgggcgatacggcatgggatttcggatcattgggaggcgtttttacgagtattgggaaagcattacatcaagtatttggagctatatatggagcagctttttctggagtatcttggacaatgaaaattttgattggagtaattatcacatggataggcatgaactctaggtctacatcgttgtcagtatcgcttgtactcgtcggaattgtaacactatatctaggagttatggtacaggccgattcgggttgtgtagtaagctggaaaaataaagaattaaaatgtgggtctggaatattcattactgacaacgtgcatacatggacagaacagtacaaattccagcctgagagcccaagcaaactggccagtgccattcaaaaagcacaggaggagggaatatgtggtatcagatcggtcacgaggctagagaacctaatgtggaaacaaatcacaccagagctaaaccacattttagcagaaaatgaggtaaaattgacaatcatgacaggtgacatcaaaggaatcatgcaagcaggtaaaaggtcactcagaccgcaacccacagaattaaaatacagttggaaaacatggggtaaagcaaaaatgctaagcacagagagccataaccaaacatttctgatcgatggaccagagacagcggaatgtcccaacacaaatagagcatggaactcacttgaggttgaagattatgggtttggggtatttacaacaaacatttggttaaaattaaaagaaaagcaagatgcattctgcgatagcaagttgatgagcgcagctatcaaggacaacagagcggtccatgcggacatggggtattggatagaaagcgccctaaacgacacctggaagatcgagaaagcatcattcatagaagttaaaaactgtcactggcccaaaagtcacactttgtggtccaatggagtcctagaaagtgaaatgatcatacccaaaaatctagccggtccagtaagtcaacataattaccgtccaggatatcacactcagattgcagggccatggcatttaggaaaactggaaatggactttgacttctgtgacggaactacagtcgtagtgacggaagactgtggaaatcgaggacctagtcttagaacaaccacagcttcaggaaaactaattacagagtggtgctgtagatcatgcactctaccacctttaagatacagaggagaagatggatgttggtacgggatggaaatacgaccattaaaggaaaaagaagagaacctggtaaatagtcttgtcaccgcgggacaggggcagatcgacaatttttctttaggagttctcgggatggcattattcctagaagaaatgttacgaacaagagtaggaactaaacatgcaatacttttagtcgcggtttcattcgtgaccctgattacaggcaacatgagtttcaaagatttgggtagagtcgttgtaatggtgggtgcaaccatgacagacgatatagggatgggtgtaacctatttagcgctgctagccgcgttcaaagttagacctactttcgcagcaggattattacttcgaaaactgacaagcaaagaattaatgatgacgaccatcggtatcgttctattgtcccaatcaaccataccagagacaattctagagttgactgacgcgcttgccttagggatgatggtactcaaaatcgtgcgagatatggaaaaatatcaacttgcagtaacaatcatggccatattatgtgttccaaacgctgttatattgcaaaacgcatggaaggttagctgtacgattcttgctgttgtttctgtcagtcctctgctattaacatcatcccagcagaaaacagattggataccgctagcgttaacaataaaggggctaaacccaacggctatatttttgactacactgtctcggacaaataagaaacgatcatggcctttgaatgaagcaataatggcggttggaatggtgagcatactagcaagcagcctactaaagaacgacattccgatgacaggacctttagtagctggcgggttattaacagtatgctacgttctaacaggaagaagtgccgacttggagttagagagagcgaccgatgtaaaatgggaagatcaagcagaaattagtggatcaagccccatactatccataacaatatctgaagatggttcaatgagcatcaaaaatgaagaagaagaacaaactttaacaatactgattcgcacgggactcctagtaatctcaggtctatttccggtatcgataccaattacggccgcggcctggtacttatgggaggttaaaaagcaaagggctggagtattatgggacgtgccgtccccacctcccatgggaaaagcagaactggaagatggagcataccggattaaacagaaaggaatactaggatacagccaaatcggcgctggagtatacaaagaaggaacgttccacaccatgtggcacgttactagaggagccgtgttgatgcataaaggtaaacgtattgagccatcttgggctgatgtcaagaaagatcttatcagttatggtggaggctggaaattagaaggtgaatggaaagagggtgaggaggtacaagtattagcattggagcccggaaagaatccaagggctgtacaaactaaaccgggtctctttaaaacaaacacgggaactattggtgccgtgtcattggacttcagccccggaacaagtggtagcccgataattgacaaaaagggcaaagtcgtaggcttatacggcaacggagtagtgactaggagcggagcatatgtatccgcgatagctcaaaccgaaaaatcaatagaagacaacccggacatcgaggatgacatatttcggaaaaggagattaacgatcatggacctacatccaggcgcaggcaagaccaagcgctatctgcctgccatagtccgagaggctataaagcgtgggttgaggacactaatcttagctcccacacgggtggtagcggcggaaatggaagaagcactaagaggtttgcctataaggtatcaaactcccgcaataagagccgaacatacgggtcgcgaaatagtagacctaatgtgtcacgcaaccttcacaatgcgattgctatcaccagttagagtaccgaactacaacttaattataatggacgaagcacattttacagacccagcttctatagctgccaggggatatatatctacaagagtcgaaatgggggaagcggcaggcatattcatgacagcaaccccaccaggatcgagggatccttttcctcaatctaatgcacctataattgacgaggaacgcgaaatacctgaacggagctggaactcaggtcatgagtgggtgaccgacttcaaaggcaaaaccgtttggttcgtaccatcaattaaagcggggaatgacatagctgcctgcctcaggaaaaatggaaagaaagtgatccaattatcacgaaaaacatttgatagcgaatatgtgaaaacaaggacaaatgactgggactttgtagttacaacagacattagtgaaatgggggcaaactttaaagccgaaagggtaatagaccccagaagatgtatgaaaccagtaattcttactgacggagaagaaagagtcatattagcaggacctatgcccgttacacactcgagtgcggcacaacgtcgaggcaggattggaaggaaccccaaaaacgaaaatgatcaatatatctacatgggtgagccgttagaaaatgatgaggattgtgctcattggaaagaagcgaagatgttacttgacaacataaatacaccggaagggataattccaagtatgtttgagccagaaagggagaaggtggacgctatagatggagaatatagattgcgaggagaggcacgtaaaacgttcgttgatctcatgcgacgaggggaccttcccgtgtggctagcatacaaagtagcggcagaaggtattaactacgcagatagaagatggtgctttgatggaataaagaataaccagatattggaagaaaatgtagaggtagaaatatggaccaaggagggagagagaaagaaacttaaaccaagatggctcgacgcaaggatttatagcgacccattggcgcttaaggagtttaaagaatttgcagcgggacgcaaaagtttaactctgaacctaataaccgaaatgggtagattacctacatttatgactcagaaaactagagatgcgctagacaatttagccgtacttcatacagcggaagccggaggtagagcttacaaccacgctctaagcgaactaccagaaacgctagaaacgcttctactcctgacgctattagccacagtgactggaggaatatttttattcttaatgtctggaagaggaattggaaagatgactttaggaatgtgctgcattgttacggcatccatactattatggtatgcacaaatacaacctcattggatagcagcgtccattatattagagttctttctaatagtgttgttgataccggaaccggagaaacagagaaccccacaagacaatcaactaacatatgtcgttattgctatactaaccgtggtagcggccaccatggctaacgagatgggtttcttagagaaaaccaagaaagacctgggtctgggaagtatcgccacgcaacagccagagagtaatatactagatatagatcttcgacccgcatctgcttggacattatacgctgtagccacaacttttgttactccaatgctccggcattccatcgagaacagtagcgtaaacgtttcactcacggcaatagcgaaccaagctactgtattaatgggtctagggaagggttggcccctttctaaaatggacataggtgtcccattgctggcaataggctgctattcacaagtcaatccaataacattaactgcagctctattgttattggtagcccattacgcaatcataggaccgggtttacaagcaaaagcaacaagagaagctcagaaaagagcagcggccggaattatgaaaaacccaactgtggatggcatcacagtaatagatttggacccaataccctatgatccaaagtttgaaaaacaattgggtcaagtgatgctcttagtactatgcgtcactcaagtcttgatgatgcgaacaacttgggcattgtgtgaagcactcacgttagcgacaggacccataagtaccctatgggaaggaaaccctggccgattttggaatactactatcgctgtgagtatggctaatattttccgtgggtcctacctagctggagcaggtctactattttcaataatgaagaacaccacgaacactcgcagaggaacagggaacataggagaaactctaggggaaaaatggaagtcgaggctgaatgcacttggaaaatcggagttccaaatatataaaaagagcgggatccaggaagtggataggacccttgcaaaagaaggaataaaaagaggggaaacggatcaccatgcagtctctcggggcagcgctaaattacgctggtttgtggaaagaaacatggtcacgcctgaaggaaaagttgtagatttaggatgtggacgaggaggctggagctactattgcggcgggcttaaaaatgttcgagaagttaaaggcctaaccaaagggggtcccggccatgaagaaccaatacccatgtcaacatatggatggaatctagttcgattacagtccggcgtagacgtattctttattccaccggaaaaatgtgacacattactgtgcgatattggcgagtcaagtcctaacccaacggtagaagctggtagaacattaagggttttaaacttagtcgagaactggctgaacaataatactcaattttgcataaaagtgcttaatccctacatgccatcagtcatcgagaaaatggaaactttacaacggaaatatgggggagcccttgttagaaaccctctttcacgaaatagtactcatgaaatgtactgggtgtctaacgcgagtggaaacatcgtatcgagtgtaaacatgatcagtaggatgctcataaatcgatttactatgagacacaagaaagcaacatatgaaccggacgtagacttggggtcaggcacccggaacattggtatagagagtgagatacctaatttagacataattggaaaaagaattgagaagataaaacaggaacatgaaacttcatggcactatgaccaagaccatccctataagacgtgggcataccacgggagctatgaaacaaaacaaactggatcagcatcgtctatggtaaatggagtagttagattattaacaaaaccatgggatgtcctgcccactgttacgcaaatggctatgactgataccacaccctttggtcaacaaagagtattcaaagaaaaagtcgatacacgtacacaagaaccaaaagaaggaactaagaaactgatgaaaattactgccgagtggttatggaaggagttgggtaagaagaaaactccgagaatgtgcacgcgtgaagagtttactcgtaaagtccgtagtaatgctgccttaggagcaatcttcaccgatgagaacaaatggaaatcagcgagggaagcagtcgaagatagtcgattttgggaactggtagacaaagaacgaaacttgcatctagaaggaaaatgtgaaacgtgtgtatataatatgatgggcaaacgagaaaagaaattaggagaatttggtaaagctaaaggctcaagagcaatttggtacatgtggctaggagcacgttttcttgaatttgaagcattaggatttctaaacgaagaccactggttcagtagagaaaattcactatcaggcgttgaaggggaggggctatataaactcggatatattctacgcgatgtgagcaagaaagagggcggcgccatgtacgcagatgacacggccggatgggatacacgcatcacattggaagacctcaaaaacgaagaaatggtcacgaatcatatggagggagagcataagaaattagctgaagctatattcaaactgacgtaccaaaataaagttgtacgagttcaacgtccaaccccacgcgggactgtaatggacataatcagtagaagagatcagagaggaagtggtcaagtaggtacttatggacttaacaccttcaccaatatggaagctcagttgataagacagatggaaggtgaaggggtatttaagaatatacagcatttaactgtaacggaggagattgcagtacaaaattggctagcaagggttggacgtgaacgactatctagaatggcaatatcaggtgatgactgtgtcgttaaaccgctagatgaccgcttcgcaagtgctctgacggcattaaatgatatggggaaaataagaaaagacatacaacaatgggaaccaagcaggggttggaatgattggacacaagtaccattttgctctcatcactttcatgaattaatcatgaaggatggaagggtcttagtggttccctgccggaatcaagatgaactcattggtagagctagaatatcacagggcgcaggctggagtttacgggaaacagcgtgtctcggtaaatcgtacgcacaaatgtggtcgctaatgtattttcataggagagatctcagactagctgctaacgcaatttgctctgcggttccatctcactgggtccctacatcgaggactacatggtcaatacatgcaaaacatgaatggatgaccactgaagatatgctgacagtgtggaatcgagtttggatacaagaaaacccgtggatggaagacaaaaccccagtcgaaagttgggaggaaatcccatacttgggtaaaagggaagatcagtggtgcgggtcgctgatcggattaacatcccgcgccacatgggcaaagaacattcaagcagctataaatcaagtaagatctttaattggaaatgaagaatacacagactatatgccgtctatgaaacgatttcggagagaggaagaagaagctggcgtactatggtaa

SEQ ID NO: 22522 - RNA, 9876 nt, synthetic construct
  misc_feature 1..9876: note = derived and/or modified CDS sequence (opt6) from DENV-2__GQ868545__SS-prME
  source 1..9876: mol_type = other RNA
tctgcaggaatgatcattatgttaatacccaccgttatggcttttcacttgaccacacgaaatggagaaccccatatgatagtaagtatacaagaaaaaggaaaaagtttgttgtttaaaacagaagatggagtaaatatgtgtacattaatggcaatggatttaggagaactatgtgaagacactatcacatataaatgtcccttgttgagacaaaacgaacccgaagacatcgactgttggtgtaatagcacaagtacatgggtaacttatgggacatgtaccacaaccggagaacacagacgtgagaaaagatcggtggcacttgtccctcatgtaggaatgggactcgaaacgcggacagaaacgtggatgagttcggaaggtgcttggaaacatgcgcaacgaattgaaacatggatcctaaggcatcctggattcacaataatggcagcaatactagcttataccataggtacaacgcattttcaaagggcattgatatttatattactgacagccgtagcacctagcatgacaatgagatgtataggtatcagcaatcgggatttcgttgaaggcgtgtcgggtggcagttgggtcgatatagttttagaacatgggtcatgtgtgaccacaatggccaaaaataaaccaacattagactttgaactcataaaaaccgaagccaaacaaccagctactctaagaaaatactgtatagaagcaaaactaacaaacaccacaacagaatctcgatgcccgacgcaaggggagcccagcttgaaagaagaacaagacaaacgtttcgtttgcaaacactcaatagtcgatagaggttggggcaatgggtgtggattattcggaaaaggtggaatagtaacttgtgcaatgtttacatgtaagaaaaacatggagggaaaaatagtgcaaccagaaaatttagaatatacgatagtcgtaaccccacactcgggagaagaacacgcagtagggaatgatacaggaaaacacggcaaagaaataaaagtcacaccacaaagctcggttaccgaagcagaattaactggctatgggacagtaactatggaatgtagtcctcgtactgggctagactttaacgaaatggtattgctacagatggaaaacaaggcttggctagtgcaccgacaatggtttctcgatttacctttaccgtggcttcctggcgctgatacacagggatcaaattggattcaaaaagagacattagttacgttcaaaaatcctcacgcaaagaaacaagacgtggttgtattgggatcacaagagggtgcaatgcatacagcgctgacaggagcaacggagattcaaatgagctctggtaacctcctatttacaggacatttaaaatgtcgtctaagaatggataaattacaactaaaagggatgtcatacagtatgtgtactggtaaatttaaagtggtaaaagaaatcgctgaaacacaacatgggactattgtgatacgtgtgcaatacgagggagacggctcaccgtgtaaaataccatttgaaataatggacctggagaaaaggtatgtgctaggtaggcttataactgtcaatcccatcgtcactgagaaagattcccccgtgaacatagaagcggaaccaccgtttggggatagttacataataataggggtcgaaccgggtcaactaaaattaaattggttcaaaaagggaagtagtataggacagatgtttgaaacgacgatgagaggagccaaaaggatggctattctaggagacacagcatgggacttcggaagcctgggaggtgtattcacatctatcggaaaagcattacatcaggtatttggagccatttatggggcagcattctcgggtgtctcctggactatgaaaatactgattggagtaatcataacatggattggaatgaactctagatcaacaagcctttcggtatctttagtccttgtgggcatagtaacactgtatctgggcgtgatggtacaagctgactcagggtgcgtcgtctcatggaaaaataaggagctgaaatgtggttctggtatatttataactgacaacgtccatacttggactgaacaatataaattccaacctgagtcaccttctaagttagcttctgcgatccaaaaagcacaagaggaaggtatctgtggtataaggtccgtaacaaggttagaaaacctaatgtggaaacagataaccccagaattaaatcatatactcgctgaaaatgaagttaaattaaccataatgactggtgacataaaaggtataatgcaagctggaaagcgttcgctacgtccacagccaacagaattaaaatacagctggaaaacctgggggaaggcaaaaatgttatctacggagagccacaaccagacattcttaatagacggtcctgagactgcagagtgccccaataccaatagagcgtggaactcgctggaagttgaagattatggatttggcgtcttcactacgaatatatggctcaaactgaaagaaaaacaagatgcattttgtgattcgaaacttatgtcagccgcaattaaggataatcgagccgttcacgcagatatgggatattggatagaaagtgcacttaatgacacatggaaaattgaaaaagcatcatttatcgaagttaaaaattgtcattggcccaagtcacatacattatggtcaaacggggtcctagaaagcgaaatgataatacccaagaatttagctggacctgtgtcccaacataattatagaccaggataccatacccaaatagcaggaccttggcatctcggaaaattggaaatggatttcgacttctgcgatggcacaacagtagtagttacagaagactgtggaaatagaggaccaagtctaagaacaactacagcttctggcaagctaattactgagtggtgttgcagaagctgcactttaccaccattaaggtaccgtggagaggatggatgttggtatggaatggagataagacccttaaaagaaaaggaagaaaatctggtcaacagtctcgtcacagcaggtcatggccagatagacaattttagtttaggagttttaggtatggctttatttttagaagaaatgttgagaacgagggtaggcacgaaacacgccattctattagttgcagtgagtttcgtgactttaatcaccggaaatatgagtttcaaggacttgggaagagttgttgtaatggtgggcgcaacaatgacagatgacattggtatgggcgtgacctacttggccttattagctgccttcaaagtgagaccaacactagctgccggtctattgcttcgtaaattaaccagtaaagagcttatgatgaccactattggaatcgtattgctaagccaaagcaccatccctgaaaccatattagaattaaccgatgcacttgccttaggcatgatggtcctgaaaattgttagagatatggagaagtaccagctagctgtaacgattatggctactctctgtgtaccgaatgcagtaatcttgcaaaatgcttggaaagttagttgtacaattctggcagttgtgagtgtaagccccttactgctaacgtcctcacagcagaaaactgattggataccattggcacttaccataaagggcctaaacccaactgcaattttcctaaccaccttgtcaagaactaacaaaaagcggtcctggccactgaatgaagcaattatggcggtgggaatggtctctattttagcgtcaagtctattaaagaatgacataccgatgacaggaccattagtggcagggggccttttgacagtttgttatgttttgacaggcaggtctgcggatctagagctagaaagagcgacagacgtaaaatgggaggatcaggcagaaataagtggcagttcgccaatactctctataaccataagtgaagatggtagcatgtcaattaaaaatgaagaggaggaacaaacattaacaatacttatcagaaccggcttgttagttatttccggactgtttcctgtaagcatacccatcacggctgctgcgtggtacctatgggaggtgaagaaacagcgcgctggtgtactctgggacgtcccatcaccaccgccaatgggaaaagctgaactagaagatggagcatatcgcattaaacaaaaaggcattcttggatactcgcaaatcggtgcaggcgtatataaagagggtacgtttcacacgatgtggcatgttacacgtggcgctgtactgatgcataagggaaagagaatagaaccttcctgggcagatgtcaagaaagacctaatctcatatggtggtggttggaagttagaaggagaatggaaggaaggagaagaggtacaagttttggcgttagaaccaggcaaaaacccaagagcagtacagactaaaccagggttatttaaaacgaacactggtacgataggggccgtatcgctggatttttcgccaggcacctcgggttcacccatcatagacaagaaagggaaggtcgtgggcttgtatggaaacggggtagttacgagaagtggcgcttacgtttcagcgatagcacaaacagagaaaagtattgaggacaacccagatatagaagatgatatttttcgtaaaaggcgcctgaccattatggacttacaccctggagcagggaaaacaaagcgatacttacctgcaatcgtacgcgaagccatcaagcgagggctcagaactttaatacttgcaccgacacgtgtagtagcagcagaaatggaggaggcactacgcggtttacctatacgataccaaacacccgcaatacgagcagagcatacaggaagagaaatcgtagacttgatgtgtcacgctacttttaccatgcgtctactaagccctgtccgcgttccaaattataatctaattattatggatgaagctcattttacagatccagcatctatagccgctagaggctacatttctacacgtgtagaaatgggcgaggcagctggaattttcatgacagcaacaccacctggttcccgcgatccttttccgcaatctaatgctccgataattgatgaagaacgcgagatccccgaacgcagttggaactctggacacgaatgggtcacagatttcaagggaaaaacggtgtggttcgtacctagtattaaagcgggaaacgacatcgctgcctgcctccgcaagaatggtaagaaagtcatacaattatcgcgtaaaacattcgatagcgagtatgttaaaaccaggactaacgactgggattttgtggttacaactgatatttctgaaatgggagcgaattttaaggctgaaagagtgatagacccaagaaggtgcatgaaacctgttatattgactgacggggaagaacgggtaattttagcaggtccgatgcctgttacccatagttccgcagctcaacgtaggggcagaatcgggagaaacccaaagaacgagaatgaccagtacatttacatgggtgaaccattagaaaatgacgaagattgtgcacattggaaagaagccaagatgttattagataatattaacacacccgaaggcattataccatcaatgtttgaacctgagcgagaaaaagttgatgcaatagatggtgaataccgattacgtggtgaagcgcgaaaaacttttgtagatctcatgagacgaggggatcttcccgtttggctagcttacaaagttgcagccgaagggatcaactatgccgatagaagatggtgtttcgatggtatcaaaaacaatcaaattctagaagaaaacgtagaagtagaaatttggactaaggagggagaacggaagaaattaaaaccgcggtggttggatgcaagaatttatagtgatcctctagctctcaaagaatttaaagagtttgcagccggacgaaaaagtctaaccttaaatttaattacagaaatgggcaggttgccaacattcatgacacagaagacccgggacgcattagacaatttagcggtgttacatacagcagaggccggtgggcgagcctataaccacgctttgtcagaactaccagaaacattagaaacccttctcctcttgactctgcttgctaccgtaaccggtggcatattcctcttcctcatgtcaggaagagggatagggaaaatgacgttaggaatgtgttgtataataaccgcctcaattctattgtggtatgcccaaattcaaccccactggatagccgcaagtatcatactagagtttttcttaattgtgcttctcataccagaacccgaaaaacagagaacgccacaagataatcaactaacttacgtggtcattgcaatactgaccgtggttgctgcaacaatggccaacgaaatgggatttctcgagaaaaccaagaaagatctcggattgggtagcattgcaactcaacaacctgaatcaaacatcttagacattgatctaagaccggcttctgcgtggaccctatacgctgtggccacaacgtttgtaactccaatgttgcgtcatagtatagaaaattcaagtgtgaatgtatctcttaccgccatcgcaaatcaggcaaccgttctcatgggactcggtaaaggatggcccctgagtaagatggatatcggtgtgccattactagcaatagggtgctattcacaggtgaaccctataaccttaactgcagcgttactattacttgtagctcattacgcgataatcggacccggtctgcaagcaaaagcaactagagaagcacagaaaagagcagcggctggaattatgaagaatcccacagtagatggaataaccgtaatagacctagaccccatcccttatgatcctaaattcgagaagcaactgggacaagtgatgttacttgtgttgtgcgtgactcaagttttgatgatgcggacaacttgggctttatgcgaagcgctaacattggcaacaggtcctatatctacattatgggaaggtaatccggggcgattctggaacactactatagccgtgtcaatggctaacatatttagaggttcatatttagcaggcgctggactactatttagtattatgaaaaatactactaacactaggagggggacaggcaatataggcgaaacattaggagaaaagtggaaatcccgccttaacgctttaggcaagtcagagtttcaaatctacaaaaagtccggaatccaggaagtcgacagaacgctggcgaaagaaggtataaaacggggtgagacggaccatcatgcagtgtcacgagggtcggccaagctaagatggttcgtcgagagaaatatggtgacaccagaaggaaaagtggtagatctcggttgtggtagaggtgggtggtcctattactgtggtggactaaagaatgtcagagaagtaaaagggctaaccaaaggaggtcctgggcatgaagaacctattccaatgtcgacatatggatggaatttagttaggttacaatcgggtgtagacgtattctttatccctccagaaaaatgcgacacactgctgtgtgatataggtgagagcagcccaaatcccacagttgaggctggaagaacgttacgagtcttaaatctcgtagaaaattggttaaataataatacacaattttgcataaaggtacttaatccatatatgcctagcgtcattgagaaaatggagacactacagcggaagtatgggggagccttagtaagaaatccgctaagtcggaacagtactcacgaaatgtattgggtatcgaatgctagcggtaatatagtttcaagtgtaaatatgattagtagaatgctcataaataggtttactatgagacataagaaagctacctacgaacctgatgtggatcttggatcaggaacaagaaatattgggattgaaagtgaaattccaaatctagacattataggcaaaaggatcgaaaagattaaacaagagcatgaaacaagctggcattacgatcaagatcacccatataaaacttgggcatatcatggctcctacgaaactaaacaaactggatcagcgagttcaatggttaacggcgtagtacgcctgttgactaaaccctgggatgttttaccaacggttactcagatggcaatgaccgatactacgccctttggacagcaaagagtttttaaagaaaaggtcgacacgaggacgcaagaacccaaagagggaactaaaaagctaatgaaaataacagcagaatggttatggaaggagctcggcaagaaaaagaccccaagaatgtgcacgcgtgaggaatttacacgtaaagttagatctaacgcagctctcggcgcgatattcacggatgaaaacaagtggaagtccgcgagggaagcagtagaggatagtagattctgggagttagtcgacaaagaaagaaagctacatttagaaggaaaatgtgaaacgtgcgtttataacatgatgggaaaaagagagaagaaacttggagagtttggcaaagctaaaggatccagggccatctggtacatgtggcttggtgcaagattcttggaatttgaagctctaggctttctaaatgaagaccattggttcagtagagaaaatagcctaagcggtgtagaaggcgaaggattacacaagttaggatacatattaagagacgtaagtaagaaagaagggggtgcaatgtatgcagacgacacagccggatgggatacaagaataacacttgaagatttgaaaaatgaagagatggtaactaatcacatggaaggtgagcataagaaactagcggaggctatattcaaactaacataccaaaataaagtagttagagtacagcggcctacaccacgaggaacagttatggatataatatcgagacgagatcaaagaggatcaggacaagtaggaacatatggcctaaacacatttaccaatatggaagctcaactaattaggcagatggaaggagaaggcgtctttaaaaacatccaacacttgactgtgaccgaggaaatcgcagtacaaaattggttagctagagtaggacgagagcgtttaagcagaatggcgatcagcggagatgactgtgttgtcaagccattggatgatagatttgccagtgcactgacagccttaaatgacatggggaaaatcaggaaagatattcaacaatgggaaccatcccgcgggtggaacgattggacacaagttccgttctgcagccatcactttcatgaattaataatgaaagacggtagagtgctagtagtgccgtgtagaaaccaagatgaattgataggcagagctagaatatcacagggagcaggttggtctttaagagaaacagcctgtctgggcaaatcttacgcccaaatgtggagtttaatgtatttccaccgtcgagatttaagacttgcagcaaacgctatctgctctgcagttccgagccattgggtccccacaagcagaacaacttggagtattcatgccaaacatgagtggatgaccaccgaagatatgctgacagtgtggaatcgcgtatggattcaagaaaatccctggatggaagacaaaacaccagtggaaagttgggaagaaatcccttatctcggtaaaagggaggaccaatggtgtgggtcgttgataggattaacttccagagcgacgtgggcgaaaaacattcaagccgccattaatcaagtacgatcgctaataggcaatgaagaatacactgattatatgccttctatgaaaaggtttaggagagaagaggaggaagcaggagtactttggtaa

SEQ ID NO: 22523 - RNA, 9876 nt, synthetic construct
  misc_feature 1..9876: note = derived and/or modified CDS sequence (opt6) from DENV-2__GQ868543__SS-prME
  source 1..9876: mol_type = other RNA
tccgctggcatgataatcatgcttattccaacagtaatggcttttcatctaacaacgagaaacggggaaccacatatgatcgtcggtatccaagaaaaaggaaaatcactcttatttaagacagaggacggcgtcaatatgtgtacactaatggcgatggacttgggagaactttgtgaagatacaataacatataaatgccctttacttagacaaaatgaacctgaagatattgactgctggtgcaatagcacaagtacatgggtaacttatggaacttgtactacaacaggtgagcatcgcagggaaaaaaggagcgttgcacttgtacctcacgtcggcatgggattggagacacgaacggaaacatggatgagcagtgaaggagcgtggaaacacgcacaaagaatagagacatggatcctgcgtcaccccggttttacaataatggctgccattttagcgtacacaataggtacaacgcactttcagagagcactcatatttatattgttgacggcggtcgcacccagtatgacaatgaggtgtattggaattagtaatcgtgacttcgtagaaggagtaagcggcggatcgtgggtagacattgtattagagcatgggtcctgtgtcactacgatggcgaaaaacaaacctaccttagatttcgaactaattaaaacggaagcaaagcagccagcgacccttaggaaatactgtatcgaagcaaaattgactaatacaacaactgaatctaggtgcccaacacaaggagaaccgagtctaaaggaagaacaagataaaaggtttgtatgtaaacatagtatggttgacagaggttggggaaacggctgcgggctattcggaaaaggagggattgtaacgtgtgcaatgtttacgtgtaaaaaaaatatggaaggaaaaatagtacaacccgaaaatctagagtacaccattgtagttaccccccatagcggagaggaacatgctgtaggaaatgacactggcaagcatgggaaagaaataaaggttaccccacaatcttcaatcacagaggcagagttaacaggatatggaacggtaacaatggaatgttccccaaggaccggcttagattttaacgaaatggtgctattgcagatggaaaacaaggcatggctagttcacagacaatggtttctagacctccccctcccatggttgcccggcgcagataaacaaggtagcaattggatccagaaggaaactttggtcacattcaaaaaccctcacgcgaaaaaacaagacgttgtagtacttggaagtcaggaaggtgccatgcacacagcacttacgggagccacggaaatccaaatgtcatcagggaatttactcttcactggacatctcaaatgcagattgagaatggataagttacaattaaagggaatgtcctattctatgtgtacgggaaagttcaaggtagttaaagaaatagctgagactcaacacgggacaatagtgatacgagtacaatacgagggagatggatcaccttgtaaaataccctttgaaataatggacctagaaaagagatatgtattaggaagattgattacagtaaatcctattgtcactgaaaaagacagtcccgtgaacatagaagcggagcctcctttcggtgactcatacattattataggtgtagaacctggtcaattaaaattaaattggtttaaaaaaggatcaagcattggacaaatgtttgaaacgaccatgagaggtgctaaacgtatggcaatacttggagatacggcttgggattttggctccctcggtggaatgtttactagtattggaaaagctctccaccaagtatttggggcgatatacggggctgccttctctggcgtgagttggacaatgaaaatcttgattggagtaataataacatggatcggtatgaattcacgttcgactagtcttagcgtctctctcgtgctagtgggcatcgtcactttatatttgggagtaatggtacaagctgacagcggatgtgtagttagctggaaaaataaagagttaaaatgcggctcagggatctttattaccgacaatgttcatacctggacagaacaatataaatttcaaccagaaagtccgagtaagttagcaagtgccatccagaaagcgcaagaggagggaatatgtggtatacgctctgttaccagactggaaaatcttatgtggaaacaaataacacctgaattaaaccatatacttgctgaaaatgaggttaagctcaccataatgacaggagatataaaaggtattatgcaggctggtaaacgcagtttgcgccctcaacccacggaattaaaatactcctggaaaacttggggaaaagctaaaatgctatctacggaaagtcataaccaaacgtttttgatagatgggccagaaactgcagaatgcccaaacacgaacagggcatggaactctctcgaagtcgaggattacggatttggagtgttcacaacaaacatctggcttaagttaaaagaaaaacaagatgcgttttgtgactcaaaacttatgagcgcggctataaaagacaacagagcagttcacgctgatatgggctactggatagagagcgccttaaatgatacttggaaaatagaaaaagcgtcatttatcgaagttaagaattgccattggccaaaatctcatacactgtggagtaatggggtcctcgaatcggaaatgatcatccctaagaacttggcggggccagttagtcaacataattacaggccgggctatcatacacaaattgcggggccctggcatttaggtaaactagaaatggactttgatttctgcgatggaacaactgttgtagtaacggaagattgcggtaatagaggaccatctctaagaaccacaacggccagcggcaaattaattacagaatggtgttgtagatcatgcacactacctccattaagataccgaggagaagatggctgttggtatggtatggaaataagaccgctcaaagaaaaggaagagaatttggtgaactccttggtaacagcagggcatggccaggttgataatttctcacttggagtattaggcatggcactctttctggaagagatgctccgaacacgcgtcggaaccaaacatgcaatattactggtagctgtatcatttgttaccctcataacaggtaacatgtccttcaaagatctcggaagagtggtagtcatggtaggggctactatgaccgatgacataggaatgggtgtcacgtacctagccttacttgcagcgtttaaagtaagaccaacttttgccgcaggactactactccgtaagttaacgtcaaaagagctcatgatgactaccattggcatcgtattgctgtcccaaagtaccattccagagacaattttggaattaactgatgcattggctcttggtatgatggtgctaaaaattgttcgaaatatggagaaataccaattagcagtaacaataatggcgattctttgcgtgcctaatgcagtcatcctgcagaatgcgtggaaagtatcatgcacaatacttgcagtagtcagtgtaagcccgttgttattgacgagttcacaacagaaaacagattggatcccactggcactaactataaaaggcctaaatccaacagccatctttttaacaactttgtccaggacgaacaaaaaacgctcatggcccttaaacgaagctattatggcggttgggatggtctctattttagctagcagcttactaaagaatgatatcccaatgactggaccactggtagctggcggactactgactgtatgctacgtcctgaccggccgtagtgccgatttagaattagaacgagccactgacgtaaaatgggaagatcaagccgaaatcagcggatcatcccccattctatccatcactatatccgaagatggctcgatgtcaataaaaaacgaagaagaagaacaaaccttaacaatactaataagaacgggactattagttataagcgggttatttcccgtctcaataccgattacagcagcagcatggtacctatgggaagtcaagaaacaacgcgcgggagtcttatgggacgtacctagtccacctccaatgggcaaagctgaattggaggatggagcttaccgaattaaacaaaaaggtatcctcggttattctcagattggggcaggcgtatacaaagagggcacttttcacacaatgtggcatgtaacaaggggtgcagttttgatgcacaaaggaaaacgaatagaaccaagctgggccgacgttaaaaaagatctaatatcatatggtggaggttggaaacttgaaggagaatggaaggaaggcgaagaagttcaagtactggcattagaacccggcaaaaacccaagagctgtacagacaaaacccgggctatttaagactaacacaggcacaattggtgcagtatcgctagactttagcccaggaacttcaggctctccaataatcgataagaaaggcaaagtagtaggtctgtacgggaatggggtagtcactaggagtggagcttacgtaagcgcaattgcccaaactgagaaaagtatcgaagataatccagaaatcgaggacgacatctttcgaaaacgcaggcttacgatcatggatctacacccaggcgccggtaagacaaagcggtacttacctgccattgtacgtgaagcaatcaaacggggattacgaacattaattctagcaccaacaagagtcgttgcagcggaaatggaagaagccttgcgtggtctccctattcgataccaaacgccggcgataagagcggaacacacaggtcgagaaatcgtagatctgatgtgtcacgcaacctttacaatgcgcctgcttagcccagtacgagtacccaactacaatcttataataatggacgaagcgcactttaccgaccccgcctctattgcagctcggggatacatcagcactagggtagaaatgggtgaagctgcaggaatctttatgacagcgacacccccaggctctcgggatccttttccccaatcaaatgcaccaattatagatgaagaacgagaaataccagagagatcatggaactccggacatgaatgggtgaccgattttaaaggtaagacggtatggtttgtaccgagtataaaggctggcaacgacattgccgcatgtttgaggaagaacggaaaaaaagtcatacaattaagtagaaaaacctttgatagtgaatatgtgaaaacaaggaccaatgattgggatttcgtggtcacaaccgatatttccgaaatgggagctaatttcaaagcagagagagttatagaccctagaaggtgtatgaaaccagtgatactaactgacggcgaggaacgagtaatactcgctggtcccatgccagtcacacattcatctgcagcacagagacgaggcagaatcggaaggaacccaaagaacgaaaacgatcaatacatatacatgggcgaaccactggaaaatgacgaagactgtgcccattggaaagaggcaaagatgctattagataatataaatactccagaaggtattataccgtcaatgttcgaaccagaacgagaaaaggtcgacgccatagatggtgaatacagattacgcggggaggcgagaaagacctttgtagatttaatgcgacgtggagatcttcccgtatggttagcctacaaagtcgcggccgagggtataaactatgcggacaggaggtggtgctttgatggtattaaaaacaaccaaatactagaagaaaatgtagaggtagaaatatggacaaaggaaggagagagaaaaaaattaaaaccgcggtggttagatgcgcggatctattcggatccattagcattaaaagagtttaaggagtttgctgcgggaagaaagtctttaacccttaacctcataacagaaatgggaagactgccgacttttatgactcagaaaacgcgggatgcccttgacaacttagcagtccttcatactgctgaagcaggggggagggcatacaatcatgctctcagtgaattgcctgaaaccctagaaactttattacttctaaccctattggcaacagtgactggaggcattttcttatttttaatgtcggggagagggatcggcaaaatgactttagggatgtgctgcattataacagcatcaatactactttggtatgcgcagattcaaccacactggatagctgcctccattatattagaattttttttaattgtattattaatcccagaaccagaaaaacaaagaacaccacaggacaatcagcttacctatgtagtgatagcaatattaacagtagtagctgctacgatggcaaacgagatgggatttctcgaaaagacgaaaaaagatcttggtctcggatccatagctacgcaacaacctgaaagtaatatcttagatatcgacctaagacccgcctcagcctggacattatatgctgttgctacaacgtttgtgaccccaatgctaaggcactctatagaaaattcaagcgtaaacgtatcgttaacggcaattgcaaatcaagctacagttctaatgggtctaggaaagggatggcctttgtcaaagatggatataggggtcccattattagcaatcggttgttactcccaagtaaatccgataaccctgacagccgcactattactacttgtggcccattatgcaatcattggccccgggttacaagcaaaagcaaccagagaagcacaaaagagagctgctgccggtattatgaaaaatcctactgttgatggaattacggtgattgacctcgacccaataccctatgacccaaaatttgagaaacaattaggacaagtaatgttgttgattttatgtgtaacacaggtgcttatgatgcgaactacctgggcattatgcgaagcattgactctggttacgggccccatctctaccctatgggaaggtaatccaggcagattttggaatactacaatagcggtgagtatggcgaacattttccggggtagttatcttgcaggtgcaggactactattctcaatcatgaagaacacaaccaacacacggcgaggaacgggtaatattggggagacattgggcgaaaaatggaagtcaagactaaacgccctaggcaaatcagaatttcaaatatataaaaaatcaggaatccaagaagtagacaggacactagcaaaagaaggcattaaaagaggtgagacagatcaccatgctgtctcgagaggctcagccaaactacggtggttcgtcgaaagaaatatggtgactcccgaaggaaaagttgtagacttaggttgcggaaggggtggatggtcgtactattgcgggggcctgaaaaacgttagagaagtgaagggtctgacaaaaggtggaccaggacatgaagaaccaataccgatgtccacttatggatggaatcttgtaaggttacaatcaggagtcgatgtatttttcatcccaccggaaaaatgtgacacgttattgtgtgatataggtgaaagtagccccaaccccacagtagaagccgggaggaccttacgcgtcttgaacttagtagaaaattggttaaataataatacacaattctgcataaaagtgttgaacccttatatgccatctgtgatcgaaaagatggaagcactgcaacggaaatatggtggtgctctagtaagaaatccattaagccgaaactcaactcacgaaatgtactgggtttcaaatgcatcagggaatatcgtgagtagtgttaatatgatatcacgaatgttgattaacagattcacgatgcgacataaaaaagcgacgtatgagcctgacgtggatttaggtagcggtacaagaaatatcggtattgaaagtgaaattcccaacttagacattataggaaaacgaatagaaaaaataaaacaggaacatgaaacatcatggcattatgaccaggatcatccttataaaacttgggcctatcacggatcttatgaaacaaaacaaaccgggtcggcatcgagtatggttaacggggtagtacgattattaacgaagccctgggacgtactcccaactgtcactcagatggctatgacagacacaaccccttttggacaacaaagggtttttaaagaaaaagtagatacacgtacacaagagcccaaggagggcactaaaaaactaatgaaaataactgctgaatggctatggaaggaacttggaaagaaaaaaaccccccgaatgtgtacgagagaagagtttacgagaaaagtccgaagtaatgcggcgctcggcgcaatttttacagatgaaaataaatggaaatccgcaagagaagcagtggaggactcgaggttttgggaattggtggacaaagaaagaaacctacatttagagggtaaatgtgagacctgcgtatacaatatgatgggtaaacgcgaaaaaaaactgggagaatttggaaaagccaaaggaagcagggctatatggtacatgtggcttggtgcaagatttttggaatttgaggcattaggatttttaaatgaagatcattggtttagcagagagaattcgttgtcgggagttgaaggggagggtctacacaaacttggttatatccttagggacgtttcaaagaaagaaggtggcgcaatgtatgccgatgacactgcggggtgggacactcggataactctggaggacttaaaaaacgaagaaatggtcacaaaccacatggagggagagcataaaaaattagctgaagctatatttaaattaacatatcaaaataaagtggtaagagttcaaagaccaactccacgtggtaccgtaatggacattataagccggcgagatcaacgcggaagcggacaagttggcacgtatggactcaacacattcactaatatggaagcacaactgattagacaaatggaaggagagggggtattcaaaaacatacagcatctcacagtaaccgaggaagttgcagtacagaattggctagcccgcgttggaagagaacgactatcccgaatggcaatctctggagatgactgcgttgtaaaacccttggacgatagattcgctaacgcactaaccgctttaaacgatatgggcaaaatacgaaaggatatacaacaatgggagccctcaaaggggtggaatgactggacgcaagtacccttctgctcacatcacttccatgaactcattatgaaagatggcagagtccttgttgtcccatgcagaaatcaagacgaattaataggacgagctagaatatcccaaggagccggatggtcgttgagagaaaccgcatgcctgggaaaatcatatgctcaaatgtggagcctgatgtacttccatcgaagagaccttagattagcggccaacgcaatttgtagcgccgtacccagccactgggtacccacctcacgcacaacatggtccattcatgcaaaacacgagtggatgactaccgaggatatgcttacagtatggaatagagtttggatacaagaaaacccttggatggaggataaaacaccagtagaatcgtgggaagagataccttacttaggcaaacgcgaagatcagtggtgcggctcgctcataggtttaactagtcgagcaacttgggcaaagaatattcaagcggctatcaatcaagtacggtccttaattgggaacgaagaatacacagattatatgccatctatgaaacgatttaggagagaagaggaagaagctggtgttttatggtaa

SEQ ID NO: 22524 - RNA, 9876 nt, synthetic construct
  misc_feature 1..9876: note = derived and/or modified CDS sequence (opt6) from DENV-2__EU482544__SS-prME
  source 1..9876: mol_type = other RNA
acagcgggcgttataattatgttaattccaacggtgatggcattccacttgaccacgcgaaatggagaaccacatatgattgtaggcagacaagaaaaaggaaaatcgctattattcaaaactgaagatggagtaaatatgtgtacactgatggcaatagatttaggtgaactttgtgaagataccataacttacaaatgtccactactaagacagaatgaaccagaagacattgattgctggtgtaatagtacatccacatgggtaacatatggaacatgcacaacaacaggtgaacaccgacgagaaaaacgatcggtagcattagttccacatgttggaatggggttggaaacacgtacagaaacatggatgtcaagtgaaggtgcctggaaacacgtccaacgaatagaaacttggatattaaggcatccgggatttacaataatggccgcaattctggcatatacaatagggaccactcacttccaacgtgcactcatcttcatccttctaactgcggtagcaccatcaatgactatgagatgcataggtataagtaacagagacttcgtagagggcgtctccggagggagctgggtggatattgtattagaacacggttcttgtgtaacaacgatggcgaaaaataaacctaccttagacttcgagttgattaaaaccgaagcgaaacaaccagctacattgcgtaaatactgtatagaagctaaactgacgaataccacgacagaaagtagatgtcccacacaaggagagccatcattaaatgaagaacaagacaaaaggttcatatgcaaacatagtatggtagatcgaggctggggaaatggctgtggtttatttgggaaaggaggaatagtgacttgtgccatgtttacatgtaagaaaaacatggaaggcaaagtagtattgcctgaaaacctagaatatactatagtcattacacctcatagtggggaagaacacgcagtagggaatgatacagggaaacacggaaaagaaattaaaatcacgccccaatcatctataaccgaagcagaactaacaggttacggcaccgtcaccatggaatgtagtccaagaaccggcctagattttaatgaaatggtactactccaaatggaagacaaagcatggttagttcacagacaatggtttttagatctgccactcccctggctcccgggggcggacacacaaggaagcaattggatacaaaaagaaacacttgtaacattcaaaaatcctcatgctaagaaacaggatgtagtagtccttgggtcccaagaaggggcgatgcatactgcactcacaggagccactgaaattcaaatgagttccggaaatctgctctttacgggacacctaaaatgtagattaagaatggacaaattacaattgaaaggaatgtcgtattcgatgtgcacgggtaaatttaaaatagtcaaagaaatagcagaaacgcaacacggtacaattgtcattagagttcaatatgagggagacgggtccccatgcaaaattccattcgaaataatggatctggagaaaaggcacgtactgggaagattaataacggtaaacccaatcgtaactgagaaagattctcccgtaaacatagaagctgagccaccattcggagactcttacataatcataggtgttgaaccaggtcaacttaaactgaattggtttaaaaagggatcgagtattggccaaatgtttgaaaccacaatgcgaggagcgaagagaatggcaatactaggtgataccgcatgggattttgggtctcttggaggcgtgtttacgagtattggaaaagcattgcatcaggtctttggagctatatacggagcagcttttagcggagtaagttggacgatgaagatcttgattggagtgattattacctggatcggcatgaacagtcggtcgacttcactatcggtgtcactcgtcctagtcggagttgttacactttatctgggagttatggtgcaagctgacactggatgtgtggttagctggaaaaacaaggaactaaaatgcggttccggtatttttatcaccgacaatgtgcatacatggacagaacaatacaagtttcagccagaaagtccatcaaaattggcatctgcaatccaaaaggcccatgaggaaggcatctgtgggatacgatctgtcacaaggctcgaaaatcttatgtggaagcaaataactccagaattgaaccacattttgtctgagaatgaagtcaaattaacaataatgactggtgatataaagggaatcatgcaagccggcaaacgatctcttcgtcctcagccgactgagctcaaatattcctggaaaacttggggtaaagcaaagatgctaagtacggaaagtcacaatcaaacattccttatagatggtccagaaaccgccgaatgccccaatacgaaccgagcctggaactcactagaagttgaggattacggtttcggagtattcagtacgaatatatggctaaaactacgtgaaaaacaagatgttttctgcgactctaaattaatgagtgcagcaatcaaagacaatagagcagtccacgcggacatgggatactggatagagtccgccttaaacgacacttggaaaatggaaaaggcgagttttatcgaaataaagtcctgccattggcctaaatcgcatactctctggtccaatggagtactcgaaagtgaaatgatcatccccaaaaatttcgcaggaccggtttctcaacataactatagaccgggatatcatacgcaaaccgccggtccatggcatttaggtaaactggagatggattttgacttttgtgagggcacaacggttgtagtgaccgaagactgcggaaatagaggtcctagcctgagaacaacaacggcctcaggtaaactgataacagagtggtgttgtcgttcgtgcaccttacccccattgcgttatcgtggagaggacggctgttggtatggcatggagatccgccccctaaaagaaaaggaagaaaacctagttaacagtttagtaaccgctggacacggtcaaatagacaactttagtctgggcgtgcttgggatggcgttatttctagaggaaatgttgcgaacccgcgttggaactaaacacgcgattctactcgttgccgttagctttgttacattaataacgggaaatatgagttttcgcgacctaggtcgagtgatggtaatggttggggcaactatgactgatgacataggcatgggggtaacatacttagcgttgcttgcggcttttaaagtccgaccaacattcgctgcaggtttacttcttcgaaaactaacatctaaagaattaatgatggcgacaatcggcatcgccttgctttctcaatcgacaataccagagacgatccttgaactaaccgatgcacttgcactaggaatgatggttcttaaaatcgtaagaaatatggagaaatatcaactagcagtaacgattatggctatttcttgcgttccgaacgccgtcatacttcaaaatgcttggaaagttagctgcaccattcttgcggcagtgtccgtatcacccctcctccttacttccagtcagcagaaagcagattggataccattagcattaaccataaagggtttaaatccgaccgcgatatttttgacaaccctgagccgtacgtctaagaaaaggtcttggccattaaatgaagccgttatggcagttggcatggtatctatactcgcatctagcctactcaaaaacgacattccaatgacaggtccattggtagccggcggattattgactgtttgttacgtattaacaggaagaagtgctgaccttgagttagaacgagcggctgatgttaagtgggaagatcaagctgagatatcaggttcttcaccgattctttctattaccatatctgaagatggaagcatgtctatcaaaaatgaagaagaagaacataccctcacaattctcattcgcaccggtctattagttatcagtggagtctttcctgtatcaataccgatcacggccgctgcgtggtatttatgggaggttaagaaacaaagggcaggagtgttatgggacgtgccatccccacccccagtaggtaaggccgaactcgaagatggtgcctatcgaatcaaacagagaggcatttttggatatagccagataggagcgggggtatataaagaaggtacctttcataccatgtggcatgtgacacgaggagccgtgctaatgcacagaggtaaacgaatcgaaccgtcctgggccgatgtcaagaaagatctaatctcgtacggtggcggttggaaactagaaggagaatggaaagaaggagaagaagtacaagttctagctctagaaccaggaaagaacccgcgagccgttcagaccaaacccggactattcaagaccaataccggtacgataggagccgtaagtttagacttctcccctggtacctctggttctccaatcgtagaccgcaagggaaaggtagtaggtttatatggtaacggagttgtgacgcgctctggagcgtacgtcagtgctatagcccagacagaaaaatcgattgaagacaatcctgaaattgaagatgatatattccgcaagaaaaggctaaccataatggacttacacccgggcgcgggaaaaaccaaacggtacttaccagcaattgtacgtgaagcaattaaacgaggtctacgtacgctcatacttgctcccacacgggtagtcgccgccgaaatggaagaagctctaagaggcctgcctatacgataccaaacaccagccataagagccgagcatacaggaagagaaatagtagatctaatgtgccacgcaacctttacgatgagattgttatccccagttagagttccaaattataacttaatcatcatggacgaagctcatttcacagacccagctagcatagctgcacgtggttacatctcaacacgagtagaaatgggtgaagcagcaggaatatttatgactgctacaccccctgggtccagggatccttttccacaatcgaacgcaccaataatggacgaagaacgcgagatccccgaaagaagctggaactcaggtcacgaatgggtaacagatttcaaaggcaaaaccgtttggttcgtaccttctattaaggcaggtaatgacattgccgcttgcttaaggaagaatgggaaaaaggtaatacaactcagtcgcaagacctttgattccgagtatgtaaaaactagggccaatgattgggattttgtagtaaccaccgacatcagtgaaatgggtgccaattttagagcagaacgggtaatcgatcctcgaaggtgtatgaaaccggttattttgactgatggagaagaacgtgttatattagcggggcctatgccagttactcattcttccgctgcgcaacggcgtggtagaatagggcggaatcctaagaatgaaaacgatcaatacatctacatgggggaaccattagagaatgatgaagattgtgctcattggaaagaagcaaagatgttactggataacataaacacccctgagggaattattccaagcatgtttgaaccagaacgtgaaaaagtcgacgcgatcgatggagaataccgactgaggggtgaagctcgcaaaacgtttgtagatttaatgagacgtggggacctgccggtatggctagcgtatcgagtcgcagcggaaggaataaactacgctgaccgtaggtggtgttttgatgggataaagaacaatcaaattttagaagaaaatgtagaagttgaaatttggacgaaagaaggtgagcgaaagaaactaaagcctcgatggctagacgctaggatatattcggatcccctagccttaaaagagttcaaagaatttgcggcggggagaaaaagcctgacgctaaatttgattacagaaatgggaagattgccaacgttcatgactcagaaggctagagatgcacttgacaatctggctgttttacatactgctgaagtaggaggaagggcatataatcacgcattgagcgaactaccagaaacgttagaaactcttttattattgactctgcttgctaccgtaaccggtggtatatttttattcctaatgtctggaaagggaataggaaaaatgactttaggcatgtgctgtatcataacagcatctatccttctttggtatgctcaaattcaaccacattggattgcagcaagtattatactcgagttctttttaatagtattattaataccggaaccggaaaaacaacgtacgccacaagataatcagctaacctatgtagttatagcaatccttactgttgtcgcggccacaatggcgaatgaaatgggctttttggagaaaacgaaaaaggacctgggcttgggaagcataacaacacaagaaagtgaatcaaatatactggatattgatctaaggcctgcctcagcctggacgctatatgccgtagcaacaacatttgtaacaccgatgttacgtcacagtatagagaatagctcggtaaatgttagcttgacagctatagcaaatcaagcaactgtacttatgggattagggaggggctggcctttatcaaaaatggacattggagttccacttttagcaatagggtgctatagccaagtcaacccaataacacttacagctgcgttactgttattagtcgcacattacgcaattataggaccaggcttacaggccaaagcaactagggaagcgcaaaaacgaactgctgcaggtataatgaagaaccctactgtagatgggatcacagtaatagacctagaaccaataccctacgatcctaaatttgaaaaacagttaggccaagttatgctattagtgttatgtgttacgcaagtactaatgatgcgcacaacctgggctctatgtgaagcattgacactagctactgggccaattagtacactctgggaggggaaccctggaaggttttggaatactacaatagcagtctcgatggcaaacatattccgcggatcatacctagctggtgcaggtttactattctctatcatgaagaacaccaccaacacaagaagaggaacgggaaacataggggaaactttaggagaaaagtggaaaagcagacttaacgccctcggaaaaagcgaatttcagatttataagaagtcaggaatccaagaggtagatcgaacactagcgaaagaagggatcaaacgtggggaaaccgaccaccatgctgtaagcagaggctcagcgaaattaagatggtttgtagagagaaatatggtaactccagagggcaaagttgtagatcttggatgtggtaggggtggttggtcttattactgtggcgggctcaaaaatgtacgtgaggtaaaaggtttaacaaaaggagggccggggcacgaagaacccatccctatgagcacctatgggtggaatttagttcggctgcaatcaggcgttgatgtattctttacgccaccggaaaaatgtgataccctcttatgcgacatcggagaatcttctccgaacccaactatagaagctggaagaacacttcgcgtattaaacttagtggaaaactggctgaataataatacgcaattttgtgtaaaagttttaaacccatatatgccatcagtaattgagaaaatggaaactttacaacgtaaatatggtggcgcacttgtacgaaatccactaagtcgcaactcaacacacgaaatgtattgggtttcgaacgctactggaaatatagtaagtagtgtaaatatgatatctcgaatgttaataaacagattcacaatgaaacataagaaagccacttatgaaccagatgtggatttgggttctggaacccgaaatatagggattgaaaatgaaatacctaatctggatattatcggaaaaagaatagagaaaattaaacaagaacacgagacctcttggcactatgaccaagatcacccatacaagacgtgggcttatcacgggtcttatgagacgaaacaaacaggaagtgccagctcgatggtaaatggtgtagttaaattactcactaagccctgggacgtagtcccgatggttacacaaatggcgatgaccgatacgaccccgttcggccagcaaagagtatttaaagagaaggttgacactagaacgcaagaacccaaagaaggaacaaagaaactgatgagaatcacggcagaatggttatggaaagaattgggcaaaaagaaaacaccacggatgtgcacaagagaagaatttacgcggaaagtacgatcaaatgcagcactaggagcaatatttaccgatgaaaataagtggaaatcagccagagaagcggtggaagattcaagattttgggagttagtagacagagaacgcaacttacacctggaaggaaagtgtgaaacctgcgtttataatatgatgggaaaaagagaaaagaaactgggagaatttggaaaggcaaagggatcacgagcgatttggtacatgtggctaggggcaaggttcttggagttcgaagcattaggtttcttaaacgaagatcattggtttagtagaggaaattctctatcaggcgttgaaggcgaaggcttacataaactaggctatattctacgcgacgtgtctaagaaagaaggcggggcaatgtatgcggacgatactgcagggtgggatacgcgaataactcttgaagatctcaaaaatgaagaaatggtaacgaaccacatgaagggagaacataagaaactagctgaagcgatattcaaactaacatatcaaaataaagttgtgagagtccaacgaccgacacccagaggaacagttatggacataattagccgcaaagatcaaaggggatcagggcaggtaggcacatatgggctaaacacgtttacaaacatggaggctcagttgataaggcaaatggagggcgaaggaattttcaagtcgatacagagattaaccgtcactgaagaaattgcagtccagaactggcttgccagagtaggaagagaaaggctaagtaggatggcgatttcaggtgatgactgcgttgttaagccgttagacgatagattcgcaagtgccttaactgcacttaatgacatgggaaaagtaaggaaagatattcaacaatgggaaccaagccgtggttggaatgactggacgcaagtaccgttttgttctcatcatttccacgagctagttatgaaagacggacgagttttagtcgttccatgcagaaatcaagacgagctgataggacgtgcaagaattagtcaaggagcaggatggagtctaaaagaaactgcctgtctagggaaatcgtacgcgcagatgtggactcttatgtatttccatcgacgggacttaagactggcagcaaatgctatttgttcagcagtgccttctcattgggtaccaacatcgagaaccacctggtcaatacacgcaaagcacgaatggatgacaacagaagatatgcttgctgtatggaatcgagtttggatacaagaaaacccatggatggaggataaaacacccgtggaaagttgggaggaagtcccctaccttggaaaaagagaagaccagtggtgtggatctctaataggcttgacatcacgagctacctgggctaagaacatacagacagcaataaaccaagtacgatcactaatagggaacgaagaatataccgattatatgccgagtatgaaaaggtttcgaaaagaagaagaggaagcaggagtattatggtaa

SEQ ID NO: 22525 - RNA, 9876 nt, synthetic construct
  misc_feature 1..9876: note = derived and/or modified CDS sequence (opt6) from DENV-2__EU482545__SS-prME
  source 1..9876: mol_type = other RNA
actgcaggagtaatagtaatgttaattccaacagcgatggcatttcatttaactacccgaaacggagaacctcatatgattgtaggtcgtcaagaaaaaggcaaatcactcttgtttaaaacagaagatggcgtgaatatgtgcaccctcatggctatagatctcggcgaattatgtgaagacactataacatataaatgtcctctactccggcagaacgaacctgaagacatagattgctggtgcaatagtacaagtacttgggtaacctatggaacatgtacgacgactggagaacacagaagagaaaaacgtagtgtggcgctagtaccgcatgtaggcatggggctcgaaacgcgaactgaaacgtggatgtcatcagaaggagcttggaaacacgttcagcggatagaaacttggatactacggcaccccggtttcacaattatggccgcaatactagcatataccataggaacgacacactttcaacgtgccctcatctttatacttttgacagcagtagctccctccatgacaatgcgatgcatcggaatatctaatcgagattttgttgaaggagtatcagggggatcttgggttgatatagtattggaacatggttcctgcgtgacaacaatggcgaaaaataaaccaacattggatttcgaactaattaaaactgaagcaaaacaaccagcgacattgcgtaaatattgtatagaggctaaattaactaatactacaacagaaagtcgttgcccaacgcaaggtgaaccatctttaaatgaggaacaagacaaaaggtttatatgtaaacattctatggtggacagaggatggggcaatggttgtggtttatttggaaaaggtggaattgttacatgcgcgatgttcacttgcaagaaaaatatggaaggaaaaatagtacaaccggaaaatttggaatacaccataatgattaccccgcatagcggtgaggaacatgcagtaggcaacgacaccggtaaacatggaaaagaaatcaaaataacaccgcaatcttctattacagaagctgaacttactggttatgggacagtaacgatggaatgtagtcctcgaacgggtttggacttcaatgagatggtgctcctgcaaatggaagacaaggcttggctagtacatagacaatggtttcttgacttacctctaccatggcttccgggtgcagatactcagggaagtaattggattcagaaagaaacacttgttacattcaaaaacccccatgctaagaaacaagacgttgttgtactaggatcacaagaaggagcaatgcatacagctctgaccggtgctacggaaatccaaatgagttccggaaatctattgttcactggacatctgaaatgtaggctccgcatggacaaattacagttaaaagggatgagctatagcatgtgtacaggcaaatttaaaatcgttaaagaaatcgcagaaacacaacatggtacaatagtgattagagttcagtatgagggcgacggatcaccatgtaaaataccgttcgaaatcatggatctggagaaaaggcatgtattgggaagattgatcactgtaaaccctatcgtcacggaaaaagatagtccggtcaacatagaagcagaaccaccatttggagactcatacatcattattggagtagaacccggacaactaaaactaaactggttcaagaaaggatcttcaataggacagatgtttgagactactatgagaggagcaaaacgtatggcgatactcggagataccgcatgggacttcggaagtttaggtggtgtcttcacttctgtcgggaaagcactacaccaagtttttggcgctatttacggtgctgctttcagtggggtgtcttggaccatgaaaattctaatcggagtcataataacgtggattggtatgaacagtcgttcaacaagtctcagcgtgtctttagttttggtaggagtagtaacactatatctaggagcgatggttcaagcagactcaggatgcgtagtgtcgtggaaaaacaaagaacttaaatgtggatcagggatttttatcacagacaacgtacacacctggactgagcaatataaatttcaaccggaaagcccttcgaaactggcaagcgcaatccaaaaagcacatgaagaaggaatatgtggaatacgctcagtaacaagattagaaaacttaatgtggaaacaaattacgccggagttaaaccacatactcagcgaaaacgaagtcaaactaaccattatgactggagacataaaaggaataatgcaagcagggaaacgtagtcttagaccccaacccactgaactcaaatattcatggaaaacttggggtaaagcgaaaatgttatcaacagaatcccataatcagacctttctcatagatgggccagaaacagcggaatgcccgaataccaatagagcttggaactctctagaagtcgaagattacgggtttggcgtctttacgacaaatatatggttaaaacttcgagaaaaacaggatgtcttttgtgatagtaaattaatgtctgctgccataaaagataaccgagcggtacacgctgatatggggtattggatagagagtgccttaaacgatacttggaaaatggagaaagcatccttcattgaagtcaaatcttgtcattggccgaaatcacatacactatggagtaatggagtattagagagtgaaatgatcatacccaaaaattttgctggaccagttagccaacacaactaccgaccaggttatcatacgcaaacagcaggcccttggcatttaggaaaactggaaatggattttgatttttgtgaaggaaccacagtagtagtaaccgaggactgtggaaacagaggaccctcgttacgaacaacaacagcatctggtaaacttataactgaatggtgctgcagatcctgcacccttcctccactgaggtataggggagaagatggatgctggtacggaatggaaatacgaccacttaaggaaaaagaagagaaccttgttaattcattggttactgctggacatggtcagattgataatttctcattgggagtgctgggtatggcactattcttagaagaaatgctgaggacaagagttggaactaagcacgcgattttgttagttgcagtttcctttgttacactaattacagggaatatgtcgtttcgggatttaggccgggtaatggttatggtaggcgcaacaatgactgacgatataggaatgggagtaacatacttagctctgctagctgcatttaaagtcaggccaacgttcgcggcaggactgctgcttcgaaaactgaccagtaaagagctaatgatggctactatcggtatcgcccttctatcacagtcgaccataccagagacaatcctcgaactaacagatgcactagcgctagggatgatggctttaaaaattgtcaaaaacatggaaaaatatcagcttgcagtaactataatggccatatcgtgcgtaccaaatgcagtaattcttcaaaatgcatggaaagtatcctgtaccatattggcagctgtaagcgtgagccctcttttactgacgagcagccaacaaaaggctgattggattcccttagccttaaccatcaagggacttaatcctactgcaatcttcttaacaactttatcaagaacttcaaagaagaggagttggcctcttaacgaagcaataatggcggttggaatggtgtcaatattagccagcagcttactgaaaaacgatatccccatgacaggacctctagtagccggtggtctacttacggtttgctatgtcttgacaggaagaagtgcggacttagaacttgagagggccgcagatgtcaaatgggaagatcaagctgaaatatcaggctcctctcctatattatctataaccatatccgaagatggctcaatgtcaataagaaatgaggaagaagaacaaactttaacaattttaatacgaactgggctgctagtgatctcaggtgtgtttcctgtttcaatccctgtaacagcggcggcatggtacctctgggaggtgaaaaagcaacgagcgggagtcctttgggatgtaccgtcgccaccacctgtcggaaaggcggaactagaagatggagcatataggatcaagcaacgtggtatactggggtacagtcaaattggagcgggggtttacaaagaagggacattccacacaatgtggcatgttaccaggggtgccgtattaatgcacagaggtaaacgaattgaaccttcgtgggccgacgtcaagaaagatttggtatcgtatgggggagggtggaaattggaaggtgaatggaaagaaggcgaagaagtacaagtcttggctctggagcctggcaaaaatccccgcgctgtacagacaaaaccaggtatctttaagacgaacacaggaacaatcggtgctgtgagtcttgacttttccccaggaacaagtggtagtcccatcgtagacagaaagggaaaagtcgtaggcctatatgggaatggagtagtaacacgttctggagcttatgtatcagcaattgctcaaacagagaaaagtatagaagacaatccagaaatagaggacgatatatttagaaagaaaagattaacaataatggaccttcatcccggagctggtaaaacaaaaaggtaccttccagcgatagtgcgtgaagctattaaacgtggactcagaacattgatacttgcacccactagggtagtggctgcagaaatggaggaagcactccgaggtttaccaatacgataccaaacacccgcaatccgagctgaacacactggacgagaaatagtagacctaatgtgccatgcaacatttaccatgcggctattaagccccgtaagggttcccaattataatctgattattatggacgaagcgcacttcactgatcctgcgtcaatagcagctagaggctatatatccactcgtgtcgagatgggagaagctgcaggcattttcatgaccgcgacaccaccaggtagtagggatccgttcccacaatcgaatgcgcccataatggatgaggagcgcgagatccctgaacgaagttggaatagcggccatgaatgggttacagactttaaggggaagactgtatggtttgtcccaagtataaaagccggcaacgacattgcagcttgtttaaggaaaaatggcaagaaagtaatacaactctcacgtaaaacattcgacagtgaatatgtaaaaacacgtgccaatgactgggattttgtagtaacaacagatatatccgaaatgggagcgaattttaaagccgagcgagtaatagatccacgtagatgtatgaaacccgtcatcttgactgatggagaagaacgcgtcatacttgctggaccaatgcctgtgacacattcctcggccgcacaacgaagagggcggatagggagaaatccgaaaaatgagaacgatcaatacatctatatgggagagccgttggagaatgatgaagattgcgcgcactggaaagaagcgaaaatgctcttagacaacataaacactccggaaggaataataccatctatgtttgaacccgaacgagaaaaggtagacgcaattgatggggagtatcgtctaagaggggaagctcgaaaaacctttgtagatttaatgcggagaggagatctcccagtatggctagcttacaaagtagctgccgaaggaataaattacgctgatcgaaggtggtgtttcgacggcatcaaaaataaccagattctagaggagaatgtggaagtggaaatatggacaaaagaaggggaacgtaagaaacttaaaccgagatggctagatgcgaggatttattctgacccactcgctctaaaagagttcaaagaatttgcagctggaaggaaatcgctaaccttaaatcttataactgaaatgggaagactgccaacattcatgacacaaaaagcacgtaatgctttggataacttagcggtgctgcatacagcagaagcgggtggaaaagcgtataaccatgctttatcagaattaccagaaacattagaaaccttactgctgttgactttattggcaacagtaactgggggaatctttctgttcttgatgtctggtaaaggcatagggaagatgaccctcggtatgtgctgcataattactgcaagtattctgctttggtatgctcaaattcaaccccactggatagcagccagtattatactagagttctttctaatcgtgttgttgataccagaaccagagaagcaacgaacgcctcaagacaatcaactaacctacgtggtcatagcgatattaacagttgtcgcggcaacaatggctaacgaaatgggtttcctagagaaaacgaagaaagatttaggcttagggagcatcacaacacaggaaagcgaatctaatattttagatattgacttgagaccagcttctgcgtggacactttacgcagttgccacaacatttgtaacacccatgttgagacattccatcgaaaattcctcggtaaacgtttctcttacggccatagcaaaccaggctaccgtactcatgggattaggcaaaggatggccattatctaaaatggatattggcgttcctctactagccataggttgctatagccaggtcaatccaattaccctaacagccgcattattattattagtagctcattacgcgattataggacccggactgcaagcaaaagcaacacgcgaggctcagaaaagagccgcagcaggaattatgaaaaatcccacagtagatggcattactgtgatagatctagagccaattccatacgatccaaaatttgaaaaacaactaggtcaggtgatgctacttatactttgtgtaacacaagtactaatgatgagaaccacatgggcactatgcgaagccctgactttagcgacgggaccaataagtacattatgggaaggcaacccaggacgattttggaatactacgatcgcagtgagtatggcaaatatttttaggggaagttatctggccggtgcggggttattatttagtataatgaagaatactactaacacaagaagaggaacggggaatattggtgagactctaggggaaaagtggaaatcccgattaaatgccttgggaaaaagtgaatttcagatatataaaaagtcgggcatacaagaagtagatcgtacccttgcaaaagagggtattaaaagaggtgagacagaccaccacgctgtttctagaggctcggccaaattacgctggttcgtagaaaggaacatggttacacccgaaggcaaggtagtagatctaggttgtggccgaggaggatggtcttactattgtggtggtttgaaaaatgtaagagaagtgaaaggacttactaaaggtgggccaggccacgaagaaccgatacccatgtcgacttacgggtggaatttggttcgacttcaatcaggtgtagatgtgtttttcacgccaccggaaaaatgtgatacactgttatgtgatattggtgaatcgagtccgaatccaacaatagaagccggccggacattaagagtactaaacttggtagaaaattggctaaacaacaacacacaattttgtataaaagtactaaatccatacatgccttcggtcatcgagaaaatggagacattgcagaggaaatatgggggcgctttagtaagaaatcccctgagccgaaacagtacccacgaaatgtattgggtgagtaacgcaaccggaaatattgttagttcagttaacatgatttcgagaatgcttattaataggttcactatgaaacacaagaaagctacgtacgagccagacgtcgacctcggatccggaacgagaaatattggaatcgaaagcgaaatcccaaacttggatataataggaaagcgaatcgagaaaattaaacaggagcacgaaacttcttggcattacgatcaagatcacccttataagacgtgggcataccatggatcatacgaaacaaaacaaactggcagcgcctcaagtatggtaaacggcgtagtacggctgctaacaaaaccttgggacgtggtaccaatggtaacacaaatggctatgacagatacaacgccatttggacaacagagagtatttaaagagaaagtagatacaaggactcaagaaccaaaagaaggcaccaaaaagttaatgaaaatcacagcagagtggctttggaaagaattagggaagaagaaaacaccaaggatgtgcactcgggaagaatttactcggaaggtaagaagtaatgctgctctaggagcaattttcaccgacgaaaataaatggaaatctgcccgagaggcagtagaggatggccgcttttgggagttagttgacagagagcgcaatctacatctagaaggaaaatgtgaaacctgtgtatacaatatgatgggaaagcgggagaagaaactaggagagtttggtaaagcaaaaggaagtagggcaatttggtacatgtggctaggagcaagatttctagagttcgaagcacttgggttcctcaatgaagatcattggttttcgagagggaactcactttccggtgtagaaggtgaaggactgcatcggttaggatacatcttgcgagacgtcagtaagaaagagggaggagcaatgtatgcggatgacaccgccggctgggacacgagaattacattggaagacttgaagaatgaagaaatggtaacgaatcacatgaagggagaacataagaaactcgcagaagctatattcaaattaacataccaaaacaaagttgtccgtgtacaaagaccgacaccgaggggaacagtgatggacattataagccgtagagaccagagggggtcaggtcaggtaggaacgtatggtctaaatacatttacaaatatggaagcacagctcataaggcagatggaaggtgaaggcatcttcaaatcaatacagcacttaacagtcactgaagagattgcggtacaaaattggctggccagagtgggtagagagcggcttagtagaatggcgatctctggcgatgactgtgtagttaaacctattgatgatagatttgccagtgctctgactgcactaaacgatatgggtaaagtgagaaaagacatacaacaatgggaaccgtcgcgaggatggaatgactggacacaagtaccgttttgtagccatcactttcatgaactggtaatgaaagatggaagagtcttagtagtaccttgtcggaatcaagacgaacttatcggacgagcacgcatatctcaaggagcgggttggtcgttaaaggaaacagcatgtctaggaaaatcttacgcccaaatgtggacccttatgtattttcatagacgagatttacgtttggcagccaatgcgatctgcagtgctgtaccctcgcactgggtccccactagcagaacgacttggtcaattcacgcaaaacatgaatggatgacaaccgaagacatgttagctgtatggaatagagtgtggatacaggaaaatccatggatggaagataagactccagtggaaagctgggaagaggttccatatttgggcaaaagggaagatcaatggtgcggaagcctaattggtctcacaagtcgtgctacttgggcaaagaatatacagaccgctattaatcaagtaagaagtctaataggtaacgaggagtacactgactacatgccaagtatgaaacgatttagaagagaagaggaagaagcaggcgtgttatggtaa

SEQ ID NO: 22526 - RNA, 9876 nt, synthetic construct
  misc_feature 1..9876: note = derived and/or modified CDS sequence (opt6) from DENV-2__EU482546__SS-prME
  source 1..9876: mol_type = other RNA
actgcgggggtaatagtgatgttgatacccactgtaatggcgttccatctaacaacaagaaatggagaaccccatatgattgttggaagacaagaaaaaggtaagagcttgctatttaaaacggaagatggaatcaacatgtgtacgttaatggcaatcgacttaggcgaactctgtgaagacacgattacttataaatgtccactcctaaaacaaaacgaaccagaagatattgactgttggtgcaattcaacttcaacctgggtaacatacggaacatgcaccacgacaggtgaacatcgtcgagaaaagagatcagtagctctggtaccgcacgtgggcatggggcttgaaacgcgaacagaaacttggatgagttcagaaggagcgtggaaacacgtccaacggattgaaacatggatcctaagacacccagggtttacaataatggcggcaatattggcttacacaataggtacaacacattttcaaagagcgctaatctttatccttttaacagcagtagctccgtcgatgacgatgcggtgcattggtatatcaaacagggacttcgttgaaggagtctctggaggatcctgggttgacattgtactcgaacacggctcatgcgtaacaacaatggccaaaaataaacctacgctcgattttgaattaataaaaaccgaagcaaaacaacctgcaacactcaggaaatactgtatagaagctaaactgaccaacacaactactgaaagccgttgtccaacccaaggtgaaccgtcactcaatgaagaacaggataaacgctttatctgcaaacatagcatggtggatagagggtggggtaatggttgtggactattcgggaaaggtggtatagtaacttgtgctatgttcacgtgcaagaaaaatatggaaggaaaagtggttcaacctgaaaatttagaatatactattgtaataactcctcattctggagaagaacatgcagtgggaaatgatactggaaaacacggcaaagaaataaaaataacgccacaatcctcaattaccgaagcggaattaacgggatatggcaccgtaaccatggaatgcagccctcggacgggccttgattttaatgagatggtattattgcagatggaggataaagcctggttggtacatcgccaatggtttttagatctaccattaccatggttacctggagctgacacgcaggggagtaattggatacagaaagagacgttagtaacattcaaaaacccccatgcaaagaaacaagatgtggttgttttggggtctcaagaaggagccatgcatacagcattaaccggtgcaaccgaaatacaaatgtcctccggtaatctcttatttactggacaccttaaatgtaggttacgtatggataaattgcaactaaaaggaatgtcctattcaatgtgtacaggcaaatttaaaatagtaaaagaaatagctgaaactcaacatggcaccatagtaattagagtgcaatatgaaggagacggcagtccttgtaaaattccgttcgagattacagacctagagaaaagacacgtgctaggtcgcctgattacagtcaatcccatagtgacagaaaaagattcaccagttaatattgaagcggagccgccgtttggcgatagctacataattattggcgtagagcctggtcaactaaaactaaattggttcaaaaagggaagctccataggccaaatgtttgagaccacaatgcgaggagcaaaaaggatggcaatactaggggatacggcctgggattttggatcacttggaggtgtatttacatccatcggcaaagcactgcatcaagtattcggtgcaatttatggcgctgcgttttcaggagttagttggaccatgaaaatcttgataggagtaatcataacgtggatcggaatgaactcacggagtacatcactatccgtaagtctggttttggtaggggtagttactctatatctaggcgccatggtacaagctgattccggttgtgtagtatcatggaaaaataaagaactaaaatgtggctcaggaatatttatcaccgataatgttcacacttggaccgagcagtacaagtttcaaccagagtcaccctcaaagctagcttctgccatccagaaagcgcacgaggaaggaatatgtggaatacggtcagtaactcgtttagaaaatttaatgtggaaacaaataacgccagaactgaaccatatactctctgaaaatgaggtcaaattaacaattatgacaggagatataaagggtataatgcaagccggaaagagatctctaaggcctcaaccaacagaactgaaatactcatggaaaacatggggaaaggcgaaaatgttatcaactgaaagtcacaatcagacatttctcattgacggaccagaaacagctgagtgtccaaacaccaacagagcatggaatagtctagaagtcgaagattacggattcggagtatttacaacaaatatctggctaaagttaagggaaaaacaggatgcattctgcgactcaaaacttatgagcgcggctataaaagacaaccgggcagtacatgccgatatggggtattggatagagtctgcattaaatgacacatggaaaatggaaaaagcatcttttattgaagtaaaatcatgccattggccgaaatctcacacactctggagtaatggtgtactagaaagcgagatgattataccaaagaattttgctggccccgtatcgcagcacaatcatagaccaggataccatactcaaacagccggaccgtggcatttaggaaaactggaaatggattttgatttttgtgaaggtacgacggtggtagtaaccgaagattgcggaaacagaggcccatcactgagaaccaccaccgcatcaggtaagttgattacagaatggtgttgtagaagctgtactcttccacccttgaggtatcgaggggaggatggatgttggtatggtatggaaatcagaccacttaaagaaaaagaggaaaacctggtaaattctttagtcacggccgggcacggccaaatcgacaactttagtttaggcgttctaggtatggcattatttctggaggaaatgttaaggacaagggttggaaccaagcatgccatactattggtagctgtatctttcgtcaccctgattactggtaatatgtcatttagagacttgggccgcgtgatggttatggttggtgctacaatgactgatgatattgggatgggagtcacgtacctggcattactcgcagctttcaaggtgcgtccaactttcgcagcaggactattattgaggaaattgaccagcaaagaacttatgatggcaacgatcggtatagcattactaagccaaagtactatacctgagacaatattagagttaacggatgcacttgcgttagggatgatggttctaaaaatagtgagaaatatggaaaaatatcagttggcagtaaccataatggcaataagttgtgtgccaaacgcagttatcttacaaaatgcttggaaagtctcttgcaccatcctggcagcggttagtgtgtcaccgcttcttttgacaagcagtcaacaaaaagccgattggataccattagctttaacgataaaaggactaaatcctactgcgatatttttaactacactaagcaggacttctaagaaacgtagttggccattgaatgaagctattatggccgtcgggatggttagcatacttgcgtcatccttgttgaagaatgacattcctatgacgggaccgctcgtcgcaggcggtttacttactgtctgttacgttttgaccggaagaagcgcggaccttgaactagagcgtgcggccgacgttaaatgggaagaccaagccgaaatctctggttctagtcctatcctgtccatcaccattagtgaagacggaagtatgtcaattaaaaatgaggaagaagaacaaaccctaaccattttaatacgcacaggtcttctggtgatttctggtgtattcccagtcagtattcctataaccgcagctgcatggtatctgtgggaagtcaagaaacaacgcgctggcgtgctgtgggatgtaccatcaccacctcctgttggaaaggccgaattagaagatggtgcgtatcgtattaaacaacgaggatttttaggatactcacaaataggagcaggagtttataaagaaggcacatttcacaccatgtggcatgtaacccgaggggcagtactgatgcatagaggaaagaggatcgaaccatcatgggcagatgtgaagaaagacttaatatcttatggaggaggctggaagttggaaggtgagtggaaagagggagaggaggtacaagtgctcgctttagaaccgggtaaaaaccccagagctgtccagacaaaacctggaatatttaagactaatacgggaacgataggagcagtcagccttgatttctcaccaggaacttcaggctctccaatagtggatcgaaaaggcaaagttgttggattatatggaaacggagtggtcacacgatcaggtgcttatgttagcgcaattgctcaaactgaaaaatcaatagaggataatcccgaaatagaagatgacatatttcggaagaaaaggttgacgatcatggatttgcaccctggagcagggaaaacaaaacgatatttacccgcgattgtgagagaagcaataaaacgagggctccgaacacttatattggcaccaacaagggtagtagccgccgaaatggaggaagcattaaggggcctgccgatacgatatcaaactccggcaataagagcagagcatacaggaagagaaatcgtagatttaatgtgccatgcaacatttactatgcgtctattatccccggtcagggttcccaattacaatttaataataatggatgaggctcatttcactgacccggcatcaatagcagcaaggggttatattagcacaagagtagaaatgggcgaagcggcagggattttcatgactgcaacgccacccggcagtagggatcctttccctcaaagtaatgcgccaataatggatgaagaacgcgaaattccagaaagaagctggaactcaggtcacgaatgggtaactgacttcaaaggtaagacagtctggtttgtcccgtccataaaagccggaaatgacatcgcagcatgcctaaggaaaaacggcaagaaagttatacaattatcccgaaaaacatttgacagtgaatatgttaaaactcgagcaaacgattgggattttgttgtaacaactgacatatcagaaatgggggcaaatttcaaagccgagagagttatcgatccaaggaggtgtatgaaacctgttatattaacagacggagaagaacgtgtcatattggctggacccatgcctgtgacacatagctcggcagctcaacggagaggacgcataggtcgcaaccccaaaaacgaaaacgatcagtatatatacatgggggaaccgctagaaaacgacgaagattgtgcacattggaaagaagcgaaaatgttattggataatatcaacacaccagaaggaattatcccgtctatgttcgaaccagaaagagaaaaagtggatgcaatagatggtgagtacaggctacgtggagaagcaaggaaaacattcgtagatcttatgcgacgaggagatctacccgtttggctagcgtacaaggtggctgcggaaggaatcaattacgcggatagaaaatggtgcttcgatggtattaaaaataatcaaatactagaagaaaacgtagaagtcgaaatctggactaaagaaggcgaaaggaagaaattaaaacctagatggttggacgcacgtatctacagtgacccacttgcattaaaagagttcaaggagttcgcagcaggacgaaaatctttgactttaaacctcattacagaaatgggaagactaccaaccttcatgacccaaaaggcgagaaatgcgctagacaaccttgcagttttacataccgcggaggcgggtggcagagcttacaatcatgcactctcagaacttccagagacattggaaacattactccttctcacgttattagcaacagtcactggaggaatctttttattcttaatgagtggaaaaggcataggaaagatgacattagggatgtgttgtataatcacagcgtcgatcttactctggtacgcacaaatacaaccccactggatcgcagcgtcaataattttggaatttttcttaattgtgttgttaatacctgaacctgaaaaacagcgtacaccgcaagacaaccagttaacatacgtagtgatagctatattaacggtagttgcagcgacaatggcaaatgaaatggggttccttgagaaaaccaagaaagacttgggactgggtagtatcacaactcaagaatcagagtcgaatattctagacattgacttgcgtcctgccagcgcgtggaccttgtacgcggtcgccactacgttcgttacacctatgttgagacacagtattgagaacagttccgtaaacgtatcgttaacagcaatcgctaaccaagcgacagtactaatgggtttagggaaaggatggccattatcaaaaatggatataggggtacctcttttagctatcggctgttactcccaagtaaaccccataacattaaccgctgcgctgctactcctagttgcacattatgctataataggaccaggtttacaagctaaagctactagagaggcacaaaagagggctgcagcaggaataatgaaaaacccaacagtagacgggattactgtcatagacttggaaccgattccctacgatcccaagtttgagaaacaacttggccaagtaatgctattaattttatgtgtaacacaagtattaatgatgcgtactacatgggccctttgtgaagcacttacactagccacaggtccgatatctaccctatgggaaggaaacccaggaagattttggaatacgacaatagctgtatctatggccaacatatttcgcgggtcctacctggccggtgccgggcttttgttctcaataatgaaaaatacaacgaatacaagacgtggcacaggtaacataggtgagactttgggagaaaagtggaaatctagattaaacgccctcggcaaatccgaatttcaaatatacaagaaatcaggtattcaagaagtcgacaggacattagctaaagaaggcataaaacgtggcgaaacagaccaccatgcggtatccagaggcagtgctaaactcagatggttcgtggaacgaaatatggtgacacctgagggaaaagtggtagacttaggctgcggccgtggaggatggagttactactgtggaggactcaaaaatgttcgcgaagttaaaggtttaacaaaagggggaccgggacatgaagaacctattcccatgtcaacgtatggatggaacttagtacggttacagagtggggttgatgtctttttcacacctccagaaaaatgcgatactctgttatgcgatatcggggaaagtagtccaaatccaacaattgaggcaggaagaacccttagagtattaaacttagtggaaaattggcttaacaataatactcaattctgcattaaagtgttaaatccctatatgccgagcgtgatagagaagatggaaacgttacaaagaaaatacggtggcgcacttgtaagaaatcccctatcacgtaactccacgcatgaaatgtattgggtaagcaacgccactgggaatatcgtaagcagtgtcaatatgatatcaagaatgcttatcaaccggttcacaatgaagcataagaaagcaacatacgaaccagacgtagatttgggtagcggaacccgtaatatcggtatagagagtgaaatcccaaatcttgatattattggaaaacgtatagagaaaataaaacaagaacatgaaacctcttggcattatgatcaagatcatccttacaagacatgggcataccatggatcatatgaaacaaaacaaacagggtctgcatcgtctatggttaatggtgtcgtccgactcctcaccaaaccgtgggatgtagttcctatggtaactcaaatggccatgactgacacgactccttttgggcaacaacgggtttttaaagagaaagtagataccagaacacaggaacccaaggaaggcactaaaaagctcatgaaaataaccgcggaatggctctggaaagaattaggcaagaagaaaacaccaagagtctgcacgagggaagagttcacaagaaaagttagatccaacgccgcactaggagcaatttttaccgatgagaacaaatggaaatctgcaagagaagcagtggaggatggacgtttctgggaacttgtagatcgagagagaaatttgcacttagagggaaaatgtgagacatgtgtatataacatgatgggaaagcgagagaagaaactaggtgaatttggaaaagccaaaggtagccgagccatctggtacatgtggcttggcgctagattccttgaatttgaagcattgggattcctaaatgaagatcactggttttccaggggaaattcattatcaggagttgaaggcgagggtcttcatcgtttgggatacatactaagggatgtaggcaagaaagaagggggcgcgatgtacgccgacgacactgccgggtgggacacacggataactttagaagacttgaagaatgaggaaatggtaacaaatcacatgaaaggggagcacaagaaactagcagaagctatatttaaattgacctatcaaaataaagtagtgagagtccaaagaccaacaccaaggggtaccgtgatggacattatatcaaggcgggaccaaagaggatctggacaagtgggtacatatggccttaacactttcacaaacatggaggcacagttaattcgacaaatggaaggagaaggaatctttaaaagtattcagcacctcactgcgactgaagaaatcgccgtgcaaaattggctcgctagagtaggccgtgaacgactcagccgtatggccatttctggagacgattgtgtggttaaaccaatagacgaccgattcgctagtgcactgacggcattaaatgatatggggaaagtgcgtaaagacatacagcaatgggagccgtcaagaggatggaatgactggacgcaagtaccattttgcagtcatcacttccatgagctagtaatgaaagatggacgtgtcctagttgtaccatgccgtaatcaagacgaattaataggccgagcgaggatttcgcagggcgccggatggtccctcaaagagactgcttgtcttggaaaaagttatgcccaaatgtggacattaatgtatttccatagaagagatctaagacttgctgctaatgccatttgtagcgccgtgccatcgcactgggtaccaacttcacgcacaacgtggtcaatccatgccaaacacgaatggatgacaaccgaggacatgctagcagtgtggaatcgagtttggatacaagaaaatccttggatggaagacaaaacacctgtagaatcatgggaagaagtcccttatttagggaaacgcgaagaccaatggtgtggttcactaattggacttaccagcagagcaacgtgggccaaaaatatacaaacagcaattagccaggtgcgatcactaatcggtaacgaagagtatacagattatatgccatcaatgaagaggtttaggagggaagaagaagaggccggtgtattatggtag

SEQ ID NO: 22527 - RNA, 9876 nt, synthetic construct
  misc_feature 1..9876: note = derived and/or modified CDS sequence (opt6) from DENV-2__EU482550__SS-prME
  source 1..9876: mol_type = other RNA
actgctggggttattataatgctaattccgacagctatggcattccatcttacaactcgcaacggagaaccacatatgattgtaggacgacaagaaaaaggtaaatcattattatttaaaactgaagacggagtaaacatgtgtacattaatggcaattgatttgggagaattatgcgaagatacaatcacatataaatgtccattgctaaggcagaatgaaccagaagacatagattgctggtgtaattcaacgagtacatgggtaacgtatggaacctgcactacaacgggagaacatagaagagaaaaacgtagcgttgcacttgtacctcacgtaggtatgggattagaaacaagaaccgaaacttggatgagctccgaaggtgcatggaaacacgtgcaaaggattgaaacttggattctaagacatccaggatttacaatcatggccgccattttagcttacacaatagggacaactcatttccaacgtgcattgatcttcatcctacttactgccgtagcaccctcaatgacaatgcgatgcataggaatttctaatagagactttgtagaaggtgtcagtggagggagctgggttgatattgtactagaacacggatcttgtgtaacaaccatggccaaaaataaacctacgcttgattttgaattgattaaaacggaagctaaacagccagcaaccctacgaaaatactgtatagaagcaaaactaacaaataccacaacggaaagcagatgtccaacccaaggtgaaccttctttaaatgaggaacaagataaacgctttatatgtaaacattcgatggttgatcgcggatggggaaatgggtgcgggctttttggtaaaggaggtatagttacatgcgctatgttcacttgtaagaaaaacatggaaggaaaggtcgtattgcccgagaacttagagtataccatagttataacaccgcattccggagaagaacatgcagttggaaatgatacaggtaaacacggaaaggaaataaagataaccccacagagcagtatcaccgaagcagagttgacgggttatgggactgtaactatggaatgttcaccaaggacgggtttggattttaatgaaatggtactactacagatggaggataaagcatggctagttcatagacaatggtttttagatctaccactaccatggttaccaggggctgacactcaaggtagtaactggattcagaaagaaaccctagttaccttcaaaaacccacacgccaagaaacaagacgtcgtagttttaggaagtcaggagggggcaatgcacacagcattaacaggagcaaccgagatccaaatgtcaagcggaaatttactatttacggggcatttgaaatgtcgcctaaggatggacaaacttcaactaaaggggatgtcatattcaatgtgcacagggaaattcaaaatagttaaagaaattgcagaaactcaacacggcaccattgtcataagagtacaatatgaaggagatggtagtccatgtaagattccctttgaaataatggacctggaaaaacgctatgttttgggaagactaatcaccgttaatcccatagtaacagaaaaagactcgcccgtaaacatagaagctgaacccccgttcggagattcctatattatcattggcgtcgaaccagggcagttaaagttaaactggttcaagaaaggaagctccatagggcagatgtttgaaacaactatgagaggtgcaaaacgcatggcgattctgggagatacagcgtgggattttggcagcttgggaggggtatttacaagtattgggaaggcgctgcaccaagtattcggggccatatatggggcagctttttctggtgtgagttggacaatgaagatcttaatcggcgtaataataacctggattggcatgaactcccgatccacatcattgagtgtaagtctcgttctggtaggagtggtcacattatacctaggagtaatggtacaagcagacagcggatgtgtcgtatcgtggaagaataaagaattaaaatgcggatccggaatattcataacagacaatgtccatacttggactgaacagtacaaattccagccagagtcaccatcaaaattagcttcggcaattcaaaaagcgcatgaagaaggtatttgcggcattcgttctgtaacaagactggaaaatctcatgtggaaacaaattacgccagaattgaatcacatattatcggaaaacgaagttaagttaactataatgacaggagatataaaaggaataatgcaagcagggaaaagatctctgcgtccacagcccaccgaactaaagtatagttggaaaacctggggtaaagcaaagatgctcagcacagaaagccacaatcaaacgtttttgatagatgggcccgaaactgcggaatgccctaataccaatagagcttggaactcattagaagtcgaggactatggtttcggagtattttcaacaaatatatggctcaaactaagagaaaaacaagatgtattttgtgacagtaagctaatgtctgcggctatcaaagacaatcgagcggtacatgccgacatgggatattggattgaaagtgcactgaatgacacttggaaaatggagaaagctagttttatagaagtcaaatcatgccactggccgaaaagtcatacattgtggagcaatggagtactagaaagcgaaatgattatccccaaaaattttgcaggcccagtgtcgcagcataactatagaccaggctatcatacgcaaacagccggtccctggcatctaggcaagttggaaatggactttgatttttgcgagggaacgaccgtcgtagttacagaggactgtggcaaccgagggccgagtctcaggacaacaaccgcgtctgggaaattaattacagaatggtgctgcagatcttgcaccctgcccccactacgttataggggtgaggatggatgctggtacggaatggaaattagaccgctaaaagagaaagaggaaaatctagtaaactcattagttacagctggtcatggtcaaattgacaattttagtttaggcgtcttgggcatggctttattcttagaggaaatgctacgtactcgtgtaggaactaaacacgcgattctattagtagctgtcagctttgtgactttgataacaggaaacatgagtttcagggacttagggagagttatggtaatggtaggtgccacaatgactgacgacatcggtatgggcgtcacctacctggcactactggcggcgtttaaagtacgccctaccttcgccgccggcctcctcttaagaaagctaacaagtaaagaactaatgatggcaactatcggtattgccttattatcccaatccaccataccagaaaccattctcgaattaacagatgcactggcattaggcatgatggtcttaaaaattgttcgaaacatggaaaaataccaattagctgtcactataatggctatactgtgcgtacctaatgcagttattttacagaatgcatggaaagtctcctgcaccatactagcagcagtctccgtttcacctctacttctaacgtcttcgcaacaaaaggcagattggatacccttagcgctgacaatcaaaggcttaaacccaacggcgatttttctgacaacgttaagtagaacatcgaaaaagcgtagttggcccctaaacgaagctgtaatggcagtcggtatggtaagtatactggcgtcttcattgctcaagaatgacattccaatgaccggacctcttgtagctggaggactactcaccgtctgttatgtgctgactggacgatccgctgatttagaattggaaagggccgccgatgtgaaatgggaggatcaagcagaaatatcaggttcatcaccgattttatcaataacaatatcggaagatgggagcatgagtataaagaacgaagaagaggagcaaacattgactattctcataagaacaggattattggtcatttcgggcgtctttcctgtatctattccaataactgcagcagcttggtacttatgggaggtcaagaaacaaagggctggcgtactgtgggacgtgcccagccctccacctgtgggaaaagccgaacttgaggatggagcgtataggatcaagcaaagaggaatatttggttactcacagataggagccggcgtttacaaagagggaacgtttcatacaatgtggcatgtcacaagaggagccgttttaatgcataggggtaaaagaattgaaccctcatgggcagatgtcaaaaaggatttgatatcatacggaggcggatggaagttagaaggtgaatggaaggagggagaagaagtacaagtgctcgctttagaaccgggcaaaaatccaagagctgttcagaccaaaccaggactatttaaaactaatacagggactataggcgcagtgagcttagatttctctccggggacttctggttcacctatagtagacaggaaaggaaaagtagttgggttatatgggaatggagtcgtgaccagatctggcgcctacgtatcagctatcgcccaaaccgagaaaagtatagaagataatcctgaaattgaagatgatatttttaggaaaaagcgattaacgattatggacctgcatccaggcgctggaaaaacgaagcgttatctcccagcaattgtaagagaggccattaaaagaggactcagaacattaatcttagcgccgacgagagtagtagccgctgaaatggaggaagcattacggggacttcccattagataccagactcccgccatcagagcggaacatacggggagggagatagtagatctgatgtgtcatgcaacatttacaatgagattgctaagtccagttagagtcccgaattacaatctaattataatggacgaagcacattttacagacccggcgtcaatagcagcacgtggatatatcagcacacgtgtggaaatgggtgaggcggcgggaatattcatgacagcaactccacctggatctagggatccgttccctcaatcaaacgcacccatcatggacgaagaacgtgaaattccagaacgaagttggaacagtggacatgagtgggttacggattttaaaggcaaaaccgtatggttcgtcccttcaataaaagctggaaacgatatagcggcgtgtctgcgtaaaaacggcaagaaagtaatacaactgtcgagaaaaacatttgattccgaatacgttaaaactagggcgaatgattgggattttgtagtaacgacggacatatctgaaatgggtgcaaacttcagagcagaacgagtaatagatccaagaagatgcatgaaaccagtaattcttacagatggtgaagaaagagtcatactagcaggtcccatgccggtgacacatagcagtgcggcacaaagacgaggtaggataggaagaaatccaaagaacgaaaatgatcagtacatatatatgggagaaccattagaaaatgatgaagactgtgcgcactggaaagaagcaaaaatgctacttgataacataaacactcctgaaggtataatcccttcaatgtttgagccggaaagagaaaaggtagatgcaatagatggagaatatcgactaagaggggaagcacgcaaaacatttgtcgatttaatgagaagaggggacctcccggtgtggctagcatatagggtggccgcagaaggcattaattacgcagatagaaggtggtgcttcgatggaatcaaaaataatcagatccttgaagagaatgttgaagtagaaatatggacgaaagagggagaacgtaagaaattaaaacccagatggttggacgcacgaatctattctgatccattggctttaaaggagttcaaagaatttgctgctggtcgaaagagccttaccctaaacttgatcacggaaatgggccgacttcctacatttatgacccaaaaagcaagggacgcactcgacaatttagcagtactccatacggcagaggtaggagggagagcctataatcatgccttatcagaactccccgagacgctagagactttgttattgctaaccctattggctacagtgacaggcggcatatttcttttcctaatgagtggtaagggtatcggaaaaatgacactagggatgtgctgtatcatcacagctagcatcctattatggtatgcacaaatacagccccattggattgccgcatctataattctggagttctttctcattgtacttctcataccggaacctgagaaacaacgtacaccccaggataatcaactaacatatgttgtgattgctattcttacagtagtggctgcaacaatggcaaatgaaatgggattcttggagaaaactaagaaagatttgggattgggatctattataacacaggaatcagaaagcaacattttagatatagatttaaggccggcttctgcttggacactatatgcagttgcaacgacctttgtaacgcccatgctgcgacatagtatcgaaaatagtagcgtaaacgtaagcctaaccgcgatagcaaatcaagcaactgtcctaatgggattgggaagaggctggccactatctaaaatggacattggagtaccactacttgctattggatgttatagccaggtaaatccaattacattaacagcagccctacttcttcttgtcgcccattatgctataataggacctggtttgcaagctaaggcaacaagagaagctcagaagcgagccgccgcaggaataatgaaaaaccctacagttgacggtataacagtcatcgacttagaacccataccttatgatccaaagtttgagaaacagttgggacaagtcatgctgttagtcctttgcgtgactcaggtacttatgatgcggacaacatgggcactatgtgaagcacttacactcgcgactggacccatttcaaccttatgggagggcaatccagggaggttctggaatacaaccattgccgtatcaatggcgaatatctttagaggatcgtacttagctggcgctgggctgctcttttccattatgaagaatacgactaatacacgcagggggacagggaacatcggtgaaacactaggcgaaaaatggaagtcaaggttaaatgctctaggtaaaagtgaatttcaaatttacaaaaagtcaggaatacaagaggttgatcgcaccctagcaaaagaaggtattaaaaggggtgaaacagaccaccacgcggtgagccgtgggagtgcaaaattaagatggttcgtggaacgtaatatggtaactccagaaggaaaagttgtcgatttagggtgtggcagaggaggatggagctattactgtgggggcttgaagaacgtaagggaagtgaaaggtttaactaaagggggaccagggcatgaggagcccataccgatgagtacatatggttggaacttagtgcgattacaatcaggcgttgacgttttctttacgcccccagagaaatgtgacactctgctatgcgacataggggaatctagcccaaaccctacaatagaagcagggaggacattgagggtccttaacttagttgaaaattggctaaataataacacccaattctgtattaaagtacttaatccatatatgcccagtgtcatagagaaaatggaaacactgcagcggaagtacggaggagccttagtacgcaatcctttatcacgtaactcaacacacgaaatgtactgggtcagtaacgcaaccggtaatatagttagctccgttaatatgatttctcggatgcttataaaccgatttacaatgaagcataagaaggcaacttatgagccagatgtcgatttaggatctgggacgagaaatataggcattgagaacgaaattccaaatttggatattataggcaaaaggatcgagaaaataaagcaagaacacgaaaccagctggcactacgaccaagaccatccgtataaaacatgggcatatcatgggtcatacgaaactaaacagacggggagtgcatcgtccatggtaaacggagttgttaagttactcaccaaaccctgggacgtcgttcccatggtgacgcagatggcgatgacagacacaacaccctttggacaacaaagagtatttaaagaaaaagtcgatacaaggactcaagaacccaaagaaggtactaaaaagctgatgcgtataacagctgaatggctttggaaagagttaggcaagaagaaaacacctcgtatgtgtacacgagaagagttcacaaggaaagtacggagcaacgcagccttaggagcaatttttaccgatgaaaacaaatggaaatccgccagggaagcggtagaagatagtaggttttgggagctagttgatagagaaagaaatctccatttagaaggaaaatgcgagacttgcgtatacaacatgatggggaaacgtgagaaaaagttaggagagttcggaaaagcaaaggggtcgagggccatatggtacatgtggttaggtgcacgatttcttgaatttgaagcactgggattcctaaacgaagaccattggtttagtagaggtaacagtctatcgggagttgaaggcgaaggattgcataagttaggttacatattaagggatgtatcaaagaaagaaggtggagccatgtatgcagatgacacagcagggtgggatacgagaattactttagaggacctcaaaaacgaagaaatggtcacaaaccacatgaaaggagaacataagaaactcgctgaagcgatttttaagttaacatatcaaaataaggtagtaagagtccaaagaccaacaccacggggcactgttatggatataatctctagaaaagatcaaagaggtagcggacaagtcggtacctatggtctaaacacctttacaaatatggaggcccagcttataaggcagatggaaggagaaggaatattcaagagcattcaacatctgacggtgacagaagaaatagcagttcagaattggcttgcacgagttggaagggaacgactttctcgaatggcaataagcggagatgattgtgttgtaaaaccgttggatgatagatttgcatcagcattaaccgctttgaatgatatgggcaaagttagaaaagatatccaacaatgggaaccatctagagggtggaacgactggacacaagtaccattttgttctcatcattttcatgagttggtaatgaaagacggtcgcgtactcgttgttccttgcaggagtcaagatgaattaattggtcgagcaagaatatcgcaaggcgctggctggtccctcaaggaaaccgcatgtctcggaaaaagctatgcacagatgtggaccctaatgtattttcacagacgtgatctgagacttgcggctaacgccatttgctcggccgtcccaagtcattgggtgccaacaagtcgaacaacgtggtctatacacgcaaaacacgaatggatgacaaccgaagacatgttagctgtgtggaatcgggtgtggatacaagaaaatccatggatggaagataaaacactggttgaaagttgggaagaagtaccatatctcggaaagagggaggaccaatggtgtggcagcttgatcggcctaacaagtagagcaacttgggcaaagaacattcaaactgcaatcaaccaagtaagaagtctaattggaaatgaagaatacacagattatatgcccagtatgaaacgatttcgaaaagaagaagaggaagccggagtactatggtag

SEQ ID NO: 22528 - RNA, 9876 nt, synthetic construct
  misc_feature 1..9876: note = derived and/or modified CDS sequence (opt6) from DENV-2__EU482551__SS-prME
  source 1..9876: mol_type = other RNA
acagctggtgtcatcatcatgctaattcctactgcaatggctttccatcttactacaagaaatggagaaccgcatatgatagttggaagacaggaaaaaggaaaatctttactttttaaaacagaagatggagttaacatgtgtacactaatggcaattgatcttggcgagttatgcgaggataccattacatacaaatgtcctttactaagacaaaacgagcctgaggacatagattgttggtgcaactcaacctcaacatgggtaacatatgggacatgtacaacaaccggtgaacatagacgagaaaaacgatcagtagcattagtaccccacgttgggatgggacttgagacaaggaccgagacatggatgtcgagcgagggagcttggaaacacgttcaaagaatagaaacctggattctcagacaccccggtttcactactatggcggcgattctggcatataccatcggtacaactcattttcaacgagtactaatattcatacttctaactgctgtagctccctcaatgactatgagatgcataggaattagtaatagggatttcgttgaaggtgtgtccggagggtcatgggttgatatagtattagaacacggaagctgtgtcacaacgatggccaaaaataaaccgacactagacttcgagctaattaaaacagaagcaaaacaaccagctaccttacgaaaatactgcatagaagcaaaactaacaaacaccactaccgaatcacgttgtcccactcaaggtgagccatcattaaacgaagaacaagataaaagatttatatgcaaacactccatggtcgacaggggatggggaaatggatgtgggctgtttggaaaaggaggtattgtcacatgtgcaatgtttacatgcaagaaaaatatggaagggaaagtcgtcctaccagaaaatctcgaatataccattgttattactccacactctggggaagaacatgcagttggaaatgatacgggaaaacatggaaaagaaattaaaataactccccaatctagtattactgaggcagagctcacagggtacggaaccgtaacaatggagtgtagtcctaggacagggctagacttcaacgaaatggtcctgttgcaaatggaggataaagcatggttagttcaccgtcagtggtttctagatctgccgttaccctggctaccgggggccgatactcaaggatctaattggatacagaaagaaaccttagttacttttaaaaatccacatgctaagaaacaagatgtagtagtacttggaagccaagaaggagccatgcacactgcactaactggtgcaacggaaattcagatgtccagtggaaacctattattcaccgggcatcttaaatgtcgtctcaggatggataaattacaactcaaaggaatgagttactctatgtgcaccggtaaattcaaaatagtcaaagagatagccgaaacccagcacggaacaattgttattcgcgtgcaatacgagggcgatgggtccccgtgtaaaataccatttgaaatcatggatctagaaaaacgccacgtattgggaagattgataactgtgaatccaattgtgacagaaaaagattcaccagtgaatatagaggccgagccgccatttggggatagttatattattattggggtcgaaccaggacaactaaaattaaactggtttaagaaagggtcatcaatagggcaaatgtttgaaactaccatgcgaggcgctaaaagaatggcgatcctaggcgatactgcctgggattttgggtcactagggggagtcttcacttcgataggaaaagccttacaccaagtatttggtgcaatctacggcgctgcattctcaggagtcagttggactatgaaaattttaataggagtcataataacctggatcgggatgaatagcagatcaacctctctttctgtatcattagtcctagtagggatcgtaactttatacctaggcgttatggtgcaagctgacacaggctgtgtggtttcttggaaaaacaaagaacttaaatgtggctcaggcatcttcattacggataatgtccatacatggacagaacagtataaatttcaaccagagagcccttcaaaactggctagtgcaattcaaaaagcacatgaggagggcatatgcgggattcgttctgttactagacttgaaaatttgatgtggaaacaaatcacaccagaattaaatcatattttgtctgaaaacgaagtgaaactgacaatcatgactggcgacatcaaaggaattatgcaagcaggcaagagaagcctgcgtcctcaacccactgagcttaaatacagttggaaaacttgggggaaagcaaagatgctatcaactgaatcgcacaatcagacattcctaatagacggaccagagactgcggaatgcccgaacactaatcgggcgtggaactcgcttgaagtggaagactatggatttggagtgtttagtaccaatatatggttaaaactgagagaaaaacaagatgtattttgcgactcgaaactaatgagcgctgctatcaaagataatcgagcagtgcacgcggatatgggctattggattgaatcggccctcaatgatacctggaaaatggaaaaagcatcattcatagaaataaagtcatgtcattggcccaagtcccatacgctttggtccaatggtgtactagaatcagaaatgataatccctaaaaattttgccggacctgtgtcgcagcataattatcgtcccggataccacacccaaacagcgggaccttggcacttaggaaagttggaaatggactttgacttctgtgaaggaacgacagtcgtagtaacggaagattgtggtaatagaggaccgagcttaaggactacgacagctagcggaaaattaataactgaatggtgttgccgatcttgtacgcttcctccgctaagatatagaggcgaggatggctgttggtatggaatggaaatcagacctcttaaagaaaaagaggaaaacttagtaaattctttagtcacagcaggccatggacagattgataattttagtttaggtgttctaggaatggcgctattcctagaagaaatgttacggactcgggtagggacaaaacacgcaatactgctagttgcggtaagtttcgtaacactcattacaggaaacatgagtttcagagatttggggagagtaatggtaatggtaggtgcaaccatgaccgatgacataggcatgggagtgacatatttggccttgttggcagcattcaaggtaagacccacgttcgccgctggactattactaagaaagctaacatctaaggagctcatgatggcaacgattgggattgcactactatcacaatcaactatcccagaaacgatacttgaactaacagatgcacttgcacttggaatgatggtattaaaaatagtacgaaacatggaaaaatatcaattagccgtgacgattatggcgatatcatgtgtcccgaacgcagtaatacttcaaaacgcttggaaagtatcatgtacaatactcgcagccgtttctgtgtcacctctgctactaacgagctcacaacaaaaagcggattggatacctttggcactaaccatcaagggcctcaatccgactgcaatattcctcacgacattatctcgcacaagcaaaaagaggtcgtggccacttaacgaagcagtaatggcagtaggcatggtgtcgatattagcatctagtcttctaaagaacgatatacctatgacaggcccacttgtcgcgggagggctgctaactgtatgttatgtgctaactggtagatcagctgacctcgaattagagaaagcagccgatgttaaatgggaagatcaagctgagattagtggaagtagtcctatattatcgattacgatatcagaagacggttcaatgtcaattaaaaacgaagaagaagaacacacgttgacaatacttatcagaacaggattgctagtgataagtggggtatttccggtgagcattccaatcacagcggcagcatggtatctatgggaagtcaagaaacagagagcgggcgtcttgtgggatgtaccctctccgccacctgtaggaaaggccgagctcgaagatggagcgtacagaataaagcaacgcggcatattcggttactcgcaaataggtgctggagtatataaggagggaacttttcatacaatgtggcacgtaaccaggggagcagtattaatgcacagaggaaaaagaattgaaccgtcatgggcggacgtaaagaaagatttgatttcatacggaggaggttggaagttagagggggaatggaaagaaggcgaagaagtacaggtattagcattagaaccaggcaaaaatcctcgggcagtacaaacgaagccaggtttatttaagacgaatactggaactatcggagcggtttcacttgatttctccccaggtacaagtggttcacctattgtggaccgcaaaggaaaagttgtcgggttatatggaaacggcgtggtcacacgaagcggagcatatgtctcagccatagctcagacagaaaaatcaatagaagacaatccagaaatagaagatgatatattcaggaagaagagactaacaattatggacctccaccccggagcgggtaagacgaaaagatatcttccagcgatagtcagagaagcaattaaaaggggcttgagaactctaatactggcacctaccagagtcgttgcggcagaaatggaagaagcacttagaggattgcccattagataccaaactcctgctataagagctgagcacactggaagagagatagtggacttaatgtgccacgctacgtttacgatgagactcttatctcctgtacgagtcccaaattacaacctcataataatggacgaagcacatttcacagatccggcaagtatagctgcccggggatatatctccacccgtgtagagatgggagaagccgcaggcatattcatgacagctacaccacccggttcaagagacccctttccgcagtcaaacgcacccatcatggacgaagaaagagaaatacctgaacgcagttggaacagtgggcacgaatgggtgaccgacttcaagggaaaaacagtgtggttcgttccaagcataaaagctggaaatgacatcgcagcatgtttacgtaagaatggtaagaaagtaatccaattaagccgcaaaacctttgatagcgaatacgtaaagacccgagctaatgattgggactttgtcgtaacaacagacattagtgaaatgggagcaaatttccgagcagaaagggtaattgatccgcgacgatgtatgaaaccggtgatactaacagatggagaagaacgcgtaatcctagccggacccatgcccgtaacacattcatcagcagctcaaagacggggtcggatagggcgtaatcccaaaaatgaaaatgaccaatatatatacatgggagaaccacttgaaaatgatgaggattgtgcacactggaaagaagcgaagatgctactagataatattaacaccccagaaggtataatacccagcatgtttgaacctgaaagggagaaagtcgacgcaatcgatggagaatatagactcagaggagaagctcgcaaaacatttgtagatctaatgcgtcgaggtgacttacccgtctggttagcttaccgagtagctgctgaaggtataaactatgccgaccgacgttggtgttttgatgggattaaaaataatcaaatactagaggaaaacgttgaggtagagatatggacaaaagaaggcgaaaggaagaaactgaaacctaggtggctcgatgcgcggatctattctgaccccctggccttaaaagaatttaaggagttcgctgctgggagaaaaagtttgactttaaatttaattaccgaaatggggagattgccaacatttatgacgcaaaaagcgcgagacgccttagacaacttagcagtgctacatactgcggaagttggtggacgtgcatataaccacgcactgtccgagctacctgaaacactagaaacgttacttctgttaaccctccttgctaccgttaccggcggaatatttctatttttaatgagtggcaagggcataggaaaaatgactttagggatgtgctgcattataacggctagcatactgctatggtatgcccaaattcaaccccattggatagcagcctcaataatattagagttcttcttaatcgtacttcttattcctgaaccggagaaacaacggaccccacaagacaaccaactgacctacgtggtgattgccatactcacggttgtagcggctacaatggctaacgaaatgggatttttggagaaaactaagaaagatttaggattaggatctattacgacacaggaatctgaatctaatattctagacatagacctacgtcccgcctctgcctggactttatatgcagtcgcaaccacttttgttaccccaatgttgaggcattccatcgaaaactcttcggtaaatgtgtctttaactgccatcgctaaccaggcaactgtattgatgggtcttgggcgaggctggcctctgagcaaaatggacataggagtacctttacttgctatcggatgttattcgcaagttaatccaatcactttaaccgccgcacttctattgctcgtagcccattatgcaataataggaccaggcttacaagcaaaagcaacgagagaagcacagaaaagaacagcggcaggaataatgaaaaaccctacagtagatggtatcactgtgattgatcttgaaccgataccttacgatcctaaatttgaaaaacaattgggtcaagtaatgctactggttttatgcgtaacgcaagtattgatgatgagaacaacgtgggctctttgtgaagcattaacgttagctacaggaccaatttcaactctttgggaaggcaatcccggaagattttggaatacgacaatagctgtatcgatggcaaacatctttcgtggttcttatctagcgggtgccggactcttatttagcattatgaaaaatacaacaaatacaagacgaggtacaggtaatatcggagaaacattaggagaaaagtggaaatcccgcctgaatgcgctaggaaaaagcgagttccaaatttacaagaaatccggcatacaagaagtagacaggaccctggcaaaagaaggaataaaacgaggagaaactgatcaccatgcggtaagtagagggtctgccaaactaagatggtttgtggaacgaaatatggtaacacccgagggaaaagtagtcgatcttggatgcggtcgaggaggctggtcctactactgtggcggtcttaaaaatgtaagagaggttaagggtctaacaaaaggtggtccaggtcatgaagaaccgataccaatgagcacgtatggctggaaccttgtccgcctccaaagtggggtagatgttttcttcactccgccagagaagtgtgatacattgctttgcgatataggtgaatctagccctaatcctacaatagaagcaggcagaacgttaagagtcttaaatttagtagaaaactggctaaataacaatacacaattttgtgttaaagtattaaatccttacatgccaagtgtcatcgagaaaatggagactttgcaaagaaaatacggaggtgcattagttcgaaacccattatcaagaaactctacacatgaaatgtattgggtatcaaatgctactggaaacatcgtatcatcggtaaatatgatctcacgtatgctaatcaatcgatttacaatgaaacataagaaagccacgtatgaaccggatgtagacctggggagtggtacaagaaacattggcatcgaaaacgaaatacctaatttagacataatcggtaaacgtatagagaaaattaaacaagaacatgaaacgtcatggcattatgatcaagaccacccttataaaacctgggcataccatggcagttatgaaacaaaacaaaccggatctgcaagtagtatggtaaatggggtcgtaaaactcttaaccaaaccttgggacgttgttcctatggtaacgcagatggcaatgacagatacaacgccatttgggcaacaacgagtatttaaagaaaaagtagacacacgcacacaagaacctaaagaaggtactaagaaacttatgaggattacggctgaatggctttggaaagaattaggcaaaaagaaaacccctagaatgtgtacacgcgaagagtttacacggaaagttaggagtaatgcagcactcggcgcaatctttactgacgaaaataaatggaaaagcgctagagaagctgtggaagactcacggttttgggagctagttgatagggagcggaatctccatttggagggaaaatgtgaaacttgtgtgtataatatgatgggaaagagagagaaaaagttaggcgagttcggaaaagctaaaggatcgcgtgccatctggtatatgtggttaggtgctagatttctagagtttgaagctctagggtttttaaatgaagatcactggtttagtcgtggtaactcactcagtggggtagaaggggaggggcttcataaactgggttacattctgcgtgacgtaagtaagaaagagggaggagcgatgtatgcggatgatactgctggatgggacacacgaataacgctggaggatctcaaaaatgaggaaatggtaacgaaccacatgaaaggtgaacataagaaactagcagaagcaatctttaaactaacttatcaaaacaaagtagtgcgagttcagaggcctacgcctagaggtactgtaatggacataatctccagaaaggaccaaagaggttctggccaagtaggaacctacggtttgaatacatttacaaatatggaagcacaattaattcgtcaaatggaaggcgaaggaattttcaagtccatacaacgccttaccgtaacagaagaaatagcagtacagaattggttggcacgagttggccgagaaagactgtcacgtatggcgataagtggggatgattgcgtggtaaaaccattagatgatcgatttgcatcagctcttaccgctctaaatgatatgggcaaagtgcgtaaagatatacaacaatgggaaccatcacgaggatggaatgactggactcaagtacctttttgttcacaccacttccatgaacttgtcatgaaagacggcagaatgcttgtagttccttgcagaaatcaagatgagttgataggtagagcacgcattagccaaggcgcagggtggtcactcaaagagactgcatgcctcggaaagtcatatgcacaaatgtggacactaatgtactttcatcgaagggatttaagactagcagccaatgccatatgttctgctgtaccgagccactgggtgccaacttcaagaactacatggagcatacatgcaaagcatgagtggatgacgaccgaagacatgcttgctgtatggaatagagtctggatacaagagaacccatggatggaagataaaaccccagtagaaagctgggaagaagtcccatacttgggaaagagagaagatcagtggtgcggtagtttaatcggattaacatcacgagctacgtgggccaaaaacatacagacagcgataaaccaggtacgcagtttaatcggcaacgaagaatataccgactacatgccatccatgaagcgtttccgaaaagaagaagaagaagcaggagttttatggtaa

SEQ ID NO: 22529 - RNA, 9876 nt, synthetic construct
  misc_feature 1..9876: note = derived and/or modified CDS sequence (opt6) from DENV-2__EU482552__SS-prME
  source 1..9876: mol_type = other RNA
acagcaggggtaatcataatgttgatacctaccgcaatggcattccatttaacgacgaggaatggggagccacatatgattgtcggcagacaagaaaaaggtaaatcattactattcaaaactgaagacggcgtcaacatgtgcacacttatggcgattgacttaggagaactatgtgaagatacaattacttacaagtgcccgttactaagacaaaatgaaccagaggatatagactgttggtgtaattccacatcaacttgggtgacttatggtacctgtacaacaacgggcgaacacagacgagaaaaaagaagcgtggccctcgtaccacacgtcggaatgggcttggaaactagaaccgaaacttggatgtcgtcagaaggtgcatggaaacatgtacaaagaatagaaacctggatactacggcatccaggatttaccataatggcagcaattctagcgtatacaattgggacaacgcactttcaaagggcactaatatttattctattaacggccgtagcacctagtatgactatgaggtgtataggtatatcaaatcgcgactttgtggagggcgtgagcgggggttcgtgggtagatatagtattagaacatggatcatgtgtcaccacaatggccaaaaataaaccgacgcttgatttcgagcttataaaaacagaagctaagcaaccagcgactctacgaaaatattgtatagaagcgaaactaactaatactactacggagagccgttgcccaacacaaggtgaacctagcctaaatgaagaacaagataaaagatttatctgtaaacactcgatggtagatagaggatggggcaacggatgcggcttatttggaaaaggagggatagtaacttgcgctatgttcacttgcaagaaaaatatggaaggcaaagtcgtgctcccagaaaatttagaatacactatagtaattacgccgcattccggggaagaacatgcagtcggtaatgataccggaaagcatgggaaagaaataaaaattaccccccagtcatcgattactgaagcggaattaacaggctacggtaccgtaacaatggagtgctcaccaagaactggattagactttaatgaaatggtgctattacaaatggaggataaagcgtggctggtacatagacaatggttccttgacttacctctaccttggttacccggggccgatacacaaggctcgaactggattcaaaaagaaaccctagtcacttttaaaaatccccacgccaaaaaacaggatgtagtagtactgggatctcaagaaggtgcgatgcacacggctcttacaggtgcaacagaaatacaaatgtcgagcggaaatctactttttacaggacacttaaaatgtagactccgcatggacaaactacaactaaagggaatgagttatagtatgtgcacgggaaagttcaaaatagtaaaagagatcgctgagacacaacacggaactattgtcattagagtgcaatatgaaggagacggtagcccatgtaaaataccattcgaaataatggacttagaaaaaagacatgttttgggaaggttaattactgtcaatccaattgttactgaaaaagatagtccagttaatatagaagccgaaccaccattcggagattcatacataattataggtgttgaacctgggcagttaaaactcaattggtttaagaagggttcaagcataggtcaaatgtttgaaactacgatgagaggagccaaaaggatggccattctgggggatacagcttgggatttcggctcactgggaggtgttttcacgtctacaggcaaagcgctacatcaagtcttcggcgcaatttatggcgcagctttttcaggtgttagttggacaatgaagatactgattggcgtgataataacgtggataggaatgaatagtagatctacttctttgtctgtaagccttgtattagtaggtgtagtaacactgtacttaggagtaatggttcaagccgatacaggttgtgttgtaagttggaaaaataaggaactaaagtgtggtagcggtattttcataacggacaacgttcatacgtggaccgaacaatacaaatttcagcccgaaagtccatccaaattagcatcggcgattcaaaaagctcatgaagagggaatctgcggaataagatccgtaacccggttagaaaacctgatgtggaaacaaataacaccagaattaaatcacatattatctgaaaacgaagtaaaactaacaataatgacaggggacattaaaggtataatgcaggcaggcaaacgaagtctaagacctcaaccaaccgaacttaaatattcctggaagacctgggggaaagctaaaatgctctcaacagaatcacataatcaaacttttttaatagatggtccggaaactgcagaatgcccaaacaccaatagagcatggaatagtctagaagtcgaagactatgggtttggggtattttcaacaaacatctggttgaagctacgagagaagcaagacgtcttctgtgattctaaactcatgagtgcagcgataaaagataaccgtgctgtacatgcggacatgggatactggattgaatccgctctaaacgatacatggaaaatggaaaaagcatcgttcatagaaataaagtcttgtcattggccaaaatctcacaccctatggagtaatggtgttctggaatctgaaatgataataccaaaaaatttcgcaggccccgtctcacaacataactacagacctggttatcatacacaaaccgctggaccctggcacctaggaaagcttgaaatggatttcgatttctgcgaaggaacaacagttgtagtaactgaggattgcggaaacagaggtcccagtctacgtacgactaccgcaagtggaaagttgattacagaatggtgttgcaggagctgtactctcccgcctcttcgttaccgtggagaggacggatgttggtatggtatggaaataaggccgttaaaggaaaaagaagaaaaccttgtcaattcattggtaactgctgggtatggacagatagacaacttcagcttaggcgtcctggggatggcgctttttctagaagagatgctgaggacacgagtcggtaccaaacatgcgatactactcgtggcggtttcatttgtaactctaataacaggaaatatgtcgtttagagatctaggtcgtgtaatggttatggtgggcgcgactatgacggatgacataggcatgggagtgacatacctggccttattagcggcgtttaaagtacgtcctacattcgcggccggcttgttactaaggaaattaacatccaaagagcttatgatggccactataggtatagcgttgctatcacaatcaacaataccggaaactatcctcgagctgactgacgcattagccctaggaatgatggtactaaaaattgtacgtaacatggaaaaatatcaactggccgtaaccataatggcaatatcgtgtgtaccaaatgccgtaatattacaaaatgcgtggaaggtatcatgcactatcttagccgccgtaagcgtgagtcctttattattaacctctagccaacaaaaagctgactggattccattagcgttaactatcaaagggctcaatccgaccgcaatttttctgactactttatcccgcacatcaaaaaagagatcctggcccctcaatgaagccattatggcagttggaatggtaagtatacttgcttctagcctgttaaagaatgacatccctatgacaggaccgctagtggcgggtggcctactcacagtatgttacgtattaacgggtcggtctgcagatttagagctcgaaagagctgcggatgttaaatgggaagatcaggcagaaattagcggaagtagcccaatcctgtcaattacaataagtgaagatgggtctatgtcaataaaaaacgaggaagaggagcataccctgacaatcctgatacgcacgggcttactagttatttcgggtgtgtttccagtatctatacccataacagctgccgcttggtatctatgggaggtaaagaaacaaagggcgggtgttttgtgggatgttcctagcccaccgccagttggtaaagcagaattagaggatggtgcctaccgcataaaacagagaggtatatttggctacagtcagataggtgctggggtttataaggaaggaactttccatacaatgtggcatgtaacaagaggagctgtcttaatgcacagggggaaacggatagaaccgtcgtgggcagatgtaaaaaaggacctaatctcgtatggtggaggttggaaattggaaggagagtggaaagagggagaagaagtccaggtcttagctctagaaccaggaaaaaacccgagagccgtacaaactaagcccggcctcttcaaaacaaatacgggtacaattggagctgtttcactagatttcagccctggaacatcgggaagtccaatagtagacagaaaaggcaaagtcgtaggcctatatgggaatggcgttgtcactagatccggtgcgtacgtgtcggcaatagcacaaacggagaaaagcatagaagataatcctgaaatagaagatgacatatttcgaaaaaagcgattaactataatggatcttcatccgggagcaggaaagacaaaacgatatttgccagccatcgttcgtgaagcaataaagcgaggcctacggactttaatcctagccccaacccgagtagttgctgctgaaatggaagaagccttaagaggcttgccgataagatatcaaacaccggcaatccgagcagagcacacgggaagggaaatcgtagacctaatgtgtcatgccacttttactatgcgtttgttgagtccagtaagggtacctaattataatttaataattatggatgaggcccattttaccgacccagcatcaattgctgcaaggggttatatatccacacgggtggaaatgggagaagctgctggcattttcatgactgccacacctcccggttcaagagaccctttccctcaatctaatgctcctattatggatgaagagagagagataccagagaggagctggaatagcggtcacgagtgggtaacggattttaaaggaaaaacagtgtggtttgtcccgtctataaaagcaggaaatgatatcgctgcatgcttaagaaaaaacggtaagaaagtaattcaattatcacgaaaaacattcgactcagagtatgtaaagactagggccaatgattgggacttcgtcgtaacaactgatatttcagaaatgggagcaaacttcagggccgaaagagtaatcgatcctagacgatgtatgaaaccagtaatattaactgatggagaagagcgagtaatcctggccggaccaatgcccgttacgcactccagcgctgcgcaaagaaggggtagaatcggacgtaatcctaaaaacgaaaacgaccaatacatttatatgggagaaccacttgaaaatgacgaagactgcgctcattggaaagaggcaaaaatgctattagacaatataaatacaccagaaggcattataccgtcaatgtttgaaccagagcgggaaaaggtagacgcaattgatggagaatataggctcagaggcgaagccagaaagacttttgtggacttgatgcgtcgaggagacttgcccgtgtggctagcttatcgtgtggcagctgaaggcattaattatgctgaccgaaggtggtgcttcgatggtataaagaacaatcaaatattagaagaaaatgttgaagtagaaatatggacaaaggaaggcgaaagaaagaaactcaaaccccggtggctagatgctcgaatatacagcgatcctcttgcactaaaagaattcaaggagttcgcagctggaagaaaaagtctaacgttgaaccttatcactgaaatgggcagacttccaacttttatgacccaaaaagccagagacgcacttgacaacttggccgttctacatacggcagaagtaggaggtagagcatataatcacgcactatctgaactacccgaaacattagaaacattattactgttgacactattagctacagtaacaggcggtatttttctttttctgatgagcggaaaagggataggaaagatgacattagggatgtgctgcataataacagcatcaatactactctggtacgcacaaattcaaccccactggatagccgcaagcatcatcctagagttttttttaatagtattattaatcccagagccagaaaaacaacgtacaccgcaagacaatcaactgacgtatgtagtaatagctattctaacagtggttgcagcgaccatggctaatgaaatgggtttcctagaaaaaacgaagaaagatctgggactaggctcaataactacgcaagaaagcgaatcaaacatcttagatattgaccttagaccggcctcagcctggacactgtatgctgtagcgaccaccttcgttactcccatgttaaggcactcaatagaaaattccagcgtaaatgtatctctcaccgcaattgccaaccaagccacagtactaatgggacttgggagaggatggcccctgtctaaaatggacataggtgtaccattactagcaataggatgctactctcaggtcaatccaatcactctaacagctgctttactcctactagtagcgcactatgcaataataggtcccggactgcaagctaaggccacgagagaagcccagaagagaacagcggctggcataatgaagaatcccacagtcgacggaattactgtcattgatcttgagcctatcccctacgaccctaaatttgaaaaacaactgggtcaggtaatgcttctagttctatgtgtcacacaagtactgatgatgcgcacaacttgggcattgtgcgaagcactaacattagccaccggccccatctccaccctttgggaaggaaacccgggacgtttttggaacacaactatagcagtctcaatggccaatatcttcagaggatcatatttagcaggtgctgggttattatttagcatcatgaaaaatacgacaaatacaagaagaggtacgggtaacataggcgaaacgcttggagaaaaatggaaatcacgtctcaatgcacttggtaaaagcgaatttcagatctataaaaaatccggaatacaagaagtcgataggacattagctaaagaaggtataaaaagaggagaaaccgatcatcatgccgtttctagaggctctgcaaagttacgctggtttgtagaaagaaacatggtgacgcctgaaggcaaggtagttgacttaggttgcggacgcggaggttggtcatattactgcggcgggttaaaaaacgtaagagaggtaaagggcttaaccaaaggtggacctggccacgaagaacccatcccaatgtcaacttatggctggaatttggttcggcttcagtctggagtggatgtattttttaccccacctgaaaaatgcgacactttactgtgcgatatcggagagtcgtcaccgaacccaacgatagaggcaggtagaacactacgcgtcttgaatttggtagaaaactggttgaataataatactcaattctgtgtcaaagtgttaaatccgtacatgccgagtgtaatagaaaaaatggagactctacaaagaaagtatggtggagctttggtcagaaacccgttatcaaggaactcaacacatgaaatgtactgggttagcaacgcgactggtaatatagtttccagtgtcaacatgattagtagaatgctaataaacaggttcaccatgaaacacaaaaaagcgacatatgagccggatgttgacttgggcagtggcactcgcaacatcgggattgaaaatgagatccctaatctagatataatcggcaaaagaattgagaaaataaaacaagaacatgaaaccagttggcattatgatcaagaccatccatataagacatgggcttatcatgggagttatgagacaaaacaaacaggttccgcatcgagtatggtcaatggtgtagtgaaactcctaacaaagccctgggatgtggtaccaatggttacacaaatggcaatgacagatacaacaccatttggccagcaacgggtatttaaagaaaaagtagacacgagaacacaagaaccaaaggaagggaccaaaaaactcatgcggatcacggctgaatggttatggaaagaactaggcaaaaaaaaaactccacgaatgtgcactagggaagaatttacccggaaggttcgaagtaacgcagctcttggcgcaatcttcacagatgagaataagtggaaaagtgcaagagaagcagttgaggatagtcgattttgggagcttgttgatagagaacgtaacttacatttagaagggaaatgcgaaacctgtgtatataacatgatgggcaaaagagaaaagaaactaggagaattcggtaaagctaaaggatccagggcgatttggtatatgtggttaggagcaagattcttagagttcgaagcacttggatttcttaacgaagatcattggttcagcagaggcaatagcttgagtggcgtagaaggtgaagggttgcataaactcgggtatatactccgagacgtgtcaaagaaggaaggtggggcaatgtatgccgatgacaccgcaggttgggatacacgaataacactagaagatttgaaaaacgaagagatggttaccaatcatatgaaaggtgaacataaaaaacttgccgaggcaatctttaagttgacatatcaaaataaggtagtccgggtgcaacgaccaacgccaaggggcaccgtgatggatattataagtcgcaaagaccagagaggctctggacaagttggaacatacggattaaacactttcacaaatatggaagcacaactcatacgtcaaatggagggcgaaggaatttttaaatctattcaaagacttaccgtaaccgaagaaatagctgttcaaaattggcttgcccgagtgggccgagaaagattaagtcgcatggcaattagtggcgatgattgtgtggtaaaaccattagatgaccggttcgcctcagctctgactgcattaaacgatatggggaaagtacgcaaagatatacaacaatgggaaccgtcccgcgggtggaacgattggacccaagttccattctgttcacaccactttcacgaattagtaatgaaagatggacgagtcctcgtcgtaccctgtaggaaccaagacgagcttatagggcgagccagaatatcacaaggcgcaggctggtcactaaaagaaactgcttgtttaggcaaatcctatgctcaaatgtggacgttgatgtacttccacagaagagatttaagactcgctgccaatgcaatatgcagtgcagtaccctcacactgggtccccaccagtcgaactacatggagtatacatgccaaacacgaatggatgacgaccgaagatatgctagctgtttggaacagggtttggattcaggaaaacccttggatggaagataagacaccggtagaatcgtgggaagaagttccataccttggaaaaagagaagaccaatggtgcgggtcacttatcggtttgacctcccgggcgacttgggcgaagaatattcaaacggcaatcaaccaggtacgaagcttaatcggcaatgaagaatatacagattacatgccatcaatgaaaagatttagaaaagaagaagaggaagccggagtcctttggtaa

SEQ ID NO: 22530 - RNA, 9876 nt, synthetic construct
  misc_feature 1..9876: note = derived and/or modified CDS sequence (opt6) from DENV-2__EU482554__SS-prME
  source 1..9876: mol_type = other RNA
accgcgggagtaattattatgttaatacccaccgcaatggcatttcatttaaccacacgcaatggagaaccgcatatgatcgttggaaggcaagaaaaaggaaaatccctattatttaaaactgaagatggggtaaatatgtgtacacttatggctatcgatttaggagaactatgtgaagatacgataacgtataaatgccccctattgagacaaaatgaaccagaagatattgactgctggtgtaattccacctcaacatgggtaacttatggaacttgcactacaacgggggagcaccgcagggagaaaaggtcagtagctttagtaccacatgtcgggatgggattagaaacaagaactgaaacttggatgtcttccgaaggtgcttggaaacatgttcagcgaattgaaacatggatacttcgacatccaggctttaccatcatggcagcaattcttgcatacacaatcggaactacccattttcaaagggcactgatctttattctgctaacagcagttgctccaagcatgactatgaggtgcattgggatcagcaacagagacttcgtagaaggtgtaagtggtggaagctgggtagatattgtgctagaacatggatcatgtgttacgacaatggccaaaaataaacccactttggattttgagttaatcaaaaccgaagcaaaacaacctgcaactcttagaaaatattgtattgaagctaaactaacaaatactactactgaaagtagatgtcctactcaaggagagccatctctaaacgaagaacaagataaacgatttatatgtaaacactcaatggtggacagaggatggggaaacggttgcggtttatttgggaaaggcggaatagtgacatgcgctatgtttacatgtaagaagaatatggagggaacagtcgtattaccagagaatctagagtatacgatagttataacaccgcacagtggcgaagaacatgctgtgggtaatgatacgggaaaacatggaaaagaaatcaaaatcactccacaatcttctattacagaagctgaactaacaggttacggaacagtcaccatggagtgctcaccgagaactggactagactttaatgaaatggttctattgcaaatggaggataaagcgtggttggtgcaccgacaatggttcttagatctgccgcttccatggctgccaggcgctgatacacaaggttcaaattggatacagaaagaaacgcttgtaacatttaaaaatcctcatgccaagaaacaagacgtcgtcgtattgggaagtcaggagggggcgatgcatacagcactaacgggagctactgaaatacagatgagctctggaaacctcttatttacaggtcatcttaaatgtcgactaagaatggataaattacaattaaaaggcatgtcatactctatgtgcacaggaaaatttaaaatagtaaaagaaatagcagaaacacaacatggaactatcgtaattagagtacaatatgaaggtgatgggtcgccatgcaaaataccattcgaaataatggatctcgagaaaaggtacgtgttaggcagactgatcactgtgaatccaattgtaacagagaaagattcgccagtgaacatagaggctgaacctccattcggtgactcctatattataatcggtgtcgaaccgggacagctaaaactaaattggtttaagaaaggaagcagcataggacaaatgttcgaaacgacgatgagaggggctaaacgaatggccatattgggtgatacagcttgggatttcggatcgctaggtggtgttttcacaagcattggcaaggctttgcatcaggtttttggagcaatatatggtgctgcattttcaggagttagctggacgatgaaaattctcataggcgtgataataacatggatcgggatgaactcgcgctcaacctctctatcagttagcctagtcctagtaggagtagtcactctatatcttggcgtaatggtccaggctgacagtggatgcgttgtatcatggaaaaataaggaactaaagtgcggatcgggcatatttatcactgataatgttcacacgtggactgagcaatataaatttcaacccgaatcaccatcaaagttggcatcagccatacaaaaggcacatgaggaaggcatttgtggaatcaggagtgtaacccgactagagaacttaatgtggaaacaaattactccagaactaaaccatattctctccgagaatgaagtcaaactaacaattatgacaggcgatataaaaggaatcatgcaagcaggtaaacgaagtttacggccacaacccacggaactaaaatatagttggaaaacttggggaaaagccaaaatgttgtctactgaaagtcacaatcagacgtttttaattgatggaccagaaacagcagaatgtcccaatacaaatagagcgtggaactctcttgaggttgaggactacggctttggtgtttttagtactaacatctggctaaagttaagggaaaagcaagacgtgttttgcgactcgaaactaatgtcagcggcaattaaagataatagggcagtacatgcagatatgggatattggatagaaagcgccctaaatgacacgtggaaaatggagaaggcttcattcatagaagtaaaaagctgtcattggccaaaaagccacacactatggtcaaatggagtgctagaaagtgaaatgattatacccaaaaatttcgcaggacccgtttcacaacataactaccggcccggctatcatacacagaccgcggggccttggcacttagggaagctggaaatggacttcgatttctgtgaaggtaccacagtagttgtaacagaagactgtggcaatagagggccgtcactacgaacgacaacagcctctggaaaactaattacggaatggtgctgtaggtcttgcacattgcctccccttaggtataggggtgaagacggatgctggtatggtatggagatacggccactgaaagaaaaagaagagaacttggtcaatagtctagtcaccgcaggccatggacaaatcgataacttttcactgggcgtcttgggtatggcgctctttttggaagaaatgcttagaactagggttggcactaagcatgcaatactattggttgcagttagttttgtaacattaataacggggaatatgtcattccgggatttgggtagggtaatggtaatggtaggagcaacaatgacggacgatattggtatgggcgtaacttatctagctttacttgcagcctttaaagtgagaccaacgtttgccgctgggttactactaaggaaactaacatcaaaagaactcatgatggccacaataggaatcgccttactatcgcaaagcacaattccagaaacaattttagaattgaccgatgcgctggcgttgggaatgatggtcctcaaaattgttcgaaatatggaaaaataccagctcgcggtaactataatggccatactctgcgtgcccaatgcagtcatacttcaaaatgcttggaaagtgagttgtacaatactcgcggctgttagtgtcagtccattgttattaacgagctctcagcaaaaggcggactggatacctttggcattaacgatcaaagggcttaaccctactgcaatattcttgacaacgctatctcgtacatcaaagaaaagatcatggccactaaacgaggcggtgatggccgtcggcatggtttcaattctggcatcttctttactgaaaaacgacattcctatgacaggacccttagtggctggtggtcttttaacggtctgttatgttttaacaggcagatctgctgacctagaactagagagagctgcagacgtgaaatgggaagatcaagccgaaattagtggaagtagccctatactaagtattacaatttcagaagacggtagcatgtctatcaaaaatgaagaagaagaacaaacactgacaatactgatacgaaccggactattagtcatatcgggcgtatttccagtctctatccctattacggcagctgcttggtatctatgggaggtcaagaaacaaagagctggtgtcctatgggatgtgccttcaccaccacccgtaggcaaagcagaactagaagatggtgcatatagaattaaacaacgcggtatatttggatacagccagataggcgcaggagtttataaagaagggacttttcacacgatgtggcatgtaacaagaggagcagtattgatgcatcgcggcaagagaattgaaccgagttgggccgacgttaagaaagacctaatttcatacggaggtggatggaaattagaaggggaatggaaagaaggagaggaagtacaagtactcgctctagagccaggcaaaaatccgagagcagtacagacaaaaccaggattattcaagactaacacgggcacaataggagcagtgagtcttgacttttcaccaggaacctcgggttcgccgatcgttgatcgcaagggtaaagttgtaggattatatggtaatggagtcgtgacaagatcaggtgcatacgtgagtgctattgcacaaactgagaaatcaatagaggataatccagaaatagaagatgatatcttcagaaagaaacgtctaactatcatggatctacatccgggagctggaaagactaaaagatatttgccagcaatagtaagggaagctatcaagcgaggtctaagaaccttaatacttgcccctactagggttgttgctgcagagatggaggaagcacttcgaggcctacctattcggtaccagacgccagctatccgcgctgaacacacaggtagggaaattgtagaccttatgtgtcacgctactttcaccatgcgattactctcccctgtacgtgtcccaaattataatctaatcatcatggatgaagcgcattttactgatccagcgagtatcgccgcgagaggatacatcagcactagagttgagatgggtgaagcggcaggaatatttatgactgctacgcctccaggttcgcgggacccattcccccaaagcaatgccccgataatggatgaagaaagggaaatacctgaaaggagctggaatagtggtcatgaatgggtaacagactttaaagggaaaaccgtatggtttgtccctagcataaaagccggaaacgatatagccgcgtgcttacggaaaaatggcaagaaagtgatacaattgtcaagaaaaacgttcgatagcgaatacgtcaaaactagggcaaatgattgggacttcgtagtcacgaccgatatttcagagatgggggcaaattttagggcagaacgagttattgatcctcgccggtgtatgaaacctgttatattaaccgacggtgaagaaagagtaatcttagcagggcccatgccagtcactcattcttcagcagcccagcgtcgaggtagaatcggccgcaaccccaaaaatgagaatgatcaatatatttatatgggtgaaccattagaaaacgatgaggactgtgcacattggaaagaagccaaaatgttacttgataacatcaatacgcctgaaggaataataccttctatgtttgaaccagaaagagagaaagtagatgcgatcgacggggagtacagacttagaggagaagcaaggaaaactttcgttgacctaatgaggcgtggtgacttaccagtttggttagcatatagggtagctgccgaagggataaactacgcagatagaagatggtgtttcgatgggataaagaacaatcaaattctggaagaaaacgttgaggttgagatttggacaaaagaaggggaacgaaagaaactgaaaccacggtggttagacgcaagaatctatagtgaccccctcgccctaaaagagttcaaagaatttgcagctggcagaaagagcttaacattaaacctgataaccgagatgggaagactgccaacatttatgacgcaaaaagcaagggacgctctcgataaccttgctgtgctccatactgctgaggtaggtggcagagcatacaatcatgccctatctgagttacccgagactctagaaacacttttactactgacgctactggcaacagttactgggggtatattcctatttctaatgtcaggaaaaggaataggtaaaatgacgctcggaatgtgttgtataattacggctagcattttgctctggtatgcccaaatacaaccacattggatagcagcctcaataatattagagttctttctaatagtgcttttaatacctgaaccggagaaacaaagaactcctcaggacaaccaactcacatatgttgtcattgctattcttactgtagtcgcggcaacaatggccaacgaaatgggattcctcgagaaaacaaagaaagacttaggactgggatccattattacacaagagtccgaatctaacatccttgacatcgaccttagaccagcctctgcatggacactctacgcagtcgctactacctttgtgacgcctatgttgagacattcaatagaaaacagtagcgtaaatgtgtcgttaacagcaatagccaatcaagctaccgtactgatgggattagggcgtggatggccattatcaaagatggatataggtgttcctctattagctataggctgctacagtcaggtaaatcctataaccctaacagctgctctattactcctagtagctcactatgccataataggcccaggtttgcaggcaaaagccaccagggaagcccagaaaagggcagccgcaggtattatgaaaaacccaacggtagacggtataaccgttatagatctagaacctataccctatgacccgaagttcgaaaaacaattggggcaagtcatgctcctagtgttatgtgttacacaagtcttaatgatgagaaccacatgggccctatgtgaagcactgacgcttgccaccggacccatttcaacattatgggaaggaaatccagggagattctggaatacaacgatcgctgtttcaatggcaaacattttccggggatcatacttagcgggcgcaggattactattttcaatcatgaaaaacactaccaacacaaggagaggtacagggaatataggcgaaacattgggtgaaaagtggaaatcgcgattaaacgcacttggtaaatcggaatttcaaatttataagaaatccgggatacaggaggtcgatagaacgcttgcaaaagaaggcatcaagagaggagagacggaccaccatgccgtcagtcgcgggtctgctaaattaagatggttcgtagaacgaaacatggttactccagaaggtaaggtggtagatctaggatgtggcagagggggttggagttactattgcggaggattgaaaaatgtcagagaggtaaaggggttaactaaaggaggacctgggcatgaagaacctatacctatgtcaacatacggttggaacttagtccgtttgcagtcaggagtggatgtgtttttcacacctcctgaaaaatgcgatacgctgctctgtgatataggggagtcatcacctaacccgaccatagaagcgggtaggactttaagagtcctaaacttagtagaaaattggttgaataacaacacacaattttgcataaaagttttaaacccttatatgccaagcgtcattgaaaagatggaaacactacaaagaaaatatggtggagcactggtacgaaatccattaagtagaaactcaacccacgaaatgtactgggtgagcaatgcgacaggaaatatcgtttcgagcgtgaatatgattagccgaatgttaataaaccgatttactatgaaacataagaaagcaacatatgaacccgatgttgatttaggcagcggtacgcgaaatattggtatcgaaaacgaaataccaaacttagatatcattgggaaacgaatagagaaaattaagcaggagcatgaaacaagttggcactatgatcaagaccacccatacaaaacatgggcataccatggttcgtatgagactaaacaaacaggaagtgccagcagcatggtaaatggtgtcgttcgactccttacgaaaccttgggacgtggtgccaatggtgacccaaatggcaatgactgatacaacaccatttggtcaacaacgagtgtttaaggaaaaagttgacacaagaacgcaagaaccgaaagagggaaccaagaaattgatgcgcatcacagcggaatggctttggaaagagctcggcaagaagaaaaccccaagaatgtgtactcgggaagaatttacacgcaaggtcagatcgaatgcagctttaggggcaatatttaccgatgaaaacaagtggaaatcggcaagagaagcggtcgaagacagtcgattctgggaattggtggacagagaacggaacctccatctagaagggaaatgtgaaacatgcgtgtacaacatgatggggaaaagagaaaagaaactaggagaatttggtaaagcaaagggtagtagagctatctggtacatgtggctaggagcccgattcttggagttcgaagcattggggttcctaaatgaggaccactggttttccagaggaaatagcctaagcggggtggaaggagaaggacttcacaaattgggttacatactacgagatgtctcaaagaaagaaggaggtgctatgtatgccgatgatactgctgggtgggatacgcgaataactttagaagatctcaaaaatgaagaaatggttacaaaccatatgaaaggtgagcacaagaaattagccgaagcaatcttcaaacttacttatcaaaataaagtagttagagtccaacgcccaacgcctagaggcacagttatggatataataagcagaaaagatcaacgtgggtcaggacaagtagggacatacggactaaatacttttacaaacatggaggctcaactcattaggcaaatggagggcgaaggaatatttaaatcaatacagcatctaacagtgacagaggaaatagctgtacagaactggctcgcaagagtagggagggagagactaagtagaatggcaatatcgggtgatgattgtgtagttaaaccccttgacgaccgcttcgcatctgcactcacagctttaaatgatatgggaaaagttcgtaaggacatccagcaatgggaaccgtcacgaggatggaacgactggactcaggtgcctttttgttctcatcactttcatgaactcgtcatgaaagatggaagggtactcgtagtaccatgccgatcacaggatgaactaatcggacgagcacgaatatcacaaggagctggttggtccctgaaagagacagcttgccttggaaaaagttacgctcaaatgtggacacttatgtattttcacagacgtgatctgcgcttggcggctaacgctatatgctctgcggtgccatcgcattgggtaccgacaagcagaacaacatggtctatacatgctaaacatgagtggatgactactgaggacatgctagcagtctggaatagggtctggatacaagaaaatccgtggatggaggacaaaactctagtcgaatcatgggaagaagtgccatatctcggcaagcgggaggatcagtggtgcggaagtcttatagggcttacatcaagagcgacctgggctaaaaatatacaaacagcgataaatcaggttcgttcattgataggcaacgaggaatatacggactacatgccatctatgaaaagattccgaaaagaagaggaggaggctggagtactatggtga

SEQ ID NO: 22531 - RNA, 9876 nt, synthetic construct
  misc_feature 1..9876: note = derived and/or modified CDS sequence (opt6) from DENV-2__EU482556__SS-prME
  source 1..9876: mol_type = other RNA
accgcaggagtaataattatgttaatacctaccgcaatggctttccaccttacaactcgaaacggagaaccacatatgatagtgggacgacaggaaaaaggtaaatctttactgttcaaaactgaagatggagtaaatatgtgtactttaatggcaatagatcttggtgaactttgtgaagacactataacctataaatgtccacttctacgacaaaatgaacctgaagacatagactgctggtgcaatagcacatcaacatgggttacgtatggaacttgtactacgacaggcgaacacagacgagaaaaacgaagtgttgcattagtgccacatgttggtatgggcctggaaacgaggacggaaacgtggatgagctccgaaggggcatggaaacatgtccaaagaattgaaacatggatactcaggcatccaggattcaccataatggctgcgattttagcatacaccataggaacaactcatttccaacgagccctcatttttatattgcttacagctgtcgcacctagtatgactatgcgatgtatcggaatatcgaatcgtgattttgtcgaaggtgtatcaggaggcagttgggtagacatcgtattagagcatggaagctgtgtaacaacgatggccaaaaacaaacccaccctagatttcgaattaataaaaacggaggccaaacaaccagcgacattacgcaaatattgtattgaagcaaaattaactaatacaacaactgaaagtcgatgccctacccaaggggaaccaagtttaaacgaagaacaggataaacgttttatatgcaaacattcaatggtcgatcgaggttggggtaatggatgtggactttttggcaaagggggaattgttacgtgtgcaatgtttacctgcaagaaaaatatggaagggaaagttgtacttccagagaacctggaatatacaattgtaataacaccacactcaggagaagaacacgctgtgggtaatgataccgggaaacatggaaaagagataaaaataacaccacaaagttccataactgaagcagagttaactgggtatggaaccgtcactatggaatgcagcccacgtaccggattagtgtctcacgaaatggtcttattacaaatggaggataaagcctggctagtgcaccgccaatggttccttgacctaccgctcccatggttacccggagccgatacacaaggaagcaattggatacaaaaagagaccctagttacatttaaaaatccccatgccaagaaacaggacgtggtggtccttggttcacaggagggtgcgatgcatacagcgctaactggtgctactgaaattcagatgagtagcgggaaccttctatttacaggacacctcaaatgcaggctacgaatggacaaacttcaactgaaaggtatgtcatattcaatgtgtacaggtaaatttaaaatagtaaaagaaattgcagaaacacagcacggcacaatagtcatacgagttcaatacgaaggggacggtagcccatgcaaaattccatttgaaatcatggatcttgagaaaagacatgtactaggaagattgataacagtcaaccctatagttaccgagaaagattctcctgttaacattgaagctgaaccaccatttggggattcttatataataataggcgtagagccaggacaattaaaattaaactggttcaagaaagggtcatctataggacaaatgttcgaaacaacaatgcgaggggccaaaagaatggcggtcctgggtgacactgcttgggatttcggtagcctgggaggagtatttacctccattggcaaagctctacatcaagttttcggcgccatatatggcgctgccttttcgggtgtctcttggactatgaaaattctaataggagtaatcataacatggataggaatgaactcgaggtctacaagtctatccgtatcacttgttctggtcggcgttgtaactctttacttgggtgtaatggtacaagcagacacagggtgcgtcgtttcgtggaaaaacaaagagctaaaatgcgggagcggtatcttcataactgataacgttcatacttggactgaacaatataagtttcagccggagtcaccttcgaaacttgcaagcgcaattcaaaaagcccacgaagaaggaatatgtgggatacggtcagtcaccagattggaaaatctaatgtggaaacaaataacaccggagctgaaccatattctatcagaaaatgaggtcaaactaaccataatgactggtgatataaaaggaataatgcaagcgggaaagaggtcccttcgaccgcaacctaccgagttaaaatattcatggaagacctggggaaaagcaaaaatgctgtctacagaatcacataatcagacttttctaattgatggtccagagacggcggagtgtcccaatacaaatagagcttggaactccctggaagttgaggactacggatttggagtgttttcgacgaacatatggcttaaattaagagagaaacaagatgtattttgtgattcaaaactgatgagtgcggctatcaaggataatagagcagttcacgccgatatgggctactggattgaatccgctttaaatgatacatggaaaatggagaaagcgagttttattgaaataaaaagctgtcattggccaaaaagccacacactatggagtaacggtgttctagaatctgagatgattatacctaaaaacttcgcaggcccagtcagtcaacataactatagacccggttaccatacacaaactgcagggccatggcatctaggaaagttagaaatggatttcgatttttgcgaaggtacaacagtagtagtgaccgaagattgcggtaatcgaggcccttctctaagaacgacaacagcttctggaaaattgatcacagaatggtgctgtagaagctgcactttaccacctttacgataccgaggtgaggatggatgttggtatggaatggaaatacgtccattaaaagaaaaagaagaaaacttggtaaatagcctagtgacagctgggcacggtcaaatagacaacttttctctaggagtcctgggtatggcactctttttagaagagatgctaaggactagggtaggaacaaaacatgcaatcctcctagttgccgtaagtttcgtcacattaatcacaggcaatatgagcttcagagatttgggaagagtaatggtaatggttggagcaacaatgaccgatgatataggtatgggagtaacctacttagcactactagcagcttttaaagttaggcctacattcgctgcggggctattactacgaaaactaacatctaaagaattaatgatggccactatcggaattgccttgttaagccaatcgacaattcctgagacgattctagagctcactgatgcacttgcactaggaatgatggttctgaaaatagtgaggaatatggaaaaatatcagcttgccgtcacaataatggctatctcatgtgtgccgaatgctgttattttacaaaacgcctggaaggtcagttgtactatcctagcagcagtatcagtctcacctttactgctcacttcgtcgcaacaaaaagccgactggatcccattggcgctaactataaaagggctcaacccaacggcgatatttctaacaactctctcacgcacttcaaagaagcgaagttggccattaaacgaggctgtgatggcagtgggcatggtttcgatattagctagtagtctccttaaaaacgatataccaatgactggaccattagtcgcgggaggattattaacggtatgctatgtactcactggtcgaagtgcagatttagaattagaaagagcagcagatgtcaaatgggaagaccaagcagagattagcggatcgtcgcctatattatcaataacaatttctgaagatggtagcatgtcaatcaaaaatgaagaagaagaacatacactaactatcctaatacgaaccggattgttagtaatatcaggagtcttcccagtatcgattccaattacagctgcagcttggtatctatgggaagttaaaaagcagagagcgggggtactgtgggatgtaccaagccctccacctgtagggaaagcagaattagaggatggtgcataccgaataaaacaaaggggaatatttggttacagtcaaataggagcaggagtctataaagaagggacgtttcatacgatgtggcatgtgacccgtggtgcagttttgatgcatagaggaaagaggatcgaaccatcatgggcagatgtgaagaaggatctgataagctatggaggaggatggaaattagaaggtgaatggaaagaaggagaagaagtgcaagttctcgctcttgaaccaggcaagaatccacgcgcagtacaaactaaaccagggctttttaaaacaaatacgggaacaatcggtgcagtctcgctggacttttcaccaggcacatctggttcaccaatagttgatcgaaagggtaaagtggtagggttatatggtaacggtgtcgttacgcgatcaggagcctatgtgtctgcgatagcacagaccgaaaagtccatagaagataatccggaaatagaagacgatatattcaggaagaaacggttaacaataatggacctccacccaggagcagggaaaacaaaaagatatttgccagccatagtgagggaagcgataaaacgcggccttagaacactcatactagcacctacaagggttgttgccgcagagatggaagaagcattgagaggtttgccaattagataccaaactccagccatcagggcagagcacactggccgagaaattgtggatctaatgtgtcatgccacatttaccatgcggctcctgagtccagtaagagtaccaaattataacttaatcataatggacgaggcacattttactgacccagctagtattgctgctcggggatatatatctacacgagttgagatgggcgaagcagctggaattttcatgacagcaactccccctggatcgcgagacccgtttcctcagtccaatgcgcctattatggatgaagaaagagaaataccggaaagaagctggaatagtgggcatgaatgggtcacagattttaagggcaaaacggtatggtttgttccatccatcaaagctggtaacgatatcgcagcctgcttaaggaagaatggtaaaaaggtcatacagctaagccgcaaaacattcgattctgaatatgtgaagaccagagcaaacgactgggattttgtcgtgacaacagatatctcagagatgggtgctaactttcgagcggagagagttatcgatccaagaaggtgtatgaagcccgttatcttaactgatggagaggagagagtaatacttgctggaccaatgcccgtaacacactctagcgccgcacaaagaaggggaagaataggtcgaaatccgaaaaatgaaaacgatcaatatatctatatgggggaaccattagaaaatgacgaggattgtgctcactggaaggaggcgaaaatgttattggacaacattaacactccagaagggattataccgtcaatgtttgaacccgaacgcgaaaaagtcgacgcgatagatggagaatatcgattgagaggggaagccaggaaaacctttgtggatcttatgcgcagaggggatctaccggtttggcttgcatatcgagtggcagcggaaggtataaattacgcggaccgaagatggtgtttcgatggaattaaaaacaatcaaatattggaggaaaacgtagaagtagagatctggaccaaagaaggcgaaagaaagaaattaaaaccacgatggctggatgcaaggatctattccgacccactagcactaaaagagttcaaggaatttgctgcgggacgtaaatctcttacattaaacttaatcactgaaatgggacgtcttccaacattaatgacacaaaaagcaagagatgctttggacaatctagcagttcttcatacagcggaagtgggaggtagagcctataaccatgcattaagcgagctacctgaaacattagaaacactactcttacttacacttttggctacagtcactggaggaatatttctcttcttaatgtcaggtaagggtataggtaaaatgactctcggaatgtgctgtataatcacagcaagtatcctattatggtatgctcagatacaacctcattggattgcggcatccattatactggagttctttctaatagttttgttaataccggaacccgaaaaacagcgaactccacaggacaaccagttgacatatgtcgtcattgccatattgacggtagttgcagcaacaatggcaaatgaaatgggtttcttagaaaagactaagaaagatctaggcctcggtagtataacgacccaagaatccgaatcaaatattctggacattgatttaagaccagcatctgcatggaccttgtatgcggtcgcgactacttttgtaactcccatgttaagacacagtatcgaaaattcaagcgtcaacgtttcattgaccgcgattgccaaccaagccacagtcttgatgggtctagggagagggtggcctctttctaaaatggacataggagtccctttactagccattggctgctattcacaagtaaaccccattacgctgactgcggcattacttttattggtagcccactacgctataattggtcccggattacaagctaaagctacaagagaagcgcaaaaacgaacggctgcgggaattatgaagaacccaacagttgatggtattacagtgatagacctggaaccaataccatatgaccccaaattcgaaaagcaactaggacaagtaatgctccttgttctatgcgtaacacaagtgttaatgatgaggacaacatgggcattatgtgaggctttaacattagcaaccggaccaatttcgacattgtgggaagggaacccaggaagattctggaatacaacaatagcagtctccatggccaatatattcagaggatcatacctggccggagccggtttgttgtttagcataatgaagaatactactaacactaggagaggcacgggaaacattggagagaccttaggagaaaagtggaagtctagattgaacgccttaggtaagagtgagtttcagatctataagaaaagtggaatacaagaagtagatcgaacgttggctaaagagggaataaagcgtggagaaactgatcaccatgctgtaagcagaggatccgcaaaattacgttggttcgtggagcggaatatggtaacgcctgaaggaaaggtcgtcgacttgggatgtgggagaggaggatggtcatactactgcggcggcctcaaaaacgtgagagaagtaaagggattaacaaagggtgggcctggtcatgaggaaccaatcccaatgagtacttacggatggaacctcgtgcgcttgcaaagtggcgtagacgtattctttacacctcctgaaaaatgtgacacactattatgcgatataggggaaagtagtccaaatcctactatagaagctgggcgcaccttaagagttcttaatcttgtcgaaaactggcttaataacaatactcaattctgtgtcaaagtactaaacccctatatgccaagcgtcatagagaaaatggaaaccctacaacgcaaatacggtggagctctggttcgtaatccactgagcaggaactccacacacgaaatgtactgggttagtaatgctaccggtaacatagtttcaagtgttaacatgatttcgagaatgttaatcaatagattcaccatgaaacataaaaaggccacatacgaacctgatgttgacctaggctcaggaactcgaaacataggaatagaaaatgaaataccaaacttggatataatcggtaagagaatcgagaagattaaacaagagcatgagacaagttggcattatgatcaggatcatccctacaagacctgggcataccatggttcctatgaaacaaaacaaaccggctcagcctcgtcaatggtaaatggtgtagtaaaattgctaactaagccatgggatgttgtaccaatggtgacccagatggctatgacagatacaactccctttggccaacaacgggtattcaaagaaaaagtagatactaggacacaagaaccaaaagagggaacaaagaagttaatgaggattacagcagagtggctctggaaagaactaggtaagaagaaaactcctcgtatgtgcacaagagaagaatttacgagaaaggtaagaagtaatgccgctctgggtgcgatatttaccgatgaaaataaatggaaatctgcgcgcgaagccgtggaagatagcagattctgggagttagtcgatagggagagaaatttgcatcttgaaggaaaatgcgagacctgcgtatacaatatgatgggtaaaagggaaaagaaattaggcgaatttggaaaagcaaaagggtctcgtgcgatttggtatatgtggttaggcgcaagattcctcgaatttgaagcacttggatttcttaatgaagatcactggttttcacgcggaaacagtctaagtggagtggaaggtgaaggtttacataaactaggttatattttaagagatgtaagcaagaaagagggaggagcgatgtatgctgacgatacagcaggatgggacactaggataacactcgaagatttaaagaatgaagaaatggttacaaatcacatgaagggcgaacacaagaaattagcagaagcaatattcaagttgacgtaccaaaacaaagtagtgagagtccaacgccctacaccccggggaaccgtcatggacattatctctagaaaagaccagcgaggaagtggtcaagtaggaacgtatggactaaacactttcactaacatggaggcacagctaataagacaaatggaaggtgaagggatattcaagtcaatacagagattaaccgtaacagaggaaatagcagtccaaaattggttagtaagggtaggacgcgaacgattatccagaatggccgtgagtggagatgactgcgtagtaaaaccactggatgataggtttgctagtgcattgaccgcattaaatgatatggggaaagttcgaaaggatatccagcaatgggaaccatcccgagggtggaatgattggacacaggtcccattctgtagtcatcattttcatgaattagtaatgaaggatggtcgagtattggtagtcccctgtcgtaaccaggacgaactaataggcagagcacgtattagtcagggagcgggatggtccctaaaagaaacagcgtgcttaggtaaaagctatgcccagatgtggacacttatgtactttcacagaagggatcttcgattagcggctaatgcgatatgttcagcggtgccctcacactgggtacccacttcacgtacaacatggtcaatccatgctaagcatgaatggatgacgacagaagacatgctagctgtatggaacagggtttggatccaagaaaacccttggatggaagacaaaactccggtagaaagttgggaagaggtaccttacttaggtaaaagggaagatcaatggtgcggcagtctcatagggctaacaagccgagcaacatgggccaaaaatatccaaacagcgataaaccaggttcgaagcctgatcggaaacgaagaatatacagactatatgccgagtatgaagaggtttcggaaggaggaagaagaagctggtgttctttggtga

SEQ ID NO: 22532 - RNA, 9876 nt, synthetic construct
  misc_feature 1..9876: note = derived and/or modified CDS sequence (opt6) from DENV-2__EU529693__SS-prME
  source 1..9876: mol_type = other RNA
acagcaggagttataataatgttaatccctacagctatggcgttccatttaacaacacgaaatggagaacctcacatgattgttggacgacaagaaaaaggtaaatctctgttatttaaaaccgaagacggagtgaacatgtgcactctgatggctattgatttaggagaattatgtgaagacactattacctacaaatgtcccttattacgacaaaatgaacctgaagatatcgattgttggtgtaattctacatctacatgggtgacttatggaacttgtacaactacaggcgaacacagaagagagaaacgaagcgtcgcacttgtcccgcatgtcggtatgggtttagaaacacgaacagaaacttggatgagctcagaaggtgcatggaaacacgtacaacggatagaaacctggatattgagacatcccggtttcacaacaatggcagcaatactagcatacactattggaacaactcattttcagcgagcactaatattcatactgttaacagcggtagcaccaagtatgacgatgagatgtatcgggataagtaacagagacttcgtagaaggagtctcaggtggaagttgggtggatattgttctagaacatggatcttgtgtcaccacaatggctaaaaataaacccacactagactttgaattgataaaaacggaagctaaacaaccagctactttacgaaaatattgcatagaagccaaacttaccaacaccacaacagagagccgatgtccaacccaaggagaaccttcattgaatgaagaacaagataagagatttatctgtaaacactctatggttgacagaggctggggaaacggttgtggattgtttggaaaaggcggtattgtaacttgtgccatgtttacatgcaagaagaatatggaaggaaaagtagtcttaccggaaaatcttgaatatacaatagttattacaccacactcaggagaagaacacgcagtgggcaatgatactgggaagcacggaaaagagatcaagattacaccccaaagttcgatcacggaagccgaactaacaggttatggcacagtcaccatggaatgtagccctagaacgggactggactttaacgagatggttttactacaaatggaagacaaggcttggcttgttcatcgtcagtggttcttggatctgccgttaccatggctaccaggagccgacacgcaaggttctaattggatacagaaagaaacgttagtcacttttaaaaatcctcacgccaagaaacaagacgtcgtggtactgggatcgcaagagggagccatgcacaccgccttgacgggggccaccgaaattcaaatgtcaagtggtaacctattgttcactggacatttaaaatgcagactacgaatggacaaattacagttgaaaggaatgagctattcgatgtgtacgggaaaatttaagatcgtaaaggaaatcgccgaaacacaacatggaacgattgttataagagtacaatacgagggtgatggctcgccgtgcaagatcccctttgaaataatggacctagagaaaaggcatgtactaggtaggttaatcactgttaaccccatcgtaactgagaaagattctccagtgaatattgaagcggaaccaccctttggcgattcatatataattataggtgtagaaccgggacaactaaaactaaattggtttaaaaagggatcgagcattggccaaatgtttgagactacaatgcgtggagccaaacgaatggcaatactaggggacacagcatgggatttcgggtcactagggggtgtatttacgtccataggaaaagcattgcaccaagtatttggggccatttatggggctgcattcagcggtgtatcgtggacaatgaaaatcctaattggagttattattacatggataggaatgaactcgcgaagtacaagtctaagtgtatcgttagttctcgttggaattgtcacactctacttaggcgtaatggtacaagcagatacaggatgtgtagtcagttggaagaacaaagagctaaagtgtggatcaggaatctttataaccgataatgttcatacgtggacagagcagtataaatttcagccagaaagtccgagtaaactcgctagcgcaatacaaaaagcccatgaagaaggtatttgcgggatccgatctgtgacccgactggaaaatttaatgtggaaacaaatcaccccagaattaaaccacatattatcagaaaacgaggtgaaactaaccataatgacgggagacattaaagggattatgcaagcgggaaaacggtccctgagaccacaaccaacggagcttaagtattcgtggaagacgtgggggaaagctaaaatgctttccacagagtcacataatcaaacatttttgatcgacggtcccgagacggccgaatgcccaaacaccaatagagcatggaactcactggaggtagaggattacggatttggagtattttccactaatatatggctaaagttaagagaaaaacaagacgtattctgtgactcaaaattgatgtcagctgccataaaagacaatcgtgcggtccatgcagatatgggttactggatagaatcagccttaaacgatacttggaagatggagaaggcatcctttatcgaaatcaagtcatgtcactggccgaaatcacatacactttggtcaaatggagtgcttgagagcgagatgataatacctaaaaatttcgcgggaccagtatcgcaacacaattatagaccgggatatcacacacaaacagcaggcccttggcatttaggcaaacttgaaatggatttcgacttctgtgaaggtactacagttgtcgtaactgaagactgtgggaataggggcccatcactccgcaccaccacggcgagtggaaaactaattactgagtggtgttgcagatcatgcaccctaccgcctctacgataccgtggtgaagatggttgttggtatggtatggagatcagacctctcaaagaaaaagaagaaaatctagtcaattctttagttaccgccggacatggacaaatcgacaatttctctcttggggtgctggggatggcactatttctagaagagatgttaagaactagagtaggtactaaacatgcaatactgctagtcgcagtcagtttcgttaccttaataacagggaatatgagctttagagacttaggacgtgtaatggtgatggtcggagcaacaatgacagatgatatcggaatgggagtcacatatctcgcattattagcagcatttaaagttaggcctacatttgctgccggtctattgcttagaaaattaacaagtaaagaattgatgatggctactattgggatagctttgttatctcagtccacaataccagaaactatattggaattaaccgatgctctagcgctcggtatgatggtcttgaaaattgtcagaaatatggaaaagtaccaacttgctgtcactataatggctatatcctgcgttccaaatgccgtaatactacagaacgcatggaaagtaagttgcacgatattggctgcagttagtgtgtctccattgttattaacttcatcacagcagaaagctgattggattcccttggcgctaaccataaaagggttaaatcccacagcaatattcctaacaacgttaagtagaacttcaaagaaaaggtcctggccccttaacgaagcagtcatggccgtcgggatggttagcatactcgcatcttcactacttaaaaatgacattcccatgacaggaccgttagttgcaggaggcctattgacagtctgttacgttttgactggacgaagtgctgacttagaactagagagagcggccgatgttaaatgggaagatcaagcagaaattagtggctccagtccaattttgtcaattacaatttccgaagatggtagcatgtcaattaaaaatgaggaagaggaacatacactaactatactgatccggactggtttgctcgtaattagtggtgtttttccagtatcaataccaataacagctgccgcttggtacttgtgggaagtaaagaaacaacgagctggagtgctttgggacgttccttctccgcctcccgtcggaaaagctgaattagaagacggagcttaccgaatcaaacaaaggggcatatttggatattcacaaattggcgctggtgtatacaaggagggtacatttcatacaatgtggcatgtgactagaggcgctgttttaatgcatcgaggcaaacggatagaaccgtcctgggctgatgtaaagaaggatttaatctcatatggaggagggtggaaattagaaggtgagtggaaagagggcgaagaagtccaagtactagcgttagaacctggcaaaaatccaagagccgtacaaacaaaacctggactcttcaagacaaataccggaacgatcggtgcggtatcactggacttttcgcccggtacatcaggcagtcctattgttgacaggaaaggcaaagttgttggactatatggtaacggcgtggtaacacgatcgggagcatatgtgtcggctatcgcgcaaaccgaaaaatcaatagaagacaatcctgaaattgaagacgatattttcagaaagaaacgattgacgataatggatttacaccctggcgccggaaaaactaaacgatatcttccagccatagtaagagaagcgataaagagaggccttaggacgctcattttggccccaacacgagttgtcgccgctgaaatggaagaggctttaagaggactgccgattaggtatcaaacgcctgctataagggcagaacatacgggacgagaaattgtagacttaatgtgtcatgcaacattcaccatgcgccttttgagtcctgtgcgggtgccaaattataacctaataattatggatgaagcgcacttcactgacccagcgtcaattgcagctcgtggatatatatcgacgcgagtcgaaatgggagaagcagcaggaattttcatgaccgcaacgccacctgggagtagggatccttttcctcaaagcaatgcacccattatggatgaagaacgggaaatacccgaaagatcatggaactcaggccacgagtgggtaacagactttaaaggaaaaacggtttggtttgtaccgtcaataaaagcaggaaatgacatagcggcctgcctacgtaaaaatggcaaaaaggtgatacagttatcaagaaaaacatttgatagtgaatatgtaaaaacacgtgccaatgactgggattttgtagttactaccgacatatctgagatgggggcaaattttagagccgagcgagtaattgacccacgacgatgcatgaaaccagtcattttgaccgatggtgaagaacgggtcatactagcaggtccaatgccagttacacattcatcagccgctcaaagacgaggaaggattggtaggaatcctaaaaacgaaaacgaccaatacatttatatgggtgaacctctagagaacgacgaagattgtgctcattggaaagaagcgaaaatgcttttagataacataaatacgccggaaggtataataccaagtatgtttgagcccgaacgggaaaaggtggatgctattgacggggaatatcgtttaaggggagaagccagaaagacattcgtagacctaatgagaagaggtgaccttccagtttggcttgcttacagagttgccgctgaaggcataaattatgccgatagacgttggtgcttcgatggaatcaaaaacaatcagatccttgaagaaaacgtggaggtagagatatggacgaaagaaggtgaacgaaagaagctgaagccacgttggttagacgcaagaatatattcagatccactagccttaaaagaatttaaagagttcgcagcgggacgtaaaagtcttacactcaatttaataactgaaatgggtcgattgccaacattcatgacccagaaagctagagatgcattagataatttggccgtcttgcatactgctgaggtcggaggacgagcatataaccacgcattgtcagagcttcccgaaacactagagacgctacttttattaactcttttggctactgtcacaggcggcatatttttattcctaatgtcaggcaaaggtatcggaaaaatgactttaggcatgtgctgtataattacagcatcaatattactttggtacgcccaaattcaaccgcactggatagctgcatccattatactagagttctttttaattgtactactaatcccggagcctgagaagcagcgaactccacaagacaatcagctcacttacgtagtgattgcaatactaaccgtagtagcagctactatggcgaacgaaatgggattcctagagaaaactaagaaagaccttggacttggatcgataacgacacaagaatcggaaagcaacatactcgacatcgatctaagaccggcttctgcttggaccttatatgcagtggctacaacgtttgttacgcccatgttgcgtcattcaatcgaaaatagttcagttaatgtatcattaacagctattgcaaaccaagcaactgtcttaatggggttgggacgaggatggcctctaagtaagatggatataggcgtgccactattggccattggatgctacagccaggttaatccgataacacttacagcagcactattattgcttgttgcgcactacgcaataataggaccaggacttcaagccaaggcaacgagagaggctcagaagcggaccgcagccggaattatgaaaaatcccacagtcgatggaatcacagtcatcgatttggaaccaataccttacgacccaaaatttgagaaacagttaggacaagtgatgttgttagtactatgcgtgacccaagttctgatgatgcgtacaacctgggcactatgtgaggccctgacattagccactggccctatatcaacactctgggaaggaaatccaggacgattctggaataccacgatagcagtatcaatggcgaacatcttcagagggagctatttagctggagcggggttactattttccatcatgaaaaatacgactaacacgagaagaggcactggtaatattggcgagacattgggcgaaaagtggaagagtcgtttgaacgcccttggtaaatctgaatttcaaatttataagaaatcgggaatacaggaagtggacaggacattagcgaaagagggtattaaacgtggagagactgatcatcatgcagtatcacgaggtagtgcgaaactaagatggtttgtagaaaggaacatggtgactcccgagggtaaggttgtagatttaggttgtggacgaggcgggtggtcttattactgtggaggactcaaaaacgtccgagaggtaaaaggcttgaccaaaggaggtccgggccatgaagaacctataccgatgtctacctacggttggaacttggtaagacttcaatcaggggtagatgtattctttacgccaccagaaaagtgtgacactctactatgtgatattggagaatcatcacctaaccctactatcgaagcaggtcgaacgttaagagttctcaacctagtagagaattggttaaataacaatactcagttttgtgtaaaagtcttaaatccatacatgccttcggtaatagagaaaatggaaacacttcaaagaaagtatggtggggcgttagtaaggaatcccttatctcgcaattcaacccacgaaatgtactgggtaagcaatgctaccggtaacatagtttcatcagttaatatgatatcgagaatgctgataaatagattcacaatgaaacacaagaaagcaacctatgaacctgatgtggacttaggatcaggaactagaaacatagggatcgaaaatgaaattccaaaccttgatatcattggtaaacgtattgaaaagatcaaacaggagcacgagacatcctggcattacgaccaagaccacccatacaaaacttgggcttatcacggatcatacgaaaccaaacaaacaggttccgcctcgagtatggttaatggcgtcgtaaaactactgacgaaaccatgggatgtcgtacccatggtaacacaaatggcaatgaccgacactacgccattcggacagcaacgagtatttaaggaaaaggtagacacaagaacccaagagcccaaagagggtaccaagaaactgatgagaataacggctgaatggctctggaaagaacttggcaagaagaaaactccacgaatgtgcacaagggaagagtttacaagaaaagtccgatcaaatgcagcattaggagccatatttacagatgaaaacaagtggaaatcagcgagggaagcagtcgaagattctagattttgggagttggttgatagggaaagaaacctacatttagaaggaaaatgtgaaacttgcgtatacaatatgatgggtaaacgagagaaaaagttaggtgaatttggcaaagccaaaggatcaagagcaatatggtacatgtggttgggagctagattccttgagttcgaggcgcttggtttcctgaatgaggatcattggttctcgagaggcaatagcctaagtggtgtagagggtgaagggcttcacaagttgggatacatcttgagagacgtaagtaaaaaggaaggcggcgcaatgtacgccgatgatacagcaggctgggacacacgaataacattagaggatctcaaaaatgaggaaatggtaactaatcacatgaaaggggaacataaaaagctagcagaggctatatttaaacttacatatcaaaacaaagtcgtaagagtacaacgacctaccccacgaggaacagtaatggatatcatatcacgaaaagatcagaggggaagtgggcaagtaggtacttacggattaaacacctttacgaatatggaagcccaattgatacgacagatggaaggagaaggaatatttaaatctatacaacggctgactgtaacagaagaaatagctgtccaaaattggttagcaagagttggacgtgaaagactctctaggatggctataagtggagacgattgtgttgtgaagcctttggatgataggttcgcatccgcacttacggcactaaacgacatgggaaaggttcgaaaagatatacagcaatgggaacctagtcgaggttggaatgattggactcaggtaccgttctgttcacatcacttccatgaattggttatgaaagacggaagaatgctagttgttccgtgtcgaaatcaagacgaactaattggaagggccagaattagtcaaggcgcgggatggtcattaaaagaaacagcttgcttaggaaaaagctatgcccaaatgtggacactaatgtattttcataggagagacctacgtctagccgccaatgcaatctgctcagcagtcccttcacactgggtccctacctcaagaaccacatggagcatacatgctaaacacgaatggatgaccacagaggatatgctcgcggtttggaatagggtatggatccaagaaaacccatggatggaagataaaacaccggtcgaaagttgggaagaagtcccctatctaggtaaaagggaggatcaatggtgtgggtcacttattggattaacatcacgagcaacctgggcgaagaatattcaaacagctattaatcaagttcgatcattaataggaaacgaagagtacactgattacatgccaagtatgaaacgattcaggaaagaagaagaagaagcaggagttctttggtaa

SEQ ID NO: 22533 - RNA, 9876 nt, synthetic construct
  misc_feature 1..9876: note = derived and/or modified CDS sequence (opt6) from DENV-2__EU482557__SS-prME
  source 1..9876: mol_type = other RNA
acggctggcgtaataataatgcttatacctaccgcaatggcatttcacctaaccacaagaaatggtgaaccgcatatgatcgttgggcgtcaagaaaaaggcaaatctttattatttaaaacagaagatggtgtaaatatgtgtacacttatggctattgatttaggtgaattatgtgaagatacgataacatacaaatgtccactactgagacaaaatgaaccagaagacattgactgctggtgtaacagcacgtcgacgtgggtaacatacggcacttgtactacaaccggcgaacataggagagagaaaagaagcgtagcattagtcccccatgtcggcatggggttagaaactagaacggaaacatggatgtcttcagaaggagcatggaaacacgtccaacgaattgaaacatggattctgcgacatcccggttttacaataatggcggcaatcttagcatacactatagggactacacactttcaaagagctctaatctttatactcttgacagcagtagcaccttcaatgactatgagatgtataggaatttcgaaccgagatttcgtagaaggcgtatctggtggatcatgggtcgacatagtactcgaacacgggtcatgcgttacaacaatggccaaaaataaaccaactttggactttgaactcataaaaacggaagcaaaacaaccagcaacgttgagaaaatactgtatagaagccaaactcactaatacaacaacagagtcccgctgccctactcaaggagaacctagtttaaacgaagaacaggataaaaggtttatatgcaaacatagcatggttgaccgtggatggggtaacggttgtggactgtttggtaaaggaggaattgtcacatgcgcgatgttcacatgtaagaaaaatatggaaggcaaagtggtgctaccagaaaatctagaatatacgatagtcatcacaccccactcaggagaagaacacgccgtgggcaacgacaccggaaaacacggaaaagaaataaaaataacacctcagtcatccattactgaagccgaattaacgggatatggtaccgtcactatggaatgctcgccaagaactggacttgactttaatgaaatggtattattacaaatggaggataaagcctggctagtacatagacagtggttcttggatctacctcttccatggctacctggcgcagacactcaaggctccaattggatccaaaaagaaactttggtcacttttaaaaaccctcatgctaagaaacaggatgtagtagttttgggatcacaagaaggggcgatgcatactgccctaaccggagcgaccgaaatacaaatgtcctctggaaacttactatttaccggacatctaaaatgcagacttcgaatggacaaattgcaattaaaaggcatgtcgtattcaatgtgcacaggcaaatttaaaatcgtaaaagagatagccgaaacacaacatggaacaattgttatacgggtacagtatgaaggtgacggttcaccttgcaaaattcccttcgaaataatggacctcgagaaaaggcacgtattagggcgattgatcactgtgaaccctatagtaacagaaaaagattcgcctgtgaatatagaagcagaaccccctttcggcgattcatatatcataattggtgtagaaccgggacaattaaaattgaattggttcaaaaagggatcttcaataggacaaatgttcgaaactactatgcgaggtgcgaaacgaatggcgatcctgggggacacagcctgggatttcggatcattgggaggagtttttacatcaataggcaaggcacttcatcaagtgtttggtgcaatatacggcgcggcattctcgggagtatcgtggaccatgaagatactcattggcgtcataattacgtggattgggatgaactcaaggtctacgagtctatcagtgagcctcgtcttagttggagttgtaactctctacttgggagtaatggttcaagcagattcaggatgtgttgtaagttggaaaaataaagagttgaaatgcggtagtgggatctttattacagataatgtacacacttggactgaacaatacaaatttcaacctgagtcaccgagtaaattagcatccgctatccaaaaagcacacgaagagggcatttgtggaataagatcagtcacgcggcttgaaaatcttatgtggaagcaaataacccctgagctcaatcatatactcagcgagaatgaggtaaaactaacaataatgacaggtgatataaaaggtataatgcaagcaggaaaaagaagtttgcgaccacagccgaccgaactgaaatattcttggaaaacttggggaaaagcaaaaatgctttcaacagagtcacacaatcaaacgtttttaattgatggtccggaaactgctgaatgccccaatactaatagagcttggaactcgctggaggtggaagattacggatttggagtattctctactaatatttggctaaagctaagagaaaaacaagatgtattctgtgattcaaaactaatgtcagctgctatcaaggacaatagagcagtccatgctgatatgggatattggattgagagtgccttgaatgatacctggaaaatggaaaaagcctctttcatagaagtaaaatcgtgtcattggccgaagtctcatacactatggagcaatggagttttagaatctgaaatgattataccgaaaaatttcgcaggtccagtttcccagcataactacagacctggctatcatacccagactgccgggccatggcacctcggaaagctggaaatggattttgacttttgtgaaggtactaccgtagtggtgacggaagattgtggcaacaggggcccctctcttagaaccacaacagcatcaggcaagttgataacagaatggtgttgcagatcatgcactttgccaccattacgatacagaggagaggatggttgctggtacggaatggaaatacgaccactgaaagaaaaggaagaaaacttagtaaattcactggtaacagcaggacacggacaaattgataacttttcccttggtgtgttaggaatggctctatttttagaggaaatgttacgaaccagggtaggtacgaaacatgcaatcctattggtggcggtgagcttcgtaacgctgataaccggtaatatgtctttccgtgatctaggaagagtgatggttatggtaggagcaaccatgactgatgatataggcatgggtgtaacttacttagcactattagctgcttttaaagtcaggccaacctttgctgcaggtttgttgctccgaaagttaacgtcaaaagaattgatgatggcgacgataggcatagcactactgtcccaatctacgattccagaaactatacttgaattgacagatgctttagctttgggcatgatggtacttaagattgttcgaaatatggaaaaatatcagttagctgtgacaatcatggcaatatcatgcgttcccaatgcagtcattcttcaaaatgcatggaaggtatcttgcacaattttagcagcagtatcagtatccccattattacttacatcatctcaacaaaaagcagattggatcccactagctttaacaattaaaggtttgaatccaactgctatatttctaacgaccctatcacgaacttccaagaaacgtagctggccgctgaatgaagcagtaatggctgttggcatggttagtattcttgcgtcatcactcctgaaaaacgatatacctatgacgggtccactggttgcaggcggattgctaacagtttgttatgttttaacaggaagatcagctgatctagaactagaaagagctgcggatgtgaagtgggaagatcaagccgaaatatcagggtcttctcctatactaagtataacaatatctgaagatggatcaatgagtatcaaaaatgaagaagaagaacacacgctcacaatccttattaggaccggactattagtgatatctggcgttttcccggtgagcattccaataacagctgcagcctggtatttgtgggaagtcaagaaacaaagggctggtgttctatgggacgtaccttcgcccccaccggtgggaaaagcagagctcgaagatggagcctataggataaaacaacgcgggatatttggatattctcaaataggcgctggagtatacaaggagggcacatttcacactatgtggcacgtaacacgaggcgccgtactaatgcatagggggaaaagaatagagccatcgtgggcggatgttaagaaagacctgatatcctacggaggaggatggaagctagagggggaatggaaagaaggagaagaagtacaggttctagcgctagagccaggtaaaaatccgcgagcagtacaaaccaaacccgggctctttaaaactaatactggtacaattggagcagtaagtttggattttagcccagggacaagcggcagcccaattgtggaccgcaaaggaaaagtagttggattgtacggcaatggcgtagttactaggtctggtgcgtacgtaagcgccatagcacagactgaaaagtctatagaagataacccagagatagaagatgatatattcaggaagaagcgtcttaccattatggaccttcatccaggggcagggaaaactaaacgatatttaccagccattgttcgggaggccattaagagaggtctacggacattaatattagcgcctacaagagtggtcgcagccgagatggaagaagctctaaggggcctacctatacgatatcaaactccagcaatcagagctgaacacaccggtagggaaatagttgatttaatgtgccatgcaacttttacgatgcgactactaagtcccgtacgcgtccccaattataacttgataatcatggacgaagcacactttacagatcccgcaagtatagccgcacgaggatacatttcaactcgggtggaaatgggagaagcagcaggtatattcatgacggcgacaccgccagggagtcgggacccatttccacaatcaaacgcacccattatggatgaagaacgtgaaattccagaacgttcatggaatagtggccacgaatgggtaacagacttcaaaggaaaaactgtctggttcgtacctagcataaaagctgggaacgacatcgcagcttgtctacgtaaaaatggcaagaaagtaatacaactatccaggaaaacatttgattctgaatatgttaaaactagggcaaatgactgggatttcgtagtaaccacagatataagtgagatgggtgctaacttcagagcagaacgtgtgatagatccaagacggtgtatgaaacctgtcattcttacagatggtgaagaaagagttatacttgcgggtcctatgccggttacacattcttcagcagctcagagaagaggcagaataggtaggaatcctaaaaatgagaatgaccaatacatatatatgggagagccactggaaaacgacgaggattgcgcccattggaaagaggcgaaaatgctattagataatataaacacgcccgaaggaattataccctccatgttcgaacctgaacgagaaaaggtagatgccatagacggagagtaccgattaagaggagaagcacgaaagaccttcgtcgatctgatgcggagaggagaccttccggtttggcttgcataccgggtagcagctgaaggaattaattatgctgaccgtaggtggtgctttgacggaataaagaataaccaaattttggaggaaaatgtagaagttgagatttggacaaaagaaggtgaaaggaagaaattgaaaccgagatggctagatgcaagaatctacagtgatccgcttgcattaaaagaatttaaagagttcgcggctgggagaaaatcacttactttaaacctaatcacggagatgggcaggctccccacatttatgacccaaaaggcacgagacgctttggacaaccttgctgtcttacacacagcagaggtagggggtagagcttacaatcatgctttgtccgagttgccagaaactctagaaaccctactactactaactttgctggcgacagtcaccgggggaatatttttatttctaatgagcggaaaaggaatcgggaaaatgacccttggtatgtgctgtataataacggcttcaattctcctttggtacgcacaaattcaaccacactggatagctgcaagcataatactagagttcttcctaatagtactcttgatacccgaaccagaaaaacaaagaacacctcaagataaccaactaacctatgtagtaattgcgattctgactgtggtggcggctaccatggcgaatgagatgggctttctggagaaaaccaagaaagatttgggattaggatcaataaccacacaggagtctgagtcaaatatactagatatagatctccgtccagccagtgcttggacgttgtatgcggtagcaactacttttgtaactccaatgctgcgtcatagcatagaaaatagtagtgtcaacgtgagtttgacagcaattgcgaatcaagcaactgttctgatggggctgggaaggggatggcccttaagtaagatggatatcggggtgccgttattagcgataggttgttatagtcaagttaatcccataaccctaacagcggctttactattattagttgcgcattatgctataatcggaccgggattgcaagcaaaagcaacgcgggaagcgcagaaaagaacggcagccggaataatgaaaaatcctactgtcgacggtatcacagtcatcgatcttgaaccaatcccgtacgatccaaaatttgagaagcaattgggacaagtaatgttactggtactatgtgttacacaagttctgatgatgcgtacgacttgggcactatgtgaggcactaaccttagcaacggggcccatctcaacgctctgggaaggaaatcctggtcgtttctggaatacaaccatagctgtttcaatggcgaacatcttcaggggtagttaccttgcgggagctggtctcttgtttagtataatgaaaaatactacgaatacaagacgtggaaccggaaatattggcgagacgttaggggaaaagtggaaaagcagattgaacgccttaggtaaatcagagttccaaatttacaaaaagtcgggtattcaagaagtagatcgtaccttagcaaaagaaggcatcaaaagaggagagacagaccatcatgccgtgagtagaggctctgctaaattacgttggttcgttgaacgcaacatggttacaccagagggcaaagtagtagatttaggctgtggaagaggtggttggtcatattattgcggtgggcttaaaaatgtgcgggaagtaaaaggtttgacaaagggtgggcctggacacgaagaaccaataccaatgtccacctacggatggaatcttgtgagactacaatcgggagtagatgtattctttacaccaccggagaaatgtgatacactgctgtgtgacataggcgaaagttcacccaatcctactatagaagcaggtcgtactttacgtgtgctaaatttggtcgagaattggcttaataataacacgcaattctgcattaaagttttaaacccatacatgcctagcgtaatcgaaaagatggaaacactacagagaaagtatggaggagccctagtaagaaatccgttaagtagaaattcaacccacgaaatgtattgggtgtctaacgccacaggtaacattgtgagctctgtaaacatgatctctcgtatgcttataaataggttcactatgaaacacaaaaaggcaacctacgaacccgatgtggatctaggttccgggacacgtaatatcggcatagaaaatgaaatacctaacttagatataatcggtaaaagaatcgaaaagattaagcaagaacatgaaacttcttggcattatgatcaagaccacccatacaaaacttgggcatatcacggtagttatgaaaccaaacagacaggctccgcttcttcaatggtaaacggggtagtcaaattattaactaaaccgtgggacgtggtaccgatggttacccagatggcaatgactgatacaactccatttggtcagcaacgggtttttaaagaaaaagtggatacaagaacacaagaaccaaaggaaggaactaagaaactaatgcgaataacagctgaatggctatggaaggaattaggtaagaagaaaactccgagaatgtgtactcgagaggagtttacgcgcaaggtacgtagcaacgcagcccttggtgcaatattcacggatgaaaacaagtggaagtcagcgagggaagctgtagaagatagtcgtttctgggagttagtagacagagagaggaacttacatttagagggtaaatgcgaaacatgcgtatacaatatgatggggaaacgtgagaagaaattaggcgaatttggaaaagctaaaggaagccgggctatctggtacatgtggttaggagcaagatttttagagtttgaagccttaggtttcttaaacgaagatcattggttttcgcgaggaaatagcctaagcggggttgaaggtgaaggattacataaattagggtacatattgcgggacgtatcaaagaaagaaggcggagcaatgtatgcagatgatactgcagggtgggatacgcgtatcaccctagaggatctgaaaaatgaagaaatggtaaccaaccacatgaagggcgaacacaagaaattagccgaagcaatattcaaactaacataccagaacaaagtcgtgagagtacaacggccaacgccgaggggaacagttatggacataatttctagaaaggatcaaagaggtagcggtcaagtgggaacttatggtcttaatacttttacaaacatggaggcacagcttatacggcaaatggagggtgaaggtatatttaaatcgatacaacgtctaacagtaacggaagagatagcggttcaaaactggttagctagagtaggaagagaaagattatcacgaatggccatatccggagatgattgcgtagtaaaaccgttagatgacagatttgcgagtgcacttacagcacttaacgatatgggcaaggtgaggaaggatatccagcaatgggaaccatctaggggatggaacgattggacacaagtaccattctgctcacatcattttcacgagcttgtcatgaaggacggtagagttcttgtagtaccgtgcaggaatcaagacgaactcatcggtcgcgcccgaatatcacaaggagcgggctggagtttaaaggaaacggcgtgtctcggaaaatcatacgcgcagatgtggactttaatgtattttcatcgtagagatctcagattggctgccaatgcgatatgtagcgcagttccatcgcactgggtaccgacatcgagaactacatggagcatacatgcaaaacacgaatggatgacaacagaagacatgctcgctgtctggaacagagtatggatacaagagaatccatggatggaagataagacacccgtcgaatcttgggaggaggtaccatatttgggtaaacgagaagatcaatggtgtggaagtttgattggattaacaagtcgagcaacatgggctaaaaatatacagacggcgataaaccaggtaagaagtttaataggtaatgaggaatacacggactacatgccatcgatgaagaggtttcgaaaagaagaagaggaagctggtgtactttggtga

SEQ ID NO: 22534 - RNA, 9876 nt, synthetic construct
  misc_feature 1..9876: note = derived and/or modified CDS sequence (opt6) from DENV-2__EU482560__SS-prME
  source 1..9876: mol_type = other RNA
actgcaggagtaattgttatgctaatcccaactgtcatggctttccacttaacgactcgaaacggtgaacctcacatgattgtaggacgtcaagaaaaaggtaaatcgcttctcttcaaaactgaagacggtatcaacatgtgtacgttaatggcgattgatttgggagaactgtgcgaagataccatcacatataaatgccccctattaaaacaaaacgaacctgaagacatcgactgttggtgcaattccacatcaacatgggttacgtacgggacgtgcacaaccacgggtgaacatcggcgagagaaaagaagtgttgcattagtaccacatgttggtatgggattggaaaccagaactgaaacttggatgtccagtgagggagcttggaaacatgtacaaaggatcgaaacatggattctgaggcatcctggtttcactatcatggcagctatcttagcatatacaataggtaccacacatttccaacgagcactaatttttattctgttaacggcagtagcaccttcaatgacaatgcgttgtatcggaatatctaatcgtgattttgtagagggagtttctgggggatcctgggttgatatcgtcttagaacacggcagttgcgttacgacaatggccaaaaataaaccaactctagacttcgaactcattaaaaccgaagctaaacaaccagcaacacttcgaaaatattgtatagaggctaaattgaccaatacaactacggagtcgagatgtcctacgcaaggagagccctctttaaatgaagaacaagacaaacggttcatctgcaaacatagcatggttgacaggggctggggaaacggatgcggtctattcggaaaaggcggaatagtgacttgtgccatgttcacctgtaagaaaaatatggagggtaaagtagtacagccggaaaacctggaatatacaatcgtaataacaccacatagcggagaagaacacgcagtcggaaatgacactggcaagcatggtaaggagattaaaataactccacagagtagtataacagaagcagaattaacaggttatggaacagttacaatggaatgtagtccacggacaggattagactttaacgagatggtattgctccaaatggaagacaaggcatggctggtacatcgtcaatggttcctcgacttgccattaccgtggttaccaggagcagacacccaaggtagtaactggattcaaaaagagacgttggtaacctttaagaacccacacgctaagaaacaagatgtggtcgtactcggatcacaggaaggtgccatgcacactgcactaacaggagctacagaaatacaaatgagctccggtaatttgctattcactggacatctaaaatgcagattgcgaatggataaactacagttaaagggtatgtcgtattcaatgtgtactggaaaatttaaaatagtaaaggaaatagctgaaacgcaacatggaacaatcgtaataagagtgcaatacgagggtgacggatcaccatgtaaaataccattcgaaataaccgatctagagaaacgacacgtactgggtagactaataaccgttaatcccattgtaacggaaaaagactcacctgtaaatatcgaggcagaaccgccgtttggcgattcatatataatcataggcgtcgaaccggggcaactcaaattaaactggtttaagaaaggatcgagtataggtcaaatgttcgagacgactatgaggggagctaagcggatggcaatcttaggcgatactgcgtgggacttcggtagtttaggtggcgtcttcacttccatcggaaaggcactacaccaagtattcggtgcgatttatggagcggcattctctggcgtgagttggacgatgaagattttgattggcgtcataattacttggataggaatgaactcacgttcgacaagtttaagtgttagtctagttttagtaggcgttgtgaccttatacctaggcgcaatggttcaggctgattctgggtgcgtagtttcctggaaaaataaagagctgaaatgcggatcaggaatctttataaccgacaatgtacacacttggaccgaacagtataaatttcaaccagaaagtccctctaaattggcatccgcaatacaaaaagctcacgaagaagggatttgcggaattagaagtgtgacgaggctagaaaaccttatgtggaaacaaattactcctgaacttaaccatatactatcagagaatgaggtgaaattgacaattatgacaggagatataaagggaataatgcaagcaggcaaacgatcactgagaccgcaaccaacagaattgaaatattcctggaaaacttggggtaaggctaagatgttatccaccgaaagtcataatcagacatttctaatcgatggcccagaaaccgctgaatgccccaacacaaacagagcttggaatagtttagaggtagaagattacgggtttggtgttttcactacgaatatctggcttaaattaagagaaaaacaagacgctttttgcgattcaaaacttatgagtgcagcaataaaggataatagagctgttcacgcagacatgggttattggatagagagcgcattaaatgatacgtggaagatggaaaaagccagctttatagaagtcaaatcatgccattggccaaaaagtcatactctgtggtccaatggagtcctagaaagtgagatgattatcccaaagaatttcgcgggaccggtctcgcaacataatcatcgcccaggctatcatactcaaacagcgggaccgtggcacctaggcaaactggaaatggattttgacttttgcgaaggtaccacggtagtcgtaaccgaagactgtggaaataggggacccagcttgagaactaccactgcttctggcaaacttatcacagagtggtgttgtcggtcttgtacactacctccgttacgttacagaggggaagatgggtgctggtatggaatggagattcgccctttaaaagaaaaggaagagaatttagtaaacagtcttgttacggcaggacacggccaaattgataacttttctttgggagtgttaggaatggcattatttttagaagaaatgttacgaacgagggttgggaccaagcatgcaatcctattggtagctgtaagcctagtcaccctaattacaggtaacatgagttttagagacttgggaagggtaatggttatggttggggcaacaatgacagatgacataggtatgggagtaacttatttggcgttgctcgcggctttcaaagtacgtcccacatttgctgctggattattacttcgaaagttaacaagtaaagaacttatgatggctacaataggcatcgcactcctatcccagtccacgataccggaaacaattctagaattaaccgacgccttagctttagggatgatggtattaaaaatagtaaggaatatggaaaaataccaactggcagtaactataatggcaataagctgtgtgcccaacgcagtaatactccagaatgcatggaaagtctcatgtacaatactagccgcagtatcggtgtcacctcttttactaacatcaagtcaacaaaaggctgattggatacccttagcacttaccataaaaggattaaaccctacagctatatttttaactacgttatctaggacaagcaaaaagagatcgtggcctttaaatgaagcaataatggccgtaggtatggtatcgatcttggcgagctcattactcaaaaatgatatccctatgaccggtccgctagttgcagggggtctacttacagtttgttatgttcttaccggtagatcagcagacctagagctagaaagagctgcggacgttaaatgggaagatcaagccgaaataagcggaagcagtcctatactatcaataactattagtgaagatggatctatgagcattaaaaatgaagaggaggaacagactctaactatacttattaggactggtctgctagtgatatctggggtgtttccagtttccatacctataacagccgccgcctggtacttgtgggaagttaagaaacagagggccggcgtactatgggatgtccccagtccaccacctgtagagaaagcggagttagaagacggtgcctatcgtataaagcagcgaggatttctgggctatagtcaaataggcgcaggagtatataaagaaggtacatttcatactatgtggcacgtaacaagaggagcagtcttaatgcacagaggaaaacgtatcgaaccatcttgggctgacgtgaagaaagacctaatatcatatgggggtggatggaaactagagggagaatggaaagaaggtgaagaagtgcaggttctagcattagaaccaggtaagaatccaagagctgtacaaactaaaccaggcatattcaaaacaaacacaggaactataggcgcagtaagtctagatttttcaccaggcacaagtggctcacctattgtggaccgaaaaggtaaagtcgtaggactttacggtaacggagtagttactaggtctggagcttatgtttcggcaattgcacagacggagaaaagcatagaaaataatccagaaattgaagacgatatatttcggaagaaacgtctcacgattatggatctgcatccaggagctggaaaaacaaaacgttatcttccagctatcgttcgagaggcaataaaaagaggtctaagaacattaatcttggcaccaactcgtgttgtggcagcggaaatggaggaagctctgagaggcttgcctataagataccagactccagcaattagggcagagcatacagggagagaaatagtggacctaatgtgccatgctacatttacaatgagattgctatctcccgtcagagtcccaaactacaacctcatcataatggatgaagctcatttcactgatccggcaagcatagccgcccgggggtacatcagtacacgtgtagagatgggagaagcagcgggcatcttcatgactgctactcctcccggttcaagagatccatttccccaaagtaacgcccctattatggacgaagaacgtgaaataccggaacgaagttggaacagtggccatgagtgggtaacagacttcaagggaaagactgtatggttcgtaccgagtataaaagctggaaatgacatagccgcttgccttagaaagaacggtaaaaaggtcattcaacttagtcgaaaaacgttcgacagtgaatatgtaaaaacaagggccaacgattgggattttgtagttacaactgatatttcagaaatgggcgcgaacttcaaagcagagagggtgatagatcccagaagatgtatgaaacctgttatcttgaccgatggagaagaaagagtcatattggctggtccaatgccggtaactcattcatcagcagcccagcgacggggtagaataggacgaaaccccaaaaatgaaaatgatcaatatatatatatgggagaacctctcgagaatgatgaagattgtgcacactggaaagaggcgaaaatgcttttagacaatattaatactcctgaaggaatcataccctctatgtttgaaccagagcgcgaaaaggtggacgcaatagatggagaatatcgattaaggggagaagctaggaaaacatttgttgaccttatgagaagaggtgatcttcccgtgtggctagcctataaagtcgctgcagaaggcataaattatgcggacagaaaatggtgtttcgatggtatcaaaaataatcaaatattagaagagaacgtagaggttgaaatctggacaaaggaaggggaaaggaagaaactaaaaccaaggtggctcgacgctagaatatacagtgatccactagcgttgaaggaatttaaagagttcgcggctggtcggaaatcattaacactcaatttaatcacggaaatgggcagactgcctacttttatgacacagaaagccaggaatgcattggacaatctagcagtcctacacacagccgaagctggtggcagagcatataaccatgctctatcagaacttcccgaaacactcgaaacactgcttttattaacactactagctacagttacaggcggcatatttttattcttaatgtctggaaaggggattggcaaaatgacattaggcatgtgctgtataataacggccagtattcttctatggtatgctcagattcaacctcactggattgccgcgtctataatactagagttctttttaattgtactactaatacctgaaccagaaaagcagaggactccgcaggacaatcaattaacatacgtagttattgcaattctcacagtggttgcggctacaatggccaacgaaatgggttttctagagaaaaccaagaaagacctaggtctaggatccataacaacccaagaatctgagtcaaatatcctcgatattgatttacgaccggcctccgcatggactctatacgcagttgcgacgacttttgtgactccgatgctaagacatagtatcgaaaacagcagtgtcaatgtaagcctaacagcaatagctaatcaagcgacagtattgatgggccttgggaaaggatggccactatccaaaatggatataggagtaccgttgctagctataggatgttatagccaggtaaatccgataacactaacggccgccttattattacttgtggcgcattacgcaattattggaccaggtctccaggccaaagccacgcgagaagcccaaaaacgagccgctgcgggaattatgaaaaatccaacggtcgacggaatcacagtaatcgacttagaaccaataccctatgaccctaaattcgaaaaacaactaggccaagtcatgttattaattttatgtgtaactcaagttttaatgatgagaaccacttgggctttatgcgaagcgcttacactagctacaggacctataagtacgctctgggagggaaaccctgggcggttctggaatactacaatagcagtatcaatggcgaatatttttcggggatcatacctggcaggcgcgggattacttttcagtattatgaaaaatacaacgaacactcgacgcggtacaggaaatatcggtgaaactttaggggaaaaatggaaatcgcgtctcaatgctctgggtaaatcagagttccaaatatataagaaaagtggcattcaagaagttgatcgtacattagcaaaagaaggcataaaaaggggcgaaacagatcatcacgcagtgtcaaggggatctgctaaattaagatggttcgttgaaagaaatatggtaacgcctgagggtaaggtagtagacttgggatgcggacgaggcggttggtcttactactgtggtgggctgaaaaatgtaagagaggtaaaagggttgacaaagggaggtccaggacacgaggagccaatccctatgagcacatatgggtggaacttagtaaggctacaaagtggcgtagacgttttctttacgcctcctgaaaagtgcgatacactgttatgcgacattggtgaaagcagtccgaatccaacgatagaggcaggtagaacactaagagttttaaatttagtagagaattggctaaacaataacacccaattttgtataaaagtcttgaacccttatatgccatccgtgatcgagaaaatggaaaccctacagcgcaagtatggcggtgctcttgtgagaaacccattaagtagaaatagcacacatgaaatgtactgggttagtaatgctacaggtaacatagtgagctcagtaaatatgataagtagaatgttaattaacagatttacaatgaaacataagaaagctacttacgaaccagatgtagacctaggatcaggtaccagaaatataggaattgagagcgagattccgaatctcgatattataggaaaacgaatagagaaaataaaacaggaacacgaaacaagttggcactatgaccaagatcacccatataaaacgtgggcataccacggctcgtacgaaacaaagcaaacaggatccgcaagcagcatggtcaatggagtagtacgactgcttacaaagccatgggacgtggttccaatggttactcaaatggctatgaccgacacaactccattcggacagcagagagttttcaaagaaaaagtggatacaagaacccaagagccgaaagagggtactaagaaattaatgaaaatcactgctgaatggttgtggaaagagctgggaaagaagaaaactccaagagtttgcacaagagaggagttcacaagaaaagttagatcaaatgcagcactcggagctatttttaccgatgaaaacaaatggaaatcagcacgtgaggcggtagaggacgggaggttttgggagctagttgatagagaaagaaatctacacttagaaggaaaatgtgagacatgtgtatacaacatgatgggaaaacgagagaagaaattaggagaatttggaaaagccaaggggagtagggcaatatggtatatgtggctgggagctcgcttcttagagtttgaagcactagggtttcttaacgaagaccattggttttcaagaggaaactcactctcaggagtagaaggagagggactgcaccgactaggctacatccttagagacgtagggaaaaaggaaggaggggccatgtacgctgatgacacggctggatgggacactagaatcactttggaagacctcaaaaatgaggaaatggtgactaaccatatgaaaggcgaacataagaaacttgcggaagcgatatttaagctgacataccagaataaagtagtgcgcgttcagagacccactccccgagggacggtaatggatataatttcgagaagagaccagagaggatcaggacaagtgggtacttatggattaaacacattcactaatatggaagctcagctaattagacaaatggaaggcgaaggaatatttaaaagtatccaacacttgacggccactgaagaaatcgctgtgcaaaattggttagcacgtgtaggaagagaaagactctcgagaatggcaataagtggcgatgactgcgtagtaaaacctatagatgaccgctttgcaagcgctctgaccgcacttaacgatatgggtaaagtgaggaaggacattcagcaatgggaaccaagtaggggatggaatgattggacgcaggttccattttgctcgcatcattttcacgagctagttatgaaggacggaagggtcctagtcgtcccttgtaggaaccaagatgagttaattggacgtgcgagaatatctcagggtgctggttggtcattaaaagaaaccgcatgcttaggcaaaagctatgcacagatgtggaccctaatgtactttcacagacgcgatctacgtcttgctgccaatgcaatatgctccgctgtaccgtctcattgggttccgacctcgagaacgacgtggtctatacatgccaaacacgagtggatgactacagaggatatgctggctgtatggaacagagtctggatccaggaaaatccatggatggaggacaaaacacctgtagaaagctgggaagaagtgccgtatcttggcaaacgagaggaccaatggtgcggcagcctcatcggactgaccagcagggctacttgggctaaaaacatacagacagcgataagccaagtcagatctctaatcggaaatgaagaatataccgactacatgccaagtatgaaacgattccgccgagaagaagaagaagcgggagttttgtggtaa

SEQ ID NO: 22535 - RNA, 9876 nt, synthetic construct
  misc_feature 1..9876: note = derived and/or modified CDS sequence (opt6) from DENV-2__EU482561__SS-prME
  source 1..9876: mol_type = other RNA
accgctggtgtaataatcatgcttatacctaccgctatggcattccatttgaccacaagaaacggagaaccacatatgatagtaggtagacaagaaaaaggaaaaagtttattattcaaaacagaagatggagttaatatgtgcacactaatggcaatagatctaggggaattatgcgaagatacaataacttacaaatgtccgctactgcggcaaaatgaaccggaagatatagactgctggtgtaacagtaccagtacttgggtgacgtatggaacatgcaccacaacaggggaacacagacgggaaaaacgatcagtcgcgctagtgccacatgtcggcatgggcctggaaacaaggacagaaacatggatgagctcagaaggtgcatggaaacatgtacaaagaattgaaacgtggattttaagacacccaggattcacgatcatggcagcaattttagcttatacgattggcacaacccacttccagagagcgcttatatttatacttctgacagcagttgcaccgtccatgacaatgaggtgcatagggatatctaaccgagattttgttgaaggcgtctctggcggatcttgggtggatatagtactagaacatgggtcctgcgtaacgacgatggccaaaaataaaccaacactggattttgaattaataaaaacagaagctaaacagccggcaacgctcagaaaatactgcatagaagcaaaactaactaatactacaacagaatcaaggtgtccaacacaaggagaaccaagtctaaatgaagaacaggataaaaggttcgtgtgtaaacactctatggtagacaggggatggggaaacgggtgtggactttttggcaaagggggaattgtaacttgtgcaatgttcacatgcaagaaaaatatggaaggaaaagtggtacttccggagaatctagaatatacgatagttataaccccgcatagtggagaagaacatgcagttggaaacgatacgggtaaacacggaaaagaaataaaaattactccacaaagttccataaccgaggcagagcttaccggatatggtacagtaaccatggaatgcagtccgcgtacgggtttagatttcaatgaaatggtattattacagatggaagataaggcttggttagtacacaggcaatggttccttgatttaccattaccctggttacctggcgctgatactcaaggatccaattggattcagaaagagacattagtaacgttcaaaaatccacacgctaagaaacaagacgtggtagtattggggagtcaagaaggggccatgcatacggcgttgaccggtgcaaccgaaatccaaatgtcgtcaggaaatttactctttacgggtcacttaaaatgcagactgagaatggataaattacagctgaaaggtatgagctacagtatgtgtacaggaaaattcaaaatagtcaaagaaattgcagaaacacagcatggaacaattgtaataagagtgcaatacgaaggagatggtagtccatgtaaaattccatttgaaataatggacttagaaaagcgccatgttcttggaagactaattactgtaaacccaatagtcgcggaaaaagattcacctgtcaatatagaagccgaaccaccatttggtgacagctatataataattggcgtcgaaccggggcaactaaaactaaactggtttaagaaaggaagttcgattggacaaatgtttgaaacgacaatgagaggtgccaagcgaatggcgatcttaggtgatacagcctgggattttggatcccttggtggagtcttcaccagcataggaaaagcacttcaccaagttttcggggctatatatggagccgcatttagtggggtgtcgtggacaatgaagatcttaattggagtaattataacatggattggtatgaatagccgttccacaagtctgtcagtcagtctagtcctggtaggcgtagtcaccttatatttaggcgctatggtacaggcagattctgggtgtgtcgtaagttggaaaagtaaagagttaaaatgcggttcgggtatttttataacagacaatgtgcacacatggactgaacagtataagtttcaaccggaatcaccaagtaaattggcatctgcgatacaaaaagcccatgaagaaggtatttgtgggattagatctgttactaggcttgagaatttaatgtggaaacagataacgccagaacttaaccacatactgtcggaaaacgaagtaaaactcactatcatgactggtgatatcaaagggataatgcaagcaggtaaaaggagtctaagacctcaacctaccgagcttaagtacagttggaaaacttggggaaaagcaaaaatgttatccacagaaagtcacaaccaaacgtttctaatagatggtccagagacggcagaatgtccaaatactaatagggcatggaactcactagaagtagaggattatggattcggagtattcaccactaatatttggctcaaattaagggaaaaacaagacgtgttctgcgatagcaaacttatgagcgctgcaataaaggacaacagagcggtccatgcagacatgggatattggattgaatcagctcttaatgatacttggaaaatggagaaggcctcatttattgaagtgaagtcgtgccactggccaaagtctcataccctatggagtaatggcgtattagagtcggaaatgataattccaaagaatttcgcaggacccgtttctcaacataattatagaccggggtatcacactcaaactgcagggccgtggcatctaggcaaactagaaatggatttcgacttttgcgagggtacaacagtagtagttaccgaagattgtggaaatagaggcccttcacttcggaccacgacggcatcgggcaaactaataacagaatggtgttgtcgaagctgtaccctcccgccacttaggtaccgaggagaagatggttgttggtacggaatggagataaggcctttaaaagagaaagaagaaaatctggttaactcgctggttaccgcaggtcatggtcaaatagacaattttagtttgggagtgctaggcatggcattatttctagaggaaatgctgagaacccgggtaggaacaaaacacgctatgctgttggtcgtcgtgtccttcgtaacattaattactgggaacatgagctttagagatctaggtagggttatggttatggtgggagcaaccatgacggatgatataggtatgggaataacgtacttagctctcttagctgcatttaaagtaagacccacgttcgctgcgggactcttattaagaaagttgacaagtaaagaattgatgatggcaaccatcggtattgcacttttatcccagagtacaattccagagactatcttagaactcacagacgcactagcactagggatgatggttctcaagatagtaagaaatatggaaaaataccaactagcagtaacgatcatggcgatttcatgtgtgccaaatgcggtaatattacagaacgcgtggaaagtctcatgcacgatacttgccgcagtaagcgtatcaccattactgttaacaagctcacaacagaaagcagactggattccactcgccttaaccattaagggattaaaccccactgccattttcctaaccaccttatctagaacaagtaagaaaagatcctggccactaaatgaagctatcatggctgtaggtatggtcagcattttggcaagctcattattgaaaaacgacatacctatgactggtcctctagttgccggcggacttctgactgtttgttacgtattaacaggccggtcagcagatttagaattagaaagagccgccgatgtaaaatgggaagaccaagcggagatatctggttccagtccaatattgagtataacaatatccgaggatggaagtatgtctatcaaaaacgaagaagaggagcagacgttaacaatactaatacgtacagggttattagttatcagtggagtatttccggtgtcaatacctataacggcggccgcatggtacctttgggaagtcaagaaacagagggccggtgttctttgggatgtacccagtccccctccggttgggaaagctgaattagaagacggtgcgtaccgtattaaacaaagagggattctaggttattcccaaataggggccggtgtatacaaggaaggtactttccatacaatgtggcatgtaacaagaggagcagtattaatgcatagaggaaagcgaatagaaccatcctgggccgatgtaaagaaggatctaataagttacggtggaggctggaagctggagggcgaatggaaagaaggggaagaggtccaggttttagcactagagcctggtaagaacccacgagctgttcaaacaaaaccaggactttttaagacaaatactggaaccataggggcagtctcactcgatttctcgcccggaacgtctggaagccctatcgtcgataggaaaggtaaagtagttggcttatacggcaacggcgtagtaactagaagcggggcttacgtgtcagcaatagcccaaactgagaaaagtattgaagacaatccagaaattgaagatgatatatttcgtaagaaaagactaacaataatggatttacacccaggtgcggggaagactaaaaggtatcttcccgcaattgtaagggaagcgataaagagaggattacgtacgctaatactcgccccaacacgagtagtggctgcggaaatggaagaagcattaaggggtcttccgataaggtatcagacaccagctatacgtgctgaacacacgggcagagaaatagttgatctgatgtgtcacgcaaccttcacaatgagacttctaagccctgtacgggtcccaaattataatttgataataatggatgaagcacactttacggaccctgcaagtatcgcagctcgaggatatatttctacgcgtgtagagatgggtgaagcagctggaatctttatgacagcaacaccgcctgggtctcgtgacccatttccgcaaagtaatgctcctataatggatgaagaacgagaaattcctgaaagatcgtggaactcaggtcatgagtgggtcactgattttaaaggtaaaacagtgtggttcgtaccatccataaaagcaggaaatgacatcgcggcatgtttgaggaaaaatggcaagaaagtaattcaattaagtcgaaaaaccttcgacagtgaatatgtcaaaacgcgggctaacgattgggactttgtagtaactacagatatttcagaaatgggcgctaatttcaaagcagagagagttatagacccacggcgatgcatgaaacctgtaatccttactgatggtgaagaacgcgtaattctagccggacctatgcctgtaacacactcaagtgcggctcaaagaagaggaagaatcggacgaaatcccaaaaatgaaaatgaccaatacatctacatgggagagcctcttgaaaacgatgaagactgtgctcattggaaggaagctaagatgttacttgacaacataaatacacctgaggggataattccatctatgttcgaaccggaaagggagaaagtcgacgcaatagatggcgaatataggctaagaggagaggcgagaaagacattcgtagacttaatgaggagaggagacctaccagtttggttagcataccgagttgcagccgagggaattaattacgctgacaggagatggtgttttgatggaatcaaaaataaccaaattcttgaagaaaacgtggaagtggaaatttggacgaaagaaggcgaaaggaagaaactaaaacccagatggctcgatgctagaatttactcagatccattagcactgaaggaatttaaggaatttgctgcaggacgaaagagtctgacgctaaacctaataacggaaatgggaagactgccgacctttatgacccagaaagccagagacgcactcgataacctcgcggtcctacacactgctgaagccggtggccgggcctacaaccatgcgttaagcgagcttcctgaaacactggagacgttactactgttaactttgctcgccacggtgacgggtggaattttcttattcctcatgtcagggaaaggaataggtaaaatgactctcggaatgtgttgcatcattacagcatccatattattatggtatgctcaaattcaaccacattggatagcagcctctatcattcttgagttctttcttatagtactactgatcccggaaccagaaaaacagaggacgccacaagacaaccaactgacatatgttgtgatagctatattaaccgtcgtcgctgcaaccatggcaaacgaaatgggctttctagagaaaacaaagaaggacttaggtttaggatcaatagctacgcaggagagcgaaagcaacatactagacatagatcttaggccggcatctgcgtggactttatacgcagtcgccacaactttcgtaacaccgatgctgagacatagtatagaaaacagtagcgtaaacgtttcgcttacagctatcgcgaaccaagccaccgtgctaatgggattgggcaaaggatggccgctcagtaagatggacataggagtccctttgttagccattggatgttattcacaggtcaacccaataactttgacggctgcactactgctcctcgtggcacactatgcgataataggaccgggtctgcaagcgaaagcaacaagagaagcccagaaaagggcagcagcggggataatgaagaatcctacagttgacggaataacagtgatagatttggaaccaataccctatgatccaaaatttgaaaaacaattgggtcaagtcatgttactgattctctgtgttacacaagtactgatgatgagaacaacgtgggccctctgcgaggctttaacattagcgacagggccgataagcactttatgggaaggtaatccaggaagattttggaatacgaccattgcagtttctatggcaaatatttttagaggttcataccttgctggtgctgggttactattttctataatgaagaataccactaatacacgtcgaggcacaggcaatattggagaaacattaggagaaaaatggaaaagcagacttaatgctttgggaaaatctgaatttcaaatatataagaaatcagggattcaagaggtagataggaccctagctaaagaagggatcaaaaggggtgaaaccgaccaccatgctgtatcacgtggttcagcaaaactaaggtggtttgttgaacgtaatatggtaacccccgaaggaaaagtggtcgatttaggatgtggaagaggagggtggtcctactattgcgggggccttaaaaacgtcagagaagtaaaaggattaacaaaaggaggaccagggcatgaggaaccaataccaatgagtacgtacggatggaaccttgtgagattacagtcaggggtagatgtattcttcactccacccgagaaatgtgacacattattatgtgatataggagaatcgagccccaacccaacaatagaagcaggacgcactcttagagtactaaacttagttgaaaattggttaaacaacaacacgcagttctgtataaaagtcttgaacccttacatgccatctgtgatagaaaagatggaaacattacaacgaaaatatgggggagccctagtaagaaatcctttaagtcgtaacagtacccacgaaatgtactgggtttcaaacgcgactgggaatattgtgagtagtgtaaatatgatcagtagaatgttaataaatagatttacaatgaagcacaagaaggcgacttatgaaccagatgtagatctcgggtctggtacacgaaatatagggatagagagtgaaatacccaacttagacattattggcaagagaattgagaagataaaacaagaacatgagacatcatggcactacgatcaggaccacccgtacaaaacgtgggcataccacggatcatatgagacaaaacaaacaggttcggcgtcctcgatggtcaacggcgtcgtcaggcttctaactaaaccttgggatgttgttccgatggtaacacaaatggcgatgacagatacgaccccattcggacagcaaagagtgtttaaagaaaaagttgacacaagaacccaagagcctaaagaaggtactaagaaattaatgaaaataacagctgaatggttatggaaagagctaggcaagaagaaaacacctcggatgtgtactcgagaagaatttacacgcaaagtgaggagtaacgcggcattaggtgcaatatttacagacgagaataaatggaaatccgcaagagaagctgtagaggactcaagattctgggaactaattgatcgcgaaagaaacctacatctcgaaggcaagtgtgaaacatgtgtttataatatgatgggcaaaagagagaagaaattaggcgagttcggaaaagcaaagggctctagggcaatttggtatatgtggctaggagcgcgattccttgagttcgaagccctgggattcctgaacgaggatcactggttttcgcgtggcaatagtttaagtggggtagaaggggaaggacttcatcgtctaggctacatattaagggacgtttctaagaaagaaggtggtgccatgtatgcagatgacacagctgggtgggacaccagaataacacttgaggatctcaaaaacgaggaaatggttacaaaccatatgaagggagaacacaagaaattagcagaagctatctttaagctcacataccagaataaggttgtaagagtgcaaaggccaacaccacggggtacagtcatggacataatttcgagacgagatcaaagggggtctggtcaagtgggaacgtatggcctcaatacatttactaatatggaagcccaacttatacgacaaatggaaggagaagggatattcaaatcgatacagcatctaacggttaccgaagagatagctgttcaaaactggttagcacgtgttggacgggaacgattaagccgaatggccatatcgggggatgattgtgtagttaaaccgctagacgacagatttgcctctgcattaaccgctctaaacgatatgggaaaggtacggaaggatattcagcagtgggaaccaagtagaggttggaacgactggacacaagtcccattctgttcacatcactttcacgaactcatcatgaaagacgggagggtactcgtggttccatgtcgaaaccaagacgaactaataggaagggcaagaatttctcaaggagcgggttggagtttaaaggaaacagcgtgtcttggtaaatcgtatgcgcagatgtggactctcatgtactttcaccgaagagatttgagactcgcagcaaatgcaatatgttcagcagtaccgtcccattgggtcccaacatcgaggactacgtggtcaatccacgctaagcatgaatggatgacaaccgaggacatgttggccgtatggaatcgcgtttggatccaagaaaacccatggatggaagacaaaacaccggttgaatcatgggaggaagttccgtatttgggcaaaagagaggatcaatggtgtgggtcattaatcggtttgacgtcacgagcgacatgggccaaaaatatacaaacagccataaaccaagtaaggagcttaataggcaatgaagagtacacagattatatgccgagcatgaaacgttttagacgtgaagaagaagaagcgggagttctctggtaa

SEQ ID NO: 22536 - RNA, 9876 nt, synthetic construct
  misc_feature 1..9876: note = derived and/or modified CDS sequence (opt6) from DENV-2__EU569703__SS-prME
  source 1..9876: mol_type = other RNA
acggcaggagttatcatcatgcttatacctacagcaatggcatttcatcttactactagaaacggagaacctcatatgatagtgggacgtcaagaaaaaggaaaatcgctactctttaaaacagaagatggggtaaatatgtgcaccttgatggcgatagatttgggagaattgtgtgaagacacaattacatacaaatgtcccctactacgccaaaacgaacccgaagatattgactgttggtgcaactcaacaagtacttgggttacatatggaacctgcaccactacaggtgaacatcgtcgggagaaaagaagcgtagcattagtaccccatgtaggaatgggcttggaaaccagaacggaaacatggatgtctagcgaaggcgcgtggaaacacgtacaacgcatagaaacgtggatacttagacatcccgggtttacaataatggcagccattcttgcatacacaattggaaccactcattttcaaagagctctaatcttcatcctcctcacggctgttgccccgagcatgacaatgagatgtataggaatatcaaatagagattttgtagaaggcgtgtcaggtggctcctgggttgatattgtacttgaacacggttcgtgcgtcacaacgatggccaaaaataaacccacgctagactttgaattaatcaaaacggaagcaaaacaacctgcaacgcttagaaaatattgtatagaagcaaaattgacgaatacaacaactgaaagcagatgtcctacccaaggtgaacccagcttaaatgaagaacaagataaaaggttcatatgtaaacatagcatggtagacagaggatggggtaacggttgcgggctttttggaaaaggaggaattgtcacgtgtgcaatgtttacttgtaagaaaaacatggaaggaaaagttgtgcttccagaaaatctagagtatactatagtgataacgccacattctggcgaagaacacgcggtcggaaatgacacaggaaaacatgggaaagaaattaaaattactcctcagagttcaataacagaggcagagctgacaggctatgggacggtaacaatggagtgtagtccaagaacaggtcttgattttaacgaaatggttttactccagatggaagataaagcatggctagtacatcgacagtggttccttgaccttccgttaccatggctaccaggagctgacacacaggggagcaattggatacaaaaagaaacattagtaacattcaaaaacccacatgccaagaaacaggatgtcgtggtgttgggaagtcaggagggggcgatgcatacggctctaacaggagcaacagaaattcaaatgagttcgggaaatctgctattcacagggcatctcaaatgtaggttaaggatggacaaactacaactaaaagggatgagttattcaatgtgtacaggcaaatttaaaatagtgaaagaaattgcggaaacgcaacacgggactatagttatcagggtacagtatgaaggtgatggttcgccctgtaaaattccatttgaaataatggatctagagaaaagacatgtgctaggccgtttgatcactgtaaatcccattgtcactgaaaaagattctccggtaaacatagaagcagaaccacccttcggcgacagctatattattataggtgtcgaacctggacaattaaaactaaactggtttaagaaaggatctagtattggacaaatgtttgaaaccacaatgcgcggagcaaaaagaatggcgatccttggagacactgcatgggattttggatcactaggtggagtttttacatcaatagggaaggctttgcaccaagttttcggcgctatttacggtgctgcattctctggggttagttggacaatgaaaattttgataggggtaataataacctggataggaatgaacagtcgatcaacgtcactctcagtctcgttagtcttagttggagtggtcacactatacctgggggtgatggtccaagccgatagtggatgtgtcgtatcatggaaaaataaagaactaaaatgtggatcaggtatctttataaccgataatgtacatacttggacagagcaatataaatttcaaccagagtcaccatcaaaactggcttccgctatacaaaaagcgcatgaggaaggtatatgtggtataagatccgtcactcgtctagaaaatttaatgtggaagcagataacacccgaactgaaccatatattatccgaaaacgaagtaaaattaacaattatgactggcgatataaaaggaattatgcaagcaggaaaaaggtctcttaggccacagcccactgaactaaaatatagttggaaaacgtggggaaaagccaagatgttaagtacggaatcccacaaccaaacgttcctaatcgacggcccagaaactgcagaatgcccgaataccaatagggcttggaactcactcgaagtagaagattatggattcggcgtcttctcgactaacatctggcttaaattaagagagaagcaggatgtattttgtgattcaaaactgatgagtgcggcaataaaggataatagagcagtgcatgctgacatgggatattggattgaaagtgctctgaacgatacatggaaaatggaaaaggcaagtttcatagaggttaaatcatgccactggccaaagagccatacgttatggagcaacggagtcctagaatctgaaatgataattccgaaaaatttcgcagggccagtcagtcaacataactatcgaccaggatatcatacacaaacggccggtccatggcatcttggcaaacttgaaatggattttgacttctgtgaaggtacaacggttgttgtgaccgaagactgcggcaataggggtccttccctacgaacgacaactgcgtctggaaaattgataaccgaatggtgttgtcgtagctgcactttgcctccgttaagataccgtggagaggacgggtgttggtacggtatggaaataagacctttaaaagagaaagaagagaatctagtaaattctctagtaacggcaggccatgggcagatagataatttctccttaggtgttcttggtatggctttattcttagaagaaatgctaagaactcgcgttggcacaaaacacgctatattgcttgtagctgttagcttcgtaacactcattacaggcaatatgtcctttcgagatcttggtagagtaatggttatggtaggtgcaaccatgaccgacgatattggcatgggcgtaacatacctggcgttgttggctgcatttaaagttagaccaacgtttgctgcaggacttctattacgaaagctaacttccaaagagttaatgatggcaactataggaatcgccttactatcacaaagtactatacctgagacaatactcgagttaactgatgccctagctttaggaatgatggtcctgaaaatagttagaaacatggaaaaataccaactcgcagttactataatggctatatcttgtgtaccaaacgcggtgattctacaaaacgcctggaaagtctcctgtaccatactagcggctgtcagtgtatctcccttactcttgacaagttcgcaacaaaaagcagattggatccctctagcactaacaatcaagggtcttaatcctaccgcaatctttcttacaacgctctctcgaaccagtaagaaaagatcttggcccctgaatgaggcagtcatggctgtgggaatggtttctatactggcaagcagcttattaaagaacgatatcccaatgacaggtccgttagtggccggaggccttctgactgtatgttatgttttaacaggaaggagcgcggacctagaactggaacgagccgctgatgtgaaatgggaggaccaagcagaaattagcggctcaagcccaatactgagtataacgattagtgaggacggctccatgtcaattaaaaacgaagaggaagaacacactctgaccatcttaatcagaactgggctcctagtaataagtggagtcttcccagtatcgattccaataactgcggcagcgtggtacttgtgggaggtcaagaaacaaagagctggagtgttatgggacgtgccttcaccaccacccgtcggaaaagctgaactggaagacggagcatatcgtattaaacaaagaggcatattcggttattcccaaatcggcgctggggtttataaagagggcacttttcatactatgtggcacgtgactcgaggggccgtgctcatgcacaggggtaaacgaatagaacctagctgggcagacgttaagaaagatctaatttcatacggcggcggatggaaattggagggtgaatggaaagagggggaagaagttcaggtattagcattagagcctggaaagaatccgcgtgctgtccaaactaaaccgggcttattcaaaacaaatacaggaacgatcggcgcagttagtttagactttagtcctggtacatccggttcacccatagttgacaggaaaggtaaggttgttggtctgtacggtaatggagtagtaacaagatccggagcgtacgtttcagcaatagctcaaacagagaaaagcatagaggataatcccgaaattgaagatgatatatttagaaagaagagattgacgataatggacctgcatcccggagctggcaaaaccaaaagatacttaccagctatagtcagagaggcgataaaaaggggtttacgtactctaattttggcacctactcgtgtagtggcagctgagatggaggaagcacttagaggccttccaatccgttaccaaactcctgcaattagagccgaacacactgggagagaaatagttgatttaatgtgtcacgcgacattcactatgagattattaagccctgtccgagtcccaaactacaacctaattattatggatgaagcacattttacggaccccgctagtatcgcagcaagagggtatatttcaacacgagttgaaatgggagaagcagctggaatattcatgactgctacaccccctggatcgcgagatccattcccccaaagcaatgccccaataatggacgaagaaagggagataccggagagaagctggaatagcggacacgagtgggttacagacttcaaaggaaaaacggtatggtttgtaccctccattaaagctggtaatgacatcgcagcttgtctaagaaagaatgggaagaaagttatacagctttctcgaaaaacgttcgactctgaatatgttaaaacaagggctaacgactgggactttgtcgtaacaacggatatatcggaaatgggtgcaaattttcgagcagaaagagtgatagacccacgcagatgtatgaagcctgtaatattaactgatggagaggaaagagtcattttagcaggaccaatgcctgtaacacattcttctgcagcgcaaagaagaggaagaatcggccgaaatcctaaaaatgagaacgatcaatatatttacatgggagaaccactcgaaaatgacgaggactgcgcgcattggaaagaagcaaagatgcttcttgataatattaacactccagagggaattataccatcgatgtttgaacccgaaagggaaaaggtagatgccatcgacggtgagtataggctacgaggcgaagcacgaaaaactttcgtcgatttaatgaggcgtggggacctgccagtatggttagcttaccgagtggcagcagaaggaataaattacgccgatcgtcgatggtgttttgatggaattaaaaacaatcaaattttggaggaaaatgtcgaagtggagatatggacaaaagaaggggagaggaagaaactaaagccgagatggctggatgccagaatttattctgatcctttagctttgaaggagtttaaagaatttgcagcggggcgcaaaagtttaacattaaatctgatcacagaaatgggaagattaccaacctttatgacacagaaagcacgcgatgctttagataatttagctgtcttacatacagcggaagtaggcggacgtgcatacaatcacgccctgtcagaattgccggaaacattagaaacactattattgttaacattgttagcgaccgtaacagggggtatctttttatttttgatgagtggcaagggaattggaaaaatgacattgggcatgtgttgcattataacagcatcaatactattatggtatgcacaaattcagcctcactggatcgccgcaagcataatactagagttctttttgatagtacttctaataccagagccagaaaaacaaagaactccgcaagacaaccaactgacctatgttgttatcgccatactgaccgtagtcgcagcaacgatggcaaatgaaatgggcttcctggaaaagacaaagaaagatctaggcttaggttcgataacgacacaagaaagcgagagtaatattttggatatcgacctccgacccgcgtccgcttggacactttatgcagttgccacgacctttgtaacaccgatgctacgacacagtatagaaaattcaagtgttaacgtttcactaacggcgatagcaaatcaggcgacagttttaatgggcctaggccgagggtggccgttatccaaaatggatataggggttccattactcgctattggttgctatagccaggtaaacccaataacacttactgcagcccttttgttattagtcgctcattacgcgataattggacccggacttcaagctaaagccactagggaggcacagaaaagagcagctgctgggattatgaaaaatccgacagtggacggtatcaccgtcatagatctagaacctataccatacgatccaaaatttgaaaaacaactaggccaagtaatgttgttagtgttatgtgtaactcaagtactgatgatgcgaactacctgggcactctgcgaggcacttaccctggccacaggaccaatatcaacgttatgggaaggaaaccctggccggttctggaataccaccatagccgtatccatggcaaatatcttccgaggtagttacttagctggagcgggtctcttattttcgatcatgaaaaacaccacaaacactcgaagaggaactggtaatataggggaaactcttggagaaaaatggaaatcgagattaaacgccttgggaaaatctgagtttcaaatctataagaaaagcgggatacaagaagtggaccgaacattagcgaaggaaggcataaaaagaggagaaacagatcatcatgcagtgtccagaggttccgcaaagctaagatggttcgtggaaagaaatatggttacaccggaaggaaaagtcgtagatctaggatgcggcaggggcgggtggagctactactgtggaggcttaaagaacgtcagagaagtaaaagggcttactaagggtggtccaggacacgaagaacccatccccatgtctacatatggatggaatctcgtcagactacaatccggtgtcgatgtctttttcacccctccggaaaaatgcgatacgcttttatgcgacatcggtgagtccagcccaaaccccacaatagaagcgggacggacgctcagagtgctgaatttagtcgagaactggctgaacaataacacacaattttgtataaaagtactaaatccatacatgccatctgttatcgagaaaatggagacccttcagagaaaatatggcggcgcattagtacgtaatccattaagtcgaaatagcacccatgaaatgtattgggttagcaacgctacaggaaacatagtatcatccgttaatatgatctcacggatgctgatcaacaggttcaccatgaagcataagaaagctacatacgaaccggacgtcgatttaggatcaggtacaagaaatataggtattgaaaatgaaattccaaacctggacataataggcaaaagaattgagaaaattaagcaagagcatgaaacatcatggcattatgatcaagatcacccatataaaacatgggcatatcatggatcctacgaaaccaagcaaactgggtcagcatcatcaatggtaaacggagttgtacggttattgacgaaaccatgggacgtcgtgcccatggtgacccagatggctatgacggatacaacacctttcggccagcaacgtgtcttcaaagaaaaagtagatacgcgcacacaagaacccaaagaagggacgaagaaattgatgcgtataacggctgaatggttgtggaaggaattaggtaagaagaaaacacctagaatgtgtacgcgagaagaatttacaagaaaagttcggtcgaacgcagccctaggagcaatatttaccgatgaaaataagtggaaatctgccagagaagcagtagaggattctagattttgggaattagtggatagagaaagaaatcttcatctggaaggaaaatgtgaaacgtgcgtctacaatatgatgggtaaacgagagaagaaattaggagaatttggtaaagcgaaaggttcacgagcgatatggtacatgtggctaggtgctagatttctggaatttgaggctttaggattcctaaacgaggatcactggtttagtagaggaaattcactgtccggagttgaaggtgaaggtttgcacaaactcgggtatattttaagggacgtgtctaagaaagagggcggagcaatgtatgcagacgacacggcaggttgggacacgcgtattacactagaagatctcaaaaatgaggaaatggtcacgaaccacatgaaaggtgaacataagaaactagccgaggcaattttcaaattaacgtaccaaaataaggtggtgagagtacaaagaccaaccccgcgaggcacagttatggatataatttcacggaaagatcaacgtggatctggacaagtcggaacctacgggttaaataccttcactaatatggaggcacaactcattagacagatggaaggggaaggtatatttaaaagtatccagagactaactgtaacagaggaaattgcagttcaaaattggttagccagagtgggaagagaacgactctctagaatggctatatccggagatgactgtgtagtcaaaccattggatgatcgattcgcctcagcgttgaccgcattaaatgatatgggcaaggttcgcaaagatattcaacagtgggaaccgtcaagagggtggaatgattggacccaggtcccattttgcagccaccatttccacgagctagtgatgaaggatggcagagtcctagttgtaccatgtcgaaatcaagatgaactgatagggcgtgcaagaatctcccaaggagcgggttggagcctaaaagaaactgcctgcctgggtaaaagctacgcacaaatgtggactctaatgtacttccatcgaagagacctacgattagcagcgaatgcaatatgcagcgctgtcccatcacattgggtccccacgtcacgcactacctggtcaattcatgcgaaacatgaatggatgactacggaagatatgttggcagtctggaatcgggtatggattcaagagaacccttggatggaagataaaacacctgtagaaagctgggaggaagttccttatttaggaaaaagagaggatcaatggtgcggaagcctgatcggtttaacaagcagagcaacatgggccaaaaacatacaaacagcaattaaccaagttcgctctttgataggaaatgaagaatacacagactatatgccaagcatgaaacggtttagaaaggaagaagaagaagcaggagtattgtggtaa

SEQ ID NO: 22537 - RNA, 9876 nt, synthetic construct
  misc_feature 1..9876: note = derived and/or modified CDS sequence (opt6) from DENV-2__EU529694__SS-prME
  source 1..9876: mol_type = other RNA
accgctggagtctttatcatgcttattccaactgcaatggcttttcatctgaccactaggaacggagaaccgcacatgatagtgggaagacaagaaaaaggaaagagtctgttatttaagacagaagatggggtaaacatgtgcacccttatggcaatggatctgggggaattatgcgaggacacaataacatataaatgcccgttacttagacaaaatgaacccgaagacatcgattgctggtgtaattctacttcaacttgggtaacttatggaacatgtactactacaggtgaacatagaagagaaaaacgttctgtggcattagttcctcatgttggaatgggcctagaaacacgtactgaaacatggatgtcaagcgagggtgcatggaaacatgtacaacggatagaaacatggattttacggcatcctggctttaccataatggcggcaatacttgcttataccatcggaacaacccacttccaaagagcattaatattcatattattgacagccgtagcaccttcgatgacaatgcgatgtattggaatttcaaatagagatttcgtagaaggggtgtccggggggtcttgggtcgacattgttctggaacatgggtcttgtgtaacaacgatggcgaagaacaaacctacacttgactttgaattaataaaaacagaagcaaagcaaccagcaacgttgaggaaatactgcatcgaagcaaagttgacaaatacaacaacagaaagcagatgtccaactcagggagaacctagtcttaatgaggaacaggacaaaagattcgtatgtaaacacagcatggtagataggggttggggaaatggttgcggactgtttggtaaaggaggaatcgttacatgtgctatgtttacctgcaagaagaatatggagggtaaagtagttctacctgagaatttagaatatactatagtaattacgccacatagcggagaagaacatgctgtgggaaacgatacgggaaaacacggtaaggaaattaaaattacaccacaatcatccataacagaggctgaattaactggatacgggacggtcacgatggaatgtagccccagaacaggcctcgattttaatgagatggtattactgcagatggaagataaggcttggttagtacacagacagtggttcttggatcttcctttaccttggttacccggtgcagatacacaaggttcaaattggatacaaaaagaaacgttggttacttttaaaaatccacacgcaaagaagcaggatgttgttgtattaggtagtcaggaaggggccatgcatacagcactgactggtgcaactgaaatacaaatgtcaagtggcaacctacttttcactggtcatttaaaatgtaggctaagaatggacaagttacaactcaaggggatgtcatattcaatgtgtactggaaagttcaaaatagtcaaagaaatagctgaaactcagcatggtacaattgttattcgagttcaatacgaaggagatggtagtccctgtaaaattccttttgaaataatggaccttgaaaaaaggcacgtattgggtaggctcatcactgttaatcctatagtagcggaaaaagacagtcctgttaacatagaagcggaaccaccattcggcgactcgtacatcataataggagtagagccaggacaactcaaactaaactggtttaagaagggatcttcaataggccaaatgttcgaaacaacaatgcgaggagctaaacgtatggcaatcctaggggacacagcgtgggattttggttccttgggaggagtgtttacgagcatcggaaaagcactacatcaagtgttcggagcaatatatggagccgcattctctggtgtgtcatggacgatgaagatactcatcggagtaattataacctggatcggaatgaacagtagatcaacctcacttagcgtgtctttagtactagttggggtcgtcacattatatctaggtgcaatggtacaagcggactcaggatgtgtggtaagctggaagagtaaggaacttaagtgcggaagcggcatttttataactgataatgtacatacatggactgaacaatacaagtttcagccagagtcacctagtaaattagcctcagcaattcaaaaagcacatgaagaaggcatctgtggaatacgttcagtaacgagattggaaaatttaatgtggaagcaaataactcctgagttgaatcatatattgtccgaaaatgaagtcaaattgacgataatgaccggtgacataaaaggcattatgcaagccggaaagagatcacttaggccacaacctacggagttaaaatattcttggaagacatgggggaaggccaaaatgttatccactgaaagtcataaccagacatttttaattgacggtccagaaacagctgagtgcccaaataccaaccgcgcttggaacagtttagaagtcgaagattatggttttggagtatttaccacgaatatttggctaaaactacgtgaaaaacaagatgttttttgtgatagtaagttaatgagtgcggctatcaaagacaatagggcagttcatgcggatatgggctactggatagaatcagcactaaatgacacttggaaaatggaaaaagcgagcttcattgaagtcaaatcgtgtcattggccaaaatcacatacactatggagtaatggcgtattagaatccgagatgataattccgaaaaattttgccggtcccgtatctcaacacaattacagacccggataccatacccagacagccggaccgtggcacctaggtaaattagaaatggactttgatttttgcgaaggaacaaccgtagtagtaacggaagactgtggaaaccgaggaccatctctaaggacaacaacggcaagcggaaagttgattactgaatggtgttgtcggagttgcaccttgccaccactacgctatagaggtgaagacggctgctggtatggtatggagattcggccgttgaaagaaaaagaggaaaacttggtaaatagcctcgttactgcgggtcacggacaaatagacaattttagtttaggcgtgttaggtatggctctctttttagaagaaatgttacgcacgagagtgggaactaaacacgcaatgttactggtagcagtatcttttgttaccctgattacgggaaatatgtcattccgagatttaggccgtgtaatggtaatggttggggccacgatgacagatgatattggtatgggaatcacatatttagccctgctggccgcattcaaagtaaggcctactttcgcagctggcctgttattacgtaaactaacctccaaggaactaatgatggccacaatcggaatagcgcttttatcacaatcaactatacctgaaactatactagaattaacagatgccttggccctaggaatgatggtattaaaaatagtaagaaatatggagaaatatcaactagcggtaaccattatggcaatttcttgcgttccaaacgcggtaatactacaaaacgcttggaaggtatcatgcactatcctggctgctgtgagcgtctctccgcttcttttaaccagcagccaacaaaaggcagattggatcccattggctctaaccataaaaggtcttaaccccacggcaatatttttgactaccctatcacgtacatctaaaaagagatcgtggcctcttaatgaagccattatggccgttgggatggtctcaatacttgcatcaagtctcttaaaaaacgacatcccaatgacaggccccttagttgcaggagggttactgacagtttgttatgtattgacaggccgctcggctgatctagaacttgaaagagccgctgacgtaaaatgggaagatcaagcagaaatcagtggtagttctcctatactgtcgatcactatctcggaggatggatcaatgtcaataaaaaatgaagaagaagaacaaaccctcactatattgataagaaccggtttactagtaatcagcggtgtatttccagtatctatacccataacagcagcagcatggtatttatgggaggtaaagaaacagagagctggagtgttgtgggatgtaccgtcaccaccacctgttggtaaagctgaattagaagatggggcatatcgaataaaacaaagaggaatactagggtattcacagattggagcaggggtttacaaagaggggacctttcatacgatgtggcatgtaacacgtggtgcagtgttaatgcatagaggaaagaggatagaacctagctgggcagatgtaaaaaaggacttaataagttatggaggaggatggaaattagagggcgaatggaaagagggggaagaagtccaagtacttgctttggaacccggaaaaaatccacgagctgttcagacaaaacctggcctcttcaaaaccaatactggaacaataggcgcagtctccctagatttctctcccggcacaagcggcagtccaatagttgatagaaaaggaaaagtcgtaggtctgtacgggaatggagtggtaacccgcagcggagcgtacgtgtctgctatagcacagacagagaaaagcattgaagataatcctgagatagaagatgacatttttagaaagaagcgattaaccatcatggacctgcatcctggtgcaggaaaaacaaaacgatatttgccggcaatagtcagagaagcaataaaaagggggcttcgaacattaatactggctcccactagagtggttgctgcagaaatggaagaagctctaagaggactcccaattcgatatcagacaccggccattcgagcagaacatacaggccgagagatagtagatctaatgtgtcatgctacatttacaatgcggctgttgtctccagtacgcgtcccaaattacaatctgataataatggacgaagcacacttcacagatcccgcgtcgatagcagcacgaggatacatatcgacaagagtggaaatgggggaggccgcaggaatatttatgacagccacgcctcccggatcaagggatccatttcctcagtcaaacgcccctatcatggacgaggaacgagaaattccagagagatcctggaatagtggtcatgagtgggttactgattttaaaggaaaaaccgtttggttcgtaccatcaataaaagccggaaatgacatcgcggcttgtttaagaaagaatggaaaaaaagtaatacagttatcaaggaagacatttgattctgaatatgtgaagacaagggcgaacgattgggatttcgtagtgaccacggacatatcggaaatgggggcaaactttaaagccgaacgcgtaattgacccaagaagatgtatgaaaccagtaatcttaacggatggtgaagaaagagtaatcctagctggcccaatgccggtaacacattcgagcgctgcacaacgaagaggtcggatagggcggaacccaaaaaatgaaaatgatcaatatatctacatgggagagccattagaaaatgatgaagattgcgctcattggaaagaggccaaaatgttgttagacaatattaatactccagaaggtatcatccctagtatgttcgaaccagaaagagagaaagttgatgcaattgacggagagtatagactacgcggtgaggcacgtaaaacatttgttgatttaatgcgcaggggagatttgcctgtatggctcgcgtatagggtagcagcagaaggaataaattatgcggaccgcaggtggtgttttgatggaattaaaaataatcaaatattagaagaaaatgtagaagtagagatctggacaaaagaaggagaaaggaagaaattaaaacccagatggttagatgcacgtatttatagcgatccacttgcactcaaagagttcaaagaatttgctgcaggacgaaagtcgttaactttgaatctcataacagaaatggggagattgcccaccttcatgactcaaaaggcaagagacgcattagacaatcttgctgtgttacacaccgcagaagcaggcggcagggcttataatcatgctctatcagaattacctgagacattggagacattattgcttttaacactattagcaacggtcacaggaggcatatttctttttctcatgtcgggaaaaggaataggaaaaatgaccctaggaatgtgctgcataataacggcttctatcttactgtggtacgcacaaatacaaccccattggattgccgcaagtataattttggaattcttccttatcgtcctcctaatccctgaaccagaaaaacaaagaacaccgcaagataaccaattaacttatgtggtaatcgcaatactgacagtagtagccgctaccatggcaaacgaaatgggatttctggagaaaactaaaaaagatcttggcctaggctctatagcaactcaagagtccgaatcaaatattttagatatagatctgagacctgcatcagcatggaccctatatgctgtggctaccactttcgtaacacctatgttgagacactctatcgaaaatagcagtgtcaacgtgagtttaaccgctattgcgaatcaagcgacagtactaatgggattaggaaaaggctggcctttgtcgaaaatggatataggagtacctctcctggctattggttgttatagtcaagttaatccaataacgctaacagccgctttattactactagtagcacattacgcaattataggacctggacttcaagcaaaggccacaagagaagctcaaaagagagccgcagctggaataatgaaaaacccaaccgtagatggtattacagtaatagatttagagccaataccttacgatcccaagtttgaaaaacagttgggacaagtaatgttgctcattttatgtgtaacacaagtattgatgatgcgaacaacctgggcactgtgtgaggcacttaccttggcaacgggaccgatctcaaccctgtgggagggtaacccagggagattctggaacacgactattgcagttagcatggctaacatcttccggggaagttatttagcgggggctggtctactattctcaatcatgaaaaacacaaccaatacgagaagaggtactggaaacataggagagaccttaggcgaaaaatggaaatcaagactgaatgcccttggcaaatccgaattccagatttataaaaagtcaggaatacaagaggtagacagaacactagcaaaagagggtattaaacgaggtgagacggatcatcacgcggtaagtcgtggaagcgcgaaactaaggtggttcgtagagcggaatatggtgacacccgaaggtaaagtagtagatctagggtgtggcagagggggttggagttattattgcggaggattaaaaaatgttcgagaagtcaagggtctcaccaaaggcggaccaggacatgaagagcccataccaatgtcaacttacggctggaacttagtaagacttcaatcaggagtggacgtatttttcaccccgccagaaaagtgcgacactttgttgtgtgatataggtgaaagctcgccaaatccgacgattgaagctggaagaacgctaagggtcctaaatttagtcgaaaattggcttaacaataacacccaattttgtataaaagtgttaaacccatacatgccttccgttatagaaaaaatggaaaccttgcaaagaaaatatggaggagcactagtacgcaaccccctctcaaggaattcaacacacgaaatgtattgggtttcaaacgcaacgggaaacattgtcagctctgttaatatgataagccggatgttaatcaatcgttttacaatgaaacataaaaaagccacttacgaaccagacgtagacctgggatcaggcactcgtaatataggaatcgaatctgaaatacccaacctcgatataatcggcaaacgtatcgagaaaataaaacaggaacacgaaacaagttggcattacgaccaagaccatccttacaaaacatgggcttatcatggtagttacgaaacgaaacaaaccgggtctgcttcatcaatggtaaacggtgtagtacgattattaacgaagccttgggacgttgtgccaatggttacgcagatggcaatgacagatactactccattcggccaacagagagtgtttaaggaaaaagtcgacactcggacgcaggaaccgaaagagggcacaaaaaaattaatgaaaataaccgcagaatggctatggaaggaattaggcaaaaaaaagacgccaaggatgtgtaccagagaagaatttacacgtaaagtgagaagcaatgcagcattaggtgcaatattcacagacgaaaataaatggaaaagtgctcgggaagctgtagaagatagtaggttctgggaattaatagatcgagaaagaaatctccaccttgagggcaaatgtgagacttgtgtatataatatgatgggaaaaagggagaaaaaattaggagaattcggaaaagcaaaaggatcaagagctatttggtacatgtggcttggagcaaggtttctcgaattcgaagcactgggctttctgaacgaagaccattggttctctcggggaaactctttgtcaggggttgaaggagaaggcctacatagactaggctacattcttagagacgtatcaaaaaaggaaggcggtgctatgtatgctgacgacacggcaggatgggacaccaggattacactggaagacttgaaaaatgaagaaatggttaccaaccacatgaaaggggagcataaaaagttagctgaagccatatttaaactaacataccagaataaagtagttagagtacagcgaccaactcctagaggtacagttatggacataattagtaggagagatcaacgcgggtccggccaagttggcacatatggcctcaatacatttactaacatggaggctcaacttatccgccaaatggagggagaaggtattttcaaatcgatacaacatttgacagtcacagaagaaattgcagtacaaaattggctcgcacgagtcggtagggaacgactaagtagaatggcaatctcaggcgacgactgcgtagtaaaaccactcgatgatcgattcgcctccgcactaacagcactcaacgatatgggaaaagtacgaaaagatatacaacaatgggaacctagtagagggtggaatgattggacacaagtaccgttctgctcacaccacttccatgaattagtaatgaaagacggaagggtattagtagtaccctgtaggaatcaagacgaactaattggaagggcgaggatatcgcagggagctggatggagtttaaaagagacagcatgtctcgggaagtcctatgcgcagatgtggaccctgatgtactttcatcggcgagacctaagactagcagctaatgcaatctgctcagcggtcccatcacattgggtacctactagcagaacaacatggtccatacacgctaagcatgaatggatgactactgaggacatgcttgccgtttggaacagggtttggatacaagaaaatccctggatggaggataagacaccagttgagtcgtgggaagaggtgccctatttgggaaaaagagaggatcaatggtgtggaagcctcatcgggctcacatcgagagctacttgggcaaagaatattcagacggcaattaatcaagttagatcccttatcggaaatgaagaatatacagactatatgccctcaatgaaaagatttcgtagagaagaagaagaagctggagtgttatggtaa

SEQ ID NO: 22538 - RNA, 9876 nt, synthetic construct
  misc_feature 1..9876: note = derived and/or modified CDS sequence (opt6) from DENV-2__EU529695__SS-prME
  source 1..9876: mol_type = other RNA
acagctggcgtaataataatgcttattccgacagctatggcatttcacttaactacgaggaatggagaaccacatatgattgtcggaaggcaagaaaaggggaaaagcctcctgtttaaaacggaagacggagtgaatatgtgcactcttatggcaatagatttaggagaattatgtgaagatacgataacatataaatgtcctcttttgaggcaaaatgaaccagaagacattgactgttggtgtaacagcacatctacatgggttacatacggaacgtgcactaccacgggagaacatagaagagaaaaaagatcagtagctcttgttcctcatgttgggatgggtcttgaaacgcgcacggagacgtggatgagcagtgagggagcttggaaacatgtccagcgaatagaaacttggattcttagacatccaggatttacaattatggccgcaattctggcttatacaatcggaacaacgcattttcagcgcgctttgatatttattctcttgacagctgtagctccctccatgacaatgcggtgtatagggatttcaaatcgagactttgtggagggcgtatctggcgggtcttgggttgatatagtactcgagcacggaagttgtgttactacgatggcaaagaataaacccacactagactttgagttaatcaaaacggaagcgaaacaacctgcaactctgcgaaagtattgtattgaagcaaaattaactaatactactacagaatcacgttgtcctacccaaggggaaccttctctaaatgaggaacaagataaacgatttatctgcaaacacagcatggttgatagaggttggggtaacggttgtggactttttgggaaaggtggcattgtaacgtgcgcaatgtttacgtgcaaaaaaaatatggagggcaaagtagttctccccgaaaatttagaatatacaattgttataacgccacacagtggagaggaacacgcagtaggcaacgatacaggcaaacatggaaaagaaataaaaattacaccacaaagttcgataaccgaggctgaattaacgggctacggaaccgtaacgatggaatgttcaccaagaactggacttgactttaatgaaatggttttgttgcaaatggaagacaaggcatggttagttcaccgacagtggtttctagacctgcccttaccctggcttcccggagctgacacccaaggatccaactggatacaaaaagaaaccttagtgaccttcaaaaatcctcacgctaaaaagcaagatgttgtcgtattagggagtcaggaaggagcaatgcatacagcattaacaggagcaactgaaatacagatgtcttcgggaaatcttttatttaccgggcaccttaaatgtagattaagaatggataagttgcaattaaaaggaatgtcgtattcaatgtgtacaggcaagtttaagattgttaaggaaatagccgaaacacaacatggcacaattgttattcgagtccaatatgaaggggatggttccccctgtaagattccctttgaaatcatggacttagaaaaaagacacgtactagggagattgataacagttaatccaatagtaactgaaaaagattcaccagtaaatatcgaagctgaaccgccctttggggactcttacatcataatcggtgtagagcctggtcaattaaagctcaactggttcaaaaagggaagctctataggacaaatgtttgaaacaacaatgagaggagcaaagcgcatggctatattgggggacactgcctgggattttggaagccttggtggagtattcacctccataggaaaagcactccaccaagtcttcggggcaatatatggtgctgctttctcaggtgtatcgtggaccatgaagattcttattggagtcataataacttggattggaatgaactcccgaagtactagtctcagcgtcagcttggtattagtcggagttgtaacattatacttaggtgtcatggttcaggcagactcaggttgtgtagtttcgtggaagaataaagaattaaaatgcggttcaggtattttcattaccgacaatgtacatacctggaccgaacaatacaagtttcagccagaatcaccaagtaagctggcatctgccattcaaaaggcccacgaagaaggaatatgtggcatccgtagcgtgacgaggctcgaaaatctaatgtggaaacagataacgccagaacttaatcacattctatcggaaaacgaagtaaaactaacaattatgacaggagatataaaaggaatcatgcaagcaggtaaacgaagtctgagacctcaacccacagagctcaaatattcatggaaaacgtggggaaaagctaaaatgttatccaccgaatcgcacaatcaaacctttttgatagacgggccagaaacagcagaatgtcctaataccaatagagcatggaactcacttgaggttgaggattatgggtttggagtgttttcaacaaatatatggttgaagcttcgagaaaaacaagacgtgttttgtgatagcaaattaatgagtgcagctataaaagataaccgtgctgtacatgcggacatgggatattggatagaaagcgcactaaatgacacctggaaaatggagaaagcttcgttcattgaagtaaaatcatgtcattggccaaaaagtcatactttatggagcaacggagtgcttgagagtgagatgataataccgaaaaatttcgctggtcctgtatcacaacataattacagaccgggttatcatacacaaacagctggaccatggcacctagggaagttagaaatggacttcgacttttgtgagggcaccaccgttgtggtcacagaagactgcggaaaccgtggtccctctttgcgaactacaactgctagtgggaaacttatcacggaatggtgctgtagatcgtgtacacttcctccattacgttacagaggtgaagatggttgctggtacggaatggaaatacgtccacttaaggaaaaagaagaaaacctagttaacagtctggtcacagcagggcacggacaaatcgataatttctccctaggagtgctgggaatggctctatttttggaggagatgttaaggacaagggtaggtacaaaacacgcaattctattagttgccgtttcttttgtgacgcttattacaggtaatatgtcatttcgagacctagggagagtaatggtgatggtcggagcaactatgacagacgatattggaatgggggtaacatacctagctctcctagccgcatttaaagtgcgtcccacttttgcagccggtttgctgctaagaaaactaacaagcaaagagttgatgatggcaacaattggtattgctctattgagccagtccacaatccctgagacaattctggaattaacagatgcactcgctcttggtatgatggttttaaaaatagtacgaaatatggaaaaataccaattggctgttactataatggccatatcttgcgtaccaaatgcagtaatacttcaaaacgcgtggaaagttagttgcacaatattagccgccgtttcagtatcaccgctattattaacgagcagtcaacaaaaggctgactggattccattagctttaaccatcaagggtctaaatccgacggcaatatttttaacgactctatcacgtacatctaaaaagcgaagttggcctttgaatgaagctgtcatggcagttggtatggtttcaatcttagcatcatccttactgaaaaatgatattccgatgacaggacctttggttgcaggcggactacttaccgtttgttacgtgctaacgggacggtctgctgatctagaactcgagagagccgctgatgtaaaatgggaagaccaagcagaaatttcaggtagcagcccaatcctgagtataaccatatccgaagacggttctatgtcgattaaaaacgaagaagaagaacaaaccttgactatccttatcagaactggccttttagttatctcaggtgttttccccgtatctattccaattactgctgcagcatggtatctatgggaagtcaaaaaacaaagagctggtgtcctgtgggacgtaccctcaccaccacctgttggcaaagcagaattggaggatggtgcatatcgaatcaaacaacgggggatattcgggtattctcagataggagcaggtgtctacaaagagggcacatttcataccatgtggcatgtaaccagaggcgctgtattgatgcatcgaggaaaaagaattgaacctagttgggctgatgtaaaaaaagacctaatttcttatggtggaggatggaaacttgagggagaatggaaagaaggtgaagaagtacaagtgctagcactagagccagggaaaaacccacgtgccgtacagacaaaaccaggattatttaaaacaaatacaggaacgattggagccgtatctctagacttttcaccaggaacgtcaggctcaccaattgtagatagaaaagggaaagtggttggcttatacgggaatggtgtagtaactagaagtggggcctatgtatcggcgatagcacaaacggagaagagtatcgaggataatcccgaaatagaagatgatatattccgtaagaaacggctaacaatcatggatttacatccaggagccggaaaaacaaaaaggtacctacccgctatcgtaagagaagccattaaaaggggattgagaacgttgatattagcaccaactcgagtcgtagcagccgaaatggaagaagccttaagaggattacctatcagataccaaacaccagcaataagagccgaacacaccggaagagaaattgttgacctaatgtgccatgcaactttcaccatgagactcttaagcccagttagagtgccaaactataaccttattattatggatgaagcccattttaccgatccagcttcaatcgccgcaagaggttatatcagtacacgagtagaaatgggagaagcagccggaatatttatgaccgcgacaccaccgggaagtagagatccatttccgcaatccaatgcaccaatcatggacgaagagcgagaaatcccggagcgttcatggaactctggtcatgagtgggtgaccgatttcaaagggaaaacagtctggtttgtgccaagcattaaggctggaaatgatattgcagcatgcctaagaaaaaatggaaagaaagtgattcaactatcgcgcaagacttttgactctgagtacgttaaaactcgtgctaacgactgggatttcgttgtcacaacagatatttctgaaatgggggccaattttcgtgccgaacgtgtaatagatccaagacgttgtatgaaaccggtcatcttaacggacggtgaggagagagtaatattagccggcccaatgccggtcactcattcgagcgctgctcaacgcagagggcggataggccgaaatcccaagaacgagaacgaccaatatatttacatgggagaaccgctagaaaatgacgaagattgtgctcattggaaggaagccaaaatgctgctagataacatcaatacaccagaggggatcatcccaagtatgttcgagccagaacgtgaaaaggtagacgctatcgacggggagtatagattgcgcggagaagcaagaaaaacatttgtagacttgatgcggcgtggtgatttacctgtctggcttgcatatagagtagccgcagaaggtataaactacgcagatagaaggtggtgcttcgatgggataaaaaacaaccagatactggaagaaaatgtagaagtggaaatatggactaaagaaggagagcgtaagaagttaaagccaaggtggctcgacgcgcgcatatatagtgacccacttgcgctgaaagaattcaaggaattcgcagctggcagaaaaagcttgaccctcaatttaatcaccgaaatgggtaggctccctacgtttatgactcagaaagctcgtgatgccctagataatcttgcagttctacacactgcggaagtgggaggacgggcatataatcatgctctatcggaattaccagagacgttggagaccctactcctattaacgctattggctaccgtaaccggagggatatttctatttcttatgagtggtaagggaataggaaaaatgactcttggaatgtgttgcattattaccgcgtcgatcttgctctggtatgctcaaatacagccacactggatagccgcaagtattatcttggaattttttctaatagtgttattaatcccagaacccgaaaaacagagaacgccgcaagataatcaactcacatacgtggttatagccattttgacagtcgttgcggctacaatggctaacgaaatgggatttcttgaaaagacaaaaaaagacttggggctgggaagtataattacacaagaaagtgaatcaaatatcttagatattgatttaagacctgcttccgcctggactttatatgcagtagctacaactttcgttacaccgatgttgcgccattctatagaaaacagcagtgtgaatgtttctttaactgcaattgcaaaccaagcgacagttctcatgggattgggccgaggttggccgttatcgaaaatggacatcggagttccattgctggctatcggctgctactcgcaagtaaatccgataacactcactgcagccctcttattactcgttgctcattatgcaatcatcggaccaggtctacaggcgaaagcaacaagagaggctcagaaacgagcggcagcgggcataatgaagaacccaacagtcgatgggataacggtgatagatttagaacctatcccatatgacccaaagtttgagaaacaattaggacaagttatgcttctggtgttatgtgtaactcaagtgctgatgatgcgtactacatgggcgctttgtgaagcattaacattagccactgggccaatatccacactttgggaaggaaacccggggaggttctggaatactacaatagccgtctctatggccaacattttccgtggatcctatctggcaggcgctggtttattgtttagtatcatgaaaaatactacgaacactagacgcggcactggtaatattggtgaaacattaggtgaaaagtggaaatccagactaaatgcattaggtaaaagtgaattccagatatataagaaatcaggaatacaggaagtagatagaaccctggcgaaagaaggaatcaaacgaggagaaacagaccaccacgctgtaagcagaggatcagcaaaattaaggtggttcgtagaacgaaatatggttacacctgaaggaaaagtggttgatttagggtgcggtagaggaggatggtcatactactgcggaggactgaaaaatgtacgtgaagtaaaaggtttaactaagggaggaccaggccatgaagagccaataccaatgtccacatacggttggaatctggttaggttacaatcaggagtcgacgtcttctttacaccacctgagaagtgtgacactctattgtgtgatattggagaatctagcccgaatccaaccatagaagcaggaagaactctaagagtactcaatttggttgaaaattggctaaataataatacccagttttgtatcaaagttctaaatccttatatgcctagcgtaattgagaaaatggagactctgcaaagaaagtacgggggagctcttgtgaggaaccctttatcgagaaactcgactcatgaaatgtactgggtctcgaatgcgactggaaacatagtatcatccgtaaatatgatatccagaatgttgatcaacaggttcacaatgaaacataaaaaagcaacatatgaaccagacgtagatctgggttcaggcacccgaaatattggtatagaaaatgaaattccaaacttggatatcataggtaagagaattgaaaaaatcaaacaggaacatgaaacaagttggcactatgaccaggatcacccctataagacttgggcttaccatggttcatacgaaacgaaacagacaggaagcgcgtcttcaatggttaatggtgtagtcagattacttaccaagccatgggacgtagtaccaatggtaacccaaatggccatgaccgatacgactccatttggacaacaacgagtatttaaggaaaaagttgatacaaggacacaagaaccgaaagagggaaccaaaaaattgatgcgaattacagctgaatggctatggaaggaattaggcaaaaaaaagacaccaaggatgtgtacacgggaagagtttaccagaaaagttagatcgaatgcagcgttaggcgcaatattcaccgacgaaaataaatggaagtccgcaagagaggcagtagaagattcgcggttctgggaacttgttgacagggaacgtaatttacacttggaagggaaatgcgaaacttgtgtgtataatatgatgggtaaacgagagaaaaagctaggagaattcggaaaagcgaaagggtcgagagcaatatggtatatgtggttaggcgcacgatttttagaatttgaagccttagggtttttaaacgaagaccattggtttagtcggggcaattcactgagcggcgtagaaggagaaggactacataaacttggatacattttaagagacgtaagtaaaaaggagggaggggctatgtatgcagacgatacggctgggtgggatacaagaataacactggaagatttaaaaaacgaagagatggtgacgaatcatatgaaaggggagcacaagaaattagcagaagcgattttcaaacttacataccagaataaggtcgtccgagtacaacggcctactccacggggtactgtaatggatataatatcacgaaaagatcaaagagggtcgggacaggtgggtacatatgggttgaacacgtttacaaacatggaagctcaattaattcgtcaaatggagggtgagggaatcttcaaaagtatacaacaccttacagttaccgaggagatagcagtacaaaactggttagcgagggtaggacgggaaagactgagcagaatggctatctccggtgatgattgcgtagttaaacctcttgacgaccgtttcgcgagtgccctcacggcattaaatgacatgggcaaagttaggaaagatatacagcaatgggagccaagtaggggttggaatgattggacacaagtccctttctgctcccatcacttccatgagctcgttatgaaagatggccgcgttcttgtagtaccgtgtagaaatcaagatgagctaattggtagagctagaatatctcaaggtgcaggttggtcattaaaggaaacagcctgtctaggaaaatcgtacgcacagatgtggactctcatgtattttcataggagagacttgcgactagcagcaaacgccatatgcagtgccgtacctagtcattgggttcctacgagtcgaacgacctggagcattcatgcaaaacatgaatggatgacaacagaagatatgttagccgtgtggaaccgagtatggatacaggaaaacccctggatggaagacaaaactccagtggaatcgtgggaggaggtcccatacttggggaaacgtgaagaccagtggtgtggatccttaattgggctaacgagtagagctacgtgggccaaaaatatacaaacggctattaaccaggtaagatcattaattgggaatgaagaatatacggattacatgccgagtatgaaaagatttcgtaaggaggaagaagaagcaggtgttttatggtaa

SEQ ID NO: 22539 - RNA, 9876 nt, synthetic construct
  misc_feature 1..9876: note = derived and/or modified CDS sequence (opt6) from DENV-2__EU482562__SS-prME
  source 1..9876: mol_type = other RNA
acagctggtgtaattatcatgttaattcccactgcaatggcatttcatcttactactagaaatggggaacctcatatgattgttggtcgccaagaaaaaggtaaatcattattatttaaaacagaagacggtgtaaatatgtgcacattaatggcaattgacttaggagaactgtgcgaagatacaattacatataaatgtcctctgttgagacaaaacgaaccagaagatattgattgttggtgtaacagcaccagtacatgggtgacgtatggaacatgtacaactactggagaacacagacgtgaaaaacgaagtgtggcattagtacctcacgtaggaatgggactagaaacacgtacagaaacttggatgtccagcgagggggcatggaaacatgtgcaaagaatagaaacgtggatactacgacacccaggttttacaattatggcagcaattcttgcgtatactattggaaccacccactttcaaagagcacttatttttatattattaactgcggtagcgccatctatgactatgcgctgtattggaatttcaaatagagattttgtagaaggggtgtctggagggtcatgggtggacatagtcttagaacatggctcatgtgtaacaaccatggccaaaaacaaaccaacgttggacttcgaattaattaaaaccgaagcaaaacaacctgctactctacggaaatattgtatagaagcaaaattaaccaatacaacaacagaatctagatgtccaacacaaggtgaaccgtccttaaacgaagaacaggacaaacgattcgtttgtaaacattcaatggttgaccgtggatggggtaacggatgtggactttttggtaaaggaggtatagtcacatgtgctatgttcacgtgcaagaaaaacatggaagggaaagtagttctaccggagaacttggaatacacgattgtaatcacaccccacagcggagaagaacatgcggtaggaaacgacaccgggaaacatggtaaagaaatcaaaataactccgcaatcatcaataactgaagcagagctaactggttacgggacggtaacgatggaatgcagtcctaggacagggttggattttaatgagatggtcctattacaaatggaagacaaagcctggcttgtacatagacagtggtttctagatttaccgctcccatggctgcccggagccgacacgcaaggctctaactggatacaaaaagaaacacttgtcacattcaaaaatccgcatgcaaagaaacaagacgtggtggtattagggtcccaagaaggagcaatgcacacagctctcactggagcaacagaaattcaaatgtcgagtgggaatctcttgtttacaggtcacctgaaatgtaggctaagaatggataagctacaattaaagggtatgtcatatagcatgtgcacgggaaaattcaaaattgtaaaagaaatagctgagacccaacacggaactatagtcattagagtgcagtatgaaggtgacggttcaccttgcaaaattccgtttgagattatggatctagagaagagacatgtccttggtagattgataactgtaaatccaatcgttacagaaaaggattctcctgtaaacattgaagcggaaccacctttcggagactcttatatcattataggcgtagaaccgggacagcttaaactgaactggttcaagaaaggatcatctatcggtcaaatgtttgagactacaatgaggggagcaaaacgtatggctatcctcggtgacaccgcttgggattttggatccctaggcggcgttttcacaagtataggcaaagccctgcatcaggtctttggagcaatatacggcgcagccttctcaggggtttcatggacaatgaagattttaatcggtgtgatcataacctggataggaatgaatagtcggagtacctcactttctgtctcgctcgttctcgttggtgtagtgatcttatatctaggagctatggtacaggccgactccggttgcgtagtctcatggaaaagcaaagaactaaagtgtggttcagggatatttatcaccgataacgttcacacatggaccgaacaatacaagtttcagcctgaatcaccctctaaattggcgtcggcaatacaaaaagcacatgaggaaggtatatgcggtataagatcagtgactcgattagaaaacctcatgtggaaacaaatcaccccggaactaaatcatatattaagtgaaaatgaagtaaaacttacaataatgacaggagatataaaaggcataatgcaagccggaaaaagaagtctacgaccccaacccaccgaactaaaatatagctggaaaacatggggaaaagctaaaatgttatcgaccgaatcacataatcagacctttctgatagatgggcctgaaactgctgaatgccccaatactaatagagcctggaatagcttggaggttgaagattatggatttggtgtttttacgacaaacatctggctaaaactgagagaaaaacaagacgttttctgcgattccaagttaatgtccgctgcaatcaaagataatagggcagtacatgctgatatgggttattggatagaatcggcgttgaatgatacatggaagatggaaaaagcatcgtttatagaagtaaaaagttgtcattggcctaagtcccacacgctctggtcaaacggtgtactggaaagtgaaatgattataccaaagaattttgcggggcctgtatcccaacataattatcgaccaggatatcatactcaaacagcagggccatggcacctaggcaaactcgagatggacttcgatttttgtgaggggactacggttgtggtaacagaagactgtggcaaccgagggccatcattgagaacgactacagcaagcggtaagctcattacagagtggtgctgcagaagttgtactctacctccattaaggtatcgcggtgaagatgggtgttggtacggaatggaaatcagaccacttaaggagaaagaggagaacttagttaacagcttagttaccgctggacatgggcaaatcgataatttttcgctaggagttctcggtatggccctatttctggaagaaatgctcagaacgagagtaggcaccaaacacgcaatactattagttgcggtcagctttgttacgttgataactggtaatatgtcttttcgtgaccttggtagagtgatggtcatggtcggagcaaccatgactgacgacattggaatgggggtgacttatctagcattactagcagcattcaaagtgaggccaacctttgcagcgggtctactactaagaaagttgaccagtaaggaattaatgatggcaacgataggcatagcactcctaagtcaatcaactatacctgaaacgatattggaattgactgatgcgctggctttaggcatgatggtactgaaaatcgtacggaatatggaaaagtaccaattagccgttaccataatggctatttcctgcgtgcccaacgctgtcatactgcaaaacgcttggaaggtatcgtgcacgatccttgcagcagtgagtgttagcccattactattgacatctagtcaacaaaaagcggattggataccactggcactcaccataaaaggacttaacccaacagcaattttcttaaccacgctgtctagaacctctaagaaacgatcttggccactcaatgaggcaataatggctgtaggaatggtttccatactagctagttctctcctcaaaaatgatatacctatgacaggtcctctggtggccggtggtttgctgaccgtatgctacgtgctaacaggtagatcagcagacctagaattggaacgggcagcagatgtgaaatgggaagaccaggcggagatatctggatcatcacctatactctcaataactatttctgaagatggatccatgtccattaaaaacgaagaggaagaacaaaccctgacaatcttaataagaactggactcttagttatttcaggtgtattcccggtctctatccccatcacagccgcagcatggtatctctgggaagtaaagaagcagagagcaggggtattatgggatgtaccatctcctccgccagtaggcaaagcagagcttgaagatggagcttatcgaatcaaacaacgtggaatattaggatatagtcaaatcggcgctggggtatacaaggagggaacattccacaccatgtggcacgtaacaagaggcgcggtattgatgcaccggggaaaaagaatagaacctagttgggccgacgtcaagaaagacctgatctcatatggtggtggttggaaactagaaggagaatggaaagaaggggaagaagtacaagttttagcgttggaacctgggaaaaacccaagggcagtacaaacaaagcccggactgttcaagactaataccggtacaataggtgcagtttcacttgactttagtccaggtacaagtggcagtcctattgttgataggaaagggaaagtagtggggctttacggcaacggtgtggttacgcgctctggagcatatgtatcagcgatagcacaaacggaaaaatcgattgaagataacccagaaatagaagacgacatatttagaaagaaacggttgaccataatggatcttcacccaggagcaggcaaaaccaaacgatacttgccagcaatagtaagagaagcaataaaacgaggattaaggacattaatactcgctcctacaagagtagtagcggctgaaatggaggaagccttacgagggctacctatcagataccaaactcctgcaatacgcgcagaacatacggggagagaaatagttgatcttatgtgccacgcgacttttactatgagacttttaagtcctgtacgagtcccaaattataatttaataataatggacgaagcgcactttacggatcccgcaagtatagctgcaaggggctatatcagcacaagagtagagatgggggaagctgccgggatattcatgacggccacaccacccggcagcagggacccatttccacagagcaacgccccgattatggacgaagaacgagaaataccggaaaggagctggaacagtggtcacgaatgggtcactgatttcaaaggaaaaacagtatggttcgttccaagcataaaagctggaaatgacatcgcagcttgcttaaggaaaaacggaaagaaggttatccaattatcgagaaaaacatttgattctgaatatgtcaagactcgtgctaatgactgggattttgtggtaacgacagatataagcgaaatgggagctaactttaaggctgagcgagttattgatccacgtcgatgtatgaaacccgtaatattgactgacggggaagaaagagtaattctcgcgggaccgatgccagttactcattcgtctgctgcgcagaggagaggaagaataggaagaaatccgaaaaacgaaaatgaccagtacatttatatgggcgagccgttagaaaatgacgaagattgcgcacactggaaagaagcgaaaatgctactagataatattaataccccggaagggataataccatcaatgttcgagcctgaacgggaaaaggtggatgcaatagatggtgagtatcgcttacggggagaagcgagaaaaactttcgttgatcttatgagaagaggggaccttcccgtatggctagcatatagagtcgctgccgaaggaatcaattacgcggatagacgctggtgttttgatggaatcaaaaataatcaaatactggaggagaacgtagaagtcgaaatttggacaaaagaaggggaaaggaagaaactgaaaccgagatggctcgacgctaggatatatagcgatcccttagcacttaaggaatttaaagaatttgcagcaggcaggaaatctttaacgcttaacctgataactgagatgggacgtttacctacatttatgacacaaaaggcccgtgacgccttggacaatttggctgtattacataccgctgaagctggagggcgcgcgtataaccatgcattatctgaattacctgaaacattagaaactttactgctattaactttgctagcgactgtcacgggtggtatctttttatttttaatgtccggtaaaggaattggcaaaatgacactgggaatgtgctgtataataacagctagtatattattgtggtacgcacaaatacaacctcattggatagccgcatccattatactcgagttctttctaatagttttactaataccggaaccagaaaaacaaagaactccgcaggataatcaattgacttatgtcgtaattgcaatcttaacggtagttgcagctacaatggcgaatgaaatggggtttttagagaaaacgaagaaggatttaggattaggttcaataaccacacaagaatcggaaagtaacattctagacatagatctccgacctgctagtgcttggacactatatgcagtagccactaccttcgtaacaccaatgctgcggcattcaatagaaaacagcagtgtgaatgtctctctgactgcaatagcaaaccaagcgacagtattaatgggattgggaaaaggatggccgctaagcaagatggatataggtgtaccacttctagccataggatgttactcacaggtaaacccgataacactaacagcggcactactattattagtagcacattacgctattatagggcccgggttacaagctaaagcaacccgggaagcacagaaaagagccgctgcaggtattatgaagaatcccaccgtagatggtattacagttattgatttggagccaataccatatgacccaaagtttgaaaaacaactaggccaagtcatgttgctcatactatgcgttactcaggttctaatgatgagaacgacatgggcactttgtgaagctcttacgttagctacaggaccaatatcaacattgtgggaaggaaaccccgggagattctggaacacgacgattgcggtaagtatggcgaatatattccgtggtagctacttagccggagctgggttactgttctctattatgaaaaacactacgaacacgaggagaggaactggaaacatcggggaaacgttaggggagaaatggaagtcaagattgaatgcattaggaaaaagtgaatttcagatatataagaaaagtggaatccaagaagttgatcgaactttggcaaaagaaggcataaaaagaggggagacagaccaccatgcagtctcacggggttccgcgaaactgcgatggttcgtagaacgaaacatggtaacacccgaaggcaaagtagttgatctaggttgtggcaggggtggatggtcttattattgtgggggactaaagaacgtaagggaagtaaaagggttaacaaaaggaggtcccggccacgaagaacctataccgatgtcgacttatggctggaacttagtgagattacaatcaggagttgacgtgttctttaccccacctgaaaaatgtgatactcttctctgtgatatcggagaaagttcacccaatccaacaatagaagccggaaggactctgcgagtgctaaatttagttgaaaattggttgaataataatacgcaattctgtatcaaagtactgaacccatacatgccctcagttatagagaaaatggagacgctacaaagaaaatatggaggggcgttagtcagaaaccccttatcccgtaattccacccacgaaatgtactgggtctcaaatgcaaccggtaacattgttagtagcgtcaacatgatatcacgaatgctaataaacaggttcacgatgaaacataagaaagctacatacgagccagatgtggatcttgggagtggcacaagaaatatagggatagaatctgaaattcctaacttagacattataggcaaaaggatagagaaaataaagcaagagcatgaaacttcgtggcattatgatcaagaccatccatataaaacatgggcatatcatggtagttatgaaacaaaacagacaggaagcgcatcttttatggtaaatggagtggtaagactactcactaaaccttgggacgtcgtacctatggtcacgcaaatggcaatgacggatacaacaccatttggccaacagagggtgttcaaagaaaaggtggacacaaggacgcaagaacctaaagaagggactaagaaacttatgaaaattaccgctgaatggctatggaaggaactggggaagaagaaaacgccgagaatgtgtactagggaggaatttacccgtaaagttagaagtaacgcggcattgggggcgatatttacagatgagaataagtggaaaagcgcgagagaggcagtggaagactcaaggttctgggagttgatagatcgagaacggaatctacatctcgaaggaaaatgtgaaacttgcgtttataacatgatgggtaaacgagagaagaaattaggggagttcgggaaagcgaaaggtagcagagcaatatggtatatgtggttaggtgcaagattcctagaatttgaggccctaggcttcctaaatgaagaccattggttctcacgcggcaactccctcagtggtgttgaaggcgaaggattacatcgcttgggatatatcttaagagatgtcagtaagaaagaaggaggtgctatgtacgcagatgacacagcagggtgggacacccgtataactttagaagatttaaagaacgaagagatggtaacaaatcacatgaaaggggaacacaagaaattagccgaagcgatttttaaactgacatatcaaaataaagtagtacgagtacagcggcccactccccgtggcacagtgatggatataatctcacgaagagaccaacggggaagcggacaagtaggtacttacggactaaatacatttaccaatatggaggcacagctaatccgacaaatggagggcgaaggcatattcaaaagtatacagcatttaacagttacagaagaaatagcagtacaaaattggcttgccagagtgggtagagaacggttatcccgtatggcaatttcgggcgacgactgtgtcgtcaaaccattagatgacagattcgccagtgcgcttacagctttaaacgatatggggaaagtacgcaaagacattcaacagtgggaaccgtctagaggatggaatgattggacacaagtcccgttttgcagtcaccatttccacgagttagtaatgaaagatggtagagtccttgtcgttccatgtagaaaccaggatgaactgataggacgagcccgcatttcccaaggtgcaggttggagcttaaaagaaacagcctgtttgggaaaatcatacgctcaaatgtggaccttaatgtactttcatcgtagagatctgagactcgctgcaaacgctatatgcagtgccgtaccaagccattgggtcccgaccagccgtacaacatggagtatacacgccaaacatgaatggatgacaaccgaggacatgctagccgtatggaatcgcgtttggatacaagaaaacccctggatggaggataaaacccctgttgagagctgggaggaagtaccctacctaggaaaacgggaagatcagtggtgtggatctttaattggattgacaagtagagcaacctgggccaaaaatattcaaacagccataaatcaagtaagaagtttaataggcaacgaagagtataccgactatatgccttccatgaagagatttcgtcgagaagaagaagaagccggtgtactctggtaa

SEQ ID NO: 22540 - RNA, 9876 nt, synthetic construct
  misc_feature 1..9876: note = derived and/or modified CDS sequence (opt6) from DENV-2__EU482565__SS-prME
  source 1..9876: mol_type = other RNA
acagcgggagttataataatgctaatcccaacagcaatggcatttcacctaaccacaagaaacggagaaccacatatgatagttggaagacaagaaaaaggtaaatcattactatttaaaacggaagatggagttaacatgtgcacactaatggcaattgacttaggcgaattgtgcgaagatacaataacatacaaatgtccactccttcgccaaaacgaacctgaagatatcgactgttggtgcaactctacatccacttgggttacttatggaacatgcacaacaactggtgagcacagaagagagaaaagatctgtagcattagtacctcacgtgggtatgggattagaaaccagaacagaaacttggatgtctagtgaaggtgcttggaaacacgtccagaggatcgaaacatggattttaagacacccaggattcactattatggcagctattctagcttatacaattggcaccacgcattttcaacgggctttaatcttcatattgcttaccgcggtggcacctagtatgacaatgcggtgtattggtattagtaatcgggatttcgttgaaggggtttctggtggtagttgggtggatatcgttttggaacatggctcatgtgttacaacaatggcgaaaaataaaccgaccctcgatttcgaacttataaaaacagaagcaaaacaaccagctacattaaggaaatattgcatagaagctaaactaacgaatactaccacagaatctcgatgtccaacacaaggggaaccatcactaaacgaggaacaagataaacgatttatctgcaaacatagcatggttgacagaggttggggaaatggttgtggtttatttggaaaaggtggaatagtaacatgtgcgatgttcacgtgtaagaaaaatatggaaggtaaagtggtcttacctgaaaatctagaatacaccatcgtgataactccacatagtggcgaggaacacgcggtaggaaacgataccggaaaacatggaaaagaaataaaaatcacacctcaatcctcaataaccgaggctgagttaaccggttatggaacagtaacaatggagtgttcccctcgaacggggctcgattttaacgaaatggtcctactccagatggaagataaagcatggctggtacaccgccaatggtttctagaccttccactgccgtggctgccaggtgctgacactcaaggctcgaactggattcagaaagagaccttagtaacctttaaaaatccacatgccaagaaacaagatgttgtagtcctcggcagtcaagaaggcgccatgcatactgccctaacaggagcaaccgaaatacaaatgtcctctgggaatttattattcacgggtcacctaaagtgtcgtttgaggatggacaaattgcaactaaaaggtatgagttatagtatgtgtactggaaaattcaagatagtaaaggaaatagccgaaacacagcatggtacaatcgtgattcgtgtacaatatgaaggtgatggctcaccatgcaaaattccatttgagataatggatttagagaaacgacacatcctaggacgtctaataaccgtaaatccaatagtaactgaaaaagattcacccgtgaatattgaggcggaacctcctttcggtgacagttatattattataggcgtcgagccaggacaattaaagctaaattggttcaagaaaggatcaagtatagggcaaatgttcgaaacaacaatgaggggcgcgaaacgaatggcgatattgggcgatacagcttgggactttggtagcctgggaggagtatttacatctattggaaaagcccttcaccaagtatttggtgcaatttacggtgctgctttttcaggcgtatcctggactatgaaaatacttataggagtaattattacatggataggtatgaactcgaggagtacatcattatcagtttccctagtattagttggcgttgtaacgctgtatctgggcgttatggtgcaagcagatagtggatgcgtggttagctggaaaaataaggaactcaaatgtggtagtggtatttttataactgacaatgtacatacctggaccgaacaatataaattccaaccagaatctccaccaaagctagcttctgcaatccagaaagcgcacgaagaagggatatgcggaataagaagcgttacaagactggaaaatttaatgtggaaacagatcacaccggagttgaatcacatcctatcagaaaacgaagtaaaactcacgataatgacaggcgatataaaaggcataatgcaagcaggaaaaagaagtttacggccacaaccgacagaactaaagtatagttggaaaacttggggaaaggcaaaaatgctaagcacagagtctcataaccagacatttttaattgatggaccagaaacagcagagtgtccgaataccaaccgagcatggaactcattggaagtggaggactatggattcggagtatttagcaccaatatttggcttaagctcagagagaagcaagatgtattttgcgacagcaaattaatgtctgcagcgataaaagacaatagagctgtccatgctgacatgggctactggattgaatccgcgctcaatgatacctggaaaatggagaaggccagcttcatcgaggttaaaagttgtcattggccgaagtcacatacgttatggtcaaatggtgtgttggaaagcgagatgattatccccaaaaattttgccggcccagtaagccaacataattatagacctggttatcacacgcagacagccggaccttggcacctgggcaaattggaaatggactttgatttttgtgaaggtacaacagttgttgttacagaagattgtggaaaccgtggccccagcttacgtactaccaccgcttcgggcaaactaattactgaatggtgttgtcgttcttgtacgttaccaccgttaaggtataggggagaagatggatgttggtatggtatggagataagaccccttaaagagaaagaagaaaacctagtcaacagccttgtaacagcgggtcacggtcaaatagacaatttttcacttggcgtcttaggtatggctctattccttgaggaaatgctcagaactcgggtaggcacgaagcatgcaatcctattagtagccgtcagctttgtaacactaatcacaggaaacatgagtttccgtgatctgggccgagtaatggtaatggtaggagcaactatgactgacgacataggcatgggagttacatatttagctttactagccgcatttaaagtccgaccgacctttgcagctgggctactgttaagaaaattgaccagcaaggaactaatgatggccacaataggtatcgctctactatcgcaatctactattccagaaacgattcttgaattaactgacgcactcgccttaggcatgatggtcttaaaaatagtgcgaaatatggaaaaataccagctggcagtcacaatcatggctataagctgcgtacctaacgccgtaattctacagaatgcttggaaagtcagctgcactatactagctgctgtctcagttagccctcttctactcacttcctcacaacaaaaagcagactggatcccattagcactcacaataaagggactgaatcctaccgcgatatttttaactactctttcgaggacttcgaagaaaagaagttggccattaaatgaagcggtcatggcagtaggcatggtgagtatactggcttcgagcctcctgaaaaatgacattccaatgacaggaccattagttgcagggggactactaactgtctgctatgtgttgactggtaggtccgctgatctagaattagagagagcagctgatgtaaaatgggaagaccaagcggaaatatctggatcatcacccattctatcaataactatttccgaagacggttcaatgagcatcaaaaatgaggaagaagaacacaccctaacaattcttattagaacgggccttctagtgatttcgggcgtattccctgtctcaataccgattactgctgcagcttggtatctttgggaggtcaagaaacaacgagcaggggttttatgggatgttccatcaccccctccggtgggtaaagcagaactagaagatggagcctatcgaatcaaacaaaggggtatatttggatactcacagataggtgctggagtgtataaagaaggcaccttccacacgatgtggcatgtaacgagaggagcagtattaatgcatcgaggaaaacgaattgaaccttcatgggctgatgtcaagaaagatcttataagctacggcggaggatggaaactagagggcgaatggaaggaaggagaggaggtgcaggttctcgctttggaaccaggaaagaatccaagggcagtccagacaaaacctggactgttcaaaaccaatacaggtacaataggggccgttagtttagacttcagccctggtacaagtggatccccaatcgttgatagaaagggcaaagtggtaggtctatacggcaatggagtagtgacacggtcaggtgcttacgtatcagcaatcgcacaaacagagaaaagcatagaggataatccagaaattgaagatgacatttttagaaagaaacggctgacaataatggacctacatccaggggctggaaaaacaaagaggtatctacccgcaatagtaagagaagctataaaaagaggcttgcgaacattgatactagcaccaacgagggtagtcgcagcagaaatggaagaagcgctaagaggcctaccgattcgatatcagactcctgctatccgtgcagaacacacagggagagaaattgtagacttgatgtgtcatgccacatttaccatgcgattactttcaccagtcagagttccaaattacaatttaataattatggatgaagcccattttacggacccagcgtctattgcagcgagaggatacatctccacacgtgttgaaatgggggaagcagctggtatttttatgacagcaactccgcccggatcccgggatccgtttccacaaagtaatgcgcctattatggatgaagaaagagaaatccccgaaagatcctggaactcgggacatgaatgggttacagatttcaaaggaaaaacagtttggttcgtgccttccatcaaagcaggtaatgatatagctgcatgtttaaggaaaaatgggaagaaagttattcaattatctaggaaaacgtttgattcagaatacgtgaaaactagggctaatgattgggactttgtagttactactgacatatcagagatgggagcaaatttcagagcggaaagagttatcgaccctcgcagatgtatgaaaccagtaattctaacagacggagaagaacgagtaatattagcgggccctatgcccgttacacactcttcagcagcacaacggagagggcgtataggtcgtaatccaaagaatgagaatgatcagtatatatacatgggcgagcccttagagaatgatgaagactgtgcacattggaaagaagccaaaatgttacttgataatattaatactcctgaaggcatcattccatctatgtttgagcctgaaagagagaaagtggatgcaatcgatggggagtacagattacgaggcgaggctagaaaaaccttcgtagatttaatgcgtcgcggagacttaccagtatggttagcctacagagtcgccgcagaaggcattaattatgccgatagacgatggtgcttcgacggaattaagaataatcaaattctagaagaaaacgttgaagttgagatctggacgaaagagggagaacggaagaaactaaaaccccgatggttggacgctcgaatatatagtgatccgctagcgcttaaagagtttaaagaatttgcagcggggagaaaaagcctaacactcaatctgataactgaaatgggaagattaccaacgtttatgacgcaaaaagcaagagacgcgttggacaatttggccgttttacatacagcagaagtaggtggcagagcttacaatcatgcattgtcggaactccccgagaccctggaaacactcctattactcactctattagcaaccgttacaggcggtatatttctttttctaatgtcaggtaagggaataggaaagatgacgctggggatgtgctgcattataaccgcctccatactattgtggtacgcacaaattcaaccacattggattgcagcttcaatcatacttgagttctttctaatcgtgctactaattccggaacctgaaaaacaaagaacaccacaagataaccaattaacatacgtagtaatcgcaattttaactgttgtagccgcaacaatggccaacgaaatgggattccttgagaaaacgaagaaagatttggggcttggaagtattactacccaagaaccagaatcaaatattcttgacatagacttgagacccgcatccgcatggactctatatgcagttgcaaccacatttgtgacaccaatgctgagacacagcatcgaaaatagtagcgttaatgtatcgctaacggcgatagctaatcaagctactgttttaatgggtctaggacgagggtggccattatccaaaatggatattggtgtccccttactagccataggctgttactcacaagtcaacccaatcacactcactgcagcattgttactcctagttgcacattacgccataattggtccaggactacaagcgaaagcaactagagaggctcaaaagagagccgcggccggtattatgaaaaatcctaccgtagatgggattaccgttattgacttagaacccataccatatgacccaaagtttgagaaacaattgggtcaagttatgttattggtcttatgtgtgacacaagtattaatgatgcgcactacctgggcactatgtgaagcattaacattggcaacgggtccaatctccactttatgggaaggtaacccaggacgcttctggaatactacaatcgcagtttcgatggcaaatattttccgcggatcctatttagcgggggcaggacttttattctcaattatgaagaatactactaacacacgacgggggaccggaaatataggtgaaacgttaggagaaaagtggaaatctagactaaacgctctagggaaaagtgagtttcagatttataaaaagtctggcatccaagaggtagataggaccctcgctaaagaaggtataaaaagaggggaaaccgatcaccatgcagtatctagaggtagtgcaaaattgagatggtttgtagaacgcaatatggtcactcccgaagggaaagttgtggacttgggatgtggacgaggcgggtggtcctattactgtgggggactaaagaatgttagagaagtaaaaggactcactaaaggagggccaggtcacgaggaacccatacccatgtcaacgtatgggtggaacttagtcaggttgcaatcgggcgtggacgtatttttcacaccccctgagaaatgtgatacactattatgtgatattggtgagtccagtccgaacccaacaatagaagctgggcgaactttaagagtgttgaacctcgtggaaaattggcttaacaataacacgcaattttgtattaaagttttaaatccatatatgccaagcgtaatagaaaagatggaaacacttcagcgtaaatacggtggcgctttagttcgaaatccattaagtagaaattcgactcatgagatgtattgggtttcaaatgctacaggaaatatagtcagttcagtaaacatgatatctcgaatgttgataaacagattcactatgaaacataagaaagcgacctacgaacctgatgtagatctcggtagtggaaccagaaacgtggggattgaaaacgaaatacccaatttagatatcataggaaaacgtatagagaaaataaaacaagagcacgaaacgtcctggcattacgatcaagaccacccatacaaaacgtgggcgtaccacggttcatacgagaccaaacaaacgggatcggctagcagcatggtcaatggcgtagtacgattgctaacaaaaccatgggatgtcgttccgatggtgacacaaatggccatgacggataccactccctttggtcaacaaagggtattcaaagaaaaagtagatactagaactcaggaaccaaaagagggtacgaagaagctcatgagaataacggctgaatggctgtggaaagaattaggtaagaagaaaacaccgagaatgtgtacacgggaagaatttacccgtaaagtacgatcaaatgcagcactaggtgcaatattcacggacgagaataagtggaaatctgcacgagaagccgttgaagactcccggttctgggaattggtcgatcgagaacggaatttgcatttggagggtaaatgcgagacatgcgtatacaatatgatggggaaaagggagaagaaattaggggagttcggcaaagcaaagggatcaagagcaatttggtatatgtggctcggagctcgcttcctagaatttgaggcactcgggtttctaaatgaagaccattggtttagcagaggaaattcactaagtggagtcgaaggtgagggcctccacaaactaggttatatactccgagatgtgtcaaagaaagagggaggagcaatgtatgcagacgatacagcaggatgggacactagaataaccttggaagatctcaaaaatgaggaaatggtcacaaatcacatgaaaggagaacataaaaagctagcagaagctattttcaaacttacataccaaaacaaagtggttcgagtccaaaggcctacgccccgtggaacagtaatggatatcatttcgcgaaaagatcaaagaggatcaggccaagttggtacatacgggctaaatacttttactaacatggaagcccagttaatacggcagatggaaggggaaggcattttcaaatcaatacaacgattaacggtaaccgaagagattgcggttcagaattggctagcccgagtgggtcgcgagcgtttatcgaggatggcaataagcggagatgattgcgtagtaaaaccacttgatgatcggtttgcaagtgcattaactgcacttaacgacatgggaaaggtacgtaaagatatacaacaatgggaaccatcaaggggttggaatgactggactcaggtacctttttgtagccatcatttccatgaactggtgatgaaagatgggagagttctcgtagttccctgcagaaaccaagatgagctgataggacgggctcggattagtcaaggtgccggatggagcttgaaagaaacagcttgtcttggcaaaagctatgcccaaatgtggactctcatgtatttccacagacgagatcttcggctcgctgccaatgcgatctgttctgccgtgccatctcattgggtaccgacatcgagaactacatggtctatccatgcaaaacacgaatggatgacaacagaggacatgctcgcggtctggaatagagtatggatccaagaaaatccttggatggaggacaaaacaccagtggaatcctgggaagaggttccatacctgggaaaaagggaagaccaatggtgtggcagcttgattggtctgacaagtcgtgcaacctgggccaaaaatatacaaacagcaataaaccaggttcgtagtttaattggaaacgaagagtacacagattacatgcccagtatgaaaaggttcaggaaagaggaggaagaagcaggggttctatggtaa

SEQ ID NO: 22541 - RNA, 9876 nt, synthetic construct
  misc_feature 1..9876: note = derived and/or modified CDS sequence (opt6) from DENV-2__EU529700__SS-prME
  source 1..9876: mol_type = other RNA
actgcgggagttattataatgctaattccaacggctatggctttccatctgacgacacgaaatggtgaaccgcatatgatagtaggacgacaggaaaaaggtaaaagtcttttgttcaaaaccgaagatggagtgaatatgtgtactttaatggcaatagatctaggtgaattgtgtgaagataccataacatataaatgccctctcctccgacaaaatgaaccagaagatatagactgttggtgcaactcaacgtcaacctgggtgacatacggaacgtgtacaacaacaggtgaacacagaagagagaaaagatcagttgctcttgttccgcatgtcgggatgggactcgaaacaagaacagaaacttggatgagctcagagggggcctggaaacacgtgcaaagaatagaaacttggattctacgccatcccggattcacaataatggcggcgattctagcctatacgatagggacaacgcattttcagagagcgctaatttttattctacttacggccgtagccccttcaatgactatgcggtgtatcgggatatccaacagagatttcgttgagggcgtaagtggcgggagttgggtcgatattgtccttgaacatggatcatgtgtaacgacaatggccaaaaataaacccacattagattttgaacttattaaaactgaagctaaacagcccgccaccttacgcaaatattgtatcgaagccaaattaactaatacaacaacagaatctagatgcccaacacagggagaaccaagcctaaacgaagaacaggacaaacgatttatatgcaaacattcgatggtagacaggggttggggaaacgggtgcgggctctttggaaagggaggaatcgtgacctgcgccatgtttacgtgtaagaaaaatatggaggggaaagttgtcctgcccgagaatttagagtacacaatcgtaatcacgcctcacagcggggaggaacacgcagtaggaaacgatacaggaaaacacggaaaagaaataaagataacccctcaaagcagtattacagaagcagaactgacaggttacggtacagttactatggagtgttctccaaggaccggacttgacttcaacgagatggtgctgttacaaatggaagataaagcctggttagtacaccgacaatggttcttggatctcccattaccatggctccccggagctgatacccaaggatcaaattggatacaaaaagagacgcttgttaccttcaagaatccccacgctaaaaagcaggatgtcgttgtccttggaagtcaagagggagctatgcacaccgcgctcacaggagctaccgaaattcaaatgtctagtggcaatcttttgttcacgggtcatctcaaatgtagacttagaatggacaaattacagcttaagggaatgtcttattcaatgtgtacaggtaagttcaaaattgtaaaagaaatagcagaaactcaacatggtacgatcgtcattagggtccaatacgaaggagatgggtcaccatgtaaaatcccatttgagattatggatcttgaaaaacggcacgtcctaggaaggctaataacagttaatcccatcgtaacggagaaagacagccctgtgaatattgaagcagaaccaccttttggagacagttatataataataggagtagaaccaggacaacttaaattaaattggttcaagaaagggtcctctataggacaaatgttcgaaacaaccatgcgtggagccaagagaatggcaatattaggagacacagcatgggattttggcagtttgggaggcgtatttacctcaatcgggaaagcattgcatcaagtttttggagctatatacggcgcggctttttctggagttagttggacaatgaaaattttaattggtgtaattatcacatggataggcatgaactcgaggtctacctcgttgagcgtaagcctagtcctagtgggcgtagtaactttatatttaggtgttatggtccaagctgactctggatgcgttgtcagttggaaaaacaaggaattgaaatgtggaagtggtatctttattacagacaacgtgcatacatggacagagcaatacaagtttcaacctgaatcacccagtaagctagcgtctgcaattcaaaaagctcatgaggaagggatatgcggtatacgttcagtaacgagactcgaaaatttaatgtggaaacaaataacacctgaactaaaccatatattaagtgaaaacgaagtaaaactaacgataatgactggagacataaaaggaattatgcaagctggcaaacgttcattgcgaccacaacccacggaattaaaatatagttggaaaacttggggaaaagcaaaaatgctatccacggagagccataatcagacctttttaattgacggcccggagaccgccgaatgtcctaatactaaccgagcatggaatagcttagaagtagaagattacggctttggcgtattttccacaaatatatggctgaagctaagagagaaacaggacgtattctgcgattcaaaactcatgagtgcagcgataaaagataatagggcagttcatgcggatatggggtattggattgaaagcgccttaaatgatacatggaaaatggaaaaagcgtcatttatcgaagtgaaatcatgtcactggcctaagtcacatactctttggtcaaacggagtactcgaaagtgaaatgataatccctaaaaatttcgctggcccagtatcacaacataattatagaccaggctaccatactcaaactgcaggtccatggcacctgggaaaattggaaatggatttcgacttttgtgaaggaactacggtggtagtaaccgaagactgtggtaacagagggccaagtctcagaacgacaactgccagcggtaagttaataacggaatggtgttgtcgaagttgtacgctaccacccttgcggtacagaggtgaggatggatgctggtacggtatggagatacgaccacttaaagaaaaggaggagaacttagtcaatagtcttgtaactgcgggtcatggccaaatagacaacttcagtttaggtgtgctaggcatggcgctctttcttgaagagatgctaaggacccgggtagggacgaaacatgcaatcttacttgtagcggtcagtttcgtcaccttaatcacagggaatatgagttttcgggatctaggaagagttatggtaatggtcggcgctactatgaccgacgatattggaatgggagttacttacttagccttgctagcagcctttaaagttaggcctaccttcgcagcggggttacttttaagaaaattaacaagtaaagaacttatgatggccactattggaatagcattgctttcacaaagcaccattcctgaaactatacttgaactaacagacgcattagctctaggaatgatggttcttaaaatagtacggaacctcgaaaaatatcaacttgcagtgacaattatggccatatcgtgtgtaccaaatgcagttatactccaaaatgcatggaaagtatcgtgcactatcctcgcagccgtaagtgtatcgccacttttactcacttcttctcaacaaaaagccgattggataccgttagcgctcacgattaaaggtttgaaccctactgccatattcctaacaacactaagtcggacatcgaaaaagagatcttggcccttgaacgaggctgtcatggccgttgggatggtttcaatcttagcttcgtcgttactcaaaaatgatataccaatgactggccctctagttgctggtggacttctaacagtatgttatgtattaaccggacgaagtgcggacttagaactcgaaagggcagcagatgtaaagtgggaagaccaggcagagataagcgggagttcacccatcctgagcataactatatcagaggacggctcgatgtcgattaaaaatgaagaagaagaacagactcttaccatattaataagaaccggactcttagtaatttctggcgtatttccagtctcgattccaatcactgcagccgcctggtatttatgggaagtaaagaaacaacgcgcgggggtactgtgggatgttccatcaccaccaccggtcggaaaagcagaattagaggatggagcatatagaataaaacaacgaggcatctttggttactcacaaatcggagccggtgtatacaaagagggtacattccacacaatgtggcacgtaactagaggtgcagtcttaatgcacagaggtaagcggatagagcctagttgggctgacgtgaagaaggatctaataagctatggtgggggttggaaattagagggagagtggaaagaaggggaagaagttcaagtgttagcattagagccgggcaagaatccaagagctgttcaaacaaaacccggactgtttaagacaaatacaggtacaattggggcagtatcactagacttttcacctgggacttccggtagtcccatagtcgataggaaaggaaaagtagtgggtctatatggaaatggtgttgtgactcggtccggagcatacgtatctgcgattgcccaaactgaaaaatcaatcgaagataaccccgaaattgaagacgatatatttcgtaagaaacgattaactattatggatttacacccaggggcaggtaagacaaagcgatatttacctgcgatagtacgtgaggctataaaaagaggactacggacacttatactagcgccaacgagggtagtagctgcagagatggaagaagctctaagaggactacctataaggtaccaaactccagcaatccgggcggaacatactgggagggagatagttgacttaatgtgtcatgccacgtttactatgagattattaagcccagtcagggtcccaaattataaccttatcattatggatgaagctcacttcacagatccagcaagtatcgctgcacggggatatataagcactagggtggaaatgggcgaagcagccggaatattcatgaccgcgacacctccaggaagccgtgatccatttcctcaaagtaacgctcccatcatggacgaggaacgggaaatccccgagcgatcatggaactcaggtcatgaatgggtaacagattttaagggaaaaactgtatggtttgtaccgtctattaaagccggtaatgatatcgccgcatgtttaaggaaaaatggcaagaaagtaatccaactcagtcggaagacttttgattccgaatatgtaaagacgcgagcaaatgattgggatttcgtagttactactgatatcagcgaaatgggtgctaattttagagccgaacgagtaattgatccgagaaggtgtatgaaaccagttatattaaccgatggagaggagcgcgttattctagcaggcccaatgccggtaacacattcaagcgctgcacagaggcgaggacgtataggcagaaatcccaaaaatgaaaacgatcaatacatttatatgggggaacctctagaaaatgatgaggattgcgcacattggaaagaggctaaaatgttattggataatataaatacaccagaagggataattccaagtatgtttgaacccgaaagagaaaaggttgacgcaatagatggtgaatatcgtctacgtggcgaagcgcgaaaaacttttgttgaccttatgaggcgtggggatcttccagtatggttagcctatcgggtagcagcagaaggcataaactacgccgacagacgttggtgctttgacggaattaagaacaatcagattctggaagaaaatgtcgaggtagaaatctggacaaaggagggggaacgtaagaaactaaaacccaggtggctagatgcccgcatttactcagatccattagctttaaaggagttcaaagaatttgctgcaggacgaaaaagccttactttgaatctcattacagaaatgggccgtttacctactttcatgactcaaaaagcccgcgacgcactagacaatttagccgtgttgcacacggcagaggtaggtggtcgcgcatataatcacgctctatcagagttaccggaaactttggagacattattattgcttactttgctcgctacagtaacgggaggaatcttcctatttctgatgagtggaaagggaattgggaaaatgacattaggcatgtgctgcatcatcacggcctccatattactatggtatgcacaaattcaaccacattggatagcggccagtataatactagaatttttcttaatcgtactactgataccagaacccgaaaaacaaagaacaccacaggataaccagttaacctatgttgtaatagcaatactcactgtcgtagcagccaccatggcaaacgaaatggggtttttggagaaaaccaagaaagaccttgggttaggatcgataaccacacaggaaagtgagtccaacatactagatatagatctaaggcctgccagtgcttggactctctatgcagtggcaacaacttttgtgacaccaatgttaagacatagtatcgagaacagtagcgttaatgttagtttaactgctattgcgaatcaggcgactgtcctgatgggattaggcagaggatggcccctatccaaaatggacataggcgtaccactgttggccataggatgctactctcaggtaaacccaataacgcttacagcagccttactgttattagtagcacattacgcgataataggccctggactacaggccaaggcgaccagagaagcacagaaaagagcagcagcgggtataatgaaaaaccccaccgtagatggaataacagtaattgatttagaaccaataccatatgatcccaaatttgaaaaacaactaggacaagtaatgctattggttttatgtgttacgcaagtactcatgatgcgcacaacatgggccttgtgtgaagctctaacactagccactggtccaatttcgacactatgggaaggtaatccaggaaggttttggaatacgacgatcgcagtatcgatggccaacatttttaggggaagctaccttgcaggagctggacttttatttagcataatgaaaaacacaaccaacacaaggagagggacaggcaatatcggtgaaactctgggagagaaatggaaaagtagattaaatgcactgggaaagagtgaatttcaaatatacaagaaatcaggtattcaagaagtagatcgcactctggcaaaagagggaattaaaagaggtgaaaccgatcatcatgctgtctctagaggttcggcgaaactaaggtggtttgtcgaacgaaacatggttacaccggaaggaaaggtagtagatttaggctgcggtagaggaggatggtcatactactgcgggggactcaagaatgtacgtgaagttaagggattaacaaaagggggacccggacatgaagaacccattccaatgtcaacatatggatggaatttagtacgtctccagtcaggcgtcgatgtatttttcacaccgccagaaaaatgtgatacccttttatgcgatataggtgaaagttcaccaaaccctaccattgaagccggcagaaccttacgggtacttaatctagtagaaaactggttaaataataacacacaattctgcataaaagtattaaatccctacatgccaagcgtaatagagaaaatggaaaccctgcagcgtaaatacggaggtgcgttggtaaggaaccctctatctagaaactcaacgcacgaaatgtactgggtttcgaatgcgacagggaatatagtaagcagtgttaatatgataagcagaatgttgatcaacagattcacaatgaagcataagaaagcaacttatgagcccgacgtagatctgggatcagggacacgtaatataggaatagaaaacgaaattcctaatctcgacatcataggaaaaagaatcgagaaaattaaacaggaacatgaaacgagttggcattatgatcaagaccacccatacaaaacttgggcataccatggctcttacgaaacaaaacagacaggctcagcgagttcgatggttaacggggttgtgagattacttacgaagccttgggacgttgtgcctatggtaacacaaatggcaatgacagacacaactccttttggccagcaaagggtctttaaagaaaaagtagatacaagaacgcaagagccaaaagaaggaactaaaaagctaatgcgaatcacagccgaatggttatggaaggaattaggaaagaagaaaacacccaggatgtgtactagggaagaatttactcgaaaagtaaggtcgaatgcagccctaggggctattttcactgatgaaaacaagtggaaatcggctcgagaagctgtcgaagacagccgattctgggagctagttgacagagagcggaatttacacctcgaaggtaaatgcgagacctgcgtatacaatatgatgggtaagagagagaagaaactaggggagttcggcaaagcaaaaggtagccgagcgatctggtatatgtggctaggagccagatttttagaatttgaggccctaggatttttaaatgaagatcactggtttagtcgcggcaatagtttatcaggagtagaaggcgaagggttacataagttaggctatatcttaagggacgttagcaagaaagaaggcggtgcaatgtatgctgatgatacagctggttgggatacacggataactttagaagatcttaaaaatgaagaaatggtaactaatcatatgaagggcgaacataagaaattggctgaagctatcttcaaacttacctatcaaaataaggtagttcgtgtacaaagaccgacacctagaggtacagtcatggatataatatcaagaaaagaccagagaggatcggggcaagtagggacttatgggctgaatacatttacaaatatggaggcgcaactaatacgtcaaatggaaggagaaggtatctttaaaagcatccagcatcttaccgtcacggaagaaatcgcggttcagaactggctagcaagagtaggtagggagagactttccagaatggcaattagtggagatgattgcgtggtcaaaccgttggacgatcgctttgcttctgcattgaccgccctcaacgatatgggtaaggtacgaaaggatatacaacaatgggaacccagtagaggatggaacgattggacgcaagttccattttgtagtcatcattttcacgaattagttatgaaagatggaagagtactggtagtcccatgtcgaaaccaagacgaactgataggcagggcgcgcatatcccaaggtgccgggtggtccctaaaagaaacggcgtgtttaggtaagagttatgctcaaatgtggaccctaatgtatttccaccgaagagatcttcgactcgcagcgaacgcaatatgtagtgctgttccttctcattgggtaccaacatcgcgcacaacctggtcaatacatgcgaaacatgaatggatgacaactgaggacatgcttgcagtatggaatcgagtttggatacaagaaaatccttggatggaagataaaacgcctgtagaaagctgggaagaggtaccatacctgggcaaacgggaagaccagtggtgtggttcattaataggactaacgtcgagagctacatgggccaagaacattcaaaccgcgataaaccaagttagaagtttgataggaaatgaggagtatactgactacatgccaagcatgaaacgattcagaaaagaggaagaagaggccggtgttttatggtaa

SEQ ID NO: 22542 - RNA, 9876 nt, synthetic construct
  misc_feature 1..9876: note = derived and/or modified CDS sequence (opt6) from DENV-2__EU529701__SS-prME
  source 1..9876: mol_type = other RNA
actgcaggcgtaattataatgttaataccaaccgcaatggcattccacttaacaactaggaacggcgaaccgcatatgatagtaggacgtcaggaaaaaggaaagtcacttctgtttaaaacagaagatggtgtaaatatgtgtacattaatggctatggatctgggagaactctgtgaggacactattacctacaagtgtccgcttctacgtcaaaatgaacctgaagacatcgattgctggtgcaatagcacatctacttgggtcacttacggcacatgtactacgacaggtgaacacaggagagaaaaaagaagtgtcgctttagtgcctcacgtaggtatgggattagaaacaagaacagagacctggatgtcatcggaaggggcatggaaacacgttcaaaggattgaaacatggatcctaagacaccctggatttacaataatggcagcaatacttgcttataccattggtacaacccatttccaacgtgcgctaatttttatactattaacggcagtagcgccatcaatgacgatgaggtgcataggaatatccaatcgtgatttcgtggagggagttagtggaggttcttgggtggatatcgtacttgaacatggttcttgtgtcacgacaatggcaaaaaataagccgacactagacttcgagttaatcaaaaccgaagctaaacaaccagcaacactacgaaaatactgtattgaagcaaagctcacaaatacaacgacagagagcagatgtccaactcagggtgaaccatcactaaatgaagaacaggacaagcgctttctgtgcaaacattccatggtagatcggggatggggaaacgggtgtggtcttttcggaaaaggtggcatcgttacctgcgccatgtttacttgtaaaaaaaatatggagggaaaggtagtccagcccgaaaatttagaatatacaatagtgataacacctcatagtggagaggaacatgccgtaggaaatgatacaggaaaacacggtaaagagattaaaatcaccccccaatcatcaatcacagaggctgaattaacaggatacggaacggttaccatggagtgcagccctaggactggcctggactttaacgagatggtcttactacagatggaggataaagcttggctcgttcatcggcagtggttcttagacctaccactaccttggcttcctggtgcagacacccaaggcagcaattggatccaaaaagaaactttggttactttcaaaaacccgcatgcaaagaaacaagatgtcgttgtactcggtagtcaagaaggagccatgcatacagcccttacaggggcaacagaaatccaaatgtcaagtggaaacttactatttactggccatttaaaatgcagattacgaatggataaattacaattaaaggggatgagttacagcatgtgtaccggtaaattcaagatagttaaggagattgccgaaacacaacacgggactatagtgataagagttcaatatgaaggagacggatctccctgcaaaatcccttttgaaattatggacttggaaaaacgccatgtattaggcagattaataaccgtaaacccaattgtcacagagaaagactcacccgtgaatatagaagctgaaccaccatttggtgacagctatatcataatcggagtcgaacctggtcagctgaagttaaattggttcaagaaggggagcagtattggtcaaatgtttgaaacaactatgcggggggcaaaaaggatggcaatattgggtgatacggcttgggatttcggatcattaggcggggtctttaccagcgtcggtaaagccctgcaccaagtcttcggtgctatatatggagctgcatttagcggtgtaagctggacgatgaaaatatttataggggtcattattacatggataggtatgaattccagatcaacatcattatctgtctcattggtcctagttggagtagtaacactttacctcggagcaatggtacaagctgattctggatgcgttgtctcatggaaaaataaagagctaaagtgtgggagcggaatttttatcacagacaatgtgcacacatggacagaacaatataaatttcaaccggaaagtccaagtaaattagcttcagcaattcaaaaggcacatgaagaaggcatttgcggaataagatctgtaacaaggctagaaaaccttatgtggaaacaaattactccggaattgaaccatatattatcagaaaacgaggtaaaactaacaatcatgacaggggatataaaaggcatcatgcaagctggtaaacgaagtctcagaccgcaacccactgagctgaaatactcttggaagacctggggaaaagctaaaatgttgtctactgaatctcacaatcagaccttcctaatagatggacctgaaacagctgaatgcccaaatactaaccgagcatggaactccctggaagttgaagattatgggttcggggtattcactacaaatatatggctaaagctaagagagaaacaggacgtcttctgcgactcaaaactaatgtctgcggcaattaaggacaatagagcagtacacgcagatatggggtattggattgaatccgcgctaaatgacacatggaaaatggaaaaagcgtcattcatagaggtaaagtcgtgtcattggccaaaaagtcatacgttgtggtcaaacggtgtcttagaatcagagatgatcatacccaaaaattttgctggaccagtttcacaacataactacagacccgggtatcatactcaaactgctggcccatggcatctgggcaaactagagatggactttgatttttgtgaaggtactacggttgtggtaacagaagattgcggaaatagaggaccttccctaagaaccactacggcctctggaaaactgatcaccgaatggtgctgtagaagctgtacattaccacctctgcggtaccggggtgaagatggctgttggtatgggatggaaataagacccttaaaagagaaagaagaaaacctcgtaaacagcttggtaacagcaggacacggtcaaattgataacttttcattgggagtcctaggaatggcactatttttagaggagatgttaagaacacgagtaggtactaaacatgcgatcctattggtggccgtatctttcgtcacattaattaccggaaatatgtcgtttcgagacctcggaagagtaatggtaatggtcggtgccactatgacagatgatataggaatgggcgtgacatatcttgctcttctcgcagcatttaaggtacgaccaacatttgcagctggtttactactaagaaagctgacaagtaaggaactcatgatggcaactatcggaatcgcgctgcttagtcagagtacaatacccgaaactatcctcgaacttacagatgcactagcattgggaatgatggtacttaagatcgtcagaaacatggaaaaataccagctagctgtaacgataatggccatttcttgcgtaccgaatgctgtaatactccaaaatgcatggaaggttagttgtacgattctggccgcagtttcagtatcaccactcttgctaacatcaagccaacaaaaagcggattggatacctcttgcattaactataaaaggtttaaatccgacagctatatttttaaccactctgtcacgaacttcaaagaaaaggagctggccgcttaatgaagcgatcatggctgtaggtatggttagcatattggcttcaagccttttgaagaacgatataccaatgactggccctttagttgcaggcggactattaactgtctgttatgtgctaacaggtagaagtgcagatttagagttagagagagccgcagacgtcaaatgggaggaccaagcggaaatcagcggatcttctccaattttgtctattactatttctgaagatggaagtatgtccatcaagaacgaagaggaagagcaaacgctgacaatattaatacgtacaggactattggtgataagtggagtgtttcctgtatcaattcctataaccgccgcagcttggtatctttgggaggtaaaaaagcaacgcgcaggagtattatgggatgtacctagtcccccacctgtaggcaaagcggaattggaagatggagcataccgaataaaacagaggggtatactcggatactcccagatcggagctggcgtctacaaagaaggtacctttcacacaatgtggcatgtcacccgtggagctgtattgatgcacaggggtaaaaggatagaaccatcatgggctgacgtgaaaaaagacctaatttcatacggtggcggctggaagttggaaggtgaatggaaagaaggtgaagaagtacaggtattagcgctcgaaccaggtaaaaatcctagagctgtgcaaacaaaacctggattatttaaaacaaatacagggacaattggggctgtaagcctggatttttcacctggaacaagtgggtcccctattgttgataggaagggtaaagtggtaggattgtatggcaatggtgtagtaacacgatctggagcgtatgtgagtgcgattgctcaaacagaaaaatcaatagaagacaaccctgaaatagaggacgatatctttcgaaaaaaacgcttaaccatcatggatttacatcccggtgcaggtaagactaagagatacttaccggctatagtgagagaagcaataaaacggggattgagaaccctcatcttggcaccaactagagtagtcgcggcagagatggaagaagctctaagagggttaccaattagatatcaaactcccgctataagggctgagcatactggcagagagatagttgatttaatgtgccatgcaacattcacaatgcgcctattgtcacctgtacgagtaccaaattataacttaattattatggacgaagcgcacttcaccgatccggcctcaatagctgcgagaggttacattagcacaagagtcgaaatgggtgaagcagcaggtatttttatgacggcgactccgcctggatcgagggacccatttccgcaatcaaatgcgccaatcatggatgaggaaagagaaatacctgaacgaagttggaactcaggacatgaatgggtgactgactttaaagggaagactgtgtggtttgtgccgagtataaaggcaggcaatgatatagcagcttgtttgaggaaaaatgggaaaaaagtaatacaattatccagaaaaacattcgactccgaatacgttaaaacacgcgctaacgactgggattttgtcgtaaccaccgacatcagcgagatgggcgctaattttaaagcagaaagagtcattgatccaagaagatgcatgaaaccggtgatcttaacagacggagaagaaagagtgattttagccggaccaatgccagtgacccactctagtgctgctcaacgtagaggacgaatcggtagaaacccgaaaaacgaaaatgatcaatatatttatatgggtgaaccattggaaaatgatgaagactgtgcccattggaaggaagcaaagatgttactagacaacataaatactccagaaggcataataccgagtatgtttgaacccgaacgcgaaaaagttgatgccatcgacggagaataccgtttacggggagaagctcgaaagacttttgttgatttaatgagacgaggagatttgccagtatggctggcctacagagtagcagcagaagggatcaactacgctgatcgtcgatggtgcttcgatggaatcaaaaataatcagatactagaagaaaatgtagaagtagaaatatggacaaaagaaggagaacgaaaaaaactaaaaccgcgatggttagacgcccggatatacagtgatccgttagccctcaaggagtttaaggaattcgccgccggacgaaaaagcctcactttaaatcttataacggaaatgggcagattaccaacatttatgacccaaaaggctcgtgatgcactcgacaatctagcggtactacatacggcagaagctgggggtaaagcatataatcatgctttgtcagaattgcctgaaacattagaaactcttctcttattaactttacttgcaactgttaccggaggaatatttttgtttttaatgtcaggaaaaggaataggtaaaatgacattaggcatgtgttgcattatcactgcgtctatattattatggtatgctcagatacaaccccactggatcgcggccagcataattcttgaatttttcctaatagtactactaataccagaaccggaaaagcagcgaaccccacaggataaccaactaacctatgttgttatagcaatcttaacggtcgttgcggcgacaatggcaaatgagatgggtttcctcgaaaaaacaaagaaagacctcggattagggtcaattacaacacaagaatccgagagtaatattctagacatagatttaagacctgcgagcgcatggacgttgtatgccgtagccacaacatttgttactccaatgctaaggcactcgatcgaaaactccagcgtaaacgtaagcttaactgcgattgccaatcaagcaacagtactaatgggccttggtaaggggtggccacttagtaagatggacattggggtgccacttctggcaattggctgttactctcaggtcaatccgataaccctcacagcagctctactactattagtagcacattatgcgattattggtcctggtttgcaagccaaagcaacccgtgaagcccagaaacgagccgctgcaggcatcatgaaaaatcctacagttgacggtataacagtcatagatctagaaccgataccgtacgatcctaaatttgaaaagcaattaggtcaggtaatgctcctcattttgtgcgtaacccaagtgctcatgatgaggacaacgtgggcactttgtgaagcgttaactctcgctactggaccgatatcaaccctatgggaaggcaatccagggaggttctggaataccaccatcgccgttagcatggcaaatatcttcagagggtcttatttagctggagctggattacttttctctataatgaaaaataccacgaatacgagacgaggaacaggaaatattggggaaactttaggtgagaaatggaaatcacggcttaacgcgttaggaaaatcagagttccaaatatacaaaaaatcaggaattcaagaagtcgatagaacattagcaaaagaaggtattaaacgtggagagactgaccaccatgctgtaagtagaggttcggcaaagctgaggtggttcgtagaacgcaatatggtaacaccagaaggaaaagttgttgatcttggttgcggcagggggggatggtcctactactgcggaggattaaaaaacgtaagagaagtaaagggtttgacaaaaggaggcccgggccatgaagaaccaataccaatgagcacctacggatggaatctcgttagattgcaaagtggggtcgacgttttttttactccgcccgaaaaatgtgatacattactatgtgacattggggaatcaagtccaaaccccactattgaagcgggccgtactcttcgagtacttaacctagtagaaaattggttgaacaataatacacaattttgtatcaaagtcctaaatccatatatgcccagtgttatagagaaaatggagacgttgcaaagaaaatacggcggcgctctagtacgcaatccattatcacgaaattcgacacatgaaatgtactgggtctctaatgctactggtaacattgtgagttccgtaaatatgatttctcggatgttaataaaccgttttactatgaaacataagaaagctacatatgaacctgatgtagatctaggcagcgggacaagaaatataggtattgaatctgagatccctaacctcgatattatcggaaagagaattgaaaaaatcaaacaagaacacgaaacttcttggcattacgatcaagaccatccctacaaaacttgggcatatcatggatcttatgaaacaaaacaaactggtagtgctagtagtatggttaatggggttgtacgtcttctaacaaaaccatgggacgtagtcccaatggtaacacaaatggcaatgaccgatacaacaccctttggacaacagagagtatttaaagagaaagtcgatacaagaacacaagaaccaaaagaaggtactaagaaattgatgaaaatcacagcagaatggctatggaaagaattgggaaaaaaaaagacgcctagaatgtgtacaagagaagagttcactcgaaaggtgcgatctaatgcagcactcggcgcaatatttactgacgagaacaaatggaaatcagcacgtgaggcagtcgaagatagtagattttgggaacttgtagatagagagagaaacttacacttagaagggaaatgtgagacatgtgtatataatatgatgggcaaacgagagaaaaagttaggagaattcgggaaagcgaaaggaagtcgagccatttggtatatgtggcttggggcaagattccttgaattcgaggcacttgggttcctgaatgaagaccactggttttctaggggaaattctctcagtggagttgaaggagaaggtcttcatcgattgggatatatactgagggatgtttctaaaaaggaaggcggtgccatgtatgctgatgacacagcaggttgggacactagaattactcttgaggacttaaaaaatgaggagatggtcacaaaccacatgaaaggagaacacaaaaaattagctgaggccatatttaagctcacataccaaaacaaggttgtccgagttcaacgtccgacaccaaggggaactgtaatggacataatctcaagacgagatcagcgtggctcagggcaagttggtacttatggattaaacacattcacaaatatggaagcccagttaatccgacaaatggagggtgaagggattttcaaaagtatccaacaccttactgtgacagaagaaatcgcagtccaaaactggcttgctagagtagggcgtgagcgattatcccgaatggccatttccggtgacgactgcgtcgttaaacctctagatgaccgcttcgctagtgcccttacggcactaaatgatatgggcaaggttaggaaggacatacaacaatgggagccatccagagggtggaatgactggacacaagtaccattttgtagccatcattttcacgagttggttatgaaagatggtagagtactagtagtaccatgccgaaaccaagatgaattaatcggcagagcgagaatttcacaaggagctggatggagtttaaaagaaacagcatgtctcgggaaatcctacgcccaaatgtggacactaatgtactttcatagaagggatctgcgattggccgccaacgcaatctgctccgcagttccctcacactgggtaccaacgtcaagaacgacatggtcaattcatgcaaaacacgaatggatgacgaccgaggatatgctcgcagtctggaatcgtgtatggatccaggaaaatccatggatggaagataaaaccccagttgaatcatgggaagaagtaccgtacctaggcaaacgtgaggatcaatggtgtggctcattgataggattaactagtagagctacatgggccaaaaatattcaaacagcaataaatcaagttagatctttaattggaaatgaggagtacacagattacatgccatctatgaagcgctttcgaagagaggaggaggaggcaggagtactctggtag

SEQ ID NO: 22543 - RNA, 9876 nt, synthetic construct
  misc_feature 1..9876: note = derived and/or modified CDS sequence (opt6) from DENV-2__EU569704__SS-prME
  source 1..9876: mol_type = other RNA
actgcgggagtcataataatgttaataccgaccgccatggcatttcacttaacgacaagaaatggagaaccacacatgattgtgggccgtcaagaaaaaggaaaatccctattattcaaaacggaagacggagtgaacatgtgcacactcatggcaatagatttaggagaactctgtgaagataccataacatataaatgtccgttattaaggcagaacgaaccagaagacatagattgttggtgtaactcaacttctacttgggtaacatatggcacttgcactaccacaggagagcatagacgagagaaaaggtccgtggcattagtaccacatgtaggaatgggactagaaacacgtacagaaacatggatgagctctgaaggagcatggaaacatgttcaacgtatagaaacatggattcttaggcatcccgggttcacgattatggccgctattctagcatatacaataggaacaacacattttcaaagggcgttaatatttatacttttaacggcagtagctccaagtatgactatgcgttgcataggcataagtaacagagattttgttgaaggagtaagcggaggatcgtgggttgatattgtattagaacacggctcatgtgtcacgacgatggctaaaaacaaaccaaccttggattttgaattgataaaaactgaagcgaaacaacccgcaaccttacgaaaatactgtatagaggcaaaactcactaataccacgactgagtcgaggtgcccgacacaaggagaaccatcacttaatgaagaacaggacaaacgattcctttgtaagcattccatggtggatagagggtggggcaatgggtgcgggttgttcggaaaagggggtatagtcacttgcgcaatgtttacatgtaagaaaaacatggaaggaaaggtcgtattaccagaaaatttagaatatacaatagtaattacaccccattcaggtgaagaacacgctgtaggaaatgacacaggaaaacacggaaaagaaataaagatcactccgcaatcatctattacagaagcggaactcactggatatggaaccgttacgatggaatgcagtccccgaacaggcctggatttcaacgagatggtacttcttcaaatggaggataaagcctggctggtacatagacaatggttcctcgacttgcctttaccctggcttccaggagctgacacacaaggttctaattggatacagaaagaaactttagttacatttaaaaatccccacgcaaagaaacaagacgtagttgtcctgggatcccaagaaggagcaatgcatacagcacttaccggggctacagaaatacagatgtcttccggaaacctactcttcacaggacacctaaagtgccgactaaggatggacaagctacaattaaagggcatgtcatattcaatgtgtaccggcaaatttaagatagtaaaggaaatagcagaaacgcaacacggtacaattgtaattagggtacagtatgaaggtgatgggtcgccttgtaaaatcccatttgaaattatggatttggagaaaaggcatgtccttggacggctgattacagtaaacccaatcgtgacagaaaaagattcaccggtgaacatcgaagcagaacctccattcggagactcctatataataattggagtggaaccaggacaattaaaactcaactggttcaagaaagggagctccataggacaaatgtttgagacaacaatgcggggagcaaaaagaatggcgatattgggagacacagcgtgggattttgggtcattaggaggagtatttacaagtatagggaaggctttacaccaagtattcggggcaatatatggcgcggctttcagtggtgtatcctggacaatgaaaattcttataggtgtaattattacgtggattgggatgaatagcagatctacatccctatcagtcagtttagttttggtaggtgtagtgacgttatacctgggagctatggtccaggcagatagcggctgcgtagtatcatggaaaaataaagaactaaaatgcggaagtggcatatttatcacagataatgttcacacttggaccgaacaatacaaattccaacctgaaagtccatctaaattagcatctgcgatacaaaaagcacacgaggagggaatctgcggtatacgatctgtaacacgcttggaaaacctaatgtggaaacaaatcacccctgagcttaatcacattctaagcgaaaatgaagtcaaacttaccattatgaccggggatataaagggaataatgcaggctggcaagagatcactaagaccccaacctaccgaactaaaatatagttggaagacatgggggaaggcaaagatgttgagtactgaaagtcacaatcaaacattcttaatagatggtccagaaacagcagagtgtcctaacacgaaccgagcatggaactctctcgaagttgaggattacggcttcggggtgtttacaacaaacatatggttaaaactgcgcgaaaaacaagatgtgttttgcgatagtaagttgatgtctgcagcaattaaagataatcgtgcagtacatgcggacatgggatattggatagaaagcgctctaaatgatacctggaagatggaaaaagcatcattcattgaagtaaaatcatgtcattggccaaaaagccatactctgtggagtaatggagtgttagaaagtgaaatgatcattcctaagaatttcgccggaccagtctctcaacacaactatcggcccggatatcatacccaaactgcaggaccatggcacctaggaaaacttgaaatggatttcgatttttgcgaaggtacaacggtagttgtaacagaggactgtggaaatcgaggaccctcacttcgaactactactgcgagtggaaaactaatcactgagtggtgttgtagaagttgcactttaccaccattgagatatagaggtgaagacgggtgttggtatggaatggagatacggcctctaaaagagaaagaagaaaacttggtaaattccctagtaacagcgggtcatggacaaatcgataactttagcttgggcatcttaggaatggcgttgttcttggaagagatgctaaggacaagggtaggtacgaaacacgctatcttattggtcgcggtttccttcgtaacactcatcactggtaacatgtcctttcgagacctagggcgagtaatggtaatggtaggagcgacaatgacagacgatattggaatgggcgtaacttatttagcacttttggctgcttttaaagtacgtcccacatttgccgctggattactcttacgaaagctaacaagtaaagagcttatgatggcgacaataggtatagctcttttatcacagagtactataccagaaacaatactggagttgacagacgcactggcattaggtatgatggttctaaaaattgttaggaacatggaaaaataccaattggccgtaacaataatggcaataagttgtgttcctaatgctgtaattctccagaatgcctggaaagtttcctgcacaatcttagcagctgtgtcggtgagccccttattacttacatcatcgcaacagaaagcagattggataccattagcattaacaatcaaaggactaaatccaacagctatatttttgaccaccctttcaagaactagcaagaaacgctcatggccgctaaatgaagctataatggctgtaggcatggtgtctatactagccagctcgctattgaaaaacgacattcctatgacaggacctcttgtagcgggtgggttattaacggtatgttatgttctcacaggaagatctgcagatctagagttggaacgagctgcggatgtaaaatgggaagaccaagcggagatatcaggttccagtccgattctatctatcactatttcagaagatggatcaatgtctatcaaaaatgaagaagaggagcaaaccttaaccatattaatacgtacgggacttttggtaatcagcggagtattcccagtgagtatcccaatcaccgcagcggcttggtacctatgggaagttaagaaacaaagagcaggagttttgtgggacgtcccatctcccccaccagttggtaaagctgaattggaagatggtgcttatagaataaaacaaagagggattctgggctatagccagataggcgcaggagtatataaagagggtacttttcacacaatgtggcatgtaacgagaggagctgtcctaatgcacagggggaagcgcatcgagcctagctgggccgacgtgaagaaagatttaatatcatatggaggaggatggaaacttgaaggcgaatggaaagaaggtgaagaagtacaagtcttggctttagaaccaggcaaaaatccaagagcagtacaaacaaagccggggctattcaagacaaatactgggaccattggggctgttagcctagatttttccccagggacgtctggatcaccaatagttgacaggaaggggaaagtggtagggttatatggtaatggcgtagtgacacgctcgggggcttacgtctctgctatagcccaaacagaaaaatcaattgaggacaatcctgaaattgaggatgatatttttagaaagaaacgacttacaataatggatcttcaccctggtgctggaaaaactaaacggtacttgccagccatagttcgggaagctataaaaagaggactacgaactctaattttggcaccgactcgtgttgtcgcagcagagatggaagaggccttacgaggtttaccgataagatatcaaacacccgcgattcgtgcagaacatacaggaagggagatcgtagatctaatgtgtcacgcaacttttacaatgcgtttattaagtccggtccgagtgccaaattataatttaattataatggatgaagcacactttacagatccggcaagtattgcagcacggggatatatatcgacgagagttgaaatgggggaagctgcaggaattttcatgacagctacaccacccggatctcgcgatccattccctcaaagtaatgcccctattatggacgaagaacgcgaaataccagaacggtcatggaactcgggtcacgagtgggtcactgatttcaaggggaaaacagtatggtttgtaccatcaataaaagccggcaatgacatcgccgcatgtctacgcaaaaatgggaaaaaggtaattcaactatcaaggaaaacgtttgatagcgaatatgtcaaaacgagagcaaatgactgggatttcgtcgtaacaactgatattagcgaaatgggagcaaattttaaggctgagagagtgatcgaccccagaaggtgcatgaaaccagtgattttgacagatggagaagaaagggtgatattagcgggccccatgccagttacacactccagcgcagcacagagacgaggaaggatcggccgtaatcctaaaaatgaaaacgatcaatatatatacatgggagaacccttagaaaacgacgaagattgtgctcactggaaagaagcgaaaatgcttctagataacattaacacccccgagggaattataccgtctatgttcgagcccgaaagagaaaaagtggatgccattgacggagaatacaggcttcgtggagaagctagaaaaacatttgtagatctaatgcgaagaggcgatcttccagtatggcttgcatatagagtagctgcggaaggaataaattatgctgataggcgttggtgctttgatgggatcaagaataaccaaatactagaggaaaacgttgaagtagaaatatggacaaaagaaggtgagagaaagaaacttaaaccacgttggttagacgcaagaatctatagcgatccgctcgcattgaaagagttcaaagaatttgctgccgggcgtaaaagtctaaccttaaatctcatcactgagatgggtagactccccacatttatgacacaaaaagcaagggatgctttagataatttagcggttttgcatactgcagaagccggaggacgcgcatataatcacgcgcttagtgaactccctgaaactctcgaaacactgttattactaactctgcttgctacagtaacaggtggaatattcttattcctaatgagcgggaaaggaattggtaaaatgactttagggatgtgctgtataataacagcatctatactattgtggtatgcccaaatacaaccacattggatagctgcttcgattattttagaatttttcctcattgtgttactaataccagaaccagaaaaacagcgtacaccccaagacaatcaattaacatatgtagttatagccatcctcactgttgtggcggcgactatggcgaacgaaatgggatttttggagaaaactaagaaagatttaggactagggagtataactacacaagaatctgaaagcaacattcttgatattgatttgcggccagcatctgcttggacgttgtatgcagtagctacaacctttgttacacctatgctgagacattctatagagaacagtagtgttaatgtatcactgacggctatcgcaaatcaagctaccgtgttaatgggtttaggcaagggctggccgttaagtaaaatggatataggtgtgccattactagcaatcggttgctactctcaagttaacccaataacactgactgcggcgctcttgctattagttgcacattatgcgataatcggccctggtctgcaagccaaggcaactagagaagcccaaaagagagcagccgcaggcatcatgaagaatcccaccgttgatggaataacggtaattgatttagaacccattccctatgacccaaaattcgaaaaacaactaggacaagtgatgttattgattctttgtgtaactcaagtcctcatgatgcggacaacatgggcactctgcgaagctcttactctagctacaggtccgatttctaccctgtgggaaggaaaccctggaaggttttggaatactacaatcgcggtaagtatggcaaacatctttcggggtagctatttagctggcgcaggattgttatttagcatcatgaaaaacacaactaacacaagaagaggaactgggaacatcggagaaacactaggagagaaatggaaaagtagattaaacgcactaggaaagtctgagttccaaatatacaagaagtctggtatacaggaagttgaccgaacactggcgaaggaaggaattaaacgcggagaaacggatcaccatgcggtttcaagaggaagtgctaagttacgatggttcgttgagagaaatatggtaaccccagaaggtaaagtggtagatctaggatgtggcagagggggttggtcatattattgtggcggtctcaaaaatgttagggaagtaaaagggctaacaaaaggaggccccggacacgaagaaccgataccaatgtcaacttacggttggaacctagtacggctccaaagcggggtggacgtcttcttcactccccctgaaaaatgcgatacactcttgtgtgatatcggagaaagttcgccaaatcctactatagaagcaggacgaacactaagagtactaaacttagtggagaactggcttaataacaatactcaattctgtataaaagttctgaatccatacatgccctccgtgatagaaaagatggagactttacaaagaaaatacgggggtgcgctagttaggaatccactgagtcgcaactccacacacgagatgtactgggtttccaacgcaactggaaacatcgtttcaagcgttaacatgataagtaggatgttaattaataggttcactatgaagcataagaaagcaacttacgaaccagatgtagacttaggtagtggaacaaggaacataggcattgaaagcgaaataccaaatctagatatcataggtaaaagaattgagaaaataaaacaggagcatgagacttcgtggcattacgatcaagaccacccttataaaacatgggcataccacggcagttatgaaaccaaacagacgggatctgcgtcatcgatggtaaatggagtagtacggttgttaacaaaaccatgggatgtggtaccaatggtaacccaaatggcaatgacagacacgactccctttggccaacagagagtgttcaaagaaaaagtagacactcgaacacaggaacccaaagaaggaaccaagaaacttatgaagataaccgccgagtggttgtggaaagaattaggcaagaagaaaacgccaagaatgtgcactcgagaagaatttacaagaaaagtaagatcgaacgccgcacttggagctatattcacagatgaaaacaaatggaaaagtgcaagagaagcggtagaagattcaagattctgggaattaatagatcgtgaacggaatctccatttagaagggaaatgtgagacttgcgtctacaatatgatgggtaaacgtgagaagaaactcggtgaatttggcaaagctaaaggttcgagagcaatatggtacatgtggctcggagcgagatttcttgagttcgaagcattaggatttttaaacgaggatcattggttttcaaggggtaatagtcttagcggagtagagggtgaaggtctacatcgtttaggatacatacttagagatgtaagcaagaaagagggtggagcgatgtatgcagacgatacagcagggtgggacacgcgaataactcttgaagatcttaaaaatgaagagatggtgactaatcatatgaaaggtgaacataagaaactagccgaagctatattcaaattaacctatcaaaacaaagtcgtaagggtacagagaccgacaccgagaggaactgtaatggacataatatcacgaagagatcagcgcggttccggacaagtaggaacttacggtcttaacacatttaccaatatggaagctcagctcataaggcagatggagggagagggaatttttaagtcaatacaacacctgacagtaacagaagaaatagcggtacaaaactggctggctagagttggcagagaaagactttcaaggatggccataagtggggacgactgcgtagttaaacccttggacgatcgcttcgcaagcgcactcactgcattaaacgatatgggaaaagtgcgtaaggatattcaacaatgggagcccagtagagggtggaacgattggacacaagtaccattttgtagtcatcattttcatgagctggtaatgaaggatggtagggttctagtagtcccatgtcgaaatcaagatgaattaataggtcgagcaagaattagccaaggagctggctggtccttaaaggaaacggcatgcttagggaaaagttacgctcaaatgtggacgttgatgtattttcatcgacgtgacttacggttggcagcaaacgcaatttgttctgctgtcccgtctcattgggtaccgacaagcagaacgacttggagtattcatgcaaaacacgaatggatgacaacagaggatatgctagccgtatggaaccgagtatggattcaggagaatccgtggatggaagacaaaacccctgtcgaatcatgggaagaggtaccctatctcggcaagagagaagaccagtggtgtggcagcttaatcggactaacatctcgcgcaacctgggcaaagaatatccaaacagctattaaccaagtgcgcagcctaataggaaatgaggaatacacagactatatgccaagcatgaagcgcttcagaagagaggaagaagaggcaggagtattatggtaa

SEQ ID NO: 22544 - RNA, 9876 nt, synthetic construct
  misc_feature 1..9876: note = derived and/or modified CDS sequence (opt6) from DENV-2__EU482568__SS-prME
  source 1..9876: mol_type = other RNA
acagctggtgttataataatgttgattcccacagcaatggctttccatcttactacaagaaatggagaaccgcatatgatagtaggacgacaagaaaaaggtaaatcactgttattcaaaactgaagatggcgttaatatgtgtacattaatggcgatagatcttggcgaactatgcgaagacacgataacttacaaatgtccgttgctgcgtcagaatgaaccagaagacattgattgctggtgtaacagtacttcaacttgggttacctatggcacgtgtacaacaacaggagaacaccgcagagagaaaagatctgtggcattagtacctcacgtaggaatgggactagagacaagaacagaaacttggatgagctctgaaggagcatggaaacatgtacaacgaatagaaacctggattttaagacaccctggtttcacgataatggcagcaatactggcttatactattggaacaacacacttccaaagagccctaatttttattctactgactgcggtcgccccaagtatgaccatgaggtgtataggaataagcaatagagattttgttgaaggagtcagtgggggttcttgggtagatatagttcttgaacacggtagttgtgttactacgatggctaaaaacaaacccacacttgattttgaattaataaaaacagaggcaaaacaaccagcaaccctaaggaaatattgtatagaagccaaattaactaataccactaccgaaagtcgttgtccaacgcaaggagaaccatctctaaatgaagaacaggataaaagatttttatgtaaacattctatggtagacagagggtggggtaatggctgcggattatttgggaaagggggaattgtgacttgtgcaatgttcacttgtaagaaaaatatggagggtaaagtggtattaccagaaaacttagaatatacaatagttatcacgccgcattcgggagaggaacacgcagtaggtaacgacacagggaaacacggcaaagaaattaaaattacaccacaatcaagcattaccgaagcggagctgactgggtatggaacagttacgatggaatgtagcccacgaacgggtctagatttcaatgaaatggtactgctgcaaatggaagacaaagcatggttggttcaccgacaatggtttttagatctgccactcccatggttaccgggagcggatacacagggttctaattggatacaaaaagaaaccctagtaactttcaaaaacccacatgccaagaaacaggacgtagtagttctaggatcacaggagggtgcaatgcacacagcgctcacaggagcgactgaaattcaaatgtcttctggaaacctcctattcactggccatctgaaatgtagactaaggatggataaactgcaattgaaaggcatgagttactcaatgtgcactggcaaatttaaaatagtgaaagaaatagctgaaacgcaacacggaactattgtgatccgagttcagtatgaaggagatggttcaccctgtaaaataccctttgaaattatggatcttgagaaacgacacgttctaggacgcctaatcaccgttaatccaattgtaactgagaaagactctccggtaaatatcgaagctgagccgcctttcggggattcatacattataattggcgtagaacccggacagctcaaattaaactggtttaagaaaggatcttccatcgggcaaatgttcgaaactacgatgcgcggagccaaacggatggcgatccttggagatactgcttgggattttgggtcgctaggtggcgtatttacaagtattggaaaggccttacatcaagtgttcggagcaatttatggagccgcattcagtggagtgtcatggacaatgaaaatacttatcggagttataataacctggataggtatgaacagccgatcaacgagcttgtcagtgtcactcgtcttagtaggcgtagtaacactatacctaggagctatggttcaagcggactccggctgcgtcgtgtcatggaagaacaaagagttaaaatgtggctcgggaatctttataacagacaacgtgcatacgtggactgagcaatataaattccaaccagaatcacctagtaagctagcctcggctatacaaaaagcccatgaagaaggaatttgcggaatcagatcagtcacgcgattagagaaccttatgtggaagcaaataacacccgaattaaatcacatactaagtgaaaacgaagtaaagttgactatcatgacaggggatattcgaggtatcatgcaagcagggaaaagaagtctcagaccgcaaccaactgaattaaagtactcatggaaaacctgggggaaggctaaaatgttatctacagagtcacacaaccaaacttttctgatcgacgggccagaaactgcagaatgtcctaacacaaatcgagcatggaactcattagaagtggaagactatgggtttggagtcttcacaacgaacatatggttaaaattacgtgaaaaacaggacgtattctgtgacagtaagttaatgtcagccgcaataaaagataatagagctgtacatgctgacatgggatattggattgagagcgctctaaatgatacatggaaaatggagaaagccagttttattgaagttaagtcatgtcattggcctaaatcgcacacactatggtctaacggagtactcgagagtgaaatgatcataccgaaaaactttgcaggacccgtaagccaacataattaccgccccggatatcatacacaaaccgcaggaccatggcatctgggaaaattggaaatggacttcgacttctgcgaaggcactacggtggtagtgactgaagattgcggtaatcgtggtccgagtctgaggactacaacagcaagtggtaaactcataacggaatggtgctgtcgttcgtgcactttgcctccattgagatatagaggagaagatggatgttggtacggtatggaaatcagaccgctcaaagaaaaagaagaaaaccttgtaaattcactcgtcacagccggccatggacaaattgacaattttagcctggggatattaggaatggcattattccttgaggaaatgttaagaacacgagttggaactaagcatgctattctccttgtagcagtttcattcgtcactttgattacaggaaatatgagttttagagatctaggacgtgtaatggttatggtaggggctacgatgactgacgatattggtatgggcgtaacctatcttgctctgctagccgcatttaaagtaaggcctaccttcgctgcaggactgttattaagaaaactaacaagtaaggaattgatgatggccacaattggaatagctctgcttagccaatcgacaatccctgaaacaatacttgaactgactgatgcacttgcactaggaatgatggtgttaaaaatagtgagaaatatggaaaaatatcaactcgctgttacaataatggcaataagttgtgttccaaacgcagtgatactacaaaacgcctggaaagttagttgtaccatactagcggcagtatcggtctcccccttgctcctaacatcaagtcaacaaaaagcagattggatccccttagcactgacaatcaaggggctaaaccctaccgccatctttttaactaccctgtcccgaaccagtaagaaacgcagctggccgttaaatgaagctataatggcagttggcatggtatctatcctagcgtcctcactactcaaaaacgatattccaatgactggtcccctagtagccggtggattgcttactgtatgctatgtcctcaccggtagatcagcagatttagaacttgagagagcagccgatgtgaaatgggaggatcaagcggaaatctctggatccagtccaatattatcaattactattagtgaagacggaagtatgtcaatcaaaaatgaggaagaagaacagacacttactatactaattagaacgggactgttagtcatctctggcgtattcccagtaagtattccaataacggcggccgcttggtacttatgggaagttaagaaacagagggctggtgtattatgggacgtaccaagcccaccaccagtggaaaaagccgaacttgaagatggtgcgtacagaataaaacaaagagggattctaggatacagtcaaataggagccggtgtatataaagagggtacattccacactatgtggcacgtaacaagaggggcggtcttaatgcaccgaggaaaaagagtagagccatcatgggccgacgtcaagaaagatttaatcagttacggtggtggatggaaactggaaggtgagtggaaggaaggcgaagaagtccaagtattggcactggagccaggcaagaatccaagagcagttcaaacaaaaccaggactgtttaaaacaaatacagggacaataggggccgtcagtttggatttctccccagggacaagtgggtcacccatcgtcgataggaaaggaaaagtcgtaggactgtacggaaacggagtagtaacgcgcagcggagcttatgtatccgccattgcgcaaacagagaaatcgatcgaagataatccagaaatagaagatgatatcttcaggaagaaaaggttaacaattatggacttacatcccggtgctggaaaaactaaacgctatcttccagcaattgtcagagaagctattaaaagaggactaagaaccctaattctagcccccacaagggtcgttgcagctgagatggaggaagcgctacgtggattgcctatacgataccagactcccgcaataagagctgaacacaccggacgagagatcgttgatctgatgtgtcacgcaacatttacgatgcggcttttaagtccggtacgagtcccaaattataacctaattataatggacgaagcacattttacagacccggctagtatagccgccagaggatatatctctactagggttgagatgggagaagccgcaggaattttcatgactgctactcccccaggatctagagatccgttcccgcaatcgaacgctcctataatggacgaagaaagggaaatacccgagcgaagttggaatagtggtcatgaatgggtgacagactttaaaggaaaaacagtttggttcgtcccgagtataaaagccggaaacgatatagcagcatgtctgaggaaaaacggcaagaaagtgatacaactgtcaagaaagacatttgacagcgaatacgtaaaaacgagagcgaatgattgggatttcgtagtaaccactgatatatcagagatgggagcgaatttcaaagctgaaagagtaatagatccgaggaggtgcatgaagccagtcatactgacagatggagaggaaagagtgatccttgcaggacctatgccagtaacacactcaagtgcagcgcagcggcgaggccgaattggacggaaccctaagaacgaaaacgaccagtatatatatatgggtgaacctcttgaaaatgacgaagattgtgctcactggaaagaagcaaaaatgcttttagataatattaacactccagaaggaataataccgtcaatgtttgaaccagagagagaaaaagtagatgccattgatggagagtatcgcctaagaggagaagcacgtaagacgtttgttgatctaatgaggcgcggcgatttgcctgtctggctagcttatcgtgttgctgcagaaggaattaattatgcagacagacgttggtgttttgatggaattaaaaacaatcaaatattagaagaaaacgtggaggtcgaaatatggacaaaagagggggaaagaaagaaacttaaaccccgttggttggatgcgcggatttacagcgacccgttagccttgaaggaatttaaggagtttgcggcagggagaaagagcttaacccttaatttaataaccgagatgggccgattaccaacgttcatgacacaaaaggcgagggatgccttagataatttagctgtgttgcacacagcagaagccggtggcagagcatacaaccacgcattgagcgaattaccggaaactttagaaaccttattacttctaaccctcctcgctactgtaaccggaggaatattcttattcttgatgtcaggaaaaggtattggtaagatgacattgggaatgtgctgtataataactgccagtatattattatggtacgctcaaattcaaccgcattggatagccgcaagcattatcttggaatttttccttatagtccttttaatacccgaaccagagaaacagagaactccacaagataatcaacttacttacgtagtcatcgcaatccttacggttgtagctgcaacaatggcaaatgagatgggatttcttgaaaagacgaaaaaggatttaggactgggttctataactactcaagaatcagaatctaatatactggacatagacctacgacccgcttcggcttggactttatatgcagtagcaacaacattcgttactccgatgctgcgccattccatcgaaaattcgagtgttaatgtatcgctaactgcaattgcgaaccaagcaacagttttaatgggtctaggaaaaggctggcccttaagtaaaatggatattggggtacctctactcgccataggatgctatagccaagtaaaccctattacactcacggcagcattattgctcctagtcgcacactatgccataataggaccgggcctccaagcaaaagcaactcgcgaagcacaaaagagggcagcagctgggataatgaaaaaccctactgtagatggcattaccgtgattgatctagagccaatcccatatgacccgaagtttgaaaaacagctaggtcaagtaatgcttctaattttgtgtgtcacccaagtgcttatgatgagaaccacatgggcactttgcgaagcattaacactggcaacgggaccaatatctactctttgggaggggaatccaggacgattctggaatacaacgatagctgtatcgatggcaaacatatttagaggttcttatctagcaggggccggtcttttattctctataatgaagaatactactaatacccgcagaggtactggcaacataggagaaaccttaggggagaaatggaaatcccgcctaaacgcactaggaaaatccgagttccaaatttacaagaaaagtggtattcaagaagtcgaccgaacgttggcaaaagaaggaatcaaacggggtgaaactgatcaccacgcagtatctagagggtcagcgaaactaagatggtttgtagaacggaatatggtaacacctgaaggaaaagttgttgacttaggatgtgggagaggtggttggagttactattgtggtggactcaaaaatgtaagagaagtcaaaggtctaacgaaaggcggacccggccacgaagaaccaattccaatgagtacttacggatggaaccttgtgcgcttacaatccggagtggacgtattctttacacctccagaaaagtgtgatacacttttgtgcgacatcggggaatctagtcctaatcccacaatagaagcggggcgaacattgcgggtattgaacttagtagaaaattggctgaataacaatacacagttctgtatcaaggttcttaatccatatatgccaagtgtaattgaaaagatggagacccttcaacgtaaatacggcggagctctagtcaggaatccattatcgagaaactcaactcatgaaatgtactgggtcagtaatgcaacaggtaatattgtatctagtgtaaatatgatatcccgcatgcttataaaccgatttacgatgaaacacaagaaagcaacctacgaacccgatgtcgatctcggttcaggaactagaaatataggaatagaatccgaaatccctaatttagatattatcggtaaaaggatagagaaaataaagcaggaacacgaaacaagttggcattacgatcaggatcatccatataaaacatgggcataccatggtagttacgaaacaaagcaaacaggttctgcttcgtcaatggtgaacggagtagtcagactgctgacgaaaccttgggacgtcgtgccaatggtgactcaaatggcaatgacagacacaacaccttttggacagcaacgcgtatttaaagaaaaggttgatactagaacgcaggaacctaaggagggaaccaaaaagctaatgaaaattacagcagaatggctttggaaagagctgggcaagaagaaaactccaagaatgtgtacgcgcgaggagtttacaagaaaagtccgaagtaatgcagctttaggcgcaatattcactgatgaaaataaatggaagtccgctcgagaagcagtagaggacagccgattctgggaattaatagaccgagaaagaaatctccacttagagggaaagtgtgaaacatgtgtttacaatatgatgggtaaaagggaaaagaaattgggcgagtttggtaaggcaaagggatcaagagctatttggtatatgtggttgggagcaagatttttagaatttgaagccttaggttttctaaacgaggaccattggtttagcagaggaaattctctttccggagttgagggagaagggctacataggctgggttatatcctacgggatgtatctaagaaagagggcggagccatgtacgcagatgacactgccggatgggatacgagaataacactggaggatctcaaaaacgaagagatggtgactaaccatatgaaaggtgaacacaagaagttagccgaagcaatattcaaactaacttatcaaaataaggtcgtacgtgtccaaagacctacccccagaggcacggtgatggatataatttcaagaagagatcaacgtggctctgggcaagtagggacttatggacttaacacgttcacgaacatggaagctcaactgataagacaaatggaaggtgaaggcatattcaaaagtatccagcatttaactgtgactgaggagatagctgttcaaaattggttagcaagagttggaagggagcgcttaagcaggatggctatctcaggtgacgactgtgtagtaaaaccgctagacgatcgctttgcaagtgccttaaccgccctgaatgatatgggaaaagtgaggaaagacattcaacaatgggaaccaagcagggggtggaatgattggactcaagtcccattctgttctcatcatttccatgagttggtaatgaaagatggaagggtcttagttgtaccttgcaggaaccaagacgagttgatcgggcgtgcacgcattagtcaaggcgcgggctggtcactgaaggagacggcctgtctaggaaaatcctatgctcaaatgtgggctttaatgtattttcatcgtagagacctacgtctcgcagcaaacgcaatttgttcggcagtaccatctcactgggttcctacgagccgaacgacttggtcaatccacgcgaaacacgagtggatgactacagaagatatgttagctgtatggaacagagtatggattcaagagaatccatggatggaggataaaacaccggtcgaaagctgggaagaagtaccctacctagggaagcgtgaagatcaatggtgcggctcactaatcggacttacttctagagcaacctgggccaaaaatatccaaacagcgattaaccaagtacgatcgctaattggaaacgaagaatacactgattatatgcctagcatgaagcgttttcgaagagaggaagaagaagcaggagtattatggtga

SEQ ID NO: 22545 - RNA, 9876 nt, synthetic construct
  misc_feature 1..9876: note = derived and/or modified CDS sequence (opt6) from DENV-2__EU482569__SS-prME
  source 1..9876: mol_type = other RNA
acagctggggtaatcattatgctaattccgaccgcaatggcgttccaccttaccacacgaaatggggaaccccacatgatcgtaggacgtcaagaaaaaggaaaaagtttattattcaaaactgaagacggagtcaatatgtgtacattaatggcgatagacctgggagaactgtgtgaagataccataacatataaatgccccttacttaggcagaatgagcccgaagacattgactgctggtgtaatagtacatcgacatgggtcacatacggaacgtgcaccaccacaggagaacatcgtagagagaaaaggagtgtagccctagtaccgcacgtaggaatgggattagaaacgcgtaccgaaacttggatgtcatcagaaggtgcgtggaaacatgttcagagaattgaaacgtggattcttcgccaccccggatttacgatcatggcagctatcttggcatatacaattggtacaacccattttcaaagggcattaattttcattttattaactgcagtagcaccatcaatgacaatgcgctgcataggaatatcaaacagagattttgttgaaggtgtatctggaggatcttgggtcgacattgtgttagagcatgggagttgtgtaacaacaatggccaaaaacaaaccaacgttggactttgaactaattaaaactgaagcaaaacagccggcaacgcttcgaaaatattgcattgaagcaaaattgacaaatactacgacagaatcaagatgtccaacacaaggcgagccatcattgaatgaagaacaagataaacgctttgtgtgtaaacattcaatggttgacaggggttggggaaatgggtgcggattattcgggaaaggaggtatagttacttgcgcaatgttcacttgcaagaaaaatatggaaggtaaagtagtgttgccggaaaatttagaatacacgattgtaattacgccacattctggggaagaacatgccgtgggaaacgacactggaaaacacgggaaagaaataaaaataacgccacaatcaagcatcacagaggcagagttaaccgggtatggcacggtcactatggaatgttccccacgcacggggttagattttaacgaaatggttctattacagatggaagataaagcatggctagttcatcgacagtggtttttggatctacctttgccatggctaccgggtgcagacactcaaggaagtaactggattcagaaagaaacgcttgtcacgtttaaaaatccacatgcgaagaaacaggacgtagtggtgctaggctcacaagagggagctatgcatacagcgttaacaggcgctacagaaatacaaatgtcaagtgggaaccttttatttaccggacacctcaaatgtagattacgaatggataaactacaacttaaagggatgtcatactccatgtgtacaggtaaattcaaaatagttaaagaaatagccgaaactcagcatggtacaattgtcataagagtacaatatgaaggggatgggtcaccatgtaaaataccattcgaaattatggatctagagaaacgacatgtgttgggccgactaattacagtaaatccgatcgttactgagaaagattcacccgttaacatagaagcggaaccaccatttggggatagttatattattattggtgtagaaccaggtcaactaaaattgaactggtttaagaaaggttcatctataggtcaaatgttcgagacgacaatgagaggggctaaaagaatggccattctgggagacacagcttgggattttggatctctgggaggcgtatttacgtcaatcggtaaagcgctgcaccaggtattcggtgcaatatacggcgcagcattctccggggtatcatggactatgaaaattttaataggggtaataataacatggattggaatgaactcacgttcaactagcttatcagttagcctagttttagttggtgtagtaactttatacttaggggctatggttcaagcagactctgggtgcgtggtatcttggaaaaataaagagttaaaatgcggcagcggaatattcataacagacaatgttcacacttggacggaacagtacaaatttcaaccagagtcaccatccaaactggcctcagcaatacaaaaggcccacgaggagggtatttgtggaatacgatcggtaacaaggctagagaatttgatgtggaaacaaattacaccagagctaaaccatatattatcggagaatgaagtcaagttgacaataatgaccggagacataaaaggtattatgcaggccggtaagcgttcgctgagaccacaaccaaccgaacttaaatactcgtggaaaacatggggtaaagccaaaatgttatccacagaatcacacaatcaaacatttttaatagatggccccgaaactgcagaatgtcctaacaccaatcgcgcatggaactcgctagaagtggaagattacgggtttggagtctttacgacaaatatatggttaaaattacgagaaaagcaagatgtattttgcgatagtaaattgatgtcagcagcaattaaggataatagagctgtgcatgcggatatgggatactggattgagtccgctttaaatgacacatggaaaatggaaaaggcgagttttatagaagtaaaatcttgtcactggccgaagtcacacactctatggagtaacggagtactagaaagcgaaatgataatccccaaaaacttcgcaggtccggtaagtcagcacaattatagaccggggtatcacacacagacggcgggtccgtggcatttgggtaaactagagatggattttgacttctgcgaaggaaccacagttgtcgtaaccgaagattgtggaaataggggtccatccttgcgaacgactacagcaagtggtaaattgatcacagagtggtgttgtagatcctgtacgctaccgcccttaagatatcgaggtgaagatggttgttggtatggaatggaaatccgacccctaaaggaaaaagaggagaatttagtaaatagtctagtaaccgctggacatggccaaattgataactttagtttaggagtattggggatggccttatttttagaggaaatgttaagaacaagagtcgggacaaagcatgcaatattattggtagctgtaagtttcgtaactctaataactggtaatatgagctttcgagatctaggtagagtgatggtcatggtcggtgccaccatgacagacgatattggaatgggagtaacatatttagcactactcgcggcattcaaagtaagaccgacattcgcagcggggctactactaaggaagctaacttcaaaagaactcatgatggcgacgattggtattgcacttctatcgcaaagcacgataccggaaacaatcttggagctaacggacgcgctagcgcttggtatgatggtgctaaaaattgtgagaaatatggaaaagtaccaattagcggtaacgattatggcgatcagctgtgtaccaaatgccgtgatattacaaaatgcatggaaggtttcgtgcactatcttagccgcagtttcagtgagccctctattattgacttcctctcaacagaaggctgactggataccattagcactcacgataaaaggactaaaccctacggcaatctttttaactactttaagtagaacaagtaagaaacgaagctggccgctcaatgaagcaattatggccgtggggatggtcagtatcctagcaagttctcttctgaaaaacgatattcccatgactggaccactggtcgctgggggattactgacagtatgttacgtgctaaccgggagaagtgctgatctggaattagaaagggcggcagatgttaaatgggaagaccaagctgaaatttccggtagcagtccgatcctttctattacaatcagtgaagacggatctatgtcaatcaaaaacgaagaagaagaacaaacattaacaattctaataagaacgggtctgttagtcatatctggtgtattcccagtgtcaataccgataactgctgctgcttggtatctttgggaagtcaagaaacagagagcaggcgttctttgggacgtccctagtccccctccggtaggaaaggcagaactagaggatggcgcatacaggatcaaacagcgaggtattctcgggtactcacaaatcggcgccggagtgtacaaagaagggacgtttcatacaatgtggcatgtaactaggggcgcagtgctaatgcacagaggaaaaagaatagagccatcctgggctgacgtcaagaaagacttaataagctacggtggcgggtggaaactagaaggtgaatggaaggagggtgaagaggtccaagtactagccttggaacctggcaaaaacccaagagctgttcaaacaaaaccaggactatttaaaaccaacacgggaactataggtgctgttagcttagactttagccccggcacaagtggttccccaatagtcgaccgcaaaggaaaagtagtcggactgtacggcaatggtgtagtcactaggtcgggagcctacgtttcagcaatcgcacaaactgaaaagtcaatcgaagacaatccagaaatagaagatgatattttcaggaagaaacgcttaacaataatggatcttcatcctggagcaggaaaaacgaaacgatacctaccagctattgtacgagaagctattaaaagggggctcagaacgttgatattagcaccgactcgagttgtagcggcggaaatggaagaggcgctacgaggcttgccgattaggtatcaaactccagcaattagagcagaacatacaggacgggaaatcgtagacttgatgtgtcatgccacctttacgatgcggcttctctcaccagtacgggtcccgaattacaatctaattattatggatgaggcgcatttcactgaccccgcgtccatagcagctagaggatacattagtacaagagttgagatgggtgaagcagcaggaatcttcatgacagcaacgccgcctggtagtagagatccatttccacaatcgaatgcacctatcatggatgaagaaagagaaataccagaaagaagttggaactccggacatgaatgggtgacagacttcaaaggtaagacagtctggttcgtgccatcaatcaaagctgggaatgacatagcagcttgccttagaaagaatggcaagaaagtaatccaacttagtaggaagacctttgacagtgaatatgttaaaacacgagcaaatgattgggattttgtggtcacaacagacatttcggaaatgggcgcaaattttaaagcggaaagagtaattgaccccagacggtgtatgaagcctgtgattctaacagacggagaagaaagggttattttagcggggcccatgccagtaacgcatagtagtgccgcacaacgaagaggaagaattggccgcaatccgaaaaatgagaatgatcaatacatctatatgggcgaaccgttagaaaacgacgaggattgcgcgcactggaaagaagcaaaaatgctactcgacaatattaataccccagaaggaatcatccccagtatgtttgaaccagagagagaaaaggttgacgcaatagacggagagtatcggctaagaggtgaagcacgaaaaacatttgtagacttgatgagacgtggcgatttaccagtctggctagcttatagggtagcagcagaaggcattaattacgcagatcgaaggtggtgcttcgatggtatcaaaaacaaccaaatactagaggagaacgtagaagtggaaatatggactaaggaaggagaaagaaagaaactaaagccaagatggctagatgccaggatatattcagatccactggcattaaaagaatttaaagaatttgcggcaggaagaaaatcattaaccctcaacctaataactgaaatgggcagactgccaacattcatgactcagaaagctagagatgctcttgataatttggcagttttacatacggcagaggcgggaggacgagcatataaccatgcattgtcggaattacccgagacactagaaactttgctattactaacactcttagcgacggtcacaggagggatctttttattcctaatgtcagggaaagggataggaaaaatgacattgggcatgtgctgcattataacggcaagtattctactatggtacgctcagatacaaccacattggatcgcagctagcataatattggaatttttcttaatagttttattgattccagaaccagaaaaacagagaacacctcaagacaatcaactgacatacgtagtcattgcaatattgaccgttgtggcagccacaatggcaaacgaaatgggatttttagagaaaactaagaaagatctgggattaggttcgataaccacacaagaaagcgaatccaatattttagatatagaccttagaccagcgtcagcatggacactatatgctgtggcaaccacatttgtaactccaatgttacgtcactcaattgaaaactcatcggttaatgtttcattaacagctattgcaaaccaagcaactgttttgatgggcctaggtaaaggttggccgttgtcaaaaatggacataggcgttccacttctagcgataggatgctactcacaagtgaacccgattacgcttacggctgcactactactcttagtggcgcactacgcgataattgggccaggcttacaggcaaaagctacaagagaagcacagaaacgagcggcagcaggtataatgaaaaatccaaccgtagatgggataactgttatagacctagaaccaattccctatgaccctaagtttgaaaagcagttaggacaggttatgttattgattctatgcgtgacacaagttctaatgatgagaaccacgtgggcgctatgtgaggctcttaccttagccaccgggcctatttcaacactatgggaaggaaatccgggtaggttctggaatacaacaatcgctgttagcatggctaatatatttcgaggtagttatttagccggtgcgggacttctgttctccattatgaagaacacaactaacacgcgtcgaggcaccggaaacattggcgagacactcggggagaaatggaaatctagactgaatgcattaggtaaaaatgagttccaaatatataagaaatccggaatacaagaagtggataggacactcgctaaggaaggaataaaacgaggagaaacagaccatcatgcagtaagtagaggctcggcaaagctacgatggtttgtagaacgtaatatggtgatcccagaaggtaaagttgtagacctagggtgcggtcgaggtggttggtcctactactgtgggggtttgaagaatgtacgcgaggtaaagggccttacgaaagggggtccgggtcacgaagaacccatacctatgtctacttacggatggaacttggttcgattacaaagcggagttgatgtattctttacaccacccgaaaaatgcgatacgttactctgcgatataggagaaagcagcccaaaccctactatagaagccgggcgaaccctaagggtcttaaatttagtggaaaactggctgaataataacacgcagttttgtattaaagttttgaacccttacatgccctccgtgatagaaaagatggaaacattacaacgcaaatacggaggggccctagttaggaatccactatcgagaaatagtacacacgagatgtactgggtatcaaacgctacgggcaacatcgtgagttcggtcaacatgataagtaggatgctaatcaatagattcacaatgaaacataagaaagctacatatgaacccgatgttgatttgggcagtggcactcgcaatattggtatcgaaagcgaaataccaaatctcgacattattgggaaacgaatagagaaaataaagcaagaacatgaaacaagctggcactatgaccaggatcatccttacaaaacttgggcttatcatgggagctacgaaaccaaacaaactggaagcgcgtcttccatggtcaacggagttgttcgtctattgacgaaaccatgggatgtcgtcccaatggtgacccaaatggcaatgacagacactaccccattcggccaacaaagggtatttaaggaaaaagtagatactagaacacaagaacctaaagagggcaccaagaaactaatgaaaataaccgcggaatggttgtggaaagaactaggcaagaagaaaacgccccgtatgtgcacgcgcgaagagttcactaggaaggtgaggagcaatgccgcactgggtgcgatatttacagatgaaaataagtggaagagtgcccgcgaagctgtcgaagacagtagattttgggaattaatagatagggagcgtaatcttcatcttgaaggcaaatgtgaaacatgtgtttacaacatgatggggaagcgagaaaagaaattaggagaatttggtaaggccaaaggaagccgagccatctggtacatgtggctaggtgcacgatttctcgagtttgaggctttgggctttctaaacgaagatcactggttcagtagaggaaatagtttatctggcgtagaaggagaaggcctacataggttaggatatatattgcgtgacgtaagcaagaaagaaggaggcgcgatgtacgctgacgatacagctggctgggacactcgaattaccctagaagatctgaaaaatgaagaaatggtaacaaatcatatgaaaggcgagcataaaaagttagccgaagcaatctttaagctgacatatcaaaataaggtagtgcgcgttcaacgtccaactcctcgagggacagtcatggatataatatcacgaagagaccaacgcgggtcaggacaggtgggaacgtatggactgaatacgtttaccaatatggaagcgcaactcattagacagatggaaggagaaggaatatttaaaagtatacaacatttaaccgtgactgaagaaattgccgttcaaaattggttggccagggtaggacgtgaaaggttatctagaatggcaatatcgggagatgattgtgtggtaaagcctttagatgatagatttgcttcggctctaactgcactcaatgatatgggaaaagtgagaaaagatatacaacaatgggagccctctcgaggatggaatgactggacacaagtaccattctgttcacaccactttcatgagttagtcatgaaagatggaagagtcctagttgtaccgtgccgaaatcaagacgaactgattgggagagcaagaataagccagggggcgggttggtcactgaaagagacagcatgcctaggaaagtcttatgctcaaatgtggacattaatgtattttcaccgtagagatcttaggttggcagctaatgctatatgttcagcagtcccctcacactgggttccaacaagccgaacaacatggagtatacatgcgaaacatgagtggatgactacggaagatatgctcgcagtatggaaccgcgtgtggatccaagagaatccatggatggaagacaaaactccagtagagtcctgggaagaggtcccttatctaggtaaacgagaagatcagtggtgcggtagtttaataggcttaacttcacgggccacttgggccaaaaacatacaaacagcgattaatcaggtacggtcactcattgggaatgaagaatatacggactatatgccgtccatgaaaaggttcaggagagaagaggaagaggcgggagttttatggtga

SEQ ID NO: 22546 - RNA, 9876 nt, synthetic construct
  misc_feature 1..9876: note = derived and/or modified CDS sequence (opt6) from DENV-2__EU482570__SS-prME
  source 1..9876: mol_type = other RNA
acagcgggtgttataataatgcttataccaacagcaatggcatttcacctgacgacacgcaatggagaacctcatatgattgtaggccgtcaagaaaaaggcaaaagtctactattcaaaacagaagatggggtaaatatgtgtaccctcatggctatagacttaggggaattatgcgaagacacgatcacatacaaatgcccattactcaggcaaaacgaaccagaagacattgactgttggtgtaattcgacttcaacttgggttacgtatggcacgtgcactacaacaggtgaacataggcgtgaaaaacgatccgtcgcgctagtgccacacgttggtatggggctcgaaactcgaacagaaacttggatgtcaagcgaaggagcatggaaacacgtccaacgtatcgaaacctggattcttcgccatcctggattcacgattatggcagcaattttggcctacacaataggaaccacccacttccaaagagctctaatcttcattttgttgacggcagtcgctccgtccatgaccatgaggtgcataggaataagtaatagggattttgttgaaggtgtaagcggaggcagttgggtcgatatcgtgctagaacatggatcttgcgttacgacgatggctaaaaacaaaccgactttagatttcgaacttattaaaactgaagctaaacaaccagcaaccctacgtaaatattgtattgaagccaaattaacgaataccacgacggaatctcgatgtccaacgcaaggtgaaccatctcttaatgaagaacaagacaaaagattcttatgtaagcattcaatggtagaccgaggatggggaaatgggtgcggattgtttggaaaaggtggaattgtaacttgcgcaatgtttacatgcaagaaaaatatggagggtaaagtcgtccagccagagaatttagaatacacgattgtcattactccgcattcgggtgaggaacatgccgtaggcaatgatactggaaaacatgggaaggaaataaaaataacccctcagtcttcaataactgaagcagagttaacagggtatggtacagttacaatggaatgctcacccaggacgggtttagatttcaatgagatggtgctattacaaatggaagataaagcatggctcgttcatagacaatggttccttgacctacccctaccatggttacctggggcagacactcaaggatcaaattggattcagaaggagactttagtaacatttaaaaaccctcatgccaaaaagcaagatgtagttgtgttaggatcacaagaaggggcaatgcacacagcattaaccggtgcaacagaaattcagatgagcagtggaaatttgctgtttacaggtcacctaaaatgtaggttaaggatggacaaattgcaattaaaaggaatgtcttatagtatgtgtactggtaaatttaaaatagtcaaagaaatcgcggaaacacagcatgggaccatcgtaataagagttcagtatgaaggtgacggtagtccatgcaagatccccttcgaaataatggatctggagaaacgacacgtacttggacgtctcataactgttaatccaatagtaacagaaaaagactcaccagtgaatattgaagctgaaccaccgtttggcgattcatacataattataggagtagagccagggcaactcaaattgaattggtttaagaaaggaagtagtattggacagatgtttgaaactaccatgagaggcgcgaaacgcatggccattttaggagatacagcgtgggattttggtagcttgggaggagtattcaccagcattggtaaagcacttcatcaagttttcggagcaatttacggagcagctttttccggtgtttcgtggacaatgaaaatactcatcggagtgataatcacgtggataggtatgaactcacgaagcacatccctgtcagtttcattagttttggtgggcgttgtcactctctatttaggcgctatggtgcaagcagattcaggctgtgtagtatcatggaaaaacaaagaactaaaatgcggatcaggtatttttattacagataatgtacacacatggacggaacagtataagttccaaccagaatctccgagtaaactagcttctgctattcaaaaagcgcatgaggaaggaatttgtggtataaggtcggtgacacgacttgaaaacctcatgtggaaacaagttacaccagagctgaaccatatcttgtcagagaacgaagtgaaacttactattatgacaggcgatattaagggtattatgcaagcaggaaaaagatctttacgaccacaaccaacagaactgaaatatagttggaaaacatggggcaaagcgaaaatgcttagtactgaaagtcacaatcagaccttcctaatagatgggccagagacagcagaatgtccgaataccaatagagcttggaactctctggaagtagaagactacggcttcggtgtctttactaccaatatttggttaaagttaagggaaaaacaggatgtcttttgcgactctaaactgatgtcagctgcaataaaggacaacagagcggtacacgccgacatgggttattggatagaaagtgcgttgaatgacacgtggaagatggaaaaagcatcattcatagaagtaaaaagctgccactggcctaaatctcatactttgtggtccaacggagtcttagaatcggagatgataatacctaaaaactttgcaggccctgtatctcaacataactatcggcccggttatcacacccaaactgctggaccttggcatcttgggaaacttgagatggattttgatttctgtgagggtacgaccgtcgtagtaacagaagactgtggcaatagaggtccttcactacgtacgacgactgcatctggtaaacttattactgaatggtgttgtagatcatgtaccctaccgccacttagatatcgaggagaagatggctgctggtatgggatggaaatccgtccccttaaagagaaggaggagaacttggtaaattcgttggttacagctggccatggacagattgataatttttcactaggagtacttggaatggccctattcttagaggaaatgttgcgcacacgagttggaacaaagcatgcgattctcttagtagcagtatcatttgtgacgctaatcactggtaatatgagtttccgtgatctaggaagagtaatggttatggtaggagctactatgacagatgatataggaatgggtgtgacttatttagcgcttctggcagcctttaaagttcgaccgactttcgcagcaggacttctactgagaaagttgacatctaaagagctaatgatggcaacaattggcattgctcttttgagtcaatctacgatcccagaaacaatactagaacttaccgacgctctcgccctaggaatgatggtgttgaaaatagtccgtaacatggaaaaatatcagctagcggtgacgattatggcaattagctgtgtccctaatgctgtcatcctacaaaacgcttggaaagttggctgtacaatcttagcagctgtatcagtaagcccacttctattaacaagttcacaacagaaagccgattggataccacttgcactaactattaagggactcaatcctacagcgatctttctgactacattaagcagaacatccaaaaagcggagttggcccttgaatgaggccataatggccgtaggcatggtttcaatactagcatcaagtctattgaagaacgatattccgatgaccggacccctagtggccggaggtctattaaccgtttgctatgtcttgaccggccgaagcgcagacctagaattagaaagagccgcagacgttaaatgggaagatcaagccgaaataagcggcagcagccccattttatcaattacaatatcagaagatggaagtatgtcaattaaaaacgaagaagaagaacaaaccctgacaatactaataagaacagggttattggtaataagcggagtattccctgtaagcataccgattacagcggcagcatggtacttatgggaggtgaaaaagcaaagagcgggcgtattgtgggatgtaccatcacctccgccagtagggaaagccgagttagaagatggagcttacagaattaaacaacgcggtattcttggatattcacaaattggcgctggtgtttataaagaaggtaccttccatactatgtggcacgtgaccagaggagcagtactcatgcatcgtgggaagaggatagagccttcttgggccgatgtaaagaaagatcttatatcttacggcggaggctggaaactagaaggggaatggaaggaaggggaggaggtacaagtattagcactagaacctggaaagaatcccagggcggtacaaactaaaccagggctctttaaaactaacacaggaactataggagcggtctcactagatttctcaccaggaacctcaggcagtccaattgtcgacagaaaggggaaggtcgtaggactttatggaaatggggtagtaacacgaagtggagcatatgtttctgctatagcacaaacagaaaaatcgatcgaagataatcccgaaatagaagacgatatattcagaaagaaacgactcacaataatggatcttcacccaggtgcgggcaaaacaaaaagatatctaccggcaatagtgcgagaagctataaaaagaggcctaagaactttaatactagcacctacaagagtggtagcagcggaaatggaagaggcattaagaggactcccaataagataccagactccggcaattagagcagaacacacaggaagagagatagtggacctcatgtgtcatgctacgtttaccatgcgattgctatccccagtaagagttccgaattataacctcataataatggatgaggctcattttacagaccctgcatctattgctgcaaggggatatatttcgacaagggtcgaaatgggcgaggcggcaggtatcttcatgaccgccactcctccgggatcgcgagatccatttccacaatccaatgccccaataatggatgaagaacgagaaatacccgagcgtagctggaactctggacacgaatgggttacagatttcaaaggaaaaacggtatggttcgtcccttcaataaaggctggtaatgatatagccgcctgtcttcgtaagaatggcaagaaagtaattcaactctcgcgaaaaacattcgactcggaatacgtcaaaacaagagcaaatgattgggactttgttgtcaccacagacatttccgaaatgggtgcgaacttcaaagcagaacgagtaatagatccaaggagatgcatgaaaccagttattttgactgacggagaagagagagttatactagcgggacccatgcctgtcactcactcatccgctgcacaaagaagaggacgtataggacgaaaccccaaaaatgaaaatgatcagtatatatatatgggagagccactggaaaatgatgaggactgtgcacactggaaagaagcaaaaatgcttctggacaacataaatactcccgaaggtataatcccctcaatgttcgaacctgagagagaaaaggttgatgcaatcgatggggaatacagattaagaggtgaggcaagaaagacatttgtagacctcatgaggcgcggagatttaccagtctggctagcttatagagtagcagcagaagggataaattatgcagacaggagatggtgttttgacgggattaaaaacaatcaaatcttagaggaaaacgtagaagttgaaatatggaccaaagaaggagaacgtaaaaagttgaaaccacgatggttagacgcacgcatatactcagacccattggctctaaaagagtttaaggaatttgccgccggacgaaagtccctgacgttaaatttgatcacagaaatggggcggctcccaacttttatgacacaaaaagctcgggatgccctggacaacttagctgtattacataccgcagaggctggagggaaagcgtacaatcacgcgttgtctgaattgccagagaccctagaaacgttattgttgctaaccttattggcaacagtaactggaggcatctttctatttttaatgtcaggaaaaggcatcggtaaaatgacgttaggaatgtgttgtattataactgcatcgatcttattatggtatgcacaaatacaacctcattggatcgcagcatcaattatattagagttctttctaatagtcttattgattcctgaaccagagaaacaaaggaccccacaagacaatcaattaacatatgtcgtaatagcaatactgaccgtggtagcagcaacaatggcgaatgagatggggttcctagagaaaaccaagaaagaccttggacttggatctataacaacgcaagagtccgaaagtaatatattagacatagatctaagaccagcatcagcctggactctttatgcagtggcaactaccttcgtgacgcctatgttaagacactccattgaaaattcatcagtaaatgtttctctcacagctatagccaaccaagcaaccgtacttatgggattgggtaaagggtggccgctatcaaaaatggatattggagtacctttattagcgataggctgctatagccaagtgaacccaatcacacttacggcagctctcctattattggttgcacactacgcaataatcggcccaggactacaggctaaggccacgcgtgaagctcagaaacgggctgccgcgggtataatgaaaaatccaacagtggacgggattacagttatagacttagagcctattccatatgacccaaagttcgaaaaacagctaggacaagtaatgctgctaatattatgcgtcacacaagtactaatgatgagaaccacctgggctctttgtgaagcattaacactagctacagggccgatttcaactttatgggaaggaaatcctgggcggttttggaatacaacgatagcagtttccatggcaaacatcttcagagggagttacctagctggggccggactactctttagtatcatgaaaaatacgactaacacgcgacgaggcacaggcaacataggtgaaactcttggtgaaaaatggaaaagtcgacttaatgcgttaggaaaaagtgagttccaaatctacaaaaagtctggaatacaagaagtagaccgtaccttagcaaaagaggggataaagagaggcgagactgaccatcatgcagtttcacgtgggtcggctaagctacggtggtttgtagagagaaacatggtaacgcctgagggcaaagtggtcgatttagggtgcggccgcggtggatggtcctattattgcggtggcctcaaaaatgtccgggaagtaaaaggtctcacgaaagggggaccaggacatgaagaaccgataccgatgtccacttatggttggaacttagtaagattgcagagtggtgtggacgtattctttacgcctccagaaaagtgtgatacactcttgtgtgatataggcgaatcatcacccaacccaactatagaggcaggacgaacgttgcgagtattgaatctagtagagaattggttaaataataatactcaattctgtataaaagtcttaaacccctatatgccgtcagtaatagagaagatggaaacattacaacgaaaatacggtggggcgttagtgcggaaccccttatccagaaattccacacatgaaatgtattgggtgagcaatgcaactggtaatattgtatcttctgtaaatatgataagtagaatgttgataaataggtttacaatgaagcataaaaaggcaacttatgaacctgacgtagacctgggatctggaacccggaacatagggattgaatcggaaatacctaatctagacatcataggcaaaaggatagagaaaatcaaacaagaacacgaaacgagttggcattatgatcaagaccatccatataagacatgggcctatcatggctcatatgagacgaaacaaaccggttcagcctcatcaatggtcaacggggttgttagactattaaccaaaccgtgggatgtggttccgatggttacccaaatggcgatgacggacacaacaccctttgggcaacaacgcgtattcaaagaaaaagttgacactaggacacaagagcctaaagaagggactaagaaacttatgaaaatcacagctgagtggttatggaaagagttgggcaagaagaaaacacctagaatgtgtaccagggaagagttcacgcgtaaagttcgaagtaacgcggccttaggagctatcttcaccgatgaaaataaatggaaaagcgctagagaagctgtagaagattcgagattttgggaattggtggaccgagagcgaaatttgcacctagaaggaaaatgcgaaacatgcgtatataacatgatgggaaagagagagaaaaagttgggagaatttggcaaagcgaaaggatctcgagcaatttggtatatgtggttaggcgctcgatttttagagttcgaagcattgggtttcctcaacgaagatcactggtttagtcgcggaaattcactctctggcgttgaaggcgagggcttgcaccgattaggatacatactgaaagacgtatccaagaaagagggaggcgcaatgtatgcagacgacaccgcgggttgggacacgagaataacgctggaggatcttaaaaacgaggagatggtaaccaaccatatgaagggcgaacataagaaattagctgaggcaatatttaaattgacctaccaaaacaaagttgtgagggtccaaagaccaacaccacgcggtacagtaatggatatcataagtcggcgtgatcaaagaggatctggtcaagtagggacttatggtctaaacacttttactaacatggaagcacagttaatacggcaaatggagggagaaggaatatttaaatccattcaacaccttaccgttacggaagaaatagcggtacaaaactggttagcaagagtgggcagagagcggctatcaagaatggtcatctctggtgatgattgtgtcgtgaaaccgcttgatgacagatttgcttcagctctcacggctctaaatgatatgggaaaagttagaaaagacatacaacaatgggaaccaagcagagggtggaatgattggacgcaggttccgttctgttcacatcatttccatgaattagttatgaaagacgggcgggtgttagttgtaccttgcagaaatcaagacgagttaataggtcgcgcacgcatatcacaaggagccggatggtcgttaaaagagacggcttgtttaggtaagtcgtatgctcaaatgtggacactaatgtactttcaccgaagagatctaaggttagcagcaaacgcgatctgtagcgcagtcccgtcacattgggtaccgacatcgagaacaacttggtcaatacacgccaagcatgagtggatgactacagaagatatgttagcagtgtggaatcgtgtctggattcaagaaaatccctggatggaagacaaaacccctgtcgagtcctgggaagaagtaccatacttaggtaaaagagaagatcaatggtgtggttcactaatcggtttaacgagtcgcgcgacatgggccaaaaatatacaaacagccatcaaccaggtccgtagcttaatcggaaatgaagaatatacagattacatgccttcaatgaaaagatttcggcgagaggaagaagaagctggtgtgttgtggtga

SEQ ID NO: 22547 - RNA, 9876 nt, synthetic construct
  misc_feature 1..9876: note = derived and/or modified CDS sequence (opt6) from DENV-2__EU482571__SS-prME
  source 1..9876: mol_type = other RNA
actgctggggttattataatgctcataccaaccgcaatggcattccatctgactactagaaatggtgaaccacatatgatagtagggcggcaggaaaaaggaaaatctctactatttaaaactgaagatggagtaaatatgtgcactcttatggcaattgatttgggggaattatgtgaagatactattacttacaaatgtccgctattaagacaaaacgaacccgaagacatagactgttggtgcaattccacgtcaacttgggtgacatacggaacatgcacaacaacaggagaacatcgcagagaaaaacgaagtgtagctctagtaccacacgtaggaatgggattagaaacacgcactgaaacttggatgtctagtgaaggagcatggaaacatgttcaaagaatagaaacatggattttaaggcaccctggatttactataatggcagcaattctcgcatatacaataggcaccacacattttcaaagagctctaattttcatattgctgacagcagtagcaccaagtatgacaatgcgttgtataggaataagtaatagagattttgtagaaggagtaagtggaggctcatgggtagatatagttttggaacacggttcgtgcgttactacgatggccaaaaataaaccaactttggactttgaattaataaaaaccgaagcaaaacaacctgcaacattaaggaaatattgcattgaagccaaacttactaatacaacaactgaatcacgatgcccaacacaaggagaaccgtctctaaacgaagaacaagacaaaagatttctttgtaaacactccatggttgaccgaggatggggcaatggctgtggtctatttggaaagggaggcatagtaacttgcgctatgtttacatgtaagaaaaatatggaaggaaaagtcgttctgccggaaaatttggaatacaccattgtgattacaccccacagtggtgaagaacacgcagttggtaacgatacaggcaagcatggcaaggaaataaagataacacctcaaagttcgataactgaagcagaactgactggatatgggacagtaaccatggaatgctctcctcgtacgggactagactttaatgaaatggtgttattacaaatggaagacaaagcatggctggtacatcgacagtggttcttagacttgccactaccgtggcttccaggggctgatacacaaggatcaaattggatccagaaagaaacgttagtaacttttaaaaaccctcacgcgaaaaagcaagacgttgtagtcttggggtcccaagagggtgcaatgcacactgctcttacgggtgcaaccgaaattcaaatgagctccggaaacctattgtttacaggccatttaaaatgtaggttgagaatggataaattacagttaaaaggcatgagctacagcatgtgcacaggcaaatttaaaattgtaaaggaaatcgcagaaacgcagcacggcactatagttatccgagtacaatatgagggtgatggcagtccttgcaaaataccgttcgagatcatggatcttgagaagcgtcatgtcctaggtcgactgattactgtcaatccaatagttactgaaaaagattcacctgtaaacatcgaagcagagcctccatttggggattcatatattataataggagtagagccaggtcaactaaaactaaactggttcaagaaaggatcctcgatagggcaaatgtttgaaacaacaatgcgtggagctaagaggatggcaatacttggggataccgcatgggattttggtagcttaggtggagtattcacgagtatcggtaaagcacttcatcaagtctttggagcaatttatggagcggcattttcaggtgttagttggacaatgaagatcttaattggggtaataataacttggattggtatgaatagtcgatcaacttcgttaagtgtatcgttagtgttagtcggagtagttacactatatctaggtgccatggtacaggcagattctggatgtgtcgttagctggaaaaacaaggaattaaaatgcggttcgggaatatttattacagataacgtacacacctggactgaacaatacaaatttcagccggaatcgcccagtaaattagcatcagcaatacaaaaagcacacgaagaaggaatatgtggtattagatctgttaccagattggaaaacttaatgtggaaacagataacgcccgagttaaatcacattttatctgaaaatgaagtaaaactaacaataatgacaggagacatcaagggcattatgcaagcaggaaaacgaagtctcagaccgcaacctaccgaattgaaatattcatggaaaacttggggaaaagctaaaatgctaagtactgaaagtcataaccaaactttcctcatagatgggccagaaacagcggagtgtccaaataccaatcgggcatggaatagcttagaagttgaagactatggatttggagtatttacaacaaacatctggctcaagttaagagaaaaacaagacgttttctgcgatagcaagctgatgtcagctgcgattaaagacaacagggccgtacacgctgatatgggttattggattgagtcagctctcaatgatacgtggaaaatggaaaaggcatcatttattgaagtaaaatcttgccattggccaaagagtcatacattatggtcaaacggggtcttagaatcagagatgataattcccaaaaattttgcagggccggtttctcaacataattacagaccagggtatcacacacaaactgcgggtccatggcatttaggaaagctcgaaatggatttcgacttttgtgaaggaacgacagtagtggtaactgaagactgtgggaatcgaggtccgtctctacgaacaacgacagcgtcgggcaaactaattacagaatggtgttgcagaagttgcactcttcctcccttaagatatcgtggtgaagatggctgttggtatggtatggaaatccggccattaaaggaaaaagaggaaaatcttgtgaatagtctagtaactgccggacacggacaaattgataatttttcactcggtgtcttgggaatggctttattcctagaagaaatgcttagaacaagagtcgggactaaacacgcaatacttctagtagctgtttcctttgtaacactcattacggggaacatgagttttcgtgacctaggacgcgttatggtaatggtaggagcaaccatgacggatgacattggtatgggagtgacatatttggcactcttagccgcattcaaagtccggccgacattcgcagcaggtttactcttaagaaaattaacaagtaaagagctgatgatggccactataggtatagcacttttgtcacaatctacaatccctgaaaccatattagagttaaccgatgcactcgcccttggaatgatggttctcaaaatagtgcgcaacatggagaaatatcaattggcagtcacaataatggcaataagttgtgtcccgaatgcagtaatacttcaaaacgcgtggaaagtctcgtgcacgattctagcagctgtctctgtctctccattactactaacctcgagtcaacagaaagctgattggataccacttgctttgacaattaagggattgaatccaactgcaattttcttaactaccctatccagaaccagtaagaaaagaagctggccacttaatgaagcgattatggcggtaggaatggtatcaattctagcatctagcttattgaagaacgatataccaatgacaggccccttagtagcaggaggtttactcactgtatgctacgtattaactggccggagtgcagatctagaacttgaaagagcggcagatgttaaatgggaagatcaagccgaaatatcaggttccagcccaattttatctataacaatttctgaggatggaagtatgtcgatcaaaaatgaagaggaagaacagacgctgacaattctgataagaacaggtctacttgttatatcgggtgtattccccgtgtctatacccataacggcagcagcttggtacctatgggaagtaaagaaacaacgtgccggtgtactgtgggatgtacctagtccaccaccagtaggcaaagcagaattagaagatggggcttaccgtattaaacaaagaggtatcttaggctattcccaaattggtgcaggggtctataaagaaggtacttttcacacaatgtggcatgtcacgaggggcgcggtattaatgcatagaggaaaaaggatagaaccctcctgggcagatgtcaagaaagatcttatctcgtacgggggcggatggaaacttgaaggggaatggaaagaaggagaagaagtacaagtgctggcattagaacccggcaaaaatcctcgcgcagtacaaacaaaacctggtttgttcaaaacaaatactggaacaataggggcagtatcattggacttttccccaggaaccagtggaagtccaattgtagatcgcaaaggtaaagtagttggcttgtacggaaacggagtggtgacacgtagcggtgcatatgtcagtgcgattgcgcagacagagaaaagtatagaagataatccagagatagaggatgacatatttaggaagaaaagattgacaattatggatctgcaccctggcgccggaaaaaccaaaaggtaccttcctgccatagtacgtgaagctattaaaagagggttaagaaccctaatattagcaccgactcgtgtcgtggcagctgaaatggaggaagcattgaggggtttaccaatcaggtatcaaacgccagctatccgtgctgaacacacaggtagagaaatagtagatttaatgtgccacgcaactttcaccatgcgtcttttatcaccagtaagagtacctaactataatcttatcatcatggatgaagcacattttacagaccctgcgtcgattgcagcacggggatacatctctacccgagtagaaatgggcgaagctgcgggaatatttatgacggctactcccccaggatcacgtgatccttttccgcaaagcaatgctcccatcatggatgaggaaagagagataccagaaagaagttggaactcaggacacgaatgggtaacggatttcaaaggtaagacggtatggtttgttccaagcataaaagcgggtaatgatatagccgcatgcctacggaaaaacggcaagaaagtgatacaattatcccgaaagacttttgatagtgaatatgtcaagacaagagcaaatgattgggatttcgttgttacgaccgacataagcgagatgggggcgaatttcaaagcggaacgtgtaatcgatccaaggagatgtatgaaacccgtcatactcactgatggggaagaacgagtgatactggcaggtcctatgccagtaacacattcatctgctgcacagagaagaggtagaatcggcaggaatcctaagaatgaaaacgaccagtacatatacatgggagagccgttagaaaatgacgaagactgcgcgcattggaaagaagcaaagatgctactggacaacataaacacacctgagggcattatccccagtatgttcgaaccagaacgggagaaagtagatgccatagacggcgaatacaggttacgtggagaagcaagaaagaccttcgtagacctgatgcggcgtggggatttgccagtatggttggcatacagagtagcagcagaggggatcaattatgcagatagacgctggtgtttcgacggaattaaaaataaccaaattcttgaggaaaatgtagaagtggaaatatggaccaaagaaggtgaacgaaagaaacttaaacctcggtggttagacgctcgaatttattcagaccccttagctctaaaggagtttaaagaatttgcggcaggtaggaagagtttaacgttaaatttaataaccgaaatgggccgtttaccaacgttcatgacacaaaaagcgagggatgcattagacaatctggcagtactacatactgcagaggccggtgggagagcttataaccatgcattgagcgaactacctgagaccctggaaacgctacttctattaacattactggccacggttacaggtggaatattcctcttcttaatgtccgggaaaggaataggaaaaatgacattagggatgtgctgtatcataaccgcgtcaatattactgtggtatgcgcaaatacaacctcattggattgccgccagcataattctggagttcttcttgattgtactattgatacctgagcctgagaaacaacgaacgccccaagataatcagttaacgtatgtcgtgatagcgattttgaccgttgtagcagctacaatggcgaacgaaatgggatttttagaaaagacaaagaaagacctaggtttgggatctattacaacccaagaaagcgagtcaaacatactggacatagatcttagaccagcctcagcttggacattatacgcggtagctacaacattcgttactccaatgttaaggcactccatagaaaacagctcggtcaatgtatcattaacagcaatagcgaatcaagcaacagttcttatgggattaggtaaaggttggccgctaagtaagatggatataggggtgccccttttggccataggatgctattcacaagtaaaccctataacccttacagcagctttacttcttttagttgcccactatgccataataggaccagggttacaagcaaaggcaacacgggaagctcaaaagcgcgccgcagcaggtatcatgaaaaatcctacagtagacggtataacagttatcgaccttgaacctatcccatatgaccctaaattcgaaaaacagctaggtcaggttatgttattaattctatgtgtaacgcaagtattaatgatgagaacaacatgggcattatgtgaggcgttaaccttggctacgggacccatttcaacactatgggaaggaaacccaggacgtttttggaacactaccatagccgtaagcatggcaaatattttcagaggttcatatctagccggagccggactcctattttcgatcatgaagaacaccaccaatacgcgaagaggcacgggtaacattggggaaaccttaggcgagaaatggaaatcaagattgaatgctctaggcaaatctgagttccaaatctacaagaaaagcggaatccaggaagttgaccgaactttagctaaggaaggtataaaacgaggagagacagaccatcacgctgtttcgcgggggagcgcaaaactgagatggtttgtagaaagaaacatggtcactccggaaggtaaagtggtagatttgggttgcggacggggtggatggtcatactattgtggcgggcttaagaatgtcagagaggtaaagggattaacaaagggagggcctggtcacgaggaaccaatacccatgagtacatacgggtggaatttagtacgattacagtctggagtggatgtattctttacacccccggaaaaatgcgacacactcctgtgtgatataggcgaaagttccccaaacccgacaatcgaagcaggtaggaccttacgtgttctcaatcttgtcgagaattggttaaacaacaacactcaattttgtatcaaagttcttaacccctatatgcctagtgttatcgagaaaatggaaaccttacaaagaaagtatggtggtgcgttagtacgtaacccgttaagccgtaacagtactcacgaaatgtattgggtatctaatgcaaccggcaatatagtaagttcggtaaatatgatctcgcgaatgcttatcaaccgatttacgatgaagcataagaaagcaacctacgaaccagatgtagacttaggtagtggaactcgcaatattggtattgagtcagaaatcccaaatttagacataatcgggaaaagaatagagaagataaaacaagagcatgagacttcctggcattatgatcaggatcatccttataaaacatgggcctaccatggatcctatgagactaagcaaacagggtcagctagttccatggttaacggggttgtccgactattaactaaaccatgggatgtggtaccaatggtaacgcaaatggctatgactgacactacaccctttgggcaacaacgcgtttttaaggaaaaagttgacactcgcacgcaggagccaaaagaaggcaccaagaaattaatgaaaataactgccgcctggttgtggaaagaattggggaaaaagaaaacacctcggatgtgtacaagagaagagttcacacgaaaggttcggagcaatgcggcgctaggagcgatatttactgatgaaaacaaatggaagtcagcacgggaagctgtagaagattcgagattttgggaattaatagaccgagagagaaatttgcaccttgagggaaaatgtgaaacatgcgtttataatatgatgggaaaaagagaaaagaagctgggagagtttggaaaagcgaaaggaagcagagctatttggtatatgtggttaggcgcgcgatttctggagttcgaagcactaggcttccttaacgaggaccactggtttagtagaggaaattccttaagtggagttgaaggagagggattgcatagattaggttacatattaagggatgtatctaagaaagagggtggcgctatgtatgcagatgacacagcgggttgggacacaagaataacattagaagacttgaaaaatgaagaaatggttacaaatcatatgaagggcgaacacaaaaagttggctgaagccatctttaaactgacatatcagaataaggtagtcagagttcaacgccctacaccaagagggacagtgatggatatcatttcacgtcgggatcaacggggatccggtcaagttggaacctatgggttgaatacatttacaaatatggaagcacaacttatacggcaaatggaaggtgaaggaattttcaaatcaatacagcatctaaccgttacagaggaaatagctgtacaaaactggttagcacgggttggaagagaacgactttcacgaatggccattagtggcgacgactgtgtagtgaaacccctagacgaccgttttgcgtcggcattaaccgcactaaatgacatgggtaaagttagaaaggatattcaacaatgggaaccttcaaggggatggaacgactggacgcaggtcccattttgttcccatcatttccatgaattagtaatgaaagatggacgagtgctcgttgtaccatgtcgcaaccaagatgagcttataggacgtgcgcgaatcagtcaaggtgccggttggagcctaaaagaaacagcatgtctcggcaagagttatgctcaaatgtggactttaatgtatttccatagacgtgatttacgactagcagctaatgcaatttgtagtgcagtaccatcgcactgggtcccaacgtcccgaactacatggagtatacatgccaagcacgaatggatgacaacagaagatatgttggcggtatggaatagagtttggattcaagaaaatccctggatggaagacaagacccctgtagaaagttgggaggaagtcccgtaccttggtaagagggaagaccagtggtgcggatcattaataggactcactagccgagcgacttgggcaaagaatatacagacggcaatcaaccaggtaagatcattaataggaaacgaagaatatactgactacatgccatcaatgaaaaggttcagaagagaggaagaagaggctggcgtgctatggtga

SEQ ID NO: 22548 - RNA, 9876 nt, synthetic construct
  misc_feature 1..9876: note = derived and/or modified CDS sequence (opt6) from DENV-2__EU482572__SS-prME
  source 1..9876: mol_type = other RNA
acagctggtgtcataattatgttgatcccaactgcaatggcattccacttaactactaggaatggagaaccacacatgatagtaggaagacaagaaaaaggtaaaagtttattgtttaaaacggaagatggtgtaaacatgtgcacgcttatggcaatagatctaggcgaattatgtgaagataccataacttataaatgcccactactgcggcaaaatgaaccagaagacatagattgctggtgtaactctacaagtacttgggtaacttacggaacatgtacgaccaccggagaacatagaagagagaaaaggtcagtggcattagtgccacacgttggaatgggtttagaaacaagaactgaaacatggatgtcaagcgaaggcgcctggaaacatgttcagcggatagagacatggatacttcgacatccaggctttacaataatggcggccatattagcatacacaattggcactacacattttcaacgagcccttatatttatactattaacagcagtagcaccgtcgatgacaatgcggtgtattggaatttcaaacagagatttcgttgaaggggtaagtggtggtagttgggtagatatagtattagaacatggtagctgtgttactactatggctaaaaataaaccaacactcgattttgaactaatcaaaactgaagctaaacagccagcaacacttagaaaatattgtatcgaagctaaattgactaataccactacggagtcacggtgcccgacccaaggagaacccagtttgaacgaagaacaagataaacgctttctctgtaaacattcaatggtcgatagaggctgggggaacggatgtggtctctttggaaaaggaggaatcgtaacttgcgctatgttcacgtgcaagaaaaacatggaaggaaaagtcgttcagccagagaacttagaatatacaattgtgataactccccatagcggagaggaacatgcagtaggaaacgacactgggaaacacgggaaagagattaaaataacaccacaaagttctattactgaagcggaattaacaggctacggaacagttacaatggaatgttcgccacggaccgggctcgatttcaacgaaatggtacttctacagatggaagacaaagcatggcttgttcatagacagtggttcttagatttacccttaccttggctgccaggagcggatacacaaggatcaaactggatacaaaaagagaccctcgtcacttttaaaaaccctcacgctaagaaacaagatgtagtggttctgggaagccaagaaggcgctatgcatacagcactcacaggtgcaactgaaattcaaatgtcttcagggaatctcctattcacaggacatttgaaatgtcgtctgagaatggataaattgcaactaaaaggcatgtcgtatagcatgtgtaccggaaagtttaagattgtgaaagaaatcgcggaaacgcaacatggcactatcgtaatcagagttcaatatgaaggggatggtagtccctgtaaaattcccttcgaaattatggatctagagaaacgccatgtattgggacgattaattacagttaatccaatagtaaccgaaaaagattctccagtaaatattgaagcggaaccgcctttcggcgacagctatataatcataggtgtagaacctggacaacttaaactaaactggttcaagaaagggtcatccattggtcaaatgtttgaaacaactatgagaggagctaaacgaatggctatacttggcgatacagcatgggactttggatcacttggaggggtgtttacaagtatcggaaaagcgttacatcaagtatttggggcaatatatggtgctgcattttctggagtttcgtggacaatgaaaattttaatcggagtaattataacatggataggtatgaatagcaggtcaacgtctttatctgtctcacttgttcttgttggggtggtaacactatatttgggtgctatggtccaagcggatagtgggtgtgtggtatcatggaaaaataaagaacttaaatgtggtagtggaatctttataacagacaacgtccatacttggacagaacagtacaagtttcaacctgaatcgccctctaaactagcatctgcaatacagaaagcacatgaagaaggaatatgcggaattagaagcgtcacacgactagaaaatttaatgtggaagcaagtcactccggaactcaaccatatattatcagaaaacgaagtaaaactcaccataatgaccggtgatattaagggcataatgcaagctggaaaaagatctttacgtccacagccgacagaactgaaatactcatggaaaacgtggggtaaagcaaaaatgctctcaacagagtcacataaccaaacatttttaatcgatggcccagaaacagcagagtgcccaaatacaaatagggcatggaacagcttagaagtggaggattatgggtttggcgtatttacgaccaatatatggttaaaattaagagaaaaacaagatgtattttgcgattctaaactgatgagcgcagcaattaaagacaatcgcgctgtacacgcagacatgggctattggatcgagtcggctttaaacgacacgtggaaaatggaaaaggcgtcgtttatcgaagttaaatcatgtcactggcctaaatcacacaccttatggtcgaacggggttttagaaagtgagatgataatccccaaaaatttcgcgggtcctgtaagtcaacacaattaccgacctggttaccacacacaaacggcagggccatggcatctcggaaaactagaaatggattttgatttttgtgaagggacaaccgtagtagtcacaggtgactgcggaaatcgaggtccgtcactacgaactaccacagccagtggaaaactgattacagaatggtgctgtcgttcctgcacacttccacccctcagatatagaggtgaagatggatgctggtacggtatggaaataagaccattaaaggaaaaagaggagaacttagtaaattcgcttgttactgctggtcatggtcaaatagataatttcagcttaggagttctaggcatggcgctgtttttggaagaaatgctccgtacaagggttggaacgaagcacgccattttattagttgcagtgtcgttcgtaacattgattactggcaatatgtcgtttagggacctcggtcgtgtaatggtgatggtaggggcaaccatgaccgacgacatcgggatgggtgtaacctatctagcgttgctagcagccttcaaagtaagacccaccttcgcagcaggattgttactaaggaagttaacttcaaaagaactcatgatggcgacgatcggcattgcacttttatcgcagtcaactatacccgaaacaatcttagaactgacggatgcattggctttaggaatgatggtattgaaaatagtgaggaatatggaaaagtatcaattagcagtaaccattatggccattagttgtgtccccaacgcagttattttacaaaatgcatggaaagtatcttgcacaatcttagccgtagtgagtgttagcccacttttattaacttcaagccaacaaaaagcagattggataccacttgcacttacaataaagggtttgaacccaactgccatattcttaacgacgttatcaagaacctctaaaaagcgaagctggcctctaaatgaagcgattatggcagtaggaatggtcagcatactcgcatcgagtcttttgaaaaatgatattcctatgactggaccattggtagctggagggcttctaacagtatgctatgtcttaacaggaaggtcagcagacttggaattagaaagggctgcagatgtcaagtgggaggaccaggccgaaatatccggaagctccccaattctaagcataacaatttcggaagacggatccatgagtatcaaaaatgaggaagaagaacaaacactaacaatattgatacgaacaggtctgttggtgatctcaggcgtattcccggtgtcaattccaataaccgcagcagcatggtatctatgggaggtcaagaaacaaagagcaggagttttatgggacgtcccatctccacctccggtgggtaaagcagagttagaagatggcgcgtacaggattaaacaaagaggaatactaggatactcccaaataggagctggagtctacaaagagggcacatttcatacaatgtggcatgttaccagaggggcagttcttatgcacagagggaagagaatagaacctagctgggcagatgtaaagaaagatctcatcagttacgggggagggtggaaacttgagggcgagtggaaagaaggagaagaagtacaagttttagcattggaacctggaaagaatccccgtgctgtgcagacaaagccgggactctttaaaactaatacaggaacaatcggtgcggtgagtttagatttctctccaggaacgtcaggatcccctattgtggatagaaaagggaaagtagttggactatacggcaacggtgtcgtaacaagaagtggagcatatgtaagcgcgatagcgcagacagaaaaatcgatcgaagacaatccagaaattgaggatgatatttttcggaagaagcgtttgacaataatggatctacacccaggagccggcaaaacgaaacgctatctaccagctatcgttcgtgaagccatcaaaagaggactccgtactcttatactggcgcctaccagagtagtcgcagctgagatggaagaagcgttgagaggtttaccaataagatatcaaactccagctattagggcagagcacacaggacgtgaaatagttgatttaatgtgtcatgccacttttacgatgagactcctaagtccagtacgagtacctaattataaccttataataatggatgaagcccacttcactgacccagcatcgatcgccgcaagagggtacatttccacgagagtggaaatgggagaagccgctggtatattcatgacagcaacaccacctggatcccgagatccttttccacaaagtaacgcgccaatcatggacgaggaaagagagataccagaacgatcatggaactcaggccacgagtgggtcactgattttaagggtaagaccgtatggttcgtaccttccatcaaagccggcaatgatatagcagcgtgcctacgaaagaacggcaagaaagtaatacaactcagtcgaaaaacgtttgactcagaatatgttaagactcgtgcgaatgattgggactttgtcgtaactacggatatttcggaaatgggagcaaactttaaagctgaaagagttatagatcctcgaagatgtatgaaacctgttatactaacggatggagaagaaagggttatcttagcgggtcccatgccagtcacacactctagtgctgcccagaggagaggccgtatcggacgaaaccccaaaaatgaaaacgaccagtacatatatatgggtgagccattagaaaacgacgaggactgtgcacattggaaagaggctaaaatgcttttagataacataaatacaccagagggaataatacctagtatgtttgaacccgaaagagagaaagtggatgcaatagacggagagtatcggttacgtggagaagcaagaaagacatttgttgacttgatgcgccgaggcgatttacctgtatggctcgcatacagagtagcagcagaaggtatcaactatgcagacagaagatggtgcttcgacgggatcaaaaataaccaaatactagaagaaaatgttgaagttgaaatttggacaaaagaaggtgaacggaagaaacttaaaccaagatggttagatgccaggatatactccgatcctttagcattgaaagagttcaaagagttcgccgccggtcgcaaatcactgacactgaatctcataaccgaaatgggcaggttacccacgttcatgacccaaaaggcaagagatgctcttgataacttagccgtactacatacagccgaagctggaggaaaagcgtataaccatgcgctatctgaattaccagaaacactggaaacactgttattgttgacattactggcaacagtgaccggaggaatattcctgtttttaatgtctgggaaaggaataggcaaaatgacattaggtatgtgctgtataataacggcatctatactactttggtacgcacaaatacaaccacattggattgctgcgagtattatactagaatttttcctcatagtgttgttaattccagaaccagaaaaacaacgaactcctcaagataatcaattaacgtatgttgttatagctatcttgactgtagtggcagccactatggcgaacgaaatgggttttcttgagaaaactaagaaagacctaggattagggagcataacaacacaagaatccgaaagtaatatccttgacatagatctccggccagctagtgcttggacactctacgcagtagctacaacatttgtaacaccgatgctaagacactcgattgaaaattcatcggttaatgtttctttgacggcaatagctaaccaggcaactgtcctgatgggtttaggcaaaggatggccgttgtccaaaatggacataggcgtccctcttcttgcgataggttgttattcccaggttaatccaataacacttactgcagcgctcttattgctcgtagcccattacgctataattgggcctggattacaagctaaggcaacacgggaagcacagaaaagagctgccgcagggataatgaaaaaccctacagttgatggtataacagtcatagacttagaacctataccatatgatccgaagttcgaaaaacaattgggacaggtaatgttgttgatactctgcgttacacaggtaatgatgatgcggacaacctgggcattatgcgaggcactaacactggctaccggacccatttcaactctatgggaaggaaatccaggacgtttctggaacacgacaatagcggtctccatggccaacatatttagggggagttatttagcaggcgcagggttacttttcagcataatgaaaaacactaccaatacaagacgaggtacaggaaatatcggagaaacactaggggaaaaatggaagagtagacttaatgctttagggaaatccgagttccagatatacaagaaatcaggtatacaagaagtagatagaactcttgccaaagaaggtattaaaagaggcgaaactgatcaccacgcagtatcgaggggatcagctaaattacgctggttcgttgaaagaaatatggtaactccagaaggaaaagtagttgatctcggatgtggaaggggtggttggtcatattactgcggtgggttgaaaaatgttcgtgaagtaaagggcctgactaagggtggcccgggacatgaggaacccatacctatgtctacgtacggttggaacttagtaagactccagagtggggtcgatgtgttcttcacgccgcccgaaaaatgcgatacactcttgtgcgacatcggagagagctccccaaacccaacaatagaggccggccgcactctacgcgtattaaacttggttgagaactggctcaacaataacactcaattctgtataaaagtcctgaatccatatatgccttctgttattgaaaagatggaaactttacaaaggaaatatgggggtgccctagtaagaaatccactaagtcgtaattcaacgcatgaaatgtactgggtttccaacgcgacagggaatatcgttagtagtgtaaacatgataagtagaatgctaatcaaccggttcacgatgaaacataagaaagctacttatgaaccagatgttgacttaggatctggaacaagaaatataggaatagaaagtgagatacccaatttggacataattggtaagagaattgagaagatcaaacaggaacacgaaacgtcgtggcattatgatcaggatcatccctacaagacttgggcgtaccatggttcatatgaggctaaacaaacaggttcggcatcatcgatggtaaacggtgtggtaagattgcttactaagccatgggatgttgttccaatggtgacacaaatggctatgacggacaccacaccattcggacaacagcgcgtattcaaagaaaaagtagatacaagaacgcaagaaccaaaagaaggcactaagaaacttatgaaaattacggcagagtggttatggaaagagttaggtaagaagaaaactccccggatgtgcacgagagaagaatttacgagaaaagtccggtcaaacgcagccttaggtgctattttcactgacgagaacaaatggaaaagtgccagggaggccgtggaagatagtagattctgggaactggtagacagagaaagaaacttacacctcgaaggcaaatgtgaaacatgcgtgtataatatgatgggaaaaagagagaagaaactcggagaatttggaaaagctaaaggaagtagggccatatggtatatgtggcttggcgccagatttttagaatttgaagccttaggcttcctgaacgaagatcactggttctcaagaggaaacagcttaagtggagtggaaggagagggtctccaccgtttagggtacatcctgagggatgtttcaaagaaagaaggcggagctatgtatgccgacgatacagcaggttgggacacccgcataacactcgaagatctcaaaaatgaagaaatggtaacgaatcatatgaaaggagagcacaagaaacttgcagaagccatatttaaactcacgtatcaaaacaaagtagtacgggtacaacgacccacccctagggggacagttatggatataataagtagaagagatcagcggggatctggacaagtaggaacttatggactgaacacatttaccaatatggaagctcaactgatacgacagatggaaggggagggcatttttaaatcaatccaacatctaacagtaactgaggagatagcagtacagaattggttagctcgggttggtcgtgaaagattaagtcgtatggtgatatctggcgatgattgtgtagtgaaaccattagacgatagatttgcgtctgctctaactgcacttaacgacatgggtaaagtacgtaaagatatccaacaatgggaacctagccgtggatggaatgactggactcaagtacctttttgtagccatcatttccatgagctcgtaatgaaggatgggagggtacttgtagtcccttgccgcaaccaggatgagttgataggacgagctcgcattagtcaaggggctggctggtccctcaaagaaactgcctgtcttggaaaaagttacgctcaaatgtggacgcttatgtatttccatagaagggacttacgcctcgcagctaacgcaatttgttccgcagttccatcgcactgggttcccacttcgcgaactacatggagcatacatgcgaaacatgaatggatgacaactgaggatatgttagcagtttggaaccgagtatggatacaagaaaatccatggatggaagataaaaccccagtggagagttgggaagaagtaccatacctcggtaaacgagaagatcaatggtgcggaagtttaataggcctgacatctagagccacctgggctaagaacatacaaaccgcaataaatcaagtacgcagcttaattggaaacgaggaatatactgactacatgccttcaatgaagcgattccgacgagaagaagaagaagccggagtcctctggtga

SEQ ID NO: 22549 - RNA, 9876 nt, synthetic construct
  misc_feature 1..9876: note = derived and/or modified CDS sequence (opt6) from DENV-2__EU482573__SS-prME
  source 1..9876: mol_type = other RNA
actgcaggagtgataataatgttaattccaacagctatggcatttcacctaaccactagaaatggagaacctcacatgatagtaggaagacaagaaaaaggtaaatccttattattcaaaacggaagacggagtaaatatgtgtaccctaatggcaatagacttaggagaattgtgcgaagatacaataacgtataaatgtcccctattacgacaaaatgaacccgaagatattgattgttggtgtaactcaacatccacgtgggttacctatggtacatgcacaacaacaggtgaacacagacgtgagaaaagaagtgtagcattagtacctcacgtcgggatgggtttagaaactcgaacagaaacatggatgtcatcggaaggagcgtggaaacatgtacagcgtatagaaacatggatactacgacatcccgggtttacaataatggcagcaatattggcatataccatagggacgacacactttcaaagggcgctaattttcatacttttaacggcagtagcaccaagcatgactatgagatgtataggtattagtaacagagatttcgtagaaggagttagtggaggctcatgggtggatatcgttctggaacacgggagctgcgttacgacgatggctaaaaataaaccgactttagacttcgaacttataaaaacggaagcaaaacaacctgctaccctccgtaaatactgtatagaggcaaaattaacaaacacaacaactgaatcacggtgccctacccaaggagaaccgagtttaaatgaagaacaagataaaaggttcctttgtaaacatagcatggtagatagaggttgggggaacggctgtggtttatttggcaaaggaggtatcgtaacctgcgctatgttcacatgtaagaaaaacatggaaggaaaagtagtattaccggaaaacttagaatacactatagtcataaccccacattcgggtgaagaacatgcggtcgggaatgacaccgggaaacatggaaaagaaataaaaattacacctcaaagctcaataactgaagcagaacttacaggctatggaactgtcacgatggagtgtagtccaagaactggactagattttaatgagatggtactacttcaaatggaggataaagcatggctagtccatcgtcagtggtttctagacttaccgctcccttggctgccgggtgcagatactcagggctcgaattggatccaaaaagaaacgctcgtaacatttaaaaatccacatgcaaagaaacaagatgtagtagtattaggtagtcaggaaggggctatgcacacagctctgacaggagctacagaaatacaaatgagttcgggaaatctactctttactggtcacctaaaatgtcgcttaagaatggacaaactacagctgaaaggaatgagttatagtatgtgcactggtaaattcaaaatagttaaagagatcgcagaaactcagcacggcactatagttattcgagtacagtacgagggggatggatccccatgtaaaataccatttgaaattatggacttagaaaaacggcatgttttaggacggcttatcaccgttaatcccatagtaacagagaaagactcccccgtgaacatagaagctgaaccgccatttggggatagctacataattatcggagtcgaacctgggcaattaaaactaaattggtttaagaaagggagctccatagggcaaatgttcgaaaccactatgagaggcgcaaaaagaatggcaattttaggagacactgcctgggactttgggagtttaggaggcgttttcacttcaataggaaaggctttgcaccaagtcttcggggccatttacggagcagctttttctggcgtatcgtggactatgaaaattttaattggcgtaataataacttggataggtatgaactcacgtagtacttcacttagtgtgtcattagttttagtaggtgtagttacgttatacttgggagcaatggttcaagcagattctggatgcgttgtgagctggaaaaacaaagaactaaaatgcggatccggtatattcataacggataacgtacatacatggacggaacaatacaaattccaacccgaaagcccaagtaaattagcttcagccattcaaaaagcacatgaagaaggaatatgtggtatcagaagtgtaacgcgtttagagaatttaatgtggaaacaaatcactccagagcttaaccacatactctcagaaaatgaggtcaaattaactataatgacaggtgatataaaaggaataatgcaagcaggtaaaagatccctgagacctcaaccaaccgaactgaaatacagttggaagacgtggggaaaagcaaaaatgctatctacggaaagccataatcaaaccttcttaatagacggccctgaaaccgcagaatgcccaaatacgaatcgcgcatggaactcgttagaagtggaagactatggttttggagtattcacaacaaatatttggctgaaattacgagaaaaacaggatgtcttttgtgactcaaaattaatgagtgcggctatcaaagacaatagagccgttcatgcggacatgggatattggattgaatcagctcttaatgacacgtggaaaatggagaaggcttcatttatagaagtaaaaagctgtcattggccaaaatctcatacattatggagtaacggcgtcctggaatcggagatgataatacccaaaaatttcgcaggtcctgtatcacaacataattatcgacccggatatcacactcagacggcaggcccttggcatctgggtaaattagagatggattttgatttctgtgaagggacaactgtggtcgtaacagaagattgcggaaacagaggccccagcctacgcacaacaaccgcctctggtaaattgataacagaatggtgctgtcgttcttgcactcttcctccgttgcgatatcgaggagaagatggttgttggtacgggatggaaatccggccgttaaaagaaaaagaagaaaatttagtaaattctttagtaacggcagggcatgggcaaattgataacttttcgcttggtgttcttgggatggccctgtttttggaagagatgcttagaactagagtagggaccaaacacgcaatacttttggttgctgtgtccttcgtaactttaattaccggaaacatgtcttttcgagaccttggtagagtcatggttatggtaggagcaaccatgaccgacgatatcggaatgggagtcacatatctggcgttactagcagcatttaaagttagacctacttttgcagcaggtttgctcttaagaaaattgacttcaaaagaactgatgatggccactatcggcatagccttattgagtcaatcaaccatacccgaaacgatattagaattaaccgacgcactggctttaggcatgatggttttaaaaattgtcaggaatatggaaaaatatcaactagcagttactataatggctatctcttgtgttccaaatgctgtaatcctacagaatgcgtggaaagttagttgtactatactagctgcagtctcagtctcacctttgttgcttacttcgtcccagcaaaaagccgactggatacctctagcgctaacgataaaaggactgaatcccactgcgatctttctaacaacgctgagtagaacaagtaaaaagagaagctggccattaaacgaagcgataatggcagtagggatggtatctatattagcctcatctttacttaaaaatgacattccaatgactggacccctcgtagcgggaggtctactaactgtatgttatgttttaacaggaagatctgcagatctagaattagagcgcgcagctgacgtaaaatgggaagaccaagcagagatttccgggagttccccgattctctccataacgatatctgaggatgggtcaatgtcgatcaaaaatgaagaagaggaacaaacattaacaatacttatacgaacgggattattggtcataagtggcgtattcccagtgtctatccctataacggcagccgcctggtatctctgggaagttaaaaagcaacgagccggtgttctgtgggatgttccgagtccacccccagtaggtaaggcagaactagaggatggtgcatatagaatcaaacaaaggggaatacttggatactcacagataggagcgggagtgtacaaagaggggacattccacacaatgtggcacgtaacacgaggtgcggtcttgatgcatagaggaaagaggattgagccatcctgggcagacgtgaagaaagacctcatcagttatggaggagggtggaagttagaaggagagtggaaagaaggagaagaagtacaagttctagctctagaacctggaaagaatccgcgagctgtgcagacgaagccaggcttatttaagacaaatacgggaaccataggggcagtctcacttgactttagccctggaacgtcaggttcaccaattgttgataggaaaggtaaagttgttgggttgtatgggaatggcgtagttacacggagtggagcttatgttagtgcgatagcacaaaccgaaaagtcgattgaagataatcctgaaatcgaagacgatatctttagaaagaaacgattaactatcatggacttacatccaggagctggaaaaacaaaaagatatctaccagcaatagtgagggaagctataaagagggggttgaggacactaatactagcccccacaagagtcgttgctgcagagatggaagaggctttaagaggacttcctatcagatatcaaacaccagccatcagagccgagcacacgggaagagagattgtcgatttgatgtgccatgctacctttacgatgagactgttgtctcctgttagagttccgaactacaatctcataatcatggacgaggcacatttcacagatcctgcctcgatagcggcaagaggatatatatccaccagagtagaaatgggggaggcagcaggtatatttatgactgctactcctccggggtcgcgggatccgtttccgcagtccaatgcgcctatcatggatgaagaacgcgaaattcccgaacgaagctggaactctggtcatgaatgggtcacagactttaaaggtaaaactgtatggtttgtcccttcgataaaggcaggcaatgatattgccgcttgcttaaggaaaaacggcaagaaagtgattcagctctcaagaaagacatttgattctgagtacgttaagaccagggctaatgattgggacttcgtagtcacaaccgatatctcagaaatgggagctaattttaaggcagaacgcgtaatagacccgagaagatgcatgaagccagtaatattaactgatggcgaagaacgtgtaattttggctggacctatgccggtgactcatagtagtgccgcacagagacgtggcagaatcggacgaaatcccaaaaatgagaatgaccaatatatctatatgggagaaccactagaaaacgatgaagattgcgctcactggaaagaggctaaaatgttacttgataacatcaacacacccgaaggtatcataccatcgatgtttgagccggaaagagagaaagtagacgccatagacggggaatatagactaagaggagaagcacggaaaacatttgtggacctcatgcgccgaggagacctcccagtgtggttagcatacagagtagcggctgaaggcattaattatgcggatagacgatggtgctttgatggcatcaaaaacaatcaaatactcgaggaaaatgtagaagtagaaatctggactaaggagggtgaaaggaagaaattgaaacctagatggttggatgctaggatctatagtgatccattagcactcaaagagttcaaagaatttgccgcaggtagaaaatccctaaccttaaatttaataacagaaatgggtcgcttaccaacattcatgacacaaaaagcaagagatgctcttgataacttagccgtactacacacagcagaagctggcgggcgtgcgtataatcatgctttatcagaacttcctgagacactagaaacgctattgcttctaacacttctagctacagtaacaggtggcatctttcttttcctcatgtcagggaaaggaattggaaagatgacacttggtatgtgttgtattattactgcatctattctgctctggtatgcacaaatccagccccattggatcgcagcatccataattctcgagttctttttgatagtacttctcatacctgaaccagaaaagcagagaacaccccaggacaaccaactaacgtacgttgtaatagctatattaacggtcgtagcagcaacgatggccaacgaaatggggtttcttgaaaagactaagaaagacctaggactcggaagcataacgacccaagaatctgaatccaatatactagacatagatttacgcccagcctctgcctggacactttacgctgtagcaaccactttcgtaacgcctatgttacgccactcaatagaaaacagcagcgttaatgtgtcgctcaccgcgatagctaaccaggcaactgtactcatgggactagggaagggatggcccctatcaaaaatggatattggtgttccgcttttagcaatagggtgttacagccaagttaacccaataacactaactgcagctttgctactcctagtcgcgcattatgctattatagggcccggattacaagcaaaagctacaagggaagcacaaaagcgcgcggcggcgggaataatgaagaatccgaccgttgatggaattactgtaattgaccttgagccaatcccgtatgatccaaaatttgaaaaacaacttggacaggtcatgcttctaattctatgcgtaacgcaggtacttatgatgcgaactacctgggcactttgcgaagcattgaccttagcaacaggtccaatatcgacactttgggagggaaatccgggtaggttctggaacacaacgattgcggtctctatggctaatatttttagggggagttacttagcgggtgccggtttactctttagtatcatgaaaaatacaacaaatacacgcaggggtactggaaacataggagagacgttaggggaaaagtggaaatcaagattgaatgcattggggaaatcggagttccaaatatacaagaaaagcggcatacaagaagttgatagaacattggccaaagaaggtattaaaagaggagagacagatcatcatgcagtcagtagaggatcagctaaattgcgttggttcgtcgaaaggaacatggtaaccccagaggggaaagtagtagatttaggatgcggtagagggggttggtcatactattgtggagggctcaaaaatgttcgagaagtgaagggacttacgaaaggcggacctggccatgaagaacccatacccatgagtacttacggatggaatctagtcagacttcaaagtggcgtggatgtcttcttcacaccacctgaaaaatgtgatacattactatgtgatattggcgaatcgtcccctaaccctacgatagaagctgggcgaactcttcgtgtgctgaacttggttgaaaactggctgaataataatactcaattttgtatcaaggtcttaaatccgtatatgccttcagtaatagagaaaatggaaacccttcaacgaaaatacggaggagctctagtaaggaacccgctgtcacggaactcaacccacgaaatgtactgggtgtcgaacgcgactggtaacatagtatcgtccgtcaatatgatctcgcggatgcttatcaatagatttaccatgaaacacaagaaagcgacatatgaaccagatgttgatttaggaagcggtacaagaaacataggtatcgagagcgaaataccaaatttagacattattgggaaaagaatcgagaaaataaaacaagagcacgaaacaagctggcattatgaccaagatcatccctataaaacatgggcctatcatggtagttatgaaacaaagcaaacaggttctgcttcttcaatggttaatggggtagtccgtctgttaactaaaccgtgggacgtggtacccatggtaacgcaaatggccatgaccgataccacaccgtttggccaacagcgtgtatttaaagaaaaggtcgatacaagaacacaggagccgaaagagggaaccaagaaattaatgaaaataacagctgaatggttatggaaagagctgggcaagaagaaaacacccagaatgtgtacacgcgaggaatttacacgcaaagtgcgctcaaacgctgctttaggggcaatttttaccgatgagaacaagtggaaatctgcaagagaagcagtagaagacagtagattttgggaattaatagatcgagaaagaaatctccatttagaaggtaaatgtgaaacatgtgtatataatatgatgggaaagcgtgaaaagaagttaggtgagtttggaaaggctaaagggagtagagcaatatggtacatgtggctcggtgcacgattcttagagttcgaagctctaggttttctcaatgaagatcattggttctctcgaggaaacagcttaagcggggtggagggggaagggttacataggctaggatatatcttgagagatgtgagcaagaaagaaggaggtgctatgtacgcagatgacaccgcaggatgggacacacggattacacttgaagatttgaaaaacgaagaaatggtaactaatcacatgaaaggcgaacataagaaacttgccgaagctatatttaaattaacataccaaaataaggttgtaagagtgcaacgacccactccacgtgggactgtaatggatattatatctcgacgagatcagagaggcagcggtcaagttggcacatacggacttaatacgtttactaacatggaggcacagctgataagacaaatggaaggagaaggaattttcaagagcatacaacacctcacagtaacagaagaaattgcagtgcaaaactggctggcgagagtggggagagagaggctctcccgaatggcaataagtggagatgactgtgtagtaaaaccactcgatgaccgtttcgcaagtgctctaacagccctaaatgacatgggaaaagttaggaaagatatacagcagtgggaaccaagtaggggatggaatgactggacacaagtgcccttttgtagtcatcactttcatgaacttgttatgaaggacggaagagtattagttgtcccatgccgaaatcaagatgaactaatagggagagcgagaattagccaaggcgctggctggagtttaaaggaaactgcgtgcctaggaaagagttacgctcaaatgtggacccttatgtacttccatcgtagagacttaagattagccgctaacgcaatatgtagcgcagtaccgtcacattgggttccaacatcgagaaccacctggagcatccatgcaaaacacgagtggatgacaacagaagatatgctcgcagtttggaacagggtttggattcaggaaaatccatggatggaagataaaacgcctgtcgaatcttgggaggaagtaccctatttaggcaaaagagaagatcagtggtgtggaagccttataggattgacaagcagagcaacttgggccaaaaacatacaaacagctataaatcaagtacgttcattgattggtaacgaagaatatacggattacatgcctagcatgaagagatttcgtcgagaagaggaggaagcaggggtactctggtaa

SEQ ID NO: 22550 - RNA, 9876 nt, synthetic construct
  misc_feature 1..9876: note = derived and/or modified CDS sequence (opt6) from DENV-2__EU482574__SS-prME
  source 1..9876: mol_type = other RNA
acagcaggagttataataatgctaatacctacagcgatggcgtttcatttaacaacacggaatggagaacctcatatgatagtaggacgccaagaaaaagggaaaagtctactgttcaaaacagaagacggggttaacatgtgtacattaatggctatagatctaggagaactatgtgaagatacaattacctacaaatgtcctcttctaagacaaaacgaaccagaagacatagactgctggtgtaatagcacgtcaacctgggtaacttatggtacgtgtactacaaccggagaacatagaagggaaaaacgttcagtagctcttgtaccgcacgttggtatgggattggaaacacgaactgaaacatggatgtcatcagaaggagcttggaaacatgtacaaagaatagagacatggatactacgtcatcctggattcacaataatggctgcaatactagcttacacaataggcaccacccacttccaaagggctcttattttcatactattaaccgcagtagcgccatccatgaccatgagatgtattggtatttccaatagagattttgtggaaggagtcagcgggggttcgtgggttgatattgtacttgaacacggatcttgcgtaaccacaatggccaaaaataaaccaacgttagacttcgaactaataaaaaccgaagccaaacaaccagctacactacgtaaatactgtatcgaagcgaaattgacaaacactacaacggagtcgaggtgtcctacccaaggcgagccttccctaaacgaagaacaagataaaaggtttttatgtaaacacagcatggtcgaccgtggctggggaaacggatgcggtctattcggcaaaggaggaattgtgacatgcgcaatgttcacatgcaagaaaaatatggaagggaaagtggttctcccggagaatcttgagtatacaattgtcataaccccacattcaggggaagaacatgctgttggcaatgatacaggcaaacacggaaaggaaataaaaataacgcctcagtcatcaattactgaagcagaattgaccggatatggcaccgtcacaatggaatgtagccctagaacaggcttggattttaatgaaatggtgctacttcatatggaggataaggcatggttagtacaccgacaatggtttctggacttgccgcttccttggctaccaggagcagatacccaaggtagtaactggatccaaaaagaaacattagtaacatttaagaaccctcatgccaagaaacaggacgtcgtggttctaggttctcaagaaggagcgatgcatacagccttaaccggtgcaaccgaaattcaaatgagttcaggtaatctgttgtttacaggccacttaaagtgtcggttaagaatggataaacttcaattaaaaggcatgtcttactccatgtgcacaggcaaattcaaaattgttaaagaaattgccgaaactcagcatggtacaattgtcattagagtacagtatgaaggagatgggagtccttgcaaaatcccatttgaaataatggatcttgagaaaagacacgtactaggtagactcattacggtaaatccaatcgttactgaaaaagacagtccagtaaatatagaagcggaaccgcccttcggcgatagctacattatcataggggtagaacctggacagctcaaactcaattggtttaagaaaggatcttcgatcggccaaatgtttgaaactacaatgcgaggagctaagcgtatggctattttaggtgatacggcttgggactttgggagtttgggaggagtcttcacttcgataggaaaagcattacaccaagtattcggcgcgatatatggagccgcattcagcggtgtcagctggacaatgaaaatactcataggagtcataatcacctggatcggaatgaactcacgttcaacttcattaagtgtttcgttggtattagtaggagtggtaacactatacctcggtgctatggttcaagcggattccgggtgcgtcgtcagctggaaaaacaaagagctaaaatgcggttcggggatttttataacagacaatgttcacacttggacggagcaatacaagtttcaaccggaatcgcctagcaaactagcaagtgccatacaaaaagcccacgaggaaggaatttgcggaatacggagtgtaacacgactagaaaatttaatgtggaaacagattacaccagagttaaatcatatactatcagaaaacgaagtaaaattaactattatgacaggcgatataaaaggaataatgcaggcaggaaaacgttctctacgaccgcaaccgaccgaacttaaatattcgtggaagacttgggggaaagccaaaatgttatcaacggaaagtcacaaccagacatttttgatagatggtcctgaaacagctgaatgcccaaataccaatagagcatggaactcactggaagtagaagactacggattcggggtcttcacaacaaatatctggttaaaacttagagaaaagcaagacgtattttgcgattcgaaattaatgtcagcagcgattaaagataacagagcagtacatgctgatatgggttactggattgaaagtgctcttaatgatacatggaaaatggaaaaagcaagtttcatagaagttaagagttgccattggccaaaatcacacacattgtggagtaacggcgttttagaatccgaaatgattatccccaagaacttcgcgggccctgtatcccaacacaattatcggcctggatatcacacccaaacagctggtccctggcacctaggcaaactcgaaatggattttgatttctgtgaaggaacaaccgtagtcgttacagaagattgtggtaatagaggtccatcactaagaacaaccacagccagtgggaaacttataacagaatggtgttgtcggtcctgtaccctaccaccccttcgttaccgaggagaagacggatgttggtatggaatggagatacgtcccttaaaagaaaaagaagagaatttagtcaactcgttagtaacagccggacacggacagatcgataacttctcgctcggagtattaggtatggctttattcctggaagagatgctcagaacaagagtaggaacaaaacatgcaattctcctagtagccgtatcctttgtaaccctaatcacaggaaatatgtcttttagggacttaggaagggtaatggtaatggttggggcaactatgactgatgacataggaatgggcgttacttatcttgcacttcttgcggcctttaaagttagacctacgttcgcagcaggactgttactgagaaaattaacctctaaggaattaatgatggcaaccatcggcattgcactcttatcacagagtactattccagaaacaatccttgaactaacagatgccttggctttaggaatgatggtattgaaaatagtcaggaacatggaaaaatatcaacttgctgttactataatggcaatcagttgtgtaccgaatgccgtaattctacaaaacgcatggaaagtatcctgtacaatattagcagcagtatcagtaagccccttattactaacttcaagccaacagaaagcagattggattcctttggcactaacaataaagggattaaatccaaccgccattttcttgaccactttgtcccgtacttctaaaaagaggtcgtggcctctaaacgaagcgataatggcagtaggaatggtatcaatccttgcttcatcacttctcaaaaatgacattccaatgactggaccgttagtagcgggaggattactaacagtctgttacgtgcttaccggacgatctgcagatctagagttagagcgcgcggcagatgtgaaatgggaagatcaggctgaaattagtggatcatctccaatcttaagtataactatatctgaagatggatcaatgagtatcaaaaatgaagaggaagaacagacgctcaccatactaatcaggaccggattgttagttataagtggggtcttcccagtatcgataccaatcactgccgccgcgtggtacctctgggaagtcaagaaacaacgagctggtgttttgtgggatgtaccgagtccgcctccggttggaaaagccgaattagaagatggagcctatagaatcaagcaaagaggtatactaggttatagtcagataggagccggtgtctataaggaaggcacttttcataccatgtggcacgttaccaggggcgccgtactaatgcacaggggaaaaagaatcgagccctcatgggctgacgtcaagaaagacttaataagctatggaggagggtggaaattggagggagaatggaaagaaggagaggaagttcaagtattagctcttgaacctggcaaaaatccgcgggccgtacagactaagccgggtctattcaagaccaatacaggtacaatcggggcggtctcactggatttttccccaggcacaagtggttccccgattgttgataggaaggggaaggtagttggattatatggtaacggtgtggtaactagatctggagcatacgtttctgcaatagctcaaaccgaaaagtccatagaagataacccagagatagaagacgatatatttcgtaagaaaagattgacgataatggatctccatcccggggcaggtaaaacaaaaagatacctaccagcgatagtcagagaggcaataaaaagaggtcttaggacccttatattagcacctacaagggttgtagctgcagagatggaggaagctcttaggggattgccaataagataccaaaccccagcaatacgggcggagcatactggcagggaaatagttgatttaatgtgtcacgcgacgttcacgatgagattactcagtcccgtacgagtgcctaactacaacttaataataatggacgaagcacactttacagatcccgctagcatagctgcaagaggctatatcagcacccgcgttgaaatgggcgaagcagctggaatctttatgacagcaacacctccaggaagtcgtgacccattcccccaaagtaatgccccaatcatggatgaagaaagagagataccagaaagatcttggaactcaggacatgagtgggttacggattttaagggaaaaacggtctggttcgtaccatcaataaaagcaggtaatgatatcgcagcctgtttaaggaaaaatggaaagaaagtgatacagctaagtcgaaaaacatttgatagtgaatatgtgaaaactagagctaacgactgggactttgtagtaacaacagatatatctgagatgggtgcgaactttaaagcggaaagagtaatcgatcctaggcgttgcatgaaaccagttatcttaacagatggcgaagaaagagttattttagcgggacccatgccagttactcattcatccgccgcccagcgaaggggcagaattggaagaaatcccaaaaatgagaacgaccaatatatatacatgggggagccactagaaaatgacgaagactgtgctcactggaaagaagcgaagatgttattggacaatattaatacaccagaaggtataattccaagtatgtttgagcccgaaagagaaaaagttgacgccatagatggagaataccgactaagaggagaagcgaggaaaacattcgtcgatcttatgcgaagaggcgatctaccagtatggctcgcttatagagtagctgctgaaggaattaattatgcggatcgtagatggtgctttgacggtatcaaaaataatcaaatcttggaagagaacgtggaggtagaaatttggacaaaggaaggagaaaggaagaaactaaaaccgagatggcttgatgcgagaatatacagcgacccattagcattaaaagaatttaaagagtttgcagctggacgtaagtctctaactctaaatctgattacagaaatggggagattgccgactttcatgacacaaaaagcaagagacgctttagataatctagcagtactccatacagccgaggccggcggtagagcatataatcacgccctatccgagctaccagaaacactagagactcttctcctactgactttactagctacagtgactggaggaatttttctttttctcatgagtggaaaaggaataggtaaaatgacgttagggatgtgctgtataatcaccgcctctatattactatggtacgcacagattcagccccattggatagcggcatccataattcttgagtttttcttaatagtattattaataccagaacccgagaaacagagaacaccacaagataaccaattgacctatgtcgttatagcgatactaaccgtcgtagctgcaacgatggccaacgagatgggatttctggagaagaccaagaaagacctaggactcgggtccataactacccaagagtccgaaagcaatatattagatatcgatttacggcccgcttctgcctggactctatacgcagtagcaacaacttttgttacgccaatgttaagacactctatagaaaacagcagtgttaatgtatctctaaccgctatagcgaaccaggcaacggtactaatgggactgggaaaaggatggccattaagcaaaatggatatcggtgtaccacttctagcaataggatgttattctcaggtaaatcctattaccctgactgcagccctattgttacttgttgcacactatgcgataatagggccgggtttacaggcaaaagcaacgagggaagctcaaaagcgagccgccgcgggaatcatgaaaaaccccacagtagatggtattacagttatcgatttagagccaataccttacgatccaaaatttgagaaacaattaggacaggtcatgttactaatattatgcgtaacacaagttctaatgatgcgaactacctgggcgttatgtgaagcattaacacttgctaccgggccaataagtacgttgtgggagggcaacccaggtcggttctggaataccactatagcagttagtatggccaatatatttcggggttcctacctggccggagcagggctactattcagtataatgaagaatacaacaaatacgaggaggggcacagggaatatcggcgaaaccttaggagaaaagtggaaaagcaggcttaatgcgctcggcaaatctgagttccaaatttataagaaatcgggcattcaagaggtagatcgaacattagcgaaagaaggaataaaacgaggcgaaactgatcaccacgcagtaagtcgtggtagtgcgaagttaagatggtttgtggaaagaaacatggttacccctgaaggtaaagtagtcgatttaggatgtggaaggggcgggtggtcctactactgcggtggattaaagaacgtgcgagaggtaaagggtttgactaaagggggaccaggtcacgaagaaccgattccaatgagcacctacggctggaaccttgttcgactgcagagtggtgttgacgtatttttcacgccacctgaaaaatgcgacacattattatgtgacattggtgaaagttcaccgaatcccactattgaggctggaagaacccttagggtcttaaatctagtggaaaattggctaaataataacacgcaattctgtataaaagttttaaatccctacatgccatcagttatcgagaagatggagacgctacaaagaaagtatggcggcgccctagttagaaatccattgagccgaaacagtacacatgaaatgtattgggtcagtaacgcaacaggaaatatagtgagtagtgtaaatatgatatctagaatgctcattaatcggtttactatgaaacacaaaaaggctacatatgaaccagatgtcgatctcggatcagggactagaaacatagggatagaatcagaaattcccaacctggatatcataggaaaacggatagagaaaatcaaacaagaacacgagacgagttggcattatgatcaggatcatccatataaaacatgggcataccatgggagttatgagactaaacaaaccggaagtgccagctcaatggttaatggggtagtcagactactcacaaaaccatgggacgtggtacctatggtaacccagatggcgatgactgatacaactccatttggacaacaaagagttttcaaggagaaagtcgatacacgaacccaggagcctaaagagggaactaagaaactaatgaaaataacagccgagtggctatggaaagaactcggtaagaagaaaacgccaaggatgtgtacacgtgaagagttcaccaggaaagtgagatcaaatgccgcacttggagcgatattcacagacgaaaataagtggaagagtgcaagggaagcggttgaagattcgagattttgggaactcattgatcgcgaaagaaacctgcatcttgaggggaaatgtgaaacttgtgtctacaacatgatgggaaaaagagaaaagaaactaggtgagttcggtaaagctaaaggatctcgagctatatggtatatgtggttaggagcgcgatttcttgagttcgaagctctcggtttcctcaatgaggatcactggttttcccgaggcaatagcctcagtggagtcgaaggagaaggcttacatagattaggttacatactcagagacgtgagtaagaaagaaggaggcgcaatgtatgcggacgatacggcaggttgggacacacgaataactcttgaagatttaaagaatgaagaaatggtaacgaaccacatgaagggagaacataagaagttggcggaagcaatttttaaactaacttatcaaaataaggtagtgcgcgtacaaagacccactcctagaggaacagtaatggatataataagcaggcgcgaccaacgaggttctgggcaagtgggcacttatggccttaatacatttacaaatatggaggcccagctaattagacaaatggagggagagggtatctttaaaagtatacaacacctcactgtaacggaagaaatagcagtacaaaattggctcgcaagagttggcagggaaagattatcaaggatggctataagcggtgatgattgtgtggtgaaaccacttgacgatcgtttcgcgtcggctctaactgcattaaatgatatgggaaaggtaagaaaggacatacaacaatgggaaccaagcagaggttggaatgattggacacaggtgcccttctgttctcaccacttccatgaactcgtaatgaaagatgggcgagtcttggtcgtcccttgccgaaaccaggacgaactaatagggagagcaagaatttcacaaggtgcaggatggtcgcttaaagaaactgcatgcttgggaaaaagttatgcccaaatgtggactctaatgtactttcaccgaagggatcttagactagcagctaatgcgatctgcagtgcagttccctcccactgggtccctaccagtaggactacttggagtatacatgccaaacatgaatggatgaccacagaagatatgctggccgtctggaatagagtatggatacaggaaaacccctggatggaagataaaacgccagttgaaagctgggaggaagtaccataccttggtaaacgagaagaccaatggtgtggatcattaatcggcctcaccagtagagctacatgggctaaaaatatccaaactgcaattaatcaagtaagatccttaataggcaatgaagaatacacagactacatgcccagcatgaaacggttcaggcgagaagaagaagaagccggtgttctctggtag

SEQ ID NO: 22551 - RNA, 9876 nt, synthetic construct
  misc_feature 1..9876: note = derived and/or modified CDS sequence (opt6) from DENV-2__EU482575__SS-prME
  source 1..9876: mol_type = other RNA
actgcgggcgtgattataatgctaatccccacagcaatggcttttcatttaactacacgaaatggtgaaccccatatgattgtcggacgacaggaaaaaggaaaatcgcttctatttaaaacagaagacggcgttaatatgtgtacgttgatggccattgatctaggagaattatgtgaagatactataacttacaaatgccccttgcttaggcaaaacgaaccggaagacattgattgctggtgcaatagtaccagtacttgggtgacatatggtacatgtacgactacaggcgaaaggcgaagggagaaaagaagtgttgcattagttccacatgtaggcatgggacttgaaacgaggacagaaacttggatgtctagtgaaggggcctggaaacacgtacaaagaatagaaacttggattctacggcatccaggatttacaattatggcagcgatattggcttataccattggaacaacgcattttcaaagagcgttaatatttatattattaacagccgtagccccaagtatgacgatgagatgcataggaattagtaatcgtgactttgtagaaggagtatccggtggaagttgggtagatattgttttagaacatggatcttgtgtaacgactatggcgaaaaacaaaccaacattagacttcgaactaataaaaactgaagcaaaacaacccgctacattacgtaaatattgcattgaagctaaactgactaacacaacaactgaatctagatgtcccacacaaggtgaaccctctttaaacgaagaacaagacaaaagatttctgtgcaaacattctatggttgatagaggctggggaaatgggtgcgggctttttggcaaaggtggaatcgtaacatgcgcaatgttcacgtgtaagaaaaatatggaaggaaaagtggtgttacccgaaaacttagagtatactatagttataactcctcattcaggggaagaacacgcagtcgggaatgatacagggaaacatggcaaagagataaaaattacaccacaaagttctattactgaggcagaattgactggctacggaacggttacaatggagtgtagtcctcgaacgggcctagacttcaacgagatggtactgcttcaaatggaagacaaagcgtggctagtacatcgtcaatggtttcttgacttgccactaccatggctaccaggcgcagacacgcaaggttcaaactggatacaaaaagagaccttagtaactttcaaaaacccacatgccaagaaacaagacgtagttgtgttaggaagtcaggaaggcgcgatgcacacagctctgactggagcaactgaaattcaaatgtcgtcaggtaatttactatttaccggccacctcaaatgcaggcttcgaatggacaaacttcagctaaaaggtatgtcttactcgatgtgcacagggaaatttaaaattgtaaaagaaatagctgagacacagcatggaacaattgtaattcgggtccaatatgaaggtgatggttcaccatgtaaaataccattcgaaataatggatctcgagaaaagacatgtactcgggcgactaattacagtaaatcctatagttactgaaaaagactcccccgtaaatattgaggcagaaccaccctttggggatagttatataataattggtgttgagcctgggcagcttaaactcaattggtttaagaaagggagtagcattggacagatgtttgagaccacaatgaggggagcgaaaagaatggcgatattgggggatactgcatgggatttcggatctctagggggagtttttacctcgattggaaaggctttacaccaagttttcggagcaatatatggtgcagcatttagtggcgtaagttggaccatgaaaatcctcatcggagtcataataacatggatagggatgaacagtcgatcaaccagcctgtctgtaagcctggtattggtgggagttgttacactatacctaggtgctatggtacaagcggacagtggttgtgttgtcagttggaaaaataaagaattgaaatgtggatctggaattttcattactgacaatgttcacacttggactgaacaatataaatttcagcctgaatcgccctcaaaactagctagtgcaatccaaaaagcacacgaagaaggaatatgcggtattagatcggtgacacgattagaaaatttgatgtggaagcaaattacccctgaacttaatcatatattgagcgaaaatgaggtcaaactaactatcatgaccggagatattaaaggaataatgcaggcggggaaaagatcactgagaccacagccaacggagctaaaatatagttggaaaacgtggggtaaagctaaaatgttgagtactgaatctcataatcaaacttttctcattgatggtccagaaacagcggaatgtccaaatacgaacagggcatggaactcacttgaagtagaagattatggttttggggtattttcgaccaatatctggcttaaattaagagaaaaacaagatgtattttgtgattcgaagctcatgtcagcggcaataaaagataatagggcagtacatgctgatatgggctattggattgaaagcgcgctaaacgatacttggaaaatggaaaaggcctcatttattgaggtaaagagttgtcactggcccaaatctcatacactctggtcaaatggagtcttagaatctgaaatgattatacctaaaaatttcgccggaccagtctcgcaacataattacagacctggctaccatacacaaacggcaggtccctggcatttaggaaagctagaaatggatttcgatttctgcgaaggcacaactgtagtggttactgaggactgtggaaatcgaggaccttctttaagaacgacgacagcgagcgggaaattgataacagaatggtgttgtagaagctgcaccctccctccactgcggtacaggggagaggacggctgctggtatggaatggaaataagaccacttaaggaaaaagaagaaaacttggtaaacagtctcgtcacagcagggcatgggcagatagataatttttccctaggagtcttaggaatggcccttttccttgaggagatgttaaggacaagagtcggcactaagcatgcaatactgttggttgccgtttccttcgtcaccttgattacaggaaacatgagcttccgggacctcggcagggttatggttatggtgggagcaacaatgacagatgatattggaatgggcgttacctatttagcattactggctgcttttaaagtacgcccgacattcgcagctggacttttactacgaaagctaacatcaaaggagctaatgatggcaacaattggtatagcgttactgtcgcaatcaacaattcctgagacgatactagaactcacagacgctctcgctctaggtatgatggtacttaaaatagtcaggaatatggaaaagtatcaacttgcagtgactataatggctatctcatgtgtaccaaatgcggtaatattacagaatgcatggaaagtttcgtgcaccattctagctgccgtatcggttagtcccctcctattgacatcttcacaacaaaaagcggattggatacccttggcactaaccattaaaggactaaacccaacggccatattccttaccactttaagtcggacttctaagaaaaggtcttggccacttaatgaagcaataatggcagtagggatggtaagtatcctagcttccagtctattgaaaaatgatattcctatgactggtcccctagtcgctggcggcttacttactgtttgctatgtcctaactggacgtagcgctgacctagaattggaaagagctgcagatgtaaaatgggaagatcaagccgaaatatcaggctcctcaccaatcctgagcattacaatcagtgaggacggaagtatgtcaattaaaaacgaagaagaagaacaaacactgacaatattaataagaactggattattggtgatttcaggagtttttcctgtgtcgatacccattacggctgcagcatggtatctatgggaagttaagaaacagcgagcaggagtcctatgggatgttccttctccgccgccagttggcaaagccgaacttgaagacggggcgtatcgaataaaacagaggggcatcttaggctatagccaaataggtgcgggcgtctataaggaggggacttttcacacgatgtggcatgtgacccgcggcgcagtgttaatgcacagaggaaaaagaatagagcctagttgggcagatgtaaagaaagatttaatcagttatgggggtgggtggaaattagaaggtgaatggaaagaaggcgaagaagtgcaggttctggctttagagccaggtaaaaaccctagggctgttcaaactaagccaggtttgtttaaaacaaataccggaaccatcggtgcagtatccttggacttctcaccggggacttccggctcgcctatagttgacagaaaaggaaaagtagtggggctatatggaaacggagttgtaacgcggtctggagcatatgtatcggccatcgcccaaactgaaaagagtatagaagacaatccagaaatagaagatgatatatttaggaagaaacgactcacgattatggatctccatcctggagctggaaaaacaaaaaggtacctcccagctatagtgcgcgaagcaattaagaggggattacgcacattaatcctggcaccgacccgtgtagtggctgctgaaatggaagaggcacttcgcgggctacccatccgttaccagacaccagctatacgcgcagaacatactggaagggaaatcgtagatctcatgtgccatgcaacatttacaatgagactactttcaccagtgagagtcccgaattacaacttaataataatggacgaagctcattttacagacccagcgagtatagcggcacgtggttacataagcactcgggtcgaaatgggtgaagctgcaggcatattcatgacggccacaccccctggttctagagatccctttcctcagagtaatgctccaataatggatgaagaacgcgaaattccagaacgttcatggaactcaggacatgaatgggtaaccgactttaaaggcaagacagtgtggtttgtaccatcaattaaagcaggaaatgacatagctgcatgcctccgcaaaaatggtaagaaagtaatacagctgagtagaaaaactttcgattctgaatacgtaaagacgcgtgcaaacgattgggacttcgtagtgaccacagatatttctgagatgggcgcaaactttaaagcagaaagagtcatagaccctagacgatgcatgaaacctgtcattctcactgatggagaggaaagagtgattctagcaggaccgatgcctgttacgcacagcagcgctgcccaacgaagaggaagaattggacggaatcccaagaacgaaaatgaccagtatatttatatgggtgaacctttagaaaatgatgaggattgtgcacattggaaagaggccaaaatgctattagacaatattaatacaccggaagggataataccttccatgtttgaaccagaacgtgaaaaggtagacgctatcgatggagagtataggcttcgcggagaagcacgcaaaacgtttgttgatctcatgagacgtggagatttgcctgtttggctggcgtatagagttgccgcggaagggataaactatgcagatagacgatggtgttttgacggtatcaaaaataatcagatccttgaagaaaacgtagaggttgaaatttggactaaggaaggagagagaaagaaattaaagccaagatggcttgatgctagaatttatagtgacccattagccctaaaagagtttaaagaatttgcagcaggtcgtaagtctcttaccctcaatcttataactgaaatgggaagactacctacttttatgacgcagaaagcaagagacgctctcgataacctagccgtgctacatacagcggaagcaggcggtagagcatacaaccatgcattaagcgaactccccgaaacactagaaactcttttactgctaacactgctcgcaactgttacagggggaattttcttgtttctcatgtcgggaaaaggaattggaaagatgaccctaggcatgtgttgtataataactgcgagtatcttactttggtacgcccaaattcaaccgcactggatagcagcatctattatattagagttctttctaattgtcttattaattcctgaacctgaaaaacaaagaacgccacaagataatcaattgacttatgtagtcatcgcaatcttaacggtcgttgcagctactatggccaatgaaatggggtttttggaaaagaccaagaaagatctaggactaggaagtataactacgcaagaaagtgaatcaaatattttagacatagacttaagaccagcctcagcatggactttatacgcagtagcaacaacatttgtaacccccatgttgagacactccatcgaaaatagctctgttaatgtctctctaacagcaattgcgaaccaagcgactgtactaatgggacttggaaagggatggccgttatctaaaatggacataggtgtcccactgttagcaattggatgttactctcaagtaaatccaattacattgaccgcagcattactattattggtagcccattatgcgatcatcggacccggtcttcaagcgaaagctactagggaagcacagaaacgtgcagcagcgggaataatgaaaaaccctactgtggacgggataacagtcatagacttagaacccataccgtacgacccgaagttcgaaaagcagcttggacaagtcatgcttctaatactatgcgtaacccaagttctaatgatgagaacaacatgggcactttgtgaagcactaactttagctacagggccgatatcgacactatgggaaggtaacccaggtcgattctggaatacaacaatagcggtaagcatggccaacatattcagggggtcctatttagcaggcgccggtttgctattcagtatcatgaaaaacactactaatacacgtagaggcactggtaatattggagaaacccttggagagaagtggaaatccagactcaacgcactaggaaagtcagagttccaaatctataagaaatcgggaatccaagaagtggacagaacattggctaaagagggtataaaaagaggagagacagaccaccatgccgttagtagaggatcagcgaaactaaggtggttcgttgaacggaatatggtaactcccgagggaaaagtggttgatcttgggtgtgggagaggcggatggtcatactactgtgggggattgaaaaatgttagagaagttaaagggttaacaaaaggaggtcctggccatgaagaacctatcccaatgtctacatacgggtggaacttagtacggctgcaaagtggagtggatgtatttttcacgccacccgagaaatgtgacacattattatgtgatataggagaatcatcaccaaaccctacaatagaagcgggacggacgttaagagtactgaacttagtggagaactggcttaataataacacacagttctgcataaaagtactaaatccatatatgccatccgtaattgaaaagatggagactctacaacgtaaatacggaggtgccttagtacgcaaccctctttcgagaaattcaacccatgagatgtattgggtaagcaatgctactggaaatattgtctcgtcagtaaacatgatttctaggatgcttataaaccgtttcactatgaaacacaagaaggcaacatatgaacccgatgtagaccttggatctggaactaggaacataggaatagaatctgaaattcccaatttggacataattggaaaaagaattgagaaaataaaacaagagcatgaaacatcctggcattacgaccaagaccatccatacaaaacctgggcgtaccacggaagttatgaaactaagcaaacaggttcagcgagtagtatggtaaatggtgtggtgcgtttattgaccaaaccatgggatgtggttccaatggtaactcagatggcaatgacggacacaacaccgttcgggcagcagcgggtgttcaaggaaaaggtagacacgagaacacaggaacccaaagaaggtacgaagaaattaatgaagataactgcggaatggctatggaaagaattaggcaagaagaaaacgccccggatgtgcacgagggaggagtttacacgaaaagtacgaagcaatgctgcacttggggcaatcttcacagatgaaaataagtggaaaagtgcgcgcgaagcggttgaggacagtagattctgggagctaatagatagggaaagaaatctacacttagagggcaagtgtgaaacatgtgtatataacatgatgggtaaacgagagaagaaactaggggaatttggaaaagcaaaaggaagtcgggccatatggtacatgtggctgggggccagatttctagaatttgaagctctcggattcctaaatgaggatcactggttttcccgtggaaattctttatcgggggtagagggagaaggtctgcaccgcctgggatacattctgagagatgtatccaagaaagaagggggcgcgatgtatgctgatgatacagcaggttgggacacgagaattactttggaagatctcaaaaatgaagaaatggtgacaaatcacatgaaaggggaacacaagaaattggctgaagctatatttaaattaacatatcaaaacaaggtggtaagagtccaaaggcctacacctcgaggtacggtgatggatataatatcaaggagagatcagagaggcagcggacaagttggaacctacggacttaatacgtttacgaatatggaggctcagttaataagacaaatggaaggtgaaggaatatttaaaagtatacaacatttaactgtaacagaggaaatcgctgttcaaaattggttagcgagagtgggacgagagaggctaagtagaatggctatctctggggacgattgtgtagttaaaccgctcgacgatcggtttgcctccgctctaactgcactcaatgatatgggtaaagttcgcaaagatatacaacaatgggaacctagtagaggatggaatgactggacccaagttcctttctgctctcaccattttcatgaactcgttatgaaggacggacgagttttagtcgtgccatgtagaaaccaggatgagcttataggcagagcgagaatatcacagggggctggatggtctttaaaagagactgcctgcctgggtaaaagctatgcccaaatgtggacactaatgtatttccatagaagggatctccgactagcggcaaacgcaatttgttctgcggtcccatctcactgggtacctacaagtcgaacaacttggagcatacatgcaaagcatgagtggatgacgaccgaagatatgcttgcagtatggaatagagtatggatacaagaaaatccatggatggaagacaagacaccagtcgaatcatgggaagaagtaccatacctaggtaaacgagaagaccagtggtgtgggtcccttatcggacttacatcaagagcaacctgggcaaagaacatacaaacagccataaatcaagtaagatcattaataggaaatgaagaatatacagactatatgccgtcaatgaaacgattccgaagggaggaagaagaggctggtgtactgtggtaa

SEQ ID NO: 22552 - RNA, 9876 nt, synthetic construct
  misc_feature 1..9876: note = derived and/or modified CDS sequence (opt6) from DENV-2__EU482578__SS-prME
  source 1..9876: mol_type = other RNA
acagcgggcgtaataattatgctaattcctactgcaatggcttttcatctaacaactagaaatggagaaccacacatgattgttggacgtcaagaaaaaggtaaaagtctattattcaaaacagaagatggtgtaaatatgtgtacacttatggcaatagacttaggagaactttgtgaagatacaataacatataaatgcccattactgcgacaaaatgaaccggaagatattgactgttggtgtaattcaacgagtacgtgggtcacatatggtacatgtacaacaactggcgaacaccgaagagaaaaacgctcagtggcacttgtcccgcacgtgggcatggggctggagacgcgtacagaaacatggatgtcttctgagggcgcttggaaacatgtgcaaagaatagaaacgtggattctgcgtcaccctggtttcacgataatggcagctatacttgcatacacaattggaactacacattttcagagggctttaatttttatactgctcactgcagtagcacctagtatgacaatgagatgtataggcatttccaacagggattttgtcgaaggtgtttcaggaggttcgtgggttgatatagttctcgaacacggtagttgcgtcacaacgatggccaaaaacaaacccacactcgatttcgaattaatcaaaaccgaagctaaacaacctgcgactcttagaaaatattgcatagaggcaaaacttaccaatacgactacggagtccaggtgcccaacgcaaggggagccgtcactcaatgaagaacaagacaaaagatttgtatgcaaacacagtatggtggataggggttgggggaatggttgtggattgtttgggaaaggaggaatagtaacttgtgcaatgttcacttgtaagaaaaatatggagggaaaagtggtgttaccagaaaatttagaatatacaatcgttataacacctcactcgggagaagaacatgcagtaggaaacgatacaggtaaacacggaaaagaaataaaaattacgcctcaatcatcaattacagaagccgagttaacagggtatggcacagtaactatggagtgcagtccacgtacagggctagacttcaatgaaatggtactcctccagatggaagataaggcttggctagtacacaggcaatggtttttagatctgcctcttccctggctacctggagctgacactcaaggcagtaattggatacagaaagaaacgttagtaaccttcaaaaatccacacgcaaagaaacaagacgtagtcgtcttgggaagtcaagaaggagcgatgcatacagcgctgacaggggccactgaaatccaaatgtcatcggggaatttactttttacaggacatctaaaatgtcggttacgaatggacaaattacagttaaaagggatgtcctattccatgtgtactggaaaatttaaaatcgtaaaagaaattgcggaaacccagcacgggacgatcgtcattagagtgcagtacgaaggcgacggatcaccatgtaaaataccctttgagatcatggatttagagaaaagacatgtacttgggaggttgataacagttaacccaattgttacagagaaagatagcccagtaaacattgaagcggaaccaccatttggcgactcctacataataatcggagtggagcccggtcaactgaaattaaactggtttaagaaaggaagtagtataggtcaaatgttcgaaacaacaatgagaggcgctaaacgaatggctatattaggagatacggcgtgggactttggtagtttagggggagtatttacgtcaatcggaaaagcactgcatcaggtatttggagcaatctacggtgccgctttttcaggagtatcttggacaatgaaaatcctgatcggagtaataatcacttggatcgggatgaacagtagaagtacgagcttaagcgtatcacttgtattagtaggagtagttacattgtatttgggtgctatggtacaagcagattcaggctgtgttgtcagttggaaatctaaagagctcaaatgcgggagtggcatcttcatcacagacaatgtacacacgtggaccgaacaatacaaattccaacccgagtcgccctctaaattggcatcagcgatacagaaggcacatgaagaggggatatgcgggattcgatctgtgactagacttgagaatttaatgtggaagcagataactccagaattaaatcacatactaagtgaaaatgaggttaagctgaccattatgaccggtgacataaagggtataatgcaagctggcaaaagatcattaaggccgcaacctactgaactcaagtatagttggaaaacatggggcaaagcaaaaatgctatcaacagaaagccacaatcaaacatttcttatagatgggcctgaaacggcagagtgcccgaatacaaatcgcgcatggaactctctagaggtagaagattacggatttggagttttcacaactaatatctggttgaaactaagagaaaaacaagacgtcttttgtgattcaaaattaatgagtgcagccataaaggacaacagggccgtccacgctgatatgggttattggattgaatcagccctcaatgatacatggaagatggagaaggcctcattcatcgaagtgaaaagttgtcattggccaaaatcccacacactttggagtaatggagtgttggaatccgaaatgataatacctaaaaacttcgccggaccagtgtcgcaacataactacagacctggctaccatacacaaactgcggggccctggcatctgggcaagttagaaatggacttcgatttctgtgaaggtacaacagttgtagtcaccgaagattgcggcaatcgtggaccttcactaagaacaaccaccgcgagcggaaaactgatcacagagtggtgctgccggagttgtacactacctcctcttcgatatagaggtgaagacggatgctggtatgggatggaaataagacctctgaaggaaaaagaggaaaacttggttaacagcttagttaccgcgggacatggacaaatagataatttttcactaggggttctgggaatggcgctattcttagaggaaatgttaagaactagggtaggaacgaaacacgctattttactggtcgcagtgagttttgttacgttgattacgggtaatatgagttttcgggacctaggaagagtaatggttatggtaggtgctacaatgacagatgacatcggcatgggtgttacatatcttgcactcttagcagcctttaaggttaggcccacatttgcagccgggctactattgcggaaactcacaagtaaggagttaatgatggcaacaataggaattgcattattaagtcaatcaactattcctgaaaccatactagagttaaccgatgcattagcgttagggatgatggtgctaaaaattgttcgtaacatggagaagtaccaattagctgtaactataatggctatatcttgtgtgcccaacgctgtgattctgcaaaatgcatggaaagtgtcgtgtacaattctagctgcagtgtcagtttcacctctactattaacatcctcacaacaaaaagcagactggattcccctggcattaacgatcaaagggcttaatccaaccgccatattcttaacgactcttagtcggaccagtaagaaaaggtcatggcctctgaacgaagcgatcatggctgttggtatggtgtcaatcctcgctagctctttgctgaagaacgatataccaatgaccggtccgttagtagcaggagggttactgacggtgtgttacgtattgaccgggagaagcgcagatttagaattagaaagagcagctgatgtcaaatgggaagatcaggcagagatttcaggatcatcacctattttgagcataacaataagtgaggatggctcaatgtctatcaaaaatgaagaagaggaacagactttgacaatattaatcagaacgggcttgctagtgattagcggggtttttccggtctctatacctataacagcagcagcatggtacttatgggaggtgaagaaacagcgagcaggggtattgtgggacgtaccaagtccgccgcctgtaggaaaagcagagttagaagacggagcctatagaataaaacagaggggcatactaggctatagtcagattggcgcaggagtgtataaggagggaacatttcacacaatgtggcacgtgacacgaggagcagtcttaatgcatagaggaaaaagaatcgaacccagctgggccgatgttaagaaagatcttataagttatggaggagggtggaaactcgaaggcgaatggaaagagggcgaggaagtacaggtactagcacttgaacctggcaaaaatccaagagccgtacaaactaaaccaggattattcaaaacgaatactggaacaataggggccgtatcattagattttagtcctggaacaagtggatcacctatagttgatagaaaggggaaagtggtaggactatacgggaatggtgttgtgacacgctcaggagcctacgtatctgcaattgctcaaacagagaaatctatcgaagacaaccctgagatcgaagatgacatctttaggaagaaacgattgacaatcatggatcttcatccaggtgctggaaagaccaaacggtatctgccagcaattgtgagggaagctattaaacgtggcctaaggactttgatcctagcccccactagagttgtagcagccgaaatggaagaagcccttagaggtttacctataagatatcaaacccccgctattagagctgaacatactggcagagaaattgtagaccttatgtgtcatgcgactttcaccatgaggcttctatccccagtgagagtccctaactataatttgataataatggatgaagcgcacttcacagaccctgctagcatcgccgctagaggatatatatcaactcgggtagagatgggtgaagctgcaggaatttttatgacagctacacccccgggttcgagagatcctttcccccaatccaacgctcctattatggatgaggagagagaaatacccgaacgaagttggaactcgggtcatgaatgggttacagacttcaaaggtaagactgtgtggtttgtaccctctataaaagccggtaatgatattgcagcttgtttaaggaaaaatgggaagaaagtgatacagctgagcagaaaaacttttgattcagaatacgtaaaaacaagagcaaacgactgggattttgtcgtaacgactgacattagcgaaatgggtgcaaattttaaagcggaaagagtgattgaccctagaagatgtatgaaacccgttattctcaccgacggtgaagaaagggtcatattggcaggtccaatgcccgtaacacattcctctgcagcacaacgccgtggaaggataggaagaaatccaaagaatgaaaacgatcaatacatatacatgggggaaccattagaaaacgacgaggattgtgctcactggaaagaagctaagatgttattagacaacataaatacaccagaaggtattataccatcaatgttcgaaccagaacgagaaaaagttgatgccatagacggagaataccgattgagaggggaagcgcggaaaacgtttgtcgatctcatgcgccgtggtgatctgcccgtatggttagcgtatagagtagctgcggaaggaatcaattacgcggataggcgttggtgttttgatggaattaaaaataatcaaattttagaagaaaacgtggaagtagagatatggaccaaagaaggcgaacgtaaaaagctaaagccacggtggttggacgcccggatatactccgatccgctagctctcaaggagtttaaagagtttgctgcaggaaggaaatcactaaccttaaatctcatcacagaaatgggacgtttaccgactttcatgacacaaaaggcacgagacgctcttgacaacctagctgtacttcatactgcggaagctggcggtcgagcatacaatcatgccctatccgagctaccggaaacattagagactttattgctgctaacattattggcgaccgtaacaggtggaatatttttgtttctcatgtctggaaaaggtattgggaaaatgacattagggatgtgttgcattattacagcgtcaatacttctttggtacgctcaaattcaaccacattggattgctgcgtcgattatcttagaatttttcttgatagtattgctaattcctgaacccgagaaacagaggacacctcaggacaaccaactaacatatgttgtcatagcaatattaaccgtagttgcggccacaatggcaaatgaaatgggatttttagagaaaacaaagaaagatctcggccttggatcaataacaacccaagagtcagaaagcaacatactagatatagacttaagaccggcaagtgcgtggacgttatacgctgttgctacaacgtttgtgacgcctatgctaagacattcgatagaaaactcaagtgtcaatgtatccttaacagctatcgctaatcaagcaactgttctaatgggcctcggaaaaggctggccactatcgaaaatggatatcggagtaccactactcgctatcggatgttatagtcaagttaacccaattactctaactgcggcgttattactcctagtagcccattatgctataattggaccgggcctccaggcaaaagctacccgggaagcacaaaaacgagcagctgcaggtataatgaaaaacccaactgtcgacggcataacggtaatagatctagagccgatcccgtatgaccctaaatttgaaaaacagttaggtcaagtaatgctactaatattgtgtgtgacgcaagtactgatgatgcgcactacatgggcattatgtgaggcactaacactcgccactgggcctattagcacattgtgggaaggaaatccgggtagattctggaatacgacaattgcggttagtatggctaacatattccgaggctcttatttagcaggcgccggattattgtttagcattatgaagaatactacaaacactcgtcgaggtacagggaatataggggaaactttgggggaaaagtggaaatcaagattaaatgcgctgggaaaatctgaatttcaaatctacaagaaatcagggattcaggaagtagatagaacgttggccaaagaggggataaagagaggggaaaccgatcaccacgccgtctcacggggatccgctaaacttagatggttcgtcgaaagaaacatggtaacacctgaaggaaaagtagttgatttaggttgtggaagaggtggatggtcatattactgcggaggattgaaaaatgtacgtgaagtaaaagggctaacaaaaggaggtcctgggcatgaggaaccaatacctatgtcgacttatggatggaatttagttcggttacaaagcggtgtcgacgtcttctttacgcccccagaaaaatgtgatactctcctatgtgacataggtgaaagcagtcctaatcccacaatagaggcgggaagaacgctaagagtattaaatttagtagagaattggctaaataataatacgcaattttgtataaaggtattgaatccttatatgccgtcagtaatcgagaaaatggaaacgctacagcgaaaatacggtggcgctcttgtccggaatccgctcagtcgaaatagcacccacgaaatgtattgggtgtccaacgctaccgggaatatagtatcttctgtcaatatgatatcacgaatgctcataaatagattcaccatgaagcacaagaaagcgacgtatgaaccagatgtggatcttggatctggaacaagaaatataggtattgaatcggaaataccgaacctagacattattggaaagagaatcgagaaaataaagcaagaacatgaaacgtcctggcattatgaccaggaccacccatataagacgtgggcatatcacggatcttatgaaacaaagcaaacaggctcagcatcttccatggtcaacggcgtagttagacttttaaccaaaccatgggatgtcgtgccaatggtcacgcaaatggcaatgacggatacgacaccgtttgggcaacaaagggtttttaaggaaaaggttgatacgcgcactcaggaacctaaagaaggaaccaagaaacttatgaaaataactgctgaatggttatggaaagagctgggtaagaagaaaacacctagaatgtgcacgagagaagagttcacaagaaaagtgaggtcaaacgcagctttaggtgctatatttactgatgagaacaaatggaaatctgctcgagaggcagtagaagatagtaggttctgggaactaatagaccgcgaacgcaatcttcacttagagggaaaatgtgaaacctgtgtgtataatatgatgggaaaaagagaaaagaaactgggagaatttggaaaagcaaaaggttcaagagcaatttggtatatgtggttgggtgcaagattcctggaatttgaagcattaggattcttaaatgaggaccattggttcagtcgagggaacagtttatctggagtagagggtgaaggattacatcgccttggatatatacttcgagacgtgagcaagaaagaaggcggagcgatgtatgctgatgatactgctggttgggatacaaggataaccttagaagatctcaaaaatgaggaaatggtaactaatcatatgaaaggagaacataagaaattagcagaagcaatatttaagttaacctaccaaaataaagtggtcagagttcaaagaccaactccacgcggaacagtaatggacataatatcaagaagggatcaacgagggagtggacaagtgggaacgtacggtctgaacacgtttactaacatggaagcgcagttaataagacaaatggagggagaaggaatatttaaaagcattcaacatctgacagttacagaggaaattgcagtgcaaaactggttagcacgtgtcggacgagagcggctcagtcgtatggctattagtggggatgattgtgttgtaaaaccactagacgatagatttgctagtgcactgacagcattaaatgatatgggaaaagtcagaaaagacatccaacaatgggagccatctaggggatggaatgactggacacaagtaccattttgtagtcatcatttccatgaattagttatgaaggacggaagagtattggtagttccgtgtagaaaccaagacgaattgataggcagagcgcgtatttcacaaggcgcaggatggtcgttgaaagaaacagcctgcctcggtaaaagctacgctcaaatgtggacactaatgtattttcatagaagagacttaagactagccgctaatgcaatttgttcagctgtacctagtcactgggtaccgacgtctaggacaacttggagtatacatgccaaacatgagtggatgacaactgaagatatgcttgcagtatggaacagagtctggatccaagagaatccgtggatggaagacaagacgccagttgaaagctgggaggaggttccatatttgggcaaacgtgaagatcaatggtgtgggtcactgataggattaacttccagggcaacgtgggccaaaaatatacaaacagccattaaccaagtcagatcgctaattggaaatgaagaatatacggattacatgccatcaatgaaaaggtttagaagggaagaggaagaggcaggggtcctgtggtga

SEQ ID NO: 22553 - RNA, 9876 nt, synthetic construct
  misc_feature 1..9876: note = derived and/or modified CDS sequence (opt6) from DENV-2__EU482580__SS-prME
  source 1..9876: mol_type = other RNA
acagcaggggttattataatgctaattcccacggcgatggcattccatctaactacacgcaatggagaacctcatatgatagtcggacgtcaagaaaaagggaaaagtttacttttcaaaactgaagatggagttaacatgtgtacgttaatggcgatggaccttggagaactctgcgaagatacaataacctataaatgtccgctcttgcgacaaaacgaaccggaagacattgattgctggtgtaactcaacgagcacatgggtgacttatgggacatgtactacaacaggggaacaccgcagagaaaaacgatcagttgccttagttccccacgtgggaatgggattggaaacgcgaacagaaacatggatgtcttctgaaggggcatggaaacatgtgcaacgtatagaaacttggatcttaaggcatcccggattcacgataatggcagcgatattagcttacactatcggaacaacacattttcaacgtgctttaatatttatactcctgacggcagttgcaccatctatgacaatgcgttgtataggaatatctaatagagatttcgttgaaggtgtctcaggcggatcgtgggtggacatcgtgttggaacatggttcttgtgttactacaatggcgaaaaataaaccaacattagattttgagttgatcaaaacggaagcaaaacaaccggctaccttgaggaaatactgtatagaagctaaactaactaacaccactacagagagtcgatgtccaactcaaggagaacctagcttgaacgaggaacaagataaaagatttttgtgcaaacactcaatggtagaccgagggtgggggaacggatgtggactattcggcaaaggagggatagtaacatgtgcaatgtttacttgtaagaaaaacatggaaggaaaagtagttcaaccggaaaacctcgagtatacaatcgtcattactccacacagtggagaggaacatgctgtagggaatgacacaggaaaacatgggaaagaaataaaaataacgccacagtcttcaatcacagaagcagaattaacaggctacggcaccgtaaccatggaatgttctccgcgtactggccttgattttaacgagatggtacttttacaaatggaagacaaagcctggctggtccatcgtcaatggtttttagatcttccactcccatggttacccggtgcggacacacaaggttccaactggatccaaaaagaaaccctagtaacgtttaaaaatccacatgcgaagaaacaggacgtagtcgtactgggatcacaagaaggtgcaatgcataccgcactaacgggcgctacagaaatacagatgagtagcggtaacctgctatttacaggtcacctgaaatgtagactcaggatggataaattgcaactgaaagggatgagttacagcatgtgtacaggaaaattcaaaatagtaaaagaaatagcggaaacccaacacggaacgatcgtaattagagtgcagtatgaaggtgatggctcgccctgcaaaataccgtttgaaataatggacctagagaaaagacatgttctagggcgcttaatcacagttaatcctatagtaacagagaaagattcccccgtaaacattgaagcagaaccacccttcggagactcatatataatcataggcgttgaacctgggcaattaaaactgaactggttcaagaaaggtagtagcattgggcagatgtttgagacaactatgcggggagctaaacgaatggctatattgggcgatactgcatgggattttggaagtctgggaggcgtattcacctcaattggtaaagcacttcaccaggtgtttggagcgatatatggcgcagcattttcgggagtgagttggaccatgaaaatctttatcggcgtgataataacctggataggtatgaatagcaggtcaacatcattgtcagtcagtctagtacttgtcggagttgtaactctataccttggcgccatggtacaggccgattcaggatgcgttgtatcttggaaaaataaagaacttaaatgtggatctggaatattcatcaccgacaacgtacacacttggactgaacaatataaatttcaaccggagtctccatcaaaattagcgagtgctatacaaaaagcacacgaagaaggaatatgcggcataagaagtgttactagacttgagaacctaatgtggaaacaaattacgcccgaattaaaccatattttaagtgaaaatgaagtaaagttgactataatgaccggagacattaaggggataatgcaggcagggaaaaggtcattgcgaccacagccaaccgaacttaaatacagctggaagacgtggggcaaagcaaaaatgctaagtaccgaatctcacaatcagacgtttctaatagacggcccagaaacagctgaatgtccaaacacgaatagggcttggaacagtcttgaggtcgaggactatggatttggagtattcactactaacatatggttaaaattaagagagaaacaagatgtattttgcgacagtaaacttatgtccgccgccatcaaagacaatagagcagtacacgcagacatgggatattggattgaatccgctctaaacgatacatggaaaatggagaaagctagttttatcgaagtaaaatcatgccattggcctaagtcccacacactttggtcaaatggggtcttagaatcagaaatgataatccctaagaacttcgccggtcccgttagtcagcataattaccgaccaggttaccacacgcaaacggccgggccatggcacctaggcaaattggaaatggattttgatttttgtgaaggtacaacggtagtcgtaactgaggattgcgggaacagaggaccatcacttaggaccaccacagcatccggaaaattaataacagaatggtgttgcagatcttgtacactaccacccctacgctatagaggcgaagatggatgctggtatgggatggaaataaggccgctgaaagagaaagaggaaaacctcgtaaacagccttgtgactgcaggacatgggcaaatagataatttcagcctaggcgtcttaggtatggcgttattcttggaagaaatgcttagaactagagttggaacaaagcatgcaatattattagtagcagtttcatttgtaacacttattaccggaaatatgagcttcagagatttggggagagtaatggttatggtaggtgccactatgacagatgacataggtatgggagtcacatatttagcattattagcagcattcaaggtaaggccaacatttgcagcggggctcctgttacggaagctaacgtcaaaagagttaatgatggcaacgataggcatagccttattatcacaatcaacaatcccagaaacaattttagaacttaccgacgcccttgcattagggatgatggtgttaaaaatagtgcggaatatggagaaataccaacttgctgttacaataatggccatatcatgtgtacccaacgcagttatactacaaaacgcttggaaggtctcatgcaccatacttgcagctgtcagtgtgagtcctctattgctaacgtcatcgcaacagaaagcggattggatacccttagcgttaacaattaagggtttgaatccaacggctatctttttaactacgttatcccgcaccagcaagaaaagatcgtggccactgaacgaagctataatggcagtgggtatggtatcaattttagcatctagtttgctcaaaaatgatattccaatgacaggtcccttggttgctggcggtttactgacagtctgttatgttttaactggccgctctgcagatttagaattagaaagagcggctgatgtaaaatgggaggaccaggcagaaataagtggatcaagccctattcttagcattactatttcagaagacggatcgatgagcatcaaaaatgaagaggaggagcaaacattgacaatactgatcagaacggggctgctcgtcataagcggagtattccccgttagtataccaataacagccgccgcttggtacctatgggaagtgaagaaacagcgggctggtgtactatgggacgtacccagtcccccacccgtcggaaaagcagaactggaagatggtgcatatagaataaaacaacgcggaatattagggtacagccaaataggtgcgggagtctataaagaaggaaccttccacactatgtggcacgtcactagaggagctgttctaatgcatagggggaaaaggattgaaccgtcctgggctgatgtcaagaaagacttgataagttatggcggaggctggaaattggaaggcgaatggaaagaaggagaagaagtacaagtattggcgttagaaccagggaaaaacccaagagcggtacaaaccaaaccgggtctattcaagaccaataccgggacgattggagcagttagtttagacttttcgccgggaaccagtggttcaccaatcgtggaccgaaaagggaaagtagtcggtctatatggtaatggagttgtcacgagatccggggcatatgtaagcgcaattgctcagacagagaaatccatagaggataacccggagattgaagatgatattttcaggaagaaacgtctgacaattatggatctacacccaggtgcaggaaaaacaaaaagatatctacctgctatcgtacgggaagcgatcaaacggggactacgtaccctaatattagcacccacaagagtagttgcagccgagatggaagaggctttgcgtggtctacctataagataccagacgcctgctataagagcagaacacacgggccgagaaattgtagatttgatgtgccacgctaccttcaccatgaggctcctaagccctgtacgggttccaaattataatctaatcataatggatgaggcacatttcacagatcctgcaagtatcgctgccagggggtatatttctacacgagttgaaatgggcgaggcggcgggaattttcatgacagcgactccacccggtagcagagacccgttcccgcagtcgaatgccccgattatggacgaagaaagagaaataccggaaagatcctggaacagcggtcatgagtgggttaccgatttcaaaggcaaaactgtttggtttgttccttcgattaaagcaggtaacgatattgcagcttgccttaggaaaaacgggaagaaagtaatacaattgtcaagaaaaacgtttgatagtgaatacgttaaaacaagagcgaatgactgggattttgtcgtaaccaccgatattagtgaaatgggtgcaaacttcaaagcagaacgtgtcattgatccgagacgttgtatgaagccagtaatacttaccgatggcgaagaaagagtaattttagcgggtcctatgcccgtcacacattcatccgctgcgcaacgaagaggtagaattggacgtaatcctaaaaatgagaacgatcaatatatatatatgggtgagccactcgaaaacgatgaagattgtgctcattggaaagaagctaaaatgttattagacaacataaatacacccgaaggaatcattccctcaatgtttgagccagagagggaaaaggtggacgctatagacggggaataccgattaagaggcgaggcgagaaaaacgttcgtcgacttaatgcgaagaggagatctcccagtctggctagcatatagggtagcagcagagggaataaactacgccgaccgaaggtggtgttttgatggcatcaaaaataatcaaatcttagaggaaaatgtagaggttgagatatggacaaaagaaggtgaaaggaagaaactaaaaccaagatggctagatgccagaatatattccgatccactcgccttaaaggagtttaaagagttcgccgccggaaggaaatcattgacactaaacttaattactgaaatgggacggctacctactttcatgacccagaaagctcgagatgctctagataatttagccgtattacatacggcagaagccggtggtaaggcctataaccatgccctctctgaattaccagaaacactggaaacactattactattaacactcttagcaaccgtgaccggaggtattttcttatttttaatgagcggtaaaggaattgggaaaatgactctaggaatgtgttgtatcataaccgcgagcatattattgtggtatgcacaaattcaaccacattggattgccgcatcaataatattagagttcttcctcatagtattgcttatcccagaacccgaaaaacaaagaaccccacaagacaaccaattaacatacgtcgtcatcgctatactaacggtggtcgcagctaccatggcaaacgagatggggtttttagagaaaaccaagaaagacctaggattggggtccataactactcaagagtcagagtctaatattctagacatagatttgagacccgcatccgcctggacgctctatgccgttgcaacgacgtttgtcacaccaatgttacgccactcaatcgaaaacagttcagtaaacgtgagtcttacggctattgcaaaccaagctacagtattaatgggtctaggaaagggctggccactatcaaaaatggatattggagtaccattattggcgataggctgttattcacaggtcaatccgatcaccttgaccgcggcattgttattgttagttgcgcattatgccataatcggcccaggattacaggccaaagcgacgcgtgaagcccagaaaagagcagcggctgggataatgaaaaacccgaccgtcgatggcataaccgtaatagatctcgaacctataccgtatgacccaaagttcgaaaaacagttgggtcaagtaatgttactaattctatgcgttacacaagtactgatgatgaggacaacttgggccctatgtgaagcactgacattagcgacaggacccatatcgacgttatgggaaggaaacccaggaaggttttggaataccacaattgctgtcagtatggcaaatatttttcgaggttcgtatctagcaggcgcaggattactttttagtataatgaaaaataccacaaacacacgaagaggtacagggaacataggagaaaccttaggtgaaaaatggaagtccagactaaacgcacttggaaaaagtgaatttcaaatatacaagaaatcgggtattcaagaagtagatcgtactcttgcaaaagaaggaataaagcgtggggagacagatcatcacgcagtatcaagaggttctgcaaaattgaggtggtttgtcgaacgaaatatggtaactcccgaaggaaaagtagtcgacctaggctgtggtaggggagggtggagctattattgcggtggactaaagaatgtgagggaagtgaaaggattaacaaaaggagggcccgggcatgaagaacccataccgatgtcaacatacggctggaatctagtccggctacaatctggtgtagatgtattctttacgccaccagaaaaatgtgacaccctcttatgtgatattggagaaagcagtcctaaccctaccatagaagcaggaagaacattacgcgtcctcaatttagtagaaaattggttaaacaataacacacaattttgcataaaagtacttaacccctatatgccgtctgtcattgagaaaatggaaactctacagaggaaatatggtggtgctctcgtgcgtaatccgctttccagaaattccactcatgaaatgtactgggtatcaaatgcgacgggcaatattgtaagttctgtaaacatgatcagcaggatgcttataaataggttcactatgaaacacaagaaagcaacatatgaaccagacgtggaccttggctctggcacacgaaatatcggaatagaatcagaaataccgaacctcgatataataggaaaaagaatagagaaaattaaacaagagcatgagacaagttggcattacgaccaggatcatccatataaaacttgggcctaccacggatcatacgagacgaaacagactggttcggcctcttcaatggtaaatggagtagtaaggcttcttactaaaccctgggatgttgtacccatggtaacccaaatggcaatgactgatacaacgcctttcggacaacagcgagttttcaaagagaaagtcgatacaagaactcaagaaccaaaagaaggaaccaagaaattgatgaaaataacggcagaatggctctggaaagaactcggtaagaagaaaacaccaagaatgtgtacacgtgaagaatttacgaggaaagtcagaagtaatgccgcactaggtgcaatttttacggatgaaaataagtggaaaagcgcgagagaagcagttgaggacagtcgcttttgggaattagtcgaccgcgaaagaaacttgcacctcgaaggaaaatgtgagacatgcgtttataatatgatgggcaaaagagaaaagaaattaggggagttcggcaaggcgaaaggatcaagagcgatatggtacatgtggctgggagcacgattcctagaatttgaagcccttggcttcttaaacgaagaccactggtttagtagagggaatagtctttccggagtagagggagaaggtttacaccgattggggtatatactaagagatgttagtaagaaggaaggaggggcaatgtacgcagatgacactgctggatgggacaccagaataacattagaagacctgaaaaacgaagaaatggtcacaaaccacatgaagggagaacacaagaaacttgcagaagcaatcttcaaacttacctatcaaaacaaggtagtacgtgttcaaagacccactcctaggggtacggtaatggatataatctctcggagggatcagcggggtagtggacaagtaggtacgtatggacttaacacctttacaaatatggaagcacaacttataagacaaatggaaggagaaggcatatttaaatcaatccaacacctaactgtcactgaagaaatagctgtacagaattggttagcgagagttggtcgggaaaggctgtccagaatggccatatctggcgatgactgtgtcgtaaaacctctagacgatcgatttgcttctgccttaactgcattaaatgatatgggcaaggtaaggaaagatattcagcagtgggagccttcacggggatggaacgattggacacaggttcctttttgttcccatcactttcacgagctagtcatgaaagacggaagagtgctcgtcgtaccatgcagaaatcaggacgaacttataggcagagcaagaatatcgcaaggagcaggatggtctttaaaggaaacagcgtgcctaggtaaaagctatgcgcaaatgtggacactgatgtattttcatcgccgtgacctcagattagctgctaatgctatttgttctgctgttccaagccattgggtaccaacttcacgtacaacttggagcattcacgcaaaacatgagtggatgacaacagaagatatgctagcagtttggaaccgagtgtggatacaggaaaatccatggatggaagacaagacccccgtggagtcatgggaagaagtgccgtatttaggaaaacgtgaagatcaatggtgtggcagcttgataggacttacgagccgcgccacatgggcgaaaaatattcaaacagcaattaaccaagttcgatctcttataggtaatgaagaatatacagactacatgcctagtatgaaaagatttaggagagaagaggaagaagcaggcgtattatggtga

SEQ ID NO: 22554 - RNA, 9876 nt, synthetic construct
  misc_feature 1..9876: note = derived and/or modified CDS sequence (opt6) from DENV-2__EU482581__SS-prME
  source 1..9876: mol_type = other RNA
acagctggagtgataatcatgctcataccaacagctatggcttttcacttaactacacggaatggcgaaccacatatgatagtaggaaggcaagagaaaggaaaatccttgctatttaaaacagaagatggagtaaacatgtgtactttaatggcaatagacctcggagaactatgtgaagatactatcacctacaaatgcccgcttttaaggcaaaacgaaccagaagacatagattgttggtgcaatagcacatcaacttgggtaacatatggaacttgcacaactactggcgaacacagacgagagaaacgatcggtggctttagtaccacatgttggcatgggattagaaacacgaacagaaacatggatgtcatcagaaggggcttggaaacatgtacagcgaattgaaacatggattttaagacacccagggtttactatcatggcagccattttagcttatacgattggtactacacactttcagcgagcattgatatttattctgttaacagccgttgccccaagtatgacaatgcgatgcatagggataagtaaccgagacttcgtagaaggagtttccggaggaagttgggtagacatagtattggaacacggatcctgtgtcactacgatggcgaaaaataaaccgaccctcgattttgaactaatcaaaacagaagcaaagcaaccagcaacactaagaaaatattgcattgaagctaagctcactaacactacgacagaatcacgctgccctactcaaggtgaacccagcttaaatgaggagcaagataagagattcgtctgcaaacattctatggtagatcgaggttggggaaacggctgtggtttattcgggaaaggaggtatcgtaacatgtgcaatgtttacttgtaaaaaaaacatggaaggaaaagtagtacttccagaaaatttagaatacacaattgtaataacaccacattcaggggaagaacacgcagtaggtaacgatacagggaaacatggtaaagagatcaaaattacgccacaaagtagtataacagaagcagaactcacagggtacggtacagtaacgatggaatgttcaccgcggacaggactagattttaacgagatggttttacttcaaatggaagacaaagcgtggcttgtacatcgacaatggttcttggacttacccttaccatggctaccaggtgctgacacacaaggatcaaattggatacaaaaagaaacactggtcaccttcaaaaatccgcacgcaaagaaacaagatgtggttgtattaggaagccaagagggagcgatgcatacagcactgacaggtgcaaccgaaattcagatgtcaagcggaaaccttttatttactgggcacctgaaatgccgcctacgtatggataagctgcaattgaaaggtatgtcatattctatgtgcacaggtaaatttaagatcgtcaaggagatcgcagaaacacaacacggtacaatagttataagggtgcaatatgagggagatggaagtccatgtaagattccctttgaaattatggatctggaaaaaaggcatgttctaggaagactaatcacagttaatccaatagttacaggtaaggatagtccagtaaatatagaagcagagcctcccttcggcgactcatacattataattggtgtagaaccaggtcagctgaaactcaattggtttaaaaaaggaagcagcataggtcaaatgtttgaaacgacgatgagaggcgcaaaaaggatggctatattgggggataccgcttgggactttggatcgctggggggagtgtttacatctataggaaaagctttacaccaagtttttggtgcaatctacggcgctgctttctcgggcgtatcatggacaatgaaaatattgattggagttataataacgtggatagggatgaattcgagatctactagcctcagtgtatctcttgtgcttgtcggcgtagtcacactctatttaggtgcaatggtacaggcagattccgggtgtgttgtatcatggaaatcgaaagagctaaaatgtggaagtggcatttttataacagacaatgttcacacttggactgaacagtataaattccagccagagtctcctagtaaacttgcgtcagctatacaaaaagcgcatgaagagggaatttgtggaatacgcagcgtcacacggctggaaaacctcatgtggaagcaaatcacacctgagttaaaccacatcttgtcagagaatgaagtgaaactaacaatcatgactggtgacataaaaggaataatgcaggctggcaaacggtcactaagacctcaacccactgaactcaagtactcttggaaaacatggggcaaagcgaaaatgctctcaacggaatcccataaccagacctttcttatagatggtccagaaacagcagaatgtccaaatacaaatagagcatggaattcacttgaagtcgaggactacggtttcggagtgttcaccactaatatttggttgaaactgcgcgagaaacaggacgtattttgtgactcgaaactaatgtcagctgcgattaaggacaatcgagccgtacatgcagatatgggctattggatcgaaagcgccctcaacgacacttggaaaatggagaaggcgtcatttatagaagttaagtcttgccattggccaaaaagccatacattgtggtctaatggagtcctagagagcgaaatgattatcccaaaaaatttcgcaggccccgtaagtcaacataattatcgtcccggctatcacacacaaacagccggaccgtggcatcttggaaagctggaaatggattttgacttttgcgaaggaacaacagttgtagttacagaagactgcggtaatagaggaccatcgttaagaacaactaccgcatcaggaaaacttattactgaatggtgctgccgttcatgcacgttgccgccattaagatatagaggagaggatgggtgctggtatggaatggaaatacggccattaaaagaaaaagaagaaaacttagtcaatagcttagtaactgcaggtcatggccagattgataatttcagtctaggcgttctaggtatggcacttttccttgaggaaatgttacgaacaagggtagggacaaaacacgcaattttgttagttgcagtatcatttgtcactctcatcacaggaaacatgtcattcagggatctggggagagtaatggtaatggtgggtgctaccatgacggatgatataggaatgggagtaacatatttagctttactagcggcattcaaagtaagacccacattcgcagccggattactattacgtaagttaacatcaaaagagttaatgatggccactattggtatagctctattgtcacagtcaactataccagaaacaatattagaacttacagacgccttagcattagggatgatggtgttaaaaatcgtaagaaatatggaaaaatatcagttggcggttacaattatggcaatttcatgtgtcccaaatgcagttatattgcaaaatgcgtggaaagtctcatgcacaatattagccgctgtcagcgttagtcctctgcttctcactagttcccagcaaaaagcagactggataccactagcgcttacgatcaaaggtttaaatcctacggctatctttctaacgaccctatccaggacatcaaaaaagcgaagctggccactcaacgaagcgattatggcagtaggtatggtatcgatacttgcgtcaagtcttttaaagaatgacatccctatgacaggtcccttagtcgcaggaggactactcaccgtatgttatgtacttacagggcgatcagctgatctagaactcgaacgcgccgcagacgtaaaatgggaagaccaggctgaaatctccggctcgtctcctatcctatcgataacgatatctgaggatggaagtatgtcaataaaaaatgaagaagaagaacagactttaaccatcctaataaggactggattgctagtcataagcggggttttccccgtgtcgattccaataacggccgctgcttggtacctttgggaagttaaaaagcaaagagcgggagtattatgggatgtaccgtcaccacctcctgtcggaaaagcagagctggaagacggggcgtatcgaataaaacagcgaggaattcttggttattcgcaaatcggagcgggagtatataaggagggaacattccatacgatgtggcacgtaacgcggggggcagttttaatgcataggggaaaacggatagaaccctcttgggcagacgttaagaaagacctgatatcctacggaggcggatggaaacttgaaggagaatggaaagagggagaagaggtccaagtattggctttagagcccggaaaaaatccacgtgcagtacagacgaaaccaggcctttttaaaacaaacacaggtacgattggggcggtatccttagacttttctccaggtacgagtggctctccaatagtagatcgtaaaggtaaggtggtcggactatatggaaacggggtcgtaacccgaagtggggcatatgtatccgccatagctcagacagagaaatcaattgaagacaacccagaaattgaggatgacatattccgtaaaaaaaggttaaccattatggacctccatcctggggctggtaagaccaaaagatacctccctgcaatagtacgagaagcaataaaaagaggacttagaacattaatactagcacccactagagtggtggccgctgagatggaggaggctttaagaggtttacccatacgctatcaaacaccggcaattagggctgaacacacaggcagagaaattgttgacctaatgtgtcacgcaacatttactatgaggctactgtcacctgtaagagtcccaaattacaatcttatcattatggacgaagctcatttcactgatcctgcatccattgctgcacgaggttacatttcaacacgcgtggagatgggagaagcggcgggcatatttatgactgcgactccacctggaagtagggatccttttccacaaagcaatgcaccgatcatggacgaagaaagagagataccagaaagaagttggaatagcggacacgaatgggtgacagattttaaaggaaaaaccgtatggttcgtcccatcgatcaaagcaggtaacgatatagctgcgtgtctccgtaaaaatggtaagaaagtaattcaattgagtagaaaaacatttgatagtgagtatgtgaaaactagagcaaatgactgggatttcgtagtgacaactgatatttcagagatgggggccaatttcaaagcagaacgtgttatagaccctaggcgatgcatgaaaccggttattttgacagatggcgaagagagagtgattctggctggacctatgccggtgacacattcaagtgcagctcagagaagagggagaatagggcgaaatcctaagaatgaaaatgaccaatacatctatatgggagaacctttggaaaatgatgaagactgtgctcattggaaagaagctaaaatgttgctcgacaatataaatactccggaaggcattatccctagcatgttcgaacccgagcgagagaaggtagatgctatcgatggtgaatacaggctaagaggagaagctcgtaagacatttgtagatcttatgagaaggggagatttacccgtatggcttgcttatcgcgtggcagcagagggaataaactatgctgaccgccggtggtgttttgatggaataaaaaacaaccagattttagaagaaaatgtggaagtagaaatatggaccaaagaaggtgagagaaaaaaattaaaaccgagatggttggatgctcgcatatactcagatcccctggcgttgaaagaattcaaagaatttgccgcaggcagaaaatcattaacattaaatctaatcacagaaatgggccgtttaccaacctttatgacacagaaggcaagagatgcgcttgacaacctcgctgtattgcacacagccgaagcaggggggagggcatataatcacgcactatcagaactacctgaaacgctagaaacactgctactactgacactattagccacagtaacgggaggaatctttctatttctcatgtctgggaaaggcattggtaaaatgacattaggtatgtgttgcataataacggcttcgatactcttatggtacgctcaaatccaacctcactggatcgcagcctcaatcatcctagaattttttctaattgtgctcttaattccagaacccgagaaacaaaggacacctcaagataaccaactaacatatgtggttatagctattcttacagtggtagctgcaactatggcaaatgaaatgggatttttagagaagacgaaaaaggacttaggattaggtagtatcacaacccaagaatctgaaagcaatatacttgacatagatttacgaccagctagcgcatggacactctatgccgtagccacgacattcgtgacacctatgttacggcacagcatagaaaacagttcagtcaatgtaagtttgacagccatagcaaaccaagcaactgtactaatgggattaggaaagggatggccattatccaaaatggatatcggagttcccttgttagcaattggatgctactcgcaagtaaatccaatcactttgacagcagctctattactgttagtcgctcactacgctattatcggtccgggtttacaagctaaagctacccgtgaagcgcaaaaacgcgcagctgcaggtataatgaaaaatccaacagtagacggaatcaccgtaatcgacttagaacctataccttatgaccctaaattcgaaaagcaactaggccaagtcatgttactgatcctgtgtgtaacccaagtgttaatgatgaggactacatgggctctatgtgaagcacttactctagccacaggacctatatctacactttgggaggggaaccctggacgtttctggaatacaaccatagcagtatccatggcaaatattttccgaggttcatacctggcgggagctggtctcctcttttcaataatgaaaaacaccaccaatacaaggagaggaactggaaacatcggagagactttaggtgaaaagtggaaaagcaggctaaatgcactagggaagagtgaatttcaaatttataaaaaatcagggattcaggaggtagataggacactagcaaaagagggcataaagagaggtgagacagatcatcatgcggtttctaggggctctgcgaaactaagatggttcgtggagagaaatatggtaacaccagaaggaaaagttgtagatttgggttgtgggagggggggctggagctactattgcggtggactcaaaaatgttagggaggtgaaaggcttaacgaagggcggaccgggacatgaggagcctatacccatgtcgacctatggatggaatctagtccgcttacaaagcggcgttgatgtctttttcacaccaccagagaagtgtgacaccttactctgtgacatcggagagtcatcaccaaatcccactatagaagcaggtcgcactttgcgagtgctcaatttggtcgagaactggctgaataataatacacaattttgtataaaggtactcaatccatatatgccatccgtaattgaaaaaatggaaacattacagcgaaaatacggaggagccttagtacgtaaccccctttcacgaaattcgactcacgaaatgtactgggtctcaaatgctacaggtaatatagtgtcttcagttaacatgataagtagaatgctaattaacagatttacaatgaaacataaaaaagcaacctatgaaccggatgtcgatcttggttcggggacaagaaatattggaatcgaatcagaaataccgaaccttgatatcattggaaaaagaatagagaaaatcaagcaagagcatgaaacttcgtggcactacgatcaagatcatccgtataaaacttgggcctaccacggtagttacgaaactaagcaaacaggcagtgcctcttctatggtgaatggagtggtaagactcttgacgaaaccatgggacgtggtgccgatggtaacacaaatggccatgactgacactactccgttcggacagcaacgggtcttcaaagaaaaagtggacactagaacccaagagcctaaagaaggaacaaagaaattaatgaaaattactgctgaatggctatggaaagaactgggcaagaagaagactccgagaatgtgcacaagagaagaattcacccgaaaagtgagaagtaatgcagctctcggtgctatatttacggatgaaaataaatggaagtcagctcgtgaagcggttgaagacagtagattttgggaactaatagatcgagagagaaacctgcatctagaaggaaaatgcgaaacatgtgtatacaacatgatgggtaaacgtgaaaaaaaattaggagaatttgggaaagcaaaagggtctcgagctatctggtatatgtggcttggagcaagatttttagaattcgaagcacttggttttctaaacgaggatcattggttctcaagggggaatagcctaagtggtgtagaaggtgagggattgcatcgactagggtacatactgagggatgtatcgaaaaaagaaggcggagcaatgtatgcagatgatactgctggctgggatactagaataacactggaagatctaaaaaacgaagaaatggtaaccaaccacatgaaaggcgagcataaaaagctggctgaggcaatattcaaactcacataccaaaacaaagtcgtgcgggtacaaagacctaccccacgtggcacagtaatggatatcattagtaggagggaccaacggggctccggtcaagtgggaacttacggattgaatacattcactaacatggaagcacaacttattagacaaatggaaggagaaggaatctttaaatcaatacagcacctcaccgtcacagaggagattgcggtacagaactggttagcaagggtcggtagggaacgtctatcgaggatggcgattagtggggatgattgtgtggtaaaaccactagacgaccgatttgccagcgcgttgacggccctaaatgatatgggcaaagtcagaaaagatatacaacaatgggaaccgtcacgcggatggaatgactggacacaggtgcccttttgctcacatcattttcacgaactggtaatgaaagacgggagagtattagttgttccgtgcaggaatcaagatgaattgattggcagggcgagaatctcacagggagcaggatggagtctcaaggaaacggcctgcctagggaaaagttatgctcaaatgtggacgctgatgtattttcatagaagagacctaagacttgctgcaaatgctatatgttcagcagtaccatcacattgggtacctacaagtcggacaacctggtcaatacacgcaaaacacgaatggatgacaacagaggacatgcttgcagtgtggaatcgagtatggatccaagaaaacccatggatggaagataaaacgcctgttgaatcatgggaagaagttccatatttagggaagcgtgaagaccaatggtgtggaagcctaatcggtttaacaagcagagcaacctgggcaaagaacattcagacagcgataaaccaagtacgaagtctaataggcaacgaagaatacacagattacatgcccagtatgaaacggttcagaagagaagaagaagaagccggtgtattatggtaa

SEQ ID NO: 22555 - RNA, 9876 nt, synthetic construct
  misc_feature 1..9876: note = derived and/or modified CDS sequence (opt6) from DENV-2__EU482582__SS-prME
  source 1..9876: mol_type = other RNA
actgcaggggtaataattatgttaataccaacggcaatggcattccacctaactacgaggaatggcgaaccacatatgattgttggcaggcaggaaaaaggaaaaagtctcctattcaaaacggaagacggcgtgaatatgtgtactcttatggctatagacctaggcgaactttgcgaagataccataacctacaaatgtcctctactgcgacagaacgaacctgaagatattgattgttggtgcaattcaaccagtacttgggtgacatacggaacgtgtaccacaacaggagaacatcgaagagagaaaaggagtgtggcactggttccacacgttggaatgggattggaaactcgaacagaaacatggatgtcctctgaaggcgcgtggaaacatgtacaaagaatagaaacctggatattacgacatcccggcttcacgattatggcagctatactagcatacaccataggtacaaatcatttccagagagcactaatatttatattactaactgcggttgctcctagtatgactatgagatgtatagggataagcaatagagatttcgtggaaggcgtttcagggggaagttgggtagacatagtattagaacatggatcatgcgttaccacaatggccaaaaataaacccacgttggatttcgagctcatcaaaactgaggcgaaacaaccggcgaccctcagaaaatactgtatagaggctaaactcaccaacacaacgactgagagcagatgccctacacaaggagaaccatctctaaacgaagaacaagataaacggtttgtatgcaaacatagtatggtagatagaggttggggtaacggttgtggactattcggtaaagggggtatagtaacatgcgcaatgtttacgtgcaagaaaaatatggagggaaaagtcgtactaccagaaaatctagaatacaccatagtgataacccctcactcgggagaagaacatgcagtagggaacgacacggggaaacacgggaaagaaataaaaataacaccacagagcagcataacggaagctgaattgactggatacggcactgtcacaatggaatgtagtccgcgaactggacttgacttcaatgagatggtactcctgcaaatggaagacaaagcatggctagttcaccgtcaatggtttttagacttacctttaccttggctacccggtgcggatactcaaggtagcaattggattcaaaaggagacgctagtaactttcaaaaatcctcatgccaagaaacaggatgtagtagtattgggaagccaagaaggagcgatgcatacagctctaacaggggctacagaaatacagatgtcttcgggaaatttgctgttcacgggtcatcttaaatgccgactcaggatggacaaactacagttaaaaggtatgtcctattctatgtgtacaggtaagttcaaaatagtaaaagaaatagcagagacacagcacggaacaattgtaataagagttcaatatgaaggagatgggtcgccatgcaaaatcccttttgagataatggacttagaaaagagacacgttctaggtcgtctaatcactgtcaaccccatagtgacagaaaaagattcaccggtaaatatagaagcagaacctcctttcggagattcatatataataattggagtcgaaccggggcaattaaagctaaactggtttaaaaaggggtcgtcaataggacaaatgttcgaaacgaccatgcgaggcgccaaaagaatggctatcctgggcgataccgcatgggactttggatcattaggaggtgtctttacaagtataggtaaggcattacatcaagtatttggagcaatctacggagcggtattttcaggtgtatcatggactatgaaaatactcataggcgtaataattacttggataggaatgaacagtagatctacatcgttgagtgtttcattagtcttagttggcgttgtaaccctataccttggtgcaatggtacaggcagacagcggttgtgtcgtatcctggaagtcaaaagaactaaagtgtggttccggaatattcatcactgataatgtacatacatggacggagcaatacaagttccagcctgaaagcccgtcgaaacttgcaagcgcaatacaaaaagcacatgaagagggaatctgcggtattaggagtgtcacgagattggaaaacttaatgtggaaacaaataacacctgagctaaaccatatacttagcgaaaatgaagtgaaattgactatcatgacaggggatataaaagggataatgcaagcaggtaaaaggtctctaaggccccaaccaacggaattaaaatacagttggaaaacatggggaaaagcgaaaatgctatctactgagtcccataatcaaacatttttgatcgatggaccagaaacagcagaatgcccaaacactaatagagcttggaacagcttagaagtcgaagactacggcttcggggtatttacgacgaatatatggctaaaactgagagagaaacaagatgtattttgtgatagtaaacttatgagtgcggcaataaaggataatcgagctgtgcacgctgatatgggttattggattgaatcggcactgaacgatacatggaaaatggagaaggcgagtttcattgaagtgaagtcatgtcactggcctaaatcacacaccctatggtccaacggagttttagagtccgagatgataattcctaagaattttgcaggacccgttagccaacataactatcgccctggttaccatacacaaactgctggtccatggcacttaggcaaactggaaatggactttgatttctgcgaaggaacaaccgttgttgtaacagaggactgtggaaataggggtccaagtctaaggacaactacggcctcaggaaaattaattacagaatggtgctgtagatcctgtacattgccaccgttacggtataggggagaagatggatgctggtacggaatggaaattcgacccttaaaagagaaggaagagaacctagttaacagtttagtgaccgcaggacatggacagattgataacttttcattgggtgttctcggtatggcgctttttctagaagaaatgttgagaacaagggttgggacgaaacatgctatcttgctagtcgctgtctcatttgttacactaatcaccggcaacatgtcttttcgagacctagggagagtaatggttatggttggcgctacaatgacagacgacataggaatgggagttacgtacctagctctactagcagcattcaaggtgcgacccacctttgcggccggcctattgttaagaaaactaacctcaaaggaactgatgatggctaccatcggaatagccctattaagtcaatcaacgataccggagacaatattagaactcaccgatgctctagcgttaggtatgatggtgttaaagatagtgagaaacatggaaaaatatcaactagctgtcacaatcatggcgatatcatgcgtcccaaacgctgtaatattacaaaatgcatggaaagtatcttgtaccatactagcggcagtgtccgtatcacctttacttcttacctcatcacaacaaaaagcagattggatccctttagctttgacaattaaaggacttaacccaactgcgatatttctaacaaccttgagtagaacaagtaagaaaagaagttggccattgaacgaagccataatggctgtagggatggttagcatcttagcaagttcactccttaagaatgatataccaatgactggacctctcgtcgctgggggactcctaacggtatgctacgtgttaacaggacgaagtgcagatttagaattagaaagagctgctgacgtcaaatgggaagaccaagctgagatatccggaagtagtccaatcttatctattacgatctctgaggacggttcgatgtcaatcaaaaacgaagaggaagaacaaacgctcacaatcttaatacggacaggattattggtgatatcaggcgtctttccggtcagtatacccattacagcggccgcatggtatttatgggaggtcaagaaacaaagagcaggggtactatgggatgtaccatccccacccccagtaggtaaagcagaactagaagacggagcttatagaataaaacaaagaggcatattaggatattcccaaattggtgcgggagtatacaaagaaggaacattccataccatgtggcatgtaacacgaggcgccgtcttaatgcataggggcaaaaggattgaaccaagctgggcagatgttaaaaaggacttgattagttacggcggtggttggaaacttgaaggcgaatggaaagaaggtgaagaagtacaagtactagctctagaacctggtaagaatcctcgtgcagttcaaactaaaccaggtttattcaaaacaaatacgggtacaattggcgccgtttcactagacttttccccagggacgtctggaagtccaatcgtcgacagaaaagggaaggtagtcggactatacggcaatggagtggtaactaggagtggagcctatgtttccgctatagcacagactgagaaaagcatagaggataaccctgaaatagaagacgacatctttcgaaagaaaagactcactattatggatctacacccaggtgccggtaaaactaaacgttatttgccagcgatcgtaagggaggccataaaaagaggattaagaactcttatacttgcacccacgagagtagtggccgccgaaatggaagaagcattgaggggactaccaattaggtatcaaacccctgcaatacgcgccgagcacacaggtcgtgagatcgtggatcttatgtgccatgcaacgtttacaatgagattactgtcgccagtccgcgtgccaaattataacctaataatcatggacgaagcgcactttactgaccctgcaagtatcgctgcgagaggttacatatctacacgggtggaaatgggagaggcggctggtatctttatgacggcgacccctccgggatcgagagatccatttcctcagagtaacgcgccgataatggacgaggaaagagagattcccgaacgaagttggaatagtggtcatgaatgggtaacggacttcaaaggaaagactgtatggttcgttccgagtatcaaggcaggtaacgatattgccgcctgtttaaggaaaaatggtaagaaagtgattcaactgagccgaaaaacgttcgattcggagtatgtaaaaactcgcgctaacgattgggactttgtagtcacgactgacattagcgaaatgggcgcaaattttaaggcagaaagagtgatcgatccccgcagatgtatgaaaccagtgatcctaactgatggtgaagaaagagttatactagccggacccatgccggtaactcactcaagtgcagcacaacgtcgtggcagaattggtagaaatcctaaaaatgagaacgatcagtacatatatatgggagaacccctagagaacgacgaagattgtgcccactggaaagaggctaaaatgctgctagataatataaacactcctgaaggaattataccaagtatgtttgagccagaaagagaaaaagtagatgctatagacggagaatacagactaaggggagaagctagaaaaacttttgtggatctcatgcgcagaggagatctcccagtatggttagcctaccgggtagcagcagaagggataaattacgcagatagaagatggtgtttcgatggaattaaaaataatcaaattctagaggaaaatgtcgaggtagaaatatggacaaaggaaggtgaacggaagaaattaaagccaagatggctcgacgcgagaatatatagcgacccactggccttaaaagagttcaaagaatttgctgcaggaagaaaatctctaacgttaaatttaattacggagatgggtagactgcccacatttatgacacaaaaagcaagggatgcacttgacaatttggctgtcctacatacagcagaagccggtggacgagcctacaatcatgctttgagtgaactccccgaaacattggaaaccttactgttattaacattactagctaccgtaacaggagggattttcttatttctcatgagtggtaaaggtatcggaaaaatgactctcggaatgtgttgcataataacagctagtatcctgctatggtatgcacaaattcaaccacactggatagcagcatcaattattctagagtttttcctaatagttttattaatcccagaaccagagaaacaacgcacaccacaagacaaccaactaacttatgttgttattgccatactaacagtagtagcagcaacaatggcaaatgaaatgggtttcctagaaaagaccaagaaagatctgggactaggctcaaccaccactcaagagtccgagtcaaacatattggatatcgatttgcggcccgcaagtgcgtggactttatacgctgtagcgactacatttgtaactccaatgctcaggcattccatcgaaaattcatctgttaacgtatcgctgacagcaatagcaaaccaagctactgtgctaatggggcttggaaaaggatggccactaagcaaaatggatattggagttcctttactagcaataggatgttacagtcaagttaatccgataactcttaccgcggccctactattgttagttgctcactatgcaatcataggcccaggacttcaggcgaaagctacacgggaagcacagaaaagagctgcagcggggataatgaaaaatccaacagtagatggaatcacagtgattgacctggaacctatcccttacgacccaaaattcgaaaaacagttagggcaggtaatgcttctaattttgtgtgttacacaagttctgatgatgagaacaacatgggctctttgcgaagcccttacacttgcgactggacccataagtaccctttgggagggtaaccctggccggttttggaataccacgatagctgtctctatggcaaacatatttcgtgggagttacttagctggtgccggcttactattctcaatcatgaaaaatacaaccaatacgcgaagaggaactgggaatataggagagactttgggtgaaaaatggaagagtagactaaatgcactgggaaaatcagagtttcaaatatataaaaagtcagggattcaggaagttgacaggactctggcgaaagaaggaataaaacgcggggagacagatcatcacgccgttagtcgtggatcggctaaattacgttggttcgtggagagaaacatggttactcccgaaggaaaagtagtggatctgggttgtggaagaggtggttggtcctattattgcggtggcttaaagaacgtgagagaggtgaaaggtttaactaaaggaggtcctggacacgaagaaccaataccaatgtctacatacggctggaatctggtgaggctacagtctggagtcgatgttttcttcactccacctgaaaaatgtgataccttattatgcgatataggggaaagcagcccgaatccaaccattgaagctgggcgcacactaagggtattgaatttagtcgagaattggctaaataataacacccaattctgtataaaggttcttaatccatatatgccatccgtaatcgagaaaatggaaacactccaacgaaaatatggaggtgctcttgttcgaaatcctctctcccgaaattcaactcacgaaatgtattgggttagcaatgctactggaaacattgtatcaactgtaaatatgatatcaagaatgctcatcaatagatttaccatgaaacataagaaagctacatacgaaccagatgtagacctaggtagcggaacaagaaacatcggcatagaaagcgaaataccaaatctagacatcataggtaaaagaatagagaaaataaagcaggaacatgaaacaagctggcactacgaccaagaccatccatacaagacatgggcgtaccatggcagttatgaaacaaaacaaacaggcagcgcatcgtcaatggtaaatggtgtagtacgtctcttaactaaaccttgggacgtagttcccatggtcacccaaatggcaatgacagatacaacaccattcggacaacaacgagtttttaaagaaaaagtagacaccagaacacaagagcctaaggagggaactaagaaacttatgaaaataactgcagagtggttatggaaggaattgggtaagaagaaaactcccaggatgtgtacgagagaggagttcacacgaaaggtcagaagtaatgctgccttaggggctatatttacggatgaaaataaatggaaatcggcacgcgaggcagtcgaagattcaagattttgggagttaatagatcgggagcgaaatttacatctcgaaggaaaatgtgaaacctgtgtctataacatgatgggtaaacgtgaaaagaaactaggagagtttggaaaagcaaaaggatccagagcgatctggtatatgtggcttggagctagattcctcgaatttgaagcactgggattcctaaacgaggatcattggttttcgagaggtaacagcttaagtggggtagaaggtgaaggcctccatcgccttggatacatactacgagatgtaagtaagaaagaaggaggggccatgtacgcagacgataccgcaggatgggataccagaataacgttggaagatttaaagaatgaagagatggtcaccaaccatatgaagggagaacataagaaactagcagaagcgatattcaaactaacttatcaaaataaagtcgttagggtacaacgaccaaccccaagggggaccgtaatggatataattagccgacgagatcaaaggggatccggacaagtaggcacgtatggactaaatacttttaccaatatggaggctcaattaataaggcaaatggaaggcgagggaattttcaaatctatacaacacctgacagtaactgaggaaatagcagtacagaactggcttgcccgtgtaggccgagaacgtcttagccgaatggcaattagcggagatgactgtgtagtaaaaccactagatgatcgattcgcttcagcacttaccgcactaaatgatatgggtaaagttcgcaaagacatccaacaatgggaaccgagtagaggttggaatgattggactcaagttccattctgctcacatcattttcatgagttggtcatgaaagacggacgtgtcctagtcgtaccgtgccgaaatcaggatgagcttataggaagggcgagaatctctcagggcgcaggatggtccctaaaagaaacagcttgtctagggaaatcgtatgcacaaatgtggacattaatgtacttccatagacgggacttgcggctagcagcgaacgcaatttgttcagcagtaccatcgcattgggtaccgacatccagaacgacatggagcatacacgcaaaacatgaatggatgacgactgaagatatgttagcagtatggaatcgagtttggattcaagagaacccctggatggaagataaaacaccagtagaaagctgggaagaagtcccatatctaggtaagcgagaagatcaatggtgcggaagtttaatcgggcttacgtcgcgtgcgacatgggccaaaaatatccaaaccgctataaatcaagttagatccctcataggaaacgaagagtacacagactatatgccgtcaatgaaacgatttaggcgcgaagaagaggaagcaggagtattatggtaa

SEQ ID NO: 22556 - RNA, 9876 nt, synthetic construct
  misc_feature 1..9876: note = derived and/or modified CDS sequence (opt6) from DENV-2__EU482583__SS-prME
  source 1..9876: mol_type = other RNA
acagctggcgtaataattatgctaatcccgacagcaatggctttccatttaaccactcgaaacggtgaaccgcatatgatagttggtcgccaagaaaaaggaaaatcgctattattcaaaaccgaagatggagtaaatatgtgtacgctaatggcaatagatctaggagaattatgcgaagatactattacatacaaatgtccactacttcgacaaaacgaaccagaagacattgattgttggtgtaatagtacctcaacatgggtaacatacggaacatgcaccacaacaggtgaacaccgcagagaaaaacgtagcgtcgcattagtaccacacgtggggatgggtctggaaactcgcacggaaacttggatgtcaagtgaaggagcatggaaacatgtacaacgaattgaaacatggatactaagacatccgggcttcacaataatggcagcgattctagcatacactataggtaccacccatttccaaagagctttaatattcatacttctcactgcagttgcacccagcatgacaatgcgatgtataggcatatccaacagagatttcgtggaaggagtttctggaggatcttgggttgatatagtattagaacacggatcctgcgtaactactatggcgaaaaataaaccaacgctagattttgaacttattaaaaccgaagcaaaacaaccagcaactctaagaaaatattgtattgaagcgaaactaacaaatacgacaacggagtcgagatgcccaacacagggcgaaccgagtctaaatgaagaacaagacaaaaggttcgtttgtaaacattcaatggtagaccgaggatggggaaatggctgtggattgtttggaaaaggtggaatcgtaacatgcgctatgttcacttgcaagaaaaatatggaaggaaaagttgtgcttccagaaaatttggaatatacaatagtcataacgccacactctggtgaggagcatgcggtcggtaacgacactggaaaacatgggaaagaaattaaaatcacaccccaatcaagtataactgaagcggagttaactggttacggaacggtaacgatggaatgctcgccaagaacaggattagacttcaacgaaatggttctactacaaatggaagacaaagcgtggctagtacatcgacagtggtttcttgacttaccgttgccatggttaccaggagcggatactcagggttcaaattggatccagaaagagaccttggtaacattcaaaaatccacatgccaagaaacaagatgttgtcgtcttaggaagtcaagaaggtgctatgcacaccgcgctaacaggcgctacagaaattcaaatgtcttcgggaaacctgttattcaccggacatctgaaatgtcgattaagaatggataaattacaacttaaaggcatgtcttattcgatgtgtacaggcaaatttaaaatcgtaaaagagatagcggaaactcagcacggcacaatagtaatcagggtacaatacgaaggagacggttctccctgcaaaattccattcgaaatcatggatttagagaaaagacatgttttgggacgattaatcacagtgaatccgatcgtaactgagaaagattcccctgtcaacattgaagcagaaccgccctttggcgactcttatataataataggagtagaaccgggacaattaaaactaaactggttcaagaaaggcagcagtatcggccaaatgttcgaaacgacaatgcgcggagctaaacgaatggcaattttaggagatactgcctgggatttcggatccttaggaggcgtattcacttcaattggaaaggccctccaccaggtctttggtgcaatatacggcgctgccttctcgggtgtctcgtggacaatgaaaatcttaataggtgtgataataacctggataggcatgaacagtaggagtacaagtcttagtgtgagtttagtcctagtaggggtagtaacgctttacttgggagcaatggttcaagcggattccggctgtgtcgtcagctggaaaaataaggaattgaaatgtggatcaggtatctttataacagacaatgtgcacacatggacagaacagtataagtttcaacctgagagtcctagtaaactagcatcggcaattcagaaagcacatgaggagggtatttgcggcattcgatcagtaacaagattggaaaatttaatgtggaagcaaattacccctgaactaaaccacattttgtcggagaacgaagtaaaacttacaatcatgacaggtgacataaaaggaataatgcaagcaggcaaaagaagtttgcgtccacaacccacagagctaaaatattcttggaagacctggggaaaagccaagatgttatcgactgaatcacacaaccaaacatttttaattgatggaccagaaacagcagaatgcccaaatacaaacagagcttggaactcactggaagttgaagattatggctttggagtctttacaacaaatatttggctcaaattaagggaaaagcaggatgtgttttgtgattctaaactaatgtcagcagcaataaaagacaacagagcggtacatgccgatatgggctattggatagaatccgctttaaacgatacctggaaaatggaaaaagcatcatttatcgaagttaaatcgtgccattggcctaaatcacacaccctttggtccaatggagtgcttgaaagtgaaatgataatccccaaaaacttcgctggacccgtaagccaacataactatagaccaggatatcatacgcaaacagcagggccttggcatttgggaaaactagaaatggattttgatttttgtgaaggcaccaccgttgtggtgaccgaggattgcggaaatagagggccaagtttaagaacgacaactgcgtcaggtaaactcataactgaatggtgctgtcgaagttgtactctcccacccttgcgatatcggggagaagatggctgttggtatggcatggagataagacctctcaaggaaaaagaggagaacttagttaactccctagtaactgcggggcacggtcaaattgataatttttctctaggtgtcttgggaatggctctatttcttgaagaaatgctacgaacgcgtgtcggaaccaaacacgctatcttgctagttgcagtaagttttgttacattgataactggtaacatgtcctttcgtgatttaggaagggtaatggttatggtaggggctacaatgacagacgacataggaatgggagttacttacttggctctacttgcggcatttaaagtgaggcctacatttgctgcagggcttcttttacgcaaattaacatcaaaagaactaatgatggctacgatcggcatagctttactatcacaatctaccataccggaaaccatactagaacttacagacgccctagctttgggcatgatggttcttaaaatagtgagaaatatggaaaaataccaactagctgttacgataatggcgatatcttgtgtacctaatgcagtcattctacaaaacgcttggaaagtgtcatgcacgattcttgccgctgtaagcgtaagtccactattactaacatcaagtcaacaaaaggcagattggattccgctagcactcaccataaaaggtctaaatccaacggcaatattcttaaccacattatcccgtacaagtaagaagagaagctggccattaaatgaagccattatggcagttggtatggtcagtattcttgcatcctcattgctgaaaaatgacatcccaatgacaggtccgctggttgcgggaggattactaacagtgtgttacgttttgaccggaagaagtgcggacctagagttagaaagagctgctgatgtgaaatgggaagaccaagccgaaatatctggatcaagtcccatactaagtataaccatttcggaggacgggagtatgtcgatcaaaaacgaagaagaggagcaaacacttactatattgatacgcactgggctattggtgattagtggggtttttccagtttcaataccaataacagccgcagcttggtatctctgggaggttaagaaacagcgggctggagttttatgggacgttccatcaccacctcccgttgggaaagcagaactggaagatggggcgtaccggatcaaacagcgtggaatattgggttactcgcaaatcggggccggagtctataaggaaggcacttttcacacgatgtggcatgtaacaagaggtgcagtcctaatgcacagaggaaaacgaatcgaaccaagttgggctgacgtcaagaaagacttgataagctacgggggaggatggaaacttgaaggtgagtggaaggaaggggaggaggtgcaggtcttagccctagaaccaggtaaaaaccccagagcagttcaaaccaagcctggacttttcaaaacgaatacgggtacaatcggtgctgtttccctagactttagcccaggaacttcaggtagtccaattgtagatagaaagggaaaggttgtaggtctatatggtaatggcgtggttacgaggtctggggcttacgtgtcagctatagctcaaaccgaaaagtcaatcgaagataacccggagatagaagatgacatatttcgaaagaagagattgacaattatggatctgcacccaggggctggtaaaacaaaacgctaccttccagccatagttcgagaagcaataaagagaggattacgaaccttgatactagcccctacccgcgtggtagctgctgaaatggaagaggcattgcgtgggctacctataagataccaaacaccggctatccgcgccgagcatacaggacgagaaattgtggatttaatgtgccacgctacatttaccatgagattgttaagtccggtaagagtgcctaactacaacttgataattatggacgaagcacatttcaccgaccctgcgtccattgcggctagaggatatataagtacccgtgttgaaatgggagaagctgccggaatattcatgacagcaacacccccgggttctagagacccattcccccaatccaatgcaccaataatggatgaagaacgagaaatcccggaaagaagttggaactcgggacatgaatgggtcacggattttaaaggaaaaactgtctggttcgttccatccataaaagctggtaatgatatagcagcgtgtttaaggaaaaatgggaagaaagtcatccaactatcaagaaaaacgttcgatgccgaatatgttaagacaagagcgaatgattgggattttgttgtaacaacagacatttcagagatgggtgcaaatttcaaagcagaacgagtaatagatcctcgtaggtgtatgaagccggtaattctaaccgatggggaagaacgcgtaattttagcaggtccgatgccagttactcattcatcagcagcacaacggcgaggcagaataggacgtaatccaaagaatgaaaatgaccaatacatttacatgggggaacccctagagaacgatgaggactgtgctcattggaaagaggcgaaaatgcttctagataatatcaacacccctgaagggataataccatccatgtttgaacctgaacgagagaaagtggatgcaattgacggcgaatatagactgcgaggggaagcgcggaaaacattcgtagatctaatgagaaggggagacttacctgtttggttagcatatagagtggctgctgaaggaatcaattatgcagacaggcggtggtgcttcgatggcatcaaaaacaatcaaattcttgaggagaatgtagaggtggaaatatggactaaggaaggtgagaggaagaaactcaaacctaggtggctcgacgctcgaatttactccgatcctttggctttgaaagagttcaaagaatttgcagcaggacggaaaagcctgacattaaatctaataacggaaatggggagattaccaacatttatgacacaaaaagctcgagatgcattagacaatctggccgtactacacacagcggaggcgggcggacgcgcttataaccacgccttatccgaattaccagagacattagaaacactgctattacttacattactggctacagttacgggcggaatttttctcttcctaatgtcaggaaaaggtataggtaaaatgactctgggtatgtgctgtattataacagcctccattcttctttggtatgctcaaattcaacctcactggatagccgcaagtataatattagagttcttcctaatcgtattactcataccagaacccgaaaagcaacgaactccacaagataaccaactcacatatgtagtgatagccatattaactgtagttgctgcaactatggcaaatgaaatgggtttcctagagaagactaagaaagatcttgggttgggaagcattactacgcaagaatcagaatcgaacatattagatatagacttaagaccagcatctgcttggacattatacgcagtagccactacatttgtaacacctatgttaaggcattcaatagaaaattcaagcgttaatgtatctttaactgcaatagcaaatcaagcgacggtattaatgggcctgggtaaagggtggcctttatcaaaaatggatatcggcgttccactcttagcaatcggatgttattcgcaagtaaatccaatcacccttaccgcagcgttattattattagtagcacactatgcgattataggaccgggactacaagccaaagcaacacgtgaagcccaaaagcgtgcggccgcggggatcatgaaaaatccaaccgttgatggaataaccgtgatagatctggaaccaattccatacgacccaaaatttgaaaaacaattaggtcaggttatgcttttaatattatgtgtaactcaagttcttatgatgagaacgacctgggcgctatgtgaggcgcttacattagcaaccggacccataagcacactatgggaaggaaacccgggccgattctggaatacaactattgctgtaagtatggcaaacatttttagaggaagttatttagccggagccggcctattatttagtataatgaaaaacaccactaatacgagaagagggacaggaaatatcggagaaactttaggagagaaatggaaatcacgcctgaatgcactgggtaagagcgaatttcagatatataagaaaagcgggatacaagaagtagatcgaaccctggccaaggagggtatcaaacgtggggagacggatcaccacgctgttagtagaggaagtgcaaaattaagatggtttgtagaacgcaacatggtaaccccggagggtaaggtcgtagacctcggttgcgggaggggaggttggagctattattgtggaggcttaaagaatgtgagagaggtcaaagggctgactaaaggaggaccagggcacgaggaaccaatccctatgagtacatacggttggaatttagttaggcttcagagtggtgtggacgtatttttcacaccaccagaaaaatgtgatacacttttatgtgacataggcgaaagcagtccaaaccctacaatagaggcaggtagaaccctaagagtactgaacttagtagagaattggctaaataataacacgcaattctgcataaaagtactcaacccatatatgccgtcagtgatagagaagatggagacgctacaaagaaaatatggaggtgcattagtacgtaatccgttgagccgcaattctacgcacgaaatgtattgggtatccaacgccacaggaaatattgtttcaagcgtaaacatgatatctagaatgttgattaatcgtttcacaatgaaacacaaaaaggcaacttatgaacccgatgtagatctaggctcagggactcgaaacatcggaatcgagtctgagattccgaatctagacataataggaaaaagaatcgagaaaataaaacaagaacatgaaacaagttggcattatgatcaagatcatccttacaagacgtgggcataccatggttcttatgaaacaaagcaaactggaagtgcaagctcaatggttaacggggtagttcgattgttaaccaagccgtgggacgtggtacccatggtaacacagatggctatgacagataccacccccttcgggcaacagcgtgtatttaaagaaaaagtagacacgcgcacacaagaaccgaaagaaggtactaagaaattaatgaaaataactgcggaatggttgtggaaagaattagggaaaaagaaaacaccaagaatgtgtacgagagaagagttcactcgaaaagttcgttccaacgcagctctaggagcgatcttcacagatgaaaataaatggaaatcggcaagagaagccgtcgaagattcaagattctgggaattaatagatagagaaagaaacttacatttggaaggtaaatgtgaaacatgcgtttataatatgatgggaaaacgcgagaagaaacttggcgaatttggtaaagcgaaaggttcaagagcaatatggtatatgtggctgggggctaggttcttggagttcgaagccctagggtttcttaacgaagatcactggttcagtagaggcaactcgctttcaggtgtggaaggtgaggggttacatagactaggatacatattaagggatgtatcgaaaaaggaaggcggtgctatgtatgcggatgatactgcgggatgggatacacgtataacactagaggatctcaaaaatgaagaaatggtgactaaccacatgaagggagagcacaagaaattagccgaggctattttcaaacttacctaccaaaataaagttgtacgtgtacaacgaccaacaccgagggggacagttatggacataatatctagaagggaccaacgagggtcgggacaagtgggtacttatggattaaatacattcaccaacatggaagcacaacttataagacaaatggaaggcgaaggaatattcaagtcgatacaacacctaacagttactgaagaaatcgcggttcaaaattggctagctagagtcggacgcgaaaggctgtccaggatggcaatttctggagacgactgtgtagtcaagccattggatgatcgatttgcgagtgcgcttacagcactaaatgatatggggaaagtccggaaagatattcaacaatgggagcccagtagaggatggaacgattggacacaagtacctttttgtagtcaccattttcatgaactggtaatgaaagatggtagggtattggttgtgccatgtagaaatcaagatgaattaattggccgagctcggatcagccaaggagctggttggtctttgaaagagacagcctgtttaggcaaaagttatgcacaaatgtggacgctaatgtattttcacagaagagatttaagactagcggctaatgctatctgtagtgcggttcctagtcactgggtaccaaccagccggacaacctggtcgattcacgcaaaacatgagtggatgaccactgaagatatgttagccgtctggaaccgcgtatggattcaagaaaacccgtggatggaagataaaacacctgtcgaatcttgggaggaggtaccatatttaggtaaacgagaagaccaatggtgcggtagtttaattggtttaactagcagagcaacatgggccaaaaatatacaaactgccataaaccaagtacggagtctcatcggtaatgaagaatatacagactatatgccatcgatgaaacgcttccgacgtgaagaagaggaagccggtgtattatggtaa
